United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 152

SEQ ID NO: 6450150 - DNA, 22 bp, Homo sapiens
tcccccagccatgccagctggc

SEQ ID NO: 6450151 - DNA, 13 bp, Homo sapiens
tcccccagcccaa

SEQ ID NO: 6450152 - DNA, 18 bp, Homo sapiens
tcccccagcccaataaag

SEQ ID NO: 6450153 - DNA, 21 bp, Homo sapiens
tcccccagcccaataaaggtc

SEQ ID NO: 6450154 - DNA, 19 bp, Homo sapiens
tcccccagccctcaggcca

SEQ ID NO: 6450155 - DNA, 21 bp, Homo sapiens
tcccccagccctcaggccagt

SEQ ID NO: 6450156 - DNA, 16 bp, Homo sapiens
tcccccagccctgtgg

SEQ ID NO: 6450157 - DNA, 12 bp, Homo sapiens
tcccccagcctc

SEQ ID NO: 6450158 - DNA, 15 bp, Homo sapiens
tcccccagctttcca

SEQ ID NO: 6450159 - DNA, 16 bp, Homo sapiens
tcccccaggagcagct

SEQ ID NO: 6450160 - DNA, 17 bp, Homo sapiens
tcccccaggagcagctg

SEQ ID NO: 6450161 - DNA, 13 bp, Homo sapiens
tcccccaggaggc

SEQ ID NO: 6450162 - DNA, 16 bp, Homo sapiens
tcccccaggctgcgcc

SEQ ID NO: 6450163 - DNA, 17 bp, Homo sapiens
tcccccaggctgcgcct

SEQ ID NO: 6450164 - DNA, 20 bp, Homo sapiens
tcccccaggctgcgcctgcc

SEQ ID NO: 6450165 - DNA, 22 bp, Homo sapiens
tcccccaggctgcgcctgcccg

SEQ ID NO: 6450166 - DNA, 21 bp, Homo sapiens
tcccccaggggtgagccccgc

SEQ ID NO: 6450167 - DNA, 16 bp, Homo sapiens
tcccccagtccccttc

SEQ ID NO: 6450168 - DNA, 14 bp, Homo sapiens
tcccccatagccac

SEQ ID NO: 6450169 - DNA, 21 bp, Homo sapiens
tcccccatcatatcctttgcc

SEQ ID NO: 6450170 - DNA, 13 bp, Homo sapiens
tcccccatccccc

SEQ ID NO: 6450171 - DNA, 18 bp, Homo sapiens
tcccccatcccccactgc

SEQ ID NO: 6450172 - DNA, 17 bp, Homo sapiens
tcccccatcctcccctt

SEQ ID NO: 6450173 - DNA, 19 bp, Homo sapiens
tcccccatcctccccttcc

SEQ ID NO: 6450174 - DNA, 21 bp, Homo sapiens
tcccccatcctccccttccct

SEQ ID NO: 6450175 - DNA, 15 bp, Homo sapiens
tcccccatccttcag

SEQ ID NO: 6450176 - DNA, 23 bp, Homo sapiens
tcccccatctcgctccctcccag

SEQ ID NO: 6450177 - DNA, 17 bp, Homo sapiens
tcccccatcttcatccc

SEQ ID NO: 6450178 - DNA, 18 bp, Homo sapiens
tcccccatcttcatccca

SEQ ID NO: 6450179 - DNA, 13 bp, Homo sapiens
tcccccatgggct

SEQ ID NO: 6450180 - DNA, 23 bp, Homo sapiens
tccccccaaatctactgagccac

SEQ ID NO: 6450181 - DNA, 13 bp, Homo sapiens
tccccccaacccg

SEQ ID NO: 6450182 - DNA, 18 bp, Homo sapiens
tccccccacccctcccca

SEQ ID NO: 6450183 - DNA, 19 bp, Homo sapiens
tccccccacccctccccac

SEQ ID NO: 6450184 - DNA, 12 bp, Homo sapiens
tccccccacccg

SEQ ID NO: 6450185 - DNA, 14 bp, Homo sapiens
tccccccacccgac

SEQ ID NO: 6450186 - DNA, 12 bp, Homo sapiens
tccccccactct

SEQ ID NO: 6450187 - DNA, 12 bp, Homo sapiens
tccccccactgc

SEQ ID NO: 6450188 - DNA, 13 bp, Homo sapiens
tccccccactgca

SEQ ID NO: 6450189 - DNA, 12 bp, Homo sapiens
tccccccagccc

SEQ ID NO: 6450190 - DNA, 20 bp, Homo sapiens
tccccccagctccctgcacc

SEQ ID NO: 6450191 - DNA, 13 bp, Homo sapiens
tccccccatagag

SEQ ID NO: 6450192 - DNA, 23 bp, Homo sapiens
tccccccatagagaccaggaggg

SEQ ID NO: 6450193 - DNA, 12 bp, Homo sapiens
tccccccatccc

SEQ ID NO: 6450194 - DNA, 13 bp, Homo sapiens
tccccccatccca

SEQ ID NO: 6450195 - DNA, 17 bp, Homo sapiens
tccccccatctctgagt

SEQ ID NO: 6450196 - DNA, 15 bp, Homo sapiens
tcccccccagcctgg

SEQ ID NO: 6450197 - DNA, 15 bp, Homo sapiens
tccccccccaggccc

SEQ ID NO: 6450198 - DNA, 16 bp, Homo sapiens
tcccccccctgtatag

SEQ ID NO: 6450199 - DNA, 17 bp, Homo sapiens
tcccccccctgtatagt

SEQ ID NO: 6450200 - DNA, 18 bp, Homo sapiens
tcccccccggggctgggt

SEQ ID NO: 6450201 - DNA, 16 bp, Homo sapiens
tccccccgcccaccca

SEQ ID NO: 6450202 - DNA, 12 bp, Homo sapiens
tcccccctcact

SEQ ID NO: 6450203 - DNA, 18 bp, Homo sapiens
tcccccctcctctgaaac

SEQ ID NO: 6450204 - DNA, 19 bp, Homo sapiens
tcccccctctcctcccagc

SEQ ID NO: 6450205 - DNA, 15 bp, Homo sapiens
tcccccctgctgccc

SEQ ID NO: 6450206 - DNA, 14 bp, Homo sapiens
tcccccctgtggtc

SEQ ID NO: 6450207 - DNA, 21 bp, Homo sapiens
tcccccctgtggtctgtgtgt

SEQ ID NO: 6450208 - DNA, 17 bp, Homo sapiens
tccccccttgaagcaat

SEQ ID NO: 6450209 - DNA, 20 bp, Homo sapiens
tcccccctttttttcctttt

SEQ ID NO: 6450210 - DNA, 21 bp, Homo sapiens
tcccccgaacgctctgcacct

SEQ ID NO: 6450211 - DNA, 23 bp, Homo sapiens
tcccccgaagaaggaccagtgaa

SEQ ID NO: 6450212 - DNA, 17 bp, Homo sapiens
tcccccgaatgcatttg

SEQ ID NO: 6450213 - DNA, 20 bp, Homo sapiens
tcccccgacactgctgcacc

SEQ ID NO: 6450214 - DNA, 21 bp, Homo sapiens
tcccccgacactgctgcacca

SEQ ID NO: 6450215 - DNA, 22 bp, Homo sapiens
tcccccgacactgctgcaccag

SEQ ID NO: 6450216 - DNA, 22 bp, Homo sapiens
tcccccgaccaatccccagcct

SEQ ID NO: 6450217 - DNA, 14 bp, Homo sapiens
tcccccgactgcct

SEQ ID NO: 6450218 - DNA, 14 bp, Homo sapiens
tcccccgagctctt

SEQ ID NO: 6450219 - DNA, 19 bp, Homo sapiens
tcccccgagctcttggcct

SEQ ID NO: 6450220 - DNA, 24 bp, Homo sapiens
tcccccgagctcttggcctttgca

SEQ ID NO: 6450221 - DNA, 20 bp, Homo sapiens
tcccccgcaatgtgccccca

SEQ ID NO: 6450222 - DNA, 22 bp, Homo sapiens
tcccccgcaggttatgtcagca

SEQ ID NO: 6450223 - DNA, 17 bp, Homo sapiens
tgaagtattttttcagt

SEQ ID NO: 6450224 - DNA, 21 bp, Homo sapiens
tgaagtattttttcagtatta

SEQ ID NO: 6450225 - DNA, 14 bp, Homo sapiens
tgaagtcaaaatat

SEQ ID NO: 6450226 - DNA, 18 bp, Homo sapiens
tgaagtcaaaatatgtaa

SEQ ID NO: 6450227 - DNA, 19 bp, Homo sapiens
tgaagtcaaaccttaagat

SEQ ID NO: 6450228 - DNA, 12 bp, Homo sapiens
tgaagtcaaatg

SEQ ID NO: 6450229 - DNA, 19 bp, Homo sapiens
tgaagtcaaatgtcacata

SEQ ID NO: 6450230 - DNA, 18 bp, Homo sapiens
tgaagtcacatcacagga

SEQ ID NO: 6450231 - DNA, 22 bp, Homo sapiens
tgaagtcacattccacatctgt

SEQ ID NO: 6450232 - DNA, 23 bp, Homo sapiens
tgaagtcacccctttctgtccca

SEQ ID NO: 6450233 - DNA, 12 bp, Homo sapiens
tgaagtcagcca

SEQ ID NO: 6450234 - DNA, 23 bp, Homo sapiens
tgaagtcagcgggcccaggccta

SEQ ID NO: 6450235 - DNA, 23 bp, Homo sapiens
tgaagtcatagataatagtacat

SEQ ID NO: 6450236 - DNA, 19 bp, Homo sapiens
tgaagtcatcataaaaggt

SEQ ID NO: 6450237 - DNA, 13 bp, Homo sapiens
tgaagtccaggac

SEQ ID NO: 6450238 - DNA, 14 bp, Homo sapiens
tgaagtccaggact

SEQ ID NO: 6450239 - DNA, 16 bp, Homo sapiens
tgaagtccaggactgg

SEQ ID NO: 6450240 - DNA, 20 bp, Homo sapiens
tgaagtccaggactgggtct

SEQ ID NO: 6450241 - DNA, 17 bp, Homo sapiens
tgaagtcccaatttaag

SEQ ID NO: 6450242 - DNA, 13 bp, Homo sapiens
tgaagtccctgtt

SEQ ID NO: 6450243 - DNA, 20 bp, Homo sapiens
tgaagtccctgttctcagct

SEQ ID NO: 6450244 - DNA, 21 bp, Homo sapiens
tgaagtcccttcctgtcctgc

SEQ ID NO: 6450245 - DNA, 16 bp, Homo sapiens
tgaagtcctggcttca

SEQ ID NO: 6450246 - DNA, 20 bp, Homo sapiens
tgaagtcgagcactctaatt

SEQ ID NO: 6450247 - DNA, 21 bp, Homo sapiens
tgaagtcgtcttaactcacca

SEQ ID NO: 6450248 - DNA, 16 bp, Homo sapiens
tgaagtctagaatcat

SEQ ID NO: 6450249 - DNA, 19 bp, Homo sapiens
tgaagtctagaatcatact

SEQ ID NO: 6450250 - DNA, 22 bp, Homo sapiens
tgaagtctcaagaactgccata

SEQ ID NO: 6450251 - DNA, 21 bp, Homo sapiens
tgaagtctgatattgcagtaa

SEQ ID NO: 6450252 - DNA, 14 bp, Homo sapiens
tgaagtctgctcat

SEQ ID NO: 6450253 - DNA, 18 bp, Homo sapiens
tgaagtctgcttaccaaa

SEQ ID NO: 6450254 - DNA, 13 bp, Homo sapiens
tgaagtctgtaca

SEQ ID NO: 6450255 - DNA, 23 bp, Homo sapiens
tgaagtcttaaggacaaagtgcc

SEQ ID NO: 6450256 - DNA, 21 bp, Homo sapiens
tgaagtcttactacagaaatg

SEQ ID NO: 6450257 - DNA, 17 bp, Homo sapiens
tgaagtcttccctcaga

SEQ ID NO: 6450258 - DNA, 17 bp, Homo sapiens
tgaagtctttaatattt

SEQ ID NO: 6450259 - DNA, 14 bp, Homo sapiens
tgaagtcttttctg

SEQ ID NO: 6450260 - DNA, 17 bp, Homo sapiens
tgaagtgaaaaacagaa

SEQ ID NO: 6450261 - DNA, 16 bp, Homo sapiens
tgaagtgaaaaagttt

SEQ ID NO: 6450262 - DNA, 19 bp, Homo sapiens
tgaagtgaacaaatttcaa

SEQ ID NO: 6450263 - DNA, 15 bp, Homo sapiens
tgaagtgaaggagaa

SEQ ID NO: 6450264 - DNA, 16 bp, Homo sapiens
tgaagtgaccccagct

SEQ ID NO: 6450265 - DNA, 18 bp, Homo sapiens
tgaagtgaccccagctcc

SEQ ID NO: 6450266 - DNA, 15 bp, Homo sapiens
tgaagtgagaactcc

SEQ ID NO: 6450267 - DNA, 17 bp, Homo sapiens
tgaagtgagcacagcct

SEQ ID NO: 6450268 - DNA, 21 bp, Homo sapiens
tgaagtgaggacaaaatcaca

SEQ ID NO: 6450269 - DNA, 14 bp, Homo sapiens
tgaagtgagtttta

SEQ ID NO: 6450270 - DNA, 22 bp, Homo sapiens
tgaagtgatataaaagctgcat

SEQ ID NO: 6450271 - DNA, 15 bp, Homo sapiens
tgaagtgatggactc

SEQ ID NO: 6450272 - DNA, 15 bp, Homo sapiens
tgaagtgattgacat

SEQ ID NO: 6450273 - DNA, 18 bp, Homo sapiens
tgaagtgattgacatttt

SEQ ID NO: 6450274 - DNA, 19 bp, Homo sapiens
tgaagtgcacaggagccaa

SEQ ID NO: 6450275 - DNA, 19 bp, Homo sapiens
tgaagtgcagctcaggaga

SEQ ID NO: 6450276 - DNA, 21 bp, Homo sapiens
tgaagtgcatgggtcagggtg

SEQ ID NO: 6450277 - DNA, 15 bp, Homo sapiens
tgaagtgcatgttaa

SEQ ID NO: 6450278 - DNA, 17 bp, Homo sapiens
tgaagtgcgtgaatgta

SEQ ID NO: 6450279 - DNA, 19 bp, Homo sapiens
tgaagtgctctttcttgga

SEQ ID NO: 6450280 - DNA, 17 bp, Homo sapiens
tgaagtgctgttttatt

SEQ ID NO: 6450281 - DNA, 22 bp, Homo sapiens
tgaagtgctgttttattactgt

SEQ ID NO: 6450282 - DNA, 13 bp, Homo sapiens
tgaagtggccctc

SEQ ID NO: 6450283 - DNA, 14 bp, Homo sapiens
tgaagtggcctctt

SEQ ID NO: 6450284 - DNA, 16 bp, Homo sapiens
tgaagtggctggtaga

SEQ ID NO: 6450285 - DNA, 21 bp, Homo sapiens
tgaagtgggtggatcaccaga

SEQ ID NO: 6450286 - DNA, 22 bp, Homo sapiens
tgaagtggtacaatctggctca

SEQ ID NO: 6450287 - DNA, 16 bp, Homo sapiens
tgaagtggttcagtct

SEQ ID NO: 6450288 - DNA, 16 bp, Homo sapiens
tgaagtgtacctgtgt

SEQ ID NO: 6450289 - DNA, 17 bp, Homo sapiens
tgaagtgtaggcagaca

SEQ ID NO: 6450290 - DNA, 12 bp, Homo sapiens
tgaagtgtcttc

SEQ ID NO: 6450291 - DNA, 15 bp, Homo sapiens
tgaagtgtggctggt

SEQ ID NO: 6450292 - DNA, 16 bp, Homo sapiens
tgaagtgtggctggtg

SEQ ID NO: 6450293 - DNA, 18 bp, Homo sapiens
tgaagtgtggctggtgtc

SEQ ID NO: 6450294 - DNA, 21 bp, Homo sapiens
tgaagtgtggctggtgtcccc

SEQ ID NO: 6450295 - DNA, 16 bp, Homo sapiens
tgaagtgtggggcggg

SEQ ID NO: 6450296 - DNA, 16 bp, Homo sapiens
tgaagtgtgtttcctt

SEQ ID NO: 6450297 - DNA, 22 bp, Homo sapiens
tgaagtgtgtttccttcagtgc

SEQ ID NO: 6450298 - DNA, 21 bp, Homo sapiens
tgaagtgttaatacatcacat

SEQ ID NO: 6450299 - DNA, 23 bp, Homo sapiens
tgaagtgttaatactagttgtga

SEQ ID NO: 6450300 - DNA, 21 bp, Homo sapiens
tgaagtgttccctttttcata

SEQ ID NO: 6450301 - DNA, 18 bp, Homo sapiens
tgaagtgttctgagctgt

SEQ ID NO: 6450302 - DNA, 18 bp, Homo sapiens
tgaagtgttgtggagaaa

SEQ ID NO: 6450303 - DNA, 16 bp, Homo sapiens
tgaagtgttttacaat

SEQ ID NO: 6450304 - DNA, 20 bp, Homo sapiens
tgaagtgttttgttctttct

SEQ ID NO: 6450305 - DNA, 16 bp, Homo sapiens
tgaagttaaaggtatt

SEQ ID NO: 6450306 - DNA, 14 bp, Homo sapiens
tgaagttaacagag

SEQ ID NO: 6450307 - DNA, 15 bp, Homo sapiens
tgaagttaacagtct

SEQ ID NO: 6450308 - DNA, 20 bp, Homo sapiens
tgaagttacacaattaattg

SEQ ID NO: 6450309 - DNA, 22 bp, Homo sapiens
tgaagttacacaattaattgtc

SEQ ID NO: 6450310 - DNA, 16 bp, Homo sapiens
tgaagttacatgcata

SEQ ID NO: 6450311 - DNA, 22 bp, Homo sapiens
tgaagttacatgcataaaaggg

SEQ ID NO: 6450312 - DNA, 16 bp, Homo sapiens
tgaagttactttatgt

SEQ ID NO: 6450313 - DNA, 15 bp, Homo sapiens
tgaagttactttctt

SEQ ID NO: 6450314 - DNA, 21 bp, Homo sapiens
tgaagttaggttcttaaaagt

SEQ ID NO: 6450315 - DNA, 22 bp, Homo sapiens
tgaagttaggttcttaaaagtg

SEQ ID NO: 6450316 - DNA, 16 bp, Homo sapiens
tgaagttatatttcct

SEQ ID NO: 6450317 - DNA, 17 bp, Homo sapiens
tgaagttatctggcttc

SEQ ID NO: 6450318 - DNA, 14 bp, Homo sapiens
tgaagttcatcttg

SEQ ID NO: 6450319 - DNA, 16 bp, Homo sapiens
tgaagttcatcttgca

SEQ ID NO: 6450320 - DNA, 20 bp, Homo sapiens
tgaagttcatggtgatcagt

SEQ ID NO: 6450321 - DNA, 20 bp, Homo sapiens
tgaagttctgaaatttaact

SEQ ID NO: 6450322 - DNA, 14 bp, Homo sapiens
tgaagttctgagat

SEQ ID NO: 6450323 - DNA, 18 bp, Homo sapiens
tgaagttctggcaagatt

SEQ ID NO: 6450324 - DNA, 16 bp, Homo sapiens
tgaagttgaaaatcat

SEQ ID NO: 6450325 - DNA, 13 bp, Homo sapiens
tgaagttgaacat

SEQ ID NO: 6450326 - DNA, 20 bp, Homo sapiens
tgaagttgattcatattgca

SEQ ID NO: 6450327 - DNA, 15 bp, Homo sapiens
tgaagttgctgcttc

SEQ ID NO: 6450328 - DNA, 14 bp, Homo sapiens
tgaagttgctgttt

SEQ ID NO: 6450329 - DNA, 16 bp, Homo sapiens
tgaagttggcacattt

SEQ ID NO: 6450330 - DNA, 20 bp, Homo sapiens
tgaagttggcacatttcatg

SEQ ID NO: 6450331 - DNA, 22 bp, Homo sapiens
tgaagttggcacatttcatgag

SEQ ID NO: 6450332 - DNA, 24 bp, Homo sapiens
tgaagttggccaccttgcttgagg

SEQ ID NO: 6450333 - DNA, 13 bp, Homo sapiens
tgaagttgggaaa

SEQ ID NO: 6450334 - DNA, 18 bp, Homo sapiens
tgaagttgggtgtttcca

SEQ ID NO: 6450335 - DNA, 21 bp, Homo sapiens
tgaagttggtttagctttgga

SEQ ID NO: 6450336 - DNA, 17 bp, Homo sapiens
tgaagttgtaagaaaag

SEQ ID NO: 6450337 - DNA, 21 bp, Homo sapiens
tgaagttgtgcaacggccagg

SEQ ID NO: 6450338 - DNA, 22 bp, Homo sapiens
tgaagttgtgcaacggccaggg

SEQ ID NO: 6450339 - DNA, 14 bp, Homo sapiens
tgaagttgtggagg

SEQ ID NO: 6450340 - DNA, 15 bp, Homo sapiens
tgaagttgtggagga

SEQ ID NO: 6450341 - DNA, 18 bp, Homo sapiens
tgaagttgttactaacta

SEQ ID NO: 6450342 - DNA, 20 bp, Homo sapiens
tgaagttgttactaactaaa

SEQ ID NO: 6450343 - DNA, 14 bp, Homo sapiens
tgaagtttaaaaca

SEQ ID NO: 6450344 - DNA, 19 bp, Homo sapiens
tgaagtttaaaacagtatt

SEQ ID NO: 6450345 - DNA, 20 bp, Homo sapiens
tgaagtttaaaacagtattt

SEQ ID NO: 6450346 - DNA, 21 bp, Homo sapiens
tgaagtttaaaacagtattta

SEQ ID NO: 6450347 - DNA, 18 bp, Homo sapiens
tgaagtttaaattctagt

SEQ ID NO: 6450348 - DNA, 12 bp, Homo sapiens
tgaagtttacat

SEQ ID NO: 6450349 - DNA, 13 bp, Homo sapiens
tgaagtttacatt

SEQ ID NO: 6450350 - DNA, 14 bp, Homo sapiens
tgaagtttatacag

SEQ ID NO: 6450351 - DNA, 13 bp, Homo sapiens
tgaagtttcacat

SEQ ID NO: 6450352 - DNA, 16 bp, Homo sapiens
tgaagtttccttggct

SEQ ID NO: 6450353 - DNA, 19 bp, Homo sapiens
tgaagtttccttggctggt

SEQ ID NO: 6450354 - DNA, 21 bp, Homo sapiens
tgaagtttccttggctggtgc

SEQ ID NO: 6450355 - DNA, 21 bp, Homo sapiens
tgaagtttgaatgttaaataa

SEQ ID NO: 6450356 - DNA, 14 bp, Homo sapiens
tgaagtttgataaa

SEQ ID NO: 6450357 - DNA, 13 bp, Homo sapiens
tgaagtttggaga

SEQ ID NO: 6450358 - DNA, 20 bp, Homo sapiens
tgaagtttgtagttgtttta

SEQ ID NO: 6450359 - DNA, 14 bp, Homo sapiens
tgaagtttgtgggg

SEQ ID NO: 6450360 - DNA, 15 bp, Homo sapiens
tgaagttttacattg

SEQ ID NO: 6450361 - DNA, 17 bp, Homo sapiens
tgaagttttactgtcta

SEQ ID NO: 6450362 - DNA, 16 bp, Homo sapiens
tgaagtttttgaaata

SEQ ID NO: 6450363 - DNA, 20 bp, Homo sapiens
tgaataaaaaacatttgtac

SEQ ID NO: 6450364 - DNA, 14 bp, Homo sapiens
tgaataaaaaagat

SEQ ID NO: 6450365 - DNA, 17 bp, Homo sapiens
tgaataaaaaagattct

SEQ ID NO: 6450366 - DNA, 18 bp, Homo sapiens
tgaataaaaaagattcta

SEQ ID NO: 6450367 - DNA, 11 bp, Homo sapiens
tgaataaaaag

SEQ ID NO: 6450368 - DNA, 18 bp, Homo sapiens
tgaataaaaagtgaactt

SEQ ID NO: 6450369 - DNA, 19 bp, Homo sapiens
tgaataaaaatatgtacaa

SEQ ID NO: 6450370 - DNA, 11 bp, Homo sapiens
tgaataaaaca

SEQ ID NO: 6450371 - DNA, 23 bp, Homo sapiens
tgaataaaacaataaatgaatga

SEQ ID NO: 6450372 - DNA, 15 bp, Homo sapiens
tgaataaaagtgcac

SEQ ID NO: 6450373 - DNA, 11 bp, Homo sapiens
tgaataaaata

SEQ ID NO: 6450374 - DNA, 15 bp, Homo sapiens
tgaataaaattaggt

SEQ ID NO: 6450375 - DNA, 21 bp, Homo sapiens
tgaataaaccaagacaagacc

SEQ ID NO: 6450376 - DNA, 20 bp, Homo sapiens
tgaataaactagattacatt

SEQ ID NO: 6450377 - DNA, 14 bp, Homo sapiens
tgaataaacttcag

SEQ ID NO: 6450378 - DNA, 16 bp, Homo sapiens
tgaataaacttcagca

SEQ ID NO: 6450379 - DNA, 20 bp, Homo sapiens
tgaataaagaatacttgaac

SEQ ID NO: 6450380 - DNA, 18 bp, Homo sapiens
tgaataaagaatgccatt

SEQ ID NO: 6450381 - DNA, 14 bp, Homo sapiens
tgaataaagacacc

SEQ ID NO: 6450382 - DNA, 15 bp, Homo sapiens
tgaataaagacacct

SEQ ID NO: 6450383 - DNA, 17 bp, Homo sapiens
tgaataaagcagggaat

SEQ ID NO: 6450384 - DNA, 13 bp, Homo sapiens
tgaataaagccac

SEQ ID NO: 6450385 - DNA, 18 bp, Homo sapiens
tgaataaagcctgctttt

SEQ ID NO: 6450386 - DNA, 21 bp, Homo sapiens
tgaataaagcctttgtatctt

SEQ ID NO: 6450387 - DNA, 23 bp, Homo sapiens
tgaataaagggaacatgcagctc

SEQ ID NO: 6450388 - DNA, 12 bp, Homo sapiens
tgaataaagtac

SEQ ID NO: 6450389 - DNA, 14 bp, Homo sapiens
tgaataaagtctga

SEQ ID NO: 6450390 - DNA, 15 bp, Homo sapiens
tgaataaagtctgag

SEQ ID NO: 6450391 - DNA, 18 bp, Homo sapiens
tgaataaagtctgagtgg

SEQ ID NO: 6450392 - DNA, 22 bp, Homo sapiens
tgaataaagtctgagtgggcgg

SEQ ID NO: 6450393 - DNA, 13 bp, Homo sapiens
tgaataaagtgca

SEQ ID NO: 6450394 - DNA, 12 bp, Homo sapiens
tgaataaagtgt

SEQ ID NO: 6450395 - DNA, 14 bp, Homo sapiens
tgaataaataccca

SEQ ID NO: 6450396 - DNA, 12 bp, Homo sapiens
tgaataaatatt

SEQ ID NO: 6450397 - DNA, 14 bp, Homo sapiens
tgaataaatcatgt

SEQ ID NO: 6450398 - DNA, 13 bp, Homo sapiens
tgaataaatgtat

SEQ ID NO: 6450399 - DNA, 16 bp, Homo sapiens
tgaataaatgtcactt

SEQ ID NO: 6450400 - DNA, 13 bp, Homo sapiens
tgaataaatgtct

SEQ ID NO: 6450401 - DNA, 14 bp, Homo sapiens
tgaataaatgtctt

SEQ ID NO: 6450402 - DNA, 17 bp, Homo sapiens
tcccccgcagtccccag

SEQ ID NO: 6450403 - DNA, 20 bp, Homo sapiens
tcccccgcagtccccagccc

SEQ ID NO: 6450404 - DNA, 20 bp, Homo sapiens
tcccccgccacctgtgtgtt

SEQ ID NO: 6450405 - DNA, 14 bp, Homo sapiens
tcccccgccactcc

SEQ ID NO: 6450406 - DNA, 22 bp, Homo sapiens
tcccccgggaggggcccgcttg

SEQ ID NO: 6450407 - DNA, 16 bp, Homo sapiens
tcccccggggcaaggt

SEQ ID NO: 6450408 - DNA, 16 bp, Homo sapiens
tcccccggggtctcca

SEQ ID NO: 6450409 - DNA, 19 bp, Homo sapiens
tcccccggggtctccacct

SEQ ID NO: 6450410 - DNA, 21 bp, Homo sapiens
tcccccgtagaaatccccctt

SEQ ID NO: 6450411 - DNA, 20 bp, Homo sapiens
tcccccgtggtgcctgcaca

SEQ ID NO: 6450412 - DNA, 18 bp, Homo sapiens
tcccccgtgttcccctct

SEQ ID NO: 6450413 - DNA, 19 bp, Homo sapiens
tcccccgtgttcccctctt

SEQ ID NO: 6450414 - DNA, 16 bp, Homo sapiens
tcccccgttgtgcctg

SEQ ID NO: 6450415 - DNA, 12 bp, Homo sapiens
tccccctaccca

SEQ ID NO: 6450416 - DNA, 15 bp, Homo sapiens
tccccctacccaccg

SEQ ID NO: 6450417 - DNA, 17 bp, Homo sapiens
tccccctaccgcatggc

SEQ ID NO: 6450418 - DNA, 18 bp, Homo sapiens
tccccctaccgcatggca

SEQ ID NO: 6450419 - DNA, 21 bp, Homo sapiens
tccccctaccgcatggcagct

SEQ ID NO: 6450420 - DNA, 13 bp, Homo sapiens
tccccctagagac

SEQ ID NO: 6450421 - DNA, 16 bp, Homo sapiens
tccccctcagctctcc

SEQ ID NO: 6450422 - DNA, 21 bp, Homo sapiens
tccccctcagctctccctcac

SEQ ID NO: 6450423 - DNA, 15 bp, Homo sapiens
tccccctccagtgct

SEQ ID NO: 6450424 - DNA, 16 bp, Homo sapiens
tccccctccccaggct

SEQ ID NO: 6450425 - DNA, 21 bp, Homo sapiens
tccccctccccaggctggaga

SEQ ID NO: 6450426 - DNA, 14 bp, Homo sapiens
tccccctcccccag

SEQ ID NO: 6450427 - DNA, 17 bp, Homo sapiens
tccccctcccccattcc

SEQ ID NO: 6450428 - DNA, 16 bp, Homo sapiens
tccccctccctcccct

SEQ ID NO: 6450429 - DNA, 19 bp, Homo sapiens
tccccctcctagggggtgt

SEQ ID NO: 6450430 - DNA, 11 bp, Homo sapiens
tccccctcctc

SEQ ID NO: 6450431 - DNA, 20 bp, Homo sapiens
tccccctcctcagccagcct

SEQ ID NO: 6450432 - DNA, 15 bp, Homo sapiens
tccccctcctccatg

SEQ ID NO: 6450433 - DNA, 16 bp, Homo sapiens
tccccctcctgcacgc

SEQ ID NO: 6450434 - DNA, 18 bp, Homo sapiens
tccccctcctgctgtgct

SEQ ID NO: 6450435 - DNA, 12 bp, Homo sapiens
tccccctccttc

SEQ ID NO: 6450436 - DNA, 15 bp, Homo sapiens
tccccctccttgtgc

SEQ ID NO: 6450437 - DNA, 20 bp, Homo sapiens
tccccctctcacgccacccc

SEQ ID NO: 6450438 - DNA, 22 bp, Homo sapiens
tccccctctcctctcccccagg

SEQ ID NO: 6450439 - DNA, 12 bp, Homo sapiens
tccccctctgct

SEQ ID NO: 6450440 - DNA, 15 bp, Homo sapiens
tccccctctgtccag

SEQ ID NO: 6450441 - DNA, 20 bp, Homo sapiens
tccccctcttcttctgaaga

SEQ ID NO: 6450442 - DNA, 11 bp, Homo sapiens
tccccctgcaa

SEQ ID NO: 6450443 - DNA, 20 bp, Homo sapiens
tccccctgcaaaaagaaaaa

SEQ ID NO: 6450444 - DNA, 12 bp, Homo sapiens
tccccctgcagc

SEQ ID NO: 6450445 - DNA, 23 bp, Homo sapiens
tccccctgcagccatcccaaggc

SEQ ID NO: 6450446 - DNA, 23 bp, Homo sapiens
tccccctgcagccgtgcaggact

SEQ ID NO: 6450447 - DNA, 22 bp, Homo sapiens
tccccctgccagaggcctggtg

SEQ ID NO: 6450448 - DNA, 15 bp, Homo sapiens
tccccctgccagcaa

SEQ ID NO: 6450449 - DNA, 17 bp, Homo sapiens
tccccctgccagtgcct

SEQ ID NO: 6450450 - DNA, 18 bp, Homo sapiens
tccccctgccagtgcctt

SEQ ID NO: 6450451 - DNA, 13 bp, Homo sapiens
tccccctgcctcc

SEQ ID NO: 6450452 - DNA, 12 bp, Homo sapiens
tccccctgcgcc

SEQ ID NO: 6450453 - DNA, 19 bp, Homo sapiens
tccccctgctccatgggca

SEQ ID NO: 6450454 - DNA, 20 bp, Homo sapiens
tccccctgctgatcaatctg

SEQ ID NO: 6450455 - DNA, 13 bp, Homo sapiens
tccccctgctgct

SEQ ID NO: 6450456 - DNA, 13 bp, Homo sapiens
tccccctgcttct

SEQ ID NO: 6450457 - DNA, 20 bp, Homo sapiens
tccccctggacggggcgggc

SEQ ID NO: 6450458 - DNA, 23 bp, Homo sapiens
tccccctggccaccaccccccac

SEQ ID NO: 6450459 - DNA, 14 bp, Homo sapiens
tccccctgggctct

SEQ ID NO: 6450460 - DNA, 16 bp, Homo sapiens
tccccctggttgggtg

SEQ ID NO: 6450461 - DNA, 12 bp, Homo sapiens
tccccctgtgtg

SEQ ID NO: 6450462 - DNA, 16 bp, Homo sapiens
tccccctgttcacatc

SEQ ID NO: 6450463 - DNA, 13 bp, Homo sapiens
tccccctgttctg

SEQ ID NO: 6450464 - DNA, 19 bp, Homo sapiens
tcccccttcagctcctgag

SEQ ID NO: 6450465 - DNA, 12 bp, Homo sapiens
tcccccttccca

SEQ ID NO: 6450466 - DNA, 18 bp, Homo sapiens
tcccccttcccatttctt

SEQ ID NO: 6450467 - DNA, 21 bp, Homo sapiens
tcccccttcccatttcttccc

SEQ ID NO: 6450468 - DNA, 15 bp, Homo sapiens
tcccccttcccctgc

SEQ ID NO: 6450469 - DNA, 19 bp, Homo sapiens
tcccccttcccgccttcag

SEQ ID NO: 6450470 - DNA, 12 bp, Homo sapiens
tcccccttcctt

SEQ ID NO: 6450471 - DNA, 10 bp, Homo sapiens
tcccccttct

SEQ ID NO: 6450472 - DNA, 13 bp, Homo sapiens
tcccccttctccc

SEQ ID NO: 6450473 - DNA, 15 bp, Homo sapiens
tcccccttctcccac

SEQ ID NO: 6450474 - DNA, 12 bp, Homo sapiens
tcccccttcttc

SEQ ID NO: 6450475 - DNA, 21 bp, Homo sapiens
tcccccttcttcctcccctca

SEQ ID NO: 6450476 - DNA, 23 bp, Homo sapiens
tcccccttcttcctcccctcaac

SEQ ID NO: 6450477 - DNA, 19 bp, Homo sapiens
tcccccttcttgccctcca

SEQ ID NO: 6450478 - DNA, 21 bp, Homo sapiens
tcccccttgaggattgtggaa

SEQ ID NO: 6450479 - DNA, 15 bp, Homo sapiens
tcccccttgcccgcc

SEQ ID NO: 6450480 - DNA, 23 bp, Homo sapiens
tcccccttgtcttcccccctctc

SEQ ID NO: 6450481 - DNA, 11 bp, Homo sapiens
tccccctttct

SEQ ID NO: 6450482 - DNA, 21 bp, Homo sapiens
tccccgaaagggacacaatgt

SEQ ID NO: 6450483 - DNA, 18 bp, Homo sapiens
tccccgaagagtcagccc

SEQ ID NO: 6450484 - DNA, 14 bp, Homo sapiens
tccccgacagtggc

SEQ ID NO: 6450485 - DNA, 17 bp, Homo sapiens
tccccgacagtggctct

SEQ ID NO: 6450486 - DNA, 15 bp, Homo sapiens
tccccgaccccccta

SEQ ID NO: 6450487 - DNA, 21 bp, Homo sapiens
tccccgagccgagctctcctg

SEQ ID NO: 6450488 - DNA, 18 bp, Homo sapiens
tccccgaggagctgggcc

SEQ ID NO: 6450489 - DNA, 16 bp, Homo sapiens
tccccgaggctgcccc

SEQ ID NO: 6450490 - DNA, 22 bp, Homo sapiens
tccccgagggatgatgccacac

SEQ ID NO: 6450491 - DNA, 19 bp, Homo sapiens
tccccgagggcgaaggcca

SEQ ID NO: 6450492 - DNA, 15 bp, Homo sapiens
tccccgagggctcag

SEQ ID NO: 6450493 - DNA, 19 bp, Homo sapiens
tccccgaggttgtggggag

SEQ ID NO: 6450494 - DNA, 21 bp, Homo sapiens
tccccgaggttgtggggaggc

SEQ ID NO: 6450495 - DNA, 16 bp, Homo sapiens
tccccgagtcctcagg

SEQ ID NO: 6450496 - DNA, 21 bp, Homo sapiens
tccccgagtcctcaggtacag

SEQ ID NO: 6450497 - DNA, 15 bp, Homo sapiens
tccccgagtgactct

SEQ ID NO: 6450498 - DNA, 23 bp, Homo sapiens
tccccgatgctgacctcacctgg

SEQ ID NO: 6450499 - DNA, 21 bp, Homo sapiens
tccccgatgtcccctgcgggc

SEQ ID NO: 6450500 - DNA, 19 bp, Homo sapiens
tccccgatgtgagccgcct

SEQ ID NO: 6450501 - DNA, 16 bp, Homo sapiens
tccccgcaacccacag

SEQ ID NO: 6450502 - DNA, 19 bp, Homo sapiens
tccccgcaacccacagctc

SEQ ID NO: 6450503 - DNA, 15 bp, Homo sapiens
tccccgcagagctcc

SEQ ID NO: 6450504 - DNA, 21 bp, Homo sapiens
tccccgcagcccgcctgccgt

SEQ ID NO: 6450505 - DNA, 19 bp, Homo sapiens
tccccgcagccctctccac

SEQ ID NO: 6450506 - DNA, 22 bp, Homo sapiens
tccccgcagccctctccaccca

SEQ ID NO: 6450507 - DNA, 16 bp, Homo sapiens
tccccgcattccaggc

SEQ ID NO: 6450508 - DNA, 15 bp, Homo sapiens
tccccgcccttcttt

SEQ ID NO: 6450509 - DNA, 15 bp, Homo sapiens
tccccgcctccactc

SEQ ID NO: 6450510 - DNA, 15 bp, Homo sapiens
tccccgcctggccag

SEQ ID NO: 6450511 - DNA, 20 bp, Homo sapiens
tccccgcctggccaggagca

SEQ ID NO: 6450512 - DNA, 16 bp, Homo sapiens
tccccgcctgtcctgc

SEQ ID NO: 6450513 - DNA, 13 bp, Homo sapiens
tccccgcctgttc

SEQ ID NO: 6450514 - DNA, 19 bp, Homo sapiens
tccccgccttagagcctcg

SEQ ID NO: 6450515 - DNA, 15 bp, Homo sapiens
tccccgcgccccagt

SEQ ID NO: 6450516 - DNA, 22 bp, Homo sapiens
tccccgcgtccgagaaggcgga

SEQ ID NO: 6450517 - DNA, 21 bp, Homo sapiens
tccccgctcaggggcctggag

SEQ ID NO: 6450518 - DNA, 13 bp, Homo sapiens
tccccgctccaca

SEQ ID NO: 6450519 - DNA, 18 bp, Homo sapiens
tccccgctccgtctctgt

SEQ ID NO: 6450520 - DNA, 22 bp, Homo sapiens
tccccgctccgtctctgtcctc

SEQ ID NO: 6450521 - DNA, 14 bp, Homo sapiens
tccccgctctccct

SEQ ID NO: 6450522 - DNA, 15 bp, Homo sapiens
tccccgctctccctg

SEQ ID NO: 6450523 - DNA, 16 bp, Homo sapiens
tccccgctctccctgt

SEQ ID NO: 6450524 - DNA, 16 bp, Homo sapiens
tccccgctgacccttg

SEQ ID NO: 6450525 - DNA, 15 bp, Homo sapiens
tccccggacatactc

SEQ ID NO: 6450526 - DNA, 22 bp, Homo sapiens
tccccggacatactctctgcct

SEQ ID NO: 6450527 - DNA, 17 bp, Homo sapiens
tccccggacgcatgcag

SEQ ID NO: 6450528 - DNA, 18 bp, Homo sapiens
tccccggacgcatgcagg

SEQ ID NO: 6450529 - DNA, 22 bp, Homo sapiens
tccccggagccggcactgcatg

SEQ ID NO: 6450530 - DNA, 13 bp, Homo sapiens
tccccggagctgg

SEQ ID NO: 6450531 - DNA, 14 bp, Homo sapiens
tccccggcaccctc

SEQ ID NO: 6450532 - DNA, 18 bp, Homo sapiens
tccccggcaccctctggc

SEQ ID NO: 6450533 - DNA, 20 bp, Homo sapiens
tccccggcaggcctgagaat

SEQ ID NO: 6450534 - DNA, 23 bp, Homo sapiens
tccccggcaggcctgagaatgag

SEQ ID NO: 6450535 - DNA, 13 bp, Homo sapiens
tccccggcccctg

SEQ ID NO: 6450536 - DNA, 15 bp, Homo sapiens
tccccggcccctgcc

SEQ ID NO: 6450537 - DNA, 21 bp, Homo sapiens
tccccggccctaccagcgccc

SEQ ID NO: 6450538 - DNA, 12 bp, Homo sapiens
tccccggcctca

SEQ ID NO: 6450539 - DNA, 16 bp, Homo sapiens
tccccggctcaagtga

SEQ ID NO: 6450540 - DNA, 15 bp, Homo sapiens
tccccgggcagcaga

SEQ ID NO: 6450541 - DNA, 17 bp, Homo sapiens
tccccgggcatctttgg

SEQ ID NO: 6450542 - DNA, 16 bp, Homo sapiens
tccccggggcccaggg

SEQ ID NO: 6450543 - DNA, 15 bp, Homo sapiens
tccccgggggaggaa

SEQ ID NO: 6450544 - DNA, 22 bp, Homo sapiens
tccccgggggccaactcaccct

SEQ ID NO: 6450545 - DNA, 19 bp, Homo sapiens
tccccggttgctggtcagg

SEQ ID NO: 6450546 - DNA, 20 bp, Homo sapiens
tccccgtccctgtcccccag

SEQ ID NO: 6450547 - DNA, 21 bp, Homo sapiens
tccccgtccctgtcccccagc

SEQ ID NO: 6450548 - DNA, 15 bp, Homo sapiens
tccccgtctcattcc

SEQ ID NO: 6450549 - DNA, 16 bp, Homo sapiens
tccccgtctctgccct

SEQ ID NO: 6450550 - DNA, 22 bp, Homo sapiens
tccccgtctctgccctgggctc

SEQ ID NO: 6450551 - DNA, 14 bp, Homo sapiens
tccccgtgtaaaaa

SEQ ID NO: 6450552 - DNA, 18 bp, Homo sapiens
tccccgtgtaaaaagcct

SEQ ID NO: 6450553 - DNA, 22 bp, Homo sapiens
tccccgtgtcctctccctgcca

SEQ ID NO: 6450554 - DNA, 15 bp, Homo sapiens
tccccgtgtgcccca

SEQ ID NO: 6450555 - DNA, 15 bp, Homo sapiens
tcccctaaagccagg

SEQ ID NO: 6450556 - DNA, 15 bp, Homo sapiens
tcccctaaagcctca

SEQ ID NO: 6450557 - DNA, 15 bp, Homo sapiens
tcccctaacccccag

SEQ ID NO: 6450558 - DNA, 17 bp, Homo sapiens
tcccctaacctgggttg

SEQ ID NO: 6450559 - DNA, 20 bp, Homo sapiens
tcccctaagcagaccactga

SEQ ID NO: 6450560 - DNA, 17 bp, Homo sapiens
tcccctaagtctttact

SEQ ID NO: 6450561 - DNA, 13 bp, Homo sapiens
tcccctaatgcct

SEQ ID NO: 6450562 - DNA, 21 bp, Homo sapiens
tcccctacactttggccaagc

SEQ ID NO: 6450563 - DNA, 20 bp, Homo sapiens
tcccctaccaggctgtaaat

SEQ ID NO: 6450564 - DNA, 16 bp, Homo sapiens
tcccctactccctctt

SEQ ID NO: 6450565 - DNA, 17 bp, Homo sapiens
tcccctactccctcttc

SEQ ID NO: 6450566 - DNA, 18 bp, Homo sapiens
tcccctagacatggcctc

SEQ ID NO: 6450567 - DNA, 18 bp, Homo sapiens
tcccctagacctccccct

SEQ ID NO: 6450568 - DNA, 19 bp, Homo sapiens
tcccctagacctccccctc

SEQ ID NO: 6450569 - DNA, 22 bp, Homo sapiens
tcccctagacctccccctcact

SEQ ID NO: 6450570 - DNA, 18 bp, Homo sapiens
tcccctagagccctctcc

SEQ ID NO: 6450571 - DNA, 23 bp, Homo sapiens
tcccctagagccctctcctccct

SEQ ID NO: 6450572 - DNA, 16 bp, Homo sapiens
tcccctagagtcccag

SEQ ID NO: 6450573 - DNA, 20 bp, Homo sapiens
tcccctagctcaccaggcct

SEQ ID NO: 6450574 - DNA, 22 bp, Homo sapiens
tcccctagctcaccaggcctgg

SEQ ID NO: 6450575 - DNA, 16 bp, Homo sapiens
tcccctagcttactga

SEQ ID NO: 6450576 - DNA, 23 bp, Homo sapiens
tcccctagggactgtcctagcca

SEQ ID NO: 6450577 - DNA, 22 bp, Homo sapiens
tcccctagtaagtgccttccat

SEQ ID NO: 6450578 - DNA, 15 bp, Homo sapiens
tcccctatccaccca

SEQ ID NO: 6450579 - DNA, 16 bp, Homo sapiens
tcccctatccacccag

SEQ ID NO: 6450580 - DNA, 15 bp, Homo sapiens
tcccctatcccattc

SEQ ID NO: 6450581 - DNA, 15 bp, Homo sapiens
tgaataaatgtcttg

SEQ ID NO: 6450582 - DNA, 12 bp, Homo sapiens
tgaataaatgtg

SEQ ID NO: 6450583 - DNA, 18 bp, Homo sapiens
tgaataaattcagtattt

SEQ ID NO: 6450584 - DNA, 16 bp, Homo sapiens
tgaataaattttcaaa

SEQ ID NO: 6450585 - DNA, 20 bp, Homo sapiens
tgaataaattttcaaatcct

SEQ ID NO: 6450586 - DNA, 20 bp, Homo sapiens
tgaataacaaggaaaacagt

SEQ ID NO: 6450587 - DNA, 15 bp, Homo sapiens
tgaataacatttaaa

SEQ ID NO: 6450588 - DNA, 14 bp, Homo sapiens
tgaataagattaat

SEQ ID NO: 6450589 - DNA, 22 bp, Homo sapiens
tgaataagcagaacatactgtt

SEQ ID NO: 6450590 - DNA, 23 bp, Homo sapiens
tgaataagcagaacatactgttc

SEQ ID NO: 6450591 - DNA, 17 bp, Homo sapiens
tgaataagccattctga

SEQ ID NO: 6450592 - DNA, 20 bp, Homo sapiens
tgaataagctttctctcaga

SEQ ID NO: 6450593 - DNA, 20 bp, Homo sapiens
tgaataagttgattctgtcc

SEQ ID NO: 6450594 - DNA, 14 bp, Homo sapiens
tgaataataaccac

SEQ ID NO: 6450595 - DNA, 12 bp, Homo sapiens
tgaataatacag

SEQ ID NO: 6450596 - DNA, 16 bp, Homo sapiens
tgaataatatcaaata

SEQ ID NO: 6450597 - DNA, 14 bp, Homo sapiens
tgaataatgaaaat

SEQ ID NO: 6450598 - DNA, 21 bp, Homo sapiens
tgaataatgcctttgtaacca

SEQ ID NO: 6450599 - DNA, 18 bp, Homo sapiens
tgaataatggaatctata

SEQ ID NO: 6450600 - DNA, 23 bp, Homo sapiens
tgaataatgtaagacaaatatgt

SEQ ID NO: 6450601 - DNA, 13 bp, Homo sapiens
tgaataattacag

SEQ ID NO: 6450602 - DNA, 16 bp, Homo sapiens
tgaataattatgttta

SEQ ID NO: 6450603 - DNA, 13 bp, Homo sapiens
tgaataattgcat

SEQ ID NO: 6450604 - DNA, 15 bp, Homo sapiens
tgaataatttcccaa

SEQ ID NO: 6450605 - DNA, 23 bp, Homo sapiens
tgaataattttctggcactggtt

SEQ ID NO: 6450606 - DNA, 15 bp, Homo sapiens
tgaatacaaacaatg

SEQ ID NO: 6450607 - DNA, 17 bp, Homo sapiens
tgaatacaaacaatgga

SEQ ID NO: 6450608 - DNA, 20 bp, Homo sapiens
tgaatacaaacaatggaaac

SEQ ID NO: 6450609 - DNA, 23 bp, Homo sapiens
tgaatacaaacaatggaaactga

SEQ ID NO: 6450610 - DNA, 13 bp, Homo sapiens
tgaatacaagcct

SEQ ID NO: 6450611 - DNA, 13 bp, Homo sapiens
tgaatacacaaat

SEQ ID NO: 6450612 - DNA, 13 bp, Homo sapiens
tgaatacactgga

SEQ ID NO: 6450613 - DNA, 17 bp, Homo sapiens
tgaatacacttacagtt

SEQ ID NO: 6450614 - DNA, 17 bp, Homo sapiens
tgaatacagcagcaaga

SEQ ID NO: 6450615 - DNA, 18 bp, Homo sapiens
tgaatacagcagcaagaa

SEQ ID NO: 6450616 - DNA, 20 bp, Homo sapiens
tgaatacagcagcaagaaaa

SEQ ID NO: 6450617 - DNA, 18 bp, Homo sapiens
tgaatacatggtagcagg

SEQ ID NO: 6450618 - DNA, 17 bp, Homo sapiens
tgaatacattaaaagaa

SEQ ID NO: 6450619 - DNA, 18 bp, Homo sapiens
tgaatacattaaaagaag

SEQ ID NO: 6450620 - DNA, 20 bp, Homo sapiens
tgaatacattaacggtgcta

SEQ ID NO: 6450621 - DNA, 15 bp, Homo sapiens
tgaatacatttccaa

SEQ ID NO: 6450622 - DNA, 14 bp, Homo sapiens
tgaatacatttgta

SEQ ID NO: 6450623 - DNA, 15 bp, Homo sapiens
tgaatacatttgtat

SEQ ID NO: 6450624 - DNA, 22 bp, Homo sapiens
tgaataccattaaaactgcttt

SEQ ID NO: 6450625 - DNA, 14 bp, Homo sapiens
tgaatacccccaga

SEQ ID NO: 6450626 - DNA, 18 bp, Homo sapiens
tgaataccccttctctgt

SEQ ID NO: 6450627 - DNA, 22 bp, Homo sapiens
tgaataccttagtgcagttatt

SEQ ID NO: 6450628 - DNA, 14 bp, Homo sapiens
tgaatactaaatgg

SEQ ID NO: 6450629 - DNA, 20 bp, Homo sapiens
tgaatactatccatgtaata

SEQ ID NO: 6450630 - DNA, 22 bp, Homo sapiens
tgaatactctgccctctagagc

SEQ ID NO: 6450631 - DNA, 15 bp, Homo sapiens
tgaatactcttgaaa

SEQ ID NO: 6450632 - DNA, 17 bp, Homo sapiens
tgaatactgaattttga

SEQ ID NO: 6450633 - DNA, 13 bp, Homo sapiens
tgaatactgcttg

SEQ ID NO: 6450634 - DNA, 16 bp, Homo sapiens
tgaatactgcttgaat

SEQ ID NO: 6450635 - DNA, 18 bp, Homo sapiens
tgaatactgcttgaataa

SEQ ID NO: 6450636 - DNA, 20 bp, Homo sapiens
tgaatacttaatatgtggga

SEQ ID NO: 6450637 - DNA, 18 bp, Homo sapiens
tgaatacttacattctct

SEQ ID NO: 6450638 - DNA, 16 bp, Homo sapiens
tgaatacttattttca

SEQ ID NO: 6450639 - DNA, 19 bp, Homo sapiens
tgaatacttgaaccataaa

SEQ ID NO: 6450640 - DNA, 15 bp, Homo sapiens
tgaatacttggaagt

SEQ ID NO: 6450641 - DNA, 14 bp, Homo sapiens
tgaatactttctta

SEQ ID NO: 6450642 - DNA, 13 bp, Homo sapiens
tgaatactttgaa

SEQ ID NO: 6450643 - DNA, 16 bp, Homo sapiens
tgaatactttttacaa

SEQ ID NO: 6450644 - DNA, 14 bp, Homo sapiens
tgaatagaagaaag

SEQ ID NO: 6450645 - DNA, 16 bp, Homo sapiens
tgaatagaagaaagaa

SEQ ID NO: 6450646 - DNA, 21 bp, Homo sapiens
tgaatagacataaattgtaat

SEQ ID NO: 6450647 - DNA, 23 bp, Homo sapiens
tgaatagaggccaaattaatctt

SEQ ID NO: 6450648 - DNA, 19 bp, Homo sapiens
tgaatagattttctctgga

SEQ ID NO: 6450649 - DNA, 13 bp, Homo sapiens
tgaatagcacagg

SEQ ID NO: 6450650 - DNA, 20 bp, Homo sapiens
tgaatagcagtggcaaaata

SEQ ID NO: 6450651 - DNA, 16 bp, Homo sapiens
tgaatagccatatttg

SEQ ID NO: 6450652 - DNA, 15 bp, Homo sapiens
tgaatagcttgtttc

SEQ ID NO: 6450653 - DNA, 15 bp, Homo sapiens
tgaataggaaaatgt

SEQ ID NO: 6450654 - DNA, 18 bp, Homo sapiens
tgaataggaaaatgtaca

SEQ ID NO: 6450655 - DNA, 19 bp, Homo sapiens
tgaataggaaaatgtacat

SEQ ID NO: 6450656 - DNA, 16 bp, Homo sapiens
tgaataggagttctcc

SEQ ID NO: 6450657 - DNA, 15 bp, Homo sapiens
tgaataggcattaaa

SEQ ID NO: 6450658 - DNA, 21 bp, Homo sapiens
tgaataggcattaaatgcaaa

SEQ ID NO: 6450659 - DNA, 19 bp, Homo sapiens
tgaataggggaaagaaatt

SEQ ID NO: 6450660 - DNA, 21 bp, Homo sapiens
tgaatagttaaaaattaaata

SEQ ID NO: 6450661 - DNA, 23 bp, Homo sapiens
tgaatagttaaaaattaaatatt

SEQ ID NO: 6450662 - DNA, 22 bp, Homo sapiens
tgaatagtttatttctgtgaaa

SEQ ID NO: 6450663 - DNA, 14 bp, Homo sapiens
tgaatataaagctt

SEQ ID NO: 6450664 - DNA, 13 bp, Homo sapiens
tgaatataaatgt

SEQ ID NO: 6450665 - DNA, 21 bp, Homo sapiens
tgaatataaatgtactacatt

SEQ ID NO: 6450666 - DNA, 14 bp, Homo sapiens
tgaatataaatgtg

SEQ ID NO: 6450667 - DNA, 21 bp, Homo sapiens
tgaatataaatgtgtgtatgt

SEQ ID NO: 6450668 - DNA, 20 bp, Homo sapiens
tgaatataacttttgtggac

SEQ ID NO: 6450669 - DNA, 14 bp, Homo sapiens
tgaatataatccct

SEQ ID NO: 6450670 - DNA, 22 bp, Homo sapiens
tgaatataccccttagtgtttg

SEQ ID NO: 6450671 - DNA, 18 bp, Homo sapiens
tgaatatagcctgcctca

SEQ ID NO: 6450672 - DNA, 13 bp, Homo sapiens
tgaatatataaac

SEQ ID NO: 6450673 - DNA, 15 bp, Homo sapiens
tgaatatatagaatt

SEQ ID NO: 6450674 - DNA, 16 bp, Homo sapiens
tgaatatatggtctgt

SEQ ID NO: 6450675 - DNA, 23 bp, Homo sapiens
tgaatatatttaagcaacatctt

SEQ ID NO: 6450676 - DNA, 13 bp, Homo sapiens
tgaatatatttta

SEQ ID NO: 6450677 - DNA, 17 bp, Homo sapiens
tgaatatatttttaaag

SEQ ID NO: 6450678 - DNA, 18 bp, Homo sapiens
tgaatatatttttaaagc

SEQ ID NO: 6450679 - DNA, 21 bp, Homo sapiens
tgaatatatttttaaagcaaa

SEQ ID NO: 6450680 - DNA, 23 bp, Homo sapiens
tgaatatcaactctgaaagagca

SEQ ID NO: 6450681 - DNA, 12 bp, Homo sapiens
tgaatatcaaga

SEQ ID NO: 6450682 - DNA, 19 bp, Homo sapiens
tgaatatcatatgtatcta

SEQ ID NO: 6450683 - DNA, 18 bp, Homo sapiens
tgaatatcattgatttta

SEQ ID NO: 6450684 - DNA, 13 bp, Homo sapiens
tgaatatcccctc

SEQ ID NO: 6450685 - DNA, 16 bp, Homo sapiens
tgaatatcccctccca

SEQ ID NO: 6450686 - DNA, 18 bp, Homo sapiens
tgaatatcccctcccagt

SEQ ID NO: 6450687 - DNA, 16 bp, Homo sapiens
tgaatatctattaata

SEQ ID NO: 6450688 - DNA, 17 bp, Homo sapiens
tgaatatctattaatat

SEQ ID NO: 6450689 - DNA, 14 bp, Homo sapiens
tgaatatctttcga

SEQ ID NO: 6450690 - DNA, 13 bp, Homo sapiens
tgaatatgagaaa

SEQ ID NO: 6450691 - DNA, 14 bp, Homo sapiens
tgaatatgagaaat

SEQ ID NO: 6450692 - DNA, 17 bp, Homo sapiens
tgaatatgagaaataca

SEQ ID NO: 6450693 - DNA, 18 bp, Homo sapiens
tgaatatgagaaatacag

SEQ ID NO: 6450694 - DNA, 22 bp, Homo sapiens
tgaatatgatccctaatgtgtt

SEQ ID NO: 6450695 - DNA, 14 bp, Homo sapiens
tgaatatgccttaa

SEQ ID NO: 6450696 - DNA, 21 bp, Homo sapiens
tgaatatgccttaatttagaa

SEQ ID NO: 6450697 - DNA, 12 bp, Homo sapiens
tgaatatggaca

SEQ ID NO: 6450698 - DNA, 21 bp, Homo sapiens
tgaatatggacagttagcatt

SEQ ID NO: 6450699 - DNA, 14 bp, Homo sapiens
tgaatatggtgtct

SEQ ID NO: 6450700 - DNA, 18 bp, Homo sapiens
tgaatatgtacataggca

SEQ ID NO: 6450701 - DNA, 23 bp, Homo sapiens
tgaatatgtagtatctatatgac

SEQ ID NO: 6450702 - DNA, 18 bp, Homo sapiens
tgaatatgttagaatcaa

SEQ ID NO: 6450703 - DNA, 19 bp, Homo sapiens
tgaatattaaagctcttca

SEQ ID NO: 6450704 - DNA, 16 bp, Homo sapiens
tgaatattaagaaaca

SEQ ID NO: 6450705 - DNA, 19 bp, Homo sapiens
tgaatattacatgtaaagc

SEQ ID NO: 6450706 - DNA, 22 bp, Homo sapiens
tgaatattactcctatttttgt

SEQ ID NO: 6450707 - DNA, 13 bp, Homo sapiens
tgaatattagatg

SEQ ID NO: 6450708 - DNA, 22 bp, Homo sapiens
tgaatattagatgctctgagaa

SEQ ID NO: 6450709 - DNA, 13 bp, Homo sapiens
tgaatattattcc

SEQ ID NO: 6450710 - DNA, 15 bp, Homo sapiens
tgaatattattcctc

SEQ ID NO: 6450711 - DNA, 16 bp, Homo sapiens
tgaatattcctggact

SEQ ID NO: 6450712 - DNA, 14 bp, Homo sapiens
tgaatattctagaa

SEQ ID NO: 6450713 - DNA, 15 bp, Homo sapiens
tgaatattgatgtta

SEQ ID NO: 6450714 - DNA, 19 bp, Homo sapiens
tgaatattgatgttaacaa

SEQ ID NO: 6450715 - DNA, 19 bp, Homo sapiens
tgaatattggtaattaaaa

SEQ ID NO: 6450716 - DNA, 19 bp, Homo sapiens
tgaatattgtggctccctg

SEQ ID NO: 6450717 - DNA, 15 bp, Homo sapiens
tgaatatttaagaaa

SEQ ID NO: 6450718 - DNA, 21 bp, Homo sapiens
tgaatatttaagcaataaaac

SEQ ID NO: 6450719 - DNA, 22 bp, Homo sapiens
tgaatatttaagcaataaaact

SEQ ID NO: 6450720 - DNA, 18 bp, Homo sapiens
tgaatatttagtgttcat

SEQ ID NO: 6450721 - DNA, 18 bp, Homo sapiens
tgaatatttataacagca

SEQ ID NO: 6450722 - DNA, 19 bp, Homo sapiens
tgaatatttcaaaataaac

SEQ ID NO: 6450723 - DNA, 20 bp, Homo sapiens
tgaatatttcattttgagaa

SEQ ID NO: 6450724 - DNA, 18 bp, Homo sapiens
tgaatatttgttttaata

SEQ ID NO: 6450725 - DNA, 21 bp, Homo sapiens
tgaatattttatattaaaata

SEQ ID NO: 6450726 - DNA, 21 bp, Homo sapiens
tgaatattttcaactatgtag

SEQ ID NO: 6450727 - DNA, 19 bp, Homo sapiens
tgaatattttcattaaaag

SEQ ID NO: 6450728 - DNA, 16 bp, Homo sapiens
tgaatattttgataat

SEQ ID NO: 6450729 - DNA, 16 bp, Homo sapiens
tgaatattttggaaac

SEQ ID NO: 6450730 - DNA, 17 bp, Homo sapiens
tgaatattttggaaact

SEQ ID NO: 6450731 - DNA, 18 bp, Homo sapiens
tgaatattttggaaactg

SEQ ID NO: 6450732 - DNA, 19 bp, Homo sapiens
tgaatattttttatttcta

SEQ ID NO: 6450733 - DNA, 21 bp, Homo sapiens
tgaatattttttatttctaag

SEQ ID NO: 6450734 - DNA, 15 bp, Homo sapiens
tgaatattttttgaa

SEQ ID NO: 6450735 - DNA, 15 bp, Homo sapiens
tgaatcaaagacatt

SEQ ID NO: 6450736 - DNA, 18 bp, Homo sapiens
tgaatcaaagacatttca

SEQ ID NO: 6450737 - DNA, 20 bp, Homo sapiens
tgaatcaaagacatttcatc

SEQ ID NO: 6450738 - DNA, 18 bp, Homo sapiens
tgaatcaagcaatatgga

SEQ ID NO: 6450739 - DNA, 15 bp, Homo sapiens
tgaatcaataatata

SEQ ID NO: 6450740 - DNA, 19 bp, Homo sapiens
tgaatcaataatatatttt

SEQ ID NO: 6450741 - DNA, 20 bp, Homo sapiens
tgaatcaataatatattttc

SEQ ID NO: 6450742 - DNA, 16 bp, Homo sapiens
tgaatcaatcctgggc

SEQ ID NO: 6450743 - DNA, 17 bp, Homo sapiens
tgaatcaatctggcttc

SEQ ID NO: 6450744 - DNA, 22 bp, Homo sapiens
tgaatcaatctggcttctgcat

SEQ ID NO: 6450745 - DNA, 13 bp, Homo sapiens
tgaatcaatgtat

SEQ ID NO: 6450746 - DNA, 18 bp, Homo sapiens
tgaatcacagtatcagta

SEQ ID NO: 6450747 - DNA, 23 bp, Homo sapiens
tgaatcacgtaaagctagaaatg

SEQ ID NO: 6450748 - DNA, 14 bp, Homo sapiens
tgaatcactgtttt

SEQ ID NO: 6450749 - DNA, 19 bp, Homo sapiens
tgaatcactgtttttagac

SEQ ID NO: 6450750 - DNA, 22 bp, Homo sapiens
tgaatcactgtttttagacacc

SEQ ID NO: 6450751 - DNA, 21 bp, Homo sapiens
tgaatcagaaaagctattaaa

SEQ ID NO: 6450752 - DNA, 21 bp, Homo sapiens
tgaatcagaataaccttcaaa

SEQ ID NO: 6450753 - DNA, 19 bp, Homo sapiens
tgaatcagacattttaagg

SEQ ID NO: 6450754 - DNA, 16 bp, Homo sapiens
tgaatcagagaaaact

SEQ ID NO: 6450755 - DNA, 16 bp, Homo sapiens
tgaatcagaggcagag

SEQ ID NO: 6450756 - DNA, 13 bp, Homo sapiens
tgaatcagctgga

SEQ ID NO: 6450757 - DNA, 18 bp, Homo sapiens
tgaatcaggaggagatta

SEQ ID NO: 6450758 - DNA, 19 bp, Homo sapiens
tgaatcaggaggagattaa

SEQ ID NO: 6450759 - DNA, 15 bp, Homo sapiens
tcccctatcctcccc

SEQ ID NO: 6450760 - DNA, 17 bp, Homo sapiens
tcccctatgccactaag

SEQ ID NO: 6450761 - DNA, 13 bp, Homo sapiens
tcccctatgctgg

SEQ ID NO: 6450762 - DNA, 12 bp, Homo sapiens
tcccctattttt

SEQ ID NO: 6450763 - DNA, 14 bp, Homo sapiens
tcccctcaaagtct

SEQ ID NO: 6450764 - DNA, 17 bp, Homo sapiens
tcccctcaaagtctgca

SEQ ID NO: 6450765 - DNA, 19 bp, Homo sapiens
tcccctcaagccccttctc

SEQ ID NO: 6450766 - DNA, 22 bp, Homo sapiens
tcccctcaaggacaaagtctcc

SEQ ID NO: 6450767 - DNA, 15 bp, Homo sapiens
tcccctcacagactc

SEQ ID NO: 6450768 - DNA, 16 bp, Homo sapiens
tcccctcacagactct

SEQ ID NO: 6450769 - DNA, 20 bp, Homo sapiens
tcccctcacagactcttcca

SEQ ID NO: 6450770 - DNA, 21 bp, Homo sapiens
tcccctcacagactcttccac

SEQ ID NO: 6450771 - DNA, 22 bp, Homo sapiens
tcccctcacagactcttccacc

SEQ ID NO: 6450772 - DNA, 19 bp, Homo sapiens
tcccctcacagcctctgac

SEQ ID NO: 6450773 - DNA, 23 bp, Homo sapiens
tcccctcacccgctgcccagccc

SEQ ID NO: 6450774 - DNA, 14 bp, Homo sapiens
tcccctcacctcca

SEQ ID NO: 6450775 - DNA, 15 bp, Homo sapiens
tcccctcacctcctc

SEQ ID NO: 6450776 - DNA, 20 bp, Homo sapiens
tcccctcacgtgaccagccc

SEQ ID NO: 6450777 - DNA, 21 bp, Homo sapiens
tcccctcacgtgaccagcccc

SEQ ID NO: 6450778 - DNA, 14 bp, Homo sapiens
tcccctcactctgt

SEQ ID NO: 6450779 - DNA, 18 bp, Homo sapiens
tcccctcactctgtcagc

SEQ ID NO: 6450780 - DNA, 13 bp, Homo sapiens
tcccctcactgga

SEQ ID NO: 6450781 - DNA, 14 bp, Homo sapiens
tcccctcagagccc

SEQ ID NO: 6450782 - DNA, 14 bp, Homo sapiens
tcccctcagagctc

SEQ ID NO: 6450783 - DNA, 20 bp, Homo sapiens
tcccctcagagctcttatgt

SEQ ID NO: 6450784 - DNA, 15 bp, Homo sapiens
tcccctcagcctgcc

SEQ ID NO: 6450785 - DNA, 11 bp, Homo sapiens
tcccctcagcg

SEQ ID NO: 6450786 - DNA, 14 bp, Homo sapiens
tcccctcagcgcag

SEQ ID NO: 6450787 - DNA, 19 bp, Homo sapiens
tcccctcagcgcaggctgc

SEQ ID NO: 6450788 - DNA, 22 bp, Homo sapiens
tcccctcagcgggggccttgaa

SEQ ID NO: 6450789 - DNA, 23 bp, Homo sapiens
tcccctcagcgggggccttgaag

SEQ ID NO: 6450790 - DNA, 23 bp, Homo sapiens
tcccctccaccctaaagtctcag

SEQ ID NO: 6450791 - DNA, 20 bp, Homo sapiens
tcccctccacgcaaggctgt

SEQ ID NO: 6450792 - DNA, 13 bp, Homo sapiens
tcccctccagcct

SEQ ID NO: 6450793 - DNA, 14 bp, Homo sapiens
tcccctccaggaag

SEQ ID NO: 6450794 - DNA, 23 bp, Homo sapiens
tcccctccaggagggaccaccct

SEQ ID NO: 6450795 - DNA, 18 bp, Homo sapiens
tcccctccatccctggcc

SEQ ID NO: 6450796 - DNA, 20 bp, Homo sapiens
tcccctccatccctggcccc

SEQ ID NO: 6450797 - DNA, 14 bp, Homo sapiens
tcccctccatctgg

SEQ ID NO: 6450798 - DNA, 17 bp, Homo sapiens
tcccctccatgggcgtc

SEQ ID NO: 6450799 - DNA, 19 bp, Homo sapiens
tcccctcccagccctgagg

SEQ ID NO: 6450800 - DNA, 15 bp, Homo sapiens
tcccctcccagggga

SEQ ID NO: 6450801 - DNA, 22 bp, Homo sapiens
tcccctcccaggggagccagct

SEQ ID NO: 6450802 - DNA, 23 bp, Homo sapiens
tcccctcccaggggagccagctg

SEQ ID NO: 6450803 - DNA, 11 bp, Homo sapiens
tcccctcccat

SEQ ID NO: 6450804 - DNA, 17 bp, Homo sapiens
tcccctcccatctggga

SEQ ID NO: 6450805 - DNA, 14 bp, Homo sapiens
tcccctccccaact

SEQ ID NO: 6450806 - DNA, 17 bp, Homo sapiens
tcccctccccactcctc

SEQ ID NO: 6450807 - DNA, 13 bp, Homo sapiens
tcccctccccagc

SEQ ID NO: 6450808 - DNA, 17 bp, Homo sapiens
tcccctccccagcccaa

SEQ ID NO: 6450809 - DNA, 16 bp, Homo sapiens
tcccctccccagctcc

SEQ ID NO: 6450810 - DNA, 11 bp, Homo sapiens
tcccctccccc

SEQ ID NO: 6450811 - DNA, 13 bp, Homo sapiens
tcccctcccccaa

SEQ ID NO: 6450812 - DNA, 17 bp, Homo sapiens
tcccctcccccactcct

SEQ ID NO: 6450813 - DNA, 15 bp, Homo sapiens
tcccctcccccctgt

SEQ ID NO: 6450814 - DNA, 16 bp, Homo sapiens
tcccctcccccctgta

SEQ ID NO: 6450815 - DNA, 19 bp, Homo sapiens
tcccctccccgccccctga

SEQ ID NO: 6450816 - DNA, 17 bp, Homo sapiens
tcccctccccgcctggc

SEQ ID NO: 6450817 - DNA, 21 bp, Homo sapiens
tcccctccccgtttcagtgga

SEQ ID NO: 6450818 - DNA, 13 bp, Homo sapiens
tcccctcccctgc

SEQ ID NO: 6450819 - DNA, 17 bp, Homo sapiens
tcccctcccctgctgca

SEQ ID NO: 6450820 - DNA, 13 bp, Homo sapiens
tcccctcccgctt

SEQ ID NO: 6450821 - DNA, 15 bp, Homo sapiens
tcccctccctcgtgg

SEQ ID NO: 6450822 - DNA, 17 bp, Homo sapiens
tcccctccctcgtgggc

SEQ ID NO: 6450823 - DNA, 18 bp, Homo sapiens
tcccctccctcgtgggct

SEQ ID NO: 6450824 - DNA, 12 bp, Homo sapiens
tcccctccctgg

SEQ ID NO: 6450825 - DNA, 13 bp, Homo sapiens
tcccctccctgta

SEQ ID NO: 6450826 - DNA, 14 bp, Homo sapiens
tcccctccctgtca

SEQ ID NO: 6450827 - DNA, 20 bp, Homo sapiens
tcccctcccttgtccttgaa

SEQ ID NO: 6450828 - DNA, 21 bp, Homo sapiens
tcccctccgcagcagggaagc

SEQ ID NO: 6450829 - DNA, 21 bp, Homo sapiens
tcccctccggactggtgccct

SEQ ID NO: 6450830 - DNA, 13 bp, Homo sapiens
tcccctcctcagt

SEQ ID NO: 6450831 - DNA, 13 bp, Homo sapiens
tcccctcctcgcc

SEQ ID NO: 6450832 - DNA, 16 bp, Homo sapiens
tcccctcctctattcc

SEQ ID NO: 6450833 - DNA, 14 bp, Homo sapiens
tcccctcctctccc

SEQ ID NO: 6450834 - DNA, 19 bp, Homo sapiens
tcccctcctcttcccttag

SEQ ID NO: 6450835 - DNA, 20 bp, Homo sapiens
tcccctcctcttcccttagc

SEQ ID NO: 6450836 - DNA, 16 bp, Homo sapiens
tcccctcctcttccga

SEQ ID NO: 6450837 - DNA, 21 bp, Homo sapiens
tcccctcctcttccgagctgc

SEQ ID NO: 6450838 - DNA, 18 bp, Homo sapiens
tcccctcctgcacacagg

SEQ ID NO: 6450839 - DNA, 14 bp, Homo sapiens
tcccctcctgtaag

SEQ ID NO: 6450840 - DNA, 16 bp, Homo sapiens
tcccctccttccagcc

SEQ ID NO: 6450841 - DNA, 18 bp, Homo sapiens
tcccctccttccctcacc

SEQ ID NO: 6450842 - DNA, 20 bp, Homo sapiens
tcccctccttccctcacccc

SEQ ID NO: 6450843 - DNA, 14 bp, Homo sapiens
tcccctccttctcc

SEQ ID NO: 6450844 - DNA, 18 bp, Homo sapiens
tcccctccttctcccttt

SEQ ID NO: 6450845 - DNA, 12 bp, Homo sapiens
tcccctccttgg

SEQ ID NO: 6450846 - DNA, 14 bp, Homo sapiens
tcccctccttgggc

SEQ ID NO: 6450847 - DNA, 17 bp, Homo sapiens
tcccctcgacagctctc

SEQ ID NO: 6450848 - DNA, 14 bp, Homo sapiens
tcccctcgctgctg

SEQ ID NO: 6450849 - DNA, 15 bp, Homo sapiens
tcccctcgcttcata

SEQ ID NO: 6450850 - DNA, 16 bp, Homo sapiens
tcccctcggagaagag

SEQ ID NO: 6450851 - DNA, 17 bp, Homo sapiens
tcccctcgtcccatcca

SEQ ID NO: 6450852 - DNA, 19 bp, Homo sapiens
tcccctcgtcctgtcccag

SEQ ID NO: 6450853 - DNA, 19 bp, Homo sapiens
tcccctcgtgtgactctct

SEQ ID NO: 6450854 - DNA, 13 bp, Homo sapiens
tcccctctatttt

SEQ ID NO: 6450855 - DNA, 23 bp, Homo sapiens
tcccctctcagaacatactgatt

SEQ ID NO: 6450856 - DNA, 15 bp, Homo sapiens
tcccctctcaggaga

SEQ ID NO: 6450857 - DNA, 16 bp, Homo sapiens
tcccctctcaggagag

SEQ ID NO: 6450858 - DNA, 23 bp, Homo sapiens
tcccctctcaggagagtgtgcaa

SEQ ID NO: 6450859 - DNA, 16 bp, Homo sapiens
tcccctctcccaggga

SEQ ID NO: 6450860 - DNA, 21 bp, Homo sapiens
tcccctctcctccccttcctg

SEQ ID NO: 6450861 - DNA, 14 bp, Homo sapiens
tcccctctcggcca

SEQ ID NO: 6450862 - DNA, 14 bp, Homo sapiens
tcccctctctgcac

SEQ ID NO: 6450863 - DNA, 14 bp, Homo sapiens
tcccctctctgccc

SEQ ID NO: 6450864 - DNA, 18 bp, Homo sapiens
tcccctctctgctccaga

SEQ ID NO: 6450865 - DNA, 19 bp, Homo sapiens
tcccctctcttgcacccgc

SEQ ID NO: 6450866 - DNA, 22 bp, Homo sapiens
tcccctctgaaagttgtacatg

SEQ ID NO: 6450867 - DNA, 17 bp, Homo sapiens
tcccctctgccccaccc

SEQ ID NO: 6450868 - DNA, 16 bp, Homo sapiens
tcccctctgccctgta

SEQ ID NO: 6450869 - DNA, 20 bp, Homo sapiens
tcccctctgccggtccccca

SEQ ID NO: 6450870 - DNA, 13 bp, Homo sapiens
tcccctctgctgg

SEQ ID NO: 6450871 - DNA, 14 bp, Homo sapiens
tcccctctgctggc

SEQ ID NO: 6450872 - DNA, 13 bp, Homo sapiens
tcccctctggaat

SEQ ID NO: 6450873 - DNA, 22 bp, Homo sapiens
tcccctctggaatcttccccaa

SEQ ID NO: 6450874 - DNA, 20 bp, Homo sapiens
tcccctctggaatgcactga

SEQ ID NO: 6450875 - DNA, 19 bp, Homo sapiens
tcccctctgtcatcactcc

SEQ ID NO: 6450876 - DNA, 13 bp, Homo sapiens
tcccctctgtgct

SEQ ID NO: 6450877 - DNA, 23 bp, Homo sapiens
tcccctctgtgcttcgactactg

SEQ ID NO: 6450878 - DNA, 17 bp, Homo sapiens
tcccctcttcccttcaa

SEQ ID NO: 6450879 - DNA, 12 bp, Homo sapiens
tcccctcttctg

SEQ ID NO: 6450880 - DNA, 18 bp, Homo sapiens
tcccctcttcttctttcc

SEQ ID NO: 6450881 - DNA, 19 bp, Homo sapiens
tcccctcttgtctcccctg

SEQ ID NO: 6450882 - DNA, 13 bp, Homo sapiens
tcccctctttgaa

SEQ ID NO: 6450883 - DNA, 19 bp, Homo sapiens
tcccctgaatcctcagaga

SEQ ID NO: 6450884 - DNA, 19 bp, Homo sapiens
tcccctgagaccaccccca

SEQ ID NO: 6450885 - DNA, 21 bp, Homo sapiens
tcccctgagagtttcctcaga

SEQ ID NO: 6450886 - DNA, 22 bp, Homo sapiens
tcccctgaggatcccctgtccc

SEQ ID NO: 6450887 - DNA, 20 bp, Homo sapiens
tcccctgaggctggcatcct

SEQ ID NO: 6450888 - DNA, 21 bp, Homo sapiens
tcccctgagggtggtcagcca

SEQ ID NO: 6450889 - DNA, 11 bp, Homo sapiens
tcccctgaggt

SEQ ID NO: 6450890 - DNA, 22 bp, Homo sapiens
tcccctgcaatgcgtcttgtga

SEQ ID NO: 6450891 - DNA, 23 bp, Homo sapiens
tcccctgcaatgcgtcttgtgaa

SEQ ID NO: 6450892 - DNA, 16 bp, Homo sapiens
tcccctgcacctggcc

SEQ ID NO: 6450893 - DNA, 17 bp, Homo sapiens
tcccctgcacctggcct

SEQ ID NO: 6450894 - DNA, 14 bp, Homo sapiens
tcccctgcactgta

SEQ ID NO: 6450895 - DNA, 22 bp, Homo sapiens
tcccctgcactgtaaaatgtgg

SEQ ID NO: 6450896 - DNA, 18 bp, Homo sapiens
tcccctgcagccctggcc

SEQ ID NO: 6450897 - DNA, 15 bp, Homo sapiens
tcccctgcagcctgg

SEQ ID NO: 6450898 - DNA, 11 bp, Homo sapiens
tcccctgccag

SEQ ID NO: 6450899 - DNA, 13 bp, Homo sapiens
tcccctgccaggg

SEQ ID NO: 6450900 - DNA, 18 bp, Homo sapiens
tcccctgcccagcctgct

SEQ ID NO: 6450901 - DNA, 15 bp, Homo sapiens
tcccctgcccatgct

SEQ ID NO: 6450902 - DNA, 21 bp, Homo sapiens
tcccctgcccatgctgggagc

SEQ ID NO: 6450903 - DNA, 14 bp, Homo sapiens
tcccctgcccccag

SEQ ID NO: 6450904 - DNA, 23 bp, Homo sapiens
tcccctgcccccagaccttttat

SEQ ID NO: 6450905 - DNA, 17 bp, Homo sapiens
tcccctgcccccaggac

SEQ ID NO: 6450906 - DNA, 20 bp, Homo sapiens
tcccctgcccccaggactgg

SEQ ID NO: 6450907 - DNA, 22 bp, Homo sapiens
tcccctgcccccaggactgggc

SEQ ID NO: 6450908 - DNA, 21 bp, Homo sapiens
tcccctgccccctgcaggaag

SEQ ID NO: 6450909 - DNA, 23 bp, Homo sapiens
tcccctgccccgtcccctgggcc

SEQ ID NO: 6450910 - DNA, 15 bp, Homo sapiens
tcccctgcccgcccc

SEQ ID NO: 6450911 - DNA, 23 bp, Homo sapiens
tcccctgccctgctgccgcctcc

SEQ ID NO: 6450912 - DNA, 15 bp, Homo sapiens
tcccctgccctggtc

SEQ ID NO: 6450913 - DNA, 13 bp, Homo sapiens
tcccctgccgcct

SEQ ID NO: 6450914 - DNA, 23 bp, Homo sapiens
tcccctgccggtgcacaggcctc

SEQ ID NO: 6450915 - DNA, 13 bp, Homo sapiens
tcccctgcctcca

SEQ ID NO: 6450916 - DNA, 18 bp, Homo sapiens
tcccctgcctcctactcc

SEQ ID NO: 6450917 - DNA, 16 bp, Homo sapiens
tcccctgcctcctgcc

SEQ ID NO: 6450918 - DNA, 17 bp, Homo sapiens
tcccctgcctcctgcca

SEQ ID NO: 6450919 - DNA, 18 bp, Homo sapiens
tcccctgcctcctgccac

SEQ ID NO: 6450920 - DNA, 18 bp, Homo sapiens
tcccctgcctgccctggt

SEQ ID NO: 6450921 - DNA, 21 bp, Homo sapiens
tcccctgccttaacctgggac

SEQ ID NO: 6450922 - DNA, 12 bp, Homo sapiens
tcccctgccttg

SEQ ID NO: 6450923 - DNA, 16 bp, Homo sapiens
tcccctgcgcaggccc

SEQ ID NO: 6450924 - DNA, 20 bp, Homo sapiens
tcccctgctactccactgac

SEQ ID NO: 6450925 - DNA, 14 bp, Homo sapiens
tcccctgctcccag

SEQ ID NO: 6450926 - DNA, 19 bp, Homo sapiens
tcccctgctgaccttggag

SEQ ID NO: 6450927 - DNA, 14 bp, Homo sapiens
tcccctgctgaggc

SEQ ID NO: 6450928 - DNA, 18 bp, Homo sapiens
tcccctgctgcaggggct

SEQ ID NO: 6450929 - DNA, 15 bp, Homo sapiens
tcccctgctgggtgt

SEQ ID NO: 6450930 - DNA, 24 bp, Homo sapiens
tcccctgctgggtgtggcgcagca

SEQ ID NO: 6450931 - DNA, 11 bp, Homo sapiens
tcccctgcttc

SEQ ID NO: 6450932 - DNA, 14 bp, Homo sapiens
tcccctgcttcaga

SEQ ID NO: 6450933 - DNA, 17 bp, Homo sapiens
tcccctggaagcagtgc

SEQ ID NO: 6450934 - DNA, 23 bp, Homo sapiens
tcccctggaagcagtgcccaggt

SEQ ID NO: 6450935 - DNA, 20 bp, Homo sapiens
tcccctggaccacacctccg

SEQ ID NO: 6450936 - DNA, 18 bp, Homo sapiens
tcccctggagccagcagg

SEQ ID NO: 6450937 - DNA, 14 bp, Homo sapiens
tcccctggcccttc

SEQ ID NO: 6450938 - DNA, 17 bp, Homo sapiens
tcccctggcccttcctt

SEQ ID NO: 6450939 - DNA, 23 bp, Homo sapiens
tgaatcaggaggagattaacaca

SEQ ID NO: 6450940 - DNA, 16 bp, Homo sapiens
tgaatcagtataaaca

SEQ ID NO: 6450941 - DNA, 21 bp, Homo sapiens
tgaatcagtataaacaaagtt

SEQ ID NO: 6450942 - DNA, 18 bp, Homo sapiens
tgaatcagtatgaagaca

SEQ ID NO: 6450943 - DNA, 22 bp, Homo sapiens
tgaatcagtttccaattatttg

SEQ ID NO: 6450944 - DNA, 19 bp, Homo sapiens
tgaatcagtttttaaaata

SEQ ID NO: 6450945 - DNA, 18 bp, Homo sapiens
tgaatcatgagcctgctg

SEQ ID NO: 6450946 - DNA, 19 bp, Homo sapiens
tgaatcatggtttttctta

SEQ ID NO: 6450947 - DNA, 12 bp, Homo sapiens
tgaatcatgtag

SEQ ID NO: 6450948 - DNA, 14 bp, Homo sapiens
tgaatcatgtagta

SEQ ID NO: 6450949 - DNA, 15 bp, Homo sapiens
tgaatcatgtctgta

SEQ ID NO: 6450950 - DNA, 18 bp, Homo sapiens
tgaatcattgtatgtggt

SEQ ID NO: 6450951 - DNA, 17 bp, Homo sapiens
tgaatccaaaagaaaaa

SEQ ID NO: 6450952 - DNA, 15 bp, Homo sapiens
tgaatccaaactaat

SEQ ID NO: 6450953 - DNA, 16 bp, Homo sapiens
tgaatccaaactaatc

SEQ ID NO: 6450954 - DNA, 11 bp, Homo sapiens
tgaatccaaat

SEQ ID NO: 6450955 - DNA, 21 bp, Homo sapiens
tgaatccaaatctgtcctctg

SEQ ID NO: 6450956 - DNA, 22 bp, Homo sapiens
tgaatccaaatctgtcctctgt

SEQ ID NO: 6450957 - DNA, 20 bp, Homo sapiens
tgaatccaaatgtgaaagat

SEQ ID NO: 6450958 - DNA, 18 bp, Homo sapiens
tgaatccacctcggagca

SEQ ID NO: 6450959 - DNA, 20 bp, Homo sapiens
tgaatccaggaggcagtgga

SEQ ID NO: 6450960 - DNA, 22 bp, Homo sapiens
tgaatccaggaggcagtggaca

SEQ ID NO: 6450961 - DNA, 14 bp, Homo sapiens
tgaatccatgcttg

SEQ ID NO: 6450962 - DNA, 17 bp, Homo sapiens
tgaatccatgcttgggt

SEQ ID NO: 6450963 - DNA, 21 bp, Homo sapiens
tgaatccatgggtctggctag

SEQ ID NO: 6450964 - DNA, 20 bp, Homo sapiens
tgaatcccacccacatgtga

SEQ ID NO: 6450965 - DNA, 16 bp, Homo sapiens
tgaatcccacttcagt

SEQ ID NO: 6450966 - DNA, 19 bp, Homo sapiens
tgaatccccgaccccccta

SEQ ID NO: 6450967 - DNA, 15 bp, Homo sapiens
tgaatccgtacttgg

SEQ ID NO: 6450968 - DNA, 16 bp, Homo sapiens
tgaatcctagggcctg

SEQ ID NO: 6450969 - DNA, 18 bp, Homo sapiens
tgaatcctcagagagttg

SEQ ID NO: 6450970 - DNA, 16 bp, Homo sapiens
tgaatcctctctctgt

SEQ ID NO: 6450971 - DNA, 20 bp, Homo sapiens
tgaatcctgttaaattttct

SEQ ID NO: 6450972 - DNA, 13 bp, Homo sapiens
tgaatccttagaa

SEQ ID NO: 6450973 - DNA, 14 bp, Homo sapiens
tgaatccttagaat

SEQ ID NO: 6450974 - DNA, 15 bp, Homo sapiens
tgaatcctttgcctg

SEQ ID NO: 6450975 - DNA, 18 bp, Homo sapiens
tgaatcgatataggcatt

SEQ ID NO: 6450976 - DNA, 17 bp, Homo sapiens
tgaatcgcaagttaact

SEQ ID NO: 6450977 - DNA, 14 bp, Homo sapiens
tgaatcgggctaag

SEQ ID NO: 6450978 - DNA, 15 bp, Homo sapiens
tgaatcggtgctgtc

SEQ ID NO: 6450979 - DNA, 17 bp, Homo sapiens
tgaatcgtttcatgtaa

SEQ ID NO: 6450980 - DNA, 20 bp, Homo sapiens
tgaatctaacagtgacttca

SEQ ID NO: 6450981 - DNA, 15 bp, Homo sapiens
tgaatctacatttgt

SEQ ID NO: 6450982 - DNA, 17 bp, Homo sapiens
tgaatctagagaacagt

SEQ ID NO: 6450983 - DNA, 15 bp, Homo sapiens
tgaatctagcttatt

SEQ ID NO: 6450984 - DNA, 19 bp, Homo sapiens
tgaatctattatactgtat

SEQ ID NO: 6450985 - DNA, 22 bp, Homo sapiens
tgaatctattatactgtattaa

SEQ ID NO: 6450986 - DNA, 12 bp, Homo sapiens
tgaatctattgg

SEQ ID NO: 6450987 - DNA, 15 bp, Homo sapiens
tgaatctcagaaaat

SEQ ID NO: 6450988 - DNA, 19 bp, Homo sapiens
tgaatctcataattggaat

SEQ ID NO: 6450989 - DNA, 15 bp, Homo sapiens
tgaatctcccaagga

SEQ ID NO: 6450990 - DNA, 16 bp, Homo sapiens
tgaatctctaaaatgc

SEQ ID NO: 6450991 - DNA, 18 bp, Homo sapiens
tgaatctctaaaatgctg

SEQ ID NO: 6450992 - DNA, 18 bp, Homo sapiens
tgaatctctcaaaatgtg

SEQ ID NO: 6450993 - DNA, 19 bp, Homo sapiens
tgaatctctcaaaatgtgc

SEQ ID NO: 6450994 - DNA, 20 bp, Homo sapiens
tgaatctctcaaaatgtgcc

SEQ ID NO: 6450995 - DNA, 21 bp, Homo sapiens
tgaatctctcaaaatgtgccg

SEQ ID NO: 6450996 - DNA, 15 bp, Homo sapiens
tgaatctctgcctct

SEQ ID NO: 6450997 - DNA, 21 bp, Homo sapiens
tgaatctctgcctctcccagg

SEQ ID NO: 6450998 - DNA, 23 bp, Homo sapiens
tgaatctctgtatatttgattct

SEQ ID NO: 6450999 - DNA, 14 bp, Homo sapiens
tgaatctgagaaag

SEQ ID NO: 6451000 - DNA, 23 bp, Homo sapiens
tgaatctgatctttttatacaca

SEQ ID NO: 6451001 - DNA, 23 bp, Homo sapiens
tgaatctgattggacattttctt

SEQ ID NO: 6451002 - DNA, 13 bp, Homo sapiens
tgaatctgcaggg

SEQ ID NO: 6451003 - DNA, 22 bp, Homo sapiens
tgaatctgcattttctgggttc

SEQ ID NO: 6451004 - DNA, 18 bp, Homo sapiens
tgaatctgcgagtagatg

SEQ ID NO: 6451005 - DNA, 13 bp, Homo sapiens
tgaatctgggact

SEQ ID NO: 6451006 - DNA, 14 bp, Homo sapiens
tgaatctgtacaga

SEQ ID NO: 6451007 - DNA, 18 bp, Homo sapiens
tgaatctgtgcaaacagt

SEQ ID NO: 6451008 - DNA, 21 bp, Homo sapiens
tgaatctgtgcaaacagtaac

SEQ ID NO: 6451009 - DNA, 20 bp, Homo sapiens
tgaatctgtgtgcatatttg

SEQ ID NO: 6451010 - DNA, 23 bp, Homo sapiens
tgaatctgtgtgcatatttgtta

SEQ ID NO: 6451011 - DNA, 18 bp, Homo sapiens
tgaatctgttactgaaat

SEQ ID NO: 6451012 - DNA, 19 bp, Homo sapiens
tgaatctgttactgaaatg

SEQ ID NO: 6451013 - DNA, 21 bp, Homo sapiens
tgaatctgttactgaaatgag

SEQ ID NO: 6451014 - DNA, 14 bp, Homo sapiens
tgaatcttaacatt

SEQ ID NO: 6451015 - DNA, 16 bp, Homo sapiens
tgaatcttaacatttt

SEQ ID NO: 6451016 - DNA, 22 bp, Homo sapiens
tgaatcttctgaaaccaaatgt

SEQ ID NO: 6451017 - DNA, 16 bp, Homo sapiens
tgaatcttggtgtcta

SEQ ID NO: 6451018 - DNA, 16 bp, Homo sapiens
tgaatcttgtctcaat

SEQ ID NO: 6451019 - DNA, 19 bp, Homo sapiens
tgaatcttgtctcaatgct

SEQ ID NO: 6451020 - DNA, 19 bp, Homo sapiens
tgaatctttcatacatata

SEQ ID NO: 6451021 - DNA, 21 bp, Homo sapiens
tgaatctttcatacatatata

SEQ ID NO: 6451022 - DNA, 16 bp, Homo sapiens
tgaatctttctcctgg

SEQ ID NO: 6451023 - DNA, 13 bp, Homo sapiens
tgaatctttgact

SEQ ID NO: 6451024 - DNA, 13 bp, Homo sapiens
tgaatctttgtgc

SEQ ID NO: 6451025 - DNA, 11 bp, Homo sapiens
tgaatgaaaaa

SEQ ID NO: 6451026 - DNA, 19 bp, Homo sapiens
tgaatgaaaaatttaagca

SEQ ID NO: 6451027 - DNA, 12 bp, Homo sapiens
tgaatgaaaaca

SEQ ID NO: 6451028 - DNA, 13 bp, Homo sapiens
tgaatgaaacatg

SEQ ID NO: 6451029 - DNA, 22 bp, Homo sapiens
tgaatgaaagattaaacagatg

SEQ ID NO: 6451030 - DNA, 20 bp, Homo sapiens
tgaatgaaatataaactgtg

SEQ ID NO: 6451031 - DNA, 22 bp, Homo sapiens
tgaatgaaatataaactgtgag

SEQ ID NO: 6451032 - DNA, 14 bp, Homo sapiens
tgaatgaaatatca

SEQ ID NO: 6451033 - DNA, 15 bp, Homo sapiens
tgaatgaacaaacct

SEQ ID NO: 6451034 - DNA, 15 bp, Homo sapiens
tgaatgaaccttctg

SEQ ID NO: 6451035 - DNA, 16 bp, Homo sapiens
tgaatgaaccttctgg

SEQ ID NO: 6451036 - DNA, 24 bp, Homo sapiens
tgaatgaagcaaatgtcatgctgc

SEQ ID NO: 6451037 - DNA, 18 bp, Homo sapiens
tgaatgaagctaatgtga

SEQ ID NO: 6451038 - DNA, 13 bp, Homo sapiens
tgaatgaagctga

SEQ ID NO: 6451039 - DNA, 15 bp, Homo sapiens
tgaatgaataaaaca

SEQ ID NO: 6451040 - DNA, 17 bp, Homo sapiens
tgaatgaatacacagga

SEQ ID NO: 6451041 - DNA, 15 bp, Homo sapiens
tgaatgaatggctaa

SEQ ID NO: 6451042 - DNA, 14 bp, Homo sapiens
tgaatgaattcttg

SEQ ID NO: 6451043 - DNA, 12 bp, Homo sapiens
tgaatgacaaag

SEQ ID NO: 6451044 - DNA, 12 bp, Homo sapiens
tgaatgactgac

SEQ ID NO: 6451045 - DNA, 13 bp, Homo sapiens
tgaatgagaagta

SEQ ID NO: 6451046 - DNA, 14 bp, Homo sapiens
tgaatgagaatcta

SEQ ID NO: 6451047 - DNA, 18 bp, Homo sapiens
tgaatgagacctggaaca

SEQ ID NO: 6451048 - DNA, 22 bp, Homo sapiens
tgaatgagacctggaacaaatc

SEQ ID NO: 6451049 - DNA, 21 bp, Homo sapiens
tgaatgagcctttgtgctttt

SEQ ID NO: 6451050 - DNA, 21 bp, Homo sapiens
tgaatgaggaacaatcacaaa

SEQ ID NO: 6451051 - DNA, 18 bp, Homo sapiens
tgaatgaggtcccaggca

SEQ ID NO: 6451052 - DNA, 19 bp, Homo sapiens
tgaatgaggtcccaggcag

SEQ ID NO: 6451053 - DNA, 18 bp, Homo sapiens
tgaatgagtctgttgtgt

SEQ ID NO: 6451054 - DNA, 14 bp, Homo sapiens
tgaatgagttttac

SEQ ID NO: 6451055 - DNA, 16 bp, Homo sapiens
tgaatgagtttttaat

SEQ ID NO: 6451056 - DNA, 21 bp, Homo sapiens
tgaatgataatagctcacagc

SEQ ID NO: 6451057 - DNA, 15 bp, Homo sapiens
tgaatgatcattgaa

SEQ ID NO: 6451058 - DNA, 23 bp, Homo sapiens
tgaatgatgatcctaggcatttg

SEQ ID NO: 6451059 - DNA, 16 bp, Homo sapiens
tgaatgattcagtgtt

SEQ ID NO: 6451060 - DNA, 15 bp, Homo sapiens
tgaatgattctacag

SEQ ID NO: 6451061 - DNA, 18 bp, Homo sapiens
tgaatgatttgtgtttct

SEQ ID NO: 6451062 - DNA, 19 bp, Homo sapiens
tgaatgatttgtgtttctt

SEQ ID NO: 6451063 - DNA, 17 bp, Homo sapiens
tgaatgatttttcattg

SEQ ID NO: 6451064 - DNA, 19 bp, Homo sapiens
tgaatgcaaaagaaattta

SEQ ID NO: 6451065 - DNA, 20 bp, Homo sapiens
tgaatgcaaaattgttttca

SEQ ID NO: 6451066 - DNA, 15 bp, Homo sapiens
tgaatgcaaaccata

SEQ ID NO: 6451067 - DNA, 15 bp, Homo sapiens
tgaatgcagaaaaca

SEQ ID NO: 6451068 - DNA, 15 bp, Homo sapiens
tgaatgcagaacggt

SEQ ID NO: 6451069 - DNA, 15 bp, Homo sapiens
tgaatgcagtataaa

SEQ ID NO: 6451070 - DNA, 22 bp, Homo sapiens
tgaatgcagtctgtccaggctc

SEQ ID NO: 6451071 - DNA, 23 bp, Homo sapiens
tgaatgcagtctgtccaggctcg

SEQ ID NO: 6451072 - DNA, 13 bp, Homo sapiens
tgaatgcatgtgt

SEQ ID NO: 6451073 - DNA, 14 bp, Homo sapiens
tgaatgcattttgt

SEQ ID NO: 6451074 - DNA, 21 bp, Homo sapiens
tgaatgccactgccttcgctt

SEQ ID NO: 6451075 - DNA, 22 bp, Homo sapiens
tgaatgccactgccttcgcttc

SEQ ID NO: 6451076 - DNA, 18 bp, Homo sapiens
tgaatgccagtgtgctga

SEQ ID NO: 6451077 - DNA, 22 bp, Homo sapiens
tgaatgccatttagaatctaga

SEQ ID NO: 6451078 - DNA, 16 bp, Homo sapiens
tgaatgcccaggaagt

SEQ ID NO: 6451079 - DNA, 17 bp, Homo sapiens
tgaatgcccaggaagta

SEQ ID NO: 6451080 - DNA, 22 bp, Homo sapiens
tgaatgccgaatttggtacaca

SEQ ID NO: 6451081 - DNA, 21 bp, Homo sapiens
tgaatgccgcgatgggtcagg

SEQ ID NO: 6451082 - DNA, 14 bp, Homo sapiens
tgaatgccgtggat

SEQ ID NO: 6451083 - DNA, 17 bp, Homo sapiens
tgaatgcctcaatgtga

SEQ ID NO: 6451084 - DNA, 16 bp, Homo sapiens
tgaatgcctcctgtgg

SEQ ID NO: 6451085 - DNA, 17 bp, Homo sapiens
tgaatgcctcctgtggg

SEQ ID NO: 6451086 - DNA, 14 bp, Homo sapiens
tgaatgccttattt

SEQ ID NO: 6451087 - DNA, 15 bp, Homo sapiens
tgaatgcctttcaaa

SEQ ID NO: 6451088 - DNA, 20 bp, Homo sapiens
tgaatgcctttcaaacattg

SEQ ID NO: 6451089 - DNA, 13 bp, Homo sapiens
tgaatgcggccca

SEQ ID NO: 6451090 - DNA, 16 bp, Homo sapiens
tgaatgctagacagaa

SEQ ID NO: 6451091 - DNA, 22 bp, Homo sapiens
tgaatgctatttgtgtaactga

SEQ ID NO: 6451092 - DNA, 14 bp, Homo sapiens
tgaatgctcctaat

SEQ ID NO: 6451093 - DNA, 19 bp, Homo sapiens
tgaatgctgagctgaagaa

SEQ ID NO: 6451094 - DNA, 20 bp, Homo sapiens
tgaatgctgagctgaagaaa

SEQ ID NO: 6451095 - DNA, 22 bp, Homo sapiens
tgaatgctgagctgaagaaatt

SEQ ID NO: 6451096 - DNA, 11 bp, Homo sapiens
tgaatgctgcc

SEQ ID NO: 6451097 - DNA, 13 bp, Homo sapiens
tgaatgctgccag

SEQ ID NO: 6451098 - DNA, 12 bp, Homo sapiens
tgaatgctgctt

SEQ ID NO: 6451099 - DNA, 11 bp, Homo sapiens
tgaatgctggg

SEQ ID NO: 6451100 - DNA, 13 bp, Homo sapiens
tgaatgctgggac

SEQ ID NO: 6451101 - DNA, 14 bp, Homo sapiens
tgaatgctgggact

SEQ ID NO: 6451102 - DNA, 13 bp, Homo sapiens
tgaatgctgggcc

SEQ ID NO: 6451103 - DNA, 14 bp, Homo sapiens
tgaatgctgtacct

SEQ ID NO: 6451104 - DNA, 15 bp, Homo sapiens
tgaatgctgtacctt

SEQ ID NO: 6451105 - DNA, 17 bp, Homo sapiens
tgaatgcttctaagtaa

SEQ ID NO: 6451106 - DNA, 17 bp, Homo sapiens
tgaatgcttctgattta

SEQ ID NO: 6451107 - DNA, 14 bp, Homo sapiens
tgaatgctttgcat

SEQ ID NO: 6451108 - DNA, 14 bp, Homo sapiens
tgaatgcttttagt

SEQ ID NO: 6451109 - DNA, 23 bp, Homo sapiens
tgaatgctttttgaatgttattt

SEQ ID NO: 6451110 - DNA, 17 bp, Homo sapiens
tgaatggaaacttggaa

SEQ ID NO: 6451111 - DNA, 15 bp, Homo sapiens
tgaatggaaataaat

SEQ ID NO: 6451112 - DNA, 19 bp, Homo sapiens
tgaatggactttgcacact

SEQ ID NO: 6451113 - DNA, 12 bp, Homo sapiens
tgaatggagaat

SEQ ID NO: 6451114 - DNA, 17 bp, Homo sapiens
tgaatggattggattat

SEQ ID NO: 6451115 - DNA, 21 bp, Homo sapiens
tgaatggattggattatttaa

SEQ ID NO: 6451116 - DNA, 22 bp, Homo sapiens
tgaatggattggattatttaat

SEQ ID NO: 6451117 - DNA, 19 bp, Homo sapiens
tgaatggcaatgttttgct

SEQ ID NO: 6451118 - DNA, 20 bp, Homo sapiens
tcccctggcccttccttcac

SEQ ID NO: 6451119 - DNA, 21 bp, Homo sapiens
tcccctggcctcagttcccag

SEQ ID NO: 6451120 - DNA, 13 bp, Homo sapiens
tcccctggctggc

SEQ ID NO: 6451121 - DNA, 15 bp, Homo sapiens
tcccctgggatgctg

SEQ ID NO: 6451122 - DNA, 20 bp, Homo sapiens
tcccctgggatgctgaccca

SEQ ID NO: 6451123 - DNA, 15 bp, Homo sapiens
tcccctgggccctga

SEQ ID NO: 6451124 - DNA, 20 bp, Homo sapiens
tcccctggggagaacccttc

SEQ ID NO: 6451125 - DNA, 22 bp, Homo sapiens
tcccctggggagaacccttcct

SEQ ID NO: 6451126 - DNA, 16 bp, Homo sapiens
tcccctggggtgcagg

SEQ ID NO: 6451127 - DNA, 18 bp, Homo sapiens
tcccctggggtgcaggcg

SEQ ID NO: 6451128 - DNA, 22 bp, Homo sapiens
tcccctgggttaacaaatgagc

SEQ ID NO: 6451129 - DNA, 15 bp, Homo sapiens
tcccctggtcctgca

SEQ ID NO: 6451130 - DNA, 18 bp, Homo sapiens
tcccctggtcctgcactg

SEQ ID NO: 6451131 - DNA, 14 bp, Homo sapiens
tcccctgtcagttt

SEQ ID NO: 6451132 - DNA, 21 bp, Homo sapiens
tcccctgtcagtttcccctct

SEQ ID NO: 6451133 - DNA, 14 bp, Homo sapiens
tcccctgtcccacc

SEQ ID NO: 6451134 - DNA, 16 bp, Homo sapiens
tcccctgtcccaccaa

SEQ ID NO: 6451135 - DNA, 17 bp, Homo sapiens
tcccctgtcccaccaac

SEQ ID NO: 6451136 - DNA, 19 bp, Homo sapiens
tcccctgtcccaccaactc

SEQ ID NO: 6451137 - DNA, 12 bp, Homo sapiens
tcccctgtcccc

SEQ ID NO: 6451138 - DNA, 16 bp, Homo sapiens
tcccctgtcccctggg

SEQ ID NO: 6451139 - DNA, 21 bp, Homo sapiens
tcccctgtcccctggggctgg

SEQ ID NO: 6451140 - DNA, 18 bp, Homo sapiens
tcccctgtcttctctcaa

SEQ ID NO: 6451141 - DNA, 19 bp, Homo sapiens
tcccctgtgccagcccaga

SEQ ID NO: 6451142 - DNA, 20 bp, Homo sapiens
tcccctgtggtgatgtgcct

SEQ ID NO: 6451143 - DNA, 16 bp, Homo sapiens
tcccctgttaaacagt

SEQ ID NO: 6451144 - DNA, 16 bp, Homo sapiens
tcccctgttcccctct

SEQ ID NO: 6451145 - DNA, 17 bp, Homo sapiens
tcccctgttcccctctc

SEQ ID NO: 6451146 - DNA, 18 bp, Homo sapiens
tcccctgttcccctctcc

SEQ ID NO: 6451147 - DNA, 19 bp, Homo sapiens
tcccctgttcccctctccc

SEQ ID NO: 6451148 - DNA, 22 bp, Homo sapiens
tcccctgttgattatcttcagc

SEQ ID NO: 6451149 - DNA, 13 bp, Homo sapiens
tcccctgtttcaa

SEQ ID NO: 6451150 - DNA, 18 bp, Homo sapiens
tcccctgtttgtttctga

SEQ ID NO: 6451151 - DNA, 18 bp, Homo sapiens
tccccttacccttagaat

SEQ ID NO: 6451152 - DNA, 17 bp, Homo sapiens
tccccttagaggacctg

SEQ ID NO: 6451153 - DNA, 19 bp, Homo sapiens
tccccttagagtgctgtga

SEQ ID NO: 6451154 - DNA, 13 bp, Homo sapiens
tccccttatcctc

SEQ ID NO: 6451155 - DNA, 22 bp, Homo sapiens
tccccttatcctccctgtaact

SEQ ID NO: 6451156 - DNA, 21 bp, Homo sapiens
tccccttcaccgctccccaca

SEQ ID NO: 6451157 - DNA, 14 bp, Homo sapiens
tccccttcagacct

SEQ ID NO: 6451158 - DNA, 17 bp, Homo sapiens
tccccttccactgaggg

SEQ ID NO: 6451159 - DNA, 16 bp, Homo sapiens
tccccttccagctccc

SEQ ID NO: 6451160 - DNA, 19 bp, Homo sapiens
tccccttccagctccctcc

SEQ ID NO: 6451161 - DNA, 14 bp, Homo sapiens
tccccttccagggg

SEQ ID NO: 6451162 - DNA, 19 bp, Homo sapiens
tccccttccatcccagagg

SEQ ID NO: 6451163 - DNA, 21 bp, Homo sapiens
tccccttcccccatccctacc

SEQ ID NO: 6451164 - DNA, 16 bp, Homo sapiens
tccccttcccctgctg

SEQ ID NO: 6451165 - DNA, 16 bp, Homo sapiens
tccccttccccttcct

SEQ ID NO: 6451166 - DNA, 11 bp, Homo sapiens
tccccttccct

SEQ ID NO: 6451167 - DNA, 13 bp, Homo sapiens
tccccttccctgc

SEQ ID NO: 6451168 - DNA, 17 bp, Homo sapiens
tccccttccctggggag

SEQ ID NO: 6451169 - DNA, 15 bp, Homo sapiens
tccccttcccttttt

SEQ ID NO: 6451170 - DNA, 18 bp, Homo sapiens
tccccttcctcttgtctg

SEQ ID NO: 6451171 - DNA, 18 bp, Homo sapiens
tccccttcctgcacccgt

SEQ ID NO: 6451172 - DNA, 14 bp, Homo sapiens
tccccttcctggac

SEQ ID NO: 6451173 - DNA, 17 bp, Homo sapiens
tccccttcctggacaca

SEQ ID NO: 6451174 - DNA, 23 bp, Homo sapiens
tccccttcctggacacactctca

SEQ ID NO: 6451175 - DNA, 16 bp, Homo sapiens
tccccttcctggcaca

SEQ ID NO: 6451176 - DNA, 19 bp, Homo sapiens
tccccttcctgttcttcct

SEQ ID NO: 6451177 - DNA, 21 bp, Homo sapiens
tccccttcctgttcttccttc

SEQ ID NO: 6451178 - DNA, 21 bp, Homo sapiens
tccccttcctgtttcagaccc

SEQ ID NO: 6451179 - DNA, 15 bp, Homo sapiens
tccccttctcatcac

SEQ ID NO: 6451180 - DNA, 19 bp, Homo sapiens
tccccttctcatcactccc

SEQ ID NO: 6451181 - DNA, 14 bp, Homo sapiens
tccccttctcccct

SEQ ID NO: 6451182 - DNA, 18 bp, Homo sapiens
tccccttctcccctgcac

SEQ ID NO: 6451183 - DNA, 13 bp, Homo sapiens
tccccttctctca

SEQ ID NO: 6451184 - DNA, 14 bp, Homo sapiens
tccccttcttcccg

SEQ ID NO: 6451185 - DNA, 19 bp, Homo sapiens
tccccttgaacctcattaa

SEQ ID NO: 6451186 - DNA, 19 bp, Homo sapiens
tccccttgaggtctcagcc

SEQ ID NO: 6451187 - DNA, 14 bp, Homo sapiens
tccccttgcagccg

SEQ ID NO: 6451188 - DNA, 16 bp, Homo sapiens
tccccttgccacatcg

SEQ ID NO: 6451189 - DNA, 16 bp, Homo sapiens
tccccttgccagctgc

SEQ ID NO: 6451190 - DNA, 17 bp, Homo sapiens
tccccttgccagctgct

SEQ ID NO: 6451191 - DNA, 20 bp, Homo sapiens
tccccttgcccagggctcag

SEQ ID NO: 6451192 - DNA, 21 bp, Homo sapiens
tccccttgcccttcctgaccc

SEQ ID NO: 6451193 - DNA, 23 bp, Homo sapiens
tccccttgcccttgccctgacct

SEQ ID NO: 6451194 - DNA, 12 bp, Homo sapiens
tccccttgcctg

SEQ ID NO: 6451195 - DNA, 16 bp, Homo sapiens
tccccttgcctgtgcc

SEQ ID NO: 6451196 - DNA, 19 bp, Homo sapiens
tccccttgccttcccctgt

SEQ ID NO: 6451197 - DNA, 23 bp, Homo sapiens
tccccttgccttcccctgtcttc

SEQ ID NO: 6451198 - DNA, 14 bp, Homo sapiens
tccccttggacctc

SEQ ID NO: 6451199 - DNA, 22 bp, Homo sapiens
tccccttggacctccaggggct

SEQ ID NO: 6451200 - DNA, 22 bp, Homo sapiens
tccccttggcttcctccgtcca

SEQ ID NO: 6451201 - DNA, 17 bp, Homo sapiens
tccccttgggatgggca

SEQ ID NO: 6451202 - DNA, 17 bp, Homo sapiens
tccccttggttctgcac

SEQ ID NO: 6451203 - DNA, 18 bp, Homo sapiens
tccccttggttctgcact

SEQ ID NO: 6451204 - DNA, 17 bp, Homo sapiens
tccccttgtctccctgg

SEQ ID NO: 6451205 - DNA, 18 bp, Homo sapiens
tccccttgtctccctggt

SEQ ID NO: 6451206 - DNA, 20 bp, Homo sapiens
tccccttgtctgaactggag

SEQ ID NO: 6451207 - DNA, 16 bp, Homo sapiens
tccccttgttctaatg

SEQ ID NO: 6451208 - DNA, 21 bp, Homo sapiens
tcccctttactcagcccagct

SEQ ID NO: 6451209 - DNA, 17 bp, Homo sapiens
tcccctttatgtacagg

SEQ ID NO: 6451210 - DNA, 13 bp, Homo sapiens
tcccctttattaa

SEQ ID NO: 6451211 - DNA, 14 bp, Homo sapiens
tcccctttattaat

SEQ ID NO: 6451212 - DNA, 11 bp, Homo sapiens
tcccctttcca

SEQ ID NO: 6451213 - DNA, 14 bp, Homo sapiens
tcccctttccaatt

SEQ ID NO: 6451214 - DNA, 13 bp, Homo sapiens
tcccctttcctcc

SEQ ID NO: 6451215 - DNA, 14 bp, Homo sapiens
tcccctttcctcta

SEQ ID NO: 6451216 - DNA, 15 bp, Homo sapiens
tcccctttgcactgt

SEQ ID NO: 6451217 - DNA, 24 bp, Homo sapiens
tcccctttgcttcattcaagtcag

SEQ ID NO: 6451218 - DNA, 21 bp, Homo sapiens
tcccctttgtattccttaaat

SEQ ID NO: 6451219 - DNA, 15 bp, Homo sapiens
tcccctttgtcctgc

SEQ ID NO: 6451220 - DNA, 23 bp, Homo sapiens
tccccttttaaggtttcaacaaa

SEQ ID NO: 6451221 - DNA, 19 bp, Homo sapiens
tccccttttaccactccca

SEQ ID NO: 6451222 - DNA, 15 bp, Homo sapiens
tccccttttccttca

SEQ ID NO: 6451223 - DNA, 22 bp, Homo sapiens
tccccttttcttttctacccta

SEQ ID NO: 6451224 - DNA, 18 bp, Homo sapiens
tccccttttgcattctcc

SEQ ID NO: 6451225 - DNA, 15 bp, Homo sapiens
tccccttttgcctgg

SEQ ID NO: 6451226 - DNA, 24 bp, Homo sapiens
tccccttttgcctggctgtggagg

SEQ ID NO: 6451227 - DNA, 22 bp, Homo sapiens
tccccttttttttctgattctt

SEQ ID NO: 6451228 - DNA, 17 bp, Homo sapiens
tcccgaaagcctttcct

SEQ ID NO: 6451229 - DNA, 22 bp, Homo sapiens
tcccgaagaatgaacccaagag

SEQ ID NO: 6451230 - DNA, 22 bp, Homo sapiens
tcccgaagtcctctgtggccag

SEQ ID NO: 6451231 - DNA, 16 bp, Homo sapiens
tcccgaatagctggga

SEQ ID NO: 6451232 - DNA, 21 bp, Homo sapiens
tcccgaatggagtccagacct

SEQ ID NO: 6451233 - DNA, 23 bp, Homo sapiens
tcccgaatggagtccagacctgg

SEQ ID NO: 6451234 - DNA, 17 bp, Homo sapiens
tcccgacaccagaagct

SEQ ID NO: 6451235 - DNA, 13 bp, Homo sapiens
tcccgacccagcc

SEQ ID NO: 6451236 - DNA, 15 bp, Homo sapiens
tcccgacccagccag

SEQ ID NO: 6451237 - DNA, 17 bp, Homo sapiens
tcccgacccagccagct

SEQ ID NO: 6451238 - DNA, 24 bp, Homo sapiens
tcccgacccagccagctgcagggc

SEQ ID NO: 6451239 - DNA, 14 bp, Homo sapiens
tcccgactgaccac

SEQ ID NO: 6451240 - DNA, 19 bp, Homo sapiens
tcccgagacggcactgaga

SEQ ID NO: 6451241 - DNA, 20 bp, Homo sapiens
tcccgagcaaagtctaaagt

SEQ ID NO: 6451242 - DNA, 13 bp, Homo sapiens
tcccgagccccct

SEQ ID NO: 6451243 - DNA, 17 bp, Homo sapiens
tcccgagccccctgtcc

SEQ ID NO: 6451244 - DNA, 19 bp, Homo sapiens
tcccgagccccctgtcctt

SEQ ID NO: 6451245 - DNA, 19 bp, Homo sapiens
tcccgaggaagggccagag

SEQ ID NO: 6451246 - DNA, 20 bp, Homo sapiens
tcccgaggaagggccagagc

SEQ ID NO: 6451247 - DNA, 14 bp, Homo sapiens
tcccgaggaggggc

SEQ ID NO: 6451248 - DNA, 18 bp, Homo sapiens
tcccgaggatgctgtcag

SEQ ID NO: 6451249 - DNA, 19 bp, Homo sapiens
tcccgaggatgctgtcagg

SEQ ID NO: 6451250 - DNA, 13 bp, Homo sapiens
tcccgagtacagt

SEQ ID NO: 6451251 - DNA, 16 bp, Homo sapiens
tcccgagtagctggga

SEQ ID NO: 6451252 - DNA, 17 bp, Homo sapiens
tcccgagtagctgggac

SEQ ID NO: 6451253 - DNA, 16 bp, Homo sapiens
tcccgatgcctccctt

SEQ ID NO: 6451254 - DNA, 19 bp, Homo sapiens
tcccgatggtctctctccc

SEQ ID NO: 6451255 - DNA, 20 bp, Homo sapiens
tcccgatggtctctctccct

SEQ ID NO: 6451256 - DNA, 23 bp, Homo sapiens
tcccgatggtctctctccctctg

SEQ ID NO: 6451257 - DNA, 19 bp, Homo sapiens
tcccgattcaccctgtcca

SEQ ID NO: 6451258 - DNA, 16 bp, Homo sapiens
tcccgattgagcctta

SEQ ID NO: 6451259 - DNA, 13 bp, Homo sapiens
tcccgcaccaggc

SEQ ID NO: 6451260 - DNA, 18 bp, Homo sapiens
tcccgcaccaggccgggc

SEQ ID NO: 6451261 - DNA, 17 bp, Homo sapiens
tcccgcaccttcctcct

SEQ ID NO: 6451262 - DNA, 17 bp, Homo sapiens
tcccgcactctgccccc

SEQ ID NO: 6451263 - DNA, 21 bp, Homo sapiens
tcccgcagcgggcgcgggaca

SEQ ID NO: 6451264 - DNA, 22 bp, Homo sapiens
tcccgcagcgggcgcgggacag

SEQ ID NO: 6451265 - DNA, 18 bp, Homo sapiens
tcccgcatgctgcctgcc

SEQ ID NO: 6451266 - DNA, 16 bp, Homo sapiens
tcccgccacacgctca

SEQ ID NO: 6451267 - DNA, 16 bp, Homo sapiens
tcccgccaccctgtct

SEQ ID NO: 6451268 - DNA, 17 bp, Homo sapiens
tcccgccaccctgtctc

SEQ ID NO: 6451269 - DNA, 18 bp, Homo sapiens
tcccgccagactgttaga

SEQ ID NO: 6451270 - DNA, 17 bp, Homo sapiens
tcccgccagagggcttg

SEQ ID NO: 6451271 - DNA, 15 bp, Homo sapiens
tcccgccattggcct

SEQ ID NO: 6451272 - DNA, 16 bp, Homo sapiens
tcccgccattggcctt

SEQ ID NO: 6451273 - DNA, 17 bp, Homo sapiens
tcccgccattggcctta

SEQ ID NO: 6451274 - DNA, 18 bp, Homo sapiens
tcccgcccaaacctttcc

SEQ ID NO: 6451275 - DNA, 19 bp, Homo sapiens
tcccgcccaaacctttccc

SEQ ID NO: 6451276 - DNA, 15 bp, Homo sapiens
tcccgcccagcctca

SEQ ID NO: 6451277 - DNA, 19 bp, Homo sapiens
tcccgcccagcctcacttc

SEQ ID NO: 6451278 - DNA, 15 bp, Homo sapiens
tcccgccccacctcc

SEQ ID NO: 6451279 - DNA, 18 bp, Homo sapiens
tcccgccccacctcccat

SEQ ID NO: 6451280 - DNA, 16 bp, Homo sapiens
tcccgccccagcctcc

SEQ ID NO: 6451281 - DNA, 17 bp, Homo sapiens
tcccgccccagcctcct

SEQ ID NO: 6451282 - DNA, 16 bp, Homo sapiens
tcccgccccagggtct

SEQ ID NO: 6451283 - DNA, 17 bp, Homo sapiens
tcccgccccagggtctg

SEQ ID NO: 6451284 - DNA, 15 bp, Homo sapiens
tcccgccccgcccct

SEQ ID NO: 6451285 - DNA, 17 bp, Homo sapiens
tcccgccccgcccctcc

SEQ ID NO: 6451286 - DNA, 21 bp, Homo sapiens
tcccgccccttcccactcacc

SEQ ID NO: 6451287 - DNA, 22 bp, Homo sapiens
tcccgccctccccctgccagag

SEQ ID NO: 6451288 - DNA, 17 bp, Homo sapiens
tcccgccggaggccagc

SEQ ID NO: 6451289 - DNA, 15 bp, Homo sapiens
tcccgcctcagcctc

SEQ ID NO: 6451290 - DNA, 20 bp, Homo sapiens
tcccgcctcagcctcctgag

SEQ ID NO: 6451291 - DNA, 16 bp, Homo sapiens
tcccgcctcagcctct

SEQ ID NO: 6451292 - DNA, 16 bp, Homo sapiens
tcccgcctcagggcca

SEQ ID NO: 6451293 - DNA, 15 bp, Homo sapiens
tcccgcctccaaccc

SEQ ID NO: 6451294 - DNA, 21 bp, Homo sapiens
tcccgcctccaacccctcgcc

SEQ ID NO: 6451295 - DNA, 19 bp, Homo sapiens
tcccgcctcttcttcttca

SEQ ID NO: 6451296 - DNA, 23 bp, Homo sapiens
tgaatggcatctcgttgtaagta

SEQ ID NO: 6451297 - DNA, 21 bp, Homo sapiens
tgaatggcatttgctggttat

SEQ ID NO: 6451298 - DNA, 18 bp, Homo sapiens
tgaatggccctagaactg

SEQ ID NO: 6451299 - DNA, 15 bp, Homo sapiens
tgaatggcctgcctt

SEQ ID NO: 6451300 - DNA, 21 bp, Homo sapiens
tgaatggcctgccttgaagcc

SEQ ID NO: 6451301 - DNA, 23 bp, Homo sapiens
tgaatggccttcatatcatccac

SEQ ID NO: 6451302 - DNA, 20 bp, Homo sapiens
tgaatggctatgtttttaat

SEQ ID NO: 6451303 - DNA, 18 bp, Homo sapiens
tgaatggctgtgccccac

SEQ ID NO: 6451304 - DNA, 20 bp, Homo sapiens
tgaatggctgtgccccacct

SEQ ID NO: 6451305 - DNA, 21 bp, Homo sapiens
tgaatggctgtgccccacctg

SEQ ID NO: 6451306 - DNA, 11 bp, Homo sapiens
tgaatggcttt

SEQ ID NO: 6451307 - DNA, 12 bp, Homo sapiens
tgaatggctttg

SEQ ID NO: 6451308 - DNA, 14 bp, Homo sapiens
tgaatggctttgtc

SEQ ID NO: 6451309 - DNA, 22 bp, Homo sapiens
tgaatggctttgtcttgaaaaa

SEQ ID NO: 6451310 - DNA, 13 bp, Homo sapiens
tgaatgggaaagg

SEQ ID NO: 6451311 - DNA, 18 bp, Homo sapiens
tgaatgggatcatgaaag

SEQ ID NO: 6451312 - DNA, 20 bp, Homo sapiens
tgaatgggcaaaactgaatt

SEQ ID NO: 6451313 - DNA, 22 bp, Homo sapiens
tgaatgggcaattccagaaatc

SEQ ID NO: 6451314 - DNA, 14 bp, Homo sapiens
tgaatggtccaggg

SEQ ID NO: 6451315 - DNA, 22 bp, Homo sapiens
tgaatggttccactcaaatgtc

SEQ ID NO: 6451316 - DNA, 21 bp, Homo sapiens
tgaatggttccatgcctgagg

SEQ ID NO: 6451317 - DNA, 22 bp, Homo sapiens
tgaatggttccatgcctgaggg

SEQ ID NO: 6451318 - DNA, 15 bp, Homo sapiens
tgaatggttgcaaag

SEQ ID NO: 6451319 - DNA, 14 bp, Homo sapiens
tgaatggtttttct

SEQ ID NO: 6451320 - DNA, 22 bp, Homo sapiens
tgaatgtaaactcgggggtgct

SEQ ID NO: 6451321 - DNA, 18 bp, Homo sapiens
tgaatgtaaatttgtact

SEQ ID NO: 6451322 - DNA, 15 bp, Homo sapiens
tgaatgtaatttgtg

SEQ ID NO: 6451323 - DNA, 13 bp, Homo sapiens
tgaatgtacaaag

SEQ ID NO: 6451324 - DNA, 15 bp, Homo sapiens
tgaatgtagcgtgta

SEQ ID NO: 6451325 - DNA, 18 bp, Homo sapiens
tgaatgtagcttccacct

SEQ ID NO: 6451326 - DNA, 16 bp, Homo sapiens
tgaatgtatcaggaaa

SEQ ID NO: 6451327 - DNA, 12 bp, Homo sapiens
tgaatgtatcta

SEQ ID NO: 6451328 - DNA, 22 bp, Homo sapiens
tgaatgtatctagtggtctgat

SEQ ID NO: 6451329 - DNA, 13 bp, Homo sapiens
tgaatgtatgtaa

SEQ ID NO: 6451330 - DNA, 22 bp, Homo sapiens
tgaatgtatgtaatgtgtggtg

SEQ ID NO: 6451331 - DNA, 23 bp, Homo sapiens
tgaatgtatgtgcactgtcactt

SEQ ID NO: 6451332 - DNA, 15 bp, Homo sapiens
tgaatgtatttattt

SEQ ID NO: 6451333 - DNA, 14 bp, Homo sapiens
tgaatgtatttgat

SEQ ID NO: 6451334 - DNA, 20 bp, Homo sapiens
tgaatgtatttgatttataa

SEQ ID NO: 6451335 - DNA, 18 bp, Homo sapiens
tgaatgtcaatatgagat

SEQ ID NO: 6451336 - DNA, 14 bp, Homo sapiens
tgaatgtcacaaat

SEQ ID NO: 6451337 - DNA, 15 bp, Homo sapiens
tgaatgtcacatttg

SEQ ID NO: 6451338 - DNA, 21 bp, Homo sapiens
tgaatgtcacatttgaattct

SEQ ID NO: 6451339 - DNA, 15 bp, Homo sapiens
tgaatgtcagttgtt

SEQ ID NO: 6451340 - DNA, 22 bp, Homo sapiens
tgaatgtcagttgttatttatt

SEQ ID NO: 6451341 - DNA, 12 bp, Homo sapiens
tgaatgtcccag

SEQ ID NO: 6451342 - DNA, 20 bp, Homo sapiens
tgaatgtccccattctataa

SEQ ID NO: 6451343 - DNA, 22 bp, Homo sapiens
tgaatgtccccattctataaat

SEQ ID NO: 6451344 - DNA, 18 bp, Homo sapiens
tgaatgtctcagcgaggt

SEQ ID NO: 6451345 - DNA, 15 bp, Homo sapiens
tgaatgtcttccttt

SEQ ID NO: 6451346 - DNA, 15 bp, Homo sapiens
tgaatgtcttttgaa

SEQ ID NO: 6451347 - DNA, 13 bp, Homo sapiens
tgaatgtgaagcc

SEQ ID NO: 6451348 - DNA, 16 bp, Homo sapiens
tgaatgtgaagccttc

SEQ ID NO: 6451349 - DNA, 16 bp, Homo sapiens
tgaatgtgagtcatta

SEQ ID NO: 6451350 - DNA, 23 bp, Homo sapiens
tgaatgtgatcatctttgctgaa

SEQ ID NO: 6451351 - DNA, 14 bp, Homo sapiens
tgaatgtgctggtg

SEQ ID NO: 6451352 - DNA, 16 bp, Homo sapiens
tgaatgtggcagttta

SEQ ID NO: 6451353 - DNA, 18 bp, Homo sapiens
tgaatgtggcagtttaaa

SEQ ID NO: 6451354 - DNA, 18 bp, Homo sapiens
tgaatgtggcttgagaaa

SEQ ID NO: 6451355 - DNA, 21 bp, Homo sapiens
tgaatgtgggcactggcccag

SEQ ID NO: 6451356 - DNA, 12 bp, Homo sapiens
tgaatgtgtgag

SEQ ID NO: 6451357 - DNA, 22 bp, Homo sapiens
tgaatgtgtgtatgtatgaagg

SEQ ID NO: 6451358 - DNA, 17 bp, Homo sapiens
tgaatgtgtttcacagt

SEQ ID NO: 6451359 - DNA, 21 bp, Homo sapiens
tgaatgttaaataaattgtat

SEQ ID NO: 6451360 - DNA, 17 bp, Homo sapiens
tgaatgttaagaataac

SEQ ID NO: 6451361 - DNA, 16 bp, Homo sapiens
tgaatgttaatttttt

SEQ ID NO: 6451362 - DNA, 14 bp, Homo sapiens
tgaatgttatttgt

SEQ ID NO: 6451363 - DNA, 20 bp, Homo sapiens
tgaatgttcccaagtaggca

SEQ ID NO: 6451364 - DNA, 14 bp, Homo sapiens
tgaatgttctgaca

SEQ ID NO: 6451365 - DNA, 15 bp, Homo sapiens
tgaatgttctgacat

SEQ ID NO: 6451366 - DNA, 16 bp, Homo sapiens
tgaatgttctgacatt

SEQ ID NO: 6451367 - DNA, 21 bp, Homo sapiens
tgaatgttctgacattaacag

SEQ ID NO: 6451368 - DNA, 23 bp, Homo sapiens
tgaatgtttatgttctcagaatc

SEQ ID NO: 6451369 - DNA, 11 bp, Homo sapiens
tgaatgtttcc

SEQ ID NO: 6451370 - DNA, 21 bp, Homo sapiens
tgaatgtttccaacctggagt

SEQ ID NO: 6451371 - DNA, 22 bp, Homo sapiens
tgaatgtttccaacctggagta

SEQ ID NO: 6451372 - DNA, 19 bp, Homo sapiens
tgaatgtttgaattacagg

SEQ ID NO: 6451373 - DNA, 20 bp, Homo sapiens
tgaatgtttgtgtctgtggt

SEQ ID NO: 6451374 - DNA, 21 bp, Homo sapiens
tgaatgtttgtgtctgtggtt

SEQ ID NO: 6451375 - DNA, 18 bp, Homo sapiens
tgaatgttttatttatca

SEQ ID NO: 6451376 - DNA, 13 bp, Homo sapiens
tgaatgtttttct

SEQ ID NO: 6451377 - DNA, 15 bp, Homo sapiens
tgaatgtttttctaa

SEQ ID NO: 6451378 - DNA, 22 bp, Homo sapiens
tgaattaaaagtctacagcact

SEQ ID NO: 6451379 - DNA, 13 bp, Homo sapiens
tgaattaaagtct

SEQ ID NO: 6451380 - DNA, 16 bp, Homo sapiens
tgaattaaattaggaa

SEQ ID NO: 6451381 - DNA, 16 bp, Homo sapiens
tgaattaagaaagatt

SEQ ID NO: 6451382 - DNA, 14 bp, Homo sapiens
tgaattaagttatt

SEQ ID NO: 6451383 - DNA, 19 bp, Homo sapiens
tgaattaagttattgattt

SEQ ID NO: 6451384 - DNA, 23 bp, Homo sapiens
tgaattaatatccctacatgtat

SEQ ID NO: 6451385 - DNA, 15 bp, Homo sapiens
tgaattaatctagaa

SEQ ID NO: 6451386 - DNA, 17 bp, Homo sapiens
tgaattaatctagaaaa

SEQ ID NO: 6451387 - DNA, 19 bp, Homo sapiens
tgaattaatctagaaaatg

SEQ ID NO: 6451388 - DNA, 20 bp, Homo sapiens
tgaattaatctagaaaatga

SEQ ID NO: 6451389 - DNA, 15 bp, Homo sapiens
tgaattaatttctaa

SEQ ID NO: 6451390 - DNA, 13 bp, Homo sapiens
tgaattacagaga

SEQ ID NO: 6451391 - DNA, 21 bp, Homo sapiens
tgaattacagagatataaatg

SEQ ID NO: 6451392 - DNA, 23 bp, Homo sapiens
tgaattacagagatataaatgaa

SEQ ID NO: 6451393 - DNA, 19 bp, Homo sapiens
tgaattacagggaagaaat

SEQ ID NO: 6451394 - DNA, 14 bp, Homo sapiens
tgaattacagtgaa

SEQ ID NO: 6451395 - DNA, 16 bp, Homo sapiens
tgaattacatttgtat

SEQ ID NO: 6451396 - DNA, 18 bp, Homo sapiens
tgaattacatttgtataa

SEQ ID NO: 6451397 - DNA, 15 bp, Homo sapiens
tgaattactaacttc

SEQ ID NO: 6451398 - DNA, 19 bp, Homo sapiens
tgaattactaacttctaaa

SEQ ID NO: 6451399 - DNA, 19 bp, Homo sapiens
tgaattagacctttatttt

SEQ ID NO: 6451400 - DNA, 22 bp, Homo sapiens
tgaattagacctttatttttct

SEQ ID NO: 6451401 - DNA, 12 bp, Homo sapiens
tgaattagccaa

SEQ ID NO: 6451402 - DNA, 14 bp, Homo sapiens
tgaattagctcact

SEQ ID NO: 6451403 - DNA, 13 bp, Homo sapiens
tgaattaggctaa

SEQ ID NO: 6451404 - DNA, 17 bp, Homo sapiens
tgaattaggctgtaact

SEQ ID NO: 6451405 - DNA, 22 bp, Homo sapiens
tgaattaggctgtaactacttt

SEQ ID NO: 6451406 - DNA, 18 bp, Homo sapiens
tgaattagtgagtatagt

SEQ ID NO: 6451407 - DNA, 15 bp, Homo sapiens
tgaattataacagtt

SEQ ID NO: 6451408 - DNA, 19 bp, Homo sapiens
tgaattatactttgttgtt

SEQ ID NO: 6451409 - DNA, 13 bp, Homo sapiens
tgaattatatggc

SEQ ID NO: 6451410 - DNA, 18 bp, Homo sapiens
tgaattatcagcaaagaa

SEQ ID NO: 6451411 - DNA, 19 bp, Homo sapiens
tgaattatcagcaaagaaa

SEQ ID NO: 6451412 - DNA, 15 bp, Homo sapiens
tgaattatctataca

SEQ ID NO: 6451413 - DNA, 19 bp, Homo sapiens
tgaattatcttggatgaga

SEQ ID NO: 6451414 - DNA, 21 bp, Homo sapiens
tgaattatcttggttgaaaat

SEQ ID NO: 6451415 - DNA, 13 bp, Homo sapiens
tgaattatgaaac

SEQ ID NO: 6451416 - DNA, 17 bp, Homo sapiens
tgaattatgaaactttt

SEQ ID NO: 6451417 - DNA, 13 bp, Homo sapiens
tgaattatgtgca

SEQ ID NO: 6451418 - DNA, 14 bp, Homo sapiens
tgaattattaatga

SEQ ID NO: 6451419 - DNA, 16 bp, Homo sapiens
tgaattattaatgaat

SEQ ID NO: 6451420 - DNA, 17 bp, Homo sapiens
tgaattattacagtgtt

SEQ ID NO: 6451421 - DNA, 15 bp, Homo sapiens
tgaattattcaattt

SEQ ID NO: 6451422 - DNA, 15 bp, Homo sapiens
tgaattattctgatt

SEQ ID NO: 6451423 - DNA, 13 bp, Homo sapiens
tgaattattgaca

SEQ ID NO: 6451424 - DNA, 16 bp, Homo sapiens
tgaattattgacactg

SEQ ID NO: 6451425 - DNA, 18 bp, Homo sapiens
tgaattattgacactgaa

SEQ ID NO: 6451426 - DNA, 21 bp, Homo sapiens
tgaattattgacactgaactt

SEQ ID NO: 6451427 - DNA, 16 bp, Homo sapiens
tgaattattttctctc

SEQ ID NO: 6451428 - DNA, 13 bp, Homo sapiens
tgaattattttga

SEQ ID NO: 6451429 - DNA, 21 bp, Homo sapiens
tgaattattttgttgtgattt

SEQ ID NO: 6451430 - DNA, 21 bp, Homo sapiens
tgaattcacaaacaaatggct

SEQ ID NO: 6451431 - DNA, 23 bp, Homo sapiens
tgaattcacaaacaaatggctgt

SEQ ID NO: 6451432 - DNA, 17 bp, Homo sapiens
tgaattcacccctccca

SEQ ID NO: 6451433 - DNA, 17 bp, Homo sapiens
tgaattcactccagtca

SEQ ID NO: 6451434 - DNA, 16 bp, Homo sapiens
tgaattcacttaagtt

SEQ ID NO: 6451435 - DNA, 17 bp, Homo sapiens
tgaattcagattttaaa

SEQ ID NO: 6451436 - DNA, 12 bp, Homo sapiens
tgaattcagtaa

SEQ ID NO: 6451437 - DNA, 19 bp, Homo sapiens
tgaattcataaaaataacc

SEQ ID NO: 6451438 - DNA, 13 bp, Homo sapiens
tgaattcatagaa

SEQ ID NO: 6451439 - DNA, 12 bp, Homo sapiens
tgaattcatgga

SEQ ID NO: 6451440 - DNA, 18 bp, Homo sapiens
tgaattcattctggaggg

SEQ ID NO: 6451441 - DNA, 15 bp, Homo sapiens
tgaattcatttcact

SEQ ID NO: 6451442 - DNA, 16 bp, Homo sapiens
tgaattccaagtgtat

SEQ ID NO: 6451443 - DNA, 17 bp, Homo sapiens
tgaattccaagtgtatt

SEQ ID NO: 6451444 - DNA, 14 bp, Homo sapiens
tgaattcccagact

SEQ ID NO: 6451445 - DNA, 13 bp, Homo sapiens
tgaattcccaggt

SEQ ID NO: 6451446 - DNA, 12 bp, Homo sapiens
tgaattccctca

SEQ ID NO: 6451447 - DNA, 13 bp, Homo sapiens
tgaattccctcac

SEQ ID NO: 6451448 - DNA, 14 bp, Homo sapiens
tgaattccctcact

SEQ ID NO: 6451449 - DNA, 22 bp, Homo sapiens
tgaattccctcactcgtctccc

SEQ ID NO: 6451450 - DNA, 15 bp, Homo sapiens
tgaattcccttttaa

SEQ ID NO: 6451451 - DNA, 17 bp, Homo sapiens
tgaattcctaaaattat

SEQ ID NO: 6451452 - DNA, 11 bp, Homo sapiens
tgaattcctgg

SEQ ID NO: 6451453 - DNA, 18 bp, Homo sapiens
tgaattctcggaatggca

SEQ ID NO: 6451454 - DNA, 21 bp, Homo sapiens
tgaattctctctaaaaataaa

SEQ ID NO: 6451455 - DNA, 23 bp, Homo sapiens
tgaattctgctctaaataaagac

SEQ ID NO: 6451456 - DNA, 17 bp, Homo sapiens
tgaattcttatgcttat

SEQ ID NO: 6451457 - DNA, 14 bp, Homo sapiens
tgaattcttcctct

SEQ ID NO: 6451458 - DNA, 20 bp, Homo sapiens
tgaattcttcctctccttcc

SEQ ID NO: 6451459 - DNA, 16 bp, Homo sapiens
tgaattctttaaggag

SEQ ID NO: 6451460 - DNA, 13 bp, Homo sapiens
tgaattctttcaa

SEQ ID NO: 6451461 - DNA, 19 bp, Homo sapiens
tgaattcttttcctctctt

SEQ ID NO: 6451462 - DNA, 16 bp, Homo sapiens
tgaattgaaagagaat

SEQ ID NO: 6451463 - DNA, 14 bp, Homo sapiens
tgaattgaaatttt

SEQ ID NO: 6451464 - DNA, 19 bp, Homo sapiens
tgaattgaagtcatcataa

SEQ ID NO: 6451465 - DNA, 16 bp, Homo sapiens
tgaattgaagtttcaa

SEQ ID NO: 6451466 - DNA, 22 bp, Homo sapiens
tgaattgaatctacaaaagtga

SEQ ID NO: 6451467 - DNA, 13 bp, Homo sapiens
tgaattgaatgct

SEQ ID NO: 6451468 - DNA, 17 bp, Homo sapiens
tgaattgacttatttca

SEQ ID NO: 6451469 - DNA, 13 bp, Homo sapiens
tgaattgagaata

SEQ ID NO: 6451470 - DNA, 12 bp, Homo sapiens
tgaattgataaa

SEQ ID NO: 6451471 - DNA, 13 bp, Homo sapiens
tgaattgataata

SEQ ID NO: 6451472 - DNA, 16 bp, Homo sapiens
tgaattgataataaac

SEQ ID NO: 6451473 - DNA, 18 bp, Homo sapiens
tgaattgatgatgcagtt

SEQ ID NO: 6451474 - DNA, 22 bp, Homo sapiens
tgaattgcctgcagagagaagc

SEQ ID NO: 6451475 - DNA, 15 bp, Homo sapiens
tgaattgcctgccat

SEQ ID NO: 6451476 - DNA, 23 bp, Homo sapiens
tcccgccttcaggttcctcctag

SEQ ID NO: 6451477 - DNA, 15 bp, Homo sapiens
tcccgcctttgacct

SEQ ID NO: 6451478 - DNA, 15 bp, Homo sapiens
tcccgcgcctttccg

SEQ ID NO: 6451479 - DNA, 19 bp, Homo sapiens
tcccgcgggaagccagccc

SEQ ID NO: 6451480 - DNA, 21 bp, Homo sapiens
tcccgcgggcctggacactta

SEQ ID NO: 6451481 - DNA, 19 bp, Homo sapiens
tcccgcggtgctgactgag

SEQ ID NO: 6451482 - DNA, 21 bp, Homo sapiens
tcccgcggtgctgactgaggc

SEQ ID NO: 6451483 - DNA, 19 bp, Homo sapiens
tcccgcgtagtgtcagtac

SEQ ID NO: 6451484 - DNA, 9 bp, Homo sapiens
tcccgctcc

SEQ ID NO: 6451485 - DNA, 14 bp, Homo sapiens
tcccgctgagccca

SEQ ID NO: 6451486 - DNA, 15 bp, Homo sapiens
tcccgctgcacacag

SEQ ID NO: 6451487 - DNA, 17 bp, Homo sapiens
tcccgctgcacacagac

SEQ ID NO: 6451488 - DNA, 22 bp, Homo sapiens
tcccgctgcacacagacggcct

SEQ ID NO: 6451489 - DNA, 20 bp, Homo sapiens
tcccgctgcacatggacaga

SEQ ID NO: 6451490 - DNA, 22 bp, Homo sapiens
tcccgctgcacatggacagact

SEQ ID NO: 6451491 - DNA, 21 bp, Homo sapiens
tcccgctgcctcctgctctct

SEQ ID NO: 6451492 - DNA, 15 bp, Homo sapiens
tcccgctgctgctgc

SEQ ID NO: 6451493 - DNA, 22 bp, Homo sapiens
tcccgctgctgtgctctgggga

SEQ ID NO: 6451494 - DNA, 14 bp, Homo sapiens
tcccgcttagcctg

SEQ ID NO: 6451495 - DNA, 19 bp, Homo sapiens
tcccgcttagcctgcctca

SEQ ID NO: 6451496 - DNA, 18 bp, Homo sapiens
tcccgcttgctctcctgg

SEQ ID NO: 6451497 - DNA, 22 bp, Homo sapiens
tcccggagaggtggccgccatg

SEQ ID NO: 6451498 - DNA, 17 bp, Homo sapiens
tcccggagcacagccct

SEQ ID NO: 6451499 - DNA, 22 bp, Homo sapiens
tcccggagcacagccctgggag

SEQ ID NO: 6451500 - DNA, 12 bp, Homo sapiens
tcccggagccat

SEQ ID NO: 6451501 - DNA, 23 bp, Homo sapiens
tcccggagccatcaccctcaccc

SEQ ID NO: 6451502 - DNA, 14 bp, Homo sapiens
tcccggaggaaatc

SEQ ID NO: 6451503 - DNA, 22 bp, Homo sapiens
tcccggcaagcgcttctgctga

SEQ ID NO: 6451504 - DNA, 21 bp, Homo sapiens
tcccggcagcgaggctgggct

SEQ ID NO: 6451505 - DNA, 16 bp, Homo sapiens
tcccggcatcctgaaa

SEQ ID NO: 6451506 - DNA, 23 bp, Homo sapiens
tcccggcatcctgaaagccagca

SEQ ID NO: 6451507 - DNA, 15 bp, Homo sapiens
tcccggccccgcgcg

SEQ ID NO: 6451508 - DNA, 19 bp, Homo sapiens
tcccggccccgcgcgtgcc

SEQ ID NO: 6451509 - DNA, 19 bp, Homo sapiens
tcccggccggccctggctt

SEQ ID NO: 6451510 - DNA, 16 bp, Homo sapiens
tcccggcctgtaacat

SEQ ID NO: 6451511 - DNA, 14 bp, Homo sapiens
tcccggctccctcc

SEQ ID NO: 6451512 - DNA, 15 bp, Homo sapiens
tcccggctccctcct

SEQ ID NO: 6451513 - DNA, 15 bp, Homo sapiens
tcccggctctgtggg

SEQ ID NO: 6451514 - DNA, 18 bp, Homo sapiens
tcccggctgaccctgtgc

SEQ ID NO: 6451515 - DNA, 19 bp, Homo sapiens
tcccggctgaccctgtgcc

SEQ ID NO: 6451516 - DNA, 21 bp, Homo sapiens
tcccggctgcccccatcacct

SEQ ID NO: 6451517 - DNA, 15 bp, Homo sapiens
tcccggctgcctgcc

SEQ ID NO: 6451518 - DNA, 14 bp, Homo sapiens
tcccggctggactt

SEQ ID NO: 6451519 - DNA, 19 bp, Homo sapiens
tcccggctttgcagggaga

SEQ ID NO: 6451520 - DNA, 23 bp, Homo sapiens
tcccggctttgcagggagaccag

SEQ ID NO: 6451521 - DNA, 19 bp, Homo sapiens
tcccgggaacgcttgctct

SEQ ID NO: 6451522 - DNA, 23 bp, Homo sapiens
tcccgggaagcatcctccccacc

SEQ ID NO: 6451523 - DNA, 20 bp, Homo sapiens
tcccgggagctgggccctgc

SEQ ID NO: 6451524 - DNA, 23 bp, Homo sapiens
tcccgggagctgggccctgcctg

SEQ ID NO: 6451525 - DNA, 16 bp, Homo sapiens
tcccgggatgggtgga

SEQ ID NO: 6451526 - DNA, 12 bp, Homo sapiens
tcccgggcactg

SEQ ID NO: 6451527 - DNA, 23 bp, Homo sapiens
tcccgggccaagacagatggaca

SEQ ID NO: 6451528 - DNA, 21 bp, Homo sapiens
tcccgggcccgttgaggatga

SEQ ID NO: 6451529 - DNA, 12 bp, Homo sapiens
tcccgggccctc

SEQ ID NO: 6451530 - DNA, 18 bp, Homo sapiens
tcccgggccctcccttgg

SEQ ID NO: 6451531 - DNA, 18 bp, Homo sapiens
tcccgggccctcctgggc

SEQ ID NO: 6451532 - DNA, 14 bp, Homo sapiens
tcccggggccatgg

SEQ ID NO: 6451533 - DNA, 24 bp, Homo sapiens
tcccggggccatggaagctggcag

SEQ ID NO: 6451534 - DNA, 16 bp, Homo sapiens
tcccggggcctggaca

SEQ ID NO: 6451535 - DNA, 15 bp, Homo sapiens
tcccggggccttcct

SEQ ID NO: 6451536 - DNA, 14 bp, Homo sapiens
tcccggggctccac

SEQ ID NO: 6451537 - DNA, 19 bp, Homo sapiens
tcccggggtcctgtggcag

SEQ ID NO: 6451538 - DNA, 17 bp, Homo sapiens
tcccgggtccttggccc

SEQ ID NO: 6451539 - DNA, 18 bp, Homo sapiens
tcccgggtctcaggcctc

SEQ ID NO: 6451540 - DNA, 22 bp, Homo sapiens
tcccgggtgccccccatgccct

SEQ ID NO: 6451541 - DNA, 17 bp, Homo sapiens
tcccgggttagcctggt

SEQ ID NO: 6451542 - DNA, 16 bp, Homo sapiens
tcccggtaccttccat

SEQ ID NO: 6451543 - DNA, 17 bp, Homo sapiens
tcccggtgacacatcca

SEQ ID NO: 6451544 - DNA, 16 bp, Homo sapiens
tcccggtgcagaacag

SEQ ID NO: 6451545 - DNA, 23 bp, Homo sapiens
tcccggtgtatcctggccctggg

SEQ ID NO: 6451546 - DNA, 15 bp, Homo sapiens
tcccggtgtgcagcg

SEQ ID NO: 6451547 - DNA, 22 bp, Homo sapiens
tcccggttccctccccagctcc

SEQ ID NO: 6451548 - DNA, 16 bp, Homo sapiens
tcccggtttcagaagc

SEQ ID NO: 6451549 - DNA, 14 bp, Homo sapiens
tcccgtaaggctgt

SEQ ID NO: 6451550 - DNA, 19 bp, Homo sapiens
tcccgtataataaaaccaa

SEQ ID NO: 6451551 - DNA, 16 bp, Homo sapiens
tcccgtatcacagtgt

SEQ ID NO: 6451552 - DNA, 16 bp, Homo sapiens
tcccgtatgctttctt

SEQ ID NO: 6451553 - DNA, 16 bp, Homo sapiens
tcccgtcagggcccaa

SEQ ID NO: 6451554 - DNA, 21 bp, Homo sapiens
tcccgtcccatatcctgcctc

SEQ ID NO: 6451555 - DNA, 15 bp, Homo sapiens
tcccgtccgtccgcc

SEQ ID NO: 6451556 - DNA, 14 bp, Homo sapiens
tcccgtcgtgcagt

SEQ ID NO: 6451557 - DNA, 15 bp, Homo sapiens
tcccgtcgtgcagtc

SEQ ID NO: 6451558 - DNA, 13 bp, Homo sapiens
tcccgtctcagaa

SEQ ID NO: 6451559 - DNA, 18 bp, Homo sapiens
tcccgtctggacctgggg

SEQ ID NO: 6451560 - DNA, 18 bp, Homo sapiens
tcccgtcttcctcctccc

SEQ ID NO: 6451561 - DNA, 17 bp, Homo sapiens
tcccgtgaaattgatgc

SEQ ID NO: 6451562 - DNA, 19 bp, Homo sapiens
tcccgtgccctgtttccaa

SEQ ID NO: 6451563 - DNA, 14 bp, Homo sapiens
tcccgtgcctggga

SEQ ID NO: 6451564 - DNA, 23 bp, Homo sapiens
tcccgtggaacgtttttcctgtt

SEQ ID NO: 6451565 - DNA, 16 bp, Homo sapiens
tcccgtggatgctctt

SEQ ID NO: 6451566 - DNA, 16 bp, Homo sapiens
tcccgtggccccagcc

SEQ ID NO: 6451567 - DNA, 18 bp, Homo sapiens
tcccgtggccccagcctg

SEQ ID NO: 6451568 - DNA, 21 bp, Homo sapiens
tcccgtggccccagcctggcc

SEQ ID NO: 6451569 - DNA, 18 bp, Homo sapiens
tcccgtggctttgtgctt

SEQ ID NO: 6451570 - DNA, 19 bp, Homo sapiens
tcccgtgtgtatttctaag

SEQ ID NO: 6451571 - DNA, 13 bp, Homo sapiens
tcccgtgttgctt

SEQ ID NO: 6451572 - DNA, 17 bp, Homo sapiens
tcccgttttccccatga

SEQ ID NO: 6451573 - DNA, 19 bp, Homo sapiens
tcccgttttccccatgaca

SEQ ID NO: 6451574 - DNA, 16 bp, Homo sapiens
tccctaaaatacattt

SEQ ID NO: 6451575 - DNA, 22 bp, Homo sapiens
tccctaaacaaaagcaaagatg

SEQ ID NO: 6451576 - DNA, 13 bp, Homo sapiens
tccctaaacatag

SEQ ID NO: 6451577 - DNA, 14 bp, Homo sapiens
tccctaaactgcag

SEQ ID NO: 6451578 - DNA, 22 bp, Homo sapiens
tccctaaactgcagcctctctg

SEQ ID NO: 6451579 - DNA, 13 bp, Homo sapiens
tccctaaactgta

SEQ ID NO: 6451580 - DNA, 13 bp, Homo sapiens
tccctaaagccct

SEQ ID NO: 6451581 - DNA, 14 bp, Homo sapiens
tccctaaatttgca

SEQ ID NO: 6451582 - DNA, 15 bp, Homo sapiens
tccctaacacttacc

SEQ ID NO: 6451583 - DNA, 16 bp, Homo sapiens
tccctaacacttaccc

SEQ ID NO: 6451584 - DNA, 22 bp, Homo sapiens
tccctaacatcatgcattcaca

SEQ ID NO: 6451585 - DNA, 13 bp, Homo sapiens
tccctaaccacta

SEQ ID NO: 6451586 - DNA, 17 bp, Homo sapiens
tccctaactcaactgtt

SEQ ID NO: 6451587 - DNA, 18 bp, Homo sapiens
tccctaagaaaccccagg

SEQ ID NO: 6451588 - DNA, 19 bp, Homo sapiens
tccctaagaaaccccaggg

SEQ ID NO: 6451589 - DNA, 15 bp, Homo sapiens
tccctaagccaaggg

SEQ ID NO: 6451590 - DNA, 14 bp, Homo sapiens
tccctaagccagct

SEQ ID NO: 6451591 - DNA, 12 bp, Homo sapiens
tccctaataaag

SEQ ID NO: 6451592 - DNA, 13 bp, Homo sapiens
tccctaataaagc

SEQ ID NO: 6451593 - DNA, 16 bp, Homo sapiens
tccctaataaagctgt

SEQ ID NO: 6451594 - DNA, 15 bp, Homo sapiens
tccctaatcctccaa

SEQ ID NO: 6451595 - DNA, 15 bp, Homo sapiens
tccctaattctcttc

SEQ ID NO: 6451596 - DNA, 16 bp, Homo sapiens
tccctaattctgcctt

SEQ ID NO: 6451597 - DNA, 17 bp, Homo sapiens
tccctaattctgcctta

SEQ ID NO: 6451598 - DNA, 14 bp, Homo sapiens
tccctaattcttca

SEQ ID NO: 6451599 - DNA, 19 bp, Homo sapiens
tccctaatttatgtgctat

SEQ ID NO: 6451600 - DNA, 20 bp, Homo sapiens
tccctaatttatgtgctata

SEQ ID NO: 6451601 - DNA, 16 bp, Homo sapiens
tccctacacagggcct

SEQ ID NO: 6451602 - DNA, 17 bp, Homo sapiens
tccctacacagggcctg

SEQ ID NO: 6451603 - DNA, 14 bp, Homo sapiens
tccctacactgatg

SEQ ID NO: 6451604 - DNA, 17 bp, Homo sapiens
tccctacactgatgcaa

SEQ ID NO: 6451605 - DNA, 20 bp, Homo sapiens
tccctacaggaggaacagtg

SEQ ID NO: 6451606 - DNA, 13 bp, Homo sapiens
tccctacattaaa

SEQ ID NO: 6451607 - DNA, 17 bp, Homo sapiens
tccctacattccccaga

SEQ ID NO: 6451608 - DNA, 15 bp, Homo sapiens
tccctaccaaaaatt

SEQ ID NO: 6451609 - DNA, 22 bp, Homo sapiens
tccctaccaaaaattgccaagt

SEQ ID NO: 6451610 - DNA, 18 bp, Homo sapiens
tccctaccactgagccct

SEQ ID NO: 6451611 - DNA, 19 bp, Homo sapiens
tccctaccactgtggcccc

SEQ ID NO: 6451612 - DNA, 18 bp, Homo sapiens
tccctacccaatgtctcc

SEQ ID NO: 6451613 - DNA, 16 bp, Homo sapiens
tccctacccacagggc

SEQ ID NO: 6451614 - DNA, 20 bp, Homo sapiens
tccctacccacagggcctga

SEQ ID NO: 6451615 - DNA, 18 bp, Homo sapiens
tccctacccactctttgc

SEQ ID NO: 6451616 - DNA, 19 bp, Homo sapiens
tccctaccccagggccctg

SEQ ID NO: 6451617 - DNA, 19 bp, Homo sapiens
tccctaccccctaagagcc

SEQ ID NO: 6451618 - DNA, 19 bp, Homo sapiens
tccctaccctaaccaagtt

SEQ ID NO: 6451619 - DNA, 17 bp, Homo sapiens
tccctaccctcttctca

SEQ ID NO: 6451620 - DNA, 19 bp, Homo sapiens
tccctacccttcctgccaa

SEQ ID NO: 6451621 - DNA, 15 bp, Homo sapiens
tccctaccgacccag

SEQ ID NO: 6451622 - DNA, 19 bp, Homo sapiens
tccctacctaagaatttca

SEQ ID NO: 6451623 - DNA, 23 bp, Homo sapiens
tccctacctaagaatttcactgt

SEQ ID NO: 6451624 - DNA, 15 bp, Homo sapiens
tccctacctcaacct

SEQ ID NO: 6451625 - DNA, 16 bp, Homo sapiens
tccctacctcaacctg

SEQ ID NO: 6451626 - DNA, 22 bp, Homo sapiens
tccctacctcaacctgtaaatt

SEQ ID NO: 6451627 - DNA, 17 bp, Homo sapiens
tccctacctcaggcagg

SEQ ID NO: 6451628 - DNA, 13 bp, Homo sapiens
tccctacctccct

SEQ ID NO: 6451629 - DNA, 18 bp, Homo sapiens
tccctacctccctcctca

SEQ ID NO: 6451630 - DNA, 21 bp, Homo sapiens
tccctacctccctcctcaggg

SEQ ID NO: 6451631 - DNA, 19 bp, Homo sapiens
tccctaccttgaaagaaga

SEQ ID NO: 6451632 - DNA, 17 bp, Homo sapiens
tccctactcccctgggc

SEQ ID NO: 6451633 - DNA, 18 bp, Homo sapiens
tccctactcccctgggca

SEQ ID NO: 6451634 - DNA, 15 bp, Homo sapiens
tccctactgaagccc

SEQ ID NO: 6451635 - DNA, 20 bp, Homo sapiens
tccctactgagtactctttc

SEQ ID NO: 6451636 - DNA, 16 bp, Homo sapiens
tccctacttaggaaat

SEQ ID NO: 6451637 - DNA, 14 bp, Homo sapiens
tccctacttccaag

SEQ ID NO: 6451638 - DNA, 16 bp, Homo sapiens
tccctacttccaagaa

SEQ ID NO: 6451639 - DNA, 17 bp, Homo sapiens
tccctacttcctgtgac

SEQ ID NO: 6451640 - DNA, 16 bp, Homo sapiens
tccctactttctctct

SEQ ID NO: 6451641 - DNA, 19 bp, Homo sapiens
tccctacttttcaagagtg

SEQ ID NO: 6451642 - DNA, 16 bp, Homo sapiens
tccctagaaacaaagg

SEQ ID NO: 6451643 - DNA, 18 bp, Homo sapiens
tccctagaagagcacaga

SEQ ID NO: 6451644 - DNA, 18 bp, Homo sapiens
tccctagactgcatcccg

SEQ ID NO: 6451645 - DNA, 13 bp, Homo sapiens
tccctagacttta

SEQ ID NO: 6451646 - DNA, 11 bp, Homo sapiens
tccctagagag

SEQ ID NO: 6451647 - DNA, 17 bp, Homo sapiens
tccctagagagaataaa

SEQ ID NO: 6451648 - DNA, 17 bp, Homo sapiens
tccctagagggttcctg

SEQ ID NO: 6451649 - DNA, 21 bp, Homo sapiens
tccctagatggttccctttgt

SEQ ID NO: 6451650 - DNA, 17 bp, Homo sapiens
tccctagccagcacttg

SEQ ID NO: 6451651 - DNA, 20 bp, Homo sapiens
tccctagccagcacttgtat

SEQ ID NO: 6451652 - DNA, 12 bp, Homo sapiens
tccctagccctt

SEQ ID NO: 6451653 - DNA, 14 bp, Homo sapiens
tccctagcccttcc

SEQ ID NO: 6451654 - DNA, 20 bp, Homo sapiens
tccctagcccttccagcctg

SEQ ID NO: 6451655 - DNA, 16 bp, Homo sapiens
tgaattgcctgccatg

SEQ ID NO: 6451656 - DNA, 18 bp, Homo sapiens
tgaattgctaattctgag

SEQ ID NO: 6451657 - DNA, 14 bp, Homo sapiens
tgaattgctgtcta

SEQ ID NO: 6451658 - DNA, 17 bp, Homo sapiens
tgaattgctttatgggg

SEQ ID NO: 6451659 - DNA, 22 bp, Homo sapiens
tgaattggaactgcaatgaaag

SEQ ID NO: 6451660 - DNA, 13 bp, Homo sapiens
tgaattggcctga

SEQ ID NO: 6451661 - DNA, 23 bp, Homo sapiens
tgaattggcctgaacagatgtaa

SEQ ID NO: 6451662 - DNA, 17 bp, Homo sapiens
tgaattggctatgcagt

SEQ ID NO: 6451663 - DNA, 17 bp, Homo sapiens
tgaattggcttccttga

SEQ ID NO: 6451664 - DNA, 21 bp, Homo sapiens
tgaattgggaacattatcaca

SEQ ID NO: 6451665 - DNA, 15 bp, Homo sapiens
tgaattgtaaaagca

SEQ ID NO: 6451666 - DNA, 21 bp, Homo sapiens
tgaattgtaaaagcaacatca

SEQ ID NO: 6451667 - DNA, 21 bp, Homo sapiens
tgaattgtaaggaatgattaa

SEQ ID NO: 6451668 - DNA, 20 bp, Homo sapiens
tgaattgtacctatttctga

SEQ ID NO: 6451669 - DNA, 18 bp, Homo sapiens
tgaattgtggctgttcac

SEQ ID NO: 6451670 - DNA, 20 bp, Homo sapiens
tgaattgtgtggagaagtgt

SEQ ID NO: 6451671 - DNA, 23 bp, Homo sapiens
tgaattgtgttttcaggttttgt

SEQ ID NO: 6451672 - DNA, 13 bp, Homo sapiens
tgaattgttacat

SEQ ID NO: 6451673 - DNA, 14 bp, Homo sapiens
tgaattgttatgaa

SEQ ID NO: 6451674 - DNA, 20 bp, Homo sapiens
tgaattgttatgtaaacatc

SEQ ID NO: 6451675 - DNA, 14 bp, Homo sapiens
tgaatttaaataaa

SEQ ID NO: 6451676 - DNA, 20 bp, Homo sapiens
tgaatttaaatataattctg

SEQ ID NO: 6451677 - DNA, 23 bp, Homo sapiens
tgaatttaacaatgcgaatggta

SEQ ID NO: 6451678 - DNA, 13 bp, Homo sapiens
tgaatttaagcat

SEQ ID NO: 6451679 - DNA, 16 bp, Homo sapiens
tgaatttaaggcaaaa

SEQ ID NO: 6451680 - DNA, 20 bp, Homo sapiens
tgaatttaaggcaaaaaagg

SEQ ID NO: 6451681 - DNA, 17 bp, Homo sapiens
tgaatttaattctttca

SEQ ID NO: 6451682 - DNA, 21 bp, Homo sapiens
tgaatttacttccttgcatgt

SEQ ID NO: 6451683 - DNA, 13 bp, Homo sapiens
tgaatttagtcat

SEQ ID NO: 6451684 - DNA, 19 bp, Homo sapiens
tgaatttagtgagatttac

SEQ ID NO: 6451685 - DNA, 17 bp, Homo sapiens
tgaatttataaagtacc

SEQ ID NO: 6451686 - DNA, 13 bp, Homo sapiens
tgaatttatataa

SEQ ID NO: 6451687 - DNA, 16 bp, Homo sapiens
tgaatttatataaagt

SEQ ID NO: 6451688 - DNA, 16 bp, Homo sapiens
tgaatttatcatttta

SEQ ID NO: 6451689 - DNA, 13 bp, Homo sapiens
tgaatttatcttt

SEQ ID NO: 6451690 - DNA, 17 bp, Homo sapiens
tgaatttatctttacca

SEQ ID NO: 6451691 - DNA, 20 bp, Homo sapiens
tgaatttatgagatttactg

SEQ ID NO: 6451692 - DNA, 15 bp, Homo sapiens
tgaatttattattgt

SEQ ID NO: 6451693 - DNA, 16 bp, Homo sapiens
tgaatttattggcttt

SEQ ID NO: 6451694 - DNA, 22 bp, Homo sapiens
tgaatttattggcttttctgat

SEQ ID NO: 6451695 - DNA, 23 bp, Homo sapiens
tgaatttattggcttttctgatc

SEQ ID NO: 6451696 - DNA, 13 bp, Homo sapiens
tgaatttcaggca

SEQ ID NO: 6451697 - DNA, 19 bp, Homo sapiens
tgaatttcaggcattttgt

SEQ ID NO: 6451698 - DNA, 19 bp, Homo sapiens
tgaatttccccatctgcca

SEQ ID NO: 6451699 - DNA, 14 bp, Homo sapiens
tgaatttcctatct

SEQ ID NO: 6451700 - DNA, 13 bp, Homo sapiens
tgaatttctaaaa

SEQ ID NO: 6451701 - DNA, 13 bp, Homo sapiens
tgaatttctaaat

SEQ ID NO: 6451702 - DNA, 16 bp, Homo sapiens
tgaatttctagacagt

SEQ ID NO: 6451703 - DNA, 23 bp, Homo sapiens
tgaatttctagacagtattgcca

SEQ ID NO: 6451704 - DNA, 12 bp, Homo sapiens
tgaatttctatg

SEQ ID NO: 6451705 - DNA, 12 bp, Homo sapiens
tgaatttctcta

SEQ ID NO: 6451706 - DNA, 15 bp, Homo sapiens
tgaatttctctacag

SEQ ID NO: 6451707 - DNA, 23 bp, Homo sapiens
tgaatttctgacctcaagtgatt

SEQ ID NO: 6451708 - DNA, 13 bp, Homo sapiens
tgaatttctggaa

SEQ ID NO: 6451709 - DNA, 14 bp, Homo sapiens
tgaatttctggaag

SEQ ID NO: 6451710 - DNA, 15 bp, Homo sapiens
tgaatttctggtttg

SEQ ID NO: 6451711 - DNA, 20 bp, Homo sapiens
tgaatttctggtttgcctga

SEQ ID NO: 6451712 - DNA, 20 bp, Homo sapiens
tgaatttcttcactgttgaa

SEQ ID NO: 6451713 - DNA, 14 bp, Homo sapiens
tgaatttctttgat

SEQ ID NO: 6451714 - DNA, 15 bp, Homo sapiens
tgaatttcttttgcc

SEQ ID NO: 6451715 - DNA, 13 bp, Homo sapiens
tgaatttgaatga

SEQ ID NO: 6451716 - DNA, 15 bp, Homo sapiens
tgaatttgaatgaaa

SEQ ID NO: 6451717 - DNA, 18 bp, Homo sapiens
tgaatttgaatgaaaaat

SEQ ID NO: 6451718 - DNA, 15 bp, Homo sapiens
tgaatttgcaaagta

SEQ ID NO: 6451719 - DNA, 21 bp, Homo sapiens
tgaatttgcaaagtactgtaa

SEQ ID NO: 6451720 - DNA, 20 bp, Homo sapiens
tgaatttgcacggtttgtga

SEQ ID NO: 6451721 - DNA, 21 bp, Homo sapiens
tgaatttgccagaggaccaat

SEQ ID NO: 6451722 - DNA, 15 bp, Homo sapiens
tgaatttggagactc

SEQ ID NO: 6451723 - DNA, 20 bp, Homo sapiens
tgaatttggagactctgtgg

SEQ ID NO: 6451724 - DNA, 14 bp, Homo sapiens
tgaatttggcttta

SEQ ID NO: 6451725 - DNA, 20 bp, Homo sapiens
tgaatttgggatactaaagt

SEQ ID NO: 6451726 - DNA, 22 bp, Homo sapiens
tgaatttggggctacttatatt

SEQ ID NO: 6451727 - DNA, 13 bp, Homo sapiens
tgaatttgtgaag

SEQ ID NO: 6451728 - DNA, 23 bp, Homo sapiens
tgaatttgtgaaggtggaaataa

SEQ ID NO: 6451729 - DNA, 14 bp, Homo sapiens
tgaattttaaaaca

SEQ ID NO: 6451730 - DNA, 13 bp, Homo sapiens
tgaattttaaagt

SEQ ID NO: 6451731 - DNA, 22 bp, Homo sapiens
tgaattttaaagtatgcattat

SEQ ID NO: 6451732 - DNA, 15 bp, Homo sapiens
tgaattttaaataat

SEQ ID NO: 6451733 - DNA, 20 bp, Homo sapiens
tgaattttaaattaaagcaa

SEQ ID NO: 6451734 - DNA, 14 bp, Homo sapiens
tgaattttaagggt

SEQ ID NO: 6451735 - DNA, 14 bp, Homo sapiens
tgaattttacaaaa

SEQ ID NO: 6451736 - DNA, 15 bp, Homo sapiens
tgaattttacaaaaa

SEQ ID NO: 6451737 - DNA, 21 bp, Homo sapiens
tgaattttagacgatcacaga

SEQ ID NO: 6451738 - DNA, 13 bp, Homo sapiens
tgaattttagctt

SEQ ID NO: 6451739 - DNA, 16 bp, Homo sapiens
tgaattttatcagcca

SEQ ID NO: 6451740 - DNA, 15 bp, Homo sapiens
tgaattttcacatga

SEQ ID NO: 6451741 - DNA, 11 bp, Homo sapiens
tgaattttcat

SEQ ID NO: 6451742 - DNA, 12 bp, Homo sapiens
tgaattttcatt

SEQ ID NO: 6451743 - DNA, 13 bp, Homo sapiens
tgaattttcattt

SEQ ID NO: 6451744 - DNA, 17 bp, Homo sapiens
tgaattttccacgcagt

SEQ ID NO: 6451745 - DNA, 14 bp, Homo sapiens
tgaattttcccact

SEQ ID NO: 6451746 - DNA, 17 bp, Homo sapiens
tgaattttcccactgca

SEQ ID NO: 6451747 - DNA, 20 bp, Homo sapiens
tgaattttcccactgcaccc

SEQ ID NO: 6451748 - DNA, 19 bp, Homo sapiens
tgaattttctgcagctgtt

SEQ ID NO: 6451749 - DNA, 15 bp, Homo sapiens
tgaattttctggaaa

SEQ ID NO: 6451750 - DNA, 14 bp, Homo sapiens
tgaattttctgtgt

SEQ ID NO: 6451751 - DNA, 15 bp, Homo sapiens
tgaattttctgtgtt

SEQ ID NO: 6451752 - DNA, 16 bp, Homo sapiens
tgaattttgagtctat

SEQ ID NO: 6451753 - DNA, 15 bp, Homo sapiens
tgaattttgcaatgt

SEQ ID NO: 6451754 - DNA, 20 bp, Homo sapiens
tgaattttggggattttcaa

SEQ ID NO: 6451755 - DNA, 21 bp, Homo sapiens
tgaattttggggattttcaaa

SEQ ID NO: 6451756 - DNA, 22 bp, Homo sapiens
tgaattttggggattttcaaaa

SEQ ID NO: 6451757 - DNA, 23 bp, Homo sapiens
tgaattttggtgatgtaaaacag

SEQ ID NO: 6451758 - DNA, 12 bp, Homo sapiens
tgaattttgtaa

SEQ ID NO: 6451759 - DNA, 22 bp, Homo sapiens
tgaattttgtaagtataagaaa

SEQ ID NO: 6451760 - DNA, 22 bp, Homo sapiens
tgaatttttaaaacccatttaa

SEQ ID NO: 6451761 - DNA, 12 bp, Homo sapiens
tgaatttttaat

SEQ ID NO: 6451762 - DNA, 15 bp, Homo sapiens
tgaatttttatttct

SEQ ID NO: 6451763 - DNA, 13 bp, Homo sapiens
tgaatttttctaa

SEQ ID NO: 6451764 - DNA, 13 bp, Homo sapiens
tgaatttttctct

SEQ ID NO: 6451765 - DNA, 15 bp, Homo sapiens
tgaatttttctctaa

SEQ ID NO: 6451766 - DNA, 18 bp, Homo sapiens
tgaatttttgatgtagat

SEQ ID NO: 6451767 - DNA, 13 bp, Homo sapiens
tgaatttttgcct

SEQ ID NO: 6451768 - DNA, 17 bp, Homo sapiens
tgaattttttgaaatgg

SEQ ID NO: 6451769 - DNA, 22 bp, Homo sapiens
tgaattttttgaaatgggcatt

SEQ ID NO: 6451770 - DNA, 14 bp, Homo sapiens
tgaatttttttcct

SEQ ID NO: 6451771 - DNA, 23 bp, Homo sapiens
tgaatttttttcgctatgggagg

SEQ ID NO: 6451772 - DNA, 16 bp, Homo sapiens
tgaatttttttgtaat

SEQ ID NO: 6451773 - DNA, 18 bp, Homo sapiens
tgaatttttttgtaataa

SEQ ID NO: 6451774 - DNA, 17 bp, Homo sapiens
tgaattttttttaacat

SEQ ID NO: 6451775 - DNA, 21 bp, Homo sapiens
tgaattttttttaacattcct

SEQ ID NO: 6451776 - DNA, 16 bp, Homo sapiens
tgaattttttttctga

SEQ ID NO: 6451777 - DNA, 19 bp, Homo sapiens
tgaattttttttctgaatt

SEQ ID NO: 6451778 - DNA, 21 bp, Homo sapiens
tgacaaaaaatgttttaaaga

SEQ ID NO: 6451779 - DNA, 18 bp, Homo sapiens
tgacaaaaataacactgt

SEQ ID NO: 6451780 - DNA, 13 bp, Homo sapiens
tgacaaaaatatt

SEQ ID NO: 6451781 - DNA, 15 bp, Homo sapiens
tgacaaaaatgtttg

SEQ ID NO: 6451782 - DNA, 19 bp, Homo sapiens
tgacaaaaatgtttgtact

SEQ ID NO: 6451783 - DNA, 15 bp, Homo sapiens
tgacaaaaattattt

SEQ ID NO: 6451784 - DNA, 16 bp, Homo sapiens
tgacaaaacctaactt

SEQ ID NO: 6451785 - DNA, 17 bp, Homo sapiens
tgacaaaacctaacttg

SEQ ID NO: 6451786 - DNA, 21 bp, Homo sapiens
tgacaaaagtgacagatgtta

SEQ ID NO: 6451787 - DNA, 23 bp, Homo sapiens
tgacaaaagtgacagatgttatt

SEQ ID NO: 6451788 - DNA, 19 bp, Homo sapiens
tgacaaaatgactggctcc

SEQ ID NO: 6451789 - DNA, 13 bp, Homo sapiens
tgacaaaatgtta

SEQ ID NO: 6451790 - DNA, 15 bp, Homo sapiens
tgacaaaatgttatt

SEQ ID NO: 6451791 - DNA, 19 bp, Homo sapiens
tgacaaaattcatttgctt

SEQ ID NO: 6451792 - DNA, 18 bp, Homo sapiens
tgacaaaatttgttgaaa

SEQ ID NO: 6451793 - DNA, 14 bp, Homo sapiens
tgacaaaattttgc

SEQ ID NO: 6451794 - DNA, 12 bp, Homo sapiens
tgacaaacacaa

SEQ ID NO: 6451795 - DNA, 13 bp, Homo sapiens
tgacaaacatgat

SEQ ID NO: 6451796 - DNA, 21 bp, Homo sapiens
tgacaaacatgatactgctgc

SEQ ID NO: 6451797 - DNA, 20 bp, Homo sapiens
tgacaaacctagcttttaaa

SEQ ID NO: 6451798 - DNA, 22 bp, Homo sapiens
tgacaaactgtgtacatagcgg

SEQ ID NO: 6451799 - DNA, 17 bp, Homo sapiens
tgacaaagaaaaatgat

SEQ ID NO: 6451800 - DNA, 19 bp, Homo sapiens
tgacaaagaaaatgagaat

SEQ ID NO: 6451801 - DNA, 14 bp, Homo sapiens
tgacaaagaagacc

SEQ ID NO: 6451802 - DNA, 15 bp, Homo sapiens
tgacaaagactcctc

SEQ ID NO: 6451803 - DNA, 19 bp, Homo sapiens
tgacaaagatggctcagag

SEQ ID NO: 6451804 - DNA, 20 bp, Homo sapiens
tgacaaagccagaggagaag

SEQ ID NO: 6451805 - DNA, 17 bp, Homo sapiens
tgacaaagccattcttt

SEQ ID NO: 6451806 - DNA, 18 bp, Homo sapiens
tgacaaaggagcattgca

SEQ ID NO: 6451807 - DNA, 18 bp, Homo sapiens
tgacaaaggatgaagaac

SEQ ID NO: 6451808 - DNA, 16 bp, Homo sapiens
tgacaaaggtggtaaa

SEQ ID NO: 6451809 - DNA, 19 bp, Homo sapiens
tgacaaaggtggtaaattc

SEQ ID NO: 6451810 - DNA, 18 bp, Homo sapiens
tgacaaagtcatgaagct

SEQ ID NO: 6451811 - DNA, 18 bp, Homo sapiens
tgacaaagtgttgaaaat

SEQ ID NO: 6451812 - DNA, 22 bp, Homo sapiens
tgacaaagttatatatttataa

SEQ ID NO: 6451813 - DNA, 22 bp, Homo sapiens
tgacaaataagattaataagat

SEQ ID NO: 6451814 - DNA, 17 bp, Homo sapiens
tgacaaatattttcatg

SEQ ID NO: 6451815 - DNA, 16 bp, Homo sapiens
tgacaaatctgtgtat

SEQ ID NO: 6451816 - DNA, 19 bp, Homo sapiens
tgacaaatgaaagagaaaa

SEQ ID NO: 6451817 - DNA, 21 bp, Homo sapiens
tgacaaatgaaagagaaaata

SEQ ID NO: 6451818 - DNA, 13 bp, Homo sapiens
tgacaaatgtgta

SEQ ID NO: 6451819 - DNA, 14 bp, Homo sapiens
tgacaaatgtgtat

SEQ ID NO: 6451820 - DNA, 12 bp, Homo sapiens
tgacaaatttag

SEQ ID NO: 6451821 - DNA, 22 bp, Homo sapiens
tgacaacaaattttggttttct

SEQ ID NO: 6451822 - DNA, 13 bp, Homo sapiens
tgacaacactcat

SEQ ID NO: 6451823 - DNA, 23 bp, Homo sapiens
tgacaacactcattgacctgagg

SEQ ID NO: 6451824 - DNA, 12 bp, Homo sapiens
tgacaacactta

SEQ ID NO: 6451825 - DNA, 14 bp, Homo sapiens
tgacaacagaagct

SEQ ID NO: 6451826 - DNA, 19 bp, Homo sapiens
tgacaacatcccacagtgg

SEQ ID NO: 6451827 - DNA, 20 bp, Homo sapiens
tgacaacatttttgtacatt

SEQ ID NO: 6451828 - DNA, 22 bp, Homo sapiens
tgacaacatttttgtacattat

SEQ ID NO: 6451829 - DNA, 19 bp, Homo sapiens
tgacaaccaccgctcccca

SEQ ID NO: 6451830 - DNA, 20 bp, Homo sapiens
tgacaaccaccgctccccag

SEQ ID NO: 6451831 - DNA, 21 bp, Homo sapiens
tgacaaccaccgctccccagc

SEQ ID NO: 6451832 - DNA, 17 bp, Homo sapiens
tgacaaccactggtctg

SEQ ID NO: 6451833 - DNA, 21 bp, Homo sapiens
tgacaaccattaaagtcagaa

SEQ ID NO: 6451834 - DNA, 17 bp, Homo sapiens
tccctagctcacactca

SEQ ID NO: 6451835 - DNA, 19 bp, Homo sapiens
tccctagctcacactcatc

SEQ ID NO: 6451836 - DNA, 20 bp, Homo sapiens
tccctagctcacactcatcc

SEQ ID NO: 6451837 - DNA, 19 bp, Homo sapiens
tccctagctcttccccatc

SEQ ID NO: 6451838 - DNA, 19 bp, Homo sapiens
tccctagctttagaccctg

SEQ ID NO: 6451839 - DNA, 20 bp, Homo sapiens
tccctagctttagaccctgg

SEQ ID NO: 6451840 - DNA, 17 bp, Homo sapiens
tccctaggcacctctgt

SEQ ID NO: 6451841 - DNA, 15 bp, Homo sapiens
tccctaggcctgagt

SEQ ID NO: 6451842 - DNA, 14 bp, Homo sapiens
tccctagggctctc

SEQ ID NO: 6451843 - DNA, 18 bp, Homo sapiens
tccctaggggacacttcc

SEQ ID NO: 6451844 - DNA, 23 bp, Homo sapiens
tccctaggtgttttgttcaccat

SEQ ID NO: 6451845 - DNA, 16 bp, Homo sapiens
tccctagtaaaaatac

SEQ ID NO: 6451846 - DNA, 12 bp, Homo sapiens
tccctagtcatt

SEQ ID NO: 6451847 - DNA, 17 bp, Homo sapiens
tccctagtctccacctg

SEQ ID NO: 6451848 - DNA, 17 bp, Homo sapiens
tccctagtggcttcctc

SEQ ID NO: 6451849 - DNA, 16 bp, Homo sapiens
tccctataataaaggc

SEQ ID NO: 6451850 - DNA, 19 bp, Homo sapiens
tccctataataaaggctga

SEQ ID NO: 6451851 - DNA, 22 bp, Homo sapiens
tccctatatgcacccctggaac

SEQ ID NO: 6451852 - DNA, 15 bp, Homo sapiens
tccctatcagttcta

SEQ ID NO: 6451853 - DNA, 15 bp, Homo sapiens
tccctatgctaccct

SEQ ID NO: 6451854 - DNA, 17 bp, Homo sapiens
tccctatgtcatgtctt

SEQ ID NO: 6451855 - DNA, 22 bp, Homo sapiens
tccctatgtcccagcccctggt

SEQ ID NO: 6451856 - DNA, 14 bp, Homo sapiens
tccctattctgcca

SEQ ID NO: 6451857 - DNA, 16 bp, Homo sapiens
tccctattctgccatg

SEQ ID NO: 6451858 - DNA, 22 bp, Homo sapiens
tccctattgtgacagagccatg

SEQ ID NO: 6451859 - DNA, 14 bp, Homo sapiens
tccctatttatgat

SEQ ID NO: 6451860 - DNA, 22 bp, Homo sapiens
tccctattttaggctattataa

SEQ ID NO: 6451861 - DNA, 18 bp, Homo sapiens
tccctatttttctctcct

SEQ ID NO: 6451862 - DNA, 20 bp, Homo sapiens
tccctatttttctctcctgt

SEQ ID NO: 6451863 - DNA, 18 bp, Homo sapiens
tccctcaaagcttccatt

SEQ ID NO: 6451864 - DNA, 20 bp, Homo sapiens
tccctcaaatgcgcgtgtgc

SEQ ID NO: 6451865 - DNA, 16 bp, Homo sapiens
tccctcaaccccacca

SEQ ID NO: 6451866 - DNA, 20 bp, Homo sapiens
tccctcacaagcgctcccag

SEQ ID NO: 6451867 - DNA, 22 bp, Homo sapiens
tccctcacaagcgctcccagcc

SEQ ID NO: 6451868 - DNA, 22 bp, Homo sapiens
tccctcacccaagtttccggag

SEQ ID NO: 6451869 - DNA, 15 bp, Homo sapiens
tccctcacccccatg

SEQ ID NO: 6451870 - DNA, 17 bp, Homo sapiens
tccctcaccccctccca

SEQ ID NO: 6451871 - DNA, 22 bp, Homo sapiens
tccctcaccccctctaagttca

SEQ ID NO: 6451872 - DNA, 15 bp, Homo sapiens
tccctcaccctgagc

SEQ ID NO: 6451873 - DNA, 17 bp, Homo sapiens
tccctcaccctgagccc

SEQ ID NO: 6451874 - DNA, 20 bp, Homo sapiens
tccctcaccctgagcccctt

SEQ ID NO: 6451875 - DNA, 21 bp, Homo sapiens
tccctcaccctgagccccttc

SEQ ID NO: 6451876 - DNA, 12 bp, Homo sapiens
tccctcacctgt

SEQ ID NO: 6451877 - DNA, 14 bp, Homo sapiens
tccctcacctgtag

SEQ ID NO: 6451878 - DNA, 22 bp, Homo sapiens
tccctcaccttggcaccagaca

SEQ ID NO: 6451879 - DNA, 20 bp, Homo sapiens
tccctcactcgtctccccca

SEQ ID NO: 6451880 - DNA, 22 bp, Homo sapiens
tccctcactcgtctcccccaac

SEQ ID NO: 6451881 - DNA, 18 bp, Homo sapiens
tccctcactgaaggacct

SEQ ID NO: 6451882 - DNA, 16 bp, Homo sapiens
tccctcactgccttcc

SEQ ID NO: 6451883 - DNA, 18 bp, Homo sapiens
tccctcactgccttccag

SEQ ID NO: 6451884 - DNA, 10 bp, Homo sapiens
tccctcagac

SEQ ID NO: 6451885 - DNA, 12 bp, Homo sapiens
tccctcagaccc

SEQ ID NO: 6451886 - DNA, 18 bp, Homo sapiens
tccctcagacccaggagt

SEQ ID NO: 6451887 - DNA, 21 bp, Homo sapiens
tccctcagacccaggagtcca

SEQ ID NO: 6451888 - DNA, 22 bp, Homo sapiens
tccctcagacccaggagtccag

SEQ ID NO: 6451889 - DNA, 11 bp, Homo sapiens
tccctcagact

SEQ ID NO: 6451890 - DNA, 12 bp, Homo sapiens
tccctcagactc

SEQ ID NO: 6451891 - DNA, 13 bp, Homo sapiens
tccctcagactca

SEQ ID NO: 6451892 - DNA, 23 bp, Homo sapiens
tccctcagactcagaggtccagg

SEQ ID NO: 6451893 - DNA, 20 bp, Homo sapiens
tccctcagagacaccaaact

SEQ ID NO: 6451894 - DNA, 18 bp, Homo sapiens
tccctcagcaacatccca

SEQ ID NO: 6451895 - DNA, 13 bp, Homo sapiens
tccctcagccacg

SEQ ID NO: 6451896 - DNA, 16 bp, Homo sapiens
tccctcagccacgcct

SEQ ID NO: 6451897 - DNA, 20 bp, Homo sapiens
tccctcagccgtcagccatc

SEQ ID NO: 6451898 - DNA, 13 bp, Homo sapiens
tccctcagcctaa

SEQ ID NO: 6451899 - DNA, 14 bp, Homo sapiens
tccctcagcctcag

SEQ ID NO: 6451900 - DNA, 17 bp, Homo sapiens
tccctcagcctcagagg

SEQ ID NO: 6451901 - DNA, 19 bp, Homo sapiens
tccctcagcctcagaggag

SEQ ID NO: 6451902 - DNA, 13 bp, Homo sapiens
tccctcagcctcc

SEQ ID NO: 6451903 - DNA, 18 bp, Homo sapiens
tccctcagcctccccttc

SEQ ID NO: 6451904 - DNA, 20 bp, Homo sapiens
tccctcagcctccccttctt

SEQ ID NO: 6451905 - DNA, 17 bp, Homo sapiens
tccctcagctctctggg

SEQ ID NO: 6451906 - DNA, 23 bp, Homo sapiens
tccctcaggcccaggagtccagg

SEQ ID NO: 6451907 - DNA, 18 bp, Homo sapiens
tccctcaggctctgtgga

SEQ ID NO: 6451908 - DNA, 22 bp, Homo sapiens
tccctcaggggcaggtggtgga

SEQ ID NO: 6451909 - DNA, 21 bp, Homo sapiens
tccctcaggttctattttctt

SEQ ID NO: 6451910 - DNA, 19 bp, Homo sapiens
tccctcagtgtgaagcctg

SEQ ID NO: 6451911 - DNA, 21 bp, Homo sapiens
tccctcagtgtgaagcctgtc

SEQ ID NO: 6451912 - DNA, 22 bp, Homo sapiens
tccctcatcctcatacccaccc

SEQ ID NO: 6451913 - DNA, 17 bp, Homo sapiens
tccctcatgtatacttc

SEQ ID NO: 6451914 - DNA, 15 bp, Homo sapiens
tccctcattcatctt

SEQ ID NO: 6451915 - DNA, 16 bp, Homo sapiens
tccctcattcatcttg

SEQ ID NO: 6451916 - DNA, 16 bp, Homo sapiens
tccctcattctgcatt

SEQ ID NO: 6451917 - DNA, 17 bp, Homo sapiens
tccctcattctgcatta

SEQ ID NO: 6451918 - DNA, 18 bp, Homo sapiens
tccctcattctgcattaa

SEQ ID NO: 6451919 - DNA, 20 bp, Homo sapiens
tccctcattctgcattaata

SEQ ID NO: 6451920 - DNA, 15 bp, Homo sapiens
tccctcatttcatta

SEQ ID NO: 6451921 - DNA, 20 bp, Homo sapiens
tccctcatttcattattttt

SEQ ID NO: 6451922 - DNA, 22 bp, Homo sapiens
tccctccaaagggcagtgggtg

SEQ ID NO: 6451923 - DNA, 11 bp, Homo sapiens
tccctccaact

SEQ ID NO: 6451924 - DNA, 17 bp, Homo sapiens
tccctccaagaggctgg

SEQ ID NO: 6451925 - DNA, 13 bp, Homo sapiens
tccctccaagcct

SEQ ID NO: 6451926 - DNA, 16 bp, Homo sapiens
tccctccaagcctggc

SEQ ID NO: 6451927 - DNA, 19 bp, Homo sapiens
tccctccaagcctggcacc

SEQ ID NO: 6451928 - DNA, 21 bp, Homo sapiens
tccctccaagcctggcaccca

SEQ ID NO: 6451929 - DNA, 15 bp, Homo sapiens
tccctccacacctcc

SEQ ID NO: 6451930 - DNA, 22 bp, Homo sapiens
tccctccacacctccacccgtc

SEQ ID NO: 6451931 - DNA, 20 bp, Homo sapiens
tccctccaccagcctgctga

SEQ ID NO: 6451932 - DNA, 14 bp, Homo sapiens
tccctccaccccac

SEQ ID NO: 6451933 - DNA, 16 bp, Homo sapiens
tccctccaccccagtc

SEQ ID NO: 6451934 - DNA, 21 bp, Homo sapiens
tccctccacccccatgtggca

SEQ ID NO: 6451935 - DNA, 17 bp, Homo sapiens
tccctccacctccctgc

SEQ ID NO: 6451936 - DNA, 16 bp, Homo sapiens
tccctccacctgcttg

SEQ ID NO: 6451937 - DNA, 13 bp, Homo sapiens
tccctccactcct

SEQ ID NO: 6451938 - DNA, 11 bp, Homo sapiens
tccctccagaa

SEQ ID NO: 6451939 - DNA, 18 bp, Homo sapiens
tccctccaggcccatctc

SEQ ID NO: 6451940 - DNA, 23 bp, Homo sapiens
tccctccagggaaaatgacttta

SEQ ID NO: 6451941 - DNA, 23 bp, Homo sapiens
tccctccagggtcctctcttcca

SEQ ID NO: 6451942 - DNA, 13 bp, Homo sapiens
tccctccatccca

SEQ ID NO: 6451943 - DNA, 17 bp, Homo sapiens
tccctccatcccagaca

SEQ ID NO: 6451944 - DNA, 13 bp, Homo sapiens
tccctccatcccc

SEQ ID NO: 6451945 - DNA, 15 bp, Homo sapiens
tccctccatccggct

SEQ ID NO: 6451946 - DNA, 15 bp, Homo sapiens
tccctccatggcagg

SEQ ID NO: 6451947 - DNA, 22 bp, Homo sapiens
tccctcccaaggagccattctg

SEQ ID NO: 6451948 - DNA, 14 bp, Homo sapiens
tccctcccacactt

SEQ ID NO: 6451949 - DNA, 15 bp, Homo sapiens
tccctcccacctctg

SEQ ID NO: 6451950 - DNA, 13 bp, Homo sapiens
tccctcccactcc

SEQ ID NO: 6451951 - DNA, 21 bp, Homo sapiens
tccctcccagaaaaactggct

SEQ ID NO: 6451952 - DNA, 13 bp, Homo sapiens
tccctcccagctg

SEQ ID NO: 6451953 - DNA, 18 bp, Homo sapiens
tccctcccagctgcactt

SEQ ID NO: 6451954 - DNA, 13 bp, Homo sapiens
tccctcccaggac

SEQ ID NO: 6451955 - DNA, 15 bp, Homo sapiens
tccctcccattcccc

SEQ ID NO: 6451956 - DNA, 13 bp, Homo sapiens
tccctccccaccc

SEQ ID NO: 6451957 - DNA, 14 bp, Homo sapiens
tccctccccaccca

SEQ ID NO: 6451958 - DNA, 18 bp, Homo sapiens
tccctccccacccaagag

SEQ ID NO: 6451959 - DNA, 14 bp, Homo sapiens
tccctccccacccc

SEQ ID NO: 6451960 - DNA, 22 bp, Homo sapiens
tccctccccaccccaaccactc

SEQ ID NO: 6451961 - DNA, 12 bp, Homo sapiens
tccctccccaga

SEQ ID NO: 6451962 - DNA, 13 bp, Homo sapiens
tccctccccagaa

SEQ ID NO: 6451963 - DNA, 15 bp, Homo sapiens
tccctccccagatct

SEQ ID NO: 6451964 - DNA, 21 bp, Homo sapiens
tccctccccagatctgtcctg

SEQ ID NO: 6451965 - DNA, 23 bp, Homo sapiens
tccctccccagatctgtcctggg

SEQ ID NO: 6451966 - DNA, 16 bp, Homo sapiens
tccctccccagctcct

SEQ ID NO: 6451967 - DNA, 17 bp, Homo sapiens
tccctccccagctcctc

SEQ ID NO: 6451968 - DNA, 14 bp, Homo sapiens
tccctccccagtgt

SEQ ID NO: 6451969 - DNA, 18 bp, Homo sapiens
tccctccccagtgttttt

SEQ ID NO: 6451970 - DNA, 14 bp, Homo sapiens
tccctcccccagag

SEQ ID NO: 6451971 - DNA, 15 bp, Homo sapiens
tccctcccccagagc

SEQ ID NO: 6451972 - DNA, 15 bp, Homo sapiens
tccctcccccagcag

SEQ ID NO: 6451973 - DNA, 16 bp, Homo sapiens
tccctcccccagcaga

SEQ ID NO: 6451974 - DNA, 14 bp, Homo sapiens
tccctcccccccat

SEQ ID NO: 6451975 - DNA, 16 bp, Homo sapiens
tccctcccccccatgc

SEQ ID NO: 6451976 - DNA, 14 bp, Homo sapiens
tccctccccctcct

SEQ ID NO: 6451977 - DNA, 17 bp, Homo sapiens
tccctccccctccttgt

SEQ ID NO: 6451978 - DNA, 17 bp, Homo sapiens
tccctccccgctgccct

SEQ ID NO: 6451979 - DNA, 15 bp, Homo sapiens
tccctcccctcagcc

SEQ ID NO: 6451980 - DNA, 13 bp, Homo sapiens
tccctcccctgcc

SEQ ID NO: 6451981 - DNA, 16 bp, Homo sapiens
tccctcccctgccatt

SEQ ID NO: 6451982 - DNA, 16 bp, Homo sapiens
tccctcccctgccctc

SEQ ID NO: 6451983 - DNA, 13 bp, Homo sapiens
tccctcccctgct

SEQ ID NO: 6451984 - DNA, 14 bp, Homo sapiens
tccctccccttctc

SEQ ID NO: 6451985 - DNA, 14 bp, Homo sapiens
tccctccccttgcc

SEQ ID NO: 6451986 - DNA, 19 bp, Homo sapiens
tccctccccttgccacatc

SEQ ID NO: 6451987 - DNA, 15 bp, Homo sapiens
tccctccccttgcct

SEQ ID NO: 6451988 - DNA, 20 bp, Homo sapiens
tccctcccggcatgggaaag

SEQ ID NO: 6451989 - DNA, 12 bp, Homo sapiens
tccctcccggct

SEQ ID NO: 6451990 - DNA, 17 bp, Homo sapiens
tccctccctagcccttc

SEQ ID NO: 6451991 - DNA, 20 bp, Homo sapiens
tccctccctagcccttccag

SEQ ID NO: 6451992 - DNA, 22 bp, Homo sapiens
tccctccctagcccttccagcc

SEQ ID NO: 6451993 - DNA, 14 bp, Homo sapiens
tccctccctccaca

SEQ ID NO: 6451994 - DNA, 14 bp, Homo sapiens
tccctccctccacc

SEQ ID NO: 6451995 - DNA, 16 bp, Homo sapiens
tccctccctcctggct

SEQ ID NO: 6451996 - DNA, 19 bp, Homo sapiens
tccctccctcctggctcac

SEQ ID NO: 6451997 - DNA, 12 bp, Homo sapiens
tccctccctctc

SEQ ID NO: 6451998 - DNA, 15 bp, Homo sapiens
tccctccctctccgc

SEQ ID NO: 6451999 - DNA, 16 bp, Homo sapiens
tccctccctctgccgg

SEQ ID NO: 6452000 - DNA, 12 bp, Homo sapiens
tccctccctctt

SEQ ID NO: 6452001 - DNA, 15 bp, Homo sapiens
tccctccctctttcc

SEQ ID NO: 6452002 - DNA, 17 bp, Homo sapiens
tccctccctctttccct

SEQ ID NO: 6452003 - DNA, 15 bp, Homo sapiens
tccctccctgctccc

SEQ ID NO: 6452004 - DNA, 10 bp, Homo sapiens
tccctccctt

SEQ ID NO: 6452005 - DNA, 15 bp, Homo sapiens
tccctcccttgctga

SEQ ID NO: 6452006 - DNA, 13 bp, Homo sapiens
tccctcccttggg

SEQ ID NO: 6452007 - DNA, 15 bp, Homo sapiens
tccctccgatccttc

SEQ ID NO: 6452008 - DNA, 14 bp, Homo sapiens
tccctccgccccca

SEQ ID NO: 6452009 - DNA, 18 bp, Homo sapiens
tccctccgcctcccatcc

SEQ ID NO: 6452010 - DNA, 18 bp, Homo sapiens
tccctccgcggctggagc

SEQ ID NO: 6452011 - DNA, 19 bp, Homo sapiens
tccctccgcggctggagcg

SEQ ID NO: 6452012 - DNA, 18 bp, Homo sapiens
tccctccgctaaggcttc

SEQ ID NO: 6452013 - DNA, 15 bp, Homo sapiens
tccctccgggacctg

SEQ ID NO: 6452014 - DNA, 18 bp, Homo sapiens
tccctccgggtcttccta

SEQ ID NO: 6452015 - DNA, 13 bp, Homo sapiens
tgacaaccctggc

SEQ ID NO: 6452016 - DNA, 16 bp, Homo sapiens
tgacaaccctggcctc

SEQ ID NO: 6452017 - DNA, 17 bp, Homo sapiens
tgacaaccgagaaggtt

SEQ ID NO: 6452018 - DNA, 17 bp, Homo sapiens
tgacaacctttgtgtaa

SEQ ID NO: 6452019 - DNA, 18 bp, Homo sapiens
tgacaacctttgtgtaat

SEQ ID NO: 6452020 - DNA, 17 bp, Homo sapiens
tgacaacgaaagtaaag

SEQ ID NO: 6452021 - DNA, 16 bp, Homo sapiens
tgacaacgtctcttca

SEQ ID NO: 6452022 - DNA, 21 bp, Homo sapiens
tgacaacgtttcagcgactcc

SEQ ID NO: 6452023 - DNA, 15 bp, Homo sapiens
tgacaactacagaaa

SEQ ID NO: 6452024 - DNA, 18 bp, Homo sapiens
tgacaactcattttcata

SEQ ID NO: 6452025 - DNA, 22 bp, Homo sapiens
tgacaactcattttcatattgt

SEQ ID NO: 6452026 - DNA, 17 bp, Homo sapiens
tgacaactgaagagaca

SEQ ID NO: 6452027 - DNA, 13 bp, Homo sapiens
tgacaactggcag

SEQ ID NO: 6452028 - DNA, 18 bp, Homo sapiens
tgacaactggcaggcagg

SEQ ID NO: 6452029 - DNA, 13 bp, Homo sapiens
tgacaactgtcta

SEQ ID NO: 6452030 - DNA, 22 bp, Homo sapiens
tgacaactgtctaactttagaa

SEQ ID NO: 6452031 - DNA, 16 bp, Homo sapiens
tgacaactgtgaagcc

SEQ ID NO: 6452032 - DNA, 17 bp, Homo sapiens
tgacaacttagctcagg

SEQ ID NO: 6452033 - DNA, 18 bp, Homo sapiens
tgacaacttagctcaggt

SEQ ID NO: 6452034 - DNA, 22 bp, Homo sapiens
tgacaacttagctcaggtgcct

SEQ ID NO: 6452035 - DNA, 23 bp, Homo sapiens
tgacaagaaaggctgctgtactg

SEQ ID NO: 6452036 - DNA, 11 bp, Homo sapiens
tgacaagagcc

SEQ ID NO: 6452037 - DNA, 20 bp, Homo sapiens
tgacaagataaaggaagtca

SEQ ID NO: 6452038 - DNA, 18 bp, Homo sapiens
tgacaagatgggacagca

SEQ ID NO: 6452039 - DNA, 12 bp, Homo sapiens
tgacaagatgtt

SEQ ID NO: 6452040 - DNA, 15 bp, Homo sapiens
tgacaagcactgcta

SEQ ID NO: 6452041 - DNA, 21 bp, Homo sapiens
tgacaagccccaggcaggctg

SEQ ID NO: 6452042 - DNA, 20 bp, Homo sapiens
tgacaagctaggaaagagga

SEQ ID NO: 6452043 - DNA, 15 bp, Homo sapiens
tgacaagctcacaga

SEQ ID NO: 6452044 - DNA, 18 bp, Homo sapiens
tgacaagctccatttaaa

SEQ ID NO: 6452045 - DNA, 22 bp, Homo sapiens
tgacaagctggccaaagtcact

SEQ ID NO: 6452046 - DNA, 14 bp, Homo sapiens
tgacaagctggctt

SEQ ID NO: 6452047 - DNA, 23 bp, Homo sapiens
tgacaagctggcttacactggca

SEQ ID NO: 6452048 - DNA, 21 bp, Homo sapiens
tgacaagctgtatcactgcct

SEQ ID NO: 6452049 - DNA, 22 bp, Homo sapiens
tgacaagctgtatcactgcctt

SEQ ID NO: 6452050 - DNA, 17 bp, Homo sapiens
tgacaaggcacttcatg

SEQ ID NO: 6452051 - DNA, 23 bp, Homo sapiens
tgacaaggccagcacccaaaggg

SEQ ID NO: 6452052 - DNA, 13 bp, Homo sapiens
tgacaaggcccca

SEQ ID NO: 6452053 - DNA, 16 bp, Homo sapiens
tgacaaggccccagag

SEQ ID NO: 6452054 - DNA, 22 bp, Homo sapiens
tgacaaggccccagagactcag

SEQ ID NO: 6452055 - DNA, 17 bp, Homo sapiens
tgacaaggcctgcttga

SEQ ID NO: 6452056 - DNA, 16 bp, Homo sapiens
tgacaagggcacaagc

SEQ ID NO: 6452057 - DNA, 16 bp, Homo sapiens
tgacaagggctgacct

SEQ ID NO: 6452058 - DNA, 22 bp, Homo sapiens
tgacaagggctgacctgcctct

SEQ ID NO: 6452059 - DNA, 16 bp, Homo sapiens
tgacaaggtcaaattt

SEQ ID NO: 6452060 - DNA, 15 bp, Homo sapiens
tgacaagtcacaccc

SEQ ID NO: 6452061 - DNA, 16 bp, Homo sapiens
tgacaagtgaagaaca

SEQ ID NO: 6452062 - DNA, 15 bp, Homo sapiens
tgacaagtggagggg

SEQ ID NO: 6452063 - DNA, 14 bp, Homo sapiens
tgacaagtgtcttt

SEQ ID NO: 6452064 - DNA, 15 bp, Homo sapiens
tgacaagtgtctttt

SEQ ID NO: 6452065 - DNA, 12 bp, Homo sapiens
tgacaagtgtgt

SEQ ID NO: 6452066 - DNA, 21 bp, Homo sapiens
tgacaagttacccctgaaatc

SEQ ID NO: 6452067 - DNA, 15 bp, Homo sapiens
tgacaagttcctagg

SEQ ID NO: 6452068 - DNA, 17 bp, Homo sapiens
tgacaagtttaaaggct

SEQ ID NO: 6452069 - DNA, 16 bp, Homo sapiens
tgacaataaaacatta

SEQ ID NO: 6452070 - DNA, 14 bp, Homo sapiens
tgacaataaataat

SEQ ID NO: 6452071 - DNA, 14 bp, Homo sapiens
tgacaataatttca

SEQ ID NO: 6452072 - DNA, 17 bp, Homo sapiens
tgacaatactgctgcct

SEQ ID NO: 6452073 - DNA, 13 bp, Homo sapiens
tgacaatatactt

SEQ ID NO: 6452074 - DNA, 16 bp, Homo sapiens
tgacaatattccagat

SEQ ID NO: 6452075 - DNA, 12 bp, Homo sapiens
tgacaatcaaag

SEQ ID NO: 6452076 - DNA, 23 bp, Homo sapiens
tgacaatcaaagaaaagactttt

SEQ ID NO: 6452077 - DNA, 16 bp, Homo sapiens
tgacaatcctgaagaa

SEQ ID NO: 6452078 - DNA, 23 bp, Homo sapiens
tgacaatcctgaagaaaccacag

SEQ ID NO: 6452079 - DNA, 14 bp, Homo sapiens
tgacaatcttttgg

SEQ ID NO: 6452080 - DNA, 14 bp, Homo sapiens
tgacaatgaaggga

SEQ ID NO: 6452081 - DNA, 14 bp, Homo sapiens
tgacaatgacaaaa

SEQ ID NO: 6452082 - DNA, 13 bp, Homo sapiens
tgacaatgactaa

SEQ ID NO: 6452083 - DNA, 22 bp, Homo sapiens
tgacaatgactaagccaagctg

SEQ ID NO: 6452084 - DNA, 23 bp, Homo sapiens
tgacaatgactaagccaagctgt

SEQ ID NO: 6452085 - DNA, 13 bp, Homo sapiens
tgacaatgctgcc

SEQ ID NO: 6452086 - DNA, 18 bp, Homo sapiens
tgacaatgctgccatgcc

SEQ ID NO: 6452087 - DNA, 21 bp, Homo sapiens
tgacaatgctgccatgcccac

SEQ ID NO: 6452088 - DNA, 14 bp, Homo sapiens
tgacaatgtatttt

SEQ ID NO: 6452089 - DNA, 16 bp, Homo sapiens
tgacaattatgaaaaa

SEQ ID NO: 6452090 - DNA, 18 bp, Homo sapiens
tgacaattcagtgactta

SEQ ID NO: 6452091 - DNA, 15 bp, Homo sapiens
tgacaattctgcatg

SEQ ID NO: 6452092 - DNA, 14 bp, Homo sapiens
tgacaattctgggt

SEQ ID NO: 6452093 - DNA, 12 bp, Homo sapiens
tgacaattgtga

SEQ ID NO: 6452094 - DNA, 15 bp, Homo sapiens
tgacaattgtgaaca

SEQ ID NO: 6452095 - DNA, 21 bp, Homo sapiens
tgacaatttcaaaatgcatgt

SEQ ID NO: 6452096 - DNA, 20 bp, Homo sapiens
tgacaatttctggcagatgt

SEQ ID NO: 6452097 - DNA, 16 bp, Homo sapiens
tgacaattttgtacaa

SEQ ID NO: 6452098 - DNA, 18 bp, Homo sapiens
tgacaattttgtacaaat

SEQ ID NO: 6452099 - DNA, 14 bp, Homo sapiens
tgacaattttgtct

SEQ ID NO: 6452100 - DNA, 16 bp, Homo sapiens
tgacaattttgtctta

SEQ ID NO: 6452101 - DNA, 22 bp, Homo sapiens
tgacaattttgtcttaagtgtt

SEQ ID NO: 6452102 - DNA, 13 bp, Homo sapiens
tgacacaaaagaa

SEQ ID NO: 6452103 - DNA, 13 bp, Homo sapiens
tgacacaaacaca

SEQ ID NO: 6452104 - DNA, 14 bp, Homo sapiens
tgacacaaaggaag

SEQ ID NO: 6452105 - DNA, 16 bp, Homo sapiens
tgacacaactgtgtga

SEQ ID NO: 6452106 - DNA, 15 bp, Homo sapiens
tgacacaagcacttt

SEQ ID NO: 6452107 - DNA, 13 bp, Homo sapiens
tgacacaatggta

SEQ ID NO: 6452108 - DNA, 21 bp, Homo sapiens
tgacacaatggtagctctgaa

SEQ ID NO: 6452109 - DNA, 22 bp, Homo sapiens
tgacacaatggtagctctgaag

SEQ ID NO: 6452110 - DNA, 20 bp, Homo sapiens
tgacacacagactacagcca

SEQ ID NO: 6452111 - DNA, 12 bp, Homo sapiens
tgacacacagca

SEQ ID NO: 6452112 - DNA, 15 bp, Homo sapiens
tgacacacagctctg

SEQ ID NO: 6452113 - DNA, 16 bp, Homo sapiens
tgacacaccaggcgct

SEQ ID NO: 6452114 - DNA, 22 bp, Homo sapiens
tgacacaccaggcgctaattca

SEQ ID NO: 6452115 - DNA, 17 bp, Homo sapiens
tgacacacccaaggggc

SEQ ID NO: 6452116 - DNA, 20 bp, Homo sapiens
tgacacacccctaagtacaa

SEQ ID NO: 6452117 - DNA, 16 bp, Homo sapiens
tgacacactacaccac

SEQ ID NO: 6452118 - DNA, 19 bp, Homo sapiens
tgacacactacaccacaca

SEQ ID NO: 6452119 - DNA, 17 bp, Homo sapiens
tgacacactcaccattt

SEQ ID NO: 6452120 - DNA, 23 bp, Homo sapiens
tgacacactcaccatttaatcat

SEQ ID NO: 6452121 - DNA, 23 bp, Homo sapiens
tgacacagaaaatgttgagaatc

SEQ ID NO: 6452122 - DNA, 17 bp, Homo sapiens
tgacacagactcatcct

SEQ ID NO: 6452123 - DNA, 19 bp, Homo sapiens
tgacacagaggctggcact

SEQ ID NO: 6452124 - DNA, 15 bp, Homo sapiens
tgacacagcttgtga

SEQ ID NO: 6452125 - DNA, 19 bp, Homo sapiens
tgacacagcttgtgaatgt

SEQ ID NO: 6452126 - DNA, 19 bp, Homo sapiens
tgacacaggaaatgggaaa

SEQ ID NO: 6452127 - DNA, 20 bp, Homo sapiens
tgacacaggccagccccatc

SEQ ID NO: 6452128 - DNA, 12 bp, Homo sapiens
tgacacaggtca

SEQ ID NO: 6452129 - DNA, 19 bp, Homo sapiens
tgacacaggtcagggctca

SEQ ID NO: 6452130 - DNA, 17 bp, Homo sapiens
tgacacagtcagcatgc

SEQ ID NO: 6452131 - DNA, 22 bp, Homo sapiens
tgacacagtcttggctcactgc

SEQ ID NO: 6452132 - DNA, 10 bp, Homo sapiens
tgacacagtt

SEQ ID NO: 6452133 - DNA, 15 bp, Homo sapiens
tgacacataaaagta

SEQ ID NO: 6452134 - DNA, 19 bp, Homo sapiens
tgacacataaaagtaatta

SEQ ID NO: 6452135 - DNA, 17 bp, Homo sapiens
tgacacatatgaacaca

SEQ ID NO: 6452136 - DNA, 21 bp, Homo sapiens
tgacacatatgcaccttgtgt

SEQ ID NO: 6452137 - DNA, 13 bp, Homo sapiens
tgacacatcagca

SEQ ID NO: 6452138 - DNA, 20 bp, Homo sapiens
tgacacatcagcatgttttc

SEQ ID NO: 6452139 - DNA, 19 bp, Homo sapiens
tgacacatccgccttttgt

SEQ ID NO: 6452140 - DNA, 22 bp, Homo sapiens
tgacacatccgccttttgtata

SEQ ID NO: 6452141 - DNA, 13 bp, Homo sapiens
tgacacatcttca

SEQ ID NO: 6452142 - DNA, 16 bp, Homo sapiens
tgacacatggcccctc

SEQ ID NO: 6452143 - DNA, 16 bp, Homo sapiens
tgacacattgcacaca

SEQ ID NO: 6452144 - DNA, 19 bp, Homo sapiens
tgacacattgcacacacag

SEQ ID NO: 6452145 - DNA, 20 bp, Homo sapiens
tgacaccaaagccacctctg

SEQ ID NO: 6452146 - DNA, 15 bp, Homo sapiens
tgacaccaagaaacc

SEQ ID NO: 6452147 - DNA, 16 bp, Homo sapiens
tgacaccaataaatgt

SEQ ID NO: 6452148 - DNA, 21 bp, Homo sapiens
tgacaccaataaatgtttgtt

SEQ ID NO: 6452149 - DNA, 18 bp, Homo sapiens
tgacaccagaaagccctc

SEQ ID NO: 6452150 - DNA, 13 bp, Homo sapiens
tgacaccagcctt

SEQ ID NO: 6452151 - DNA, 15 bp, Homo sapiens
tgacaccagcctttc

SEQ ID NO: 6452152 - DNA, 19 bp, Homo sapiens
tgacaccaggcaagaaaag

SEQ ID NO: 6452153 - DNA, 16 bp, Homo sapiens
tgacaccatgtgcaaa

SEQ ID NO: 6452154 - DNA, 14 bp, Homo sapiens
tgacaccattctcc

SEQ ID NO: 6452155 - DNA, 16 bp, Homo sapiens
tgacaccattctcctg

SEQ ID NO: 6452156 - DNA, 19 bp, Homo sapiens
tgacaccattctcctgcct

SEQ ID NO: 6452157 - DNA, 16 bp, Homo sapiens
tgacacccaccctgtg

SEQ ID NO: 6452158 - DNA, 14 bp, Homo sapiens
tgacacccagacct

SEQ ID NO: 6452159 - DNA, 13 bp, Homo sapiens
tgacacccaggcc

SEQ ID NO: 6452160 - DNA, 20 bp, Homo sapiens
tgacacccatgccagagagg

SEQ ID NO: 6452161 - DNA, 13 bp, Homo sapiens
tgacacccatgtt

SEQ ID NO: 6452162 - DNA, 22 bp, Homo sapiens
tgacaccccctccccgcccctg

SEQ ID NO: 6452163 - DNA, 11 bp, Homo sapiens
tgacaccctaa

SEQ ID NO: 6452164 - DNA, 16 bp, Homo sapiens
tgacaccctggcctga

SEQ ID NO: 6452165 - DNA, 18 bp, Homo sapiens
tgacaccctggcctgaac

SEQ ID NO: 6452166 - DNA, 23 bp, Homo sapiens
tgacacccttctcccactctcct

SEQ ID NO: 6452167 - DNA, 18 bp, Homo sapiens
tgacaccgtgggtcatta

SEQ ID NO: 6452168 - DNA, 17 bp, Homo sapiens
tgacacctaccatgctg

SEQ ID NO: 6452169 - DNA, 19 bp, Homo sapiens
tgacacctcagtcatattt

SEQ ID NO: 6452170 - DNA, 22 bp, Homo sapiens
tgacacctcccttcgtgtgtgc

SEQ ID NO: 6452171 - DNA, 20 bp, Homo sapiens
tgacacctgccgctgcttga

SEQ ID NO: 6452172 - DNA, 15 bp, Homo sapiens
tgacacctgctgaga

SEQ ID NO: 6452173 - DNA, 13 bp, Homo sapiens
tgacacctggtgc

SEQ ID NO: 6452174 - DNA, 16 bp, Homo sapiens
tgacacctgtcttgaa

SEQ ID NO: 6452175 - DNA, 17 bp, Homo sapiens
tgacacctgtcttgaat

SEQ ID NO: 6452176 - DNA, 19 bp, Homo sapiens
tgacacctgtcttgaataa

SEQ ID NO: 6452177 - DNA, 22 bp, Homo sapiens
tgacacctgtcttgaataagag

SEQ ID NO: 6452178 - DNA, 14 bp, Homo sapiens
tgacacctttaaaa

SEQ ID NO: 6452179 - DNA, 23 bp, Homo sapiens
tgacacctttcataatctttgct

SEQ ID NO: 6452180 - DNA, 16 bp, Homo sapiens
tgacacgaatattgct

SEQ ID NO: 6452181 - DNA, 19 bp, Homo sapiens
tgacacgaatattgctgat

SEQ ID NO: 6452182 - DNA, 18 bp, Homo sapiens
tgacacgcaagtgtgtga

SEQ ID NO: 6452183 - DNA, 19 bp, Homo sapiens
tgacacgcagcctgctctg

SEQ ID NO: 6452184 - DNA, 16 bp, Homo sapiens
tgacacgcgctctcca

SEQ ID NO: 6452185 - DNA, 19 bp, Homo sapiens
tgacacgcgctctccacca

SEQ ID NO: 6452186 - DNA, 22 bp, Homo sapiens
tgacacgcgctctccaccaccc

SEQ ID NO: 6452187 - DNA, 13 bp, Homo sapiens
tgacacggtagca

SEQ ID NO: 6452188 - DNA, 17 bp, Homo sapiens
tgacacggtgaaatcca

SEQ ID NO: 6452189 - DNA, 19 bp, Homo sapiens
tgacacggtgaaatccagg

SEQ ID NO: 6452190 - DNA, 17 bp, Homo sapiens
tgacacgtccaccccag

SEQ ID NO: 6452191 - DNA, 21 bp, Homo sapiens
tgacacgtgatggaccaaagc

SEQ ID NO: 6452192 - DNA, 22 bp, Homo sapiens
tgacacgtgatggaccaaagcc

SEQ ID NO: 6452193 - DNA, 17 bp, Homo sapiens
tgacactaaaacaagag

SEQ ID NO: 6452194 - DNA, 16 bp, Homo sapiens
tccctccgtccctctg

SEQ ID NO: 6452195 - DNA, 12 bp, Homo sapiens
tccctcctagct

SEQ ID NO: 6452196 - DNA, 15 bp, Homo sapiens
tccctcctagctctc

SEQ ID NO: 6452197 - DNA, 16 bp, Homo sapiens
tccctcctagctctcc

SEQ ID NO: 6452198 - DNA, 12 bp, Homo sapiens
tccctcctcaca

SEQ ID NO: 6452199 - DNA, 13 bp, Homo sapiens
tccctcctcacac

SEQ ID NO: 6452200 - DNA, 15 bp, Homo sapiens
tccctcctcactccc

SEQ ID NO: 6452201 - DNA, 11 bp, Homo sapiens
tccctcctcag

SEQ ID NO: 6452202 - DNA, 14 bp, Homo sapiens
tccctcctcagctc

SEQ ID NO: 6452203 - DNA, 14 bp, Homo sapiens
tccctcctcaggga

SEQ ID NO: 6452204 - DNA, 10 bp, Homo sapiens
tccctcctcc

SEQ ID NO: 6452205 - DNA, 14 bp, Homo sapiens
tccctcctccaggc

SEQ ID NO: 6452206 - DNA, 17 bp, Homo sapiens
tccctcctccaggcctg

SEQ ID NO: 6452207 - DNA, 14 bp, Homo sapiens
tccctcctcccatc

SEQ ID NO: 6452208 - DNA, 16 bp, Homo sapiens
tccctcctctgcccgg

SEQ ID NO: 6452209 - DNA, 13 bp, Homo sapiens
tccctcctctggc

SEQ ID NO: 6452210 - DNA, 17 bp, Homo sapiens
tccctcctctggcaggc

SEQ ID NO: 6452211 - DNA, 16 bp, Homo sapiens
tccctcctctggccca

SEQ ID NO: 6452212 - DNA, 16 bp, Homo sapiens
tccctcctcttcctgt

SEQ ID NO: 6452213 - DNA, 18 bp, Homo sapiens
tccctcctgacaaatatt

SEQ ID NO: 6452214 - DNA, 15 bp, Homo sapiens
tccctcctgagtgcc

SEQ ID NO: 6452215 - DNA, 17 bp, Homo sapiens
tccctcctgatgttttt

SEQ ID NO: 6452216 - DNA, 20 bp, Homo sapiens
tccctcctgatgtttttccc

SEQ ID NO: 6452217 - DNA, 18 bp, Homo sapiens
tccctcctgcccaggact

SEQ ID NO: 6452218 - DNA, 14 bp, Homo sapiens
tccctcctgctact

SEQ ID NO: 6452219 - DNA, 15 bp, Homo sapiens
tccctcctggctcac

SEQ ID NO: 6452220 - DNA, 19 bp, Homo sapiens
tccctcctggctcacagcc

SEQ ID NO: 6452221 - DNA, 11 bp, Homo sapiens
tccctcctggg

SEQ ID NO: 6452222 - DNA, 18 bp, Homo sapiens
tccctcctgggatctgct

SEQ ID NO: 6452223 - DNA, 18 bp, Homo sapiens
tccctcctggtcctggac

SEQ ID NO: 6452224 - DNA, 19 bp, Homo sapiens
tccctcctggtcctggaca

SEQ ID NO: 6452225 - DNA, 23 bp, Homo sapiens
tccctcctggtgaagtgtgactt

SEQ ID NO: 6452226 - DNA, 22 bp, Homo sapiens
tccctcctggtgtcaccccaga

SEQ ID NO: 6452227 - DNA, 18 bp, Homo sapiens
tccctcctgttgccacac

SEQ ID NO: 6452228 - DNA, 11 bp, Homo sapiens
tccctccttca

SEQ ID NO: 6452229 - DNA, 13 bp, Homo sapiens
tccctccttccct

SEQ ID NO: 6452230 - DNA, 17 bp, Homo sapiens
tccctccttcccttctc

SEQ ID NO: 6452231 - DNA, 12 bp, Homo sapiens
tccctccttggg

SEQ ID NO: 6452232 - DNA, 16 bp, Homo sapiens
tccctcctttcctttg

SEQ ID NO: 6452233 - DNA, 16 bp, Homo sapiens
tccctcgacagcgccc

SEQ ID NO: 6452234 - DNA, 23 bp, Homo sapiens
tccctcgaccagaatcagattca

SEQ ID NO: 6452235 - DNA, 21 bp, Homo sapiens
tccctcgacttgaccctttcc

SEQ ID NO: 6452236 - DNA, 23 bp, Homo sapiens
tccctcgacttgaccctttcctc

SEQ ID NO: 6452237 - DNA, 19 bp, Homo sapiens
tccctcgagctctgtagcc

SEQ ID NO: 6452238 - DNA, 21 bp, Homo sapiens
tccctcgagctctgtagcctg

SEQ ID NO: 6452239 - DNA, 22 bp, Homo sapiens
tccctcgatcatatttcccctt

SEQ ID NO: 6452240 - DNA, 16 bp, Homo sapiens
tccctcgccctgtgag

SEQ ID NO: 6452241 - DNA, 20 bp, Homo sapiens
tccctcgccgtccctcccag

SEQ ID NO: 6452242 - DNA, 19 bp, Homo sapiens
tccctcgctgcacaaatac

SEQ ID NO: 6452243 - DNA, 15 bp, Homo sapiens
tccctcggacccacc

SEQ ID NO: 6452244 - DNA, 20 bp, Homo sapiens
tccctcggagttcttcttga

SEQ ID NO: 6452245 - DNA, 19 bp, Homo sapiens
tccctcgggaagcagccag

SEQ ID NO: 6452246 - DNA, 21 bp, Homo sapiens
tccctcgggaagcagccagct

SEQ ID NO: 6452247 - DNA, 14 bp, Homo sapiens
tccctcgggctggt

SEQ ID NO: 6452248 - DNA, 15 bp, Homo sapiens
tccctcgggctggtg

SEQ ID NO: 6452249 - DNA, 16 bp, Homo sapiens
tccctcgggctggtgt

SEQ ID NO: 6452250 - DNA, 16 bp, Homo sapiens
tccctcgggggctctt

SEQ ID NO: 6452251 - DNA, 21 bp, Homo sapiens
tccctcgggggctcttcccct

SEQ ID NO: 6452252 - DNA, 19 bp, Homo sapiens
tccctcggtcacctgtgct

SEQ ID NO: 6452253 - DNA, 15 bp, Homo sapiens
tccctcgtccacagg

SEQ ID NO: 6452254 - DNA, 15 bp, Homo sapiens
tccctcgtccgtctg

SEQ ID NO: 6452255 - DNA, 19 bp, Homo sapiens
tccctcgtccgtctgtctc

SEQ ID NO: 6452256 - DNA, 24 bp, Homo sapiens
tccctcgtccgtctgtctcgatgc

SEQ ID NO: 6452257 - DNA, 16 bp, Homo sapiens
tccctcgtctttccca

SEQ ID NO: 6452258 - DNA, 17 bp, Homo sapiens
tccctcgttttcaaaga

SEQ ID NO: 6452259 - DNA, 18 bp, Homo sapiens
tccctcgttttcaaagat

SEQ ID NO: 6452260 - DNA, 19 bp, Homo sapiens
tccctctaatgagactgac

SEQ ID NO: 6452261 - DNA, 16 bp, Homo sapiens
tccctctaatttatct

SEQ ID NO: 6452262 - DNA, 21 bp, Homo sapiens
tccctctacagagcttccctg

SEQ ID NO: 6452263 - DNA, 19 bp, Homo sapiens
tccctctactgagtaaacc

SEQ ID NO: 6452264 - DNA, 17 bp, Homo sapiens
tccctctactgggagcc

SEQ ID NO: 6452265 - DNA, 13 bp, Homo sapiens
tccctctatttat

SEQ ID NO: 6452266 - DNA, 19 bp, Homo sapiens
tccctctatttatgtttgc

SEQ ID NO: 6452267 - DNA, 14 bp, Homo sapiens
tccctctcacccag

SEQ ID NO: 6452268 - DNA, 15 bp, Homo sapiens
tccctctcactcccc

SEQ ID NO: 6452269 - DNA, 16 bp, Homo sapiens
tccctctcactcccca

SEQ ID NO: 6452270 - DNA, 21 bp, Homo sapiens
tccctctcagatacccagtgg

SEQ ID NO: 6452271 - DNA, 16 bp, Homo sapiens
tccctctcaggatcca

SEQ ID NO: 6452272 - DNA, 23 bp, Homo sapiens
tccctctcaggcatgcctgtgtg

SEQ ID NO: 6452273 - DNA, 15 bp, Homo sapiens
tccctctcagtgcct

SEQ ID NO: 6452274 - DNA, 19 bp, Homo sapiens
tccctctcagtgccttctc

SEQ ID NO: 6452275 - DNA, 14 bp, Homo sapiens
tccctctcatccag

SEQ ID NO: 6452276 - DNA, 17 bp, Homo sapiens
tccctctcatctcaggt

SEQ ID NO: 6452277 - DNA, 13 bp, Homo sapiens
tccctctcatgtc

SEQ ID NO: 6452278 - DNA, 17 bp, Homo sapiens
tccctctcatgtccctc

SEQ ID NO: 6452279 - DNA, 21 bp, Homo sapiens
tccctctcatgtccctccagg

SEQ ID NO: 6452280 - DNA, 23 bp, Homo sapiens
tccctctcatgtccctccaggga

SEQ ID NO: 6452281 - DNA, 15 bp, Homo sapiens
tccctctccactctt

SEQ ID NO: 6452282 - DNA, 20 bp, Homo sapiens
tccctctccactcttctctc

SEQ ID NO: 6452283 - DNA, 17 bp, Homo sapiens
tccctctccagcctgct

SEQ ID NO: 6452284 - DNA, 19 bp, Homo sapiens
tccctctccagcctgctgt

SEQ ID NO: 6452285 - DNA, 15 bp, Homo sapiens
tccctctcccaggcc

SEQ ID NO: 6452286 - DNA, 22 bp, Homo sapiens
tccctctcccccttaccccaca

SEQ ID NO: 6452287 - DNA, 23 bp, Homo sapiens
tccctctccccggacaagcccag

SEQ ID NO: 6452288 - DNA, 15 bp, Homo sapiens
tccctctcctctgtc

SEQ ID NO: 6452289 - DNA, 17 bp, Homo sapiens
tccctctcctgcccaga

SEQ ID NO: 6452290 - DNA, 14 bp, Homo sapiens
tccctctcctgcct

SEQ ID NO: 6452291 - DNA, 15 bp, Homo sapiens
tccctctcctgccta

SEQ ID NO: 6452292 - DNA, 19 bp, Homo sapiens
tccctctccttgcccccag

SEQ ID NO: 6452293 - DNA, 24 bp, Homo sapiens
tccctctccttgcccccagtgcct

SEQ ID NO: 6452294 - DNA, 21 bp, Homo sapiens
tccctctcgccctggccaggg

SEQ ID NO: 6452295 - DNA, 23 bp, Homo sapiens
tccctctcgccctggccagggcc

SEQ ID NO: 6452296 - DNA, 22 bp, Homo sapiens
tccctctcggaaggctggctgg

SEQ ID NO: 6452297 - DNA, 15 bp, Homo sapiens
tccctctctcactcc

SEQ ID NO: 6452298 - DNA, 16 bp, Homo sapiens
tccctctctcagcaca

SEQ ID NO: 6452299 - DNA, 21 bp, Homo sapiens
tccctctctcagcacagcctg

SEQ ID NO: 6452300 - DNA, 15 bp, Homo sapiens
tccctctctcagccc

SEQ ID NO: 6452301 - DNA, 13 bp, Homo sapiens
tccctctctcctg

SEQ ID NO: 6452302 - DNA, 14 bp, Homo sapiens
tccctctctcctgg

SEQ ID NO: 6452303 - DNA, 16 bp, Homo sapiens
tccctctctcctggac

SEQ ID NO: 6452304 - DNA, 17 bp, Homo sapiens
tccctctctctgactct

SEQ ID NO: 6452305 - DNA, 14 bp, Homo sapiens
tccctctctctgga

SEQ ID NO: 6452306 - DNA, 20 bp, Homo sapiens
tccctctctcttctgctcca

SEQ ID NO: 6452307 - DNA, 19 bp, Homo sapiens
tccctctctgatgtcccag

SEQ ID NO: 6452308 - DNA, 15 bp, Homo sapiens
tccctctctgccctc

SEQ ID NO: 6452309 - DNA, 15 bp, Homo sapiens
tccctctctgtgcat

SEQ ID NO: 6452310 - DNA, 16 bp, Homo sapiens
tccctctcttcccctt

SEQ ID NO: 6452311 - DNA, 21 bp, Homo sapiens
tccctctgagaattccaagga

SEQ ID NO: 6452312 - DNA, 11 bp, Homo sapiens
tccctctgagg

SEQ ID NO: 6452313 - DNA, 12 bp, Homo sapiens
tccctctgaggc

SEQ ID NO: 6452314 - DNA, 19 bp, Homo sapiens
tccctctgaggctgtagga

SEQ ID NO: 6452315 - DNA, 18 bp, Homo sapiens
tccctctgatttttcctt

SEQ ID NO: 6452316 - DNA, 22 bp, Homo sapiens
tccctctgcagtctctatacca

SEQ ID NO: 6452317 - DNA, 13 bp, Homo sapiens
tccctctgcattg

SEQ ID NO: 6452318 - DNA, 21 bp, Homo sapiens
tccctctgcattgacctggag

SEQ ID NO: 6452319 - DNA, 12 bp, Homo sapiens
tccctctgccag

SEQ ID NO: 6452320 - DNA, 20 bp, Homo sapiens
tccctctgccccaagcagcc

SEQ ID NO: 6452321 - DNA, 21 bp, Homo sapiens
tccctctgccccaagcagcca

SEQ ID NO: 6452322 - DNA, 14 bp, Homo sapiens
tccctctgccccgc

SEQ ID NO: 6452323 - DNA, 12 bp, Homo sapiens
tccctctgcctc

SEQ ID NO: 6452324 - DNA, 18 bp, Homo sapiens
tccctctgcctcatcctc

SEQ ID NO: 6452325 - DNA, 13 bp, Homo sapiens
tccctctgcctgg

SEQ ID NO: 6452326 - DNA, 15 bp, Homo sapiens
tccctctgcctggga

SEQ ID NO: 6452327 - DNA, 23 bp, Homo sapiens
tccctctgcctgggatgcccttc

SEQ ID NO: 6452328 - DNA, 12 bp, Homo sapiens
tccctctgctca

SEQ ID NO: 6452329 - DNA, 15 bp, Homo sapiens
tccctctgctcagcc

SEQ ID NO: 6452330 - DNA, 16 bp, Homo sapiens
tccctctgctcagcca

SEQ ID NO: 6452331 - DNA, 18 bp, Homo sapiens
tccctctgctcagccaag

SEQ ID NO: 6452332 - DNA, 21 bp, Homo sapiens
tccctctgctcagccaagctt

SEQ ID NO: 6452333 - DNA, 13 bp, Homo sapiens
tccctctgctccg

SEQ ID NO: 6452334 - DNA, 11 bp, Homo sapiens
tccctctgctg

SEQ ID NO: 6452335 - DNA, 13 bp, Homo sapiens
tccctctggagtt

SEQ ID NO: 6452336 - DNA, 17 bp, Homo sapiens
tccctctggagtttcat

SEQ ID NO: 6452337 - DNA, 19 bp, Homo sapiens
tccctctggcactccagaa

SEQ ID NO: 6452338 - DNA, 18 bp, Homo sapiens
tccctctgggccaatgct

SEQ ID NO: 6452339 - DNA, 15 bp, Homo sapiens
tccctctgggggctc

SEQ ID NO: 6452340 - DNA, 18 bp, Homo sapiens
tccctctgggggctctgg

SEQ ID NO: 6452341 - DNA, 19 bp, Homo sapiens
tccctctgggggctctggc

SEQ ID NO: 6452342 - DNA, 14 bp, Homo sapiens
tccctctggtccca

SEQ ID NO: 6452343 - DNA, 16 bp, Homo sapiens
tccctctggtcccaca

SEQ ID NO: 6452344 - DNA, 14 bp, Homo sapiens
tccctctggtctac

SEQ ID NO: 6452345 - DNA, 21 bp, Homo sapiens
tccctctggtctactctagaa

SEQ ID NO: 6452346 - DNA, 18 bp, Homo sapiens
tccctctgtcttttctcc

SEQ ID NO: 6452347 - DNA, 21 bp, Homo sapiens
tccctcttagtctaggtcctt

SEQ ID NO: 6452348 - DNA, 15 bp, Homo sapiens
tccctcttcactccc

SEQ ID NO: 6452349 - DNA, 21 bp, Homo sapiens
tccctcttcactgtggccaca

SEQ ID NO: 6452350 - DNA, 14 bp, Homo sapiens
tccctcttcccaga

SEQ ID NO: 6452351 - DNA, 14 bp, Homo sapiens
tccctcttccctct

SEQ ID NO: 6452352 - DNA, 16 bp, Homo sapiens
tccctcttccctctcc

SEQ ID NO: 6452353 - DNA, 16 bp, Homo sapiens
tccctcttccttcccc

SEQ ID NO: 6452354 - DNA, 23 bp, Homo sapiens
tccctcttccttccctgctgtga

SEQ ID NO: 6452355 - DNA, 13 bp, Homo sapiens
tccctcttctctc

SEQ ID NO: 6452356 - DNA, 19 bp, Homo sapiens
tccctcttctctcctcagt

SEQ ID NO: 6452357 - DNA, 14 bp, Homo sapiens
tccctcttctgccc

SEQ ID NO: 6452358 - DNA, 16 bp, Homo sapiens
tccctcttctttcaga

SEQ ID NO: 6452359 - DNA, 13 bp, Homo sapiens
tccctcttggtct

SEQ ID NO: 6452360 - DNA, 12 bp, Homo sapiens
tccctcttgtaa

SEQ ID NO: 6452361 - DNA, 13 bp, Homo sapiens
tccctcttgtaag

SEQ ID NO: 6452362 - DNA, 17 bp, Homo sapiens
tccctcttgtgctcagt

SEQ ID NO: 6452363 - DNA, 15 bp, Homo sapiens
tccctcttgttttgt

SEQ ID NO: 6452364 - DNA, 21 bp, Homo sapiens
tccctctttcatctcctgagt

SEQ ID NO: 6452365 - DNA, 16 bp, Homo sapiens
tccctctttcccaccc

SEQ ID NO: 6452366 - DNA, 17 bp, Homo sapiens
tccctctttccccacct

SEQ ID NO: 6452367 - DNA, 13 bp, Homo sapiens
tccctctttccct

SEQ ID NO: 6452368 - DNA, 21 bp, Homo sapiens
tccctctttccctcccttcct

SEQ ID NO: 6452369 - DNA, 12 bp, Homo sapiens
tccctctttcct

SEQ ID NO: 6452370 - DNA, 13 bp, Homo sapiens
tccctctttcctg

SEQ ID NO: 6452371 - DNA, 15 bp, Homo sapiens
tccctctttcctgtg

SEQ ID NO: 6452372 - DNA, 20 bp, Homo sapiens
tccctctttctacattctca

SEQ ID NO: 6452373 - DNA, 17 bp, Homo sapiens
tccctctttgcctgtgt

SEQ ID NO: 6452374 - DNA, 14 bp, Homo sapiens
tccctctttggcag

SEQ ID NO: 6452375 - DNA, 15 bp, Homo sapiens
tgacactagaaaact

SEQ ID NO: 6452376 - DNA, 18 bp, Homo sapiens
tgacactagcccaatgaa

SEQ ID NO: 6452377 - DNA, 18 bp, Homo sapiens
tgacactcaataaacagt

SEQ ID NO: 6452378 - DNA, 14 bp, Homo sapiens
tgacactcccttgg

SEQ ID NO: 6452379 - DNA, 19 bp, Homo sapiens
tgacactctccttgcagtt

SEQ ID NO: 6452380 - DNA, 21 bp, Homo sapiens
tgacactctcgtggtatgtat

SEQ ID NO: 6452381 - DNA, 12 bp, Homo sapiens
tgacactgaaag

SEQ ID NO: 6452382 - DNA, 22 bp, Homo sapiens
tgacactgaaagttttgtaaaa

SEQ ID NO: 6452383 - DNA, 13 bp, Homo sapiens
tgacactgaaatg

SEQ ID NO: 6452384 - DNA, 16 bp, Homo sapiens
tgacactgaaatgcct

SEQ ID NO: 6452385 - DNA, 18 bp, Homo sapiens
tgacactgaaatgcctta

SEQ ID NO: 6452386 - DNA, 22 bp, Homo sapiens
tgacactgaacttaataactgt

SEQ ID NO: 6452387 - DNA, 23 bp, Homo sapiens
tgacactgaccttggagagacac

SEQ ID NO: 6452388 - DNA, 17 bp, Homo sapiens
tgacactgagccccacc

SEQ ID NO: 6452389 - DNA, 18 bp, Homo sapiens
tgacactgagccccacct

SEQ ID NO: 6452390 - DNA, 16 bp, Homo sapiens
tgacactgcagcagaa

SEQ ID NO: 6452391 - DNA, 15 bp, Homo sapiens
tgacactgctctaac

SEQ ID NO: 6452392 - DNA, 21 bp, Homo sapiens
tgacactgctctaacagccct

SEQ ID NO: 6452393 - DNA, 17 bp, Homo sapiens
tgacactggaccaggtc

SEQ ID NO: 6452394 - DNA, 19 bp, Homo sapiens
tgacactggaccaggtcct

SEQ ID NO: 6452395 - DNA, 20 bp, Homo sapiens
tgacactggaccaggtcctg

SEQ ID NO: 6452396 - DNA, 19 bp, Homo sapiens
tgacactggtattcctgcc

SEQ ID NO: 6452397 - DNA, 21 bp, Homo sapiens
tgacactggtattcctgcctc

SEQ ID NO: 6452398 - DNA, 16 bp, Homo sapiens
tgacactgtccctctt

SEQ ID NO: 6452399 - DNA, 18 bp, Homo sapiens
tgacactgtccctctttg

SEQ ID NO: 6452400 - DNA, 16 bp, Homo sapiens
tgacactgtttcctga

SEQ ID NO: 6452401 - DNA, 19 bp, Homo sapiens
tgacactgtttcctgataa

SEQ ID NO: 6452402 - DNA, 15 bp, Homo sapiens
tgacactgttttcct

SEQ ID NO: 6452403 - DNA, 16 bp, Homo sapiens
tgacacttaaaaatgg

SEQ ID NO: 6452404 - DNA, 20 bp, Homo sapiens
tgacacttataaatatcctg

SEQ ID NO: 6452405 - DNA, 19 bp, Homo sapiens
tgacacttccaaagactcc

SEQ ID NO: 6452406 - DNA, 18 bp, Homo sapiens
tgacacttccattgttta

SEQ ID NO: 6452407 - DNA, 24 bp, Homo sapiens
tgacactttgaactcctcaagggc

SEQ ID NO: 6452408 - DNA, 21 bp, Homo sapiens
tgacacttttaaaaaacaaaa

SEQ ID NO: 6452409 - DNA, 19 bp, Homo sapiens
tgacacttttcatatcatt

SEQ ID NO: 6452410 - DNA, 14 bp, Homo sapiens
tgacactttttgta

SEQ ID NO: 6452411 - DNA, 22 bp, Homo sapiens
tgacactttttgtattttttcc

SEQ ID NO: 6452412 - DNA, 13 bp, Homo sapiens
tgacagaaaaaaa

SEQ ID NO: 6452413 - DNA, 23 bp, Homo sapiens
tgacagaaaaaaaaatgttttat

SEQ ID NO: 6452414 - DNA, 17 bp, Homo sapiens
tgacagaacacagatct

SEQ ID NO: 6452415 - DNA, 20 bp, Homo sapiens
tgacagaaggaccagccctt

SEQ ID NO: 6452416 - DNA, 15 bp, Homo sapiens
tgacagaaggtgcca

SEQ ID NO: 6452417 - DNA, 20 bp, Homo sapiens
tgacagaaggtgccacttta

SEQ ID NO: 6452418 - DNA, 18 bp, Homo sapiens
tgacagaatatacacatt

SEQ ID NO: 6452419 - DNA, 23 bp, Homo sapiens
tgacagaatatacacattttgta

SEQ ID NO: 6452420 - DNA, 16 bp, Homo sapiens
tgacagaatatgtttc

SEQ ID NO: 6452421 - DNA, 23 bp, Homo sapiens
tgacagaatatgtttcaaacttt

SEQ ID NO: 6452422 - DNA, 16 bp, Homo sapiens
tgacagaatcttgtat

SEQ ID NO: 6452423 - DNA, 16 bp, Homo sapiens
tgacagaatgctgttt

SEQ ID NO: 6452424 - DNA, 18 bp, Homo sapiens
tgacagaatgctgtttta

SEQ ID NO: 6452425 - DNA, 13 bp, Homo sapiens
tgacagaatggtg

SEQ ID NO: 6452426 - DNA, 19 bp, Homo sapiens
tgacagaatttgtgaatat

SEQ ID NO: 6452427 - DNA, 23 bp, Homo sapiens
tgacagaatttgtgaatatattt

SEQ ID NO: 6452428 - DNA, 16 bp, Homo sapiens
tgacagacacaggccc

SEQ ID NO: 6452429 - DNA, 23 bp, Homo sapiens
tgacagacacaggcccggctcca

SEQ ID NO: 6452430 - DNA, 15 bp, Homo sapiens
tgacagacaggctct

SEQ ID NO: 6452431 - DNA, 19 bp, Homo sapiens
tgacagacaggctcttagc

SEQ ID NO: 6452432 - DNA, 20 bp, Homo sapiens
tgacagacattttcaataat

SEQ ID NO: 6452433 - DNA, 18 bp, Homo sapiens
tgacagaccacatcttta

SEQ ID NO: 6452434 - DNA, 15 bp, Homo sapiens
tgacagactcactgg

SEQ ID NO: 6452435 - DNA, 19 bp, Homo sapiens
tgacagactcctgaggaca

SEQ ID NO: 6452436 - DNA, 21 bp, Homo sapiens
tgacagactttggacagtggc

SEQ ID NO: 6452437 - DNA, 14 bp, Homo sapiens
tgacagagacccag

SEQ ID NO: 6452438 - DNA, 19 bp, Homo sapiens
tgacagagacccagatctc

SEQ ID NO: 6452439 - DNA, 14 bp, Homo sapiens
tgacagagagttct

SEQ ID NO: 6452440 - DNA, 21 bp, Homo sapiens
tgacagagcaagactctgtct

SEQ ID NO: 6452441 - DNA, 22 bp, Homo sapiens
tgacagagcaagcgaaagagca

SEQ ID NO: 6452442 - DNA, 23 bp, Homo sapiens
tgacagagcaagcgaaagagcaa

SEQ ID NO: 6452443 - DNA, 20 bp, Homo sapiens
tgacagagccatatgtaccc

SEQ ID NO: 6452444 - DNA, 13 bp, Homo sapiens
tgacagagccatg

SEQ ID NO: 6452445 - DNA, 12 bp, Homo sapiens
tgacagagccct

SEQ ID NO: 6452446 - DNA, 14 bp, Homo sapiens
tgacagagcctgcc

SEQ ID NO: 6452447 - DNA, 22 bp, Homo sapiens
tgacagagccttctgaggacat

SEQ ID NO: 6452448 - DNA, 23 bp, Homo sapiens
tgacagaggaggatgtaaggcct

SEQ ID NO: 6452449 - DNA, 15 bp, Homo sapiens
tgacagaggcagccc

SEQ ID NO: 6452450 - DNA, 16 bp, Homo sapiens
tgacagaggcagcccc

SEQ ID NO: 6452451 - DNA, 18 bp, Homo sapiens
tgacagaggcagccccat

SEQ ID NO: 6452452 - DNA, 23 bp, Homo sapiens
tgacagaggcagccccattctgc

SEQ ID NO: 6452453 - DNA, 14 bp, Homo sapiens
tgacagaggctgca

SEQ ID NO: 6452454 - DNA, 22 bp, Homo sapiens
tgacagagggatggaggaagaa

SEQ ID NO: 6452455 - DNA, 15 bp, Homo sapiens
tgacagataaatcct

SEQ ID NO: 6452456 - DNA, 16 bp, Homo sapiens
tgacagataaatcctt

SEQ ID NO: 6452457 - DNA, 22 bp, Homo sapiens
tgacagataaatccttaacatt

SEQ ID NO: 6452458 - DNA, 17 bp, Homo sapiens
tgacagataacctaata

SEQ ID NO: 6452459 - DNA, 17 bp, Homo sapiens
tgacagatcaagctgtg

SEQ ID NO: 6452460 - DNA, 14 bp, Homo sapiens
tgacagatcacagg

SEQ ID NO: 6452461 - DNA, 18 bp, Homo sapiens
tgacagatgccaacttcc

SEQ ID NO: 6452462 - DNA, 19 bp, Homo sapiens
tgacagatgtcagccgagc

SEQ ID NO: 6452463 - DNA, 15 bp, Homo sapiens
tgacagatgttattt

SEQ ID NO: 6452464 - DNA, 19 bp, Homo sapiens
tgacagatgttgaatgccc

SEQ ID NO: 6452465 - DNA, 13 bp, Homo sapiens
tgacagattctga

SEQ ID NO: 6452466 - DNA, 14 bp, Homo sapiens
tgacagattctgac

SEQ ID NO: 6452467 - DNA, 15 bp, Homo sapiens
tgacagattctgaca

SEQ ID NO: 6452468 - DNA, 22 bp, Homo sapiens
tgacagattctgacatttatat

SEQ ID NO: 6452469 - DNA, 14 bp, Homo sapiens
tgacagattgaatt

SEQ ID NO: 6452470 - DNA, 16 bp, Homo sapiens
tgacagatttctgtaa

SEQ ID NO: 6452471 - DNA, 22 bp, Homo sapiens
tgacagcaaaatgttgaagaaa

SEQ ID NO: 6452472 - DNA, 21 bp, Homo sapiens
tgacagcaattcatggttcaa

SEQ ID NO: 6452473 - DNA, 12 bp, Homo sapiens
tgacagcagcat

SEQ ID NO: 6452474 - DNA, 16 bp, Homo sapiens
tgacagcagcctgtga

SEQ ID NO: 6452475 - DNA, 17 bp, Homo sapiens
tgacagcagcctgtgag

SEQ ID NO: 6452476 - DNA, 19 bp, Homo sapiens
tgacagcagcctgtgaggg

SEQ ID NO: 6452477 - DNA, 23 bp, Homo sapiens
tgacagcagcctgtgagggagtg

SEQ ID NO: 6452478 - DNA, 22 bp, Homo sapiens
tgacagcatgaggtgttgtgca

SEQ ID NO: 6452479 - DNA, 20 bp, Homo sapiens
tgacagcatttcagctgtga

SEQ ID NO: 6452480 - DNA, 14 bp, Homo sapiens
tgacagccagagcc

SEQ ID NO: 6452481 - DNA, 15 bp, Homo sapiens
tgacagccagagcct

SEQ ID NO: 6452482 - DNA, 19 bp, Homo sapiens
tgacagcccatgggaatgc

SEQ ID NO: 6452483 - DNA, 17 bp, Homo sapiens
tgacagcctccaccttg

SEQ ID NO: 6452484 - DNA, 12 bp, Homo sapiens
tgacagcctccc

SEQ ID NO: 6452485 - DNA, 17 bp, Homo sapiens
tgacagcctcccacccc

SEQ ID NO: 6452486 - DNA, 15 bp, Homo sapiens
tgacagcctcctagg

SEQ ID NO: 6452487 - DNA, 23 bp, Homo sapiens
tgacagcctcctaggctccctga

SEQ ID NO: 6452488 - DNA, 13 bp, Homo sapiens
tgacagcctctga

SEQ ID NO: 6452489 - DNA, 15 bp, Homo sapiens
tgacagcctgcagca

SEQ ID NO: 6452490 - DNA, 14 bp, Homo sapiens
tgacagccttgccc

SEQ ID NO: 6452491 - DNA, 18 bp, Homo sapiens
tgacagcgacagaaaacc

SEQ ID NO: 6452492 - DNA, 17 bp, Homo sapiens
tgacagcgatggcaggc

SEQ ID NO: 6452493 - DNA, 20 bp, Homo sapiens
tgacagcgatggcaggcctg

SEQ ID NO: 6452494 - DNA, 18 bp, Homo sapiens
tgacagcgccatgtgtgt

SEQ ID NO: 6452495 - DNA, 21 bp, Homo sapiens
tgacagctactaacctggaga

SEQ ID NO: 6452496 - DNA, 18 bp, Homo sapiens
tgacagctcttctaagga

SEQ ID NO: 6452497 - DNA, 15 bp, Homo sapiens
tgacagctgctccta

SEQ ID NO: 6452498 - DNA, 23 bp, Homo sapiens
tgacagctgctcctagagggagg

SEQ ID NO: 6452499 - DNA, 15 bp, Homo sapiens
tgacagctgtccctg

SEQ ID NO: 6452500 - DNA, 17 bp, Homo sapiens
tgacagctgtccctgtc

SEQ ID NO: 6452501 - DNA, 13 bp, Homo sapiens
tgacagctgtcct

SEQ ID NO: 6452502 - DNA, 16 bp, Homo sapiens
tgacagctgtgctgta

SEQ ID NO: 6452503 - DNA, 13 bp, Homo sapiens
tgacagctgttcc

SEQ ID NO: 6452504 - DNA, 18 bp, Homo sapiens
tgacagcttgagaaggtc

SEQ ID NO: 6452505 - DNA, 14 bp, Homo sapiens
tgacagctttgctg

SEQ ID NO: 6452506 - DNA, 16 bp, Homo sapiens
tgacagctttgctgct

SEQ ID NO: 6452507 - DNA, 20 bp, Homo sapiens
tgacagctttgctgctgaag

SEQ ID NO: 6452508 - DNA, 21 bp, Homo sapiens
tgacaggaaagccctccccct

SEQ ID NO: 6452509 - DNA, 13 bp, Homo sapiens
tgacaggaacctt

SEQ ID NO: 6452510 - DNA, 16 bp, Homo sapiens
tgacaggaagactgga

SEQ ID NO: 6452511 - DNA, 23 bp, Homo sapiens
tgacaggaagcccaaggcagtgt

SEQ ID NO: 6452512 - DNA, 18 bp, Homo sapiens
tgacaggaattctccctg

SEQ ID NO: 6452513 - DNA, 15 bp, Homo sapiens
tgacaggacatttga

SEQ ID NO: 6452514 - DNA, 16 bp, Homo sapiens
tgacaggacgctgacc

SEQ ID NO: 6452515 - DNA, 18 bp, Homo sapiens
tgacaggatgtggcactg

SEQ ID NO: 6452516 - DNA, 20 bp, Homo sapiens
tgacaggatgtggcactgct

SEQ ID NO: 6452517 - DNA, 20 bp, Homo sapiens
tgacaggattccctccacaa

SEQ ID NO: 6452518 - DNA, 17 bp, Homo sapiens
tgacaggcaatgctggc

SEQ ID NO: 6452519 - DNA, 20 bp, Homo sapiens
tgacaggcaatgctggctgt

SEQ ID NO: 6452520 - DNA, 13 bp, Homo sapiens
tgacaggcagcag

SEQ ID NO: 6452521 - DNA, 14 bp, Homo sapiens
tgacaggcccagtg

SEQ ID NO: 6452522 - DNA, 20 bp, Homo sapiens
tgacaggcccagtggaacag

SEQ ID NO: 6452523 - DNA, 15 bp, Homo sapiens
tgacaggccttcctc

SEQ ID NO: 6452524 - DNA, 18 bp, Homo sapiens
tgacaggcgaaagaaaac

SEQ ID NO: 6452525 - DNA, 20 bp, Homo sapiens
tgacaggctctcctggctgt

SEQ ID NO: 6452526 - DNA, 19 bp, Homo sapiens
tgacagggaagctacaggt

SEQ ID NO: 6452527 - DNA, 21 bp, Homo sapiens
tgacagggaagctacaggtta

SEQ ID NO: 6452528 - DNA, 19 bp, Homo sapiens
tgacagggacatgccctgt

SEQ ID NO: 6452529 - DNA, 11 bp, Homo sapiens
tgacagggcca

SEQ ID NO: 6452530 - DNA, 12 bp, Homo sapiens
tgacagggccag

SEQ ID NO: 6452531 - DNA, 13 bp, Homo sapiens
tgacagggccagt

SEQ ID NO: 6452532 - DNA, 17 bp, Homo sapiens
tgacagggccagtgggg

SEQ ID NO: 6452533 - DNA, 20 bp, Homo sapiens
tgacagggcccagttaaata

SEQ ID NO: 6452534 - DNA, 21 bp, Homo sapiens
tgacagggcgggggtggcggc

SEQ ID NO: 6452535 - DNA, 16 bp, Homo sapiens
tgacaggtaatgaagc

SEQ ID NO: 6452536 - DNA, 16 bp, Homo sapiens
tgacaggtcagcagta

SEQ ID NO: 6452537 - DNA, 18 bp, Homo sapiens
tgacaggtgatgctctgg

SEQ ID NO: 6452538 - DNA, 19 bp, Homo sapiens
tgacaggtgatgctctggc

SEQ ID NO: 6452539 - DNA, 17 bp, Homo sapiens
tgacaggttcccagcag

SEQ ID NO: 6452540 - DNA, 20 bp, Homo sapiens
tgacaggttcccagcagctg

SEQ ID NO: 6452541 - DNA, 14 bp, Homo sapiens
tgacaggttttcca

SEQ ID NO: 6452542 - DNA, 23 bp, Homo sapiens
tgacagtaacaaaattgacagct

SEQ ID NO: 6452543 - DNA, 17 bp, Homo sapiens
tgacagtaacttggtta

SEQ ID NO: 6452544 - DNA, 21 bp, Homo sapiens
tgacagtaacttggttataca

SEQ ID NO: 6452545 - DNA, 16 bp, Homo sapiens
tgacagtaagtttatt

SEQ ID NO: 6452546 - DNA, 22 bp, Homo sapiens
tgacagtaatattggcatagaa

SEQ ID NO: 6452547 - DNA, 22 bp, Homo sapiens
tgacagtaattgtgtttacatt

SEQ ID NO: 6452548 - DNA, 15 bp, Homo sapiens
tgacagtagctctta

SEQ ID NO: 6452549 - DNA, 18 bp, Homo sapiens
tgacagtatcttttttcc

SEQ ID NO: 6452550 - DNA, 21 bp, Homo sapiens
tgacagtattatacgctggca

SEQ ID NO: 6452551 - DNA, 19 bp, Homo sapiens
tgacagtcactgcatttgc

SEQ ID NO: 6452552 - DNA, 18 bp, Homo sapiens
tccctctttggctcccct

SEQ ID NO: 6452553 - DNA, 10 bp, Homo sapiens
tccctctttt

SEQ ID NO: 6452554 - DNA, 22 bp, Homo sapiens
tccctcttttcttactcctcct

SEQ ID NO: 6452555 - DNA, 17 bp, Homo sapiens
tccctgaaaacccagag

SEQ ID NO: 6452556 - DNA, 20 bp, Homo sapiens
tccctgaaaacccagagagg

SEQ ID NO: 6452557 - DNA, 13 bp, Homo sapiens
tccctgaaacacg

SEQ ID NO: 6452558 - DNA, 21 bp, Homo sapiens
tccctgaaacacgaaacttgt

SEQ ID NO: 6452559 - DNA, 16 bp, Homo sapiens
tccctgaaacactgct

SEQ ID NO: 6452560 - DNA, 17 bp, Homo sapiens
tccctgaaacattgcat

SEQ ID NO: 6452561 - DNA, 22 bp, Homo sapiens
tccctgaaactgagtctgtgga

SEQ ID NO: 6452562 - DNA, 18 bp, Homo sapiens
tccctgaacactcatccc

SEQ ID NO: 6452563 - DNA, 16 bp, Homo sapiens
tccctgaacatagttt

SEQ ID NO: 6452564 - DNA, 18 bp, Homo sapiens
tccctgaacatctgtgtg

SEQ ID NO: 6452565 - DNA, 20 bp, Homo sapiens
tccctgaacccctggccagc

SEQ ID NO: 6452566 - DNA, 18 bp, Homo sapiens
tccctgaacgccctggta

SEQ ID NO: 6452567 - DNA, 18 bp, Homo sapiens
tccctgaacgttttcttc

SEQ ID NO: 6452568 - DNA, 19 bp, Homo sapiens
tccctgaacgttttcttct

SEQ ID NO: 6452569 - DNA, 14 bp, Homo sapiens
tccctgaactggga

SEQ ID NO: 6452570 - DNA, 19 bp, Homo sapiens
tccctgaagagacaggcac

SEQ ID NO: 6452571 - DNA, 20 bp, Homo sapiens
tccctgaagctatgtctcta

SEQ ID NO: 6452572 - DNA, 15 bp, Homo sapiens
tccctgaaggccccg

SEQ ID NO: 6452573 - DNA, 18 bp, Homo sapiens
tccctgaaggccccgccc

SEQ ID NO: 6452574 - DNA, 16 bp, Homo sapiens
tccctgaagtcttgca

SEQ ID NO: 6452575 - DNA, 19 bp, Homo sapiens
tccctgaatctgaccacag

SEQ ID NO: 6452576 - DNA, 21 bp, Homo sapiens
tccctgaatctgaccacagac

SEQ ID NO: 6452577 - DNA, 18 bp, Homo sapiens
tccctgaattaaggtaat

SEQ ID NO: 6452578 - DNA, 23 bp, Homo sapiens
tccctgacactgcggggcttggc

SEQ ID NO: 6452579 - DNA, 23 bp, Homo sapiens
tccctgaccaccctgcctgtgga

SEQ ID NO: 6452580 - DNA, 11 bp, Homo sapiens
tccctgaccat

SEQ ID NO: 6452581 - DNA, 16 bp, Homo sapiens
tccctgaccccctgtc

SEQ ID NO: 6452582 - DNA, 17 bp, Homo sapiens
tccctgaccctgctcct

SEQ ID NO: 6452583 - DNA, 17 bp, Homo sapiens
tccctgacctccctcta

SEQ ID NO: 6452584 - DNA, 21 bp, Homo sapiens
tccctgacctccctctaattt

SEQ ID NO: 6452585 - DNA, 21 bp, Homo sapiens
tccctgaccttagcgttctgg

SEQ ID NO: 6452586 - DNA, 23 bp, Homo sapiens
tccctgaccttagcgttctggac

SEQ ID NO: 6452587 - DNA, 15 bp, Homo sapiens
tccctgaccttctcc

SEQ ID NO: 6452588 - DNA, 19 bp, Homo sapiens
tccctgactccctgtgggg

SEQ ID NO: 6452589 - DNA, 17 bp, Homo sapiens
tccctgactctctgtga

SEQ ID NO: 6452590 - DNA, 12 bp, Homo sapiens
tccctgactggg

SEQ ID NO: 6452591 - DNA, 23 bp, Homo sapiens
tccctgactgggggcagacatgg

SEQ ID NO: 6452592 - DNA, 18 bp, Homo sapiens
tccctgacttcccagctg

SEQ ID NO: 6452593 - DNA, 19 bp, Homo sapiens
tccctgacttcccagctgg

SEQ ID NO: 6452594 - DNA, 14 bp, Homo sapiens
tccctgacttctcc

SEQ ID NO: 6452595 - DNA, 15 bp, Homo sapiens
tccctgacttctccc

SEQ ID NO: 6452596 - DNA, 16 bp, Homo sapiens
tccctgacttctcccc

SEQ ID NO: 6452597 - DNA, 16 bp, Homo sapiens
tccctgacttgcttta

SEQ ID NO: 6452598 - DNA, 21 bp, Homo sapiens
tccctgagaaacccaccagcc

SEQ ID NO: 6452599 - DNA, 20 bp, Homo sapiens
tccctgagagtgtctctgat

SEQ ID NO: 6452600 - DNA, 13 bp, Homo sapiens
tccctgagatggg

SEQ ID NO: 6452601 - DNA, 18 bp, Homo sapiens
tccctgagcagtctactt

SEQ ID NO: 6452602 - DNA, 22 bp, Homo sapiens
tccctgagcagtctacttctgt

SEQ ID NO: 6452603 - DNA, 13 bp, Homo sapiens
tccctgagcctgc

SEQ ID NO: 6452604 - DNA, 14 bp, Homo sapiens
tccctgagcctgcc

SEQ ID NO: 6452605 - DNA, 20 bp, Homo sapiens
tccctgagcctgccccagct

SEQ ID NO: 6452606 - DNA, 14 bp, Homo sapiens
tccctgagctttgg

SEQ ID NO: 6452607 - DNA, 14 bp, Homo sapiens
tccctgaggatggg

SEQ ID NO: 6452608 - DNA, 23 bp, Homo sapiens
tccctgagggcccttcccaacct

SEQ ID NO: 6452609 - DNA, 20 bp, Homo sapiens
tccctgaggtacctttccac

SEQ ID NO: 6452610 - DNA, 23 bp, Homo sapiens
tccctgaggtacctttccaccca

SEQ ID NO: 6452611 - DNA, 16 bp, Homo sapiens
tccctgaggtcacctg

SEQ ID NO: 6452612 - DNA, 15 bp, Homo sapiens
tccctgagtctggac

SEQ ID NO: 6452613 - DNA, 20 bp, Homo sapiens
tccctgagtctggacctcca

SEQ ID NO: 6452614 - DNA, 17 bp, Homo sapiens
tccctgagttcactctc

SEQ ID NO: 6452615 - DNA, 15 bp, Homo sapiens
tccctgataaatatt

SEQ ID NO: 6452616 - DNA, 19 bp, Homo sapiens
tccctgataacaacctgga

SEQ ID NO: 6452617 - DNA, 18 bp, Homo sapiens
tccctgatcaagcttcag

SEQ ID NO: 6452618 - DNA, 15 bp, Homo sapiens
tccctgatggaccct

SEQ ID NO: 6452619 - DNA, 12 bp, Homo sapiens
tccctgatgtac

SEQ ID NO: 6452620 - DNA, 16 bp, Homo sapiens
tccctgattaaagtgc

SEQ ID NO: 6452621 - DNA, 18 bp, Homo sapiens
tccctgattaaagtgcct

SEQ ID NO: 6452622 - DNA, 22 bp, Homo sapiens
tccctgattaaagtgccttcag

SEQ ID NO: 6452623 - DNA, 22 bp, Homo sapiens
tccctgattctctctccatttg

SEQ ID NO: 6452624 - DNA, 16 bp, Homo sapiens
tccctgattgacctgc

SEQ ID NO: 6452625 - DNA, 19 bp, Homo sapiens
tccctgattgacctgctcc

SEQ ID NO: 6452626 - DNA, 20 bp, Homo sapiens
tccctgattgacctgctccg

SEQ ID NO: 6452627 - DNA, 13 bp, Homo sapiens
tccctgatttaat

SEQ ID NO: 6452628 - DNA, 20 bp, Homo sapiens
tccctgcaaaactccaggca

SEQ ID NO: 6452629 - DNA, 21 bp, Homo sapiens
tccctgcaaaactccaggcag

SEQ ID NO: 6452630 - DNA, 20 bp, Homo sapiens
tccctgcaaccaattgaaaa

SEQ ID NO: 6452631 - DNA, 13 bp, Homo sapiens
tccctgcaagctc

SEQ ID NO: 6452632 - DNA, 18 bp, Homo sapiens
tccctgcaagctccgcct

SEQ ID NO: 6452633 - DNA, 22 bp, Homo sapiens
tccctgcaagctccgcctcccg

SEQ ID NO: 6452634 - DNA, 12 bp, Homo sapiens
tccctgcaaggt

SEQ ID NO: 6452635 - DNA, 16 bp, Homo sapiens
tccctgcaataaaatg

SEQ ID NO: 6452636 - DNA, 15 bp, Homo sapiens
tccctgcacaagcca

SEQ ID NO: 6452637 - DNA, 16 bp, Homo sapiens
tccctgcacaagccag

SEQ ID NO: 6452638 - DNA, 18 bp, Homo sapiens
tccctgcacacacatgca

SEQ ID NO: 6452639 - DNA, 15 bp, Homo sapiens
tccctgcaccctgga

SEQ ID NO: 6452640 - DNA, 20 bp, Homo sapiens
tccctgcaccgccgcagaag

SEQ ID NO: 6452641 - DNA, 23 bp, Homo sapiens
tccctgcaccgccgcagaagcag

SEQ ID NO: 6452642 - DNA, 23 bp, Homo sapiens
tccctgcactaaagccagcctga

SEQ ID NO: 6452643 - DNA, 20 bp, Homo sapiens
tccctgcactccctcctgga

SEQ ID NO: 6452644 - DNA, 15 bp, Homo sapiens
tccctgcactgtgcc

SEQ ID NO: 6452645 - DNA, 15 bp, Homo sapiens
tccctgcacttcatc

SEQ ID NO: 6452646 - DNA, 14 bp, Homo sapiens
tccctgcacttgca

SEQ ID NO: 6452647 - DNA, 20 bp, Homo sapiens
tccctgcagacctcaagcca

SEQ ID NO: 6452648 - DNA, 15 bp, Homo sapiens
tccctgcagccacca

SEQ ID NO: 6452649 - DNA, 14 bp, Homo sapiens
tccctgcagggtag

SEQ ID NO: 6452650 - DNA, 15 bp, Homo sapiens
tccctgcagggtagg

SEQ ID NO: 6452651 - DNA, 17 bp, Homo sapiens
tccctgcatatgcttct

SEQ ID NO: 6452652 - DNA, 18 bp, Homo sapiens
tccctgcatatgcttctg

SEQ ID NO: 6452653 - DNA, 19 bp, Homo sapiens
tccctgcatccaatctgct

SEQ ID NO: 6452654 - DNA, 16 bp, Homo sapiens
tccctgcatctgacca

SEQ ID NO: 6452655 - DNA, 18 bp, Homo sapiens
tccctgcatctgaccagc

SEQ ID NO: 6452656 - DNA, 21 bp, Homo sapiens
tccctgcatctgaccagcagc

SEQ ID NO: 6452657 - DNA, 20 bp, Homo sapiens
tccctgcatggcatcctcca

SEQ ID NO: 6452658 - DNA, 17 bp, Homo sapiens
tccctgcatttctgagt

SEQ ID NO: 6452659 - DNA, 20 bp, Homo sapiens
tccctgccaagaactctggg

SEQ ID NO: 6452660 - DNA, 22 bp, Homo sapiens
tccctgccaagtctcagaagag

SEQ ID NO: 6452661 - DNA, 16 bp, Homo sapiens
tccctgccacatacag

SEQ ID NO: 6452662 - DNA, 21 bp, Homo sapiens
tccctgccacatacaggtgct

SEQ ID NO: 6452663 - DNA, 18 bp, Homo sapiens
tccctgccacatccagct

SEQ ID NO: 6452664 - DNA, 22 bp, Homo sapiens
tccctgccaccaggcactgcct

SEQ ID NO: 6452665 - DNA, 18 bp, Homo sapiens
tccctgccactgggctct

SEQ ID NO: 6452666 - DNA, 20 bp, Homo sapiens
tccctgccactgggctctgg

SEQ ID NO: 6452667 - DNA, 22 bp, Homo sapiens
tccctgccactgggctctggac

SEQ ID NO: 6452668 - DNA, 22 bp, Homo sapiens
tccctgccacttcaacccccag

SEQ ID NO: 6452669 - DNA, 15 bp, Homo sapiens
tccctgccagcaccc

SEQ ID NO: 6452670 - DNA, 13 bp, Homo sapiens
tccctgccagctc

SEQ ID NO: 6452671 - DNA, 23 bp, Homo sapiens
tccctgccatccccctctcacgc

SEQ ID NO: 6452672 - DNA, 16 bp, Homo sapiens
tccctgcccaaaccct

SEQ ID NO: 6452673 - DNA, 20 bp, Homo sapiens
tccctgcccaaactcccctt

SEQ ID NO: 6452674 - DNA, 23 bp, Homo sapiens
tccctgcccagaattcccagctg

SEQ ID NO: 6452675 - DNA, 17 bp, Homo sapiens
tccctgcccagcctgtg

SEQ ID NO: 6452676 - DNA, 12 bp, Homo sapiens
tccctgcccagg

SEQ ID NO: 6452677 - DNA, 21 bp, Homo sapiens
tccctgcccatccgtctgtct

SEQ ID NO: 6452678 - DNA, 16 bp, Homo sapiens
tccctgccccaccacg

SEQ ID NO: 6452679 - DNA, 17 bp, Homo sapiens
tccctgccccgcccccc

SEQ ID NO: 6452680 - DNA, 19 bp, Homo sapiens
tccctgcccctcccttcaa

SEQ ID NO: 6452681 - DNA, 19 bp, Homo sapiens
tccctgcccctctctgcct

SEQ ID NO: 6452682 - DNA, 13 bp, Homo sapiens
tccctgcccctgt

SEQ ID NO: 6452683 - DNA, 15 bp, Homo sapiens
tccctgccctcatct

SEQ ID NO: 6452684 - DNA, 16 bp, Homo sapiens
tccctgccctcatctc

SEQ ID NO: 6452685 - DNA, 17 bp, Homo sapiens
tccctgccctcatctct

SEQ ID NO: 6452686 - DNA, 12 bp, Homo sapiens
tccctgccctcc

SEQ ID NO: 6452687 - DNA, 20 bp, Homo sapiens
tccctgccctcgggtctccc

SEQ ID NO: 6452688 - DNA, 22 bp, Homo sapiens
tccctgccctgtcctccagctt

SEQ ID NO: 6452689 - DNA, 14 bp, Homo sapiens
tccctgccgcctca

SEQ ID NO: 6452690 - DNA, 17 bp, Homo sapiens
tccctgcctaggagctg

SEQ ID NO: 6452691 - DNA, 19 bp, Homo sapiens
tccctgcctaggagctggg

SEQ ID NO: 6452692 - DNA, 12 bp, Homo sapiens
tccctgcctcac

SEQ ID NO: 6452693 - DNA, 13 bp, Homo sapiens
tccctgcctcaca

SEQ ID NO: 6452694 - DNA, 17 bp, Homo sapiens
tccctgcctcacatctc

SEQ ID NO: 6452695 - DNA, 18 bp, Homo sapiens
tccctgcctcacatctcc

SEQ ID NO: 6452696 - DNA, 17 bp, Homo sapiens
tccctgcctcaggcctc

SEQ ID NO: 6452697 - DNA, 18 bp, Homo sapiens
tccctgcctcaggcctct

SEQ ID NO: 6452698 - DNA, 20 bp, Homo sapiens
tccctgcctcaggcctctgt

SEQ ID NO: 6452699 - DNA, 17 bp, Homo sapiens
tccctgcctccacccac

SEQ ID NO: 6452700 - DNA, 19 bp, Homo sapiens
tccctgcctccacccacag

SEQ ID NO: 6452701 - DNA, 20 bp, Homo sapiens
tccctgcctccacccacagt

SEQ ID NO: 6452702 - DNA, 18 bp, Homo sapiens
tccctgcctcctgccggc

SEQ ID NO: 6452703 - DNA, 16 bp, Homo sapiens
tccctgcctcctgcct

SEQ ID NO: 6452704 - DNA, 17 bp, Homo sapiens
tccctgcctcctgccta

SEQ ID NO: 6452705 - DNA, 19 bp, Homo sapiens
tccctgcctcctgcctatg

SEQ ID NO: 6452706 - DNA, 17 bp, Homo sapiens
tccctgcctctcatcaa

SEQ ID NO: 6452707 - DNA, 23 bp, Homo sapiens
tccctgcctctcatcaactgaat

SEQ ID NO: 6452708 - DNA, 14 bp, Homo sapiens
tccctgcctgaggg

SEQ ID NO: 6452709 - DNA, 18 bp, Homo sapiens
tccctgcctgctccttgg

SEQ ID NO: 6452710 - DNA, 12 bp, Homo sapiens
tccctgcctgga

SEQ ID NO: 6452711 - DNA, 13 bp, Homo sapiens
tccctgcctggac

SEQ ID NO: 6452712 - DNA, 20 bp, Homo sapiens
tccctgcctggcggcagggg

SEQ ID NO: 6452713 - DNA, 11 bp, Homo sapiens
tccctgcctgt

SEQ ID NO: 6452714 - DNA, 15 bp, Homo sapiens
tccctgcctgtggcc

SEQ ID NO: 6452715 - DNA, 18 bp, Homo sapiens
tccctgcctgtggcccct

SEQ ID NO: 6452716 - DNA, 22 bp, Homo sapiens
tccctgcctgtggcccctcccc

SEQ ID NO: 6452717 - DNA, 15 bp, Homo sapiens
tccctgccttgctga

SEQ ID NO: 6452718 - DNA, 17 bp, Homo sapiens
tccctgccttgctgaca

SEQ ID NO: 6452719 - DNA, 19 bp, Homo sapiens
tccctgccttgctgacaat

SEQ ID NO: 6452720 - DNA, 22 bp, Homo sapiens
tccctgccttgctgacaataaa

SEQ ID NO: 6452721 - DNA, 15 bp, Homo sapiens
tccctgcgacggagg

SEQ ID NO: 6452722 - DNA, 23 bp, Homo sapiens
tccctgcgagacgcacacagctg

SEQ ID NO: 6452723 - DNA, 17 bp, Homo sapiens
tccctgcgcaccaggct

SEQ ID NO: 6452724 - DNA, 21 bp, Homo sapiens
tccctgcgcctgtgatgctgg

SEQ ID NO: 6452725 - DNA, 16 bp, Homo sapiens
tccctgcgcctttcct

SEQ ID NO: 6452726 - DNA, 16 bp, Homo sapiens
tccctgcgcttcatct

SEQ ID NO: 6452727 - DNA, 18 bp, Homo sapiens
tccctgcggaagccacag

SEQ ID NO: 6452728 - DNA, 21 bp, Homo sapiens
tccctgctacctgatttcagc

SEQ ID NO: 6452729 - DNA, 22 bp, Homo sapiens
tgacagtcactgcatttgcctg

SEQ ID NO: 6452730 - DNA, 18 bp, Homo sapiens
tgacagtcatcatcaggg

SEQ ID NO: 6452731 - DNA, 20 bp, Homo sapiens
tgacagtcatcatcagggcc

SEQ ID NO: 6452732 - DNA, 21 bp, Homo sapiens
tgacagtcatcatcagggcct

SEQ ID NO: 6452733 - DNA, 11 bp, Homo sapiens
tgacagtcctc

SEQ ID NO: 6452734 - DNA, 15 bp, Homo sapiens
tgacagtcctctcca

SEQ ID NO: 6452735 - DNA, 16 bp, Homo sapiens
tgacagtgaaacaaat

SEQ ID NO: 6452736 - DNA, 21 bp, Homo sapiens
tgacagtgacacccagaggga

SEQ ID NO: 6452737 - DNA, 22 bp, Homo sapiens
tgacagtgacgtgactcagagc

SEQ ID NO: 6452738 - DNA, 19 bp, Homo sapiens
tgacagtgaggtcctgggg

SEQ ID NO: 6452739 - DNA, 12 bp, Homo sapiens
tgacagtgcctt

SEQ ID NO: 6452740 - DNA, 16 bp, Homo sapiens
tgacagtgcttgcatc

SEQ ID NO: 6452741 - DNA, 20 bp, Homo sapiens
tgacagtgcttgcatcctat

SEQ ID NO: 6452742 - DNA, 16 bp, Homo sapiens
tgacagtggaactaca

SEQ ID NO: 6452743 - DNA, 18 bp, Homo sapiens
tgacagtggcgtttgtaa

SEQ ID NO: 6452744 - DNA, 17 bp, Homo sapiens
tgacagtggctgctctg

SEQ ID NO: 6452745 - DNA, 19 bp, Homo sapiens
tgacagtggctgctctggg

SEQ ID NO: 6452746 - DNA, 17 bp, Homo sapiens
tgacagtggttatattt

SEQ ID NO: 6452747 - DNA, 19 bp, Homo sapiens
tgacagtggttatatttca

SEQ ID NO: 6452748 - DNA, 20 bp, Homo sapiens
tgacagtgtgggacaggctc

SEQ ID NO: 6452749 - DNA, 17 bp, Homo sapiens
tgacagtgttatcccaa

SEQ ID NO: 6452750 - DNA, 14 bp, Homo sapiens
tgacagtgttttta

SEQ ID NO: 6452751 - DNA, 13 bp, Homo sapiens
tgacagttatttt

SEQ ID NO: 6452752 - DNA, 14 bp, Homo sapiens
tgacagttcccaga

SEQ ID NO: 6452753 - DNA, 18 bp, Homo sapiens
tgacagttcccagagtgg

SEQ ID NO: 6452754 - DNA, 17 bp, Homo sapiens
tgacagttctgaagaat

SEQ ID NO: 6452755 - DNA, 23 bp, Homo sapiens
tgacagtttcttttgtgttccta

SEQ ID NO: 6452756 - DNA, 13 bp, Homo sapiens
tgacataaaattt

SEQ ID NO: 6452757 - DNA, 17 bp, Homo sapiens
tgacataaaatttacat

SEQ ID NO: 6452758 - DNA, 19 bp, Homo sapiens
tgacataaaatttacattt

SEQ ID NO: 6452759 - DNA, 17 bp, Homo sapiens
tgacataacactataaa

SEQ ID NO: 6452760 - DNA, 20 bp, Homo sapiens
tgacataaccaatttgtaat

SEQ ID NO: 6452761 - DNA, 21 bp, Homo sapiens
tgacataaccaatttgtaatg

SEQ ID NO: 6452762 - DNA, 15 bp, Homo sapiens
tgacataataaagta

SEQ ID NO: 6452763 - DNA, 21 bp, Homo sapiens
tgacataataaagtattttct

SEQ ID NO: 6452764 - DNA, 13 bp, Homo sapiens
tgacataattcta

SEQ ID NO: 6452765 - DNA, 15 bp, Homo sapiens
tgacatacagaaggg

SEQ ID NO: 6452766 - DNA, 13 bp, Homo sapiens
tgacatacatatt

SEQ ID NO: 6452767 - DNA, 17 bp, Homo sapiens
tgacatacatccaacat

SEQ ID NO: 6452768 - DNA, 16 bp, Homo sapiens
tgacataccccctccc

SEQ ID NO: 6452769 - DNA, 22 bp, Homo sapiens
tgacataccttagactgaaaaa

SEQ ID NO: 6452770 - DNA, 15 bp, Homo sapiens
tgacatagcctcatg

SEQ ID NO: 6452771 - DNA, 12 bp, Homo sapiens
tgacatagcctt

SEQ ID NO: 6452772 - DNA, 16 bp, Homo sapiens
tgacataggccaaggc

SEQ ID NO: 6452773 - DNA, 20 bp, Homo sapiens
tgacataggccaaggcccaa

SEQ ID NO: 6452774 - DNA, 18 bp, Homo sapiens
tgacataggtcataaagc

SEQ ID NO: 6452775 - DNA, 15 bp, Homo sapiens
tgacatattatgcct

SEQ ID NO: 6452776 - DNA, 16 bp, Homo sapiens
tgacatattatgtctt

SEQ ID NO: 6452777 - DNA, 15 bp, Homo sapiens
tgacatattcaagtg

SEQ ID NO: 6452778 - DNA, 12 bp, Homo sapiens
tgacatatttaa

SEQ ID NO: 6452779 - DNA, 15 bp, Homo sapiens
tgacatatttaatgt

SEQ ID NO: 6452780 - DNA, 18 bp, Homo sapiens
tgacatatttaatgtttt

SEQ ID NO: 6452781 - DNA, 19 bp, Homo sapiens
tgacatatttaatgtttta

SEQ ID NO: 6452782 - DNA, 16 bp, Homo sapiens
tgacatcaaaatgagt

SEQ ID NO: 6452783 - DNA, 23 bp, Homo sapiens
tgacatcaactgcatcaagatgt

SEQ ID NO: 6452784 - DNA, 16 bp, Homo sapiens
tgacatcactggcatg

SEQ ID NO: 6452785 - DNA, 18 bp, Homo sapiens
tgacatcactggcatggt

SEQ ID NO: 6452786 - DNA, 20 bp, Homo sapiens
tgacatcacttgtacaaaat

SEQ ID NO: 6452787 - DNA, 22 bp, Homo sapiens
tgacatcacttgtacaaaataa

SEQ ID NO: 6452788 - DNA, 23 bp, Homo sapiens
tgacatcagaagtaactcccact

SEQ ID NO: 6452789 - DNA, 12 bp, Homo sapiens
tgacatcagatt

SEQ ID NO: 6452790 - DNA, 13 bp, Homo sapiens
tgacatcagccag

SEQ ID NO: 6452791 - DNA, 14 bp, Homo sapiens
tgacatcagccagc

SEQ ID NO: 6452792 - DNA, 17 bp, Homo sapiens
tgacatcagccagctgc

SEQ ID NO: 6452793 - DNA, 14 bp, Homo sapiens
tgacatcagcctgc

SEQ ID NO: 6452794 - DNA, 21 bp, Homo sapiens
tgacatcaggtgatccacctg

SEQ ID NO: 6452795 - DNA, 23 bp, Homo sapiens
tgacatcagtggcatggctccag

SEQ ID NO: 6452796 - DNA, 18 bp, Homo sapiens
tgacatccacaaatgcag

SEQ ID NO: 6452797 - DNA, 21 bp, Homo sapiens
tgacatccactgtttgccttg

SEQ ID NO: 6452798 - DNA, 21 bp, Homo sapiens
tgacatccagaaagctgagga

SEQ ID NO: 6452799 - DNA, 13 bp, Homo sapiens
tgacatcccagga

SEQ ID NO: 6452800 - DNA, 14 bp, Homo sapiens
tgacatcccaggag

SEQ ID NO: 6452801 - DNA, 11 bp, Homo sapiens
tgacatccctt

SEQ ID NO: 6452802 - DNA, 14 bp, Homo sapiens
tgacatcccttcct

SEQ ID NO: 6452803 - DNA, 16 bp, Homo sapiens
tgacatcccttcctgg

SEQ ID NO: 6452804 - DNA, 18 bp, Homo sapiens
tgacatcccttcctggaa

SEQ ID NO: 6452805 - DNA, 21 bp, Homo sapiens
tgacatcccttcctggaaaca

SEQ ID NO: 6452806 - DNA, 22 bp, Homo sapiens
tgacatcccttcctggaaacag

SEQ ID NO: 6452807 - DNA, 19 bp, Homo sapiens
tgacatcggaaaaataatc

SEQ ID NO: 6452808 - DNA, 21 bp, Homo sapiens
tgacatcggaaaaataatcaa

SEQ ID NO: 6452809 - DNA, 22 bp, Homo sapiens
tgacatctacgaagccacaggc

SEQ ID NO: 6452810 - DNA, 18 bp, Homo sapiens
tgacatctcaggggccag

SEQ ID NO: 6452811 - DNA, 21 bp, Homo sapiens
tgacatctgattggcagatga

SEQ ID NO: 6452812 - DNA, 14 bp, Homo sapiens
tgacatctggaatc

SEQ ID NO: 6452813 - DNA, 15 bp, Homo sapiens
tgacatcttatttac

SEQ ID NO: 6452814 - DNA, 19 bp, Homo sapiens
tgacatctttttaaagctt

SEQ ID NO: 6452815 - DNA, 20 bp, Homo sapiens
tgacatctttttaaagctta

SEQ ID NO: 6452816 - DNA, 12 bp, Homo sapiens
tgacatgaaaag

SEQ ID NO: 6452817 - DNA, 16 bp, Homo sapiens
tgacatgaaaagttat

SEQ ID NO: 6452818 - DNA, 14 bp, Homo sapiens
tgacatgaaatgaa

SEQ ID NO: 6452819 - DNA, 17 bp, Homo sapiens
tgacatgaattttagct

SEQ ID NO: 6452820 - DNA, 22 bp, Homo sapiens
tgacatgaattttagcttttgt

SEQ ID NO: 6452821 - DNA, 13 bp, Homo sapiens
tgacatgaccctc

SEQ ID NO: 6452822 - DNA, 16 bp, Homo sapiens
tgacatgaccctctgt

SEQ ID NO: 6452823 - DNA, 17 bp, Homo sapiens
tgacatgaccctctgtc

SEQ ID NO: 6452824 - DNA, 23 bp, Homo sapiens
tgacatgaccctctgtccccagg

SEQ ID NO: 6452825 - DNA, 17 bp, Homo sapiens
tgacatgagtctccaga

SEQ ID NO: 6452826 - DNA, 18 bp, Homo sapiens
tgacatgagtctccagat

SEQ ID NO: 6452827 - DNA, 18 bp, Homo sapiens
tgacatgattccttcctg

SEQ ID NO: 6452828 - DNA, 13 bp, Homo sapiens
tgacatgcacagt

SEQ ID NO: 6452829 - DNA, 13 bp, Homo sapiens
tgacatgcactga

SEQ ID NO: 6452830 - DNA, 15 bp, Homo sapiens
tgacatgcactgacc

SEQ ID NO: 6452831 - DNA, 15 bp, Homo sapiens
tgacatgccaccctc

SEQ ID NO: 6452832 - DNA, 17 bp, Homo sapiens
tgacatgccaccctctc

SEQ ID NO: 6452833 - DNA, 23 bp, Homo sapiens
tgacatgcctatatgagaagaat

SEQ ID NO: 6452834 - DNA, 22 bp, Homo sapiens
tgacatgctaacctctctgaac

SEQ ID NO: 6452835 - DNA, 13 bp, Homo sapiens
tgacatgctcaca

SEQ ID NO: 6452836 - DNA, 15 bp, Homo sapiens
tgacatgctcacaca

SEQ ID NO: 6452837 - DNA, 15 bp, Homo sapiens
tgacatggaaatgaa

SEQ ID NO: 6452838 - DNA, 21 bp, Homo sapiens
tgacatggacccactaccctt

SEQ ID NO: 6452839 - DNA, 21 bp, Homo sapiens
tgacatggaggcactgaagcc

SEQ ID NO: 6452840 - DNA, 14 bp, Homo sapiens
tgacatggagttcc

SEQ ID NO: 6452841 - DNA, 21 bp, Homo sapiens
tgacatggattggatttcagt

SEQ ID NO: 6452842 - DNA, 22 bp, Homo sapiens
tgacatgggcctttaagaacct

SEQ ID NO: 6452843 - DNA, 20 bp, Homo sapiens
tgacatggggaaggcagagg

SEQ ID NO: 6452844 - DNA, 16 bp, Homo sapiens
tgacatgggtgtgcca

SEQ ID NO: 6452845 - DNA, 15 bp, Homo sapiens
tgacatggtgcctga

SEQ ID NO: 6452846 - DNA, 13 bp, Homo sapiens
tgacatggtgctg

SEQ ID NO: 6452847 - DNA, 17 bp, Homo sapiens
tgacatggtgctgtgtg

SEQ ID NO: 6452848 - DNA, 19 bp, Homo sapiens
tgacatgtaagaaaatgtt

SEQ ID NO: 6452849 - DNA, 21 bp, Homo sapiens
tgacatgtaagaaaatgttac

SEQ ID NO: 6452850 - DNA, 17 bp, Homo sapiens
tgacatgtaatgaatgg

SEQ ID NO: 6452851 - DNA, 12 bp, Homo sapiens
tgacatgtacag

SEQ ID NO: 6452852 - DNA, 17 bp, Homo sapiens
tgacatgtacagagaac

SEQ ID NO: 6452853 - DNA, 17 bp, Homo sapiens
tgacatgtctacttttt

SEQ ID NO: 6452854 - DNA, 15 bp, Homo sapiens
tgacatgtcttttct

SEQ ID NO: 6452855 - DNA, 12 bp, Homo sapiens
tgacatgtgaaa

SEQ ID NO: 6452856 - DNA, 13 bp, Homo sapiens
tgacatgtgaaac

SEQ ID NO: 6452857 - DNA, 14 bp, Homo sapiens
tgacatgtgcctgt

SEQ ID NO: 6452858 - DNA, 21 bp, Homo sapiens
tgacatgtggaaagtgaattt

SEQ ID NO: 6452859 - DNA, 22 bp, Homo sapiens
tgacatgtggaaagtgaatttg

SEQ ID NO: 6452860 - DNA, 19 bp, Homo sapiens
tgacatgttcctttaaggt

SEQ ID NO: 6452861 - DNA, 18 bp, Homo sapiens
tgacatgtttcacaacag

SEQ ID NO: 6452862 - DNA, 13 bp, Homo sapiens
tgacatgttttat

SEQ ID NO: 6452863 - DNA, 21 bp, Homo sapiens
tgacattaaatgcaataattt

SEQ ID NO: 6452864 - DNA, 19 bp, Homo sapiens
tgacattaacaaataaaaa

SEQ ID NO: 6452865 - DNA, 19 bp, Homo sapiens
tgacattaagaatgttggt

SEQ ID NO: 6452866 - DNA, 15 bp, Homo sapiens
tgacattatagacat

SEQ ID NO: 6452867 - DNA, 14 bp, Homo sapiens
tgacattatgtttt

SEQ ID NO: 6452868 - DNA, 23 bp, Homo sapiens
tgacattatgttttatttaaatg

SEQ ID NO: 6452869 - DNA, 15 bp, Homo sapiens
tgacattcacctgcc

SEQ ID NO: 6452870 - DNA, 17 bp, Homo sapiens
tgacattcagaaaactt

SEQ ID NO: 6452871 - DNA, 14 bp, Homo sapiens
tgacattcattttc

SEQ ID NO: 6452872 - DNA, 12 bp, Homo sapiens
tgacattccaca

SEQ ID NO: 6452873 - DNA, 23 bp, Homo sapiens
tgacattccagcattgtctgact

SEQ ID NO: 6452874 - DNA, 16 bp, Homo sapiens
tgacattccatgacga

SEQ ID NO: 6452875 - DNA, 20 bp, Homo sapiens
tgacattcctaaactatctt

SEQ ID NO: 6452876 - DNA, 19 bp, Homo sapiens
tgacattcctaagagtgga

SEQ ID NO: 6452877 - DNA, 11 bp, Homo sapiens
tgacattcctt

SEQ ID NO: 6452878 - DNA, 15 bp, Homo sapiens
tgacattccttgctg

SEQ ID NO: 6452879 - DNA, 20 bp, Homo sapiens
tgacattcggggtgatcctg

SEQ ID NO: 6452880 - DNA, 17 bp, Homo sapiens
tgacattctctattgta

SEQ ID NO: 6452881 - DNA, 16 bp, Homo sapiens
tgacattctgaatgct

SEQ ID NO: 6452882 - DNA, 17 bp, Homo sapiens
tgacattgcacctggat

SEQ ID NO: 6452883 - DNA, 16 bp, Homo sapiens
tgacattgctaagatg

SEQ ID NO: 6452884 - DNA, 15 bp, Homo sapiens
tgacattgctggtca

SEQ ID NO: 6452885 - DNA, 18 bp, Homo sapiens
tgacattgtagagcttct

SEQ ID NO: 6452886 - DNA, 22 bp, Homo sapiens
tgacattgtagagcttctggca

SEQ ID NO: 6452887 - DNA, 14 bp, Homo sapiens
tgacattgtcagaa

SEQ ID NO: 6452888 - DNA, 15 bp, Homo sapiens
tgacattgtcagaat

SEQ ID NO: 6452889 - DNA, 16 bp, Homo sapiens
tgacatttaatgccat

SEQ ID NO: 6452890 - DNA, 18 bp, Homo sapiens
tgacatttaatttagtga

SEQ ID NO: 6452891 - DNA, 19 bp, Homo sapiens
tgacatttacaccacactt

SEQ ID NO: 6452892 - DNA, 23 bp, Homo sapiens
tgacatttacaggagggcccgga

SEQ ID NO: 6452893 - DNA, 16 bp, Homo sapiens
tgacatttagaacttt

SEQ ID NO: 6452894 - DNA, 20 bp, Homo sapiens
tgacatttatatattgaatt

SEQ ID NO: 6452895 - DNA, 13 bp, Homo sapiens
tgacatttatatt

SEQ ID NO: 6452896 - DNA, 12 bp, Homo sapiens
tgacatttatgt

SEQ ID NO: 6452897 - DNA, 15 bp, Homo sapiens
tgacatttcactaaa

SEQ ID NO: 6452898 - DNA, 17 bp, Homo sapiens
tgacatttcatctgggt

SEQ ID NO: 6452899 - DNA, 20 bp, Homo sapiens
tgacatttcattagccatgc

SEQ ID NO: 6452900 - DNA, 22 bp, Homo sapiens
tgacatttccttctttgtctta

SEQ ID NO: 6452901 - DNA, 20 bp, Homo sapiens
tgacatttctaacatatgta

SEQ ID NO: 6452902 - DNA, 13 bp, Homo sapiens
tgacatttctcaa

SEQ ID NO: 6452903 - DNA, 18 bp, Homo sapiens
tgacatttcttaaaactt

SEQ ID NO: 6452904 - DNA, 21 bp, Homo sapiens
tgacatttcttaaaactttat

SEQ ID NO: 6452905 - DNA, 13 bp, Homo sapiens
tgacatttcttct

SEQ ID NO: 6452906 - DNA, 22 bp, Homo sapiens
tgacatttcttctagtgatgat

SEQ ID NO: 6452907 - DNA, 22 bp, Homo sapiens
tgacatttgggagacatgtgac

SEQ ID NO: 6452908 - DNA, 19 bp, Homo sapiens
tccctgctagcacagaggc

SEQ ID NO: 6452909 - DNA, 20 bp, Homo sapiens
tccctgctagcacagaggcc

SEQ ID NO: 6452910 - DNA, 23 bp, Homo sapiens
tccctgctaggggttttaggtct

SEQ ID NO: 6452911 - DNA, 20 bp, Homo sapiens
tccctgctcagctggccggg

SEQ ID NO: 6452912 - DNA, 16 bp, Homo sapiens
tccctgctcagtgctt

SEQ ID NO: 6452913 - DNA, 12 bp, Homo sapiens
tccctgctccca

SEQ ID NO: 6452914 - DNA, 15 bp, Homo sapiens
tccctgctcccaggg

SEQ ID NO: 6452915 - DNA, 11 bp, Homo sapiens
tccctgctcct

SEQ ID NO: 6452916 - DNA, 13 bp, Homo sapiens
tccctgctcctca

SEQ ID NO: 6452917 - DNA, 14 bp, Homo sapiens
tccctgctcctcat

SEQ ID NO: 6452918 - DNA, 17 bp, Homo sapiens
tccctgctcctcatggg

SEQ ID NO: 6452919 - DNA, 22 bp, Homo sapiens
tccctgctctaacacctgccta

SEQ ID NO: 6452920 - DNA, 16 bp, Homo sapiens
tccctgctgagtggct

SEQ ID NO: 6452921 - DNA, 15 bp, Homo sapiens
tccctgctgccaggc

SEQ ID NO: 6452922 - DNA, 17 bp, Homo sapiens
tccctgctgccaggctc

SEQ ID NO: 6452923 - DNA, 18 bp, Homo sapiens
tccctgctgctcctagga

SEQ ID NO: 6452924 - DNA, 12 bp, Homo sapiens
tccctgctggcc

SEQ ID NO: 6452925 - DNA, 12 bp, Homo sapiens
tccctgctgggg

SEQ ID NO: 6452926 - DNA, 17 bp, Homo sapiens
tccctgctgtcccctct

SEQ ID NO: 6452927 - DNA, 21 bp, Homo sapiens
tccctgctgtcccctcttgcc

SEQ ID NO: 6452928 - DNA, 21 bp, Homo sapiens
tccctgctgtgccatgctggg

SEQ ID NO: 6452929 - DNA, 12 bp, Homo sapiens
tccctgcttatc

SEQ ID NO: 6452930 - DNA, 20 bp, Homo sapiens
tccctgcttatgatgggctc

SEQ ID NO: 6452931 - DNA, 21 bp, Homo sapiens
tccctgcttatgatgggctcc

SEQ ID NO: 6452932 - DNA, 16 bp, Homo sapiens
tccctgcttcatatct

SEQ ID NO: 6452933 - DNA, 14 bp, Homo sapiens
tccctgcttccagg

SEQ ID NO: 6452934 - DNA, 18 bp, Homo sapiens
tccctgcttccaggaaac

SEQ ID NO: 6452935 - DNA, 21 bp, Homo sapiens
tccctgcttgcacacttcccc

SEQ ID NO: 6452936 - DNA, 22 bp, Homo sapiens
tccctgcttgcaggaggccaaa

SEQ ID NO: 6452937 - DNA, 19 bp, Homo sapiens
tccctgcttgcccgctccc

SEQ ID NO: 6452938 - DNA, 19 bp, Homo sapiens
tccctgctttctggtataa

SEQ ID NO: 6452939 - DNA, 19 bp, Homo sapiens
tccctgctttttgtgtttt

SEQ ID NO: 6452940 - DNA, 20 bp, Homo sapiens
tccctggaaaccttccaccc

SEQ ID NO: 6452941 - DNA, 21 bp, Homo sapiens
tccctggaagctctccgagct

SEQ ID NO: 6452942 - DNA, 18 bp, Homo sapiens
tccctggaagctggaaga

SEQ ID NO: 6452943 - DNA, 10 bp, Homo sapiens
tccctggaca

SEQ ID NO: 6452944 - DNA, 11 bp, Homo sapiens
tccctggacac

SEQ ID NO: 6452945 - DNA, 15 bp, Homo sapiens
tccctggacacagct

SEQ ID NO: 6452946 - DNA, 17 bp, Homo sapiens
tccctggacacagctct

SEQ ID NO: 6452947 - DNA, 19 bp, Homo sapiens
tccctggacaggcagcctc

SEQ ID NO: 6452948 - DNA, 17 bp, Homo sapiens
tccctggaccagatgct

SEQ ID NO: 6452949 - DNA, 18 bp, Homo sapiens
tccctggaccagatgctg

SEQ ID NO: 6452950 - DNA, 22 bp, Homo sapiens
tccctggactctgtggggccac

SEQ ID NO: 6452951 - DNA, 15 bp, Homo sapiens
tccctggagaagcac

SEQ ID NO: 6452952 - DNA, 22 bp, Homo sapiens
tccctggagaagggacatggga

SEQ ID NO: 6452953 - DNA, 17 bp, Homo sapiens
tccctggagcaggagcc

SEQ ID NO: 6452954 - DNA, 11 bp, Homo sapiens
tccctggagct

SEQ ID NO: 6452955 - DNA, 21 bp, Homo sapiens
tccctggagctagtgtctcct

SEQ ID NO: 6452956 - DNA, 21 bp, Homo sapiens
tccctggaggcacgcaccact

SEQ ID NO: 6452957 - DNA, 14 bp, Homo sapiens
tccctggagttcct

SEQ ID NO: 6452958 - DNA, 20 bp, Homo sapiens
tccctggatctacctggagg

SEQ ID NO: 6452959 - DNA, 20 bp, Homo sapiens
tccctggatgacattaaaga

SEQ ID NO: 6452960 - DNA, 19 bp, Homo sapiens
tccctggatttttaccagt

SEQ ID NO: 6452961 - DNA, 21 bp, Homo sapiens
tccctggcaagactgtcttac

SEQ ID NO: 6452962 - DNA, 14 bp, Homo sapiens
tccctggcactgaa

SEQ ID NO: 6452963 - DNA, 22 bp, Homo sapiens
tccctggcatcgtgtattccat

SEQ ID NO: 6452964 - DNA, 17 bp, Homo sapiens
tccctggccacctgcca

SEQ ID NO: 6452965 - DNA, 12 bp, Homo sapiens
tccctggcccag

SEQ ID NO: 6452966 - DNA, 13 bp, Homo sapiens
tccctggcccagc

SEQ ID NO: 6452967 - DNA, 14 bp, Homo sapiens
tccctggcccagcc

SEQ ID NO: 6452968 - DNA, 19 bp, Homo sapiens
tccctggcccagccagcca

SEQ ID NO: 6452969 - DNA, 12 bp, Homo sapiens
tccctggcctca

SEQ ID NO: 6452970 - DNA, 19 bp, Homo sapiens
tccctggcctggctctcct

SEQ ID NO: 6452971 - DNA, 15 bp, Homo sapiens
tccctggcgctgtgc

SEQ ID NO: 6452972 - DNA, 21 bp, Homo sapiens
tccctggctacttcccttcct

SEQ ID NO: 6452973 - DNA, 15 bp, Homo sapiens
tccctggctcaggga

SEQ ID NO: 6452974 - DNA, 15 bp, Homo sapiens
tccctggctctcaga

SEQ ID NO: 6452975 - DNA, 16 bp, Homo sapiens
tccctggctctcagaa

SEQ ID NO: 6452976 - DNA, 18 bp, Homo sapiens
tccctggctctcagaagg

SEQ ID NO: 6452977 - DNA, 21 bp, Homo sapiens
tccctggctgcagcctccggg

SEQ ID NO: 6452978 - DNA, 15 bp, Homo sapiens
tccctggctgccctg

SEQ ID NO: 6452979 - DNA, 20 bp, Homo sapiens
tccctggctgtgagcagcct

SEQ ID NO: 6452980 - DNA, 14 bp, Homo sapiens
tccctggcttcccc

SEQ ID NO: 6452981 - DNA, 23 bp, Homo sapiens
tccctggcttccccttcagacct

SEQ ID NO: 6452982 - DNA, 16 bp, Homo sapiens
tccctggcttccttac

SEQ ID NO: 6452983 - DNA, 11 bp, Homo sapiens
tccctggcttg

SEQ ID NO: 6452984 - DNA, 22 bp, Homo sapiens
tccctgggaaccgccctcctga

SEQ ID NO: 6452985 - DNA, 17 bp, Homo sapiens
tccctgggaactcatcc

SEQ ID NO: 6452986 - DNA, 19 bp, Homo sapiens
tccctgggacacagaccca

SEQ ID NO: 6452987 - DNA, 20 bp, Homo sapiens
tccctgggacacagacccag

SEQ ID NO: 6452988 - DNA, 14 bp, Homo sapiens
tccctgggaggccc

SEQ ID NO: 6452989 - DNA, 17 bp, Homo sapiens
tccctgggatctggtgg

SEQ ID NO: 6452990 - DNA, 19 bp, Homo sapiens
tccctgggatggacgctgc

SEQ ID NO: 6452991 - DNA, 23 bp, Homo sapiens
tccctgggcaagtggatggccca

SEQ ID NO: 6452992 - DNA, 17 bp, Homo sapiens
tccctgggcaccctgca

SEQ ID NO: 6452993 - DNA, 23 bp, Homo sapiens
tccctgggcaccctgcaggcagg

SEQ ID NO: 6452994 - DNA, 16 bp, Homo sapiens
tccctgggccaacaga

SEQ ID NO: 6452995 - DNA, 14 bp, Homo sapiens
tccctgggccacct

SEQ ID NO: 6452996 - DNA, 15 bp, Homo sapiens
tccctgggccacctc

SEQ ID NO: 6452997 - DNA, 24 bp, Homo sapiens
tccctgggccagggtctgtgtgaa

SEQ ID NO: 6452998 - DNA, 17 bp, Homo sapiens
tccctgggcccctccac

SEQ ID NO: 6452999 - DNA, 18 bp, Homo sapiens
tccctgggcccctccacg

SEQ ID NO: 6453000 - DNA, 22 bp, Homo sapiens
tccctgggcctcaacaaggatc

SEQ ID NO: 6453001 - DNA, 20 bp, Homo sapiens
tccctgggcctcagcctcca

SEQ ID NO: 6453002 - DNA, 21 bp, Homo sapiens
tccctgggcctgctgctgaga

SEQ ID NO: 6453003 - DNA, 14 bp, Homo sapiens
tccctgggcctgtc

SEQ ID NO: 6453004 - DNA, 16 bp, Homo sapiens
tccctgggcctgtctc

SEQ ID NO: 6453005 - DNA, 14 bp, Homo sapiens
tccctgggccttgg

SEQ ID NO: 6453006 - DNA, 19 bp, Homo sapiens
tccctgggccttgggctcc

SEQ ID NO: 6453007 - DNA, 20 bp, Homo sapiens
tccctgggctgtgctacctg

SEQ ID NO: 6453008 - DNA, 10 bp, Homo sapiens
tccctgggga

SEQ ID NO: 6453009 - DNA, 20 bp, Homo sapiens
tccctggggaaaacttgcag

SEQ ID NO: 6453010 - DNA, 14 bp, Homo sapiens
tccctggggacggg

SEQ ID NO: 6453011 - DNA, 16 bp, Homo sapiens
tccctggggacggggc

SEQ ID NO: 6453012 - DNA, 22 bp, Homo sapiens
tccctggggacggggctcccct

SEQ ID NO: 6453013 - DNA, 18 bp, Homo sapiens
tccctggggaggacccct

SEQ ID NO: 6453014 - DNA, 22 bp, Homo sapiens
tccctggggatatgcaaccctt

SEQ ID NO: 6453015 - DNA, 19 bp, Homo sapiens
tccctggggcactccccca

SEQ ID NO: 6453016 - DNA, 20 bp, Homo sapiens
tccctggggcactcccccag

SEQ ID NO: 6453017 - DNA, 21 bp, Homo sapiens
tccctggggccaacggcaaca

SEQ ID NO: 6453018 - DNA, 16 bp, Homo sapiens
tccctggggctgtgca

SEQ ID NO: 6453019 - DNA, 17 bp, Homo sapiens
tccctggggctgtgcat

SEQ ID NO: 6453020 - DNA, 15 bp, Homo sapiens
tccctgggggcatcc

SEQ ID NO: 6453021 - DNA, 16 bp, Homo sapiens
tccctgggggcgctgt

SEQ ID NO: 6453022 - DNA, 13 bp, Homo sapiens
tccctgggggcgg

SEQ ID NO: 6453023 - DNA, 15 bp, Homo sapiens
tccctgggggcggga

SEQ ID NO: 6453024 - DNA, 20 bp, Homo sapiens
tccctgggggcgggactcct

SEQ ID NO: 6453025 - DNA, 17 bp, Homo sapiens
tccctgggggtcccagg

SEQ ID NO: 6453026 - DNA, 18 bp, Homo sapiens
tccctgggggtcccagga

SEQ ID NO: 6453027 - DNA, 19 bp, Homo sapiens
tccctgggggtcccaggat

SEQ ID NO: 6453028 - DNA, 16 bp, Homo sapiens
tccctgggggtggggc

SEQ ID NO: 6453029 - DNA, 19 bp, Homo sapiens
tccctgggggtggggctcc

SEQ ID NO: 6453030 - DNA, 23 bp, Homo sapiens
tccctgggggtggggctcctacc

SEQ ID NO: 6453031 - DNA, 22 bp, Homo sapiens
tccctggggtcacatgctttgt

SEQ ID NO: 6453032 - DNA, 12 bp, Homo sapiens
tccctgggtgga

SEQ ID NO: 6453033 - DNA, 17 bp, Homo sapiens
tccctgggtggagcagg

SEQ ID NO: 6453034 - DNA, 21 bp, Homo sapiens
tccctgggtggagcaggactc

SEQ ID NO: 6453035 - DNA, 23 bp, Homo sapiens
tccctgggttagactgccagctc

SEQ ID NO: 6453036 - DNA, 23 bp, Homo sapiens
tccctgggtttgggagccaggac

SEQ ID NO: 6453037 - DNA, 21 bp, Homo sapiens
tccctggtaataagtactgtg

SEQ ID NO: 6453038 - DNA, 22 bp, Homo sapiens
tccctggtcccctcccccatcc

SEQ ID NO: 6453039 - DNA, 19 bp, Homo sapiens
tccctggtctggctctgct

SEQ ID NO: 6453040 - DNA, 22 bp, Homo sapiens
tccctggtctggctctgctgga

SEQ ID NO: 6453041 - DNA, 21 bp, Homo sapiens
tccctggtgaaagagtaaaac

SEQ ID NO: 6453042 - DNA, 14 bp, Homo sapiens
tccctggtgcagag

SEQ ID NO: 6453043 - DNA, 22 bp, Homo sapiens
tccctggtgcccttccctggag

SEQ ID NO: 6453044 - DNA, 15 bp, Homo sapiens
tccctggtgcttatg

SEQ ID NO: 6453045 - DNA, 16 bp, Homo sapiens
tccctggtggcagctc

SEQ ID NO: 6453046 - DNA, 18 bp, Homo sapiens
tccctggtggcagctcac

SEQ ID NO: 6453047 - DNA, 14 bp, Homo sapiens
tccctggttcaagc

SEQ ID NO: 6453048 - DNA, 14 bp, Homo sapiens
tccctggttcattg

SEQ ID NO: 6453049 - DNA, 16 bp, Homo sapiens
tccctggttctgatga

SEQ ID NO: 6453050 - DNA, 15 bp, Homo sapiens
tccctggttgcctct

SEQ ID NO: 6453051 - DNA, 20 bp, Homo sapiens
tccctggttttaccccagct

SEQ ID NO: 6453052 - DNA, 22 bp, Homo sapiens
tccctggttttaccccagctcc

SEQ ID NO: 6453053 - DNA, 15 bp, Homo sapiens
tccctgtaacttgat

SEQ ID NO: 6453054 - DNA, 13 bp, Homo sapiens
tccctgtaatatt

SEQ ID NO: 6453055 - DNA, 22 bp, Homo sapiens
tccctgtaatgcactcctgccc

SEQ ID NO: 6453056 - DNA, 16 bp, Homo sapiens
tccctgtagctctgcc

SEQ ID NO: 6453057 - DNA, 17 bp, Homo sapiens
tccctgtagctctgcct

SEQ ID NO: 6453058 - DNA, 18 bp, Homo sapiens
tccctgtagctctgcctc

SEQ ID NO: 6453059 - DNA, 21 bp, Homo sapiens
tccctgtagttgacaattctg

SEQ ID NO: 6453060 - DNA, 23 bp, Homo sapiens
tccctgtatgtctacctctgact

SEQ ID NO: 6453061 - DNA, 22 bp, Homo sapiens
tccctgtattttctttctctac

SEQ ID NO: 6453062 - DNA, 15 bp, Homo sapiens
tccctgtcacacact

SEQ ID NO: 6453063 - DNA, 16 bp, Homo sapiens
tccctgtcacacactg

SEQ ID NO: 6453064 - DNA, 18 bp, Homo sapiens
tccctgtcacacactgga

SEQ ID NO: 6453065 - DNA, 20 bp, Homo sapiens
tccctgtcacacactggacc

SEQ ID NO: 6453066 - DNA, 14 bp, Homo sapiens
tccctgtcaccaag

SEQ ID NO: 6453067 - DNA, 13 bp, Homo sapiens
tccctgtcacctc

SEQ ID NO: 6453068 - DNA, 14 bp, Homo sapiens
tccctgtcacctct

SEQ ID NO: 6453069 - DNA, 17 bp, Homo sapiens
tccctgtcacctcttcc

SEQ ID NO: 6453070 - DNA, 22 bp, Homo sapiens
tccctgtcacgctcatgtcctg

SEQ ID NO: 6453071 - DNA, 15 bp, Homo sapiens
tccctgtcagcctga

SEQ ID NO: 6453072 - DNA, 15 bp, Homo sapiens
tccctgtcaggacac

SEQ ID NO: 6453073 - DNA, 18 bp, Homo sapiens
tccctgtcaggacacatg

SEQ ID NO: 6453074 - DNA, 12 bp, Homo sapiens
tccctgtccacc

SEQ ID NO: 6453075 - DNA, 16 bp, Homo sapiens
tccctgtccagcacta

SEQ ID NO: 6453076 - DNA, 18 bp, Homo sapiens
tccctgtccatccccagt

SEQ ID NO: 6453077 - DNA, 15 bp, Homo sapiens
tccctgtcccagttg

SEQ ID NO: 6453078 - DNA, 15 bp, Homo sapiens
tccctgtcccccagc

SEQ ID NO: 6453079 - DNA, 19 bp, Homo sapiens
tccctgtcccctcctcgcc

SEQ ID NO: 6453080 - DNA, 17 bp, Homo sapiens
tccctgtccctgccccg

SEQ ID NO: 6453081 - DNA, 11 bp, Homo sapiens
tccctgtcctc

SEQ ID NO: 6453082 - DNA, 12 bp, Homo sapiens
tccctgtcctcc

SEQ ID NO: 6453083 - DNA, 14 bp, Homo sapiens
tccctgtcctcctc

SEQ ID NO: 6453084 - DNA, 17 bp, Homo sapiens
tccctgtctccagctgc

SEQ ID NO: 6453085 - DNA, 19 bp, Homo sapiens
tccctgtctccagctgcct

SEQ ID NO: 6453086 - DNA, 23 bp, Homo sapiens
tgacatttgggagacatgtgaca

SEQ ID NO: 6453087 - DNA, 14 bp, Homo sapiens
tgacatttgtagtt

SEQ ID NO: 6453088 - DNA, 13 bp, Homo sapiens
tgacatttgtcat

SEQ ID NO: 6453089 - DNA, 15 bp, Homo sapiens
tgacatttgtcattt

SEQ ID NO: 6453090 - DNA, 17 bp, Homo sapiens
tgacatttgtcattttc

SEQ ID NO: 6453091 - DNA, 19 bp, Homo sapiens
tgacatttgtcattttcat

SEQ ID NO: 6453092 - DNA, 20 bp, Homo sapiens
tgacatttgtcattttcatt

SEQ ID NO: 6453093 - DNA, 22 bp, Homo sapiens
tgacatttgtcctgcagagctg

SEQ ID NO: 6453094 - DNA, 12 bp, Homo sapiens
tgacatttgttt

SEQ ID NO: 6453095 - DNA, 18 bp, Homo sapiens
tgacattttaaaaaacaa

SEQ ID NO: 6453096 - DNA, 17 bp, Homo sapiens
tgacattttagaatgtc

SEQ ID NO: 6453097 - DNA, 17 bp, Homo sapiens
tgacattttgtagctag

SEQ ID NO: 6453098 - DNA, 13 bp, Homo sapiens
tgacatttttccg

SEQ ID NO: 6453099 - DNA, 15 bp, Homo sapiens
tgacatttttcctct

SEQ ID NO: 6453100 - DNA, 18 bp, Homo sapiens
tgacatttttcctctctg

SEQ ID NO: 6453101 - DNA, 14 bp, Homo sapiens
tgaccaaaaaccaa

SEQ ID NO: 6453102 - DNA, 16 bp, Homo sapiens
tgaccaaaaaccaaaa

SEQ ID NO: 6453103 - DNA, 18 bp, Homo sapiens
tgaccaaaaccagagggc

SEQ ID NO: 6453104 - DNA, 20 bp, Homo sapiens
tgaccaaaaccagagggcag

SEQ ID NO: 6453105 - DNA, 22 bp, Homo sapiens
tgaccaaaaccagagggcagtc

SEQ ID NO: 6453106 - DNA, 16 bp, Homo sapiens
tgaccaaaagttacat

SEQ ID NO: 6453107 - DNA, 13 bp, Homo sapiens
tgaccaaaatcag

SEQ ID NO: 6453108 - DNA, 18 bp, Homo sapiens
tgaccaaaatgtgtttca

SEQ ID NO: 6453109 - DNA, 22 bp, Homo sapiens
tgaccaaaattttaagtaggaa

SEQ ID NO: 6453110 - DNA, 21 bp, Homo sapiens
tgaccaaagactgcagaaccc

SEQ ID NO: 6453111 - DNA, 19 bp, Homo sapiens
tgaccaaagtcccttcctg

SEQ ID NO: 6453112 - DNA, 14 bp, Homo sapiens
tgaccaaagtcctt

SEQ ID NO: 6453113 - DNA, 22 bp, Homo sapiens
tgaccaaatatcaccaggactg

SEQ ID NO: 6453114 - DNA, 22 bp, Homo sapiens
tgaccaaatggccagttttctg

SEQ ID NO: 6453115 - DNA, 11 bp, Homo sapiens
tgaccaacaga

SEQ ID NO: 6453116 - DNA, 19 bp, Homo sapiens
tgaccaacagaaacctttt

SEQ ID NO: 6453117 - DNA, 16 bp, Homo sapiens
tgaccaacctgtttct

SEQ ID NO: 6453118 - DNA, 21 bp, Homo sapiens
tgaccaactagacattctgtc

SEQ ID NO: 6453119 - DNA, 22 bp, Homo sapiens
tgaccaactagacattctgtcg

SEQ ID NO: 6453120 - DNA, 18 bp, Homo sapiens
tgaccaactgtgttgtat

SEQ ID NO: 6453121 - DNA, 14 bp, Homo sapiens
tgaccaagaactgc

SEQ ID NO: 6453122 - DNA, 19 bp, Homo sapiens
tgaccaagaactgcatgga

SEQ ID NO: 6453123 - DNA, 22 bp, Homo sapiens
tgaccaagacaggttcaggtag

SEQ ID NO: 6453124 - DNA, 19 bp, Homo sapiens
tgaccaagactgagccagc

SEQ ID NO: 6453125 - DNA, 22 bp, Homo sapiens
tgaccaagactgagccagctta

SEQ ID NO: 6453126 - DNA, 15 bp, Homo sapiens
tgaccaagagagaaa

SEQ ID NO: 6453127 - DNA, 16 bp, Homo sapiens
tgaccaagagagaaag

SEQ ID NO: 6453128 - DNA, 17 bp, Homo sapiens
tgaccaagagagaaaga

SEQ ID NO: 6453129 - DNA, 18 bp, Homo sapiens
tgaccaagagagaaagaa

SEQ ID NO: 6453130 - DNA, 14 bp, Homo sapiens
tgaccaagcaggaa

SEQ ID NO: 6453131 - DNA, 17 bp, Homo sapiens
tgaccaagcaggaagct

SEQ ID NO: 6453132 - DNA, 23 bp, Homo sapiens
tgaccaagcggctcaagaataaa

SEQ ID NO: 6453133 - DNA, 19 bp, Homo sapiens
tgaccaagggaagtgacca

SEQ ID NO: 6453134 - DNA, 20 bp, Homo sapiens
tgaccaaggtgcttttcttc

SEQ ID NO: 6453135 - DNA, 22 bp, Homo sapiens
tgaccaagtgatgtgtttacat

SEQ ID NO: 6453136 - DNA, 16 bp, Homo sapiens
tgaccaagttataaat

SEQ ID NO: 6453137 - DNA, 15 bp, Homo sapiens
tgaccaatacatttg

SEQ ID NO: 6453138 - DNA, 17 bp, Homo sapiens
tgaccaatacatttgta

SEQ ID NO: 6453139 - DNA, 18 bp, Homo sapiens
tgaccaatacatttgtat

SEQ ID NO: 6453140 - DNA, 18 bp, Homo sapiens
tgaccaatactactgtaa

SEQ ID NO: 6453141 - DNA, 18 bp, Homo sapiens
tgaccaatattgtacagt

SEQ ID NO: 6453142 - DNA, 13 bp, Homo sapiens
tgaccaatctctg

SEQ ID NO: 6453143 - DNA, 15 bp, Homo sapiens
tgaccaatctctgtg

SEQ ID NO: 6453144 - DNA, 17 bp, Homo sapiens
tgaccaatctctgtgac

SEQ ID NO: 6453145 - DNA, 13 bp, Homo sapiens
tgaccaatgtctt

SEQ ID NO: 6453146 - DNA, 14 bp, Homo sapiens
tgaccaatgtcttg

SEQ ID NO: 6453147 - DNA, 16 bp, Homo sapiens
tgaccaattgccctgc

SEQ ID NO: 6453148 - DNA, 18 bp, Homo sapiens
tgaccaattgccctgcca

SEQ ID NO: 6453149 - DNA, 15 bp, Homo sapiens
tgaccaattgtgctg

SEQ ID NO: 6453150 - DNA, 16 bp, Homo sapiens
tgaccaattgtgctgc

SEQ ID NO: 6453151 - DNA, 17 bp, Homo sapiens
tgaccaattgtgctgcc

SEQ ID NO: 6453152 - DNA, 19 bp, Homo sapiens
tgaccaattgtgctgccat

SEQ ID NO: 6453153 - DNA, 13 bp, Homo sapiens
tgaccaatttgca

SEQ ID NO: 6453154 - DNA, 19 bp, Homo sapiens
tgaccaatttgcaccagtt

SEQ ID NO: 6453155 - DNA, 13 bp, Homo sapiens
tgaccaattttaa

SEQ ID NO: 6453156 - DNA, 13 bp, Homo sapiens
tgaccacaaaaga

SEQ ID NO: 6453157 - DNA, 17 bp, Homo sapiens
tgaccacaaaagaggct

SEQ ID NO: 6453158 - DNA, 19 bp, Homo sapiens
tgaccacaccaaccaggcc

SEQ ID NO: 6453159 - DNA, 22 bp, Homo sapiens
tgaccacaccaaccaggccttc

SEQ ID NO: 6453160 - DNA, 17 bp, Homo sapiens
tgaccacacctgcctct

SEQ ID NO: 6453161 - DNA, 12 bp, Homo sapiens
tgaccacactgt

SEQ ID NO: 6453162 - DNA, 14 bp, Homo sapiens
tgaccacagacact

SEQ ID NO: 6453163 - DNA, 17 bp, Homo sapiens
tgaccacagacactcct

SEQ ID NO: 6453164 - DNA, 17 bp, Homo sapiens
tgaccacagcacagcca

SEQ ID NO: 6453165 - DNA, 15 bp, Homo sapiens
tgaccacagcccgct

SEQ ID NO: 6453166 - DNA, 18 bp, Homo sapiens
tgaccacaggcagttact

SEQ ID NO: 6453167 - DNA, 12 bp, Homo sapiens
tgaccacataga

SEQ ID NO: 6453168 - DNA, 23 bp, Homo sapiens
tgaccaccaccccaacaaaccat

SEQ ID NO: 6453169 - DNA, 13 bp, Homo sapiens
tgaccacccacct

SEQ ID NO: 6453170 - DNA, 14 bp, Homo sapiens
tgaccacccacctg

SEQ ID NO: 6453171 - DNA, 18 bp, Homo sapiens
tgaccacccacctgacca

SEQ ID NO: 6453172 - DNA, 15 bp, Homo sapiens
tgaccaccctcccct

SEQ ID NO: 6453173 - DNA, 18 bp, Homo sapiens
tgaccaccctcccctctc

SEQ ID NO: 6453174 - DNA, 14 bp, Homo sapiens
tgaccaccctgcct

SEQ ID NO: 6453175 - DNA, 19 bp, Homo sapiens
tgaccaccctgcctgtgga

SEQ ID NO: 6453176 - DNA, 21 bp, Homo sapiens
tgaccaccttctgtccccagc

SEQ ID NO: 6453177 - DNA, 22 bp, Homo sapiens
tgaccaccttctgtccccagcc

SEQ ID NO: 6453178 - DNA, 15 bp, Homo sapiens
tgaccacgcacctcc

SEQ ID NO: 6453179 - DNA, 21 bp, Homo sapiens
tgaccacgctttctagctgtt

SEQ ID NO: 6453180 - DNA, 22 bp, Homo sapiens
tgaccacggacgtttccatcag

SEQ ID NO: 6453181 - DNA, 17 bp, Homo sapiens
tgaccacgggcctcagt

SEQ ID NO: 6453182 - DNA, 19 bp, Homo sapiens
tgaccacgggcctcagttt

SEQ ID NO: 6453183 - DNA, 14 bp, Homo sapiens
tgaccactcagaga

SEQ ID NO: 6453184 - DNA, 16 bp, Homo sapiens
tgaccactcagagaca

SEQ ID NO: 6453185 - DNA, 17 bp, Homo sapiens
tgaccactccagagaag

SEQ ID NO: 6453186 - DNA, 17 bp, Homo sapiens
tgaccactgaattcact

SEQ ID NO: 6453187 - DNA, 14 bp, Homo sapiens
tgaccactggccct

SEQ ID NO: 6453188 - DNA, 16 bp, Homo sapiens
tgaccacttattctgt

SEQ ID NO: 6453189 - DNA, 22 bp, Homo sapiens
tgaccagaaaacaaatcttcaa

SEQ ID NO: 6453190 - DNA, 19 bp, Homo sapiens
tgaccagaaaatatgatat

SEQ ID NO: 6453191 - DNA, 13 bp, Homo sapiens
tgaccagaaaatt

SEQ ID NO: 6453192 - DNA, 18 bp, Homo sapiens
tgaccagaaaatttttgt

SEQ ID NO: 6453193 - DNA, 21 bp, Homo sapiens
tgaccagaaaatttttgtctt

SEQ ID NO: 6453194 - DNA, 13 bp, Homo sapiens
tgaccagaagcct

SEQ ID NO: 6453195 - DNA, 15 bp, Homo sapiens
tgaccagaagggaaa

SEQ ID NO: 6453196 - DNA, 19 bp, Homo sapiens
tgaccagaagtggcaggag

SEQ ID NO: 6453197 - DNA, 20 bp, Homo sapiens
tgaccagaagtggcaggagg

SEQ ID NO: 6453198 - DNA, 22 bp, Homo sapiens
tgaccagactgtgggtccctgc

SEQ ID NO: 6453199 - DNA, 12 bp, Homo sapiens
tgaccagagaat

SEQ ID NO: 6453200 - DNA, 20 bp, Homo sapiens
tgaccagagaatgcacctct

SEQ ID NO: 6453201 - DNA, 18 bp, Homo sapiens
tgaccagatatatagaag

SEQ ID NO: 6453202 - DNA, 16 bp, Homo sapiens
tgaccagatctttctc

SEQ ID NO: 6453203 - DNA, 18 bp, Homo sapiens
tgaccagatctttctctt

SEQ ID NO: 6453204 - DNA, 19 bp, Homo sapiens
tgaccagcactgaccccga

SEQ ID NO: 6453205 - DNA, 17 bp, Homo sapiens
tgaccagcagatcccag

SEQ ID NO: 6453206 - DNA, 18 bp, Homo sapiens
tgaccagcagatcccagc

SEQ ID NO: 6453207 - DNA, 20 bp, Homo sapiens
tgaccagcagatcccagctc

SEQ ID NO: 6453208 - DNA, 22 bp, Homo sapiens
tgaccagcagatcccagctcac

SEQ ID NO: 6453209 - DNA, 19 bp, Homo sapiens
tgaccagcataccagttct

SEQ ID NO: 6453210 - DNA, 20 bp, Homo sapiens
tgaccagcataccagttctt

SEQ ID NO: 6453211 - DNA, 23 bp, Homo sapiens
tgaccagccccgtgtagccccgg

SEQ ID NO: 6453212 - DNA, 23 bp, Homo sapiens
tgaccagcctccatgctgcctcc

SEQ ID NO: 6453213 - DNA, 22 bp, Homo sapiens
tgaccagcggaaacaggtgtgt

SEQ ID NO: 6453214 - DNA, 17 bp, Homo sapiens
tgaccagcggctgctca

SEQ ID NO: 6453215 - DNA, 18 bp, Homo sapiens
tgaccagctccccctccc

SEQ ID NO: 6453216 - DNA, 20 bp, Homo sapiens
tgaccagctccccctccctc

SEQ ID NO: 6453217 - DNA, 22 bp, Homo sapiens
tgaccagctccccctccctccc

SEQ ID NO: 6453218 - DNA, 18 bp, Homo sapiens
tgaccagctggagtgagg

SEQ ID NO: 6453219 - DNA, 12 bp, Homo sapiens
tgaccaggacta

SEQ ID NO: 6453220 - DNA, 22 bp, Homo sapiens
tgaccaggatggagcaagctct

SEQ ID NO: 6453221 - DNA, 16 bp, Homo sapiens
tgaccaggcatcctcc

SEQ ID NO: 6453222 - DNA, 14 bp, Homo sapiens
tgaccaggccacca

SEQ ID NO: 6453223 - DNA, 15 bp, Homo sapiens
tgaccaggccaccat

SEQ ID NO: 6453224 - DNA, 13 bp, Homo sapiens
tgaccaggccctg

SEQ ID NO: 6453225 - DNA, 21 bp, Homo sapiens
tgaccaggccctgctcatcac

SEQ ID NO: 6453226 - DNA, 20 bp, Homo sapiens
tgaccaggctcacaactgtt

SEQ ID NO: 6453227 - DNA, 15 bp, Homo sapiens
tgaccaggctggagt

SEQ ID NO: 6453228 - DNA, 11 bp, Homo sapiens
tgaccagggaa

SEQ ID NO: 6453229 - DNA, 18 bp, Homo sapiens
tgaccagggaagtgtgtg

SEQ ID NO: 6453230 - DNA, 17 bp, Homo sapiens
tgaccagggatgctggg

SEQ ID NO: 6453231 - DNA, 20 bp, Homo sapiens
tgaccagggatgctgggctg

SEQ ID NO: 6453232 - DNA, 21 bp, Homo sapiens
tgaccagggatgctgggctgg

SEQ ID NO: 6453233 - DNA, 22 bp, Homo sapiens
tgaccagggatgctgggctggg

SEQ ID NO: 6453234 - DNA, 23 bp, Homo sapiens
tgaccagggatgctgggctgggc

SEQ ID NO: 6453235 - DNA, 14 bp, Homo sapiens
tgaccaggggccct

SEQ ID NO: 6453236 - DNA, 22 bp, Homo sapiens
tgaccaggggccctacctgggg

SEQ ID NO: 6453237 - DNA, 23 bp, Homo sapiens
tgaccaggggccctacctgggga

SEQ ID NO: 6453238 - DNA, 22 bp, Homo sapiens
tgaccaggggtgatttcagaga

SEQ ID NO: 6453239 - DNA, 23 bp, Homo sapiens
tgaccagtgataatgccccaagg

SEQ ID NO: 6453240 - DNA, 18 bp, Homo sapiens
tgaccagttctggccagg

SEQ ID NO: 6453241 - DNA, 23 bp, Homo sapiens
tgaccagtttaacctgatgcagt

SEQ ID NO: 6453242 - DNA, 14 bp, Homo sapiens
tgaccagtttctta

SEQ ID NO: 6453243 - DNA, 17 bp, Homo sapiens
tgaccataatcctagcc

SEQ ID NO: 6453244 - DNA, 23 bp, Homo sapiens
tgaccataatcctagccccgaga

SEQ ID NO: 6453245 - DNA, 14 bp, Homo sapiens
tgaccatactcaga

SEQ ID NO: 6453246 - DNA, 22 bp, Homo sapiens
tgaccatatagattttattatg

SEQ ID NO: 6453247 - DNA, 21 bp, Homo sapiens
tgaccatcatgccctctctcg

SEQ ID NO: 6453248 - DNA, 15 bp, Homo sapiens
tgaccatcatttcac

SEQ ID NO: 6453249 - DNA, 18 bp, Homo sapiens
tgaccatcatttcccagg

SEQ ID NO: 6453250 - DNA, 19 bp, Homo sapiens
tgaccatcatttcccaggc

SEQ ID NO: 6453251 - DNA, 20 bp, Homo sapiens
tgaccatccagtagagattt

SEQ ID NO: 6453252 - DNA, 14 bp, Homo sapiens
tgaccatctgcttt

SEQ ID NO: 6453253 - DNA, 16 bp, Homo sapiens
tgaccatctgtgacta

SEQ ID NO: 6453254 - DNA, 15 bp, Homo sapiens
tgaccatgaaagact

SEQ ID NO: 6453255 - DNA, 18 bp, Homo sapiens
tgaccatgcactatattt

SEQ ID NO: 6453256 - DNA, 20 bp, Homo sapiens
tgaccatgcactatatttgt

SEQ ID NO: 6453257 - DNA, 19 bp, Homo sapiens
tgaccatgcgtcaggggcc

SEQ ID NO: 6453258 - DNA, 12 bp, Homo sapiens
tgaccatgctca

SEQ ID NO: 6453259 - DNA, 16 bp, Homo sapiens
tgaccatgctcatctg

SEQ ID NO: 6453260 - DNA, 19 bp, Homo sapiens
tgaccatggttttggctct

SEQ ID NO: 6453261 - DNA, 15 bp, Homo sapiens
tgaccatgtgaatct

SEQ ID NO: 6453262 - DNA, 13 bp, Homo sapiens
tgaccattattca

SEQ ID NO: 6453263 - DNA, 17 bp, Homo sapiens
tgaccattcaattagtg

SEQ ID NO: 6453264 - DNA, 14 bp, Homo sapiens
tccctgtctccagg

SEQ ID NO: 6453265 - DNA, 16 bp, Homo sapiens
tccctgtctctgcatc

SEQ ID NO: 6453266 - DNA, 18 bp, Homo sapiens
tccctgtctctgcatctg

SEQ ID NO: 6453267 - DNA, 13 bp, Homo sapiens
tccctgtctgtgt

SEQ ID NO: 6453268 - DNA, 15 bp, Homo sapiens
tccctgtctgtgtcc

SEQ ID NO: 6453269 - DNA, 17 bp, Homo sapiens
tccctgtctgtgtccca

SEQ ID NO: 6453270 - DNA, 20 bp, Homo sapiens
tccctgtctgtgtcccagcc

SEQ ID NO: 6453271 - DNA, 23 bp, Homo sapiens
tccctgtctgtgtcccagccacg

SEQ ID NO: 6453272 - DNA, 19 bp, Homo sapiens
tccctgtctttactcctca

SEQ ID NO: 6453273 - DNA, 23 bp, Homo sapiens
tccctgtctttactcctcacact

SEQ ID NO: 6453274 - DNA, 23 bp, Homo sapiens
tccctgtctttcctaagacctgg

SEQ ID NO: 6453275 - DNA, 20 bp, Homo sapiens
tccctgtgagagagttgctc

SEQ ID NO: 6453276 - DNA, 12 bp, Homo sapiens
tccctgtgccac

SEQ ID NO: 6453277 - DNA, 18 bp, Homo sapiens
tccctgtgcccccagcct

SEQ ID NO: 6453278 - DNA, 19 bp, Homo sapiens
tccctgtgcccccagcctc

SEQ ID NO: 6453279 - DNA, 22 bp, Homo sapiens
tccctgtgcccccagcctcagc

SEQ ID NO: 6453280 - DNA, 19 bp, Homo sapiens
tccctgtgctgatcctgct

SEQ ID NO: 6453281 - DNA, 20 bp, Homo sapiens
tccctgtgctgatcctgctg

SEQ ID NO: 6453282 - DNA, 21 bp, Homo sapiens
tccctgtgctgatcctgctga

SEQ ID NO: 6453283 - DNA, 16 bp, Homo sapiens
tccctgtgggctcaca

SEQ ID NO: 6453284 - DNA, 22 bp, Homo sapiens
tccctgtgggctcacaccggca

SEQ ID NO: 6453285 - DNA, 20 bp, Homo sapiens
tccctgtggggcaggagtgc

SEQ ID NO: 6453286 - DNA, 12 bp, Homo sapiens
tccctgtggggg

SEQ ID NO: 6453287 - DNA, 20 bp, Homo sapiens
tccctgtgggggtggccatc

SEQ ID NO: 6453288 - DNA, 22 bp, Homo sapiens
tccctgtggtaccctggcagag

SEQ ID NO: 6453289 - DNA, 14 bp, Homo sapiens
tccctgtgtctttt

SEQ ID NO: 6453290 - DNA, 20 bp, Homo sapiens
tccctgtgttaactcaggat

SEQ ID NO: 6453291 - DNA, 13 bp, Homo sapiens
tccctgtgttctg

SEQ ID NO: 6453292 - DNA, 22 bp, Homo sapiens
tccctgtgttgtcccatctgcc

SEQ ID NO: 6453293 - DNA, 13 bp, Homo sapiens
tccctgttatttt

SEQ ID NO: 6453294 - DNA, 16 bp, Homo sapiens
tccctgttattttcaa

SEQ ID NO: 6453295 - DNA, 15 bp, Homo sapiens
tccctgttccccaca

SEQ ID NO: 6453296 - DNA, 14 bp, Homo sapiens
tccctgttcctttg

SEQ ID NO: 6453297 - DNA, 15 bp, Homo sapiens
tccctgttctcagct

SEQ ID NO: 6453298 - DNA, 14 bp, Homo sapiens
tccctgttctccct

SEQ ID NO: 6453299 - DNA, 16 bp, Homo sapiens
tccctgttctcccttt

SEQ ID NO: 6453300 - DNA, 18 bp, Homo sapiens
tccctgttcttcctccag

SEQ ID NO: 6453301 - DNA, 14 bp, Homo sapiens
tccctgttctttaa

SEQ ID NO: 6453302 - DNA, 14 bp, Homo sapiens
tccctgttgaagct

SEQ ID NO: 6453303 - DNA, 11 bp, Homo sapiens
tccctgtttaa

SEQ ID NO: 6453304 - DNA, 16 bp, Homo sapiens
tccctgtttaatattt

SEQ ID NO: 6453305 - DNA, 22 bp, Homo sapiens
tccctgtttaatatttaaacag

SEQ ID NO: 6453306 - DNA, 16 bp, Homo sapiens
tccctgtttctccaca

SEQ ID NO: 6453307 - DNA, 22 bp, Homo sapiens
tccctgtttcttccacagtgcc

SEQ ID NO: 6453308 - DNA, 17 bp, Homo sapiens
tccctgttttagtttct

SEQ ID NO: 6453309 - DNA, 19 bp, Homo sapiens
tccctgttttagtttctga

SEQ ID NO: 6453310 - DNA, 19 bp, Homo sapiens
tccctgttttccccccaag

SEQ ID NO: 6453311 - DNA, 15 bp, Homo sapiens
tccctgttttctgag

SEQ ID NO: 6453312 - DNA, 22 bp, Homo sapiens
tccctgttttctgagcccgggc

SEQ ID NO: 6453313 - DNA, 12 bp, Homo sapiens
tcccttaaaatt

SEQ ID NO: 6453314 - DNA, 15 bp, Homo sapiens
tcccttaaacaaaaa

SEQ ID NO: 6453315 - DNA, 20 bp, Homo sapiens
tcccttaacagttgtattta

SEQ ID NO: 6453316 - DNA, 22 bp, Homo sapiens
tcccttaacagttgtatttaac

SEQ ID NO: 6453317 - DNA, 13 bp, Homo sapiens
tcccttaactcca

SEQ ID NO: 6453318 - DNA, 15 bp, Homo sapiens
tcccttaactccaag

SEQ ID NO: 6453319 - DNA, 16 bp, Homo sapiens
tcccttaactccaaga

SEQ ID NO: 6453320 - DNA, 22 bp, Homo sapiens
tcccttaactctaaccctgtgg

SEQ ID NO: 6453321 - DNA, 23 bp, Homo sapiens
tcccttaactctaaccctgtgga

SEQ ID NO: 6453322 - DNA, 23 bp, Homo sapiens
tcccttaacttttccttgtatgt

SEQ ID NO: 6453323 - DNA, 14 bp, Homo sapiens
tcccttaagaagtt

SEQ ID NO: 6453324 - DNA, 22 bp, Homo sapiens
tcccttaagaatgagtttctta

SEQ ID NO: 6453325 - DNA, 22 bp, Homo sapiens
tcccttaataaaaatatatatt

SEQ ID NO: 6453326 - DNA, 18 bp, Homo sapiens
tcccttaataaaatattc

SEQ ID NO: 6453327 - DNA, 14 bp, Homo sapiens
tcccttacaaggtg

SEQ ID NO: 6453328 - DNA, 19 bp, Homo sapiens
tcccttacccatcttgctt

SEQ ID NO: 6453329 - DNA, 22 bp, Homo sapiens
tcccttaccctcctctgctggg

SEQ ID NO: 6453330 - DNA, 14 bp, Homo sapiens
tcccttacctcaaa

SEQ ID NO: 6453331 - DNA, 18 bp, Homo sapiens
tcccttacgtgagtcctg

SEQ ID NO: 6453332 - DNA, 19 bp, Homo sapiens
tcccttactattcccactt

SEQ ID NO: 6453333 - DNA, 21 bp, Homo sapiens
tcccttactttacctctctgt

SEQ ID NO: 6453334 - DNA, 20 bp, Homo sapiens
tcccttagaagatctgcttc

SEQ ID NO: 6453335 - DNA, 15 bp, Homo sapiens
tcccttagactttag

SEQ ID NO: 6453336 - DNA, 14 bp, Homo sapiens
tcccttagccccga

SEQ ID NO: 6453337 - DNA, 20 bp, Homo sapiens
tcccttagccccgagtttaa

SEQ ID NO: 6453338 - DNA, 16 bp, Homo sapiens
tcccttagcctctccc

SEQ ID NO: 6453339 - DNA, 13 bp, Homo sapiens
tcccttaggcatt

SEQ ID NO: 6453340 - DNA, 22 bp, Homo sapiens
tcccttagtaatcccccttgcc

SEQ ID NO: 6453341 - DNA, 20 bp, Homo sapiens
tcccttatgagcgtcactgc

SEQ ID NO: 6453342 - DNA, 15 bp, Homo sapiens
tcccttatgtccacc

SEQ ID NO: 6453343 - DNA, 21 bp, Homo sapiens
tcccttattagttacaaagtt

SEQ ID NO: 6453344 - DNA, 16 bp, Homo sapiens
tcccttattgcctccc

SEQ ID NO: 6453345 - DNA, 15 bp, Homo sapiens
tcccttatttttatt

SEQ ID NO: 6453346 - DNA, 11 bp, Homo sapiens
tcccttcaacc

SEQ ID NO: 6453347 - DNA, 15 bp, Homo sapiens
tcccttcaactgtat

SEQ ID NO: 6453348 - DNA, 21 bp, Homo sapiens
tcccttcaagacgaggggcag

SEQ ID NO: 6453349 - DNA, 18 bp, Homo sapiens
tcccttcaaggcctcccc

SEQ ID NO: 6453350 - DNA, 20 bp, Homo sapiens
tcccttcacaaacccagtgt

SEQ ID NO: 6453351 - DNA, 18 bp, Homo sapiens
tcccttcagcccccagcc

SEQ ID NO: 6453352 - DNA, 20 bp, Homo sapiens
tcccttcaggcccgctgccc

SEQ ID NO: 6453353 - DNA, 19 bp, Homo sapiens
tcccttcagtaccctctca

SEQ ID NO: 6453354 - DNA, 13 bp, Homo sapiens
tcccttcatccca

SEQ ID NO: 6453355 - DNA, 13 bp, Homo sapiens
tcccttcatctcc

SEQ ID NO: 6453356 - DNA, 17 bp, Homo sapiens
tcccttcatgcatggaa

SEQ ID NO: 6453357 - DNA, 22 bp, Homo sapiens
tcccttcatgttttaacttatt

SEQ ID NO: 6453358 - DNA, 17 bp, Homo sapiens
tcccttccacctcacaa

SEQ ID NO: 6453359 - DNA, 21 bp, Homo sapiens
tcccttccacctcacaactcc

SEQ ID NO: 6453360 - DNA, 22 bp, Homo sapiens
tcccttccacctcacaactcct

SEQ ID NO: 6453361 - DNA, 14 bp, Homo sapiens
tcccttccactgcc

SEQ ID NO: 6453362 - DNA, 17 bp, Homo sapiens
tcccttccagatggtca

SEQ ID NO: 6453363 - DNA, 22 bp, Homo sapiens
tcccttccagatggtcatccag

SEQ ID NO: 6453364 - DNA, 22 bp, Homo sapiens
tcccttccaggaatgctgggcc

SEQ ID NO: 6453365 - DNA, 16 bp, Homo sapiens
tcccttccatgcccca

SEQ ID NO: 6453366 - DNA, 21 bp, Homo sapiens
tcccttccatgccccaggatc

SEQ ID NO: 6453367 - DNA, 10 bp, Homo sapiens
tcccttccca

SEQ ID NO: 6453368 - DNA, 21 bp, Homo sapiens
tcccttcccacctactgcact

SEQ ID NO: 6453369 - DNA, 14 bp, Homo sapiens
tcccttcccacctc

SEQ ID NO: 6453370 - DNA, 21 bp, Homo sapiens
tcccttcccactggaggcatg

SEQ ID NO: 6453371 - DNA, 17 bp, Homo sapiens
tcccttcccagcgctgc

SEQ ID NO: 6453372 - DNA, 13 bp, Homo sapiens
tcccttcccagtg

SEQ ID NO: 6453373 - DNA, 22 bp, Homo sapiens
tcccttcccagtgggctgtgtt

SEQ ID NO: 6453374 - DNA, 16 bp, Homo sapiens
tcccttccccatgctt

SEQ ID NO: 6453375 - DNA, 11 bp, Homo sapiens
tcccttccccc

SEQ ID NO: 6453376 - DNA, 21 bp, Homo sapiens
tcccttcccctccctggctcc

SEQ ID NO: 6453377 - DNA, 18 bp, Homo sapiens
tcccttcccgacccagcc

SEQ ID NO: 6453378 - DNA, 20 bp, Homo sapiens
tcccttcccgacccagccag

SEQ ID NO: 6453379 - DNA, 21 bp, Homo sapiens
tcccttcccgacccagccagc

SEQ ID NO: 6453380 - DNA, 23 bp, Homo sapiens
tcccttcccgacccagccagctg

SEQ ID NO: 6453381 - DNA, 10 bp, Homo sapiens
tcccttccct

SEQ ID NO: 6453382 - DNA, 15 bp, Homo sapiens
tcccttccctcaccc

SEQ ID NO: 6453383 - DNA, 13 bp, Homo sapiens
tcccttccctcct

SEQ ID NO: 6453384 - DNA, 14 bp, Homo sapiens
tcccttccgtccat

SEQ ID NO: 6453385 - DNA, 17 bp, Homo sapiens
tcccttccgtccatccc

SEQ ID NO: 6453386 - DNA, 15 bp, Homo sapiens
tcccttcctcacccc

SEQ ID NO: 6453387 - DNA, 18 bp, Homo sapiens
tcccttcctcggtggctc

SEQ ID NO: 6453388 - DNA, 14 bp, Homo sapiens
tcccttcctctctc

SEQ ID NO: 6453389 - DNA, 18 bp, Homo sapiens
tcccttcctctgtgccac

SEQ ID NO: 6453390 - DNA, 12 bp, Homo sapiens
tcccttcctctt

SEQ ID NO: 6453391 - DNA, 14 bp, Homo sapiens
tcccttcctcttcg

SEQ ID NO: 6453392 - DNA, 16 bp, Homo sapiens
tcccttcctctttcca

SEQ ID NO: 6453393 - DNA, 15 bp, Homo sapiens
tcccttcctgccact

SEQ ID NO: 6453394 - DNA, 15 bp, Homo sapiens
tcccttcctgccagc

SEQ ID NO: 6453395 - DNA, 19 bp, Homo sapiens
tcccttcctgccctgtggc

SEQ ID NO: 6453396 - DNA, 12 bp, Homo sapiens
tcccttcctgga

SEQ ID NO: 6453397 - DNA, 13 bp, Homo sapiens
tcccttcctggaa

SEQ ID NO: 6453398 - DNA, 14 bp, Homo sapiens
tcccttcctggaaa

SEQ ID NO: 6453399 - DNA, 17 bp, Homo sapiens
tcccttcctggaaacag

SEQ ID NO: 6453400 - DNA, 19 bp, Homo sapiens
tcccttcctggaaacagca

SEQ ID NO: 6453401 - DNA, 21 bp, Homo sapiens
tcccttcctggaaacagcatg

SEQ ID NO: 6453402 - DNA, 23 bp, Homo sapiens
tcccttcctggaaacagcatgaa

SEQ ID NO: 6453403 - DNA, 16 bp, Homo sapiens
tcccttcctggcctca

SEQ ID NO: 6453404 - DNA, 19 bp, Homo sapiens
tcccttcctgtcctgctca

SEQ ID NO: 6453405 - DNA, 18 bp, Homo sapiens
tcccttccttgggcagaa

SEQ ID NO: 6453406 - DNA, 20 bp, Homo sapiens
tcccttccttttccctgctt

SEQ ID NO: 6453407 - DNA, 15 bp, Homo sapiens
tcccttcgctctgct

SEQ ID NO: 6453408 - DNA, 20 bp, Homo sapiens
tcccttcggtggaagagctc

SEQ ID NO: 6453409 - DNA, 22 bp, Homo sapiens
tcccttcggtggaagagctcaa

SEQ ID NO: 6453410 - DNA, 16 bp, Homo sapiens
tcccttctactgcttc

SEQ ID NO: 6453411 - DNA, 16 bp, Homo sapiens
tcccttctccatctct

SEQ ID NO: 6453412 - DNA, 21 bp, Homo sapiens
tcccttctccatctctctggc

SEQ ID NO: 6453413 - DNA, 23 bp, Homo sapiens
tcccttctccccagccagaggtg

SEQ ID NO: 6453414 - DNA, 19 bp, Homo sapiens
tcccttctcctttctaagc

SEQ ID NO: 6453415 - DNA, 18 bp, Homo sapiens
tcccttctcgtgtttgct

SEQ ID NO: 6453416 - DNA, 20 bp, Homo sapiens
tcccttctcgtgtttgctta

SEQ ID NO: 6453417 - DNA, 14 bp, Homo sapiens
tcccttctctcctt

SEQ ID NO: 6453418 - DNA, 15 bp, Homo sapiens
tcccttctctccttc

SEQ ID NO: 6453419 - DNA, 20 bp, Homo sapiens
tcccttctctccttccctct

SEQ ID NO: 6453420 - DNA, 16 bp, Homo sapiens
tcccttctctctttct

SEQ ID NO: 6453421 - DNA, 14 bp, Homo sapiens
tcccttctcttcca

SEQ ID NO: 6453422 - DNA, 20 bp, Homo sapiens
tcccttctcttccaggcagc

SEQ ID NO: 6453423 - DNA, 21 bp, Homo sapiens
tcccttctctttggggctcct

SEQ ID NO: 6453424 - DNA, 22 bp, Homo sapiens
tcccttctgataagactggaaa

SEQ ID NO: 6453425 - DNA, 14 bp, Homo sapiens
tcccttctgatctt

SEQ ID NO: 6453426 - DNA, 15 bp, Homo sapiens
tcccttctgccacct

SEQ ID NO: 6453427 - DNA, 13 bp, Homo sapiens
tcccttctgctac

SEQ ID NO: 6453428 - DNA, 15 bp, Homo sapiens
tcccttctgctactg

SEQ ID NO: 6453429 - DNA, 13 bp, Homo sapiens
tcccttctgtagt

SEQ ID NO: 6453430 - DNA, 16 bp, Homo sapiens
tcccttctgtccctca

SEQ ID NO: 6453431 - DNA, 22 bp, Homo sapiens
tcccttctgtccctcacagcac

SEQ ID NO: 6453432 - DNA, 23 bp, Homo sapiens
tcccttcttgcatccttcctata

SEQ ID NO: 6453433 - DNA, 21 bp, Homo sapiens
tcccttcttgggtctgccctg

SEQ ID NO: 6453434 - DNA, 15 bp, Homo sapiens
tcccttcttttcctg

SEQ ID NO: 6453435 - DNA, 20 bp, Homo sapiens
tcccttgaaactttgggaaa

SEQ ID NO: 6453436 - DNA, 17 bp, Homo sapiens
tcccttgaaattttaaa

SEQ ID NO: 6453437 - DNA, 23 bp, Homo sapiens
tcccttgaactgttctggcctca

SEQ ID NO: 6453438 - DNA, 14 bp, Homo sapiens
tcccttgaagcaag

SEQ ID NO: 6453439 - DNA, 16 bp, Homo sapiens
tcccttgaaggaagag

SEQ ID NO: 6453440 - DNA, 22 bp, Homo sapiens
tcccttgaccattggctgcgct

SEQ ID NO: 6453441 - DNA, 16 bp, Homo sapiens
tcccttgacctttcca

SEQ ID NO: 6453442 - DNA, 23 bp, Homo sapiens
tgaccattccaaagttcttatct

SEQ ID NO: 6453443 - DNA, 22 bp, Homo sapiens
tgaccattgaaaaaggaaaaat

SEQ ID NO: 6453444 - DNA, 21 bp, Homo sapiens
tgaccattttgttaaaatcta

SEQ ID NO: 6453445 - DNA, 17 bp, Homo sapiens
tgacccaaagcaaaaca

SEQ ID NO: 6453446 - DNA, 16 bp, Homo sapiens
tgacccaacagcctct

SEQ ID NO: 6453447 - DNA, 19 bp, Homo sapiens
tgacccaacagcctctgtg

SEQ ID NO: 6453448 - DNA, 20 bp, Homo sapiens
tgacccaacagcctctgtgg

SEQ ID NO: 6453449 - DNA, 17 bp, Homo sapiens
tgacccaagtggggcct

SEQ ID NO: 6453450 - DNA, 14 bp, Homo sapiens
tgacccaataaagg

SEQ ID NO: 6453451 - DNA, 17 bp, Homo sapiens
tgacccacaagaaatga

SEQ ID NO: 6453452 - DNA, 17 bp, Homo sapiens
tgacccacagcctccaa

SEQ ID NO: 6453453 - DNA, 19 bp, Homo sapiens
tgacccacagcctccaagt

SEQ ID NO: 6453454 - DNA, 14 bp, Homo sapiens
tgacccacagctct

SEQ ID NO: 6453455 - DNA, 18 bp, Homo sapiens
tgacccacagctctgggc

SEQ ID NO: 6453456 - DNA, 20 bp, Homo sapiens
tgacccacagctctgggcct

SEQ ID NO: 6453457 - DNA, 21 bp, Homo sapiens
tgacccacagctctgggcctc

SEQ ID NO: 6453458 - DNA, 21 bp, Homo sapiens
tgacccaccaaggtctcacac

SEQ ID NO: 6453459 - DNA, 16 bp, Homo sapiens
tgacccaccagtgcct

SEQ ID NO: 6453460 - DNA, 14 bp, Homo sapiens
tgacccacccagtg

SEQ ID NO: 6453461 - DNA, 13 bp, Homo sapiens
tgacccacccctg

SEQ ID NO: 6453462 - DNA, 23 bp, Homo sapiens
tgacccacccctgtgctccgtgc

SEQ ID NO: 6453463 - DNA, 14 bp, Homo sapiens
tgacccactaaaga

SEQ ID NO: 6453464 - DNA, 14 bp, Homo sapiens
tgacccactaattg

SEQ ID NO: 6453465 - DNA, 19 bp, Homo sapiens
tgacccactcacacttgga

SEQ ID NO: 6453466 - DNA, 23 bp, Homo sapiens
tgacccactgcgcacagccccag

SEQ ID NO: 6453467 - DNA, 13 bp, Homo sapiens
tgacccactgctt

SEQ ID NO: 6453468 - DNA, 23 bp, Homo sapiens
tgacccacttctcatcacacaca

SEQ ID NO: 6453469 - DNA, 16 bp, Homo sapiens
tgacccagagccacca

SEQ ID NO: 6453470 - DNA, 18 bp, Homo sapiens
tgacccagaggggaatga

SEQ ID NO: 6453471 - DNA, 20 bp, Homo sapiens
tgacccagagtggagtctga

SEQ ID NO: 6453472 - DNA, 18 bp, Homo sapiens
tgacccagatatggaaac

SEQ ID NO: 6453473 - DNA, 20 bp, Homo sapiens
tgacccagatatggaaacag

SEQ ID NO: 6453474 - DNA, 21 bp, Homo sapiens
tgacccagatatggaaacaga

SEQ ID NO: 6453475 - DNA, 12 bp, Homo sapiens
tgacccagcatc

SEQ ID NO: 6453476 - DNA, 20 bp, Homo sapiens
tgacccagcatctcccagca

SEQ ID NO: 6453477 - DNA, 19 bp, Homo sapiens
tgacccagccccttgagaa

SEQ ID NO: 6453478 - DNA, 21 bp, Homo sapiens
tgacccagccccttgagaaac

SEQ ID NO: 6453479 - DNA, 15 bp, Homo sapiens
tgacccagcctgaaa

SEQ ID NO: 6453480 - DNA, 16 bp, Homo sapiens
tgacccagcctgaaag

SEQ ID NO: 6453481 - DNA, 13 bp, Homo sapiens
tgacccaggccgc

SEQ ID NO: 6453482 - DNA, 14 bp, Homo sapiens
tgacccaggccgca

SEQ ID NO: 6453483 - DNA, 12 bp, Homo sapiens
tgacccaggctg

SEQ ID NO: 6453484 - DNA, 16 bp, Homo sapiens
tgacccaggctgcctg

SEQ ID NO: 6453485 - DNA, 15 bp, Homo sapiens
tgacccaggctgggc

SEQ ID NO: 6453486 - DNA, 12 bp, Homo sapiens
tgacccagtccc

SEQ ID NO: 6453487 - DNA, 21 bp, Homo sapiens
tgacccagtccccgtgccccg

SEQ ID NO: 6453488 - DNA, 20 bp, Homo sapiens
tgacccagtccctgggggaa

SEQ ID NO: 6453489 - DNA, 23 bp, Homo sapiens
tgacccagtgcccccactgacca

SEQ ID NO: 6453490 - DNA, 19 bp, Homo sapiens
tgacccagtgtgtgctcag

SEQ ID NO: 6453491 - DNA, 15 bp, Homo sapiens
tgacccatctgtagt

SEQ ID NO: 6453492 - DNA, 20 bp, Homo sapiens
tgacccatgctgccctgtga

SEQ ID NO: 6453493 - DNA, 16 bp, Homo sapiens
tgacccattcacattt

SEQ ID NO: 6453494 - DNA, 13 bp, Homo sapiens
tgacccattgctg

SEQ ID NO: 6453495 - DNA, 14 bp, Homo sapiens
tgacccattgctgt

SEQ ID NO: 6453496 - DNA, 21 bp, Homo sapiens
tgaccccaaacaccttccagc

SEQ ID NO: 6453497 - DNA, 22 bp, Homo sapiens
tgaccccaaacaccttccagct

SEQ ID NO: 6453498 - DNA, 14 bp, Homo sapiens
tgaccccacacgcc

SEQ ID NO: 6453499 - DNA, 22 bp, Homo sapiens
tgaccccacacgccggggctgg

SEQ ID NO: 6453500 - DNA, 19 bp, Homo sapiens
tgaccccacttatgctgct

SEQ ID NO: 6453501 - DNA, 21 bp, Homo sapiens
tgaccccacttatgctgctgt

SEQ ID NO: 6453502 - DNA, 23 bp, Homo sapiens
tgaccccacttatgctgctgtga

SEQ ID NO: 6453503 - DNA, 20 bp, Homo sapiens
tgaccccagaaattctggcc

SEQ ID NO: 6453504 - DNA, 22 bp, Homo sapiens
tgaccccagcattctcaggcac

SEQ ID NO: 6453505 - DNA, 14 bp, Homo sapiens
tgaccccagcccag

SEQ ID NO: 6453506 - DNA, 19 bp, Homo sapiens
tgaccccagcccagacagc

SEQ ID NO: 6453507 - DNA, 18 bp, Homo sapiens
tgaccccaggtcagccct

SEQ ID NO: 6453508 - DNA, 21 bp, Homo sapiens
tgaccccaggtcagccctgtg

SEQ ID NO: 6453509 - DNA, 21 bp, Homo sapiens
tgaccccagtggaaaacaaag

SEQ ID NO: 6453510 - DNA, 18 bp, Homo sapiens
tgaccccatcactcgcag

SEQ ID NO: 6453511 - DNA, 22 bp, Homo sapiens
tgacccccaaccaagtggctcc

SEQ ID NO: 6453512 - DNA, 14 bp, Homo sapiens
tgacccccatgtaa

SEQ ID NO: 6453513 - DNA, 16 bp, Homo sapiens
tgacccccatgtaaat

SEQ ID NO: 6453514 - DNA, 22 bp, Homo sapiens
tgaccccgacgccacagcccag

SEQ ID NO: 6453515 - DNA, 14 bp, Homo sapiens
tgacccctaccccc

SEQ ID NO: 6453516 - DNA, 16 bp, Homo sapiens
tgacccctaccccctc

SEQ ID NO: 6453517 - DNA, 17 bp, Homo sapiens
tgacccctaccccctca

SEQ ID NO: 6453518 - DNA, 22 bp, Homo sapiens
tgacccctaccccctcatcccc

SEQ ID NO: 6453519 - DNA, 16 bp, Homo sapiens
tgacccctccctgcag

SEQ ID NO: 6453520 - DNA, 13 bp, Homo sapiens
tgacccctcctca

SEQ ID NO: 6453521 - DNA, 15 bp, Homo sapiens
tgacccctcctcact

SEQ ID NO: 6453522 - DNA, 20 bp, Homo sapiens
tgacccctcctcactggcca

SEQ ID NO: 6453523 - DNA, 22 bp, Homo sapiens
tgacccctcctcactggccatc

SEQ ID NO: 6453524 - DNA, 13 bp, Homo sapiens
tgacccctcctgg

SEQ ID NO: 6453525 - DNA, 17 bp, Homo sapiens
tgacccctcctggggcc

SEQ ID NO: 6453526 - DNA, 18 bp, Homo sapiens
tgacccctcgtccacccc

SEQ ID NO: 6453527 - DNA, 13 bp, Homo sapiens
tgacccctgccca

SEQ ID NO: 6453528 - DNA, 16 bp, Homo sapiens
tgacccctggccacag

SEQ ID NO: 6453529 - DNA, 19 bp, Homo sapiens
tgacccctggccacagcct

SEQ ID NO: 6453530 - DNA, 13 bp, Homo sapiens
tgaccccttcctg

SEQ ID NO: 6453531 - DNA, 20 bp, Homo sapiens
tgaccccttctctctccaga

SEQ ID NO: 6453532 - DNA, 18 bp, Homo sapiens
tgacccctttcccccacc

SEQ ID NO: 6453533 - DNA, 23 bp, Homo sapiens
tgacccggattggccctgcccct

SEQ ID NO: 6453534 - DNA, 18 bp, Homo sapiens
tgacccggcaccccctgc

SEQ ID NO: 6453535 - DNA, 22 bp, Homo sapiens
tgacccggcaccccctgcagct

SEQ ID NO: 6453536 - DNA, 13 bp, Homo sapiens
tgacccggcctct

SEQ ID NO: 6453537 - DNA, 20 bp, Homo sapiens
tgacccggcctctctgcccc

SEQ ID NO: 6453538 - DNA, 21 bp, Homo sapiens
tgacccggctgggtcggccct

SEQ ID NO: 6453539 - DNA, 22 bp, Homo sapiens
tgacccggctgggtcggccctg

SEQ ID NO: 6453540 - DNA, 20 bp, Homo sapiens
tgacccggttgcagtcactg

SEQ ID NO: 6453541 - DNA, 20 bp, Homo sapiens
tgacccgtccattcttcagt

SEQ ID NO: 6453542 - DNA, 16 bp, Homo sapiens
tgacccgttccatatc

SEQ ID NO: 6453543 - DNA, 17 bp, Homo sapiens
tgaccctactcccttgc

SEQ ID NO: 6453544 - DNA, 15 bp, Homo sapiens
tgaccctactgtgga

SEQ ID NO: 6453545 - DNA, 18 bp, Homo sapiens
tgaccctagctctttcct

SEQ ID NO: 6453546 - DNA, 21 bp, Homo sapiens
tgaccctcacttttctcatct

SEQ ID NO: 6453547 - DNA, 22 bp, Homo sapiens
tgaccctcacttttctcatctg

SEQ ID NO: 6453548 - DNA, 11 bp, Homo sapiens
tgaccctcagc

SEQ ID NO: 6453549 - DNA, 14 bp, Homo sapiens
tgaccctccaaatg

SEQ ID NO: 6453550 - DNA, 23 bp, Homo sapiens
tgaccctccaccgcagaaggaag

SEQ ID NO: 6453551 - DNA, 15 bp, Homo sapiens
tgaccctcccactcc

SEQ ID NO: 6453552 - DNA, 12 bp, Homo sapiens
tgaccctcccag

SEQ ID NO: 6453553 - DNA, 14 bp, Homo sapiens
tgaccctccccaaa

SEQ ID NO: 6453554 - DNA, 22 bp, Homo sapiens
tgaccctcccggcctggcttca

SEQ ID NO: 6453555 - DNA, 13 bp, Homo sapiens
tgaccctcctgtt

SEQ ID NO: 6453556 - DNA, 13 bp, Homo sapiens
tgaccctctcact

SEQ ID NO: 6453557 - DNA, 15 bp, Homo sapiens
tgaccctctccaccc

SEQ ID NO: 6453558 - DNA, 18 bp, Homo sapiens
tgaccctctccaccccat

SEQ ID NO: 6453559 - DNA, 22 bp, Homo sapiens
tgaccctctgaatggtccaggg

SEQ ID NO: 6453560 - DNA, 14 bp, Homo sapiens
tgaccctctgtccc

SEQ ID NO: 6453561 - DNA, 18 bp, Homo sapiens
tgaccctctgtccccagg

SEQ ID NO: 6453562 - DNA, 20 bp, Homo sapiens
tgaccctctgtccccaggcc

SEQ ID NO: 6453563 - DNA, 22 bp, Homo sapiens
tgaccctctgtccccaggcctg

SEQ ID NO: 6453564 - DNA, 21 bp, Homo sapiens
tgaccctgaaaggaacactgg

SEQ ID NO: 6453565 - DNA, 20 bp, Homo sapiens
tgaccctgaaatattttcta

SEQ ID NO: 6453566 - DNA, 21 bp, Homo sapiens
tgaccctgaaatattttctac

SEQ ID NO: 6453567 - DNA, 14 bp, Homo sapiens
tgaccctgagctga

SEQ ID NO: 6453568 - DNA, 17 bp, Homo sapiens
tgaccctgagctgacca

SEQ ID NO: 6453569 - DNA, 17 bp, Homo sapiens
tgaccctgaggaggccg

SEQ ID NO: 6453570 - DNA, 13 bp, Homo sapiens
tgaccctgagggc

SEQ ID NO: 6453571 - DNA, 23 bp, Homo sapiens
tgaccctgagggctcctccatgg

SEQ ID NO: 6453572 - DNA, 15 bp, Homo sapiens
tgaccctgatgaaaa

SEQ ID NO: 6453573 - DNA, 23 bp, Homo sapiens
tgaccctgcgaaggggccctggt

SEQ ID NO: 6453574 - DNA, 18 bp, Homo sapiens
tgaccctggagcccggca

SEQ ID NO: 6453575 - DNA, 12 bp, Homo sapiens
tgaccctgggca

SEQ ID NO: 6453576 - DNA, 17 bp, Homo sapiens
tgaccctgggcctggag

SEQ ID NO: 6453577 - DNA, 14 bp, Homo sapiens
tgaccctggggctg

SEQ ID NO: 6453578 - DNA, 15 bp, Homo sapiens
tgaccctggggctgg

SEQ ID NO: 6453579 - DNA, 17 bp, Homo sapiens
tgaccctgtatatagcc

SEQ ID NO: 6453580 - DNA, 20 bp, Homo sapiens
tgaccctgtgatgcctgaca

SEQ ID NO: 6453581 - DNA, 15 bp, Homo sapiens
tgaccctgtgcctgt

SEQ ID NO: 6453582 - DNA, 14 bp, Homo sapiens
tgacccttcagggc

SEQ ID NO: 6453583 - DNA, 16 bp, Homo sapiens
tgacccttcagggcca

SEQ ID NO: 6453584 - DNA, 17 bp, Homo sapiens
tgacccttcagggccag

SEQ ID NO: 6453585 - DNA, 20 bp, Homo sapiens
tgacccttcagggccagaag

SEQ ID NO: 6453586 - DNA, 22 bp, Homo sapiens
tgacccttcccaatcagcactg

SEQ ID NO: 6453587 - DNA, 23 bp, Homo sapiens
tgacccttcccaatcagcactga

SEQ ID NO: 6453588 - DNA, 18 bp, Homo sapiens
tgacccttctgtctgtaa

SEQ ID NO: 6453589 - DNA, 15 bp, Homo sapiens
tgacccttgctgtga

SEQ ID NO: 6453590 - DNA, 16 bp, Homo sapiens
tgaccctttcctcccc

SEQ ID NO: 6453591 - DNA, 16 bp, Homo sapiens
tgacccttttctgatc

SEQ ID NO: 6453592 - DNA, 16 bp, Homo sapiens
tgaccgagagaacctc

SEQ ID NO: 6453593 - DNA, 18 bp, Homo sapiens
tgaccgagccctggagag

SEQ ID NO: 6453594 - DNA, 16 bp, Homo sapiens
tgaccgagtctaggaa

SEQ ID NO: 6453595 - DNA, 22 bp, Homo sapiens
tgaccgagtctaggaatgcttt

SEQ ID NO: 6453596 - DNA, 18 bp, Homo sapiens
tgaccgatgtgtctccca

SEQ ID NO: 6453597 - DNA, 20 bp, Homo sapiens
tgaccgatgtgtctcccaga

SEQ ID NO: 6453598 - DNA, 21 bp, Homo sapiens
tgaccgcaggttgctttccca

SEQ ID NO: 6453599 - DNA, 17 bp, Homo sapiens
tgaccgcccagctctcc

SEQ ID NO: 6453600 - DNA, 22 bp, Homo sapiens
tgaccgcccagctctcccacat

SEQ ID NO: 6453601 - DNA, 23 bp, Homo sapiens
tgaccgccgcttccagcttcctc

SEQ ID NO: 6453602 - DNA, 14 bp, Homo sapiens
tgaccgctctccct

SEQ ID NO: 6453603 - DNA, 15 bp, Homo sapiens
tgaccgctctccctt

SEQ ID NO: 6453604 - DNA, 14 bp, Homo sapiens
tgaccgctgcccag

SEQ ID NO: 6453605 - DNA, 17 bp, Homo sapiens
tgaccgctgcccaggtg

SEQ ID NO: 6453606 - DNA, 18 bp, Homo sapiens
tgaccgctgcccaggtgg

SEQ ID NO: 6453607 - DNA, 19 bp, Homo sapiens
tgaccgctgcccaggtggg

SEQ ID NO: 6453608 - DNA, 23 bp, Homo sapiens
tgaccgcttccccgatgtgagcc

SEQ ID NO: 6453609 - DNA, 13 bp, Homo sapiens
tgaccggcacctg

SEQ ID NO: 6453610 - DNA, 15 bp, Homo sapiens
tgaccggcacctgcg

SEQ ID NO: 6453611 - DNA, 17 bp, Homo sapiens
tgaccggcccgccacct

SEQ ID NO: 6453612 - DNA, 13 bp, Homo sapiens
tgaccggctgccg

SEQ ID NO: 6453613 - DNA, 19 bp, Homo sapiens
tgaccgggggctgctgggc

SEQ ID NO: 6453614 - DNA, 14 bp, Homo sapiens
tgaccggggtcctg

SEQ ID NO: 6453615 - DNA, 15 bp, Homo sapiens
tgaccggtgctttta

SEQ ID NO: 6453616 - DNA, 20 bp, Homo sapiens
tgaccgtgttggtctgtact

SEQ ID NO: 6453617 - DNA, 20 bp, Homo sapiens
tgaccgttttcacttgtctc

SEQ ID NO: 6453618 - DNA, 21 bp, Homo sapiens
tgaccgttttcacttgtctcc

SEQ ID NO: 6453619 - DNA, 18 bp, Homo sapiens
tcccttgacctttccagc

SEQ ID NO: 6453620 - DNA, 19 bp, Homo sapiens
tcccttgagaattccctgt

SEQ ID NO: 6453621 - DNA, 19 bp, Homo sapiens
tcccttgagacctcagcca

SEQ ID NO: 6453622 - DNA, 16 bp, Homo sapiens
tcccttgagatgagtt

SEQ ID NO: 6453623 - DNA, 19 bp, Homo sapiens
tcccttgagatgagtttct

SEQ ID NO: 6453624 - DNA, 21 bp, Homo sapiens
tcccttgagatgagtttctgg

SEQ ID NO: 6453625 - DNA, 23 bp, Homo sapiens
tcccttgaggaaacaacagcttt

SEQ ID NO: 6453626 - DNA, 17 bp, Homo sapiens
tcccttgagggctgcag

SEQ ID NO: 6453627 - DNA, 18 bp, Homo sapiens
tcccttgagggctgcagt

SEQ ID NO: 6453628 - DNA, 18 bp, Homo sapiens
tcccttgagtaggccctg

SEQ ID NO: 6453629 - DNA, 19 bp, Homo sapiens
tcccttgagtaggccctgc

SEQ ID NO: 6453630 - DNA, 21 bp, Homo sapiens
tcccttgagtaggccctgctt

SEQ ID NO: 6453631 - DNA, 16 bp, Homo sapiens
tcccttgatgaagaag

SEQ ID NO: 6453632 - DNA, 18 bp, Homo sapiens
tcccttgatgcacagaga

SEQ ID NO: 6453633 - DNA, 18 bp, Homo sapiens
tcccttgatgggtgctgc

SEQ ID NO: 6453634 - DNA, 20 bp, Homo sapiens
tcccttgccccaggccaggt

SEQ ID NO: 6453635 - DNA, 23 bp, Homo sapiens
tcccttgccccaggccaggtagc

SEQ ID NO: 6453636 - DNA, 14 bp, Homo sapiens
tcccttgcccccct

SEQ ID NO: 6453637 - DNA, 14 bp, Homo sapiens
tcccttgccctccc

SEQ ID NO: 6453638 - DNA, 23 bp, Homo sapiens
tcccttgccctccctttctctct

SEQ ID NO: 6453639 - DNA, 12 bp, Homo sapiens
tcccttgcctca

SEQ ID NO: 6453640 - DNA, 16 bp, Homo sapiens
tcccttgcctctgccc

SEQ ID NO: 6453641 - DNA, 19 bp, Homo sapiens
tcccttgcctctgccctgg

SEQ ID NO: 6453642 - DNA, 18 bp, Homo sapiens
tcccttgccttcctgcct

SEQ ID NO: 6453643 - DNA, 18 bp, Homo sapiens
tcccttgcttagcctgtg

SEQ ID NO: 6453644 - DNA, 14 bp, Homo sapiens
tcccttgcttgcct

SEQ ID NO: 6453645 - DNA, 18 bp, Homo sapiens
tcccttgcttttccctct

SEQ ID NO: 6453646 - DNA, 21 bp, Homo sapiens
tcccttgcttttccctctttt

SEQ ID NO: 6453647 - DNA, 22 bp, Homo sapiens
tcccttgcttttccctcttttc

SEQ ID NO: 6453648 - DNA, 20 bp, Homo sapiens
tcccttgctttttgctgtgt

SEQ ID NO: 6453649 - DNA, 19 bp, Homo sapiens
tcccttggaaacctgccct

SEQ ID NO: 6453650 - DNA, 20 bp, Homo sapiens
tcccttggaaacctgccctg

SEQ ID NO: 6453651 - DNA, 22 bp, Homo sapiens
tcccttggaaagttcagccaga

SEQ ID NO: 6453652 - DNA, 16 bp, Homo sapiens
tcccttggacatttta

SEQ ID NO: 6453653 - DNA, 18 bp, Homo sapiens
tcccttggacattttatg

SEQ ID NO: 6453654 - DNA, 18 bp, Homo sapiens
tcccttggatcagaggtc

SEQ ID NO: 6453655 - DNA, 22 bp, Homo sapiens
tcccttggatgtagtctgaggc

SEQ ID NO: 6453656 - DNA, 19 bp, Homo sapiens
tcccttggattgtccccga

SEQ ID NO: 6453657 - DNA, 20 bp, Homo sapiens
tcccttggattgtccccgac

SEQ ID NO: 6453658 - DNA, 13 bp, Homo sapiens
tcccttggccacg

SEQ ID NO: 6453659 - DNA, 17 bp, Homo sapiens
tcccttggccacggcct

SEQ ID NO: 6453660 - DNA, 16 bp, Homo sapiens
tcccttggcccagaga

SEQ ID NO: 6453661 - DNA, 16 bp, Homo sapiens
tcccttggcccctctc

SEQ ID NO: 6453662 - DNA, 16 bp, Homo sapiens
tcccttggcctcagaa

SEQ ID NO: 6453663 - DNA, 16 bp, Homo sapiens
tcccttggctttgagg

SEQ ID NO: 6453664 - DNA, 19 bp, Homo sapiens
tcccttgggaaggacacag

SEQ ID NO: 6453665 - DNA, 14 bp, Homo sapiens
tcccttgggctccc

SEQ ID NO: 6453666 - DNA, 16 bp, Homo sapiens
tcccttggggaagggt

SEQ ID NO: 6453667 - DNA, 18 bp, Homo sapiens
tcccttggtcttccatgg

SEQ ID NO: 6453668 - DNA, 21 bp, Homo sapiens
tcccttgtaaagacagagtga

SEQ ID NO: 6453669 - DNA, 15 bp, Homo sapiens
tcccttgtatcccct

SEQ ID NO: 6453670 - DNA, 16 bp, Homo sapiens
tcccttgtatcccctg

SEQ ID NO: 6453671 - DNA, 23 bp, Homo sapiens
tcccttgtattttgttaaagctg

SEQ ID NO: 6453672 - DNA, 15 bp, Homo sapiens
tcccttgtcaccagg

SEQ ID NO: 6453673 - DNA, 22 bp, Homo sapiens
tcccttgtcagttccaaacaga

SEQ ID NO: 6453674 - DNA, 17 bp, Homo sapiens
tcccttgtgtctgttgc

SEQ ID NO: 6453675 - DNA, 14 bp, Homo sapiens
tcccttgtgttcct

SEQ ID NO: 6453676 - DNA, 21 bp, Homo sapiens
tcccttgtgttccttctgtga

SEQ ID NO: 6453677 - DNA, 13 bp, Homo sapiens
tcccttgttctct

SEQ ID NO: 6453678 - DNA, 14 bp, Homo sapiens
tcccttgttctcta

SEQ ID NO: 6453679 - DNA, 18 bp, Homo sapiens
tcccttgtttataaatag

SEQ ID NO: 6453680 - DNA, 16 bp, Homo sapiens
tccctttaaagccttt

SEQ ID NO: 6453681 - DNA, 16 bp, Homo sapiens
tccctttaagccaaga

SEQ ID NO: 6453682 - DNA, 18 bp, Homo sapiens
tccctttacagctctcct

SEQ ID NO: 6453683 - DNA, 17 bp, Homo sapiens
tccctttagctgtgtta

SEQ ID NO: 6453684 - DNA, 18 bp, Homo sapiens
tccctttagctgtgttat

SEQ ID NO: 6453685 - DNA, 15 bp, Homo sapiens
tccctttcacactgt

SEQ ID NO: 6453686 - DNA, 21 bp, Homo sapiens
tccctttcatgatttgcaact

SEQ ID NO: 6453687 - DNA, 13 bp, Homo sapiens
tccctttcatgtt

SEQ ID NO: 6453688 - DNA, 14 bp, Homo sapiens
tccctttccaacct

SEQ ID NO: 6453689 - DNA, 15 bp, Homo sapiens
tccctttccaacctc

SEQ ID NO: 6453690 - DNA, 22 bp, Homo sapiens
tccctttccccattcagtgaca

SEQ ID NO: 6453691 - DNA, 23 bp, Homo sapiens
tccctttccccattcagtgacat

SEQ ID NO: 6453692 - DNA, 18 bp, Homo sapiens
tccctttcccctagatcc

SEQ ID NO: 6453693 - DNA, 13 bp, Homo sapiens
tccctttccctgc

SEQ ID NO: 6453694 - DNA, 15 bp, Homo sapiens
tccctttcccttctt

SEQ ID NO: 6453695 - DNA, 19 bp, Homo sapiens
tccctttcctcccttctga

SEQ ID NO: 6453696 - DNA, 23 bp, Homo sapiens
tccctttccttccatccctaccc

SEQ ID NO: 6453697 - DNA, 14 bp, Homo sapiens
tccctttctcccct

SEQ ID NO: 6453698 - DNA, 16 bp, Homo sapiens
tccctttctcccctgc

SEQ ID NO: 6453699 - DNA, 23 bp, Homo sapiens
tccctttctcccctgcccccagg

SEQ ID NO: 6453700 - DNA, 13 bp, Homo sapiens
tccctttctggga

SEQ ID NO: 6453701 - DNA, 15 bp, Homo sapiens
tccctttctgggagg

SEQ ID NO: 6453702 - DNA, 18 bp, Homo sapiens
tccctttgacgccatccc

SEQ ID NO: 6453703 - DNA, 19 bp, Homo sapiens
tccctttgacgccatccca

SEQ ID NO: 6453704 - DNA, 15 bp, Homo sapiens
tccctttgacttcag

SEQ ID NO: 6453705 - DNA, 15 bp, Homo sapiens
tccctttgccagcca

SEQ ID NO: 6453706 - DNA, 18 bp, Homo sapiens
tccctttgccttaaacct

SEQ ID NO: 6453707 - DNA, 20 bp, Homo sapiens
tccctttgcgtcaggagcag

SEQ ID NO: 6453708 - DNA, 14 bp, Homo sapiens
tccctttgctccac

SEQ ID NO: 6453709 - DNA, 19 bp, Homo sapiens
tccctttgctccaccccac

SEQ ID NO: 6453710 - DNA, 14 bp, Homo sapiens
tccctttgctcccg

SEQ ID NO: 6453711 - DNA, 13 bp, Homo sapiens
tccctttgctgct

SEQ ID NO: 6453712 - DNA, 14 bp, Homo sapiens
tccctttggggata

SEQ ID NO: 6453713 - DNA, 16 bp, Homo sapiens
tccctttgtctttcaa

SEQ ID NO: 6453714 - DNA, 19 bp, Homo sapiens
tccctttgtggactttatt

SEQ ID NO: 6453715 - DNA, 21 bp, Homo sapiens
tccctttgttgctgtctggct

SEQ ID NO: 6453716 - DNA, 21 bp, Homo sapiens
tccctttgtttgaagttggtt

SEQ ID NO: 6453717 - DNA, 19 bp, Homo sapiens
tcccttttaatcctggctg

SEQ ID NO: 6453718 - DNA, 20 bp, Homo sapiens
tcccttttacatactgctgt

SEQ ID NO: 6453719 - DNA, 18 bp, Homo sapiens
tcccttttacattctgtg

SEQ ID NO: 6453720 - DNA, 18 bp, Homo sapiens
tcccttttatctattaga

SEQ ID NO: 6453721 - DNA, 16 bp, Homo sapiens
tcccttttatcttcta

SEQ ID NO: 6453722 - DNA, 20 bp, Homo sapiens
tcccttttcattctcctcct

SEQ ID NO: 6453723 - DNA, 16 bp, Homo sapiens
tcccttttccatcatc

SEQ ID NO: 6453724 - DNA, 13 bp, Homo sapiens
tcccttttcctct

SEQ ID NO: 6453725 - DNA, 21 bp, Homo sapiens
tcccttttcctgtcagtgttt

SEQ ID NO: 6453726 - DNA, 13 bp, Homo sapiens
tcccttttctgtt

SEQ ID NO: 6453727 - DNA, 14 bp, Homo sapiens
tcccttttctttcc

SEQ ID NO: 6453728 - DNA, 16 bp, Homo sapiens
tcccttttctttcctt

SEQ ID NO: 6453729 - DNA, 19 bp, Homo sapiens
tcccttttggggcaagaca

SEQ ID NO: 6453730 - DNA, 14 bp, Homo sapiens
tccctttttaaaaa

SEQ ID NO: 6453731 - DNA, 15 bp, Homo sapiens
tccctttttaaaaaa

SEQ ID NO: 6453732 - DNA, 18 bp, Homo sapiens
tccctttttaaaaaatac

SEQ ID NO: 6453733 - DNA, 19 bp, Homo sapiens
tccctttttaaacaaatgg

SEQ ID NO: 6453734 - DNA, 21 bp, Homo sapiens
tccctttttctccacactcca

SEQ ID NO: 6453735 - DNA, 15 bp, Homo sapiens
tccctttttgaagtg

SEQ ID NO: 6453736 - DNA, 16 bp, Homo sapiens
tccctttttgaagtgt

SEQ ID NO: 6453737 - DNA, 16 bp, Homo sapiens
tccctttttgaattgt

SEQ ID NO: 6453738 - DNA, 19 bp, Homo sapiens
tccctttttgaattgtgtg

SEQ ID NO: 6453739 - DNA, 22 bp, Homo sapiens
tccctttttgagtaattttctg

SEQ ID NO: 6453740 - DNA, 16 bp, Homo sapiens
tccctttttgcagggg

SEQ ID NO: 6453741 - DNA, 21 bp, Homo sapiens
tccctttttttaagtaaggaa

SEQ ID NO: 6453742 - DNA, 17 bp, Homo sapiens
tcccttttttttctggg

SEQ ID NO: 6453743 - DNA, 14 bp, Homo sapiens
tccgaaaaaaaaat

SEQ ID NO: 6453744 - DNA, 19 bp, Homo sapiens
tccgaaagaagacacagaa

SEQ ID NO: 6453745 - DNA, 14 bp, Homo sapiens
tccgaaatcagcag

SEQ ID NO: 6453746 - DNA, 22 bp, Homo sapiens
tccgaacgctgctccatgcaca

SEQ ID NO: 6453747 - DNA, 15 bp, Homo sapiens
tccgaagaaaagaat

SEQ ID NO: 6453748 - DNA, 19 bp, Homo sapiens
tccgaagaccttctgaaga

SEQ ID NO: 6453749 - DNA, 22 bp, Homo sapiens
tccgaagggaattaaaaagaag

SEQ ID NO: 6453750 - DNA, 17 bp, Homo sapiens
tccgaaggggctctgag

SEQ ID NO: 6453751 - DNA, 21 bp, Homo sapiens
tccgaagtatgagggaaaatg

SEQ ID NO: 6453752 - DNA, 15 bp, Homo sapiens
tccgaagtctctgat

SEQ ID NO: 6453753 - DNA, 17 bp, Homo sapiens
tccgaatgggttttcta

SEQ ID NO: 6453754 - DNA, 20 bp, Homo sapiens
tccgacaaccgatgctccag

SEQ ID NO: 6453755 - DNA, 16 bp, Homo sapiens
tccgacaccactggga

SEQ ID NO: 6453756 - DNA, 15 bp, Homo sapiens
tccgacaggagcact

SEQ ID NO: 6453757 - DNA, 20 bp, Homo sapiens
tccgacatcccagaccagcc

SEQ ID NO: 6453758 - DNA, 18 bp, Homo sapiens
tccgaccacttccagggg

SEQ ID NO: 6453759 - DNA, 18 bp, Homo sapiens
tccgaccctctgggaacc

SEQ ID NO: 6453760 - DNA, 21 bp, Homo sapiens
tccgaccctctgggaacctcc

SEQ ID NO: 6453761 - DNA, 22 bp, Homo sapiens
tccgacctacgttcctggcccc

SEQ ID NO: 6453762 - DNA, 15 bp, Homo sapiens
tccgacctccatgat

SEQ ID NO: 6453763 - DNA, 15 bp, Homo sapiens
tccgacctctctcag

SEQ ID NO: 6453764 - DNA, 14 bp, Homo sapiens
tccgacctctctcg

SEQ ID NO: 6453765 - DNA, 17 bp, Homo sapiens
tccgacctctctcggcc

SEQ ID NO: 6453766 - DNA, 18 bp, Homo sapiens
tccgacctctctcggccc

SEQ ID NO: 6453767 - DNA, 20 bp, Homo sapiens
tccgacctctctcggccccc

SEQ ID NO: 6453768 - DNA, 14 bp, Homo sapiens
tccgactctaagct

SEQ ID NO: 6453769 - DNA, 13 bp, Homo sapiens
tccgactgcccag

SEQ ID NO: 6453770 - DNA, 14 bp, Homo sapiens
tccgactgcccaga

SEQ ID NO: 6453771 - DNA, 17 bp, Homo sapiens
tccgactgcccagaaag

SEQ ID NO: 6453772 - DNA, 12 bp, Homo sapiens
tccgactgcttt

SEQ ID NO: 6453773 - DNA, 15 bp, Homo sapiens
tccgactgctttgga

SEQ ID NO: 6453774 - DNA, 15 bp, Homo sapiens
tccgacttcccctgg

SEQ ID NO: 6453775 - DNA, 21 bp, Homo sapiens
tccgacttgtgcacaggcaga

SEQ ID NO: 6453776 - DNA, 12 bp, Homo sapiens
tccgagaacaac

SEQ ID NO: 6453777 - DNA, 14 bp, Homo sapiens
tccgagagcagtgg

SEQ ID NO: 6453778 - DNA, 20 bp, Homo sapiens
tccgagagcagtgggcaggt

SEQ ID NO: 6453779 - DNA, 19 bp, Homo sapiens
tccgagatccccagggcag

SEQ ID NO: 6453780 - DNA, 14 bp, Homo sapiens
tccgagattcagac

SEQ ID NO: 6453781 - DNA, 15 bp, Homo sapiens
tccgagcattccagt

SEQ ID NO: 6453782 - DNA, 20 bp, Homo sapiens
tccgagcattccagtaactt

SEQ ID NO: 6453783 - DNA, 11 bp, Homo sapiens
tccgagcccct

SEQ ID NO: 6453784 - DNA, 20 bp, Homo sapiens
tccgagctctggtgctttag

SEQ ID NO: 6453785 - DNA, 16 bp, Homo sapiens
tccgagctctgtcctc

SEQ ID NO: 6453786 - DNA, 12 bp, Homo sapiens
tccgagctgctt

SEQ ID NO: 6453787 - DNA, 12 bp, Homo sapiens
tccgaggcaggg

SEQ ID NO: 6453788 - DNA, 14 bp, Homo sapiens
tccgaggcagggtc

SEQ ID NO: 6453789 - DNA, 18 bp, Homo sapiens
tccgaggcctacctgctc

SEQ ID NO: 6453790 - DNA, 19 bp, Homo sapiens
tccgaggcctggctctgga

SEQ ID NO: 6453791 - DNA, 21 bp, Homo sapiens
tccgaggcctggctctggagc

SEQ ID NO: 6453792 - DNA, 14 bp, Homo sapiens
tccgaggctccccg

SEQ ID NO: 6453793 - DNA, 16 bp, Homo sapiens
tccgaggctccccgcc

SEQ ID NO: 6453794 - DNA, 21 bp, Homo sapiens
tccgaggctccccgcctccac

SEQ ID NO: 6453795 - DNA, 13 bp, Homo sapiens
tccgagggcccct

SEQ ID NO: 6453796 - DNA, 16 bp, Homo sapiens
tccgagggcccctctc

SEQ ID NO: 6453797 - DNA, 18 bp, Homo sapiens
tccgagggcccctctcca

SEQ ID NO: 6453798 - DNA, 18 bp, Homo sapiens
tgaccgttttcatcctgg

SEQ ID NO: 6453799 - DNA, 22 bp, Homo sapiens
tgaccgttttcatcctggcctc

SEQ ID NO: 6453800 - DNA, 19 bp, Homo sapiens
tgacctaaaagttgaaaag

SEQ ID NO: 6453801 - DNA, 20 bp, Homo sapiens
tgacctaaatccattttcta

SEQ ID NO: 6453802 - DNA, 21 bp, Homo sapiens
tgacctaaatccattttctaa

SEQ ID NO: 6453803 - DNA, 16 bp, Homo sapiens
tgacctaaattagata

SEQ ID NO: 6453804 - DNA, 17 bp, Homo sapiens
tgacctaaattatttac

SEQ ID NO: 6453805 - DNA, 16 bp, Homo sapiens
tgacctaacctaggag

SEQ ID NO: 6453806 - DNA, 15 bp, Homo sapiens
tgacctacagtgctg

SEQ ID NO: 6453807 - DNA, 19 bp, Homo sapiens
tgacctacagtgctgtgta

SEQ ID NO: 6453808 - DNA, 14 bp, Homo sapiens
tgacctaccccagc

SEQ ID NO: 6453809 - DNA, 19 bp, Homo sapiens
tgacctaccccagccaggc

SEQ ID NO: 6453810 - DNA, 20 bp, Homo sapiens
tgacctaccccagccaggct

SEQ ID NO: 6453811 - DNA, 14 bp, Homo sapiens
tgacctaccctgga

SEQ ID NO: 6453812 - DNA, 18 bp, Homo sapiens
tgacctacctggcccctg

SEQ ID NO: 6453813 - DNA, 18 bp, Homo sapiens
tgacctacttcctcctag

SEQ ID NO: 6453814 - DNA, 19 bp, Homo sapiens
tgacctagaccagtttgca

SEQ ID NO: 6453815 - DNA, 21 bp, Homo sapiens
tgacctagttcagatacaggg

SEQ ID NO: 6453816 - DNA, 19 bp, Homo sapiens
tgacctatcagtatggtgc

SEQ ID NO: 6453817 - DNA, 15 bp, Homo sapiens
tgacctcaaaagaaa

SEQ ID NO: 6453818 - DNA, 17 bp, Homo sapiens
tgacctcaaaagaaaat

SEQ ID NO: 6453819 - DNA, 21 bp, Homo sapiens
tgacctcaaatgatgtgcctg

SEQ ID NO: 6453820 - DNA, 17 bp, Homo sapiens
tgacctcaactaaccct

SEQ ID NO: 6453821 - DNA, 20 bp, Homo sapiens
tgacctcaagtgatctgccc

SEQ ID NO: 6453822 - DNA, 17 bp, Homo sapiens
tgacctcaatttcaatt

SEQ ID NO: 6453823 - DNA, 23 bp, Homo sapiens
tgacctcacacacctctgcccct

SEQ ID NO: 6453824 - DNA, 15 bp, Homo sapiens
tgacctcacagtgac

SEQ ID NO: 6453825 - DNA, 18 bp, Homo sapiens
tgacctcacctggtcctc

SEQ ID NO: 6453826 - DNA, 14 bp, Homo sapiens
tgacctcacgtgca

SEQ ID NO: 6453827 - DNA, 19 bp, Homo sapiens
tgacctcactgtcctgtga

SEQ ID NO: 6453828 - DNA, 15 bp, Homo sapiens
tgacctcacttctgg

SEQ ID NO: 6453829 - DNA, 12 bp, Homo sapiens
tgacctcagcaa

SEQ ID NO: 6453830 - DNA, 15 bp, Homo sapiens
tgacctcagcaaatc

SEQ ID NO: 6453831 - DNA, 14 bp, Homo sapiens
tgacctcagctgca

SEQ ID NO: 6453832 - DNA, 16 bp, Homo sapiens
tgacctcagctgcaca

SEQ ID NO: 6453833 - DNA, 19 bp, Homo sapiens
tgacctcaggcactagcct

SEQ ID NO: 6453834 - DNA, 20 bp, Homo sapiens
tgacctcagggctatgtgga

SEQ ID NO: 6453835 - DNA, 21 bp, Homo sapiens
tgacctcaggtgatccaccca

SEQ ID NO: 6453836 - DNA, 22 bp, Homo sapiens
tgacctcaggtgatccacccac

SEQ ID NO: 6453837 - DNA, 20 bp, Homo sapiens
tgacctcaggtgatccgcct

SEQ ID NO: 6453838 - DNA, 20 bp, Homo sapiens
tgacctcaggtgatctgccc

SEQ ID NO: 6453839 - DNA, 13 bp, Homo sapiens
tgacctcatgcat

SEQ ID NO: 6453840 - DNA, 16 bp, Homo sapiens
tgacctcatgcatctc

SEQ ID NO: 6453841 - DNA, 22 bp, Homo sapiens
tgacctcatgcatctccacctg

SEQ ID NO: 6453842 - DNA, 22 bp, Homo sapiens
tgacctcattaaccgatgcttt

SEQ ID NO: 6453843 - DNA, 18 bp, Homo sapiens
tgacctccagctttcctg

SEQ ID NO: 6453844 - DNA, 18 bp, Homo sapiens
tgacctccatactgggct

SEQ ID NO: 6453845 - DNA, 15 bp, Homo sapiens
tgacctcccaactct

SEQ ID NO: 6453846 - DNA, 20 bp, Homo sapiens
tgacctcccacctatccgcc

SEQ ID NO: 6453847 - DNA, 17 bp, Homo sapiens
tgacctcccactttggg

SEQ ID NO: 6453848 - DNA, 19 bp, Homo sapiens
tgacctcccactttgggga

SEQ ID NO: 6453849 - DNA, 11 bp, Homo sapiens
tgacctcccag

SEQ ID NO: 6453850 - DNA, 15 bp, Homo sapiens
tgacctcccagccct

SEQ ID NO: 6453851 - DNA, 22 bp, Homo sapiens
tgacctcccagccctatggatg

SEQ ID NO: 6453852 - DNA, 23 bp, Homo sapiens
tgacctcccagccctatggatgt

SEQ ID NO: 6453853 - DNA, 15 bp, Homo sapiens
tgacctcccagcctt

SEQ ID NO: 6453854 - DNA, 13 bp, Homo sapiens
tgacctccccctc

SEQ ID NO: 6453855 - DNA, 17 bp, Homo sapiens
tgacctccccctccttc

SEQ ID NO: 6453856 - DNA, 19 bp, Homo sapiens
tgacctccccctccttccc

SEQ ID NO: 6453857 - DNA, 14 bp, Homo sapiens
tgacctcccctccc

SEQ ID NO: 6453858 - DNA, 22 bp, Homo sapiens
tgacctccctctaatttatctt

SEQ ID NO: 6453859 - DNA, 17 bp, Homo sapiens
tgacctccgccatccac

SEQ ID NO: 6453860 - DNA, 19 bp, Homo sapiens
tgacctccggccaggtgcc

SEQ ID NO: 6453861 - DNA, 17 bp, Homo sapiens
tgacctccgtcctctcc

SEQ ID NO: 6453862 - DNA, 12 bp, Homo sapiens
tgacctcctctg

SEQ ID NO: 6453863 - DNA, 13 bp, Homo sapiens
tgacctcctctgg

SEQ ID NO: 6453864 - DNA, 15 bp, Homo sapiens
tgacctcctctgggc

SEQ ID NO: 6453865 - DNA, 13 bp, Homo sapiens
tgacctcctgcag

SEQ ID NO: 6453866 - DNA, 11 bp, Homo sapiens
tgacctcctgt

SEQ ID NO: 6453867 - DNA, 20 bp, Homo sapiens
tgacctccttctgcaaagtg

SEQ ID NO: 6453868 - DNA, 21 bp, Homo sapiens
tgacctcgactggtttttcta

SEQ ID NO: 6453869 - DNA, 18 bp, Homo sapiens
tgacctcggacagagccc

SEQ ID NO: 6453870 - DNA, 22 bp, Homo sapiens
tgacctcggacagagcccccct

SEQ ID NO: 6453871 - DNA, 16 bp, Homo sapiens
tgacctcgtactcagg

SEQ ID NO: 6453872 - DNA, 17 bp, Homo sapiens
tgacctcgtactcagga

SEQ ID NO: 6453873 - DNA, 17 bp, Homo sapiens
tgacctcgtgatccacc

SEQ ID NO: 6453874 - DNA, 18 bp, Homo sapiens
tgacctcgtgatccaccc

SEQ ID NO: 6453875 - DNA, 18 bp, Homo sapiens
tgacctcgtgatccgcct

SEQ ID NO: 6453876 - DNA, 19 bp, Homo sapiens
tgacctcgtgatctaccca

SEQ ID NO: 6453877 - DNA, 20 bp, Homo sapiens
tgacctctagccctgcccgg

SEQ ID NO: 6453878 - DNA, 21 bp, Homo sapiens
tgacctctcacttttttataa

SEQ ID NO: 6453879 - DNA, 14 bp, Homo sapiens
tgacctctcagggc

SEQ ID NO: 6453880 - DNA, 15 bp, Homo sapiens
tgacctctccagcat

SEQ ID NO: 6453881 - DNA, 19 bp, Homo sapiens
tgacctctccagcatccca

SEQ ID NO: 6453882 - DNA, 13 bp, Homo sapiens
tgacctctccggc

SEQ ID NO: 6453883 - DNA, 19 bp, Homo sapiens
tgacctctctacttcccct

SEQ ID NO: 6453884 - DNA, 16 bp, Homo sapiens
tgacctctctctctgg

SEQ ID NO: 6453885 - DNA, 17 bp, Homo sapiens
tgacctctgcaagaggg

SEQ ID NO: 6453886 - DNA, 18 bp, Homo sapiens
tgacctctgcagcaataa

SEQ ID NO: 6453887 - DNA, 21 bp, Homo sapiens
tgacctctgcagcaataaagc

SEQ ID NO: 6453888 - DNA, 16 bp, Homo sapiens
tgacctctgctgagtg

SEQ ID NO: 6453889 - DNA, 19 bp, Homo sapiens
tgacctctgctgagtgctg

SEQ ID NO: 6453890 - DNA, 23 bp, Homo sapiens
tgacctctgctgagtgctgggca

SEQ ID NO: 6453891 - DNA, 17 bp, Homo sapiens
tgacctctgtcctccct

SEQ ID NO: 6453892 - DNA, 20 bp, Homo sapiens
tgacctctgtgaccaactgt

SEQ ID NO: 6453893 - DNA, 22 bp, Homo sapiens
tgacctctgtgaccaactgttg

SEQ ID NO: 6453894 - DNA, 18 bp, Homo sapiens
tgacctctgttgtcctcc

SEQ ID NO: 6453895 - DNA, 21 bp, Homo sapiens
tgacctctgttgtcctcccct

SEQ ID NO: 6453896 - DNA, 13 bp, Homo sapiens
tgacctcttgcct

SEQ ID NO: 6453897 - DNA, 14 bp, Homo sapiens
tgacctcttgcctc

SEQ ID NO: 6453898 - DNA, 16 bp, Homo sapiens
tgacctcttgcctcga

SEQ ID NO: 6453899 - DNA, 21 bp, Homo sapiens
tgacctcttgctgtctctgct

SEQ ID NO: 6453900 - DNA, 23 bp, Homo sapiens
tgacctcttgctgtctctgctcg

SEQ ID NO: 6453901 - DNA, 19 bp, Homo sapiens
tgacctgaaataatatatt

SEQ ID NO: 6453902 - DNA, 15 bp, Homo sapiens
tgacctgaactctgc

SEQ ID NO: 6453903 - DNA, 13 bp, Homo sapiens
tgacctgaagttc

SEQ ID NO: 6453904 - DNA, 12 bp, Homo sapiens
tgacctgacacc

SEQ ID NO: 6453905 - DNA, 16 bp, Homo sapiens
tgacctgacagcccaa

SEQ ID NO: 6453906 - DNA, 22 bp, Homo sapiens
tgacctgacgatcttccccctt

SEQ ID NO: 6453907 - DNA, 14 bp, Homo sapiens
tgacctgaggaaag

SEQ ID NO: 6453908 - DNA, 15 bp, Homo sapiens
tgacctgaggaagcg

SEQ ID NO: 6453909 - DNA, 16 bp, Homo sapiens
tgacctgatgtaaaca

SEQ ID NO: 6453910 - DNA, 17 bp, Homo sapiens
tgacctgatttccattt

SEQ ID NO: 6453911 - DNA, 22 bp, Homo sapiens
tgacctgcagtcagggcccaga

SEQ ID NO: 6453912 - DNA, 23 bp, Homo sapiens
tgacctgcagtcagggcccagag

SEQ ID NO: 6453913 - DNA, 17 bp, Homo sapiens
tgacctgcatctaagcc

SEQ ID NO: 6453914 - DNA, 19 bp, Homo sapiens
tgacctgccaggcacactg

SEQ ID NO: 6453915 - DNA, 12 bp, Homo sapiens
tgacctgcccat

SEQ ID NO: 6453916 - DNA, 15 bp, Homo sapiens
tgacctgcccatgtc

SEQ ID NO: 6453917 - DNA, 23 bp, Homo sapiens
tgacctgcccatgtccagaggga

SEQ ID NO: 6453918 - DNA, 19 bp, Homo sapiens
tgacctgccccgcccagct

SEQ ID NO: 6453919 - DNA, 19 bp, Homo sapiens
tgacctgcccgatccagat

SEQ ID NO: 6453920 - DNA, 16 bp, Homo sapiens
tgacctgcctcccttc

SEQ ID NO: 6453921 - DNA, 21 bp, Homo sapiens
tgacctgcctctcacacacat

SEQ ID NO: 6453922 - DNA, 16 bp, Homo sapiens
tgacctgctaggccag

SEQ ID NO: 6453923 - DNA, 19 bp, Homo sapiens
tgacctgctaggccagagc

SEQ ID NO: 6453924 - DNA, 21 bp, Homo sapiens
tgacctgctccgccaggaaag

SEQ ID NO: 6453925 - DNA, 23 bp, Homo sapiens
tgacctgctccgctgctccttgg

SEQ ID NO: 6453926 - DNA, 13 bp, Homo sapiens
tgacctgctgaat

SEQ ID NO: 6453927 - DNA, 15 bp, Homo sapiens
tgacctgctgacctg

SEQ ID NO: 6453928 - DNA, 18 bp, Homo sapiens
tgacctgctgacctgtgc

SEQ ID NO: 6453929 - DNA, 22 bp, Homo sapiens
tgacctgctgagctctgagagg

SEQ ID NO: 6453930 - DNA, 17 bp, Homo sapiens
tgacctgctgaggcctc

SEQ ID NO: 6453931 - DNA, 22 bp, Homo sapiens
tgacctgctgtggatgtcccta

SEQ ID NO: 6453932 - DNA, 22 bp, Homo sapiens
tgacctggaagagctgggtacc

SEQ ID NO: 6453933 - DNA, 17 bp, Homo sapiens
tgacctggactgaagtt

SEQ ID NO: 6453934 - DNA, 21 bp, Homo sapiens
tgacctggaggggagaggtca

SEQ ID NO: 6453935 - DNA, 16 bp, Homo sapiens
tgacctggatggggca

SEQ ID NO: 6453936 - DNA, 22 bp, Homo sapiens
tgacctggcatctaattctgat

SEQ ID NO: 6453937 - DNA, 12 bp, Homo sapiens
tgacctggcccc

SEQ ID NO: 6453938 - DNA, 11 bp, Homo sapiens
tgacctgggcc

SEQ ID NO: 6453939 - DNA, 18 bp, Homo sapiens
tgacctgggcccacagag

SEQ ID NO: 6453940 - DNA, 17 bp, Homo sapiens
tgacctggtctggtcag

SEQ ID NO: 6453941 - DNA, 20 bp, Homo sapiens
tgacctggttaaacaaacca

SEQ ID NO: 6453942 - DNA, 16 bp, Homo sapiens
tgacctggttgtccag

SEQ ID NO: 6453943 - DNA, 20 bp, Homo sapiens
tgacctggttgtccaggtct

SEQ ID NO: 6453944 - DNA, 12 bp, Homo sapiens
tgacctgtcacc

SEQ ID NO: 6453945 - DNA, 14 bp, Homo sapiens
tgacctgtcagaat

SEQ ID NO: 6453946 - DNA, 15 bp, Homo sapiens
tgacctgtcagaata

SEQ ID NO: 6453947 - DNA, 21 bp, Homo sapiens
tgacctgtcatgcccccctca

SEQ ID NO: 6453948 - DNA, 22 bp, Homo sapiens
tgacctgtgaccagcactgtct

SEQ ID NO: 6453949 - DNA, 21 bp, Homo sapiens
tgacctgtggggatttctccc

SEQ ID NO: 6453950 - DNA, 23 bp, Homo sapiens
tgacctgtggggatttctcccag

SEQ ID NO: 6453951 - DNA, 14 bp, Homo sapiens
tgacctgtggtgca

SEQ ID NO: 6453952 - DNA, 22 bp, Homo sapiens
tgacctgttaggtctcatgccc

SEQ ID NO: 6453953 - DNA, 13 bp, Homo sapiens
tgacctgttcaga

SEQ ID NO: 6453954 - DNA, 19 bp, Homo sapiens
tgacctgttgccagcagat

SEQ ID NO: 6453955 - DNA, 14 bp, Homo sapiens
tgaccttaaatgca

SEQ ID NO: 6453956 - DNA, 16 bp, Homo sapiens
tgaccttaatttcttg

SEQ ID NO: 6453957 - DNA, 12 bp, Homo sapiens
tgaccttagccc

SEQ ID NO: 6453958 - DNA, 23 bp, Homo sapiens
tgaccttagccccattgctccat

SEQ ID NO: 6453959 - DNA, 22 bp, Homo sapiens
tgaccttagtgtttctgtgcat

SEQ ID NO: 6453960 - DNA, 19 bp, Homo sapiens
tgaccttatccttcctctc

SEQ ID NO: 6453961 - DNA, 14 bp, Homo sapiens
tgaccttcacaggg

SEQ ID NO: 6453962 - DNA, 12 bp, Homo sapiens
tgaccttcacat

SEQ ID NO: 6453963 - DNA, 20 bp, Homo sapiens
tgaccttcagagccagccgg

SEQ ID NO: 6453964 - DNA, 13 bp, Homo sapiens
tgaccttcatttc

SEQ ID NO: 6453965 - DNA, 18 bp, Homo sapiens
tgaccttccaagagcctg

SEQ ID NO: 6453966 - DNA, 19 bp, Homo sapiens
tgaccttccaagagcctga

SEQ ID NO: 6453967 - DNA, 15 bp, Homo sapiens
tgaccttccagagcc

SEQ ID NO: 6453968 - DNA, 12 bp, Homo sapiens
tgaccttcccag

SEQ ID NO: 6453969 - DNA, 11 bp, Homo sapiens
tgaccttcccc

SEQ ID NO: 6453970 - DNA, 19 bp, Homo sapiens
tgaccttcctctggggctc

SEQ ID NO: 6453971 - DNA, 14 bp, Homo sapiens
tgaccttccttcct

SEQ ID NO: 6453972 - DNA, 18 bp, Homo sapiens
tgaccttcggcagtggct

SEQ ID NO: 6453973 - DNA, 16 bp, Homo sapiens
tgaccttctccaggga

SEQ ID NO: 6453974 - DNA, 21 bp, Homo sapiens
tgaccttctgaacatgagtgt

SEQ ID NO: 6453975 - DNA, 17 bp, Homo sapiens
tgaccttgaactcctgg

SEQ ID NO: 6453976 - DNA, 18 bp, Homo sapiens
tccgagggcggccaggga

SEQ ID NO: 6453977 - DNA, 20 bp, Homo sapiens
tccgaggggcgggacccagg

SEQ ID NO: 6453978 - DNA, 17 bp, Homo sapiens
tccgaggttttgaggcg

SEQ ID NO: 6453979 - DNA, 23 bp, Homo sapiens
tccgagtgtgtttcatccttccc

SEQ ID NO: 6453980 - DNA, 15 bp, Homo sapiens
tccgatcaacattta

SEQ ID NO: 6453981 - DNA, 20 bp, Homo sapiens
tccgatcaacatttatgacc

SEQ ID NO: 6453982 - DNA, 14 bp, Homo sapiens
tccgatccttcctc

SEQ ID NO: 6453983 - DNA, 15 bp, Homo sapiens
tccgatccttcctcc

SEQ ID NO: 6453984 - DNA, 15 bp, Homo sapiens
tccgatgacagtgct

SEQ ID NO: 6453985 - DNA, 15 bp, Homo sapiens
tccgatgctgaggcc

SEQ ID NO: 6453986 - DNA, 14 bp, Homo sapiens
tccgatggtatctg

SEQ ID NO: 6453987 - DNA, 12 bp, Homo sapiens
tccgattaattt

SEQ ID NO: 6453988 - DNA, 14 bp, Homo sapiens
tccgcaaatatcct

SEQ ID NO: 6453989 - DNA, 22 bp, Homo sapiens
tccgcaacccatgccctggacc

SEQ ID NO: 6453990 - DNA, 19 bp, Homo sapiens
tccgcacacctctggctgt

SEQ ID NO: 6453991 - DNA, 15 bp, Homo sapiens
tccgcaccagctgct

SEQ ID NO: 6453992 - DNA, 18 bp, Homo sapiens
tccgcaccagctgctctg

SEQ ID NO: 6453993 - DNA, 16 bp, Homo sapiens
tccgcaccctccctag

SEQ ID NO: 6453994 - DNA, 17 bp, Homo sapiens
tccgcaccctgtcctgc

SEQ ID NO: 6453995 - DNA, 23 bp, Homo sapiens
tccgcacctgaccgctgcccagg

SEQ ID NO: 6453996 - DNA, 16 bp, Homo sapiens
tccgcactttccactt

SEQ ID NO: 6453997 - DNA, 23 bp, Homo sapiens
tccgcactttccacttcttcctt

SEQ ID NO: 6453998 - DNA, 20 bp, Homo sapiens
tccgcagactgcttggccag

SEQ ID NO: 6453999 - DNA, 23 bp, Homo sapiens
tccgcagactgcttggccagatg

SEQ ID NO: 6454000 - DNA, 23 bp, Homo sapiens
tccgcagcccccacccccaaggt

SEQ ID NO: 6454001 - DNA, 18 bp, Homo sapiens
tccgcagctctagtcctt

SEQ ID NO: 6454002 - DNA, 19 bp, Homo sapiens
tccgcagggcgcccagcgc

SEQ ID NO: 6454003 - DNA, 22 bp, Homo sapiens
tccgcaggtcaccttagttcac

SEQ ID NO: 6454004 - DNA, 16 bp, Homo sapiens
tccgcaggtgctggtc

SEQ ID NO: 6454005 - DNA, 17 bp, Homo sapiens
tccgcagtgtctccacc

SEQ ID NO: 6454006 - DNA, 14 bp, Homo sapiens
tccgcatccctacc

SEQ ID NO: 6454007 - DNA, 14 bp, Homo sapiens
tccgcatccctgct

SEQ ID NO: 6454008 - DNA, 16 bp, Homo sapiens
tccgcatccctgcttc

SEQ ID NO: 6454009 - DNA, 21 bp, Homo sapiens
tccgcatgatgtttccctctc

SEQ ID NO: 6454010 - DNA, 11 bp, Homo sapiens
tccgcatgtgt

SEQ ID NO: 6454011 - DNA, 19 bp, Homo sapiens
tccgcattggaagagcccg

SEQ ID NO: 6454012 - DNA, 22 bp, Homo sapiens
tccgccaagatctacaggacaa

SEQ ID NO: 6454013 - DNA, 16 bp, Homo sapiens
tccgccaatctggccc

SEQ ID NO: 6454014 - DNA, 17 bp, Homo sapiens
tccgccaatctggccct

SEQ ID NO: 6454015 - DNA, 18 bp, Homo sapiens
tccgccaatgcacggcct

SEQ ID NO: 6454016 - DNA, 14 bp, Homo sapiens
tccgccactggggc

SEQ ID NO: 6454017 - DNA, 12 bp, Homo sapiens
tccgccagaccc

SEQ ID NO: 6454018 - DNA, 23 bp, Homo sapiens
tccgccagaccccgtggctctgg

SEQ ID NO: 6454019 - DNA, 12 bp, Homo sapiens
tccgccagccac

SEQ ID NO: 6454020 - DNA, 16 bp, Homo sapiens
tccgccagccacagga

SEQ ID NO: 6454021 - DNA, 14 bp, Homo sapiens
tccgccagccctgt

SEQ ID NO: 6454022 - DNA, 15 bp, Homo sapiens
tccgccagccctgtt

SEQ ID NO: 6454023 - DNA, 13 bp, Homo sapiens
tccgccagcctcc

SEQ ID NO: 6454024 - DNA, 20 bp, Homo sapiens
tccgccagcctcctctggac

SEQ ID NO: 6454025 - DNA, 12 bp, Homo sapiens
tccgccaggaaa

SEQ ID NO: 6454026 - DNA, 16 bp, Homo sapiens
tccgccaggcgctgca

SEQ ID NO: 6454027 - DNA, 16 bp, Homo sapiens
tccgccagtgtttctg

SEQ ID NO: 6454028 - DNA, 17 bp, Homo sapiens
tccgccagtgtttctga

SEQ ID NO: 6454029 - DNA, 19 bp, Homo sapiens
tccgccagtgtttctgaat

SEQ ID NO: 6454030 - DNA, 16 bp, Homo sapiens
tccgcccacctcagcc

SEQ ID NO: 6454031 - DNA, 18 bp, Homo sapiens
tccgcccacctcagcctc

SEQ ID NO: 6454032 - DNA, 15 bp, Homo sapiens
tccgcccagcctctc

SEQ ID NO: 6454033 - DNA, 20 bp, Homo sapiens
tccgccccccggcctggccc

SEQ ID NO: 6454034 - DNA, 19 bp, Homo sapiens
tccgccccggacagggtgg

SEQ ID NO: 6454035 - DNA, 22 bp, Homo sapiens
tccgccccgtgctcctctgccc

SEQ ID NO: 6454036 - DNA, 14 bp, Homo sapiens
tccgcccctgagcc

SEQ ID NO: 6454037 - DNA, 20 bp, Homo sapiens
tccgcccctgagcccactgt

SEQ ID NO: 6454038 - DNA, 15 bp, Homo sapiens
tccgcccctgcctgc

SEQ ID NO: 6454039 - DNA, 17 bp, Homo sapiens
tccgccccttcccttcc

SEQ ID NO: 6454040 - DNA, 17 bp, Homo sapiens
tccgcccgcctctgcct

SEQ ID NO: 6454041 - DNA, 22 bp, Homo sapiens
tccgccctcaaaatgacagcca

SEQ ID NO: 6454042 - DNA, 12 bp, Homo sapiens
tccgccctcctc

SEQ ID NO: 6454043 - DNA, 15 bp, Homo sapiens
tccgccctcctcggg

SEQ ID NO: 6454044 - DNA, 16 bp, Homo sapiens
tccgccctcctcgggc

SEQ ID NO: 6454045 - DNA, 13 bp, Homo sapiens
tccgccctgccac

SEQ ID NO: 6454046 - DNA, 14 bp, Homo sapiens
tccgccctgccact

SEQ ID NO: 6454047 - DNA, 15 bp, Homo sapiens
tccgccctgccactc

SEQ ID NO: 6454048 - DNA, 15 bp, Homo sapiens
tccgccctgctcctc

SEQ ID NO: 6454049 - DNA, 19 bp, Homo sapiens
tccgccctgctcctccctg

SEQ ID NO: 6454050 - DNA, 14 bp, Homo sapiens
tccgccctgggctc

SEQ ID NO: 6454051 - DNA, 19 bp, Homo sapiens
tccgcccttagtcccccaa

SEQ ID NO: 6454052 - DNA, 13 bp, Homo sapiens
tccgcctcactgg

SEQ ID NO: 6454053 - DNA, 17 bp, Homo sapiens
tccgcctcccccatggc

SEQ ID NO: 6454054 - DNA, 13 bp, Homo sapiens
tccgcctctgagc

SEQ ID NO: 6454055 - DNA, 14 bp, Homo sapiens
tccgcctcttgggt

SEQ ID NO: 6454056 - DNA, 15 bp, Homo sapiens
tccgcctgcagagga

SEQ ID NO: 6454057 - DNA, 21 bp, Homo sapiens
tccgcctgcagaggacagagc

SEQ ID NO: 6454058 - DNA, 11 bp, Homo sapiens
tccgcctgcct

SEQ ID NO: 6454059 - DNA, 14 bp, Homo sapiens
tccgcctgcctctg

SEQ ID NO: 6454060 - DNA, 19 bp, Homo sapiens
tccgcctgcctctgcctcc

SEQ ID NO: 6454061 - DNA, 14 bp, Homo sapiens
tccgcctgcgcctc

SEQ ID NO: 6454062 - DNA, 20 bp, Homo sapiens
tccgcctgcgcctccatcca

SEQ ID NO: 6454063 - DNA, 21 bp, Homo sapiens
tccgcctggccggctccagtt

SEQ ID NO: 6454064 - DNA, 19 bp, Homo sapiens
tccgcctgggtcatgggcc

SEQ ID NO: 6454065 - DNA, 19 bp, Homo sapiens
tccgccttaccaggagaag

SEQ ID NO: 6454066 - DNA, 11 bp, Homo sapiens
tccgccttcac

SEQ ID NO: 6454067 - DNA, 17 bp, Homo sapiens
tccgccttcacattccc

SEQ ID NO: 6454068 - DNA, 22 bp, Homo sapiens
tccgccttctcccttctctcac

SEQ ID NO: 6454069 - DNA, 20 bp, Homo sapiens
tccgccttttagttttggtt

SEQ ID NO: 6454070 - DNA, 14 bp, Homo sapiens
tccgccttttgtat

SEQ ID NO: 6454071 - DNA, 12 bp, Homo sapiens
tccgcgaaaata

SEQ ID NO: 6454072 - DNA, 21 bp, Homo sapiens
tccgcgagggctactcagcag

SEQ ID NO: 6454073 - DNA, 14 bp, Homo sapiens
tccgcgccctccga

SEQ ID NO: 6454074 - DNA, 19 bp, Homo sapiens
tccgcgctcggggctgggc

SEQ ID NO: 6454075 - DNA, 14 bp, Homo sapiens
tccgcggaggcccc

SEQ ID NO: 6454076 - DNA, 19 bp, Homo sapiens
tccgcggggaccctgccga

SEQ ID NO: 6454077 - DNA, 13 bp, Homo sapiens
tccgcgggtggga

SEQ ID NO: 6454078 - DNA, 15 bp, Homo sapiens
tccgcgtcagcaagt

SEQ ID NO: 6454079 - DNA, 20 bp, Homo sapiens
tccgcgtcctttcctctcct

SEQ ID NO: 6454080 - DNA, 19 bp, Homo sapiens
tccgcgtggttctgccact

SEQ ID NO: 6454081 - DNA, 14 bp, Homo sapiens
tccgcgtgtgcctg

SEQ ID NO: 6454082 - DNA, 19 bp, Homo sapiens
tccgcgtgtgcctgtgtgc

SEQ ID NO: 6454083 - DNA, 16 bp, Homo sapiens
tccgctaaggcttccg

SEQ ID NO: 6454084 - DNA, 18 bp, Homo sapiens
tccgctaatctcttctag

SEQ ID NO: 6454085 - DNA, 20 bp, Homo sapiens
tccgctcatacaggaatgaa

SEQ ID NO: 6454086 - DNA, 14 bp, Homo sapiens
tccgctcccaccgc

SEQ ID NO: 6454087 - DNA, 20 bp, Homo sapiens
tccgctcccctgctcctgtc

SEQ ID NO: 6454088 - DNA, 16 bp, Homo sapiens
tccgctcccctttccc

SEQ ID NO: 6454089 - DNA, 16 bp, Homo sapiens
tccgctctctcatgtg

SEQ ID NO: 6454090 - DNA, 19 bp, Homo sapiens
tccgctgaagatggagggg

SEQ ID NO: 6454091 - DNA, 19 bp, Homo sapiens
tccgctgaggggtctcgga

SEQ ID NO: 6454092 - DNA, 13 bp, Homo sapiens
tccgctgccacca

SEQ ID NO: 6454093 - DNA, 14 bp, Homo sapiens
tccgctgccagcct

SEQ ID NO: 6454094 - DNA, 20 bp, Homo sapiens
tccgctgccccatgtgtcct

SEQ ID NO: 6454095 - DNA, 18 bp, Homo sapiens
tccgctgcgctcccacct

SEQ ID NO: 6454096 - DNA, 12 bp, Homo sapiens
tccgctgctcct

SEQ ID NO: 6454097 - DNA, 21 bp, Homo sapiens
tccgctggatggggagtctca

SEQ ID NO: 6454098 - DNA, 23 bp, Homo sapiens
tccgctgtcacccagcaaggcac

SEQ ID NO: 6454099 - DNA, 16 bp, Homo sapiens
tccgctgtcgccccag

SEQ ID NO: 6454100 - DNA, 18 bp, Homo sapiens
tccgctgtcgccccaggc

SEQ ID NO: 6454101 - DNA, 21 bp, Homo sapiens
tccgctgtcgccccaggccct

SEQ ID NO: 6454102 - DNA, 14 bp, Homo sapiens
tccgctgtgcccgc

SEQ ID NO: 6454103 - DNA, 17 bp, Homo sapiens
tccgcttctcctgcagt

SEQ ID NO: 6454104 - DNA, 19 bp, Homo sapiens
tccgcttctcctgcagtgg

SEQ ID NO: 6454105 - DNA, 20 bp, Homo sapiens
tccgcttggagctattttcc

SEQ ID NO: 6454106 - DNA, 22 bp, Homo sapiens
tccgcttggagctattttccag

SEQ ID NO: 6454107 - DNA, 16 bp, Homo sapiens
tccgctttcatgaaca

SEQ ID NO: 6454108 - DNA, 14 bp, Homo sapiens
tccgctttcctgga

SEQ ID NO: 6454109 - DNA, 17 bp, Homo sapiens
tccggaaatgaaggaat

SEQ ID NO: 6454110 - DNA, 20 bp, Homo sapiens
tccggaacagccaaagaaac

SEQ ID NO: 6454111 - DNA, 21 bp, Homo sapiens
tccggaacagccaaagaaact

SEQ ID NO: 6454112 - DNA, 20 bp, Homo sapiens
tccggaaggacacagtcagg

SEQ ID NO: 6454113 - DNA, 13 bp, Homo sapiens
tccggaagggtga

SEQ ID NO: 6454114 - DNA, 15 bp, Homo sapiens
tccggaatcctgtcc

SEQ ID NO: 6454115 - DNA, 18 bp, Homo sapiens
tccggaatcctgtcctca

SEQ ID NO: 6454116 - DNA, 14 bp, Homo sapiens
tccggaatgaccag

SEQ ID NO: 6454117 - DNA, 17 bp, Homo sapiens
tccggaatgccacccac

SEQ ID NO: 6454118 - DNA, 20 bp, Homo sapiens
tccggaccgccgatcccagg

SEQ ID NO: 6454119 - DNA, 17 bp, Homo sapiens
tccggactggcagaagc

SEQ ID NO: 6454120 - DNA, 22 bp, Homo sapiens
tccggagatgaatatgagctca

SEQ ID NO: 6454121 - DNA, 15 bp, Homo sapiens
tccggagatgtagca

SEQ ID NO: 6454122 - DNA, 16 bp, Homo sapiens
tccggagcgccctgca

SEQ ID NO: 6454123 - DNA, 17 bp, Homo sapiens
tccggagcgccctgcag

SEQ ID NO: 6454124 - DNA, 13 bp, Homo sapiens
tccggaggactga

SEQ ID NO: 6454125 - DNA, 19 bp, Homo sapiens
tccggaggactgagccccc

SEQ ID NO: 6454126 - DNA, 16 bp, Homo sapiens
tccggaggagcagcct

SEQ ID NO: 6454127 - DNA, 15 bp, Homo sapiens
tccggaggcagcaga

SEQ ID NO: 6454128 - DNA, 23 bp, Homo sapiens
tccggaggggacccagctcctct

SEQ ID NO: 6454129 - DNA, 16 bp, Homo sapiens
tccggagggggtcctc

SEQ ID NO: 6454130 - DNA, 21 bp, Homo sapiens
tccggagtgagaagctttgcc

SEQ ID NO: 6454131 - DNA, 21 bp, Homo sapiens
tccggatgacacaaataccag

SEQ ID NO: 6454132 - DNA, 19 bp, Homo sapiens
tccggatggaatcacagcc

SEQ ID NO: 6454133 - DNA, 18 bp, Homo sapiens
tccggattccggccctgg

SEQ ID NO: 6454134 - DNA, 20 bp, Homo sapiens
tccggatttctaacagtcct

SEQ ID NO: 6454135 - DNA, 14 bp, Homo sapiens
tccggcacactgcc

SEQ ID NO: 6454136 - DNA, 16 bp, Homo sapiens
tccggcagaggcaggg

SEQ ID NO: 6454137 - DNA, 17 bp, Homo sapiens
tccggcagaggcagggc

SEQ ID NO: 6454138 - DNA, 18 bp, Homo sapiens
tccggcagttctgggtgc

SEQ ID NO: 6454139 - DNA, 19 bp, Homo sapiens
tccggccaaggtgccacca

SEQ ID NO: 6454140 - DNA, 13 bp, Homo sapiens
tccggccacatca

SEQ ID NO: 6454141 - DNA, 21 bp, Homo sapiens
tccggccacatcattctgtgt

SEQ ID NO: 6454142 - DNA, 20 bp, Homo sapiens
tccggccaggtgcctcctga

SEQ ID NO: 6454143 - DNA, 14 bp, Homo sapiens
tccggccctccaga

SEQ ID NO: 6454144 - DNA, 13 bp, Homo sapiens
tccggccctgccc

SEQ ID NO: 6454145 - DNA, 13 bp, Homo sapiens
tccggccctggct

SEQ ID NO: 6454146 - DNA, 14 bp, Homo sapiens
tccggccctggctg

SEQ ID NO: 6454147 - DNA, 15 bp, Homo sapiens
tccggccctggctgg

SEQ ID NO: 6454148 - DNA, 16 bp, Homo sapiens
tccggcctctccagcc

SEQ ID NO: 6454149 - DNA, 18 bp, Homo sapiens
tccggcctctgcctttgc

SEQ ID NO: 6454150 - DNA, 19 bp, Homo sapiens
tccggcctctgcctttgca

SEQ ID NO: 6454151 - DNA, 22 bp, Homo sapiens
tccggcctctttttttcttttc

SEQ ID NO: 6454152 - DNA, 15 bp, Homo sapiens
tccggcctgcgtctc

SEQ ID NO: 6454153 - DNA, 21 bp, Homo sapiens
tccggcctgggtgacagagtg

SEQ ID NO: 6454154 - DNA, 22 bp, Homo sapiens
tccggcctgggtgacagagtga

SEQ ID NO: 6454155 - DNA, 23 bp, Homo sapiens
tccggcctgggtgacagagtgag

SEQ ID NO: 6454156 - DNA, 18 bp, Homo sapiens
tgaccttgaactcctggg

SEQ ID NO: 6454157 - DNA, 17 bp, Homo sapiens
tgaccttgacgtgtgtg

SEQ ID NO: 6454158 - DNA, 18 bp, Homo sapiens
tgaccttgacttgccatg

SEQ ID NO: 6454159 - DNA, 20 bp, Homo sapiens
tgaccttgaggagtcttgtg

SEQ ID NO: 6454160 - DNA, 17 bp, Homo sapiens
tgaccttgatgagctgt

SEQ ID NO: 6454161 - DNA, 19 bp, Homo sapiens
tgaccttgatgagctgtgc

SEQ ID NO: 6454162 - DNA, 16 bp, Homo sapiens
tgaccttgcaacttca

SEQ ID NO: 6454163 - DNA, 13 bp, Homo sapiens
tgaccttgctgcc

SEQ ID NO: 6454164 - DNA, 15 bp, Homo sapiens
tgaccttgctgccac

SEQ ID NO: 6454165 - DNA, 19 bp, Homo sapiens
tgaccttggctgactgggg

SEQ ID NO: 6454166 - DNA, 20 bp, Homo sapiens
tgaccttgggaccaaagggg

SEQ ID NO: 6454167 - DNA, 19 bp, Homo sapiens
tgaccttgtgaacatcaga

SEQ ID NO: 6454168 - DNA, 18 bp, Homo sapiens
tgacctttaactgagggc

SEQ ID NO: 6454169 - DNA, 21 bp, Homo sapiens
tgacctttaactgagggctga

SEQ ID NO: 6454170 - DNA, 23 bp, Homo sapiens
tgacctttaagaaaaatgaaaac

SEQ ID NO: 6454171 - DNA, 14 bp, Homo sapiens
tgacctttatttat

SEQ ID NO: 6454172 - DNA, 12 bp, Homo sapiens
tgacctttcaat

SEQ ID NO: 6454173 - DNA, 15 bp, Homo sapiens
tgacctttgtacagc

SEQ ID NO: 6454174 - DNA, 21 bp, Homo sapiens
tgacctttgtacagcccagag

SEQ ID NO: 6454175 - DNA, 18 bp, Homo sapiens
tgaccttttatgtagtaa

SEQ ID NO: 6454176 - DNA, 23 bp, Homo sapiens
tgaccttttatgtagtaattgac

SEQ ID NO: 6454177 - DNA, 18 bp, Homo sapiens
tgaccttttggcctttgt

SEQ ID NO: 6454178 - DNA, 19 bp, Homo sapiens
tgaccttttggcctttgta

SEQ ID NO: 6454179 - DNA, 23 bp, Homo sapiens
tgaccttttggcctttgtaagac

SEQ ID NO: 6454180 - DNA, 12 bp, Homo sapiens
tgacgaaagagt

SEQ ID NO: 6454181 - DNA, 21 bp, Homo sapiens
tgacgaaatggaaacacacac

SEQ ID NO: 6454182 - DNA, 14 bp, Homo sapiens
tgacgaactggcta

SEQ ID NO: 6454183 - DNA, 15 bp, Homo sapiens
tgacgaagacgccaa

SEQ ID NO: 6454184 - DNA, 20 bp, Homo sapiens
tgacgacaagtgctgaacag

SEQ ID NO: 6454185 - DNA, 19 bp, Homo sapiens
tgacgacctacatctgaaa

SEQ ID NO: 6454186 - DNA, 18 bp, Homo sapiens
tgacgatgggtgttgctg

SEQ ID NO: 6454187 - DNA, 20 bp, Homo sapiens
tgacgatgggtgttgctgtt

SEQ ID NO: 6454188 - DNA, 21 bp, Homo sapiens
tgacgatgggtgttgctgttt

SEQ ID NO: 6454189 - DNA, 18 bp, Homo sapiens
tgacgattatttatttct

SEQ ID NO: 6454190 - DNA, 20 bp, Homo sapiens
tgacgcaccactgccaatgc

SEQ ID NO: 6454191 - DNA, 22 bp, Homo sapiens
tgacgcagccggagggaggcac

SEQ ID NO: 6454192 - DNA, 19 bp, Homo sapiens
tgacgcagcctgagaatga

SEQ ID NO: 6454193 - DNA, 13 bp, Homo sapiens
tgacgccatccca

SEQ ID NO: 6454194 - DNA, 18 bp, Homo sapiens
tgacgccatcccagcccc

SEQ ID NO: 6454195 - DNA, 13 bp, Homo sapiens
tgacgcccacctt

SEQ ID NO: 6454196 - DNA, 23 bp, Homo sapiens
tgacgccctgcgttggagccact

SEQ ID NO: 6454197 - DNA, 21 bp, Homo sapiens
tgacgcctactggggcagggc

SEQ ID NO: 6454198 - DNA, 13 bp, Homo sapiens
tgacgcctctgga

SEQ ID NO: 6454199 - DNA, 13 bp, Homo sapiens
tgacgcctgagac

SEQ ID NO: 6454200 - DNA, 19 bp, Homo sapiens
tgacgcctgagacagcacc

SEQ ID NO: 6454201 - DNA, 20 bp, Homo sapiens
tgacgcgtggtcacaggacg

SEQ ID NO: 6454202 - DNA, 13 bp, Homo sapiens
tgacgctcagccc

SEQ ID NO: 6454203 - DNA, 14 bp, Homo sapiens
tgacgctcagcccc

SEQ ID NO: 6454204 - DNA, 20 bp, Homo sapiens
tgacgctcagccccaggcca

SEQ ID NO: 6454205 - DNA, 14 bp, Homo sapiens
tgacgctgaataaa

SEQ ID NO: 6454206 - DNA, 17 bp, Homo sapiens
tgacgctgaataaatgt

SEQ ID NO: 6454207 - DNA, 22 bp, Homo sapiens
tgacgctgaataaatgtctttt

SEQ ID NO: 6454208 - DNA, 14 bp, Homo sapiens
tgacgctgacaata

SEQ ID NO: 6454209 - DNA, 18 bp, Homo sapiens
tgacgctgcatgagacat

SEQ ID NO: 6454210 - DNA, 12 bp, Homo sapiens
tgacgctgctga

SEQ ID NO: 6454211 - DNA, 13 bp, Homo sapiens
tgacgcttccctt

SEQ ID NO: 6454212 - DNA, 18 bp, Homo sapiens
tgacgcttgtgacagtgc

SEQ ID NO: 6454213 - DNA, 22 bp, Homo sapiens
tgacggaaacaacgttgctatt

SEQ ID NO: 6454214 - DNA, 18 bp, Homo sapiens
tgacggaagaacatagaa

SEQ ID NO: 6454215 - DNA, 15 bp, Homo sapiens
tgacggacatccagg

SEQ ID NO: 6454216 - DNA, 20 bp, Homo sapiens
tgacggactcagactcctgg

SEQ ID NO: 6454217 - DNA, 21 bp, Homo sapiens
tgacggcagggaaatgtatgt

SEQ ID NO: 6454218 - DNA, 14 bp, Homo sapiens
tgacggccaggctc

SEQ ID NO: 6454219 - DNA, 19 bp, Homo sapiens
tgacggccaggctccctga

SEQ ID NO: 6454220 - DNA, 20 bp, Homo sapiens
tgacggccaggctccctgac

SEQ ID NO: 6454221 - DNA, 23 bp, Homo sapiens
tgacggccaggctccctgaccac

SEQ ID NO: 6454222 - DNA, 15 bp, Homo sapiens
tgacggccctgcaat

SEQ ID NO: 6454223 - DNA, 20 bp, Homo sapiens
tgacggcgcccccagtgtgc

SEQ ID NO: 6454224 - DNA, 12 bp, Homo sapiens
tgacggctgggg

SEQ ID NO: 6454225 - DNA, 14 bp, Homo sapiens
tgacggctgtgtat

SEQ ID NO: 6454226 - DNA, 22 bp, Homo sapiens
tgacggctgtgtatttctgtag

SEQ ID NO: 6454227 - DNA, 23 bp, Homo sapiens
tgacggctgtgtatttctgtaga

SEQ ID NO: 6454228 - DNA, 19 bp, Homo sapiens
tgacgggactcaggcggga

SEQ ID NO: 6454229 - DNA, 19 bp, Homo sapiens
tgacgggagcctcctctgc

SEQ ID NO: 6454230 - DNA, 15 bp, Homo sapiens
tgacgggaggcctca

SEQ ID NO: 6454231 - DNA, 16 bp, Homo sapiens
tgacgggaggcctcag

SEQ ID NO: 6454232 - DNA, 18 bp, Homo sapiens
tgacgggaggcctcagtt

SEQ ID NO: 6454233 - DNA, 14 bp, Homo sapiens
tgacgggatgctct

SEQ ID NO: 6454234 - DNA, 23 bp, Homo sapiens
tgacgggatgctctttaaataat

SEQ ID NO: 6454235 - DNA, 21 bp, Homo sapiens
tgacgggccaggccctggagg

SEQ ID NO: 6454236 - DNA, 19 bp, Homo sapiens
tgacgggccgcaggaggga

SEQ ID NO: 6454237 - DNA, 14 bp, Homo sapiens
tgacggggcagtca

SEQ ID NO: 6454238 - DNA, 17 bp, Homo sapiens
tgacggggcagtcagat

SEQ ID NO: 6454239 - DNA, 20 bp, Homo sapiens
tgacggggcagtcagatttt

SEQ ID NO: 6454240 - DNA, 20 bp, Homo sapiens
tgacgggggttggggtgggg

SEQ ID NO: 6454241 - DNA, 16 bp, Homo sapiens
tgacggggtgtgtggc

SEQ ID NO: 6454242 - DNA, 17 bp, Homo sapiens
tgacggtaagtgttctc

SEQ ID NO: 6454243 - DNA, 18 bp, Homo sapiens
tgacggtattatgcttct

SEQ ID NO: 6454244 - DNA, 19 bp, Homo sapiens
tgacggtattatgcttctt

SEQ ID NO: 6454245 - DNA, 19 bp, Homo sapiens
tgacggtcccacactggtg

SEQ ID NO: 6454246 - DNA, 21 bp, Homo sapiens
tgacggtcccacactggtgac

SEQ ID NO: 6454247 - DNA, 23 bp, Homo sapiens
tgacggtcccacactggtgactg

SEQ ID NO: 6454248 - DNA, 20 bp, Homo sapiens
tgacggtcctttaggcagcc

SEQ ID NO: 6454249 - DNA, 17 bp, Homo sapiens
tgacggtgcagtctggg

SEQ ID NO: 6454250 - DNA, 12 bp, Homo sapiens
tgacggttccta

SEQ ID NO: 6454251 - DNA, 21 bp, Homo sapiens
tgacgtacaagtagttctgta

SEQ ID NO: 6454252 - DNA, 21 bp, Homo sapiens
tgacgtattatctgttgcctt

SEQ ID NO: 6454253 - DNA, 20 bp, Homo sapiens
tgacgtattgtgaaatttgt

SEQ ID NO: 6454254 - DNA, 14 bp, Homo sapiens
tgacgtctgaagct

SEQ ID NO: 6454255 - DNA, 13 bp, Homo sapiens
tgacgtctgccac

SEQ ID NO: 6454256 - DNA, 14 bp, Homo sapiens
tgacgtctgccacc

SEQ ID NO: 6454257 - DNA, 15 bp, Homo sapiens
tgacgtctgggtggc

SEQ ID NO: 6454258 - DNA, 19 bp, Homo sapiens
tgacgtcttaggtggcagg

SEQ ID NO: 6454259 - DNA, 18 bp, Homo sapiens
tgacgtgccttttgcacc

SEQ ID NO: 6454260 - DNA, 21 bp, Homo sapiens
tgacgtgctccgtagctctgc

SEQ ID NO: 6454261 - DNA, 17 bp, Homo sapiens
tgacgtgtcaggaaaac

SEQ ID NO: 6454262 - DNA, 14 bp, Homo sapiens
tgacgtgtgtggct

SEQ ID NO: 6454263 - DNA, 23 bp, Homo sapiens
tgacgttgatctcctggtagcat

SEQ ID NO: 6454264 - DNA, 12 bp, Homo sapiens
tgacgtttacat

SEQ ID NO: 6454265 - DNA, 13 bp, Homo sapiens
tgacgtttctggg

SEQ ID NO: 6454266 - DNA, 22 bp, Homo sapiens
tgacgtttgacaccagggccag

SEQ ID NO: 6454267 - DNA, 22 bp, Homo sapiens
tgactaaaaaacaaagaagaca

SEQ ID NO: 6454268 - DNA, 22 bp, Homo sapiens
tgactaaaaatattataactta

SEQ ID NO: 6454269 - DNA, 19 bp, Homo sapiens
tgactaaactacattataa

SEQ ID NO: 6454270 - DNA, 20 bp, Homo sapiens
tgactaaactacattataaa

SEQ ID NO: 6454271 - DNA, 17 bp, Homo sapiens
tgactaaactaccacct

SEQ ID NO: 6454272 - DNA, 19 bp, Homo sapiens
tgactaaactttttttctg

SEQ ID NO: 6454273 - DNA, 16 bp, Homo sapiens
tgactaaagagagaat

SEQ ID NO: 6454274 - DNA, 17 bp, Homo sapiens
tgactaaagctatgtta

SEQ ID NO: 6454275 - DNA, 13 bp, Homo sapiens
tgactaaatttgg

SEQ ID NO: 6454276 - DNA, 15 bp, Homo sapiens
tgactaaattttctt

SEQ ID NO: 6454277 - DNA, 19 bp, Homo sapiens
tgactaaattttcttttaa

SEQ ID NO: 6454278 - DNA, 15 bp, Homo sapiens
tgactaacaagattt

SEQ ID NO: 6454279 - DNA, 21 bp, Homo sapiens
tgactaacaggccaaagagtc

SEQ ID NO: 6454280 - DNA, 17 bp, Homo sapiens
tgactaactatgcaata

SEQ ID NO: 6454281 - DNA, 13 bp, Homo sapiens
tgactaagaattt

SEQ ID NO: 6454282 - DNA, 21 bp, Homo sapiens
tgactaagccccgtctgaccc

SEQ ID NO: 6454283 - DNA, 14 bp, Homo sapiens
tgactaagtcaagt

SEQ ID NO: 6454284 - DNA, 14 bp, Homo sapiens
tgactaagttgcaa

SEQ ID NO: 6454285 - DNA, 14 bp, Homo sapiens
tgactaatccttaa

SEQ ID NO: 6454286 - DNA, 14 bp, Homo sapiens
tgactaatgaggca

SEQ ID NO: 6454287 - DNA, 22 bp, Homo sapiens
tgactaattagggtacatttat

SEQ ID NO: 6454288 - DNA, 23 bp, Homo sapiens
tgactaattagggtacatttata

SEQ ID NO: 6454289 - DNA, 17 bp, Homo sapiens
tgactaattgtataaca

SEQ ID NO: 6454290 - DNA, 15 bp, Homo sapiens
tgactaattttacat

SEQ ID NO: 6454291 - DNA, 16 bp, Homo sapiens
tgactacagtcaggaa

SEQ ID NO: 6454292 - DNA, 17 bp, Homo sapiens
tgactacattttgaggt

SEQ ID NO: 6454293 - DNA, 20 bp, Homo sapiens
tgactaccacttatttctaa

SEQ ID NO: 6454294 - DNA, 22 bp, Homo sapiens
tgactactaacaaatgtaaaat

SEQ ID NO: 6454295 - DNA, 16 bp, Homo sapiens
tgactagaaagtgaat

SEQ ID NO: 6454296 - DNA, 16 bp, Homo sapiens
tgactagaaattctta

SEQ ID NO: 6454297 - DNA, 17 bp, Homo sapiens
tgactagaactcctgtc

SEQ ID NO: 6454298 - DNA, 18 bp, Homo sapiens
tgactagaactcctgtct

SEQ ID NO: 6454299 - DNA, 23 bp, Homo sapiens
tgactagaactcctgtcttcttt

SEQ ID NO: 6454300 - DNA, 19 bp, Homo sapiens
tgactagacgttcatttgt

SEQ ID NO: 6454301 - DNA, 15 bp, Homo sapiens
tgactagagacgcac

SEQ ID NO: 6454302 - DNA, 18 bp, Homo sapiens
tgactagcaaacaaaaat

SEQ ID NO: 6454303 - DNA, 20 bp, Homo sapiens
tgactagcaaacaaaaatag

SEQ ID NO: 6454304 - DNA, 16 bp, Homo sapiens
tgactagcgcctggcc

SEQ ID NO: 6454305 - DNA, 18 bp, Homo sapiens
tgactagcgcctggcctt

SEQ ID NO: 6454306 - DNA, 17 bp, Homo sapiens
tgactaggaagaaaaca

SEQ ID NO: 6454307 - DNA, 18 bp, Homo sapiens
tgactaggcatacactgt

SEQ ID NO: 6454308 - DNA, 17 bp, Homo sapiens
tgactagggaaatgatc

SEQ ID NO: 6454309 - DNA, 13 bp, Homo sapiens
tgactagggagcc

SEQ ID NO: 6454310 - DNA, 19 bp, Homo sapiens
tgactagggtcctcaggca

SEQ ID NO: 6454311 - DNA, 13 bp, Homo sapiens
tgactagtacaaa

SEQ ID NO: 6454312 - DNA, 17 bp, Homo sapiens
tgactagtacaaattat

SEQ ID NO: 6454313 - DNA, 19 bp, Homo sapiens
tgactagtgaggaaagatt

SEQ ID NO: 6454314 - DNA, 15 bp, Homo sapiens
tgactagtgcctaga

SEQ ID NO: 6454315 - DNA, 17 bp, Homo sapiens
tgactagtgcctagaaa

SEQ ID NO: 6454316 - DNA, 22 bp, Homo sapiens
tgactagtgcctagaaagcaat

SEQ ID NO: 6454317 - DNA, 18 bp, Homo sapiens
tgactagtgctgaagctt

SEQ ID NO: 6454318 - DNA, 22 bp, Homo sapiens
tgactagtgctgaagcttatta

SEQ ID NO: 6454319 - DNA, 17 bp, Homo sapiens
tgactataaaaactgcc

SEQ ID NO: 6454320 - DNA, 16 bp, Homo sapiens
tgactataaccttgtt

SEQ ID NO: 6454321 - DNA, 14 bp, Homo sapiens
tgactatatagaga

SEQ ID NO: 6454322 - DNA, 17 bp, Homo sapiens
tgactatatagagatgt

SEQ ID NO: 6454323 - DNA, 19 bp, Homo sapiens
tgactatatagagatgttt

SEQ ID NO: 6454324 - DNA, 21 bp, Homo sapiens
tgactatatagagatgttttt

SEQ ID NO: 6454325 - DNA, 23 bp, Homo sapiens
tgactatcacacactttctcttc

SEQ ID NO: 6454326 - DNA, 12 bp, Homo sapiens
tgactatctccc

SEQ ID NO: 6454327 - DNA, 14 bp, Homo sapiens
tgactatctcccct

SEQ ID NO: 6454328 - DNA, 14 bp, Homo sapiens
tgactatgacataa

SEQ ID NO: 6454329 - DNA, 22 bp, Homo sapiens
tgactatgccgtcttctgccct

SEQ ID NO: 6454330 - DNA, 20 bp, Homo sapiens
tgactatgcgtggctggaac

SEQ ID NO: 6454331 - DNA, 13 bp, Homo sapiens
tgactatgtaaac

SEQ ID NO: 6454332 - DNA, 19 bp, Homo sapiens
tgactatgtatttttctat

SEQ ID NO: 6454333 - DNA, 18 bp, Homo sapiens
tccggcgtcagcctccag

SEQ ID NO: 6454334 - DNA, 18 bp, Homo sapiens
tccggcgtcttgcccagc

SEQ ID NO: 6454335 - DNA, 16 bp, Homo sapiens
tccggctaagcaggcg

SEQ ID NO: 6454336 - DNA, 17 bp, Homo sapiens
tccggctcccagcctca

SEQ ID NO: 6454337 - DNA, 21 bp, Homo sapiens
tccggctcccagcctcagcgc

SEQ ID NO: 6454338 - DNA, 16 bp, Homo sapiens
tccggctcctgtgctt

SEQ ID NO: 6454339 - DNA, 17 bp, Homo sapiens
tccggctgagctgtgcc

SEQ ID NO: 6454340 - DNA, 19 bp, Homo sapiens
tccggctgctcctccagcc

SEQ ID NO: 6454341 - DNA, 20 bp, Homo sapiens
tccggctgctcctccagccc

SEQ ID NO: 6454342 - DNA, 12 bp, Homo sapiens
tccggctggacc

SEQ ID NO: 6454343 - DNA, 15 bp, Homo sapiens
tccggctgtgctggg

SEQ ID NO: 6454344 - DNA, 23 bp, Homo sapiens
tccgggaccattgacctcagctg

SEQ ID NO: 6454345 - DNA, 19 bp, Homo sapiens
tccgggagagcggctgccc

SEQ ID NO: 6454346 - DNA, 14 bp, Homo sapiens
tccgggagctggtg

SEQ ID NO: 6454347 - DNA, 19 bp, Homo sapiens
tccgggaggcagagaggag

SEQ ID NO: 6454348 - DNA, 19 bp, Homo sapiens
tccgggcaaatgccagggc

SEQ ID NO: 6454349 - DNA, 19 bp, Homo sapiens
tccgggcaccaggggccaa

SEQ ID NO: 6454350 - DNA, 19 bp, Homo sapiens
tccgggcaggggagccagg

SEQ ID NO: 6454351 - DNA, 15 bp, Homo sapiens
tccgggcctcggcct

SEQ ID NO: 6454352 - DNA, 14 bp, Homo sapiens
tccggggagaaacc

SEQ ID NO: 6454353 - DNA, 18 bp, Homo sapiens
tccggggccccactggct

SEQ ID NO: 6454354 - DNA, 17 bp, Homo sapiens
tccggggctcagccctg

SEQ ID NO: 6454355 - DNA, 15 bp, Homo sapiens
tccggggctgctggc

SEQ ID NO: 6454356 - DNA, 22 bp, Homo sapiens
tccgggggcagctctggagggg

SEQ ID NO: 6454357 - DNA, 20 bp, Homo sapiens
tccgggggggcccatctctt

SEQ ID NO: 6454358 - DNA, 18 bp, Homo sapiens
tccggggtctgtgctgtg

SEQ ID NO: 6454359 - DNA, 20 bp, Homo sapiens
tccggggtctgtgctgtgcc

SEQ ID NO: 6454360 - DNA, 21 bp, Homo sapiens
tccggggtctgtgctgtgcct

SEQ ID NO: 6454361 - DNA, 14 bp, Homo sapiens
tccgggtcactgct

SEQ ID NO: 6454362 - DNA, 23 bp, Homo sapiens
tccgggtctcgcagcctgaagcc

SEQ ID NO: 6454363 - DNA, 17 bp, Homo sapiens
tccgggtgctcaataaa

SEQ ID NO: 6454364 - DNA, 18 bp, Homo sapiens
tccggtagggaggcagcc

SEQ ID NO: 6454365 - DNA, 19 bp, Homo sapiens
tccggtagggaggcagcct

SEQ ID NO: 6454366 - DNA, 14 bp, Homo sapiens
tccggtcagccaag

SEQ ID NO: 6454367 - DNA, 15 bp, Homo sapiens
tccggtccccacaga

SEQ ID NO: 6454368 - DNA, 23 bp, Homo sapiens
tccggtccccacagactgcccca

SEQ ID NO: 6454369 - DNA, 19 bp, Homo sapiens
tccggtcccctgcctggaa

SEQ ID NO: 6454370 - DNA, 17 bp, Homo sapiens
tccggtccctgtcccag

SEQ ID NO: 6454371 - DNA, 14 bp, Homo sapiens
tccggtgccttcca

SEQ ID NO: 6454372 - DNA, 15 bp, Homo sapiens
tccggtgtgagccca

SEQ ID NO: 6454373 - DNA, 18 bp, Homo sapiens
tccggtgtgagcccacct

SEQ ID NO: 6454374 - DNA, 15 bp, Homo sapiens
tccggtgttctaaga

SEQ ID NO: 6454375 - DNA, 18 bp, Homo sapiens
tccggtgtttaagacatt

SEQ ID NO: 6454376 - DNA, 16 bp, Homo sapiens
tccggtttactttaac

SEQ ID NO: 6454377 - DNA, 21 bp, Homo sapiens
tccggtttagtcatccaacaa

SEQ ID NO: 6454378 - DNA, 18 bp, Homo sapiens
tccgtaacagtgtaaagt

SEQ ID NO: 6454379 - DNA, 16 bp, Homo sapiens
tccgtaacccaactct

SEQ ID NO: 6454380 - DNA, 16 bp, Homo sapiens
tccgtagctcccctgg

SEQ ID NO: 6454381 - DNA, 17 bp, Homo sapiens
tccgtagctcccctggc

SEQ ID NO: 6454382 - DNA, 19 bp, Homo sapiens
tccgtagctcccctggctg

SEQ ID NO: 6454383 - DNA, 23 bp, Homo sapiens
tccgtagctcccctggctggctc

SEQ ID NO: 6454384 - DNA, 14 bp, Homo sapiens
tccgtagctctgct

SEQ ID NO: 6454385 - DNA, 15 bp, Homo sapiens
tccgtagctctgctg

SEQ ID NO: 6454386 - DNA, 21 bp, Homo sapiens
tccgtagggtctttcttggga

SEQ ID NO: 6454387 - DNA, 14 bp, Homo sapiens
tccgtagttccctg

SEQ ID NO: 6454388 - DNA, 15 bp, Homo sapiens
tccgtagttccctga

SEQ ID NO: 6454389 - DNA, 12 bp, Homo sapiens
tccgtagtttgt

SEQ ID NO: 6454390 - DNA, 17 bp, Homo sapiens
tccgtagtttgttttct

SEQ ID NO: 6454391 - DNA, 15 bp, Homo sapiens
tccgtatctccctgg

SEQ ID NO: 6454392 - DNA, 14 bp, Homo sapiens
tccgtatttcagac

SEQ ID NO: 6454393 - DNA, 15 bp, Homo sapiens
tccgtatttcagact

SEQ ID NO: 6454394 - DNA, 22 bp, Homo sapiens
tccgtcacccttggtagagttt

SEQ ID NO: 6454395 - DNA, 17 bp, Homo sapiens
tccgtcactacctggct

SEQ ID NO: 6454396 - DNA, 18 bp, Homo sapiens
tccgtcagcttctcccaa

SEQ ID NO: 6454397 - DNA, 14 bp, Homo sapiens
tccgtccacccagg

SEQ ID NO: 6454398 - DNA, 21 bp, Homo sapiens
tccgtccacccaggctgcact

SEQ ID NO: 6454399 - DNA, 22 bp, Homo sapiens
tccgtccacccaggctgcactg

SEQ ID NO: 6454400 - DNA, 14 bp, Homo sapiens
tccgtccccagggt

SEQ ID NO: 6454401 - DNA, 17 bp, Homo sapiens
tccgtccccccccaggc

SEQ ID NO: 6454402 - DNA, 18 bp, Homo sapiens
tccgtccccccccaggcc

SEQ ID NO: 6454403 - DNA, 14 bp, Homo sapiens
tccgtcccctgccc

SEQ ID NO: 6454404 - DNA, 18 bp, Homo sapiens
tccgtcccctgcccatgc

SEQ ID NO: 6454405 - DNA, 18 bp, Homo sapiens
tccgtccctctgtccact

SEQ ID NO: 6454406 - DNA, 15 bp, Homo sapiens
tccgtccgcccgccc

SEQ ID NO: 6454407 - DNA, 18 bp, Homo sapiens
tccgtccgcccgcccacc

SEQ ID NO: 6454408 - DNA, 17 bp, Homo sapiens
tccgtcctctccccagc

SEQ ID NO: 6454409 - DNA, 20 bp, Homo sapiens
tccgtcgggcccctgcctgc

SEQ ID NO: 6454410 - DNA, 21 bp, Homo sapiens
tccgtcgggcccctgcctgcc

SEQ ID NO: 6454411 - DNA, 23 bp, Homo sapiens
tccgtctagttaacatttcaagg

SEQ ID NO: 6454412 - DNA, 20 bp, Homo sapiens
tccgtctcccccgtgttccc

SEQ ID NO: 6454413 - DNA, 13 bp, Homo sapiens
tccgtctcctctc

SEQ ID NO: 6454414 - DNA, 14 bp, Homo sapiens
tccgtctctgtcct

SEQ ID NO: 6454415 - DNA, 16 bp, Homo sapiens
tccgtctctgtcctcg

SEQ ID NO: 6454416 - DNA, 20 bp, Homo sapiens
tccgtctgcaatgtcccttg

SEQ ID NO: 6454417 - DNA, 12 bp, Homo sapiens
tccgtctgtctc

SEQ ID NO: 6454418 - DNA, 23 bp, Homo sapiens
tccgtctgtctgtcgcccttctc

SEQ ID NO: 6454419 - DNA, 14 bp, Homo sapiens
tccgtctgtgtggg

SEQ ID NO: 6454420 - DNA, 15 bp, Homo sapiens
tccgtctgtgtgggg

SEQ ID NO: 6454421 - DNA, 18 bp, Homo sapiens
tccgtgaaaacggagctg

SEQ ID NO: 6454422 - DNA, 17 bp, Homo sapiens
tccgtgaattgctttat

SEQ ID NO: 6454423 - DNA, 22 bp, Homo sapiens
tccgtgagcaccaccagggctc

SEQ ID NO: 6454424 - DNA, 23 bp, Homo sapiens
tccgtgagcagtgtgtctcctgc

SEQ ID NO: 6454425 - DNA, 15 bp, Homo sapiens
tccgtgaggctgctg

SEQ ID NO: 6454426 - DNA, 22 bp, Homo sapiens
tccgtgaggctgctgccatcca

SEQ ID NO: 6454427 - DNA, 20 bp, Homo sapiens
tccgtgatccatccatctcc

SEQ ID NO: 6454428 - DNA, 15 bp, Homo sapiens
tccgtgcatcccaga

SEQ ID NO: 6454429 - DNA, 15 bp, Homo sapiens
tccgtgcccaggccc

SEQ ID NO: 6454430 - DNA, 18 bp, Homo sapiens
tccgtgccgtgtattttt

SEQ ID NO: 6454431 - DNA, 21 bp, Homo sapiens
tccgtgcctccaccaccactg

SEQ ID NO: 6454432 - DNA, 19 bp, Homo sapiens
tccgtgctgacagctgctc

SEQ ID NO: 6454433 - DNA, 21 bp, Homo sapiens
tccgtgctgacagctgctcct

SEQ ID NO: 6454434 - DNA, 12 bp, Homo sapiens
tccgtgctgggc

SEQ ID NO: 6454435 - DNA, 14 bp, Homo sapiens
tccgtgcttaacca

SEQ ID NO: 6454436 - DNA, 19 bp, Homo sapiens
tccgtgcttgctggtgcct

SEQ ID NO: 6454437 - DNA, 24 bp, Homo sapiens
tccgtgcttgtttgctcacctggg

SEQ ID NO: 6454438 - DNA, 18 bp, Homo sapiens
tccgtggaacattctgga

SEQ ID NO: 6454439 - DNA, 20 bp, Homo sapiens
tccgtggaacattctggatc

SEQ ID NO: 6454440 - DNA, 12 bp, Homo sapiens
tccgtggcacat

SEQ ID NO: 6454441 - DNA, 14 bp, Homo sapiens
tccgtggcacttgt

SEQ ID NO: 6454442 - DNA, 19 bp, Homo sapiens
tccgtgggaccctcagcag

SEQ ID NO: 6454443 - DNA, 17 bp, Homo sapiens
tccgtgggcagctcctc

SEQ ID NO: 6454444 - DNA, 20 bp, Homo sapiens
tccgtggtagaggcctgggg

SEQ ID NO: 6454445 - DNA, 14 bp, Homo sapiens
tccgtggtcagagt

SEQ ID NO: 6454446 - DNA, 18 bp, Homo sapiens
tccgtggtcagagtgcca

SEQ ID NO: 6454447 - DNA, 12 bp, Homo sapiens
tccgtggtttgt

SEQ ID NO: 6454448 - DNA, 18 bp, Homo sapiens
tccgtgtcaccgccaccc

SEQ ID NO: 6454449 - DNA, 16 bp, Homo sapiens
tccgtgtccaccccca

SEQ ID NO: 6454450 - DNA, 18 bp, Homo sapiens
tccgtgtcctctccccca

SEQ ID NO: 6454451 - DNA, 21 bp, Homo sapiens
tccgtgtctcgcgcgactgag

SEQ ID NO: 6454452 - DNA, 12 bp, Homo sapiens
tccgtgtctgtt

SEQ ID NO: 6454453 - DNA, 22 bp, Homo sapiens
tccgtgtgccgttgctccggcc

SEQ ID NO: 6454454 - DNA, 14 bp, Homo sapiens
tccgtgtgcctcct

SEQ ID NO: 6454455 - DNA, 14 bp, Homo sapiens
tccgtgtggagcac

SEQ ID NO: 6454456 - DNA, 16 bp, Homo sapiens
tccgtgtggagcacgt

SEQ ID NO: 6454457 - DNA, 16 bp, Homo sapiens
tccgtgtggagggctg

SEQ ID NO: 6454458 - DNA, 16 bp, Homo sapiens
tccgtgtgggagaccg

SEQ ID NO: 6454459 - DNA, 20 bp, Homo sapiens
tccgtgtgtcccagatgctg

SEQ ID NO: 6454460 - DNA, 16 bp, Homo sapiens
tccgtgtttctctaag

SEQ ID NO: 6454461 - DNA, 23 bp, Homo sapiens
tccgtgtttctctaaggaattat

SEQ ID NO: 6454462 - DNA, 19 bp, Homo sapiens
tccgttaacctttttgtaa

SEQ ID NO: 6454463 - DNA, 17 bp, Homo sapiens
tccgttagctcctgtgg

SEQ ID NO: 6454464 - DNA, 23 bp, Homo sapiens
tccgttccaggagcacacggccc

SEQ ID NO: 6454465 - DNA, 21 bp, Homo sapiens
tccgttcccacctctgaggac

SEQ ID NO: 6454466 - DNA, 13 bp, Homo sapiens
tccgttctgttct

SEQ ID NO: 6454467 - DNA, 19 bp, Homo sapiens
tccgttctgttctgctggg

SEQ ID NO: 6454468 - DNA, 14 bp, Homo sapiens
tccgttgctgaaaa

SEQ ID NO: 6454469 - DNA, 15 bp, Homo sapiens
tccgttggaaagaac

SEQ ID NO: 6454470 - DNA, 22 bp, Homo sapiens
tccgttgggccccagccttctt

SEQ ID NO: 6454471 - DNA, 17 bp, Homo sapiens
tccgtttccttacacat

SEQ ID NO: 6454472 - DNA, 14 bp, Homo sapiens
tccgtttgaccaat

SEQ ID NO: 6454473 - DNA, 20 bp, Homo sapiens
tccgtttttttttctttttc

SEQ ID NO: 6454474 - DNA, 18 bp, Homo sapiens
tcctaaaaataagcttta

SEQ ID NO: 6454475 - DNA, 15 bp, Homo sapiens
tcctaaaaatctgga

SEQ ID NO: 6454476 - DNA, 18 bp, Homo sapiens
tcctaaaaatctgtggca

SEQ ID NO: 6454477 - DNA, 21 bp, Homo sapiens
tcctaaaaatctgtggcaagc

SEQ ID NO: 6454478 - DNA, 20 bp, Homo sapiens
tcctaaaacaacagatgtac

SEQ ID NO: 6454479 - DNA, 16 bp, Homo sapiens
tcctaaaacacccttc

SEQ ID NO: 6454480 - DNA, 21 bp, Homo sapiens
tcctaaaactgggattaagaa

SEQ ID NO: 6454481 - DNA, 16 bp, Homo sapiens
tcctaaaagcaaaata

SEQ ID NO: 6454482 - DNA, 23 bp, Homo sapiens
tcctaaaagcaaaataaaaacta

SEQ ID NO: 6454483 - DNA, 16 bp, Homo sapiens
tcctaaaaggcccaga

SEQ ID NO: 6454484 - DNA, 13 bp, Homo sapiens
tcctaaaagttca

SEQ ID NO: 6454485 - DNA, 17 bp, Homo sapiens
tcctaaaataagggcag

SEQ ID NO: 6454486 - DNA, 17 bp, Homo sapiens
tcctaaaattatggaaa

SEQ ID NO: 6454487 - DNA, 22 bp, Homo sapiens
tcctaaaattatggaaacagat

SEQ ID NO: 6454488 - DNA, 12 bp, Homo sapiens
tcctaaacacac

SEQ ID NO: 6454489 - DNA, 21 bp, Homo sapiens
tcctaaacccccgctccagat

SEQ ID NO: 6454490 - DNA, 10 bp, Homo sapiens
tcctaaactc

SEQ ID NO: 6454491 - DNA, 23 bp, Homo sapiens
tcctaaactgagacaatgccttg

SEQ ID NO: 6454492 - DNA, 18 bp, Homo sapiens
tcctaaagagttattcaa

SEQ ID NO: 6454493 - DNA, 19 bp, Homo sapiens
tcctaaagccatcatgcct

SEQ ID NO: 6454494 - DNA, 14 bp, Homo sapiens
tcctaaagctgaat

SEQ ID NO: 6454495 - DNA, 19 bp, Homo sapiens
tcctaaagtgctgagatta

SEQ ID NO: 6454496 - DNA, 14 bp, Homo sapiens
tcctaaataaacta

SEQ ID NO: 6454497 - DNA, 17 bp, Homo sapiens
tcctaaataaactagta

SEQ ID NO: 6454498 - DNA, 16 bp, Homo sapiens
tcctaaataaattatt

SEQ ID NO: 6454499 - DNA, 11 bp, Homo sapiens
tcctaaatagc

SEQ ID NO: 6454500 - DNA, 19 bp, Homo sapiens
tcctaaatatattttaaga

SEQ ID NO: 6454501 - DNA, 15 bp, Homo sapiens
tcctaaatatccaaa

SEQ ID NO: 6454502 - DNA, 18 bp, Homo sapiens
tcctaaatattggtttgt

SEQ ID NO: 6454503 - DNA, 17 bp, Homo sapiens
tcctaaatggccctgtt

SEQ ID NO: 6454504 - DNA, 18 bp, Homo sapiens
tcctaaatggccctgttt

SEQ ID NO: 6454505 - DNA, 12 bp, Homo sapiens
tcctaacaaaag

SEQ ID NO: 6454506 - DNA, 13 bp, Homo sapiens
tcctaacaaaaga

SEQ ID NO: 6454507 - DNA, 14 bp, Homo sapiens
tcctaacaaaagaa

SEQ ID NO: 6454508 - DNA, 15 bp, Homo sapiens
tcctaacaaaagaac

SEQ ID NO: 6454509 - DNA, 16 bp, Homo sapiens
tcctaacacagcatgt

SEQ ID NO: 6454510 - DNA, 18 bp, Homo sapiens
tcctaacatgcaccttgc

SEQ ID NO: 6454511 - DNA, 19 bp, Homo sapiens
tcctaacattatattccca

SEQ ID NO: 6454512 - DNA, 22 bp, Homo sapiens
tgactattacagttgcattttt

SEQ ID NO: 6454513 - DNA, 12 bp, Homo sapiens
tgactattatgt

SEQ ID NO: 6454514 - DNA, 18 bp, Homo sapiens
tgactattctcaaatgct

SEQ ID NO: 6454515 - DNA, 19 bp, Homo sapiens
tgactattcttgatgtaaa

SEQ ID NO: 6454516 - DNA, 22 bp, Homo sapiens
tgactattcttgatgtaaaatc

SEQ ID NO: 6454517 - DNA, 18 bp, Homo sapiens
tgactattgtaatgccaa

SEQ ID NO: 6454518 - DNA, 17 bp, Homo sapiens
tgactatttacagtagt

SEQ ID NO: 6454519 - DNA, 19 bp, Homo sapiens
tgactatttttcagaatct

SEQ ID NO: 6454520 - DNA, 20 bp, Homo sapiens
tgactattttttaataaaag

SEQ ID NO: 6454521 - DNA, 13 bp, Homo sapiens
tgactcaaagatg

SEQ ID NO: 6454522 - DNA, 21 bp, Homo sapiens
tgactcaaagatgaaagctgt

SEQ ID NO: 6454523 - DNA, 14 bp, Homo sapiens
tgactcaacatgtt

SEQ ID NO: 6454524 - DNA, 15 bp, Homo sapiens
tgactcaacatgtta

SEQ ID NO: 6454525 - DNA, 14 bp, Homo sapiens
tgactcaagaagtg

SEQ ID NO: 6454526 - DNA, 15 bp, Homo sapiens
tgactcaagattccc

SEQ ID NO: 6454527 - DNA, 19 bp, Homo sapiens
tgactcaagattcccagga

SEQ ID NO: 6454528 - DNA, 21 bp, Homo sapiens
tgactcaagattcccaggagt

SEQ ID NO: 6454529 - DNA, 20 bp, Homo sapiens
tgactcaagattttttctgg

SEQ ID NO: 6454530 - DNA, 18 bp, Homo sapiens
tgactcaaggccaataat

SEQ ID NO: 6454531 - DNA, 20 bp, Homo sapiens
tgactcaagtgtctcagtcc

SEQ ID NO: 6454532 - DNA, 12 bp, Homo sapiens
tgactcaagttt

SEQ ID NO: 6454533 - DNA, 14 bp, Homo sapiens
tgactcacacctga

SEQ ID NO: 6454534 - DNA, 19 bp, Homo sapiens
tgactcacacctgaactga

SEQ ID NO: 6454535 - DNA, 13 bp, Homo sapiens
tgactcacaggcc

SEQ ID NO: 6454536 - DNA, 21 bp, Homo sapiens
tgactcacaggccctggagaa

SEQ ID NO: 6454537 - DNA, 15 bp, Homo sapiens
tgactcacattgcct

SEQ ID NO: 6454538 - DNA, 13 bp, Homo sapiens
tgactcacccaag

SEQ ID NO: 6454539 - DNA, 18 bp, Homo sapiens
tgactcacttatcccaag

SEQ ID NO: 6454540 - DNA, 20 bp, Homo sapiens
tgactcagaaacagaagaaa

SEQ ID NO: 6454541 - DNA, 19 bp, Homo sapiens
tgactcagaggctgggagc

SEQ ID NO: 6454542 - DNA, 20 bp, Homo sapiens
tgactcagaggctgggagca

SEQ ID NO: 6454543 - DNA, 21 bp, Homo sapiens
tgactcagcatacctgctggt

SEQ ID NO: 6454544 - DNA, 14 bp, Homo sapiens
tgactcaggagcct

SEQ ID NO: 6454545 - DNA, 13 bp, Homo sapiens
tgactcagggctc

SEQ ID NO: 6454546 - DNA, 22 bp, Homo sapiens
tgactcagtgcagggacagcct

SEQ ID NO: 6454547 - DNA, 20 bp, Homo sapiens
tgactcagttccaggcctga

SEQ ID NO: 6454548 - DNA, 16 bp, Homo sapiens
tgactcataggtccct

SEQ ID NO: 6454549 - DNA, 20 bp, Homo sapiens
tgactcattctgaaggagcc

SEQ ID NO: 6454550 - DNA, 13 bp, Homo sapiens
tgactcattcttt

SEQ ID NO: 6454551 - DNA, 22 bp, Homo sapiens
tgactcatttaaagctaaattt

SEQ ID NO: 6454552 - DNA, 15 bp, Homo sapiens
tgactccaaccattc

SEQ ID NO: 6454553 - DNA, 22 bp, Homo sapiens
tgactccaaccattcaaaaatt

SEQ ID NO: 6454554 - DNA, 20 bp, Homo sapiens
tgactccactcaaagagggt

SEQ ID NO: 6454555 - DNA, 19 bp, Homo sapiens
tgactccagaatttcccaa

SEQ ID NO: 6454556 - DNA, 13 bp, Homo sapiens
tgactccagagtc

SEQ ID NO: 6454557 - DNA, 15 bp, Homo sapiens
tgactccagagtctg

SEQ ID NO: 6454558 - DNA, 23 bp, Homo sapiens
tgactccagagtctgagcccccg

SEQ ID NO: 6454559 - DNA, 20 bp, Homo sapiens
tgactccagcctgccctcag

SEQ ID NO: 6454560 - DNA, 11 bp, Homo sapiens
tgactccaggg

SEQ ID NO: 6454561 - DNA, 19 bp, Homo sapiens
tgactccagggtgacaagg

SEQ ID NO: 6454562 - DNA, 23 bp, Homo sapiens
tgactccagtggggcaagatttt

SEQ ID NO: 6454563 - DNA, 20 bp, Homo sapiens
tgactccatatcccgggagc

SEQ ID NO: 6454564 - DNA, 22 bp, Homo sapiens
tgactccatatcccgggagcag

SEQ ID NO: 6454565 - DNA, 22 bp, Homo sapiens
tgactccatgtgtgctgtcctc

SEQ ID NO: 6454566 - DNA, 17 bp, Homo sapiens
tgactcccaaagagctg

SEQ ID NO: 6454567 - DNA, 20 bp, Homo sapiens
tgactcccaaagagctgcct

SEQ ID NO: 6454568 - DNA, 22 bp, Homo sapiens
tgactcccattttggtgtgcat

SEQ ID NO: 6454569 - DNA, 14 bp, Homo sapiens
tgactccccagccc

SEQ ID NO: 6454570 - DNA, 19 bp, Homo sapiens
tgactccccagcccagcac

SEQ ID NO: 6454571 - DNA, 21 bp, Homo sapiens
tgactccccagcccagcaccc

SEQ ID NO: 6454572 - DNA, 19 bp, Homo sapiens
tgactcccctttctcttct

SEQ ID NO: 6454573 - DNA, 13 bp, Homo sapiens
tgactccctcccc

SEQ ID NO: 6454574 - DNA, 14 bp, Homo sapiens
tgactccctcccca

SEQ ID NO: 6454575 - DNA, 18 bp, Homo sapiens
tgactccctccccaccca

SEQ ID NO: 6454576 - DNA, 12 bp, Homo sapiens
tgactccctggg

SEQ ID NO: 6454577 - DNA, 13 bp, Homo sapiens
tgactccctggga

SEQ ID NO: 6454578 - DNA, 15 bp, Homo sapiens
tgactccctgggagc

SEQ ID NO: 6454579 - DNA, 13 bp, Homo sapiens
tgactccctgtgg

SEQ ID NO: 6454580 - DNA, 16 bp, Homo sapiens
tgactccctgtggggg

SEQ ID NO: 6454581 - DNA, 16 bp, Homo sapiens
tgactccgctggaggt

SEQ ID NO: 6454582 - DNA, 21 bp, Homo sapiens
tgactccgctggaggtggggc

SEQ ID NO: 6454583 - DNA, 18 bp, Homo sapiens
tgactcctacctgccctg

SEQ ID NO: 6454584 - DNA, 24 bp, Homo sapiens
tgactcctcccttccccactctgc

SEQ ID NO: 6454585 - DNA, 20 bp, Homo sapiens
tgactcctctggctttccca

SEQ ID NO: 6454586 - DNA, 13 bp, Homo sapiens
tgactcctgaaac

SEQ ID NO: 6454587 - DNA, 13 bp, Homo sapiens
tgactcctgctgg

SEQ ID NO: 6454588 - DNA, 17 bp, Homo sapiens
tgactcctgctggtacc

SEQ ID NO: 6454589 - DNA, 22 bp, Homo sapiens
tgactcctgctggtacctgccc

SEQ ID NO: 6454590 - DNA, 14 bp, Homo sapiens
tgactcctgggtgg

SEQ ID NO: 6454591 - DNA, 12 bp, Homo sapiens
tgactcctgttg

SEQ ID NO: 6454592 - DNA, 22 bp, Homo sapiens
tgactccttagagacatcaaaa

SEQ ID NO: 6454593 - DNA, 17 bp, Homo sapiens
tgactccttatctcttt

SEQ ID NO: 6454594 - DNA, 15 bp, Homo sapiens
tgactccttggtgct

SEQ ID NO: 6454595 - DNA, 20 bp, Homo sapiens
tgactcctttccaatagaaa

SEQ ID NO: 6454596 - DNA, 21 bp, Homo sapiens
tgactcgcttagctgaaacct

SEQ ID NO: 6454597 - DNA, 16 bp, Homo sapiens
tgactcgggagctgca

SEQ ID NO: 6454598 - DNA, 18 bp, Homo sapiens
tgactcgggagctgcaca

SEQ ID NO: 6454599 - DNA, 22 bp, Homo sapiens
tgactcgggccttagaactttg

SEQ ID NO: 6454600 - DNA, 18 bp, Homo sapiens
tgactcgggggctgtctc

SEQ ID NO: 6454601 - DNA, 19 bp, Homo sapiens
tgactcgggggctgtctca

SEQ ID NO: 6454602 - DNA, 14 bp, Homo sapiens
tgactcggtttctc

SEQ ID NO: 6454603 - DNA, 15 bp, Homo sapiens
tgactcggtttctcc

SEQ ID NO: 6454604 - DNA, 16 bp, Homo sapiens
tgactcggtttctcca

SEQ ID NO: 6454605 - DNA, 21 bp, Homo sapiens
tgactcgtatatgtctcaggt

SEQ ID NO: 6454606 - DNA, 20 bp, Homo sapiens
tgactcgtctgactgtgtgt

SEQ ID NO: 6454607 - DNA, 15 bp, Homo sapiens
tgactcgtgctgcat

SEQ ID NO: 6454608 - DNA, 20 bp, Homo sapiens
tgactctaagctcagtgctc

SEQ ID NO: 6454609 - DNA, 20 bp, Homo sapiens
tgactctaatatgattatac

SEQ ID NO: 6454610 - DNA, 16 bp, Homo sapiens
tgactctactcccagc

SEQ ID NO: 6454611 - DNA, 19 bp, Homo sapiens
tgactctaggcttcaggtt

SEQ ID NO: 6454612 - DNA, 23 bp, Homo sapiens
tgactctagtactgtgaatccag

SEQ ID NO: 6454613 - DNA, 13 bp, Homo sapiens
tgactctcaaatc

SEQ ID NO: 6454614 - DNA, 16 bp, Homo sapiens
tgactctcacactgaa

SEQ ID NO: 6454615 - DNA, 15 bp, Homo sapiens
tgactctcacctgta

SEQ ID NO: 6454616 - DNA, 16 bp, Homo sapiens
tgactctcacctgtac

SEQ ID NO: 6454617 - DNA, 19 bp, Homo sapiens
tgactctccactcctcctc

SEQ ID NO: 6454618 - DNA, 14 bp, Homo sapiens
tgactctccagggg

SEQ ID NO: 6454619 - DNA, 17 bp, Homo sapiens
tgactctctgagctggg

SEQ ID NO: 6454620 - DNA, 20 bp, Homo sapiens
tgactctctgagctggggag

SEQ ID NO: 6454621 - DNA, 15 bp, Homo sapiens
tgactctgaaatctg

SEQ ID NO: 6454622 - DNA, 22 bp, Homo sapiens
tgactctgccagggtggggctc

SEQ ID NO: 6454623 - DNA, 13 bp, Homo sapiens
tgactctggaacc

SEQ ID NO: 6454624 - DNA, 20 bp, Homo sapiens
tgactctggaaccatcctct

SEQ ID NO: 6454625 - DNA, 22 bp, Homo sapiens
tgactctggaaccatcctctgt

SEQ ID NO: 6454626 - DNA, 23 bp, Homo sapiens
tgactctggaaccatcctctgtt

SEQ ID NO: 6454627 - DNA, 19 bp, Homo sapiens
tgactctggaccatgctga

SEQ ID NO: 6454628 - DNA, 22 bp, Homo sapiens
tgactctggcaaagcttttaga

SEQ ID NO: 6454629 - DNA, 15 bp, Homo sapiens
tgactctgggcaggg

SEQ ID NO: 6454630 - DNA, 18 bp, Homo sapiens
tgactctggggtgcagct

SEQ ID NO: 6454631 - DNA, 20 bp, Homo sapiens
tgactctggggtgcagcttc

SEQ ID NO: 6454632 - DNA, 21 bp, Homo sapiens
tgactctggggtgcagcttca

SEQ ID NO: 6454633 - DNA, 15 bp, Homo sapiens
tgactctgggtcctt

SEQ ID NO: 6454634 - DNA, 18 bp, Homo sapiens
tgactctgggtccttcct

SEQ ID NO: 6454635 - DNA, 23 bp, Homo sapiens
tgactctgggtggaagtgcccag

SEQ ID NO: 6454636 - DNA, 19 bp, Homo sapiens
tgactctgtccaactctgt

SEQ ID NO: 6454637 - DNA, 22 bp, Homo sapiens
tgactctgtccaactctgtatt

SEQ ID NO: 6454638 - DNA, 16 bp, Homo sapiens
tgactctgtctcattg

SEQ ID NO: 6454639 - DNA, 16 bp, Homo sapiens
tgactcttaagaagac

SEQ ID NO: 6454640 - DNA, 16 bp, Homo sapiens
tgactcttacacactg

SEQ ID NO: 6454641 - DNA, 20 bp, Homo sapiens
tgactcttccattcagtttt

SEQ ID NO: 6454642 - DNA, 21 bp, Homo sapiens
tgactcttccattcagtttta

SEQ ID NO: 6454643 - DNA, 15 bp, Homo sapiens
tgactcttccctcaa

SEQ ID NO: 6454644 - DNA, 14 bp, Homo sapiens
tgactcttctctca

SEQ ID NO: 6454645 - DNA, 17 bp, Homo sapiens
tgactcttcttatcaca

SEQ ID NO: 6454646 - DNA, 22 bp, Homo sapiens
tgactcttcttatcacacttgc

SEQ ID NO: 6454647 - DNA, 21 bp, Homo sapiens
tgactcttgaagtacttaaca

SEQ ID NO: 6454648 - DNA, 14 bp, Homo sapiens
tgactcttgagttg

SEQ ID NO: 6454649 - DNA, 13 bp, Homo sapiens
tgactcttgcctt

SEQ ID NO: 6454650 - DNA, 18 bp, Homo sapiens
tgactcttggagcctctt

SEQ ID NO: 6454651 - DNA, 14 bp, Homo sapiens
tgactcttggcaca

SEQ ID NO: 6454652 - DNA, 18 bp, Homo sapiens
tgactctttattgtctgt

SEQ ID NO: 6454653 - DNA, 14 bp, Homo sapiens
tgactctttccaac

SEQ ID NO: 6454654 - DNA, 16 bp, Homo sapiens
tgactctttccaaccg

SEQ ID NO: 6454655 - DNA, 18 bp, Homo sapiens
tgactctttcctaaagcc

SEQ ID NO: 6454656 - DNA, 21 bp, Homo sapiens
tgactctttctattgtttctt

SEQ ID NO: 6454657 - DNA, 14 bp, Homo sapiens
tgactctttctgaa

SEQ ID NO: 6454658 - DNA, 22 bp, Homo sapiens
tgactctttctgaaggaagaga

SEQ ID NO: 6454659 - DNA, 23 bp, Homo sapiens
tgactctttctgaaggaagagaa

SEQ ID NO: 6454660 - DNA, 22 bp, Homo sapiens
tgactctttgacgggaggcctc

SEQ ID NO: 6454661 - DNA, 23 bp, Homo sapiens
tgactctttttagggccaggcag

SEQ ID NO: 6454662 - DNA, 23 bp, Homo sapiens
tgactgaaaaaaaaaaagaagaa

SEQ ID NO: 6454663 - DNA, 21 bp, Homo sapiens
tgactgaaattactttaacat

SEQ ID NO: 6454664 - DNA, 23 bp, Homo sapiens
tgactgaaattactttaacattt

SEQ ID NO: 6454665 - DNA, 22 bp, Homo sapiens
tgactgaacattagttgcacta

SEQ ID NO: 6454666 - DNA, 19 bp, Homo sapiens
tgactgaacgatccttcaa

SEQ ID NO: 6454667 - DNA, 14 bp, Homo sapiens
tgactgaactgcac

SEQ ID NO: 6454668 - DNA, 19 bp, Homo sapiens
tgactgaactgcacgttct

SEQ ID NO: 6454669 - DNA, 14 bp, Homo sapiens
tgactgaagggaaa

SEQ ID NO: 6454670 - DNA, 14 bp, Homo sapiens
tgactgaagggact

SEQ ID NO: 6454671 - DNA, 19 bp, Homo sapiens
tgactgaaggggcacacca

SEQ ID NO: 6454672 - DNA, 12 bp, Homo sapiens
tgactgaatgca

SEQ ID NO: 6454673 - DNA, 14 bp, Homo sapiens
tgactgaatgctgt

SEQ ID NO: 6454674 - DNA, 18 bp, Homo sapiens
tgactgaatttgggcctc

SEQ ID NO: 6454675 - DNA, 20 bp, Homo sapiens
tgactgaatttgggcctctt

SEQ ID NO: 6454676 - DNA, 14 bp, Homo sapiens
tgactgaccatgca

SEQ ID NO: 6454677 - DNA, 21 bp, Homo sapiens
tgactgacccaaaatgtgaat

SEQ ID NO: 6454678 - DNA, 17 bp, Homo sapiens
tgactgacggctgtgta

SEQ ID NO: 6454679 - DNA, 20 bp, Homo sapiens
tgactgagagcccactgcag

SEQ ID NO: 6454680 - DNA, 16 bp, Homo sapiens
tgactgagataagaaa

SEQ ID NO: 6454681 - DNA, 19 bp, Homo sapiens
tgactgagataagaaaagc

SEQ ID NO: 6454682 - DNA, 18 bp, Homo sapiens
tgactgagatttgtaaat

SEQ ID NO: 6454683 - DNA, 19 bp, Homo sapiens
tgactgagatttgtaaatc

SEQ ID NO: 6454684 - DNA, 21 bp, Homo sapiens
tgactgagatttgtaaatctt

SEQ ID NO: 6454685 - DNA, 19 bp, Homo sapiens
tgactgagcagactggtga

SEQ ID NO: 6454686 - DNA, 11 bp, Homo sapiens
tgactgagctt

SEQ ID NO: 6454687 - DNA, 18 bp, Homo sapiens
tgactgaggcagtttgag

SEQ ID NO: 6454688 - DNA, 18 bp, Homo sapiens
tgactgaggcctgcttcc

SEQ ID NO: 6454689 - DNA, 13 bp, Homo sapiens
tcctaaccctggc

SEQ ID NO: 6454690 - DNA, 14 bp, Homo sapiens
tcctaactccaccg

SEQ ID NO: 6454691 - DNA, 17 bp, Homo sapiens
tcctaactccaccgcct

SEQ ID NO: 6454692 - DNA, 12 bp, Homo sapiens
tcctaactttct

SEQ ID NO: 6454693 - DNA, 13 bp, Homo sapiens
tcctaagaaagag

SEQ ID NO: 6454694 - DNA, 22 bp, Homo sapiens
tcctaagaaagaggagtgcttg

SEQ ID NO: 6454695 - DNA, 19 bp, Homo sapiens
tcctaagaaatatgtgaga

SEQ ID NO: 6454696 - DNA, 20 bp, Homo sapiens
tcctaagaaatatgtgagat

SEQ ID NO: 6454697 - DNA, 23 bp, Homo sapiens
tcctaagaaatatgtgagatttt

SEQ ID NO: 6454698 - DNA, 12 bp, Homo sapiens
tcctaagaatgt

SEQ ID NO: 6454699 - DNA, 18 bp, Homo sapiens
tcctaagaatttttcatt

SEQ ID NO: 6454700 - DNA, 13 bp, Homo sapiens
tcctaagacattt

SEQ ID NO: 6454701 - DNA, 14 bp, Homo sapiens
tcctaagacatttt

SEQ ID NO: 6454702 - DNA, 17 bp, Homo sapiens
tcctaagacatttttca

SEQ ID NO: 6454703 - DNA, 15 bp, Homo sapiens
tcctaagacctgggg

SEQ ID NO: 6454704 - DNA, 16 bp, Homo sapiens
tcctaagaccttttct

SEQ ID NO: 6454705 - DNA, 23 bp, Homo sapiens
tcctaagactaacaaaggcagct

SEQ ID NO: 6454706 - DNA, 15 bp, Homo sapiens
tcctaagacttcagt

SEQ ID NO: 6454707 - DNA, 18 bp, Homo sapiens
tcctaagacttcagtcct

SEQ ID NO: 6454708 - DNA, 23 bp, Homo sapiens
tcctaagatgtgttcttattttt

SEQ ID NO: 6454709 - DNA, 13 bp, Homo sapiens
tcctaagcagctg

SEQ ID NO: 6454710 - DNA, 13 bp, Homo sapiens
tcctaagcatcta

SEQ ID NO: 6454711 - DNA, 15 bp, Homo sapiens
tcctaagcatctaag

SEQ ID NO: 6454712 - DNA, 16 bp, Homo sapiens
tcctaagcatctaagt

SEQ ID NO: 6454713 - DNA, 14 bp, Homo sapiens
tcctaagcctaaaa

SEQ ID NO: 6454714 - DNA, 16 bp, Homo sapiens
tcctaagcctgtggct

SEQ ID NO: 6454715 - DNA, 20 bp, Homo sapiens
tcctaagcctgtggctgtgg

SEQ ID NO: 6454716 - DNA, 21 bp, Homo sapiens
tcctaagctattcagtaataa

SEQ ID NO: 6454717 - DNA, 21 bp, Homo sapiens
tcctaagctgccagccttccc

SEQ ID NO: 6454718 - DNA, 19 bp, Homo sapiens
tcctaaggagttaaatctt

SEQ ID NO: 6454719 - DNA, 20 bp, Homo sapiens
tcctaaggagttaaatcttc

SEQ ID NO: 6454720 - DNA, 22 bp, Homo sapiens
tcctaaggcccagctgccaggg

SEQ ID NO: 6454721 - DNA, 15 bp, Homo sapiens
tcctaaggctcccca

SEQ ID NO: 6454722 - DNA, 18 bp, Homo sapiens
tcctaagggtcgaaagct

SEQ ID NO: 6454723 - DNA, 21 bp, Homo sapiens
tcctaagggtcgaaagctcta

SEQ ID NO: 6454724 - DNA, 23 bp, Homo sapiens
tcctaaggtgcttacctcacacg

SEQ ID NO: 6454725 - DNA, 16 bp, Homo sapiens
tcctaaggttcttgct

SEQ ID NO: 6454726 - DNA, 23 bp, Homo sapiens
tcctaaggttcttgctttctctc

SEQ ID NO: 6454727 - DNA, 15 bp, Homo sapiens
tcctaagtcccttcc

SEQ ID NO: 6454728 - DNA, 22 bp, Homo sapiens
tcctaagttcttagatatcttt

SEQ ID NO: 6454729 - DNA, 18 bp, Homo sapiens
tcctaagtttttttcatt

SEQ ID NO: 6454730 - DNA, 12 bp, Homo sapiens
tcctaataaaaa

SEQ ID NO: 6454731 - DNA, 17 bp, Homo sapiens
tcctaataaaaaggtga

SEQ ID NO: 6454732 - DNA, 18 bp, Homo sapiens
tcctaataaaaaggtgac

SEQ ID NO: 6454733 - DNA, 20 bp, Homo sapiens
tcctaataatcattggattc

SEQ ID NO: 6454734 - DNA, 17 bp, Homo sapiens
tcctaatagcttttcct

SEQ ID NO: 6454735 - DNA, 14 bp, Homo sapiens
tcctaatatcaaat

SEQ ID NO: 6454736 - DNA, 16 bp, Homo sapiens
tcctaatcactcagag

SEQ ID NO: 6454737 - DNA, 22 bp, Homo sapiens
tcctaatcagaaatttttatca

SEQ ID NO: 6454738 - DNA, 19 bp, Homo sapiens
tcctaatcatataccagag

SEQ ID NO: 6454739 - DNA, 22 bp, Homo sapiens
tcctaatcccttcctctcccat

SEQ ID NO: 6454740 - DNA, 13 bp, Homo sapiens
tcctaatcgctaa

SEQ ID NO: 6454741 - DNA, 16 bp, Homo sapiens
tcctaatcttctgaac

SEQ ID NO: 6454742 - DNA, 20 bp, Homo sapiens
tcctaatgccctatgtgtat

SEQ ID NO: 6454743 - DNA, 15 bp, Homo sapiens
tcctaatgctctgaa

SEQ ID NO: 6454744 - DNA, 19 bp, Homo sapiens
tcctaatggctatttttga

SEQ ID NO: 6454745 - DNA, 22 bp, Homo sapiens
tcctaatggtctcatctccttt

SEQ ID NO: 6454746 - DNA, 14 bp, Homo sapiens
tcctaatggtgatg

SEQ ID NO: 6454747 - DNA, 20 bp, Homo sapiens
tcctaatgtgctgtgtgaca

SEQ ID NO: 6454748 - DNA, 17 bp, Homo sapiens
tcctaattattgtaatg

SEQ ID NO: 6454749 - DNA, 18 bp, Homo sapiens
tcctaattcttctgtcct

SEQ ID NO: 6454750 - DNA, 14 bp, Homo sapiens
tcctaattgtgccc

SEQ ID NO: 6454751 - DNA, 18 bp, Homo sapiens
tcctaatttcccttcttg

SEQ ID NO: 6454752 - DNA, 15 bp, Homo sapiens
tcctaatttctcctc

SEQ ID NO: 6454753 - DNA, 19 bp, Homo sapiens
tcctaatttctcctccctt

SEQ ID NO: 6454754 - DNA, 13 bp, Homo sapiens
tcctaatttgttt

SEQ ID NO: 6454755 - DNA, 15 bp, Homo sapiens
tcctaattttaaata

SEQ ID NO: 6454756 - DNA, 23 bp, Homo sapiens
tcctaattttaaataatttctac

SEQ ID NO: 6454757 - DNA, 16 bp, Homo sapiens
tcctaattttgagaaa

SEQ ID NO: 6454758 - DNA, 22 bp, Homo sapiens
tcctacaaaaataaaaggcttc

SEQ ID NO: 6454759 - DNA, 14 bp, Homo sapiens
tcctacaaccaggt

SEQ ID NO: 6454760 - DNA, 21 bp, Homo sapiens
tcctacaactaaaaataaatt

SEQ ID NO: 6454761 - DNA, 15 bp, Homo sapiens
tcctacaagacacag

SEQ ID NO: 6454762 - DNA, 17 bp, Homo sapiens
tcctacaagatttagaa

SEQ ID NO: 6454763 - DNA, 19 bp, Homo sapiens
tcctacaagatttagaaaa

SEQ ID NO: 6454764 - DNA, 15 bp, Homo sapiens
tcctacaatatatat

SEQ ID NO: 6454765 - DNA, 12 bp, Homo sapiens
tcctacacaatg

SEQ ID NO: 6454766 - DNA, 16 bp, Homo sapiens
tcctacacctaactca

SEQ ID NO: 6454767 - DNA, 20 bp, Homo sapiens
tcctacagaaaaaccttggg

SEQ ID NO: 6454768 - DNA, 21 bp, Homo sapiens
tcctacagaaatactgctctg

SEQ ID NO: 6454769 - DNA, 23 bp, Homo sapiens
tcctacagaaatactgctctgaa

SEQ ID NO: 6454770 - DNA, 21 bp, Homo sapiens
tcctacagagccaaaatgcca

SEQ ID NO: 6454771 - DNA, 16 bp, Homo sapiens
tcctacagatagtcaa

SEQ ID NO: 6454772 - DNA, 15 bp, Homo sapiens
tcctacagcactact

SEQ ID NO: 6454773 - DNA, 13 bp, Homo sapiens
tcctacaggagat

SEQ ID NO: 6454774 - DNA, 19 bp, Homo sapiens
tcctacaggcctatttaac

SEQ ID NO: 6454775 - DNA, 21 bp, Homo sapiens
tcctacaggcctatttaacaa

SEQ ID NO: 6454776 - DNA, 23 bp, Homo sapiens
tcctacagtgactccctgggagc

SEQ ID NO: 6454777 - DNA, 21 bp, Homo sapiens
tcctacagttggaaatccatc

SEQ ID NO: 6454778 - DNA, 18 bp, Homo sapiens
tcctacatccagctcctc

SEQ ID NO: 6454779 - DNA, 14 bp, Homo sapiens
tcctacatcttctt

SEQ ID NO: 6454780 - DNA, 16 bp, Homo sapiens
tcctaccaaatataaa

SEQ ID NO: 6454781 - DNA, 17 bp, Homo sapiens
tcctaccaatgcatgca

SEQ ID NO: 6454782 - DNA, 21 bp, Homo sapiens
tcctaccaatgcatgcagcca

SEQ ID NO: 6454783 - DNA, 23 bp, Homo sapiens
tcctaccagttgccctagcccag

SEQ ID NO: 6454784 - DNA, 16 bp, Homo sapiens
tcctaccatcagctct

SEQ ID NO: 6454785 - DNA, 17 bp, Homo sapiens
tcctaccatcagctctg

SEQ ID NO: 6454786 - DNA, 20 bp, Homo sapiens
tcctaccatcagctctgcct

SEQ ID NO: 6454787 - DNA, 15 bp, Homo sapiens
tcctacccacacctc

SEQ ID NO: 6454788 - DNA, 17 bp, Homo sapiens
tcctacccagcgtggcc

SEQ ID NO: 6454789 - DNA, 21 bp, Homo sapiens
tcctacccagcgtggcccagg

SEQ ID NO: 6454790 - DNA, 21 bp, Homo sapiens
tcctaccccaattccttgtag

SEQ ID NO: 6454791 - DNA, 21 bp, Homo sapiens
tcctaccccacctcatgcctg

SEQ ID NO: 6454792 - DNA, 23 bp, Homo sapiens
tcctaccccacctcatgcctggc

SEQ ID NO: 6454793 - DNA, 14 bp, Homo sapiens
tcctacccctccca

SEQ ID NO: 6454794 - DNA, 12 bp, Homo sapiens
tcctaccccttc

SEQ ID NO: 6454795 - DNA, 15 bp, Homo sapiens
tcctaccccttcctg

SEQ ID NO: 6454796 - DNA, 21 bp, Homo sapiens
tcctaccccttcctgtcctgc

SEQ ID NO: 6454797 - DNA, 15 bp, Homo sapiens
tcctaccctcccacc

SEQ ID NO: 6454798 - DNA, 19 bp, Homo sapiens
tcctaccctcttattgttc

SEQ ID NO: 6454799 - DNA, 20 bp, Homo sapiens
tcctaccctgcgcccagtcc

SEQ ID NO: 6454800 - DNA, 13 bp, Homo sapiens
tcctacccttttc

SEQ ID NO: 6454801 - DNA, 15 bp, Homo sapiens
tcctacctattatcc

SEQ ID NO: 6454802 - DNA, 22 bp, Homo sapiens
tcctacctattatccttctact

SEQ ID NO: 6454803 - DNA, 15 bp, Homo sapiens
tcctacctcagcctc

SEQ ID NO: 6454804 - DNA, 13 bp, Homo sapiens
tcctacctccctg

SEQ ID NO: 6454805 - DNA, 21 bp, Homo sapiens
tcctacctgaaggcagggctc

SEQ ID NO: 6454806 - DNA, 15 bp, Homo sapiens
tcctacctgccctgg

SEQ ID NO: 6454807 - DNA, 14 bp, Homo sapiens
tcctacctgctgct

SEQ ID NO: 6454808 - DNA, 16 bp, Homo sapiens
tcctacctgctgctgc

SEQ ID NO: 6454809 - DNA, 20 bp, Homo sapiens
tcctacctgctgctgctatt

SEQ ID NO: 6454810 - DNA, 21 bp, Homo sapiens
tcctacctggggactcctcaa

SEQ ID NO: 6454811 - DNA, 13 bp, Homo sapiens
tcctacctggggg

SEQ ID NO: 6454812 - DNA, 14 bp, Homo sapiens
tcctacctgggggc

SEQ ID NO: 6454813 - DNA, 21 bp, Homo sapiens
tcctacctgtctgctgccagc

SEQ ID NO: 6454814 - DNA, 22 bp, Homo sapiens
tcctacctgtctgctgccagca

SEQ ID NO: 6454815 - DNA, 20 bp, Homo sapiens
tcctaccttttgataaaatg

SEQ ID NO: 6454816 - DNA, 21 bp, Homo sapiens
tcctaccttttgataaaatgt

SEQ ID NO: 6454817 - DNA, 15 bp, Homo sapiens
tcctacgctatgtag

SEQ ID NO: 6454818 - DNA, 20 bp, Homo sapiens
tcctacgtcaaacatgaagt

SEQ ID NO: 6454819 - DNA, 14 bp, Homo sapiens
tcctactaataaac

SEQ ID NO: 6454820 - DNA, 18 bp, Homo sapiens
tcctactaataaaccagt

SEQ ID NO: 6454821 - DNA, 17 bp, Homo sapiens
tcctactcccagacacc

SEQ ID NO: 6454822 - DNA, 18 bp, Homo sapiens
tcctactcccagacaccc

SEQ ID NO: 6454823 - DNA, 16 bp, Homo sapiens
tcctactccctcttcc

SEQ ID NO: 6454824 - DNA, 17 bp, Homo sapiens
tcctactccctcttcca

SEQ ID NO: 6454825 - DNA, 14 bp, Homo sapiens
tcctactcctggag

SEQ ID NO: 6454826 - DNA, 16 bp, Homo sapiens
tcctactcctggagca

SEQ ID NO: 6454827 - DNA, 13 bp, Homo sapiens
tcctactcttctc

SEQ ID NO: 6454828 - DNA, 16 bp, Homo sapiens
tcctactcttctctct

SEQ ID NO: 6454829 - DNA, 17 bp, Homo sapiens
tcctactcttctctctg

SEQ ID NO: 6454830 - DNA, 23 bp, Homo sapiens
tcctactcttctctctgctctga

SEQ ID NO: 6454831 - DNA, 20 bp, Homo sapiens
tcctactgcgcctcgtgctg

SEQ ID NO: 6454832 - DNA, 15 bp, Homo sapiens
tcctacttaaacaaa

SEQ ID NO: 6454833 - DNA, 12 bp, Homo sapiens
tcctacttacaa

SEQ ID NO: 6454834 - DNA, 18 bp, Homo sapiens
tcctacttataaagtaga

SEQ ID NO: 6454835 - DNA, 14 bp, Homo sapiens
tcctacttcccctt

SEQ ID NO: 6454836 - DNA, 18 bp, Homo sapiens
tcctacttctctgagtca

SEQ ID NO: 6454837 - DNA, 21 bp, Homo sapiens
tcctactttctatttttatga

SEQ ID NO: 6454838 - DNA, 22 bp, Homo sapiens
tcctactttctatttttatgat

SEQ ID NO: 6454839 - DNA, 20 bp, Homo sapiens
tcctactttgcttctctcca

SEQ ID NO: 6454840 - DNA, 21 bp, Homo sapiens
tcctactttgcttctctccac

SEQ ID NO: 6454841 - DNA, 18 bp, Homo sapiens
tcctacttttaaagaatt

SEQ ID NO: 6454842 - DNA, 16 bp, Homo sapiens
tcctagaaattcccca

SEQ ID NO: 6454843 - DNA, 15 bp, Homo sapiens
tcctagaaccaagct

SEQ ID NO: 6454844 - DNA, 21 bp, Homo sapiens
tcctagaaccaagcttcagag

SEQ ID NO: 6454845 - DNA, 20 bp, Homo sapiens
tcctagaagaaccaaatacc

SEQ ID NO: 6454846 - DNA, 15 bp, Homo sapiens
tcctagaagtcttaa

SEQ ID NO: 6454847 - DNA, 23 bp, Homo sapiens
tcctagaagtcttaattgtgttt

SEQ ID NO: 6454848 - DNA, 20 bp, Homo sapiens
tcctagaagttactgaatgc

SEQ ID NO: 6454849 - DNA, 21 bp, Homo sapiens
tcctagaagttactgaatgca

SEQ ID NO: 6454850 - DNA, 18 bp, Homo sapiens
tcctagacaggtgtttat

SEQ ID NO: 6454851 - DNA, 12 bp, Homo sapiens
tcctagacccag

SEQ ID NO: 6454852 - DNA, 15 bp, Homo sapiens
tcctagacccgtgac

SEQ ID NO: 6454853 - DNA, 19 bp, Homo sapiens
tcctagacttgaaagtttt

SEQ ID NO: 6454854 - DNA, 20 bp, Homo sapiens
tcctagacttgaaagttttc

SEQ ID NO: 6454855 - DNA, 19 bp, Homo sapiens
tcctagagagcagaaataa

SEQ ID NO: 6454856 - DNA, 15 bp, Homo sapiens
tcctagagaggagaa

SEQ ID NO: 6454857 - DNA, 22 bp, Homo sapiens
tcctagagctcctgtccctacc

SEQ ID NO: 6454858 - DNA, 12 bp, Homo sapiens
tcctagaggaga

SEQ ID NO: 6454859 - DNA, 15 bp, Homo sapiens
tcctagaggagacag

SEQ ID NO: 6454860 - DNA, 21 bp, Homo sapiens
tcctagaggagacagcctgtc

SEQ ID NO: 6454861 - DNA, 20 bp, Homo sapiens
tcctagagggaggggcctag

SEQ ID NO: 6454862 - DNA, 21 bp, Homo sapiens
tcctagaggggacaagccagg

SEQ ID NO: 6454863 - DNA, 22 bp, Homo sapiens
tcctagaggggacaagccaggc

SEQ ID NO: 6454864 - DNA, 22 bp, Homo sapiens
tcctagaggtgggcagctgggc

SEQ ID NO: 6454865 - DNA, 23 bp, Homo sapiens
tcctagaggttctgggttttctg

SEQ ID NO: 6454866 - DNA, 21 bp, Homo sapiens
tgactgagggcagctttgcaa

SEQ ID NO: 6454867 - DNA, 22 bp, Homo sapiens
tgactgagggcagctttgcaaa

SEQ ID NO: 6454868 - DNA, 13 bp, Homo sapiens
tgactgagggcct

SEQ ID NO: 6454869 - DNA, 20 bp, Homo sapiens
tgactgagggcctggtcacc

SEQ ID NO: 6454870 - DNA, 20 bp, Homo sapiens
tgactgagggtgagttggct

SEQ ID NO: 6454871 - DNA, 20 bp, Homo sapiens
tgactgagtctggcaaacat

SEQ ID NO: 6454872 - DNA, 21 bp, Homo sapiens
tgactgagtctggcaaacatg

SEQ ID NO: 6454873 - DNA, 20 bp, Homo sapiens
tgactgatagcttacactga

SEQ ID NO: 6454874 - DNA, 14 bp, Homo sapiens
tgactgatgacaaa

SEQ ID NO: 6454875 - DNA, 17 bp, Homo sapiens
tgactgatgattttcct

SEQ ID NO: 6454876 - DNA, 20 bp, Homo sapiens
tgactgatgctgagattctt

SEQ ID NO: 6454877 - DNA, 20 bp, Homo sapiens
tgactgatggtttggaaaat

SEQ ID NO: 6454878 - DNA, 14 bp, Homo sapiens
tgactgatttcaaa

SEQ ID NO: 6454879 - DNA, 22 bp, Homo sapiens
tgactgatttcaaatcatgttt

SEQ ID NO: 6454880 - DNA, 17 bp, Homo sapiens
tgactgcaacttctgtc

SEQ ID NO: 6454881 - DNA, 21 bp, Homo sapiens
tgactgcaacttctgtccctt

SEQ ID NO: 6454882 - DNA, 22 bp, Homo sapiens
tgactgcaccagcgcccccaga

SEQ ID NO: 6454883 - DNA, 19 bp, Homo sapiens
tgactgcacccagctccag

SEQ ID NO: 6454884 - DNA, 13 bp, Homo sapiens
tgactgccaagcc

SEQ ID NO: 6454885 - DNA, 21 bp, Homo sapiens
tgactgccaagccagattctc

SEQ ID NO: 6454886 - DNA, 16 bp, Homo sapiens
tgactgccaagccatg

SEQ ID NO: 6454887 - DNA, 21 bp, Homo sapiens
tgactgccaggataaagcttc

SEQ ID NO: 6454888 - DNA, 14 bp, Homo sapiens
tgactgcccagcat

SEQ ID NO: 6454889 - DNA, 15 bp, Homo sapiens
tgactgccccaactc

SEQ ID NO: 6454890 - DNA, 17 bp, Homo sapiens
tgactgccccaactcct

SEQ ID NO: 6454891 - DNA, 14 bp, Homo sapiens
tgactgccccctcc

SEQ ID NO: 6454892 - DNA, 19 bp, Homo sapiens
tgactgccctgtttctgtt

SEQ ID NO: 6454893 - DNA, 20 bp, Homo sapiens
tgactgccttgcctcctcag

SEQ ID NO: 6454894 - DNA, 22 bp, Homo sapiens
tgactgccttgcctcctcagta

SEQ ID NO: 6454895 - DNA, 16 bp, Homo sapiens
tgactgcgatcttcag

SEQ ID NO: 6454896 - DNA, 14 bp, Homo sapiens
tgactgctcaggcc

SEQ ID NO: 6454897 - DNA, 23 bp, Homo sapiens
tgactgctgcgctgtgctggtct

SEQ ID NO: 6454898 - DNA, 13 bp, Homo sapiens
tgactgctgctcc

SEQ ID NO: 6454899 - DNA, 14 bp, Homo sapiens
tgactgctgctccc

SEQ ID NO: 6454900 - DNA, 16 bp, Homo sapiens
tgactgctgctcccca

SEQ ID NO: 6454901 - DNA, 18 bp, Homo sapiens
tgactggaagttgtggat

SEQ ID NO: 6454902 - DNA, 19 bp, Homo sapiens
tgactggatcttctatcat

SEQ ID NO: 6454903 - DNA, 18 bp, Homo sapiens
tgactggatggtccagtg

SEQ ID NO: 6454904 - DNA, 19 bp, Homo sapiens
tgactggatggtccagtgt

SEQ ID NO: 6454905 - DNA, 21 bp, Homo sapiens
tgactggcaagaggcctcatg

SEQ ID NO: 6454906 - DNA, 23 bp, Homo sapiens
tgactggcaagaggcctcatgcc

SEQ ID NO: 6454907 - DNA, 21 bp, Homo sapiens
tgactggcaggtgcagatggg

SEQ ID NO: 6454908 - DNA, 17 bp, Homo sapiens
tgactggcattttatag

SEQ ID NO: 6454909 - DNA, 20 bp, Homo sapiens
tgactggccaaacccttgct

SEQ ID NO: 6454910 - DNA, 20 bp, Homo sapiens
tgactggccagttgcccaga

SEQ ID NO: 6454911 - DNA, 20 bp, Homo sapiens
tgactggcccacacgtgcat

SEQ ID NO: 6454912 - DNA, 16 bp, Homo sapiens
tgactggccccaggga

SEQ ID NO: 6454913 - DNA, 11 bp, Homo sapiens
tgactggctca

SEQ ID NO: 6454914 - DNA, 17 bp, Homo sapiens
tgactggcttcagcaag

SEQ ID NO: 6454915 - DNA, 15 bp, Homo sapiens
tgactgggaaagtta

SEQ ID NO: 6454916 - DNA, 19 bp, Homo sapiens
tgactgggcaacactgcag

SEQ ID NO: 6454917 - DNA, 11 bp, Homo sapiens
tgactgggcca

SEQ ID NO: 6454918 - DNA, 14 bp, Homo sapiens
tgactgggccacag

SEQ ID NO: 6454919 - DNA, 12 bp, Homo sapiens
tgactgggccct

SEQ ID NO: 6454920 - DNA, 18 bp, Homo sapiens
tgactgggccctgtccag

SEQ ID NO: 6454921 - DNA, 15 bp, Homo sapiens
tgactgggggcctct

SEQ ID NO: 6454922 - DNA, 22 bp, Homo sapiens
tgactgggggcctctgcctcca

SEQ ID NO: 6454923 - DNA, 17 bp, Homo sapiens
tgactggggtgggaggt

SEQ ID NO: 6454924 - DNA, 21 bp, Homo sapiens
tgactggtatacctatttcat

SEQ ID NO: 6454925 - DNA, 23 bp, Homo sapiens
tgactggtgagagaagaaaacat

SEQ ID NO: 6454926 - DNA, 16 bp, Homo sapiens
tgactggttatcacac

SEQ ID NO: 6454927 - DNA, 20 bp, Homo sapiens
tgactggttatcacaccatc

SEQ ID NO: 6454928 - DNA, 16 bp, Homo sapiens
tgactggttgtcagaa

SEQ ID NO: 6454929 - DNA, 17 bp, Homo sapiens
tgactggttgtcagaat

SEQ ID NO: 6454930 - DNA, 19 bp, Homo sapiens
tgactggtttacaggccct

SEQ ID NO: 6454931 - DNA, 20 bp, Homo sapiens
tgactggtttacaggccctg

SEQ ID NO: 6454932 - DNA, 16 bp, Homo sapiens
tgactggtttctcctg

SEQ ID NO: 6454933 - DNA, 18 bp, Homo sapiens
tgactgtaaacatagata

SEQ ID NO: 6454934 - DNA, 14 bp, Homo sapiens
tgactgtaattaat

SEQ ID NO: 6454935 - DNA, 14 bp, Homo sapiens
tgactgtacagaga

SEQ ID NO: 6454936 - DNA, 18 bp, Homo sapiens
tgactgtactcctcccag

SEQ ID NO: 6454937 - DNA, 22 bp, Homo sapiens
tgactgtactcctcccaggcgc

SEQ ID NO: 6454938 - DNA, 20 bp, Homo sapiens
tgactgtagccacagctgct

SEQ ID NO: 6454939 - DNA, 17 bp, Homo sapiens
tgactgtagctttggaa

SEQ ID NO: 6454940 - DNA, 20 bp, Homo sapiens
tgactgtaggcgcccctggg

SEQ ID NO: 6454941 - DNA, 14 bp, Homo sapiens
tgactgtatataaa

SEQ ID NO: 6454942 - DNA, 19 bp, Homo sapiens
tgactgtatctgtgtagac

SEQ ID NO: 6454943 - DNA, 21 bp, Homo sapiens
tgactgtattttgttttcctt

SEQ ID NO: 6454944 - DNA, 14 bp, Homo sapiens
tgactgtcacggaa

SEQ ID NO: 6454945 - DNA, 16 bp, Homo sapiens
tgactgtccctgccaa

SEQ ID NO: 6454946 - DNA, 24 bp, Homo sapiens
tgactgtcctctcccctccagcct

SEQ ID NO: 6454947 - DNA, 18 bp, Homo sapiens
tgactgtcgccacacgcc

SEQ ID NO: 6454948 - DNA, 20 bp, Homo sapiens
tgactgtcgccacacgcctc

SEQ ID NO: 6454949 - DNA, 19 bp, Homo sapiens
tgactgtcgtgtttacaaa

SEQ ID NO: 6454950 - DNA, 19 bp, Homo sapiens
tgactgtctagccactccc

SEQ ID NO: 6454951 - DNA, 22 bp, Homo sapiens
tgactgtctagccactccctcc

SEQ ID NO: 6454952 - DNA, 22 bp, Homo sapiens
tgactgtctggggagcgggtct

SEQ ID NO: 6454953 - DNA, 14 bp, Homo sapiens
tgactgtctttcct

SEQ ID NO: 6454954 - DNA, 15 bp, Homo sapiens
tgactgtgaccacct

SEQ ID NO: 6454955 - DNA, 23 bp, Homo sapiens
tgactgtgaccaccttctgtccc

SEQ ID NO: 6454956 - DNA, 19 bp, Homo sapiens
tgactgtgatttatttgga

SEQ ID NO: 6454957 - DNA, 16 bp, Homo sapiens
tgactgtgctactgtc

SEQ ID NO: 6454958 - DNA, 15 bp, Homo sapiens
tgactgtgctgtgca

SEQ ID NO: 6454959 - DNA, 21 bp, Homo sapiens
tgactgtggagttccattctt

SEQ ID NO: 6454960 - DNA, 21 bp, Homo sapiens
tgactgtggccctgtctggag

SEQ ID NO: 6454961 - DNA, 11 bp, Homo sapiens
tgactgtgtgt

SEQ ID NO: 6454962 - DNA, 17 bp, Homo sapiens
tgactgtgttcagtgcc

SEQ ID NO: 6454963 - DNA, 19 bp, Homo sapiens
tgactgtgttcagtgcctt

SEQ ID NO: 6454964 - DNA, 13 bp, Homo sapiens
tgactgtgttggg

SEQ ID NO: 6454965 - DNA, 14 bp, Homo sapiens
tgactgtgtttgca

SEQ ID NO: 6454966 - DNA, 15 bp, Homo sapiens
tgactgtgtttgcat

SEQ ID NO: 6454967 - DNA, 17 bp, Homo sapiens
tgactgttagttgtcca

SEQ ID NO: 6454968 - DNA, 19 bp, Homo sapiens
tgactgttctcttactgcc

SEQ ID NO: 6454969 - DNA, 18 bp, Homo sapiens
tgactgttgatgaagtat

SEQ ID NO: 6454970 - DNA, 15 bp, Homo sapiens
tgactgttgatgtac

SEQ ID NO: 6454971 - DNA, 21 bp, Homo sapiens
tgactgttgtagcattttcct

SEQ ID NO: 6454972 - DNA, 11 bp, Homo sapiens
tgactgtttat

SEQ ID NO: 6454973 - DNA, 16 bp, Homo sapiens
tgactgtttatttaag

SEQ ID NO: 6454974 - DNA, 20 bp, Homo sapiens
tgactgtttatttaaggatg

SEQ ID NO: 6454975 - DNA, 15 bp, Homo sapiens
tgactgtttcattca

SEQ ID NO: 6454976 - DNA, 15 bp, Homo sapiens
tgactgtttccatca

SEQ ID NO: 6454977 - DNA, 12 bp, Homo sapiens
tgactgtttggc

SEQ ID NO: 6454978 - DNA, 15 bp, Homo sapiens
tgactgtttggctta

SEQ ID NO: 6454979 - DNA, 18 bp, Homo sapiens
tgactgtttggcttataa

SEQ ID NO: 6454980 - DNA, 19 bp, Homo sapiens
tgactgtttggcttataaa

SEQ ID NO: 6454981 - DNA, 16 bp, Homo sapiens
tgactgtttttaccca

SEQ ID NO: 6454982 - DNA, 22 bp, Homo sapiens
tgactgttttttaaactaggaa

SEQ ID NO: 6454983 - DNA, 16 bp, Homo sapiens
tgactgttttttttgc

SEQ ID NO: 6454984 - DNA, 16 bp, Homo sapiens
tgacttaactgcattt

SEQ ID NO: 6454985 - DNA, 17 bp, Homo sapiens
tgacttaactttaactt

SEQ ID NO: 6454986 - DNA, 15 bp, Homo sapiens
tgacttaagaagcct

SEQ ID NO: 6454987 - DNA, 19 bp, Homo sapiens
tgacttaagggttgcttgc

SEQ ID NO: 6454988 - DNA, 20 bp, Homo sapiens
tgacttactgtacatgaaaa

SEQ ID NO: 6454989 - DNA, 15 bp, Homo sapiens
tgacttactgtttct

SEQ ID NO: 6454990 - DNA, 18 bp, Homo sapiens
tgacttacttaaccaggt

SEQ ID NO: 6454991 - DNA, 21 bp, Homo sapiens
tgacttacttaaccaggtttg

SEQ ID NO: 6454992 - DNA, 20 bp, Homo sapiens
tgacttagaatccctgtgtt

SEQ ID NO: 6454993 - DNA, 22 bp, Homo sapiens
tgacttagaatccctgtgttaa

SEQ ID NO: 6454994 - DNA, 23 bp, Homo sapiens
tgacttagaatccctgtgttaat

SEQ ID NO: 6454995 - DNA, 17 bp, Homo sapiens
tgacttagcctaaacaa

SEQ ID NO: 6454996 - DNA, 22 bp, Homo sapiens
tgacttagcctcctcccaaagt

SEQ ID NO: 6454997 - DNA, 19 bp, Homo sapiens
tgacttagcgtcaagacat

SEQ ID NO: 6454998 - DNA, 21 bp, Homo sapiens
tgacttagcgtcaagacattt

SEQ ID NO: 6454999 - DNA, 19 bp, Homo sapiens
tgacttaggtaaaataaaa

SEQ ID NO: 6455000 - DNA, 17 bp, Homo sapiens
tgacttaggtttcagga

SEQ ID NO: 6455001 - DNA, 21 bp, Homo sapiens
tgacttaggtttcaggaagtt

SEQ ID NO: 6455002 - DNA, 15 bp, Homo sapiens
tgacttaggttttta

SEQ ID NO: 6455003 - DNA, 14 bp, Homo sapiens
tgacttagttctta

SEQ ID NO: 6455004 - DNA, 20 bp, Homo sapiens
tgacttagttcttagaagct

SEQ ID NO: 6455005 - DNA, 14 bp, Homo sapiens
tgacttatagtaca

SEQ ID NO: 6455006 - DNA, 19 bp, Homo sapiens
tgacttatagtacatgata

SEQ ID NO: 6455007 - DNA, 19 bp, Homo sapiens
tgacttatggcatgactct

SEQ ID NO: 6455008 - DNA, 18 bp, Homo sapiens
tgacttattgtggataac

SEQ ID NO: 6455009 - DNA, 18 bp, Homo sapiens
tgacttatttctgctctg

SEQ ID NO: 6455010 - DNA, 20 bp, Homo sapiens
tgacttatttctgctctgga

SEQ ID NO: 6455011 - DNA, 21 bp, Homo sapiens
tgacttatttctgctctggaa

SEQ ID NO: 6455012 - DNA, 19 bp, Homo sapiens
tgacttattttctctgtgt

SEQ ID NO: 6455013 - DNA, 20 bp, Homo sapiens
tgacttcaaatgtgtaactt

SEQ ID NO: 6455014 - DNA, 22 bp, Homo sapiens
tgacttcaaatgtgtaacttta

SEQ ID NO: 6455015 - DNA, 16 bp, Homo sapiens
tgacttcaagatgcct

SEQ ID NO: 6455016 - DNA, 18 bp, Homo sapiens
tgacttcaagatgcctct

SEQ ID NO: 6455017 - DNA, 13 bp, Homo sapiens
tgacttcaaggaa

SEQ ID NO: 6455018 - DNA, 23 bp, Homo sapiens
tgacttcaatgatagtaagaaaa

SEQ ID NO: 6455019 - DNA, 14 bp, Homo sapiens
tgacttcacagcag

SEQ ID NO: 6455020 - DNA, 15 bp, Homo sapiens
tgacttcacagcagc

SEQ ID NO: 6455021 - DNA, 14 bp, Homo sapiens
tgacttcactgtat

SEQ ID NO: 6455022 - DNA, 13 bp, Homo sapiens
tgacttcagcagg

SEQ ID NO: 6455023 - DNA, 19 bp, Homo sapiens
tgacttcagctgcctgaaa

SEQ ID NO: 6455024 - DNA, 21 bp, Homo sapiens
tgacttcaggggctgcccgct

SEQ ID NO: 6455025 - DNA, 24 bp, Homo sapiens
tgacttcaggtggagagcactaga

SEQ ID NO: 6455026 - DNA, 13 bp, Homo sapiens
tgacttcatctgg

SEQ ID NO: 6455027 - DNA, 21 bp, Homo sapiens
tgacttcatggaatggacatc

SEQ ID NO: 6455028 - DNA, 12 bp, Homo sapiens
tgacttcatttc

SEQ ID NO: 6455029 - DNA, 18 bp, Homo sapiens
tgacttcatttgtgccac

SEQ ID NO: 6455030 - DNA, 15 bp, Homo sapiens
tgacttcattttata

SEQ ID NO: 6455031 - DNA, 17 bp, Homo sapiens
tgacttcattttatatt

SEQ ID NO: 6455032 - DNA, 13 bp, Homo sapiens
tgacttcccaagc

SEQ ID NO: 6455033 - DNA, 23 bp, Homo sapiens
tgacttcccaagccctggtgacc

SEQ ID NO: 6455034 - DNA, 16 bp, Homo sapiens
tgacttcccagctggc

SEQ ID NO: 6455035 - DNA, 22 bp, Homo sapiens
tgacttccccgcattccaggct

SEQ ID NO: 6455036 - DNA, 19 bp, Homo sapiens
tgacttcccctgcctccta

SEQ ID NO: 6455037 - DNA, 23 bp, Homo sapiens
tgacttccctggaggagaagtat

SEQ ID NO: 6455038 - DNA, 16 bp, Homo sapiens
tgacttccctggtcac

SEQ ID NO: 6455039 - DNA, 17 bp, Homo sapiens
tgacttccctggtcacc

SEQ ID NO: 6455040 - DNA, 18 bp, Homo sapiens
tgacttccctggtcacca

SEQ ID NO: 6455041 - DNA, 22 bp, Homo sapiens
tgacttccgtcccactgaagga

SEQ ID NO: 6455042 - DNA, 14 bp, Homo sapiens
tgacttcctggtga

SEQ ID NO: 6455043 - DNA, 17 bp, Homo sapiens
tcctagataaaaagatg

SEQ ID NO: 6455044 - DNA, 18 bp, Homo sapiens
tcctagatggcagtcact

SEQ ID NO: 6455045 - DNA, 21 bp, Homo sapiens
tcctagatggcagtcactgaa

SEQ ID NO: 6455046 - DNA, 19 bp, Homo sapiens
tcctagattacatctgcct

SEQ ID NO: 6455047 - DNA, 22 bp, Homo sapiens
tcctagattacatctgccttaa

SEQ ID NO: 6455048 - DNA, 20 bp, Homo sapiens
tcctagcaaatttctctctt

SEQ ID NO: 6455049 - DNA, 21 bp, Homo sapiens
tcctagcaaatttctctcttt

SEQ ID NO: 6455050 - DNA, 16 bp, Homo sapiens
tcctagcacagatggc

SEQ ID NO: 6455051 - DNA, 21 bp, Homo sapiens
tcctagcactgccccacatgc

SEQ ID NO: 6455052 - DNA, 23 bp, Homo sapiens
tcctagcactttgggaggccaag

SEQ ID NO: 6455053 - DNA, 15 bp, Homo sapiens
tcctagcagacagaa

SEQ ID NO: 6455054 - DNA, 14 bp, Homo sapiens
tcctagcagagaga

SEQ ID NO: 6455055 - DNA, 21 bp, Homo sapiens
tcctagccaccgcctcctaca

SEQ ID NO: 6455056 - DNA, 22 bp, Homo sapiens
tcctagccaggtctcctgggaa

SEQ ID NO: 6455057 - DNA, 14 bp, Homo sapiens
tcctagccccaccc

SEQ ID NO: 6455058 - DNA, 22 bp, Homo sapiens
tcctagccccgagacaccatcc

SEQ ID NO: 6455059 - DNA, 16 bp, Homo sapiens
tcctagcccctctctc

SEQ ID NO: 6455060 - DNA, 18 bp, Homo sapiens
tcctagcccctctctcac

SEQ ID NO: 6455061 - DNA, 17 bp, Homo sapiens
tcctagcctgtttcttc

SEQ ID NO: 6455062 - DNA, 19 bp, Homo sapiens
tcctagcctgtttcttcct

SEQ ID NO: 6455063 - DNA, 22 bp, Homo sapiens
tcctagccttatcctctgatct

SEQ ID NO: 6455064 - DNA, 14 bp, Homo sapiens
tcctagcctttggg

SEQ ID NO: 6455065 - DNA, 20 bp, Homo sapiens
tcctagctacttggcaggct

SEQ ID NO: 6455066 - DNA, 13 bp, Homo sapiens
tcctagctctccc

SEQ ID NO: 6455067 - DNA, 14 bp, Homo sapiens
tcctagctcttaca

SEQ ID NO: 6455068 - DNA, 15 bp, Homo sapiens
tcctagctgacgcca

SEQ ID NO: 6455069 - DNA, 20 bp, Homo sapiens
tcctagctgcacagggcagc

SEQ ID NO: 6455070 - DNA, 24 bp, Homo sapiens
tcctagctggagaggagccctgcc

SEQ ID NO: 6455071 - DNA, 24 bp, Homo sapiens
tcctagctggagtgccatggctgg

SEQ ID NO: 6455072 - DNA, 12 bp, Homo sapiens
tcctagctgtgt

SEQ ID NO: 6455073 - DNA, 17 bp, Homo sapiens
tcctagctgtgtgaata

SEQ ID NO: 6455074 - DNA, 14 bp, Homo sapiens
tcctagctgtgtgc

SEQ ID NO: 6455075 - DNA, 13 bp, Homo sapiens
tcctagctgttct

SEQ ID NO: 6455076 - DNA, 13 bp, Homo sapiens
tcctagcttatct

SEQ ID NO: 6455077 - DNA, 21 bp, Homo sapiens
tcctagcttgggaggcttccc

SEQ ID NO: 6455078 - DNA, 14 bp, Homo sapiens
tcctaggaaaatac

SEQ ID NO: 6455079 - DNA, 17 bp, Homo sapiens
tcctaggaaaccagctc

SEQ ID NO: 6455080 - DNA, 18 bp, Homo sapiens
tcctaggaaccagccaac

SEQ ID NO: 6455081 - DNA, 19 bp, Homo sapiens
tcctaggacatctctgtaa

SEQ ID NO: 6455082 - DNA, 20 bp, Homo sapiens
tcctaggacccgtctccagc

SEQ ID NO: 6455083 - DNA, 23 bp, Homo sapiens
tcctaggagagccaacctcggct

SEQ ID NO: 6455084 - DNA, 19 bp, Homo sapiens
tcctaggcatctgctgtaa

SEQ ID NO: 6455085 - DNA, 22 bp, Homo sapiens
tcctaggcattacccaaaagca

SEQ ID NO: 6455086 - DNA, 13 bp, Homo sapiens
tcctaggcatttg

SEQ ID NO: 6455087 - DNA, 19 bp, Homo sapiens
tcctaggcatttgctgaat

SEQ ID NO: 6455088 - DNA, 15 bp, Homo sapiens
tcctaggcccaggcc

SEQ ID NO: 6455089 - DNA, 16 bp, Homo sapiens
tcctaggccccagagc

SEQ ID NO: 6455090 - DNA, 12 bp, Homo sapiens
tcctaggccctt

SEQ ID NO: 6455091 - DNA, 21 bp, Homo sapiens
tcctaggcccttggggtggcg

SEQ ID NO: 6455092 - DNA, 22 bp, Homo sapiens
tcctaggcccttggggtggcgc

SEQ ID NO: 6455093 - DNA, 13 bp, Homo sapiens
tcctaggcctcag

SEQ ID NO: 6455094 - DNA, 16 bp, Homo sapiens
tcctaggcgctcagag

SEQ ID NO: 6455095 - DNA, 17 bp, Homo sapiens
tcctaggcgctcagagg

SEQ ID NO: 6455096 - DNA, 20 bp, Homo sapiens
tcctaggcgctcagaggccg

SEQ ID NO: 6455097 - DNA, 19 bp, Homo sapiens
tcctaggctccctgaggta

SEQ ID NO: 6455098 - DNA, 15 bp, Homo sapiens
tcctaggctcctggg

SEQ ID NO: 6455099 - DNA, 17 bp, Homo sapiens
tcctaggctggaagcca

SEQ ID NO: 6455100 - DNA, 17 bp, Homo sapiens
tcctaggcttaaatgca

SEQ ID NO: 6455101 - DNA, 20 bp, Homo sapiens
tcctagggaaaagttcatag

SEQ ID NO: 6455102 - DNA, 20 bp, Homo sapiens
tcctagggatctgaaatcca

SEQ ID NO: 6455103 - DNA, 18 bp, Homo sapiens
tcctaggggaacagacca

SEQ ID NO: 6455104 - DNA, 23 bp, Homo sapiens
tcctaggggaacagaccagtgac

SEQ ID NO: 6455105 - DNA, 15 bp, Homo sapiens
tcctaggggaagggg

SEQ ID NO: 6455106 - DNA, 21 bp, Homo sapiens
tcctagggggtgtcagaagct

SEQ ID NO: 6455107 - DNA, 22 bp, Homo sapiens
tcctagggggtgtcagaagctg

SEQ ID NO: 6455108 - DNA, 21 bp, Homo sapiens
tcctaggggtgcgctcacctg

SEQ ID NO: 6455109 - DNA, 20 bp, Homo sapiens
tcctagggtgggaaggggct

SEQ ID NO: 6455110 - DNA, 22 bp, Homo sapiens
tcctaggtccaagccccccaca

SEQ ID NO: 6455111 - DNA, 19 bp, Homo sapiens
tcctaggtcctctgaggca

SEQ ID NO: 6455112 - DNA, 20 bp, Homo sapiens
tcctaggtcctctgaggcac

SEQ ID NO: 6455113 - DNA, 19 bp, Homo sapiens
tcctaggtgaccccatctc

SEQ ID NO: 6455114 - DNA, 14 bp, Homo sapiens
tcctaggtgctgga

SEQ ID NO: 6455115 - DNA, 22 bp, Homo sapiens
tcctagtaagaacgtactttct

SEQ ID NO: 6455116 - DNA, 14 bp, Homo sapiens
tcctagtaagaaga

SEQ ID NO: 6455117 - DNA, 15 bp, Homo sapiens
tcctagtcttcacaa

SEQ ID NO: 6455118 - DNA, 14 bp, Homo sapiens
tcctagtgaaccac

SEQ ID NO: 6455119 - DNA, 17 bp, Homo sapiens
tcctagtggatgactgt

SEQ ID NO: 6455120 - DNA, 22 bp, Homo sapiens
tcctagtggatgactgttgatg

SEQ ID NO: 6455121 - DNA, 13 bp, Homo sapiens
tcctagtgtcttt

SEQ ID NO: 6455122 - DNA, 19 bp, Homo sapiens
tcctagtgtttctttgtgg

SEQ ID NO: 6455123 - DNA, 13 bp, Homo sapiens
tcctagttctaga

SEQ ID NO: 6455124 - DNA, 15 bp, Homo sapiens
tcctagttctagaaa

SEQ ID NO: 6455125 - DNA, 17 bp, Homo sapiens
tcctagttctgtagaaa

SEQ ID NO: 6455126 - DNA, 17 bp, Homo sapiens
tcctagttcttaagcat

SEQ ID NO: 6455127 - DNA, 17 bp, Homo sapiens
tcctagtttcctctcct

SEQ ID NO: 6455128 - DNA, 21 bp, Homo sapiens
tcctagtttgacctcacagtg

SEQ ID NO: 6455129 - DNA, 23 bp, Homo sapiens
tcctagtttgacctcacagtgac

SEQ ID NO: 6455130 - DNA, 13 bp, Homo sapiens
tcctagtttttct

SEQ ID NO: 6455131 - DNA, 15 bp, Homo sapiens
tcctataaagaaacg

SEQ ID NO: 6455132 - DNA, 17 bp, Homo sapiens
tcctataaagtgcctcg

SEQ ID NO: 6455133 - DNA, 23 bp, Homo sapiens
tcctataacttcttcctgctgga

SEQ ID NO: 6455134 - DNA, 13 bp, Homo sapiens
tcctataacttga

SEQ ID NO: 6455135 - DNA, 14 bp, Homo sapiens
tcctataacttgat

SEQ ID NO: 6455136 - DNA, 18 bp, Homo sapiens
tcctataacttgatgcat

SEQ ID NO: 6455137 - DNA, 23 bp, Homo sapiens
tcctataagatctgtttttggac

SEQ ID NO: 6455138 - DNA, 20 bp, Homo sapiens
tcctataagcttaaatagga

SEQ ID NO: 6455139 - DNA, 17 bp, Homo sapiens
tcctataaggaagattt

SEQ ID NO: 6455140 - DNA, 21 bp, Homo sapiens
tcctataaggaagatttggaa

SEQ ID NO: 6455141 - DNA, 23 bp, Homo sapiens
tcctataattttgatagtgggac

SEQ ID NO: 6455142 - DNA, 17 bp, Homo sapiens
tcctatacatttctgtt

SEQ ID NO: 6455143 - DNA, 20 bp, Homo sapiens
tcctataccatttccgtaat

SEQ ID NO: 6455144 - DNA, 19 bp, Homo sapiens
tcctataccggagctccag

SEQ ID NO: 6455145 - DNA, 20 bp, Homo sapiens
tcctatagctacatgttctt

SEQ ID NO: 6455146 - DNA, 16 bp, Homo sapiens
tcctatagtcgtgggt

SEQ ID NO: 6455147 - DNA, 15 bp, Homo sapiens
tcctatagttttact

SEQ ID NO: 6455148 - DNA, 14 bp, Homo sapiens
tcctatatatttct

SEQ ID NO: 6455149 - DNA, 15 bp, Homo sapiens
tcctatatatttcta

SEQ ID NO: 6455150 - DNA, 17 bp, Homo sapiens
tcctatatatttctatt

SEQ ID NO: 6455151 - DNA, 18 bp, Homo sapiens
tcctatatcctccttctc

SEQ ID NO: 6455152 - DNA, 13 bp, Homo sapiens
tcctatatctgtt

SEQ ID NO: 6455153 - DNA, 13 bp, Homo sapiens
tcctatatgcact

SEQ ID NO: 6455154 - DNA, 21 bp, Homo sapiens
tcctatcaatccaaattccct

SEQ ID NO: 6455155 - DNA, 17 bp, Homo sapiens
tcctatcagaagtttct

SEQ ID NO: 6455156 - DNA, 15 bp, Homo sapiens
tcctatccactgggc

SEQ ID NO: 6455157 - DNA, 16 bp, Homo sapiens
tcctatcccatcccat

SEQ ID NO: 6455158 - DNA, 20 bp, Homo sapiens
tcctatccccaggccaggtc

SEQ ID NO: 6455159 - DNA, 22 bp, Homo sapiens
tcctatcccgtgagtggattgt

SEQ ID NO: 6455160 - DNA, 13 bp, Homo sapiens
tcctatccctgga

SEQ ID NO: 6455161 - DNA, 16 bp, Homo sapiens
tcctatcctaaataaa

SEQ ID NO: 6455162 - DNA, 14 bp, Homo sapiens
tcctatctccccca

SEQ ID NO: 6455163 - DNA, 18 bp, Homo sapiens
tcctatctcccccaaccc

SEQ ID NO: 6455164 - DNA, 18 bp, Homo sapiens
tcctatctgggcttcctg

SEQ ID NO: 6455165 - DNA, 20 bp, Homo sapiens
tcctatctgggcttcctgga

SEQ ID NO: 6455166 - DNA, 17 bp, Homo sapiens
tcctatctgtgttttga

SEQ ID NO: 6455167 - DNA, 18 bp, Homo sapiens
tcctatctttacatctat

SEQ ID NO: 6455168 - DNA, 14 bp, Homo sapiens
tcctatcttttatt

SEQ ID NO: 6455169 - DNA, 19 bp, Homo sapiens
tcctatgaagttggcacat

SEQ ID NO: 6455170 - DNA, 18 bp, Homo sapiens
tcctatgactcaaagatg

SEQ ID NO: 6455171 - DNA, 19 bp, Homo sapiens
tcctatgactcaaagatga

SEQ ID NO: 6455172 - DNA, 13 bp, Homo sapiens
tcctatgatggat

SEQ ID NO: 6455173 - DNA, 17 bp, Homo sapiens
tcctatgatggatggca

SEQ ID NO: 6455174 - DNA, 19 bp, Homo sapiens
tcctatgatggatggcaga

SEQ ID NO: 6455175 - DNA, 12 bp, Homo sapiens
tcctatgcaata

SEQ ID NO: 6455176 - DNA, 13 bp, Homo sapiens
tcctatgcaataa

SEQ ID NO: 6455177 - DNA, 13 bp, Homo sapiens
tcctatgcctcac

SEQ ID NO: 6455178 - DNA, 12 bp, Homo sapiens
tcctatgccttc

SEQ ID NO: 6455179 - DNA, 21 bp, Homo sapiens
tcctatgctattgacaataaa

SEQ ID NO: 6455180 - DNA, 21 bp, Homo sapiens
tcctatgctggggtacacagt

SEQ ID NO: 6455181 - DNA, 14 bp, Homo sapiens
tcctatgcttaata

SEQ ID NO: 6455182 - DNA, 13 bp, Homo sapiens
tcctatgctttag

SEQ ID NO: 6455183 - DNA, 14 bp, Homo sapiens
tcctatggaaacat

SEQ ID NO: 6455184 - DNA, 16 bp, Homo sapiens
tcctatggacaactta

SEQ ID NO: 6455185 - DNA, 20 bp, Homo sapiens
tcctatggagcctctgcaga

SEQ ID NO: 6455186 - DNA, 22 bp, Homo sapiens
tcctatggctggccactgcaca

SEQ ID NO: 6455187 - DNA, 16 bp, Homo sapiens
tcctatgtacagagct

SEQ ID NO: 6455188 - DNA, 22 bp, Homo sapiens
tcctatgtcaatttgtatatca

SEQ ID NO: 6455189 - DNA, 16 bp, Homo sapiens
tcctatgtcatttcta

SEQ ID NO: 6455190 - DNA, 22 bp, Homo sapiens
tcctatgtgattttaactctgt

SEQ ID NO: 6455191 - DNA, 17 bp, Homo sapiens
tcctatgtggcagctgg

SEQ ID NO: 6455192 - DNA, 18 bp, Homo sapiens
tcctatgtggcagctggg

SEQ ID NO: 6455193 - DNA, 12 bp, Homo sapiens
tcctatgtgtaa

SEQ ID NO: 6455194 - DNA, 18 bp, Homo sapiens
tcctattacttttcatct

SEQ ID NO: 6455195 - DNA, 12 bp, Homo sapiens
tcctattagtgt

SEQ ID NO: 6455196 - DNA, 19 bp, Homo sapiens
tcctattagtgttatatga

SEQ ID NO: 6455197 - DNA, 12 bp, Homo sapiens
tcctattatatt

SEQ ID NO: 6455198 - DNA, 23 bp, Homo sapiens
tcctattcagttcccagaatcaa

SEQ ID NO: 6455199 - DNA, 17 bp, Homo sapiens
tcctattccttcacaca

SEQ ID NO: 6455200 - DNA, 14 bp, Homo sapiens
tcctattccttggt

SEQ ID NO: 6455201 - DNA, 14 bp, Homo sapiens
tcctattctcctgc

SEQ ID NO: 6455202 - DNA, 16 bp, Homo sapiens
tcctattctcgggctg

SEQ ID NO: 6455203 - DNA, 20 bp, Homo sapiens
tcctattctgggcaaataga

SEQ ID NO: 6455204 - DNA, 16 bp, Homo sapiens
tcctattctgttgcca

SEQ ID NO: 6455205 - DNA, 22 bp, Homo sapiens
tcctattgaaagaccagatcct

SEQ ID NO: 6455206 - DNA, 17 bp, Homo sapiens
tcctattgtcattaaag

SEQ ID NO: 6455207 - DNA, 15 bp, Homo sapiens
tcctattgtgatttg

SEQ ID NO: 6455208 - DNA, 20 bp, Homo sapiens
tcctattgtgatttgactgt

SEQ ID NO: 6455209 - DNA, 14 bp, Homo sapiens
tcctatttagatgg

SEQ ID NO: 6455210 - DNA, 21 bp, Homo sapiens
tcctatttatgaaaaccatat

SEQ ID NO: 6455211 - DNA, 14 bp, Homo sapiens
tcctatttcagaag

SEQ ID NO: 6455212 - DNA, 16 bp, Homo sapiens
tcctatttcagaagtt

SEQ ID NO: 6455213 - DNA, 19 bp, Homo sapiens
tcctatttctggaatggaa

SEQ ID NO: 6455214 - DNA, 18 bp, Homo sapiens
tcctatttggggcttgca

SEQ ID NO: 6455215 - DNA, 14 bp, Homo sapiens
tcctatttgttttc

SEQ ID NO: 6455216 - DNA, 16 bp, Homo sapiens
tcctatttgttttcat

SEQ ID NO: 6455217 - DNA, 17 bp, Homo sapiens
tcctattttaaaaccat

SEQ ID NO: 6455218 - DNA, 18 bp, Homo sapiens
tcctattttgtaattttt

SEQ ID NO: 6455219 - DNA, 17 bp, Homo sapiens
tcctatttttaaacaaa

SEQ ID NO: 6455220 - DNA, 15 bp, Homo sapiens
tcctatttttgtgaa

SEQ ID NO: 6455221 - DNA, 18 bp, Homo sapiens
tgacttccttatttctga

SEQ ID NO: 6455222 - DNA, 20 bp, Homo sapiens
tgacttcgactgtgacctgt

SEQ ID NO: 6455223 - DNA, 17 bp, Homo sapiens
tgacttctaatatcatt

SEQ ID NO: 6455224 - DNA, 18 bp, Homo sapiens
tgacttctagctgtctgt

SEQ ID NO: 6455225 - DNA, 21 bp, Homo sapiens
tgacttctagctgtctgtgaa

SEQ ID NO: 6455226 - DNA, 16 bp, Homo sapiens
tgacttctatcctgtt

SEQ ID NO: 6455227 - DNA, 18 bp, Homo sapiens
tgacttctcaagtaacat

SEQ ID NO: 6455228 - DNA, 22 bp, Homo sapiens
tgacttctcccccgccctgccc

SEQ ID NO: 6455229 - DNA, 18 bp, Homo sapiens
tgacttctcccctgccct

SEQ ID NO: 6455230 - DNA, 19 bp, Homo sapiens
tgacttctgacaaaggtgg

SEQ ID NO: 6455231 - DNA, 13 bp, Homo sapiens
tgacttctgagca

SEQ ID NO: 6455232 - DNA, 19 bp, Homo sapiens
tgacttctgctaggtagag

SEQ ID NO: 6455233 - DNA, 17 bp, Homo sapiens
tgacttctgctgaagga

SEQ ID NO: 6455234 - DNA, 14 bp, Homo sapiens
tgacttctgctgct

SEQ ID NO: 6455235 - DNA, 17 bp, Homo sapiens
tgacttctgctgctggc

SEQ ID NO: 6455236 - DNA, 21 bp, Homo sapiens
tgacttctgctggcatcaaga

SEQ ID NO: 6455237 - DNA, 18 bp, Homo sapiens
tgacttcttccctaaaat

SEQ ID NO: 6455238 - DNA, 20 bp, Homo sapiens
tgacttcttccctaaaatgt

SEQ ID NO: 6455239 - DNA, 14 bp, Homo sapiens
tgacttcttcttct

SEQ ID NO: 6455240 - DNA, 16 bp, Homo sapiens
tgacttcttgcttcag

SEQ ID NO: 6455241 - DNA, 21 bp, Homo sapiens
tgacttcttgcttcagtcatc

SEQ ID NO: 6455242 - DNA, 12 bp, Homo sapiens
tgacttcttggt

SEQ ID NO: 6455243 - DNA, 19 bp, Homo sapiens
tgacttcttggtgctgttg

SEQ ID NO: 6455244 - DNA, 20 bp, Homo sapiens
tgacttcttggtttggggag

SEQ ID NO: 6455245 - DNA, 20 bp, Homo sapiens
tgacttctttactaacactg

SEQ ID NO: 6455246 - DNA, 23 bp, Homo sapiens
tgacttctttactaacactggct

SEQ ID NO: 6455247 - DNA, 15 bp, Homo sapiens
tgacttgaaaaatat

SEQ ID NO: 6455248 - DNA, 23 bp, Homo sapiens
tgacttgaaaaatattcatgtag

SEQ ID NO: 6455249 - DNA, 23 bp, Homo sapiens
tgacttgaaccacaagtgaatct

SEQ ID NO: 6455250 - DNA, 14 bp, Homo sapiens
tgacttgaatgtac

SEQ ID NO: 6455251 - DNA, 17 bp, Homo sapiens
tgacttgacagaacact

SEQ ID NO: 6455252 - DNA, 13 bp, Homo sapiens
tgacttgagccct

SEQ ID NO: 6455253 - DNA, 16 bp, Homo sapiens
tgacttgcaaagacct

SEQ ID NO: 6455254 - DNA, 20 bp, Homo sapiens
tgacttgcaatccaggctgt

SEQ ID NO: 6455255 - DNA, 24 bp, Homo sapiens
tgacttgcaatccaggctgttctc

SEQ ID NO: 6455256 - DNA, 18 bp, Homo sapiens
tgacttgcacatctctgc

SEQ ID NO: 6455257 - DNA, 18 bp, Homo sapiens
tgacttgcagatgaaaaa

SEQ ID NO: 6455258 - DNA, 16 bp, Homo sapiens
tgacttgcatgaagag

SEQ ID NO: 6455259 - DNA, 19 bp, Homo sapiens
tgacttgcatgaagagaag

SEQ ID NO: 6455260 - DNA, 13 bp, Homo sapiens
tgacttgccactg

SEQ ID NO: 6455261 - DNA, 17 bp, Homo sapiens
tgacttgccactgccat

SEQ ID NO: 6455262 - DNA, 16 bp, Homo sapiens
tgacttgctgtccagg

SEQ ID NO: 6455263 - DNA, 19 bp, Homo sapiens
tgacttgctgtccaggcag

SEQ ID NO: 6455264 - DNA, 12 bp, Homo sapiens
tgacttgcttta

SEQ ID NO: 6455265 - DNA, 15 bp, Homo sapiens
tgacttggagagaga

SEQ ID NO: 6455266 - DNA, 21 bp, Homo sapiens
tgacttggctggggaggacca

SEQ ID NO: 6455267 - DNA, 19 bp, Homo sapiens
tgacttgggcacccccagc

SEQ ID NO: 6455268 - DNA, 19 bp, Homo sapiens
tgacttggggacaccccag

SEQ ID NO: 6455269 - DNA, 12 bp, Homo sapiens
tgacttggggga

SEQ ID NO: 6455270 - DNA, 12 bp, Homo sapiens
tgacttgggttt

SEQ ID NO: 6455271 - DNA, 20 bp, Homo sapiens
tgacttgtacaaacagtatt

SEQ ID NO: 6455272 - DNA, 12 bp, Homo sapiens
tgacttgtataa

SEQ ID NO: 6455273 - DNA, 15 bp, Homo sapiens
tgacttgtataacat

SEQ ID NO: 6455274 - DNA, 19 bp, Homo sapiens
tgacttgtataacatcact

SEQ ID NO: 6455275 - DNA, 15 bp, Homo sapiens
tgacttgtctgcctc

SEQ ID NO: 6455276 - DNA, 19 bp, Homo sapiens
tgacttgtggttgaattaa

SEQ ID NO: 6455277 - DNA, 14 bp, Homo sapiens
tgacttgtttgtgc

SEQ ID NO: 6455278 - DNA, 22 bp, Homo sapiens
tgacttgtttgtgcatcctgtg

SEQ ID NO: 6455279 - DNA, 16 bp, Homo sapiens
tgactttaaaagaaaa

SEQ ID NO: 6455280 - DNA, 14 bp, Homo sapiens
tgactttaattgtg

SEQ ID NO: 6455281 - DNA, 20 bp, Homo sapiens
tgactttagaaagctgacat

SEQ ID NO: 6455282 - DNA, 18 bp, Homo sapiens
tgactttagatgggaagc

SEQ ID NO: 6455283 - DNA, 12 bp, Homo sapiens
tgactttataaa

SEQ ID NO: 6455284 - DNA, 17 bp, Homo sapiens
tgactttatctcctgct

SEQ ID NO: 6455285 - DNA, 16 bp, Homo sapiens
tgactttattatttat

SEQ ID NO: 6455286 - DNA, 17 bp, Homo sapiens
tgactttattatttatt

SEQ ID NO: 6455287 - DNA, 20 bp, Homo sapiens
tgactttattatttattttt

SEQ ID NO: 6455288 - DNA, 16 bp, Homo sapiens
tgactttatttttcta

SEQ ID NO: 6455289 - DNA, 21 bp, Homo sapiens
tgactttatttttctaagtgt

SEQ ID NO: 6455290 - DNA, 17 bp, Homo sapiens
tgactttcacatttgga

SEQ ID NO: 6455291 - DNA, 15 bp, Homo sapiens
tgactttcagattgt

SEQ ID NO: 6455292 - DNA, 14 bp, Homo sapiens
tgactttcagtaaa

SEQ ID NO: 6455293 - DNA, 14 bp, Homo sapiens
tgactttcatttgg

SEQ ID NO: 6455294 - DNA, 14 bp, Homo sapiens
tgactttccagaat

SEQ ID NO: 6455295 - DNA, 21 bp, Homo sapiens
tgactttccccaccagatgct

SEQ ID NO: 6455296 - DNA, 22 bp, Homo sapiens
tgactttccccaccagatgctg

SEQ ID NO: 6455297 - DNA, 13 bp, Homo sapiens
tgactttcctccc

SEQ ID NO: 6455298 - DNA, 13 bp, Homo sapiens
tgactttctcccc

SEQ ID NO: 6455299 - DNA, 23 bp, Homo sapiens
tgactttgaacacatctcttagt

SEQ ID NO: 6455300 - DNA, 16 bp, Homo sapiens
tgactttgaatttata

SEQ ID NO: 6455301 - DNA, 23 bp, Homo sapiens
tgactttgaatttatataaagta

SEQ ID NO: 6455302 - DNA, 14 bp, Homo sapiens
tgactttgcacctg

SEQ ID NO: 6455303 - DNA, 14 bp, Homo sapiens
tgactttgcccagg

SEQ ID NO: 6455304 - DNA, 20 bp, Homo sapiens
tgactttgcccccttgccca

SEQ ID NO: 6455305 - DNA, 21 bp, Homo sapiens
tgactttgcccccttgcccat

SEQ ID NO: 6455306 - DNA, 13 bp, Homo sapiens
tgactttgcttgc

SEQ ID NO: 6455307 - DNA, 17 bp, Homo sapiens
tgactttgcttgctttg

SEQ ID NO: 6455308 - DNA, 13 bp, Homo sapiens
tgactttggataa

SEQ ID NO: 6455309 - DNA, 14 bp, Homo sapiens
tgactttggataat

SEQ ID NO: 6455310 - DNA, 22 bp, Homo sapiens
tgactttggataataaggaaaa

SEQ ID NO: 6455311 - DNA, 19 bp, Homo sapiens
tgactttggggacaggggg

SEQ ID NO: 6455312 - DNA, 12 bp, Homo sapiens
tgactttgtata

SEQ ID NO: 6455313 - DNA, 21 bp, Homo sapiens
tgactttgtctctcctggctg

SEQ ID NO: 6455314 - DNA, 15 bp, Homo sapiens
tgacttttaaaattt

SEQ ID NO: 6455315 - DNA, 20 bp, Homo sapiens
tgacttttaaggctaaaact

SEQ ID NO: 6455316 - DNA, 14 bp, Homo sapiens
tgacttttacagct

SEQ ID NO: 6455317 - DNA, 17 bp, Homo sapiens
tgacttttacagctttt

SEQ ID NO: 6455318 - DNA, 21 bp, Homo sapiens
tgacttttacagcttttctct

SEQ ID NO: 6455319 - DNA, 17 bp, Homo sapiens
tgacttttataaagcat

SEQ ID NO: 6455320 - DNA, 22 bp, Homo sapiens
tgacttttatatgctttttctc

SEQ ID NO: 6455321 - DNA, 16 bp, Homo sapiens
tgacttttcaagtatt

SEQ ID NO: 6455322 - DNA, 22 bp, Homo sapiens
tgacttttccaaataaacattt

SEQ ID NO: 6455323 - DNA, 19 bp, Homo sapiens
tgacttttccatgtatcta

SEQ ID NO: 6455324 - DNA, 14 bp, Homo sapiens
tgacttttctgatt

SEQ ID NO: 6455325 - DNA, 19 bp, Homo sapiens
tgacttttctgattaatat

SEQ ID NO: 6455326 - DNA, 17 bp, Homo sapiens
tgacttttgaagaacaa

SEQ ID NO: 6455327 - DNA, 13 bp, Homo sapiens
tgacttttgcttt

SEQ ID NO: 6455328 - DNA, 16 bp, Homo sapiens
tgacttttgctttaat

SEQ ID NO: 6455329 - DNA, 17 bp, Homo sapiens
tgacttttgctttaatt

SEQ ID NO: 6455330 - DNA, 21 bp, Homo sapiens
tgacttttgctttaattccat

SEQ ID NO: 6455331 - DNA, 14 bp, Homo sapiens
tgactttttaaaaa

SEQ ID NO: 6455332 - DNA, 20 bp, Homo sapiens
tgactttttaaaaaatgctg

SEQ ID NO: 6455333 - DNA, 23 bp, Homo sapiens
tgactttttaaaaaatgctgggt

SEQ ID NO: 6455334 - DNA, 18 bp, Homo sapiens
tgactttttaaaatataa

SEQ ID NO: 6455335 - DNA, 13 bp, Homo sapiens
tgactttttataa

SEQ ID NO: 6455336 - DNA, 16 bp, Homo sapiens
tgactttttcagagtt

SEQ ID NO: 6455337 - DNA, 15 bp, Homo sapiens
tgactttttccattt

SEQ ID NO: 6455338 - DNA, 22 bp, Homo sapiens
tgactttttctgagcttttcat

SEQ ID NO: 6455339 - DNA, 14 bp, Homo sapiens
tgactttttggaat

SEQ ID NO: 6455340 - DNA, 23 bp, Homo sapiens
tgactttttggaattcagcagtt

SEQ ID NO: 6455341 - DNA, 15 bp, Homo sapiens
tgactttttttcact

SEQ ID NO: 6455342 - DNA, 18 bp, Homo sapiens
tgactttttttggtataa

SEQ ID NO: 6455343 - DNA, 17 bp, Homo sapiens
tgactttttttgtatgt

SEQ ID NO: 6455344 - DNA, 16 bp, Homo sapiens
tgagaaaaaagaccct

SEQ ID NO: 6455345 - DNA, 13 bp, Homo sapiens
tgagaaaaactaa

SEQ ID NO: 6455346 - DNA, 22 bp, Homo sapiens
tgagaaaaatagagcaaaatca

SEQ ID NO: 6455347 - DNA, 21 bp, Homo sapiens
tgagaaaaatttacatggcaa

SEQ ID NO: 6455348 - DNA, 24 bp, Homo sapiens
tgagaaaacctgacttaaggggct

SEQ ID NO: 6455349 - DNA, 14 bp, Homo sapiens
tgagaaaactgaga

SEQ ID NO: 6455350 - DNA, 12 bp, Homo sapiens
tgagaaaagagt

SEQ ID NO: 6455351 - DNA, 15 bp, Homo sapiens
tgagaaaaggggcat

SEQ ID NO: 6455352 - DNA, 15 bp, Homo sapiens
tgagaaaataaagct

SEQ ID NO: 6455353 - DNA, 13 bp, Homo sapiens
tgagaaaatataa

SEQ ID NO: 6455354 - DNA, 17 bp, Homo sapiens
tgagaaaatataataaa

SEQ ID NO: 6455355 - DNA, 17 bp, Homo sapiens
tgagaaaatgcaggaga

SEQ ID NO: 6455356 - DNA, 16 bp, Homo sapiens
tgagaaaattgaaata

SEQ ID NO: 6455357 - DNA, 23 bp, Homo sapiens
tgagaaacactatttgtgacttt

SEQ ID NO: 6455358 - DNA, 23 bp, Homo sapiens
tgagaaacagctcagccagtggg

SEQ ID NO: 6455359 - DNA, 12 bp, Homo sapiens
tgagaaacagtt

SEQ ID NO: 6455360 - DNA, 13 bp, Homo sapiens
tgagaaacagttc

SEQ ID NO: 6455361 - DNA, 18 bp, Homo sapiens
tgagaaacagttccattc

SEQ ID NO: 6455362 - DNA, 19 bp, Homo sapiens
tgagaaaccagccgaccgg

SEQ ID NO: 6455363 - DNA, 16 bp, Homo sapiens
tgagaaacctgtatct

SEQ ID NO: 6455364 - DNA, 17 bp, Homo sapiens
tgagaaacctgtatctt

SEQ ID NO: 6455365 - DNA, 23 bp, Homo sapiens
tgagaaaccttattgtacctctc

SEQ ID NO: 6455366 - DNA, 21 bp, Homo sapiens
tgagaaacgtccatctctctc

SEQ ID NO: 6455367 - DNA, 12 bp, Homo sapiens
tgagaaactcta

SEQ ID NO: 6455368 - DNA, 21 bp, Homo sapiens
tgagaaactggcaaagcagaa

SEQ ID NO: 6455369 - DNA, 19 bp, Homo sapiens
tgagaaacttaaatgttat

SEQ ID NO: 6455370 - DNA, 22 bp, Homo sapiens
tgagaaactttgatctctgctt

SEQ ID NO: 6455371 - DNA, 16 bp, Homo sapiens
tgagaaagaaaaggaa

SEQ ID NO: 6455372 - DNA, 16 bp, Homo sapiens
tgagaaagaatgagca

SEQ ID NO: 6455373 - DNA, 22 bp, Homo sapiens
tgagaaagacatctgaggaaaa

SEQ ID NO: 6455374 - DNA, 18 bp, Homo sapiens
tgagaaagactattcaaa

SEQ ID NO: 6455375 - DNA, 13 bp, Homo sapiens
tgagaaagagcac

SEQ ID NO: 6455376 - DNA, 14 bp, Homo sapiens
tgagaaagagcact

SEQ ID NO: 6455377 - DNA, 21 bp, Homo sapiens
tgagaaagagcacttaagaga

SEQ ID NO: 6455378 - DNA, 17 bp, Homo sapiens
tgagaaagaggcaggga

SEQ ID NO: 6455379 - DNA, 19 bp, Homo sapiens
tgagaaagatgttccagtg

SEQ ID NO: 6455380 - DNA, 17 bp, Homo sapiens
tgagaaagcccacctgg

SEQ ID NO: 6455381 - DNA, 20 bp, Homo sapiens
tgagaaagctaaaatggtgg

SEQ ID NO: 6455382 - DNA, 20 bp, Homo sapiens
tgagaaagcttttattcctt

SEQ ID NO: 6455383 - DNA, 21 bp, Homo sapiens
tgagaaagcttttattccttt

SEQ ID NO: 6455384 - DNA, 20 bp, Homo sapiens
tgagaaaggacagagccagc

SEQ ID NO: 6455385 - DNA, 16 bp, Homo sapiens
tgagaaagggagagga

SEQ ID NO: 6455386 - DNA, 21 bp, Homo sapiens
tgagaaagggagaggaagaga

SEQ ID NO: 6455387 - DNA, 13 bp, Homo sapiens
tgagaaagggcat

SEQ ID NO: 6455388 - DNA, 17 bp, Homo sapiens
tgagaaagggcatacat

SEQ ID NO: 6455389 - DNA, 19 bp, Homo sapiens
tgagaaagggtagaattct

SEQ ID NO: 6455390 - DNA, 15 bp, Homo sapiens
tgagaaaggtgagga

SEQ ID NO: 6455391 - DNA, 22 bp, Homo sapiens
tgagaaagtacagcagtagact

SEQ ID NO: 6455392 - DNA, 15 bp, Homo sapiens
tgagaaagtcacaga

SEQ ID NO: 6455393 - DNA, 20 bp, Homo sapiens
tgagaaagtcagattcttgc

SEQ ID NO: 6455394 - DNA, 18 bp, Homo sapiens
tgagaaatacagtgcttt

SEQ ID NO: 6455395 - DNA, 14 bp, Homo sapiens
tgagaaatactata

SEQ ID NO: 6455396 - DNA, 20 bp, Homo sapiens
tgagaaatactatatataca

SEQ ID NO: 6455397 - DNA, 19 bp, Homo sapiens
tgagaaataggtatcaaaa

SEQ ID NO: 6455398 - DNA, 22 bp, Homo sapiens
tgagaaatagtgcactccaaga

SEQ ID NO: 6455399 - DNA, 16 bp, Homo sapiens
tcctcaaaaagcagaa

SEQ ID NO: 6455400 - DNA, 15 bp, Homo sapiens
tcctcaaaaatcatc

SEQ ID NO: 6455401 - DNA, 17 bp, Homo sapiens
tcctcaaaaatcatcaa

SEQ ID NO: 6455402 - DNA, 18 bp, Homo sapiens
tcctcaaaaatcatcaaa

SEQ ID NO: 6455403 - DNA, 24 bp, Homo sapiens
tcctcaaaacaggcctgagcgatg

SEQ ID NO: 6455404 - DNA, 22 bp, Homo sapiens
tcctcaaaagaaagagaaatga

SEQ ID NO: 6455405 - DNA, 18 bp, Homo sapiens
tcctcaaaataaggggca

SEQ ID NO: 6455406 - DNA, 17 bp, Homo sapiens
tcctcaaaatgggagat

SEQ ID NO: 6455407 - DNA, 15 bp, Homo sapiens
tcctcaaacacacaa

SEQ ID NO: 6455408 - DNA, 15 bp, Homo sapiens
tcctcaaacactgca

SEQ ID NO: 6455409 - DNA, 20 bp, Homo sapiens
tcctcaaaccacttgcctgg

SEQ ID NO: 6455410 - DNA, 21 bp, Homo sapiens
tcctcaaaccacttgcctggg

SEQ ID NO: 6455411 - DNA, 20 bp, Homo sapiens
tcctcaaacgacagaggagc

SEQ ID NO: 6455412 - DNA, 19 bp, Homo sapiens
tcctcaaagaaagtgtatt

SEQ ID NO: 6455413 - DNA, 20 bp, Homo sapiens
tcctcaaagcacctgaacca

SEQ ID NO: 6455414 - DNA, 14 bp, Homo sapiens
tcctcaaagcctca

SEQ ID NO: 6455415 - DNA, 13 bp, Homo sapiens
tcctcaaatacat

SEQ ID NO: 6455416 - DNA, 16 bp, Homo sapiens
tcctcaaatacatgca

SEQ ID NO: 6455417 - DNA, 22 bp, Homo sapiens
tcctcaaatacatgcacagtca

SEQ ID NO: 6455418 - DNA, 23 bp, Homo sapiens
tcctcaaatacatgcacagtcat

SEQ ID NO: 6455419 - DNA, 21 bp, Homo sapiens
tcctcaaatcagtgataattg

SEQ ID NO: 6455420 - DNA, 14 bp, Homo sapiens
tcctcaacactatt

SEQ ID NO: 6455421 - DNA, 23 bp, Homo sapiens
tcctcaactcacctaatgtttat

SEQ ID NO: 6455422 - DNA, 20 bp, Homo sapiens
tcctcaagaagaaagtgttc

SEQ ID NO: 6455423 - DNA, 17 bp, Homo sapiens
tcctcaagcttctcaga

SEQ ID NO: 6455424 - DNA, 18 bp, Homo sapiens
tcctcaaggcccagccat

SEQ ID NO: 6455425 - DNA, 19 bp, Homo sapiens
tcctcaagggcagagaact

SEQ ID NO: 6455426 - DNA, 14 bp, Homo sapiens
tcctcaagttatca

SEQ ID NO: 6455427 - DNA, 22 bp, Homo sapiens
tcctcaatgggctttcccccaa

SEQ ID NO: 6455428 - DNA, 18 bp, Homo sapiens
tcctcaattatcttggaa

SEQ ID NO: 6455429 - DNA, 20 bp, Homo sapiens
tcctcaattccaacactgat

SEQ ID NO: 6455430 - DNA, 14 bp, Homo sapiens
tcctcacacacgga

SEQ ID NO: 6455431 - DNA, 17 bp, Homo sapiens
tcctcacacacggaggc

SEQ ID NO: 6455432 - DNA, 18 bp, Homo sapiens
tcctcacacccacctgct

SEQ ID NO: 6455433 - DNA, 21 bp, Homo sapiens
tcctcacacccacctgctgct

SEQ ID NO: 6455434 - DNA, 17 bp, Homo sapiens
tcctcacacccctgtcc

SEQ ID NO: 6455435 - DNA, 15 bp, Homo sapiens
tcctcacactccaga

SEQ ID NO: 6455436 - DNA, 17 bp, Homo sapiens
tcctcacactgctgtcc

SEQ ID NO: 6455437 - DNA, 19 bp, Homo sapiens
tcctcacactgctgtcctc

SEQ ID NO: 6455438 - DNA, 16 bp, Homo sapiens
tcctcacacttactgt

SEQ ID NO: 6455439 - DNA, 22 bp, Homo sapiens
tcctcacacttttggaaccatg

SEQ ID NO: 6455440 - DNA, 14 bp, Homo sapiens
tcctcacagcagtc

SEQ ID NO: 6455441 - DNA, 20 bp, Homo sapiens
tcctcacagcagtcacaggc

SEQ ID NO: 6455442 - DNA, 14 bp, Homo sapiens
tcctcacagcctag

SEQ ID NO: 6455443 - DNA, 18 bp, Homo sapiens
tcctcacagcctctccct

SEQ ID NO: 6455444 - DNA, 19 bp, Homo sapiens
tcctcacagcctctccctt

SEQ ID NO: 6455445 - DNA, 20 bp, Homo sapiens
tcctcacaggagcagacaga

SEQ ID NO: 6455446 - DNA, 15 bp, Homo sapiens
tcctcacatgcagag

SEQ ID NO: 6455447 - DNA, 14 bp, Homo sapiens
tcctcacatgcccg

SEQ ID NO: 6455448 - DNA, 23 bp, Homo sapiens
tcctcacatgcccgctgtcccag

SEQ ID NO: 6455449 - DNA, 17 bp, Homo sapiens
tcctcaccatcatcatc

SEQ ID NO: 6455450 - DNA, 16 bp, Homo sapiens
tcctcacccacctctg

SEQ ID NO: 6455451 - DNA, 13 bp, Homo sapiens
tcctcacccagat

SEQ ID NO: 6455452 - DNA, 13 bp, Homo sapiens
tcctcacccccag

SEQ ID NO: 6455453 - DNA, 20 bp, Homo sapiens
tcctcaccccgtctggggtt

SEQ ID NO: 6455454 - DNA, 23 bp, Homo sapiens
tcctcacccctcgccacctttca

SEQ ID NO: 6455455 - DNA, 14 bp, Homo sapiens
tcctcacccctgtc

SEQ ID NO: 6455456 - DNA, 20 bp, Homo sapiens
tcctcacccctgtcctcact

SEQ ID NO: 6455457 - DNA, 14 bp, Homo sapiens
tcctcacccttccc

SEQ ID NO: 6455458 - DNA, 21 bp, Homo sapiens
tcctcacctcatgcccacccc

SEQ ID NO: 6455459 - DNA, 21 bp, Homo sapiens
tcctcacctctggactggcta

SEQ ID NO: 6455460 - DNA, 15 bp, Homo sapiens
tcctcaccttttccc

SEQ ID NO: 6455461 - DNA, 22 bp, Homo sapiens
tcctcacgcccttcaatgctgc

SEQ ID NO: 6455462 - DNA, 17 bp, Homo sapiens
tcctcacgccttggcct

SEQ ID NO: 6455463 - DNA, 15 bp, Homo sapiens
tcctcacgtccatca

SEQ ID NO: 6455464 - DNA, 16 bp, Homo sapiens
tcctcacgtgcaggac

SEQ ID NO: 6455465 - DNA, 18 bp, Homo sapiens
tcctcacgtgcaggacag

SEQ ID NO: 6455466 - DNA, 23 bp, Homo sapiens
tcctcactagtgtaaacaaaaat

SEQ ID NO: 6455467 - DNA, 13 bp, Homo sapiens
tcctcactcccag

SEQ ID NO: 6455468 - DNA, 14 bp, Homo sapiens
tcctcactcccagt

SEQ ID NO: 6455469 - DNA, 17 bp, Homo sapiens
tcctcactcccagtcca

SEQ ID NO: 6455470 - DNA, 23 bp, Homo sapiens
tcctcactccctaggcccaagtc

SEQ ID NO: 6455471 - DNA, 14 bp, Homo sapiens
tcctcactctgtcc

SEQ ID NO: 6455472 - DNA, 19 bp, Homo sapiens
tcctcactctgtccctgtc

SEQ ID NO: 6455473 - DNA, 22 bp, Homo sapiens
tcctcactctgtccctgtcctt

SEQ ID NO: 6455474 - DNA, 20 bp, Homo sapiens
tcctcactgagaaggcccca

SEQ ID NO: 6455475 - DNA, 21 bp, Homo sapiens
tcctcactgagaaggccccag

SEQ ID NO: 6455476 - DNA, 16 bp, Homo sapiens
tcctcactgccccacc

SEQ ID NO: 6455477 - DNA, 19 bp, Homo sapiens
tcctcactgccctccccag

SEQ ID NO: 6455478 - DNA, 15 bp, Homo sapiens
tcctcactgctccct

SEQ ID NO: 6455479 - DNA, 21 bp, Homo sapiens
tcctcactgctccctgaagcc

SEQ ID NO: 6455480 - DNA, 23 bp, Homo sapiens
tcctcactgctccctgaagccag

SEQ ID NO: 6455481 - DNA, 17 bp, Homo sapiens
tcctcactggccatccc

SEQ ID NO: 6455482 - DNA, 13 bp, Homo sapiens
tcctcactgggct

SEQ ID NO: 6455483 - DNA, 17 bp, Homo sapiens
tcctcactgggctcact

SEQ ID NO: 6455484 - DNA, 15 bp, Homo sapiens
tcctcactggtctac

SEQ ID NO: 6455485 - DNA, 18 bp, Homo sapiens
tcctcactggtctacact

SEQ ID NO: 6455486 - DNA, 12 bp, Homo sapiens
tcctcacttctg

SEQ ID NO: 6455487 - DNA, 18 bp, Homo sapiens
tcctcacttctgtctcct

SEQ ID NO: 6455488 - DNA, 18 bp, Homo sapiens
tcctcacttggctgtctg

SEQ ID NO: 6455489 - DNA, 15 bp, Homo sapiens
tcctcacttggggga

SEQ ID NO: 6455490 - DNA, 20 bp, Homo sapiens
tcctcagaaagtgcagcatg

SEQ ID NO: 6455491 - DNA, 14 bp, Homo sapiens
tcctcagaaagtgt

SEQ ID NO: 6455492 - DNA, 11 bp, Homo sapiens
tcctcagactg

SEQ ID NO: 6455493 - DNA, 20 bp, Homo sapiens
tcctcagagaatttctacca

SEQ ID NO: 6455494 - DNA, 18 bp, Homo sapiens
tcctcagagcgccaggaa

SEQ ID NO: 6455495 - DNA, 23 bp, Homo sapiens
tcctcagagcgccaggaagccag

SEQ ID NO: 6455496 - DNA, 16 bp, Homo sapiens
tcctcagagctccatg

SEQ ID NO: 6455497 - DNA, 16 bp, Homo sapiens
tcctcagaggacagtt

SEQ ID NO: 6455498 - DNA, 21 bp, Homo sapiens
tcctcagaggctgagccctgt

SEQ ID NO: 6455499 - DNA, 16 bp, Homo sapiens
tcctcagagtcccggc

SEQ ID NO: 6455500 - DNA, 21 bp, Homo sapiens
tcctcagagtcccggcgttta

SEQ ID NO: 6455501 - DNA, 22 bp, Homo sapiens
tcctcagatccccagctttctc

SEQ ID NO: 6455502 - DNA, 15 bp, Homo sapiens
tcctcagatggggca

SEQ ID NO: 6455503 - DNA, 18 bp, Homo sapiens
tcctcagatggggcacca

SEQ ID NO: 6455504 - DNA, 12 bp, Homo sapiens
tcctcagcaccc

SEQ ID NO: 6455505 - DNA, 19 bp, Homo sapiens
tcctcagcaccccactcct

SEQ ID NO: 6455506 - DNA, 13 bp, Homo sapiens
tcctcagccagcc

SEQ ID NO: 6455507 - DNA, 14 bp, Homo sapiens
tcctcagccagcct

SEQ ID NO: 6455508 - DNA, 15 bp, Homo sapiens
tcctcagccagcctc

SEQ ID NO: 6455509 - DNA, 16 bp, Homo sapiens
tcctcagccagcctcg

SEQ ID NO: 6455510 - DNA, 21 bp, Homo sapiens
tcctcagccatgggaacctca

SEQ ID NO: 6455511 - DNA, 11 bp, Homo sapiens
tcctcagcccc

SEQ ID NO: 6455512 - DNA, 12 bp, Homo sapiens
tcctcagcccca

SEQ ID NO: 6455513 - DNA, 12 bp, Homo sapiens
tcctcagccccc

SEQ ID NO: 6455514 - DNA, 19 bp, Homo sapiens
tcctcagcccccaggccag

SEQ ID NO: 6455515 - DNA, 12 bp, Homo sapiens
tcctcagccctc

SEQ ID NO: 6455516 - DNA, 14 bp, Homo sapiens
tcctcagccctctc

SEQ ID NO: 6455517 - DNA, 18 bp, Homo sapiens
tcctcagccctctcttgc

SEQ ID NO: 6455518 - DNA, 18 bp, Homo sapiens
tcctcagccgagaaattg

SEQ ID NO: 6455519 - DNA, 19 bp, Homo sapiens
tcctcagcctccctttgcc

SEQ ID NO: 6455520 - DNA, 16 bp, Homo sapiens
tcctcagcctggggtt

SEQ ID NO: 6455521 - DNA, 18 bp, Homo sapiens
tcctcagccttgccagag

SEQ ID NO: 6455522 - DNA, 18 bp, Homo sapiens
tcctcagcgagaggcagc

SEQ ID NO: 6455523 - DNA, 12 bp, Homo sapiens
tcctcagctgcc

SEQ ID NO: 6455524 - DNA, 20 bp, Homo sapiens
tcctcagctgccaagcactc

SEQ ID NO: 6455525 - DNA, 19 bp, Homo sapiens
tcctcagctgcctcctgcg

SEQ ID NO: 6455526 - DNA, 12 bp, Homo sapiens
tcctcagctggt

SEQ ID NO: 6455527 - DNA, 22 bp, Homo sapiens
tcctcagctggttactcagggt

SEQ ID NO: 6455528 - DNA, 22 bp, Homo sapiens
tcctcagcttcttcacaggcac

SEQ ID NO: 6455529 - DNA, 15 bp, Homo sapiens
tcctcagcttgggct

SEQ ID NO: 6455530 - DNA, 16 bp, Homo sapiens
tcctcagctttgcttc

SEQ ID NO: 6455531 - DNA, 18 bp, Homo sapiens
tcctcagctttgcttcat

SEQ ID NO: 6455532 - DNA, 16 bp, Homo sapiens
tcctcaggaacagaac

SEQ ID NO: 6455533 - DNA, 16 bp, Homo sapiens
tcctcaggaaggacat

SEQ ID NO: 6455534 - DNA, 22 bp, Homo sapiens
tcctcaggagccgaagcccagg

SEQ ID NO: 6455535 - DNA, 19 bp, Homo sapiens
tcctcaggcagtggcccag

SEQ ID NO: 6455536 - DNA, 22 bp, Homo sapiens
tcctcaggcagtggcccaggga

SEQ ID NO: 6455537 - DNA, 21 bp, Homo sapiens
tcctcaggcccagctgctccc

SEQ ID NO: 6455538 - DNA, 22 bp, Homo sapiens
tcctcaggcccagctgctcccc

SEQ ID NO: 6455539 - DNA, 12 bp, Homo sapiens
tcctcagggcag

SEQ ID NO: 6455540 - DNA, 23 bp, Homo sapiens
tcctcagggggtaggagagcact

SEQ ID NO: 6455541 - DNA, 14 bp, Homo sapiens
tcctcaggggtgga

SEQ ID NO: 6455542 - DNA, 21 bp, Homo sapiens
tcctcaggggtggagaagtgt

SEQ ID NO: 6455543 - DNA, 20 bp, Homo sapiens
tcctcagggtccctcaggac

SEQ ID NO: 6455544 - DNA, 16 bp, Homo sapiens
tcctcagggtgggggg

SEQ ID NO: 6455545 - DNA, 17 bp, Homo sapiens
tcctcaggtagtactgg

SEQ ID NO: 6455546 - DNA, 14 bp, Homo sapiens
tcctcaggtcagct

SEQ ID NO: 6455547 - DNA, 20 bp, Homo sapiens
tcctcaggtcagctgggagc

SEQ ID NO: 6455548 - DNA, 21 bp, Homo sapiens
tcctcaggtcagctgggagcc

SEQ ID NO: 6455549 - DNA, 22 bp, Homo sapiens
tcctcaggtggccagcctggat

SEQ ID NO: 6455550 - DNA, 22 bp, Homo sapiens
tcctcagtaaaagtcttctccc

SEQ ID NO: 6455551 - DNA, 21 bp, Homo sapiens
tcctcagtaacatttctgttc

SEQ ID NO: 6455552 - DNA, 22 bp, Homo sapiens
tcctcagtaacatttctgttct

SEQ ID NO: 6455553 - DNA, 23 bp, Homo sapiens
tcctcagtccatttatatatgaa

SEQ ID NO: 6455554 - DNA, 15 bp, Homo sapiens
tcctcagtccctctt

SEQ ID NO: 6455555 - DNA, 15 bp, Homo sapiens
tcctcagtcctggaa

SEQ ID NO: 6455556 - DNA, 18 bp, Homo sapiens
tcctcagtggcttctcca

SEQ ID NO: 6455557 - DNA, 20 bp, Homo sapiens
tcctcagtggcttctccagg

SEQ ID NO: 6455558 - DNA, 23 bp, Homo sapiens
tcctcagtgtaccactacttaga

SEQ ID NO: 6455559 - DNA, 16 bp, Homo sapiens
tcctcagttggaatca

SEQ ID NO: 6455560 - DNA, 16 bp, Homo sapiens
tcctcagtttacatct

SEQ ID NO: 6455561 - DNA, 16 bp, Homo sapiens
tcctcataaaaagcaa

SEQ ID NO: 6455562 - DNA, 18 bp, Homo sapiens
tcctcatacccaccccca

SEQ ID NO: 6455563 - DNA, 22 bp, Homo sapiens
tcctcatacccacccccaccca

SEQ ID NO: 6455564 - DNA, 23 bp, Homo sapiens
tcctcatacccacccccacccaa

SEQ ID NO: 6455565 - DNA, 21 bp, Homo sapiens
tcctcatatggcccagtgtca

SEQ ID NO: 6455566 - DNA, 22 bp, Homo sapiens
tcctcatcagtagatggtacga

SEQ ID NO: 6455567 - DNA, 21 bp, Homo sapiens
tcctcatcagtgtgtaaataa

SEQ ID NO: 6455568 - DNA, 15 bp, Homo sapiens
tcctcatccacccca

SEQ ID NO: 6455569 - DNA, 17 bp, Homo sapiens
tcctcatccaccccatc

SEQ ID NO: 6455570 - DNA, 15 bp, Homo sapiens
tcctcatccatttct

SEQ ID NO: 6455571 - DNA, 17 bp, Homo sapiens
tcctcatccatttcttt

SEQ ID NO: 6455572 - DNA, 23 bp, Homo sapiens
tcctcatcccctcgtcctgtccc

SEQ ID NO: 6455573 - DNA, 14 bp, Homo sapiens
tcctcatcccgtgt

SEQ ID NO: 6455574 - DNA, 16 bp, Homo sapiens
tcctcatcctgcttct

SEQ ID NO: 6455575 - DNA, 15 bp, Homo sapiens
tcctcatcctttcct

SEQ ID NO: 6455576 - DNA, 22 bp, Homo sapiens
tgagaaatcacaatgagaaaaa

SEQ ID NO: 6455577 - DNA, 20 bp, Homo sapiens
tgagaaatcatgttgttcga

SEQ ID NO: 6455578 - DNA, 23 bp, Homo sapiens
tgagaaatgtaatgcgattttat

SEQ ID NO: 6455579 - DNA, 14 bp, Homo sapiens
tgagaaatgttaaa

SEQ ID NO: 6455580 - DNA, 13 bp, Homo sapiens
tgagaaattaagt

SEQ ID NO: 6455581 - DNA, 20 bp, Homo sapiens
tgagaaattacaggttcctt

SEQ ID NO: 6455582 - DNA, 13 bp, Homo sapiens
tgagaaattgaat

SEQ ID NO: 6455583 - DNA, 18 bp, Homo sapiens
tgagaaattgtgccaaag

SEQ ID NO: 6455584 - DNA, 13 bp, Homo sapiens
tgagaaatttaaa

SEQ ID NO: 6455585 - DNA, 17 bp, Homo sapiens
tgagaaatttaaactat

SEQ ID NO: 6455586 - DNA, 17 bp, Homo sapiens
tgagaaatttataaact

SEQ ID NO: 6455587 - DNA, 16 bp, Homo sapiens
tgagaaatttctgtga

SEQ ID NO: 6455588 - DNA, 19 bp, Homo sapiens
tgagaaatttctgtgaaac

SEQ ID NO: 6455589 - DNA, 22 bp, Homo sapiens
tgagaaatttgtggttgcatgt

SEQ ID NO: 6455590 - DNA, 19 bp, Homo sapiens
tgagaaatttttttccaga

SEQ ID NO: 6455591 - DNA, 19 bp, Homo sapiens
tgagaacaaagctgttaaa

SEQ ID NO: 6455592 - DNA, 23 bp, Homo sapiens
tgagaacaaagctgttaaactgt

SEQ ID NO: 6455593 - DNA, 18 bp, Homo sapiens
tgagaacaagtcacagct

SEQ ID NO: 6455594 - DNA, 19 bp, Homo sapiens
tgagaacacgttgccaggg

SEQ ID NO: 6455595 - DNA, 19 bp, Homo sapiens
tgagaaccaaaagatgcct

SEQ ID NO: 6455596 - DNA, 15 bp, Homo sapiens
tgagaacctggcctt

SEQ ID NO: 6455597 - DNA, 17 bp, Homo sapiens
tgagaactcagaagaga

SEQ ID NO: 6455598 - DNA, 19 bp, Homo sapiens
tgagaactcagaagagaaa

SEQ ID NO: 6455599 - DNA, 21 bp, Homo sapiens
tgagaactcagaagagaaata

SEQ ID NO: 6455600 - DNA, 13 bp, Homo sapiens
tgagaactcctga

SEQ ID NO: 6455601 - DNA, 13 bp, Homo sapiens
tgagaactgactt

SEQ ID NO: 6455602 - DNA, 17 bp, Homo sapiens
tgagaactggttcttgc

SEQ ID NO: 6455603 - DNA, 13 bp, Homo sapiens
tgagaactgtgaa

SEQ ID NO: 6455604 - DNA, 16 bp, Homo sapiens
tgagaactgtgaatat

SEQ ID NO: 6455605 - DNA, 20 bp, Homo sapiens
tgagaactgtgaatatgtgt

SEQ ID NO: 6455606 - DNA, 22 bp, Homo sapiens
tgagaactgtgaatatgtgtaa

SEQ ID NO: 6455607 - DNA, 15 bp, Homo sapiens
tgagaacttccaaca

SEQ ID NO: 6455608 - DNA, 17 bp, Homo sapiens
tgagaactttatttcca

SEQ ID NO: 6455609 - DNA, 15 bp, Homo sapiens
tgagaacttttcata

SEQ ID NO: 6455610 - DNA, 22 bp, Homo sapiens
tgagaagaaaatggaaccaggc

SEQ ID NO: 6455611 - DNA, 21 bp, Homo sapiens
tgagaagaagcacgaagcagt

SEQ ID NO: 6455612 - DNA, 17 bp, Homo sapiens
tgagaagaagtggctgc

SEQ ID NO: 6455613 - DNA, 21 bp, Homo sapiens
tgagaagaatattgttcctaa

SEQ ID NO: 6455614 - DNA, 10 bp, Homo sapiens
tgagaagact

SEQ ID NO: 6455615 - DNA, 17 bp, Homo sapiens
tgagaagactagcagct

SEQ ID NO: 6455616 - DNA, 19 bp, Homo sapiens
tgagaagagcttgcacagc

SEQ ID NO: 6455617 - DNA, 22 bp, Homo sapiens
tgagaagagcttgcacagccaa

SEQ ID NO: 6455618 - DNA, 16 bp, Homo sapiens
tgagaagaggaggagg

SEQ ID NO: 6455619 - DNA, 16 bp, Homo sapiens
tgagaagagggcctgt

SEQ ID NO: 6455620 - DNA, 18 bp, Homo sapiens
tgagaagagttttctcag

SEQ ID NO: 6455621 - DNA, 16 bp, Homo sapiens
tgagaagataatcatt

SEQ ID NO: 6455622 - DNA, 22 bp, Homo sapiens
tgagaagatcattggagtttag

SEQ ID NO: 6455623 - DNA, 20 bp, Homo sapiens
tgagaagatggcactgtcca

SEQ ID NO: 6455624 - DNA, 15 bp, Homo sapiens
tgagaagatgggggc

SEQ ID NO: 6455625 - DNA, 19 bp, Homo sapiens
tgagaagatgggggctgga

SEQ ID NO: 6455626 - DNA, 19 bp, Homo sapiens
tgagaagcagtataagcct

SEQ ID NO: 6455627 - DNA, 13 bp, Homo sapiens
tgagaagccaagc

SEQ ID NO: 6455628 - DNA, 17 bp, Homo sapiens
tgagaagccaagcctgg

SEQ ID NO: 6455629 - DNA, 17 bp, Homo sapiens
tgagaagccgtgggtgg

SEQ ID NO: 6455630 - DNA, 19 bp, Homo sapiens
tgagaagcgctgccctgtg

SEQ ID NO: 6455631 - DNA, 20 bp, Homo sapiens
tgagaagcgctgccctgtga

SEQ ID NO: 6455632 - DNA, 21 bp, Homo sapiens
tgagaagcgctgccctgtgag

SEQ ID NO: 6455633 - DNA, 17 bp, Homo sapiens
tgagaagcgtttttaac

SEQ ID NO: 6455634 - DNA, 14 bp, Homo sapiens
tgagaagctgaggc

SEQ ID NO: 6455635 - DNA, 16 bp, Homo sapiens
tgagaagctgaggcct

SEQ ID NO: 6455636 - DNA, 17 bp, Homo sapiens
tgagaagctgctcaact

SEQ ID NO: 6455637 - DNA, 20 bp, Homo sapiens
tgagaagctgctccaggcct

SEQ ID NO: 6455638 - DNA, 19 bp, Homo sapiens
tgagaagcttttgaataaa

SEQ ID NO: 6455639 - DNA, 13 bp, Homo sapiens
tgagaaggaacag

SEQ ID NO: 6455640 - DNA, 15 bp, Homo sapiens
tgagaaggcaggcct

SEQ ID NO: 6455641 - DNA, 16 bp, Homo sapiens
tgagaaggcgaggaga

SEQ ID NO: 6455642 - DNA, 17 bp, Homo sapiens
tgagaaggcgaggagag

SEQ ID NO: 6455643 - DNA, 17 bp, Homo sapiens
tgagaagggcctgctct

SEQ ID NO: 6455644 - DNA, 19 bp, Homo sapiens
tgagaagggctcagagagg

SEQ ID NO: 6455645 - DNA, 16 bp, Homo sapiens
tgagaaggtccttaat

SEQ ID NO: 6455646 - DNA, 14 bp, Homo sapiens
tgagaaggtgcctg

SEQ ID NO: 6455647 - DNA, 16 bp, Homo sapiens
tgagaaggtgcctgcc

SEQ ID NO: 6455648 - DNA, 19 bp, Homo sapiens
tgagaaggtgttggacagg

SEQ ID NO: 6455649 - DNA, 19 bp, Homo sapiens
tgagaaggttactgagtga

SEQ ID NO: 6455650 - DNA, 16 bp, Homo sapiens
tgagaaggtttattgt

SEQ ID NO: 6455651 - DNA, 19 bp, Homo sapiens
tgagaaggtttattgttaa

SEQ ID NO: 6455652 - DNA, 13 bp, Homo sapiens
tgagaagtacttg

SEQ ID NO: 6455653 - DNA, 19 bp, Homo sapiens
tgagaagtactttgtgctg

SEQ ID NO: 6455654 - DNA, 20 bp, Homo sapiens
tgagaagtactttgtgctga

SEQ ID NO: 6455655 - DNA, 16 bp, Homo sapiens
tgagaagtagccacag

SEQ ID NO: 6455656 - DNA, 19 bp, Homo sapiens
tgagaagtctaattcacag

SEQ ID NO: 6455657 - DNA, 16 bp, Homo sapiens
tgagaagtgccttctc

SEQ ID NO: 6455658 - DNA, 22 bp, Homo sapiens
tgagaagtgcttaacgttttct

SEQ ID NO: 6455659 - DNA, 16 bp, Homo sapiens
tgagaagttctcagaa

SEQ ID NO: 6455660 - DNA, 24 bp, Homo sapiens
tgagaagttttgtacagagaatta

SEQ ID NO: 6455661 - DNA, 19 bp, Homo sapiens
tgagaataattatttcaga

SEQ ID NO: 6455662 - DNA, 16 bp, Homo sapiens
tgagaataattgtgta

SEQ ID NO: 6455663 - DNA, 15 bp, Homo sapiens
tgagaatagaaattt

SEQ ID NO: 6455664 - DNA, 22 bp, Homo sapiens
tgagaatagaaatttgcccctg

SEQ ID NO: 6455665 - DNA, 15 bp, Homo sapiens
tgagaatagaaggaa

SEQ ID NO: 6455666 - DNA, 16 bp, Homo sapiens
tgagaatagaaggaaa

SEQ ID NO: 6455667 - DNA, 22 bp, Homo sapiens
tgagaatagaaggaaactagct

SEQ ID NO: 6455668 - DNA, 15 bp, Homo sapiens
tgagaatagtgtctg

SEQ ID NO: 6455669 - DNA, 19 bp, Homo sapiens
tgagaatataccttattta

SEQ ID NO: 6455670 - DNA, 20 bp, Homo sapiens
tgagaatatagacagtgccc

SEQ ID NO: 6455671 - DNA, 16 bp, Homo sapiens
tgagaatcacggtggt

SEQ ID NO: 6455672 - DNA, 18 bp, Homo sapiens
tgagaatcaggttgcaaa

SEQ ID NO: 6455673 - DNA, 19 bp, Homo sapiens
tgagaatccagtttctttc

SEQ ID NO: 6455674 - DNA, 20 bp, Homo sapiens
tgagaatccagtttctttcc

SEQ ID NO: 6455675 - DNA, 13 bp, Homo sapiens
tgagaatcccaaa

SEQ ID NO: 6455676 - DNA, 22 bp, Homo sapiens
tgagaatcccaaatttgattga

SEQ ID NO: 6455677 - DNA, 18 bp, Homo sapiens
tgagaatcccaattattt

SEQ ID NO: 6455678 - DNA, 15 bp, Homo sapiens
tgagaatcctctcct

SEQ ID NO: 6455679 - DNA, 21 bp, Homo sapiens
tgagaatcctctcctttctta

SEQ ID NO: 6455680 - DNA, 22 bp, Homo sapiens
tgagaatcctctcctttcttat

SEQ ID NO: 6455681 - DNA, 16 bp, Homo sapiens
tgagaatcctgcctct

SEQ ID NO: 6455682 - DNA, 19 bp, Homo sapiens
tgagaatcgacctcactgt

SEQ ID NO: 6455683 - DNA, 18 bp, Homo sapiens
tgagaatctaggccaccc

SEQ ID NO: 6455684 - DNA, 15 bp, Homo sapiens
tgagaatctgggggt

SEQ ID NO: 6455685 - DNA, 18 bp, Homo sapiens
tgagaatctgggggtgag

SEQ ID NO: 6455686 - DNA, 22 bp, Homo sapiens
tgagaatctgggggtgaggagg

SEQ ID NO: 6455687 - DNA, 15 bp, Homo sapiens
tgagaatctgtgcag

SEQ ID NO: 6455688 - DNA, 17 bp, Homo sapiens
tgagaatgaacaaagac

SEQ ID NO: 6455689 - DNA, 10 bp, Homo sapiens
tgagaatgag

SEQ ID NO: 6455690 - DNA, 22 bp, Homo sapiens
tgagaatgagggcgtgaaacac

SEQ ID NO: 6455691 - DNA, 14 bp, Homo sapiens
tgagaatgcctagg

SEQ ID NO: 6455692 - DNA, 21 bp, Homo sapiens
tgagaatgcctaggccagctc

SEQ ID NO: 6455693 - DNA, 15 bp, Homo sapiens
tgagaatggaggctc

SEQ ID NO: 6455694 - DNA, 13 bp, Homo sapiens
tgagaatggcctg

SEQ ID NO: 6455695 - DNA, 14 bp, Homo sapiens
tgagaatggcctgg

SEQ ID NO: 6455696 - DNA, 21 bp, Homo sapiens
tgagaatggcctggagcaggc

SEQ ID NO: 6455697 - DNA, 13 bp, Homo sapiens
tgagaatgtcatt

SEQ ID NO: 6455698 - DNA, 18 bp, Homo sapiens
tgagaatgtcatttgcta

SEQ ID NO: 6455699 - DNA, 12 bp, Homo sapiens
tgagaatgtgcc

SEQ ID NO: 6455700 - DNA, 13 bp, Homo sapiens
tgagaatgtgcca

SEQ ID NO: 6455701 - DNA, 14 bp, Homo sapiens
tgagaatgtgccat

SEQ ID NO: 6455702 - DNA, 17 bp, Homo sapiens
tgagaatgttaccagac

SEQ ID NO: 6455703 - DNA, 19 bp, Homo sapiens
tgagaatgttaccagactt

SEQ ID NO: 6455704 - DNA, 14 bp, Homo sapiens
tgagaattaaaata

SEQ ID NO: 6455705 - DNA, 18 bp, Homo sapiens
tgagaattaaaataaaac

SEQ ID NO: 6455706 - DNA, 19 bp, Homo sapiens
tgagaattaagttttaaat

SEQ ID NO: 6455707 - DNA, 15 bp, Homo sapiens
tgagaattacagaaa

SEQ ID NO: 6455708 - DNA, 17 bp, Homo sapiens
tgagaattacagaaaat

SEQ ID NO: 6455709 - DNA, 19 bp, Homo sapiens
tgagaattacagaaaattt

SEQ ID NO: 6455710 - DNA, 20 bp, Homo sapiens
tgagaattacagaaaatttg

SEQ ID NO: 6455711 - DNA, 12 bp, Homo sapiens
tgagaattattc

SEQ ID NO: 6455712 - DNA, 16 bp, Homo sapiens
tgagaattcagctgcc

SEQ ID NO: 6455713 - DNA, 22 bp, Homo sapiens
tgagaattcagctgcccccgct

SEQ ID NO: 6455714 - DNA, 23 bp, Homo sapiens
tgagaattcagctgcccccgctc

SEQ ID NO: 6455715 - DNA, 16 bp, Homo sapiens
tgagaattcaggcaaa

SEQ ID NO: 6455716 - DNA, 21 bp, Homo sapiens
tgagaattgaggggaggtggc

SEQ ID NO: 6455717 - DNA, 17 bp, Homo sapiens
tgagaattgcaaaacta

SEQ ID NO: 6455718 - DNA, 23 bp, Homo sapiens
tgagaattgcaaaactagacaaa

SEQ ID NO: 6455719 - DNA, 18 bp, Homo sapiens
tgagaattgggactctgt

SEQ ID NO: 6455720 - DNA, 19 bp, Homo sapiens
tgagaattgggactctgtt

SEQ ID NO: 6455721 - DNA, 19 bp, Homo sapiens
tgagaattgggcggctctg

SEQ ID NO: 6455722 - DNA, 20 bp, Homo sapiens
tgagaattgtgctcaaaatt

SEQ ID NO: 6455723 - DNA, 20 bp, Homo sapiens
tgagaatttaatttttaaaa

SEQ ID NO: 6455724 - DNA, 22 bp, Homo sapiens
tgagaatttctaaaaagattag

SEQ ID NO: 6455725 - DNA, 20 bp, Homo sapiens
tgagaatttgagtgctctga

SEQ ID NO: 6455726 - DNA, 14 bp, Homo sapiens
tgagaatttgcaac

SEQ ID NO: 6455727 - DNA, 23 bp, Homo sapiens
tgagaattttaaattataactta

SEQ ID NO: 6455728 - DNA, 20 bp, Homo sapiens
tgagaattttgatttcttaa

SEQ ID NO: 6455729 - DNA, 16 bp, Homo sapiens
tgagacaaaaaggaaa

SEQ ID NO: 6455730 - DNA, 18 bp, Homo sapiens
tgagacaaaaattatcta

SEQ ID NO: 6455731 - DNA, 14 bp, Homo sapiens
tgagacaaaagaaa

SEQ ID NO: 6455732 - DNA, 15 bp, Homo sapiens
tgagacaacacacac

SEQ ID NO: 6455733 - DNA, 15 bp, Homo sapiens
tgagacaagccctgg

SEQ ID NO: 6455734 - DNA, 20 bp, Homo sapiens
tgagacaagccctggcaaca

SEQ ID NO: 6455735 - DNA, 13 bp, Homo sapiens
tgagacaatgaaa

SEQ ID NO: 6455736 - DNA, 15 bp, Homo sapiens
tgagacaatgccttg

SEQ ID NO: 6455737 - DNA, 16 bp, Homo sapiens
tgagacaattttgctt

SEQ ID NO: 6455738 - DNA, 23 bp, Homo sapiens
tgagacacacaacggcagtgaag

SEQ ID NO: 6455739 - DNA, 17 bp, Homo sapiens
tgagacacagcccagag

SEQ ID NO: 6455740 - DNA, 20 bp, Homo sapiens
tgagacacagcccagagact

SEQ ID NO: 6455741 - DNA, 16 bp, Homo sapiens
tgagacacaggatgaa

SEQ ID NO: 6455742 - DNA, 14 bp, Homo sapiens
tgagacacaggtgg

SEQ ID NO: 6455743 - DNA, 15 bp, Homo sapiens
tgagacacatgggtg

SEQ ID NO: 6455744 - DNA, 16 bp, Homo sapiens
tgagacacatgggtgc

SEQ ID NO: 6455745 - DNA, 13 bp, Homo sapiens
tgagacactgaag

SEQ ID NO: 6455746 - DNA, 14 bp, Homo sapiens
tgagacactgtcaa

SEQ ID NO: 6455747 - DNA, 19 bp, Homo sapiens
tgagacagacacacagcct

SEQ ID NO: 6455748 - DNA, 13 bp, Homo sapiens
tgagacagacacc

SEQ ID NO: 6455749 - DNA, 11 bp, Homo sapiens
tgagacagagt

SEQ ID NO: 6455750 - DNA, 13 bp, Homo sapiens
tgagacagagtct

SEQ ID NO: 6455751 - DNA, 21 bp, Homo sapiens
tgagacagagttttcactctt

SEQ ID NO: 6455752 - DNA, 17 bp, Homo sapiens
tgagacagataagagaa

SEQ ID NO: 6455753 - DNA, 23 bp, Homo sapiens
tgagacagcggtcccaggggcct

SEQ ID NO: 6455754 - DNA, 17 bp, Homo sapiens
tcctcatctatggttct

SEQ ID NO: 6455755 - DNA, 20 bp, Homo sapiens
tcctcatctatggttctaaa

SEQ ID NO: 6455756 - DNA, 15 bp, Homo sapiens
tcctcatctccatgc

SEQ ID NO: 6455757 - DNA, 12 bp, Homo sapiens
tcctcatctcta

SEQ ID NO: 6455758 - DNA, 22 bp, Homo sapiens
tcctcatctgagaggctctccg

SEQ ID NO: 6455759 - DNA, 16 bp, Homo sapiens
tcctcatctgcaaagc

SEQ ID NO: 6455760 - DNA, 19 bp, Homo sapiens
tcctcatctgggggagtgg

SEQ ID NO: 6455761 - DNA, 21 bp, Homo sapiens
tcctcatctgggggagtggaa

SEQ ID NO: 6455762 - DNA, 14 bp, Homo sapiens
tcctcatgaatgta

SEQ ID NO: 6455763 - DNA, 17 bp, Homo sapiens
tcctcatgaggccatgc

SEQ ID NO: 6455764 - DNA, 19 bp, Homo sapiens
tcctcatggcagcctactc

SEQ ID NO: 6455765 - DNA, 18 bp, Homo sapiens
tcctcatgtaacattggt

SEQ ID NO: 6455766 - DNA, 20 bp, Homo sapiens
tcctcatgtaacattggtga

SEQ ID NO: 6455767 - DNA, 21 bp, Homo sapiens
tcctcatgtaacattggtgaa

SEQ ID NO: 6455768 - DNA, 21 bp, Homo sapiens
tcctcatgtgagaaagcagat

SEQ ID NO: 6455769 - DNA, 24 bp, Homo sapiens
tcctcatgtgagaaagcagatcat

SEQ ID NO: 6455770 - DNA, 18 bp, Homo sapiens
tcctcatgttactcagtg

SEQ ID NO: 6455771 - DNA, 15 bp, Homo sapiens
tcctcattcaaaggg

SEQ ID NO: 6455772 - DNA, 17 bp, Homo sapiens
tcctcattccttgtctt

SEQ ID NO: 6455773 - DNA, 19 bp, Homo sapiens
tcctcattgatgttaagaa

SEQ ID NO: 6455774 - DNA, 16 bp, Homo sapiens
tcctcattgcctcctg

SEQ ID NO: 6455775 - DNA, 12 bp, Homo sapiens
tcctcatttccc

SEQ ID NO: 6455776 - DNA, 14 bp, Homo sapiens
tcctcatttcccct

SEQ ID NO: 6455777 - DNA, 15 bp, Homo sapiens
tcctcatttcccctc

SEQ ID NO: 6455778 - DNA, 16 bp, Homo sapiens
tcctcatttcccctcc

SEQ ID NO: 6455779 - DNA, 15 bp, Homo sapiens
tcctcatttctccag

SEQ ID NO: 6455780 - DNA, 22 bp, Homo sapiens
tcctcatttcttgaggcttctg

SEQ ID NO: 6455781 - DNA, 22 bp, Homo sapiens
tcctcatttgcaaacctcagag

SEQ ID NO: 6455782 - DNA, 12 bp, Homo sapiens
tcctccaaaaca

SEQ ID NO: 6455783 - DNA, 23 bp, Homo sapiens
tcctccaaaacacaagggaggat

SEQ ID NO: 6455784 - DNA, 19 bp, Homo sapiens
tcctccaaactcctgcctg

SEQ ID NO: 6455785 - DNA, 20 bp, Homo sapiens
tcctccaaagcctgggcaga

SEQ ID NO: 6455786 - DNA, 17 bp, Homo sapiens
tcctccaaaggccccct

SEQ ID NO: 6455787 - DNA, 18 bp, Homo sapiens
tcctccaaaggcccccta

SEQ ID NO: 6455788 - DNA, 23 bp, Homo sapiens
tcctccaaaggccccctacgcca

SEQ ID NO: 6455789 - DNA, 18 bp, Homo sapiens
tcctccaaatctcttgct

SEQ ID NO: 6455790 - DNA, 16 bp, Homo sapiens
tcctccaaatgctgtc

SEQ ID NO: 6455791 - DNA, 17 bp, Homo sapiens
tcctccaaatgctgtcg

SEQ ID NO: 6455792 - DNA, 19 bp, Homo sapiens
tcctccaacaataaagagc

SEQ ID NO: 6455793 - DNA, 22 bp, Homo sapiens
tcctccaacaccaagcacagca

SEQ ID NO: 6455794 - DNA, 13 bp, Homo sapiens
tcctccaacagct

SEQ ID NO: 6455795 - DNA, 16 bp, Homo sapiens
tcctccaagaagccct

SEQ ID NO: 6455796 - DNA, 24 bp, Homo sapiens
tcctccaagaagccctccttgcca

SEQ ID NO: 6455797 - DNA, 19 bp, Homo sapiens
tcctccaatcaaaatcacc

SEQ ID NO: 6455798 - DNA, 14 bp, Homo sapiens
tcctccaatcccca

SEQ ID NO: 6455799 - DNA, 20 bp, Homo sapiens
tcctccaatccccactcctc

SEQ ID NO: 6455800 - DNA, 21 bp, Homo sapiens
tcctccaatccccactcctcc

SEQ ID NO: 6455801 - DNA, 16 bp, Homo sapiens
tcctccaatggaaatt

SEQ ID NO: 6455802 - DNA, 20 bp, Homo sapiens
tcctccaatgtcctgaaaca

SEQ ID NO: 6455803 - DNA, 11 bp, Homo sapiens
tcctccacaga

SEQ ID NO: 6455804 - DNA, 14 bp, Homo sapiens
tcctccacagagag

SEQ ID NO: 6455805 - DNA, 13 bp, Homo sapiens
tcctccacatcct

SEQ ID NO: 6455806 - DNA, 17 bp, Homo sapiens
tcctccacatcctgtgt

SEQ ID NO: 6455807 - DNA, 20 bp, Homo sapiens
tcctccacatcctgtgtcag

SEQ ID NO: 6455808 - DNA, 21 bp, Homo sapiens
tcctccaccaccgcccgtctg

SEQ ID NO: 6455809 - DNA, 13 bp, Homo sapiens
tcctccaccatgc

SEQ ID NO: 6455810 - DNA, 22 bp, Homo sapiens
tcctccaccgccatggcttcca

SEQ ID NO: 6455811 - DNA, 20 bp, Homo sapiens
tcctccacctgccgtggact

SEQ ID NO: 6455812 - DNA, 19 bp, Homo sapiens
tcctccacgttctgctcat

SEQ ID NO: 6455813 - DNA, 19 bp, Homo sapiens
tcctccactctcccccacc

SEQ ID NO: 6455814 - DNA, 14 bp, Homo sapiens
tcctccacttcatt

SEQ ID NO: 6455815 - DNA, 11 bp, Homo sapiens
tcctccagaac

SEQ ID NO: 6455816 - DNA, 16 bp, Homo sapiens
tcctccagaagcctct

SEQ ID NO: 6455817 - DNA, 21 bp, Homo sapiens
tcctccagaagcctctggcta

SEQ ID NO: 6455818 - DNA, 22 bp, Homo sapiens
tcctccagaagcctctggctag

SEQ ID NO: 6455819 - DNA, 20 bp, Homo sapiens
tcctccagacccctgtggca

SEQ ID NO: 6455820 - DNA, 17 bp, Homo sapiens
tcctccagagcctgggc

SEQ ID NO: 6455821 - DNA, 20 bp, Homo sapiens
tcctccagcagggaaaatgc

SEQ ID NO: 6455822 - DNA, 17 bp, Homo sapiens
tcctccagcccctgtag

SEQ ID NO: 6455823 - DNA, 18 bp, Homo sapiens
tcctccagcccctgtccc

SEQ ID NO: 6455824 - DNA, 12 bp, Homo sapiens
tcctccagccct

SEQ ID NO: 6455825 - DNA, 18 bp, Homo sapiens
tcctccagccctgggcac

SEQ ID NO: 6455826 - DNA, 14 bp, Homo sapiens
tcctccagcctccc

SEQ ID NO: 6455827 - DNA, 17 bp, Homo sapiens
tcctccagcctcccctc

SEQ ID NO: 6455828 - DNA, 10 bp, Homo sapiens
tcctccagct

SEQ ID NO: 6455829 - DNA, 17 bp, Homo sapiens
tcctccagctcctgccc

SEQ ID NO: 6455830 - DNA, 13 bp, Homo sapiens
tcctccagctgca

SEQ ID NO: 6455831 - DNA, 14 bp, Homo sapiens
tcctccagctgcac

SEQ ID NO: 6455832 - DNA, 15 bp, Homo sapiens
tcctccagctgcacc

SEQ ID NO: 6455833 - DNA, 13 bp, Homo sapiens
tcctccaggagct

SEQ ID NO: 6455834 - DNA, 13 bp, Homo sapiens
tcctccagggaag

SEQ ID NO: 6455835 - DNA, 21 bp, Homo sapiens
tcctccagggaaggtggccac

SEQ ID NO: 6455836 - DNA, 23 bp, Homo sapiens
tcctccagggaaggtggccacag

SEQ ID NO: 6455837 - DNA, 11 bp, Homo sapiens
tcctccagggg

SEQ ID NO: 6455838 - DNA, 10 bp, Homo sapiens
tcctccaggt

SEQ ID NO: 6455839 - DNA, 23 bp, Homo sapiens
tcctccaggtcggagtgcctgga

SEQ ID NO: 6455840 - DNA, 11 bp, Homo sapiens
tcctccaggtt

SEQ ID NO: 6455841 - DNA, 12 bp, Homo sapiens
tcctccaggttt

SEQ ID NO: 6455842 - DNA, 14 bp, Homo sapiens
tcctccaggttttt

SEQ ID NO: 6455843 - DNA, 22 bp, Homo sapiens
tcctccaggtttttcaattaaa

SEQ ID NO: 6455844 - DNA, 21 bp, Homo sapiens
tcctccagtacgtcccgctgc

SEQ ID NO: 6455845 - DNA, 15 bp, Homo sapiens
tcctccagtctgttc

SEQ ID NO: 6455846 - DNA, 17 bp, Homo sapiens
tcctccatcacccctgg

SEQ ID NO: 6455847 - DNA, 16 bp, Homo sapiens
tcctccatctccaaga

SEQ ID NO: 6455848 - DNA, 20 bp, Homo sapiens
tcctccatgctgtccctgtg

SEQ ID NO: 6455849 - DNA, 18 bp, Homo sapiens
tcctccatggtgctgcat

SEQ ID NO: 6455850 - DNA, 15 bp, Homo sapiens
tcctccatggtggaa

SEQ ID NO: 6455851 - DNA, 20 bp, Homo sapiens
tcctccattactctattgat

SEQ ID NO: 6455852 - DNA, 15 bp, Homo sapiens
tcctccattgctgtt

SEQ ID NO: 6455853 - DNA, 20 bp, Homo sapiens
tcctccatttcaactccaga

SEQ ID NO: 6455854 - DNA, 15 bp, Homo sapiens
tcctccatttttgtt

SEQ ID NO: 6455855 - DNA, 18 bp, Homo sapiens
tcctcccaactctggcct

SEQ ID NO: 6455856 - DNA, 19 bp, Homo sapiens
tcctcccaagctgtgctgg

SEQ ID NO: 6455857 - DNA, 21 bp, Homo sapiens
tcctcccaagctgtgctggga

SEQ ID NO: 6455858 - DNA, 17 bp, Homo sapiens
tcctcccaagtggtgcc

SEQ ID NO: 6455859 - DNA, 22 bp, Homo sapiens
tcctcccacagacctgcagtga

SEQ ID NO: 6455860 - DNA, 15 bp, Homo sapiens
tcctcccacccctcc

SEQ ID NO: 6455861 - DNA, 14 bp, Homo sapiens
tcctcccacctcag

SEQ ID NO: 6455862 - DNA, 20 bp, Homo sapiens
tcctcccacctcagcctcct

SEQ ID NO: 6455863 - DNA, 20 bp, Homo sapiens
tcctcccaccttggcctccc

SEQ ID NO: 6455864 - DNA, 12 bp, Homo sapiens
tcctcccagaaa

SEQ ID NO: 6455865 - DNA, 13 bp, Homo sapiens
tcctcccagcaca

SEQ ID NO: 6455866 - DNA, 13 bp, Homo sapiens
tcctcccagcggc

SEQ ID NO: 6455867 - DNA, 12 bp, Homo sapiens
tcctcccaggaa

SEQ ID NO: 6455868 - DNA, 15 bp, Homo sapiens
tcctcccaggaacca

SEQ ID NO: 6455869 - DNA, 23 bp, Homo sapiens
tcctcccaggaagcccaggagcc

SEQ ID NO: 6455870 - DNA, 17 bp, Homo sapiens
tcctcccaggaggtgct

SEQ ID NO: 6455871 - DNA, 13 bp, Homo sapiens
tcctcccaggcgc

SEQ ID NO: 6455872 - DNA, 20 bp, Homo sapiens
tcctcccaggctcaagctat

SEQ ID NO: 6455873 - DNA, 11 bp, Homo sapiens
tcctcccaggg

SEQ ID NO: 6455874 - DNA, 19 bp, Homo sapiens
tcctcccagggcctcctgg

SEQ ID NO: 6455875 - DNA, 23 bp, Homo sapiens
tcctcccaggtttcttctctgga

SEQ ID NO: 6455876 - DNA, 12 bp, Homo sapiens
tcctcccagtga

SEQ ID NO: 6455877 - DNA, 13 bp, Homo sapiens
tcctcccagtgag

SEQ ID NO: 6455878 - DNA, 14 bp, Homo sapiens
tcctcccagtgcct

SEQ ID NO: 6455879 - DNA, 20 bp, Homo sapiens
tcctcccatagatactctct

SEQ ID NO: 6455880 - DNA, 21 bp, Homo sapiens
tcctcccatagatactctctt

SEQ ID NO: 6455881 - DNA, 19 bp, Homo sapiens
tcctcccatcccctggact

SEQ ID NO: 6455882 - DNA, 23 bp, Homo sapiens
tcctcccatcccctggactggga

SEQ ID NO: 6455883 - DNA, 15 bp, Homo sapiens
tcctcccatctcctt

SEQ ID NO: 6455884 - DNA, 15 bp, Homo sapiens
tcctcccatggcctt

SEQ ID NO: 6455885 - DNA, 19 bp, Homo sapiens
tcctcccatgtcactgcag

SEQ ID NO: 6455886 - DNA, 22 bp, Homo sapiens
tcctcccattttagaaaatcag

SEQ ID NO: 6455887 - DNA, 21 bp, Homo sapiens
tcctccccaaatcaatacact

SEQ ID NO: 6455888 - DNA, 21 bp, Homo sapiens
tcctccccacactccactctg

SEQ ID NO: 6455889 - DNA, 16 bp, Homo sapiens
tcctccccaccagagc

SEQ ID NO: 6455890 - DNA, 20 bp, Homo sapiens
tcctccccaccagagctgcc

SEQ ID NO: 6455891 - DNA, 21 bp, Homo sapiens
tcctccccaccagagctgcct

SEQ ID NO: 6455892 - DNA, 17 bp, Homo sapiens
tcctccccaccctgtcc

SEQ ID NO: 6455893 - DNA, 12 bp, Homo sapiens
tcctccccacct

SEQ ID NO: 6455894 - DNA, 18 bp, Homo sapiens
tcctccccacctgtagct

SEQ ID NO: 6455895 - DNA, 19 bp, Homo sapiens
tcctccccaccttccccag

SEQ ID NO: 6455896 - DNA, 22 bp, Homo sapiens
tcctccccaccttccccagact

SEQ ID NO: 6455897 - DNA, 23 bp, Homo sapiens
tcctccccaccttccccagactc

SEQ ID NO: 6455898 - DNA, 13 bp, Homo sapiens
tcctccccagagc

SEQ ID NO: 6455899 - DNA, 14 bp, Homo sapiens
tcctccccagagct

SEQ ID NO: 6455900 - DNA, 15 bp, Homo sapiens
tcctccccagagctg

SEQ ID NO: 6455901 - DNA, 13 bp, Homo sapiens
tcctccccagctc

SEQ ID NO: 6455902 - DNA, 14 bp, Homo sapiens
tcctccccagctct

SEQ ID NO: 6455903 - DNA, 19 bp, Homo sapiens
tcctccccagctcttctct

SEQ ID NO: 6455904 - DNA, 22 bp, Homo sapiens
tcctccccagctcttctcttcc

SEQ ID NO: 6455905 - DNA, 15 bp, Homo sapiens
tcctccccaggaccc

SEQ ID NO: 6455906 - DNA, 19 bp, Homo sapiens
tcctccccatacacacaca

SEQ ID NO: 6455907 - DNA, 13 bp, Homo sapiens
tcctcccccaccc

SEQ ID NO: 6455908 - DNA, 15 bp, Homo sapiens
tcctcccccacccct

SEQ ID NO: 6455909 - DNA, 20 bp, Homo sapiens
tcctcccccaccttcaagca

SEQ ID NO: 6455910 - DNA, 19 bp, Homo sapiens
tcctcccccacgcctccat

SEQ ID NO: 6455911 - DNA, 15 bp, Homo sapiens
tcctcccccagagcc

SEQ ID NO: 6455912 - DNA, 18 bp, Homo sapiens
tcctcccccagcgtcagt

SEQ ID NO: 6455913 - DNA, 20 bp, Homo sapiens
tcctcccccctcctctgaaa

SEQ ID NO: 6455914 - DNA, 21 bp, Homo sapiens
tcctcccccctcctctgaaac

SEQ ID NO: 6455915 - DNA, 20 bp, Homo sapiens
tcctccccctcctagggggt

SEQ ID NO: 6455916 - DNA, 16 bp, Homo sapiens
tcctccccctcctcca

SEQ ID NO: 6455917 - DNA, 21 bp, Homo sapiens
tcctccccctcctccatgctg

SEQ ID NO: 6455918 - DNA, 13 bp, Homo sapiens
tcctccccctgcc

SEQ ID NO: 6455919 - DNA, 23 bp, Homo sapiens
tcctccccctgccagtgccttac

SEQ ID NO: 6455920 - DNA, 16 bp, Homo sapiens
tcctccccctgctccc

SEQ ID NO: 6455921 - DNA, 13 bp, Homo sapiens
tcctccccgcctc

SEQ ID NO: 6455922 - DNA, 14 bp, Homo sapiens
tcctcccctcaagg

SEQ ID NO: 6455923 - DNA, 14 bp, Homo sapiens
tcctcccctcacag

SEQ ID NO: 6455924 - DNA, 18 bp, Homo sapiens
tcctcccctcacagcctc

SEQ ID NO: 6455925 - DNA, 20 bp, Homo sapiens
tcctcccctcctcctggact

SEQ ID NO: 6455926 - DNA, 16 bp, Homo sapiens
tcctcccctcctcttc

SEQ ID NO: 6455927 - DNA, 18 bp, Homo sapiens
tcctcccctcctcttccc

SEQ ID NO: 6455928 - DNA, 13 bp, Homo sapiens
tcctcccctgccg

SEQ ID NO: 6455929 - DNA, 18 bp, Homo sapiens
tcctcccctgccgcctcc

SEQ ID NO: 6455930 - DNA, 14 bp, Homo sapiens
tcctcccctggaag

SEQ ID NO: 6455931 - DNA, 14 bp, Homo sapiens
tcctccccttccct

SEQ ID NO: 6455932 - DNA, 15 bp, Homo sapiens
tcctccccttccctg

SEQ ID NO: 6455933 - DNA, 20 bp, Homo sapiens
tgagacaggaaaaaccaaca

SEQ ID NO: 6455934 - DNA, 14 bp, Homo sapiens
tgagacaggcagtt

SEQ ID NO: 6455935 - DNA, 15 bp, Homo sapiens
tgagacaggctgggt

SEQ ID NO: 6455936 - DNA, 20 bp, Homo sapiens
tgagacaggtgcctaacctg

SEQ ID NO: 6455937 - DNA, 15 bp, Homo sapiens
tgagacaggtgcctg

SEQ ID NO: 6455938 - DNA, 18 bp, Homo sapiens
tgagacagtccagcctgg

SEQ ID NO: 6455939 - DNA, 19 bp, Homo sapiens
tgagacagtccagcctgga

SEQ ID NO: 6455940 - DNA, 23 bp, Homo sapiens
tgagacagtctggaaagtgatgt

SEQ ID NO: 6455941 - DNA, 16 bp, Homo sapiens
tgagacagtgcacatg

SEQ ID NO: 6455942 - DNA, 15 bp, Homo sapiens
tgagacagtttctta

SEQ ID NO: 6455943 - DNA, 14 bp, Homo sapiens
tgagacatcaggga

SEQ ID NO: 6455944 - DNA, 16 bp, Homo sapiens
tgagacatcagggagt

SEQ ID NO: 6455945 - DNA, 20 bp, Homo sapiens
tgagacatcagggagtaagt

SEQ ID NO: 6455946 - DNA, 12 bp, Homo sapiens
tgagacatccag

SEQ ID NO: 6455947 - DNA, 15 bp, Homo sapiens
tgagaccaaaattta

SEQ ID NO: 6455948 - DNA, 13 bp, Homo sapiens
tgagaccacagag

SEQ ID NO: 6455949 - DNA, 18 bp, Homo sapiens
tgagaccactgagtacca

SEQ ID NO: 6455950 - DNA, 15 bp, Homo sapiens
tgagaccagaagaaa

SEQ ID NO: 6455951 - DNA, 16 bp, Homo sapiens
tgagaccagaagaaaa

SEQ ID NO: 6455952 - DNA, 18 bp, Homo sapiens
tgagaccagaagaaaaga

SEQ ID NO: 6455953 - DNA, 20 bp, Homo sapiens
tgagaccagaagaaaagact

SEQ ID NO: 6455954 - DNA, 13 bp, Homo sapiens
tgagaccagccaa

SEQ ID NO: 6455955 - DNA, 14 bp, Homo sapiens
tgagaccagcctgg

SEQ ID NO: 6455956 - DNA, 16 bp, Homo sapiens
tgagaccagcctgggc

SEQ ID NO: 6455957 - DNA, 17 bp, Homo sapiens
tgagaccagcctgggca

SEQ ID NO: 6455958 - DNA, 13 bp, Homo sapiens
tgagaccaggctg

SEQ ID NO: 6455959 - DNA, 15 bp, Homo sapiens
tgagaccaggctggg

SEQ ID NO: 6455960 - DNA, 13 bp, Homo sapiens
tgagaccagggtc

SEQ ID NO: 6455961 - DNA, 12 bp, Homo sapiens
tgagaccagttg

SEQ ID NO: 6455962 - DNA, 20 bp, Homo sapiens
tgagaccatccattctcctc

SEQ ID NO: 6455963 - DNA, 16 bp, Homo sapiens
tgagaccatgtttcaa

SEQ ID NO: 6455964 - DNA, 13 bp, Homo sapiens
tgagacccagccc

SEQ ID NO: 6455965 - DNA, 18 bp, Homo sapiens
tgagacccagccctcatc

SEQ ID NO: 6455966 - DNA, 14 bp, Homo sapiens
tgagacccaggccc

SEQ ID NO: 6455967 - DNA, 19 bp, Homo sapiens
tgagaccccagtgcctgca

SEQ ID NO: 6455968 - DNA, 21 bp, Homo sapiens
tgagacccccaagcttccacc

SEQ ID NO: 6455969 - DNA, 14 bp, Homo sapiens
tgagacccccacac

SEQ ID NO: 6455970 - DNA, 17 bp, Homo sapiens
tgagaccccgcactgca

SEQ ID NO: 6455971 - DNA, 19 bp, Homo sapiens
tgagaccccgcactgcaga

SEQ ID NO: 6455972 - DNA, 18 bp, Homo sapiens
tgagacccctggcctccg

SEQ ID NO: 6455973 - DNA, 22 bp, Homo sapiens
tgagacccctggcctccggcgt

SEQ ID NO: 6455974 - DNA, 20 bp, Homo sapiens
tgagacccctttaaactgtc

SEQ ID NO: 6455975 - DNA, 19 bp, Homo sapiens
tgagaccctcttctctggg

SEQ ID NO: 6455976 - DNA, 15 bp, Homo sapiens
tgagaccctgtctca

SEQ ID NO: 6455977 - DNA, 16 bp, Homo sapiens
tgagaccctgtctcta

SEQ ID NO: 6455978 - DNA, 15 bp, Homo sapiens
tgagacccttattta

SEQ ID NO: 6455979 - DNA, 17 bp, Homo sapiens
tgagacctcagccatga

SEQ ID NO: 6455980 - DNA, 19 bp, Homo sapiens
tgagacctcagccatgagg

SEQ ID NO: 6455981 - DNA, 16 bp, Homo sapiens
tgagacctcccccagg

SEQ ID NO: 6455982 - DNA, 18 bp, Homo sapiens
tgagacctcccccaggga

SEQ ID NO: 6455983 - DNA, 19 bp, Homo sapiens
tgagacctcccccagggag

SEQ ID NO: 6455984 - DNA, 23 bp, Homo sapiens
tgagacctgaaggacctccccct

SEQ ID NO: 6455985 - DNA, 14 bp, Homo sapiens
tgagacctgaccag

SEQ ID NO: 6455986 - DNA, 14 bp, Homo sapiens
tgagacctggaaca

SEQ ID NO: 6455987 - DNA, 15 bp, Homo sapiens
tgagacctggaacca

SEQ ID NO: 6455988 - DNA, 17 bp, Homo sapiens
tgagacctggaaccaga

SEQ ID NO: 6455989 - DNA, 18 bp, Homo sapiens
tgagacctggaaccagag

SEQ ID NO: 6455990 - DNA, 19 bp, Homo sapiens
tgagacctgggatttgaga

SEQ ID NO: 6455991 - DNA, 15 bp, Homo sapiens
tgagaccttgatgag

SEQ ID NO: 6455992 - DNA, 15 bp, Homo sapiens
tgagaccttgtctct

SEQ ID NO: 6455993 - DNA, 20 bp, Homo sapiens
tgagacgccaccattcctgg

SEQ ID NO: 6455994 - DNA, 21 bp, Homo sapiens
tgagacgccggcttcctcctt

SEQ ID NO: 6455995 - DNA, 18 bp, Homo sapiens
tgagacggatggaaggag

SEQ ID NO: 6455996 - DNA, 20 bp, Homo sapiens
tgagacggatggaaggagag

SEQ ID NO: 6455997 - DNA, 23 bp, Homo sapiens
tgagacggcagagaccccaggat

SEQ ID NO: 6455998 - DNA, 22 bp, Homo sapiens
tgagacggtgtctcgctgcatc

SEQ ID NO: 6455999 - DNA, 13 bp, Homo sapiens
tgagactaagaga

SEQ ID NO: 6456000 - DNA, 20 bp, Homo sapiens
tgagactataactgtcatct

SEQ ID NO: 6456001 - DNA, 14 bp, Homo sapiens
tgagactatttaaa

SEQ ID NO: 6456002 - DNA, 19 bp, Homo sapiens
tgagactcaaaaaaacaaa

SEQ ID NO: 6456003 - DNA, 18 bp, Homo sapiens
tgagactcacactctctg

SEQ ID NO: 6456004 - DNA, 18 bp, Homo sapiens
tgagactcacaggaagga

SEQ ID NO: 6456005 - DNA, 15 bp, Homo sapiens
tgagactcagtgcag

SEQ ID NO: 6456006 - DNA, 16 bp, Homo sapiens
tgagactcagtgcaga

SEQ ID NO: 6456007 - DNA, 16 bp, Homo sapiens
tgagactccacctcaa

SEQ ID NO: 6456008 - DNA, 21 bp, Homo sapiens
tgagactccactcaggtgcac

SEQ ID NO: 6456009 - DNA, 22 bp, Homo sapiens
tgagactccagaatctgctgtt

SEQ ID NO: 6456010 - DNA, 17 bp, Homo sapiens
tgagactccagacctga

SEQ ID NO: 6456011 - DNA, 17 bp, Homo sapiens
tgagactcccgcctttg

SEQ ID NO: 6456012 - DNA, 18 bp, Homo sapiens
tgagactcccgcctttga

SEQ ID NO: 6456013 - DNA, 14 bp, Homo sapiens
tgagactcctcagc

SEQ ID NO: 6456014 - DNA, 20 bp, Homo sapiens
tgagactcctcagcacccct

SEQ ID NO: 6456015 - DNA, 21 bp, Homo sapiens
tgagactcgcgacaatgcaaa

SEQ ID NO: 6456016 - DNA, 23 bp, Homo sapiens
tgagactcgcgacaatgcaaacc

SEQ ID NO: 6456017 - DNA, 21 bp, Homo sapiens
tgagactctagggtccagtgg

SEQ ID NO: 6456018 - DNA, 13 bp, Homo sapiens
tgagactctgagg

SEQ ID NO: 6456019 - DNA, 15 bp, Homo sapiens
tgagactcttaaata

SEQ ID NO: 6456020 - DNA, 16 bp, Homo sapiens
tgagactcttaaatat

SEQ ID NO: 6456021 - DNA, 19 bp, Homo sapiens
tgagactctttagagcagc

SEQ ID NO: 6456022 - DNA, 15 bp, Homo sapiens
tgagactgaaattta

SEQ ID NO: 6456023 - DNA, 14 bp, Homo sapiens
tgagactgacacct

SEQ ID NO: 6456024 - DNA, 19 bp, Homo sapiens
tgagactgatccctggcca

SEQ ID NO: 6456025 - DNA, 14 bp, Homo sapiens
tgagactgccctgc

SEQ ID NO: 6456026 - DNA, 23 bp, Homo sapiens
tgagactgcgggatggtcctggg

SEQ ID NO: 6456027 - DNA, 14 bp, Homo sapiens
tgagactggagctg

SEQ ID NO: 6456028 - DNA, 23 bp, Homo sapiens
tgagactggggccactacatttg

SEQ ID NO: 6456029 - DNA, 23 bp, Homo sapiens
tgagactggttgcataacagcag

SEQ ID NO: 6456030 - DNA, 13 bp, Homo sapiens
tgagactgtacat

SEQ ID NO: 6456031 - DNA, 17 bp, Homo sapiens
tgagactgtacataatt

SEQ ID NO: 6456032 - DNA, 19 bp, Homo sapiens
tgagactgtcggagaggct

SEQ ID NO: 6456033 - DNA, 15 bp, Homo sapiens
tgagactgtttatta

SEQ ID NO: 6456034 - DNA, 16 bp, Homo sapiens
tgagactgtttattac

SEQ ID NO: 6456035 - DNA, 15 bp, Homo sapiens
tgagacttaaaacat

SEQ ID NO: 6456036 - DNA, 16 bp, Homo sapiens
tgagacttaaaacatg

SEQ ID NO: 6456037 - DNA, 15 bp, Homo sapiens
tgagacttactgggt

SEQ ID NO: 6456038 - DNA, 13 bp, Homo sapiens
tgagacttgcctt

SEQ ID NO: 6456039 - DNA, 15 bp, Homo sapiens
tgagacttgccttcc

SEQ ID NO: 6456040 - DNA, 17 bp, Homo sapiens
tgagacttgttcttggt

SEQ ID NO: 6456041 - DNA, 14 bp, Homo sapiens
tgagactttaaaag

SEQ ID NO: 6456042 - DNA, 18 bp, Homo sapiens
tgagactttaaaagcatt

SEQ ID NO: 6456043 - DNA, 16 bp, Homo sapiens
tgagactttcccctct

SEQ ID NO: 6456044 - DNA, 19 bp, Homo sapiens
tgagactttctaaatcaaa

SEQ ID NO: 6456045 - DNA, 12 bp, Homo sapiens
tgagactttttc

SEQ ID NO: 6456046 - DNA, 22 bp, Homo sapiens
tgagactttttggtggatgtaa

SEQ ID NO: 6456047 - DNA, 19 bp, Homo sapiens
tgagagaaaaagtgcccct

SEQ ID NO: 6456048 - DNA, 20 bp, Homo sapiens
tgagagaaaaagtgcccctt

SEQ ID NO: 6456049 - DNA, 13 bp, Homo sapiens
tgagagaaaataa

SEQ ID NO: 6456050 - DNA, 22 bp, Homo sapiens
tgagagaaaatactatttcaag

SEQ ID NO: 6456051 - DNA, 17 bp, Homo sapiens
tgagagaaagagaaatc

SEQ ID NO: 6456052 - DNA, 16 bp, Homo sapiens
tgagagaaagagagaa

SEQ ID NO: 6456053 - DNA, 19 bp, Homo sapiens
tgagagaaagagagaagcc

SEQ ID NO: 6456054 - DNA, 23 bp, Homo sapiens
tgagagaaagagagaagccagcc

SEQ ID NO: 6456055 - DNA, 22 bp, Homo sapiens
tgagagaaatatggaacttaca

SEQ ID NO: 6456056 - DNA, 17 bp, Homo sapiens
tgagagaagaaaacatt

SEQ ID NO: 6456057 - DNA, 18 bp, Homo sapiens
tgagagaataatttctgt

SEQ ID NO: 6456058 - DNA, 19 bp, Homo sapiens
tgagagaatggaaaacaga

SEQ ID NO: 6456059 - DNA, 19 bp, Homo sapiens
tgagagaatgggtttactc

SEQ ID NO: 6456060 - DNA, 23 bp, Homo sapiens
tgagagaatgggtttactctcaa

SEQ ID NO: 6456061 - DNA, 18 bp, Homo sapiens
tgagagaatgtggaaata

SEQ ID NO: 6456062 - DNA, 16 bp, Homo sapiens
tgagagaattggctca

SEQ ID NO: 6456063 - DNA, 19 bp, Homo sapiens
tgagagaattgtatcattt

SEQ ID NO: 6456064 - DNA, 17 bp, Homo sapiens
tgagagacacactgaag

SEQ ID NO: 6456065 - DNA, 22 bp, Homo sapiens
tgagagacacactgaagaagca

SEQ ID NO: 6456066 - DNA, 18 bp, Homo sapiens
tgagagacagtaacacaa

SEQ ID NO: 6456067 - DNA, 16 bp, Homo sapiens
tgagagaccacacatt

SEQ ID NO: 6456068 - DNA, 18 bp, Homo sapiens
tgagagaccacacatttt

SEQ ID NO: 6456069 - DNA, 24 bp, Homo sapiens
tgagagaccaggcaaagcaagtga

SEQ ID NO: 6456070 - DNA, 21 bp, Homo sapiens
tgagagacccaaggaggaaaa

SEQ ID NO: 6456071 - DNA, 21 bp, Homo sapiens
tgagagaccctcgcaaaatga

SEQ ID NO: 6456072 - DNA, 16 bp, Homo sapiens
tgagagaccctggcct

SEQ ID NO: 6456073 - DNA, 16 bp, Homo sapiens
tgagagacctctgcct

SEQ ID NO: 6456074 - DNA, 14 bp, Homo sapiens
tgagagacctgctc

SEQ ID NO: 6456075 - DNA, 19 bp, Homo sapiens
tgagagacctgctcaggcg

SEQ ID NO: 6456076 - DNA, 14 bp, Homo sapiens
tgagagacctgtgt

SEQ ID NO: 6456077 - DNA, 20 bp, Homo sapiens
tgagagacgccactccctgg

SEQ ID NO: 6456078 - DNA, 21 bp, Homo sapiens
tgagagacgccactccctggg

SEQ ID NO: 6456079 - DNA, 18 bp, Homo sapiens
tgagagactgccatacat

SEQ ID NO: 6456080 - DNA, 19 bp, Homo sapiens
tgagagagaatagagctgc

SEQ ID NO: 6456081 - DNA, 20 bp, Homo sapiens
tgagagagaatagagctgcc

SEQ ID NO: 6456082 - DNA, 21 bp, Homo sapiens
tgagagagaatagagctgcca

SEQ ID NO: 6456083 - DNA, 20 bp, Homo sapiens
tgagagagacaggcagctcg

SEQ ID NO: 6456084 - DNA, 17 bp, Homo sapiens
tgagagagagactgtgt

SEQ ID NO: 6456085 - DNA, 19 bp, Homo sapiens
tgagagagagactgtgtgt

SEQ ID NO: 6456086 - DNA, 12 bp, Homo sapiens
tgagagagaggg

SEQ ID NO: 6456087 - DNA, 21 bp, Homo sapiens
tgagagagagggcgcccagcc

SEQ ID NO: 6456088 - DNA, 18 bp, Homo sapiens
tgagagagagtcttactc

SEQ ID NO: 6456089 - DNA, 23 bp, Homo sapiens
tgagagagatgggagctcctctc

SEQ ID NO: 6456090 - DNA, 16 bp, Homo sapiens
tgagagaggacctcca

SEQ ID NO: 6456091 - DNA, 18 bp, Homo sapiens
tgagagaggacctccatg

SEQ ID NO: 6456092 - DNA, 21 bp, Homo sapiens
tgagagaggacctccatgccc

SEQ ID NO: 6456093 - DNA, 17 bp, Homo sapiens
tgagagaggaggcctgg

SEQ ID NO: 6456094 - DNA, 20 bp, Homo sapiens
tgagagaggctaaaatgttt

SEQ ID NO: 6456095 - DNA, 18 bp, Homo sapiens
tgagagagggggcactgt

SEQ ID NO: 6456096 - DNA, 19 bp, Homo sapiens
tgagagagggggcactgtg

SEQ ID NO: 6456097 - DNA, 14 bp, Homo sapiens
tgagagagtgctga

SEQ ID NO: 6456098 - DNA, 15 bp, Homo sapiens
tgagagagtggctgg

SEQ ID NO: 6456099 - DNA, 19 bp, Homo sapiens
tgagagagttgctcctcag

SEQ ID NO: 6456100 - DNA, 17 bp, Homo sapiens
tgagagatctgctgtca

SEQ ID NO: 6456101 - DNA, 21 bp, Homo sapiens
tgagagatgcagaaatatttg

SEQ ID NO: 6456102 - DNA, 18 bp, Homo sapiens
tgagagcaaatgcaaaaa

SEQ ID NO: 6456103 - DNA, 20 bp, Homo sapiens
tgagagcacagcgtttacat

SEQ ID NO: 6456104 - DNA, 14 bp, Homo sapiens
tgagagcagatgcc

SEQ ID NO: 6456105 - DNA, 19 bp, Homo sapiens
tgagagcagggctgggcgc

SEQ ID NO: 6456106 - DNA, 23 bp, Homo sapiens
tgagagcagtttggtttctagca

SEQ ID NO: 6456107 - DNA, 13 bp, Homo sapiens
tgagagcataatt

SEQ ID NO: 6456108 - DNA, 14 bp, Homo sapiens
tgagagccacgctg

SEQ ID NO: 6456109 - DNA, 13 bp, Homo sapiens
tgagagccagcag

SEQ ID NO: 6456110 - DNA, 16 bp, Homo sapiens
tgagagccagcagcaa

SEQ ID NO: 6456111 - DNA, 17 bp, Homo sapiens
tcctccccttccctgca

SEQ ID NO: 6456112 - DNA, 16 bp, Homo sapiens
tcctccccttcctctt

SEQ ID NO: 6456113 - DNA, 15 bp, Homo sapiens
tcctccccttcctgt

SEQ ID NO: 6456114 - DNA, 19 bp, Homo sapiens
tcctccccttcctgtttct

SEQ ID NO: 6456115 - DNA, 13 bp, Homo sapiens
tcctccccttggg

SEQ ID NO: 6456116 - DNA, 22 bp, Homo sapiens
tcctccccttttaccactccca

SEQ ID NO: 6456117 - DNA, 18 bp, Homo sapiens
tcctccccttttgccccc

SEQ ID NO: 6456118 - DNA, 19 bp, Homo sapiens
tcctccccttttgcccccg

SEQ ID NO: 6456119 - DNA, 20 bp, Homo sapiens
tcctcccgaaaaatgtgtgg

SEQ ID NO: 6456120 - DNA, 18 bp, Homo sapiens
tcctcccgcccttccatg

SEQ ID NO: 6456121 - DNA, 16 bp, Homo sapiens
tcctcccgggccctcc

SEQ ID NO: 6456122 - DNA, 14 bp, Homo sapiens
tcctcccggggcct

SEQ ID NO: 6456123 - DNA, 17 bp, Homo sapiens
tcctcccggggccttcc

SEQ ID NO: 6456124 - DNA, 13 bp, Homo sapiens
tcctccctatcaa

SEQ ID NO: 6456125 - DNA, 14 bp, Homo sapiens
tcctccctcagacc

SEQ ID NO: 6456126 - DNA, 15 bp, Homo sapiens
tcctccctcagaccc

SEQ ID NO: 6456127 - DNA, 17 bp, Homo sapiens
tcctccctcagacccag

SEQ ID NO: 6456128 - DNA, 20 bp, Homo sapiens
tcctccctcagactcagagg

SEQ ID NO: 6456129 - DNA, 15 bp, Homo sapiens
tcctccctcagcctc

SEQ ID NO: 6456130 - DNA, 20 bp, Homo sapiens
tcctccctcagcctcccctt

SEQ ID NO: 6456131 - DNA, 12 bp, Homo sapiens
tcctccctcagg

SEQ ID NO: 6456132 - DNA, 19 bp, Homo sapiens
tcctccctcaggcccagga

SEQ ID NO: 6456133 - DNA, 19 bp, Homo sapiens
tcctccctcatggctctgg

SEQ ID NO: 6456134 - DNA, 20 bp, Homo sapiens
tcctccctcatggctctggc

SEQ ID NO: 6456135 - DNA, 18 bp, Homo sapiens
tcctccctcattcatctt

SEQ ID NO: 6456136 - DNA, 20 bp, Homo sapiens
tcctccctccaagcctggca

SEQ ID NO: 6456137 - DNA, 15 bp, Homo sapiens
tcctccctcccagct

SEQ ID NO: 6456138 - DNA, 16 bp, Homo sapiens
tcctccctccctccct

SEQ ID NO: 6456139 - DNA, 14 bp, Homo sapiens
tcctccctcctcac

SEQ ID NO: 6456140 - DNA, 17 bp, Homo sapiens
tcctccctcctgcaggc

SEQ ID NO: 6456141 - DNA, 18 bp, Homo sapiens
tcctccctgacttttctg

SEQ ID NO: 6456142 - DNA, 15 bp, Homo sapiens
tcctccctgatgtac

SEQ ID NO: 6456143 - DNA, 22 bp, Homo sapiens
tcctccctgcatctgaccagca

SEQ ID NO: 6456144 - DNA, 15 bp, Homo sapiens
tcctccctgcccatc

SEQ ID NO: 6456145 - DNA, 16 bp, Homo sapiens
tcctccctgcccatcc

SEQ ID NO: 6456146 - DNA, 13 bp, Homo sapiens
tcctccctgcccc

SEQ ID NO: 6456147 - DNA, 13 bp, Homo sapiens
tcctccctgcctc

SEQ ID NO: 6456148 - DNA, 20 bp, Homo sapiens
tcctccctgcctcagtggct

SEQ ID NO: 6456149 - DNA, 15 bp, Homo sapiens
tcctccctgcctggc

SEQ ID NO: 6456150 - DNA, 14 bp, Homo sapiens
tcctccctgctcag

SEQ ID NO: 6456151 - DNA, 16 bp, Homo sapiens
tcctccctgctcagct

SEQ ID NO: 6456152 - DNA, 13 bp, Homo sapiens
tcctccctgctcc

SEQ ID NO: 6456153 - DNA, 15 bp, Homo sapiens
tcctccctgctcctc

SEQ ID NO: 6456154 - DNA, 16 bp, Homo sapiens
tcctccctgctcctca

SEQ ID NO: 6456155 - DNA, 17 bp, Homo sapiens
tcctccctgctcctcat

SEQ ID NO: 6456156 - DNA, 19 bp, Homo sapiens
tcctccctggctgcagcct

SEQ ID NO: 6456157 - DNA, 18 bp, Homo sapiens
tcctccctggctgccctg

SEQ ID NO: 6456158 - DNA, 21 bp, Homo sapiens
tcctccctggctgccctggcc

SEQ ID NO: 6456159 - DNA, 15 bp, Homo sapiens
tcctccctgggggcg

SEQ ID NO: 6456160 - DNA, 15 bp, Homo sapiens
tcctccctgtaactt

SEQ ID NO: 6456161 - DNA, 21 bp, Homo sapiens
tcctccctgtgcccccagcct

SEQ ID NO: 6456162 - DNA, 13 bp, Homo sapiens
tcctccctgttat

SEQ ID NO: 6456163 - DNA, 19 bp, Homo sapiens
tcctcccttaccctcctct

SEQ ID NO: 6456164 - DNA, 10 bp, Homo sapiens
tcctcccttc

SEQ ID NO: 6456165 - DNA, 13 bp, Homo sapiens
tcctcccttcccc

SEQ ID NO: 6456166 - DNA, 14 bp, Homo sapiens
tcctcccttcctcc

SEQ ID NO: 6456167 - DNA, 16 bp, Homo sapiens
tcctcccttctgctac

SEQ ID NO: 6456168 - DNA, 16 bp, Homo sapiens
tcctcccttgttctct

SEQ ID NO: 6456169 - DNA, 18 bp, Homo sapiens
tcctccctttccttccta

SEQ ID NO: 6456170 - DNA, 23 bp, Homo sapiens
tcctccgagccggggagtttctt

SEQ ID NO: 6456171 - DNA, 15 bp, Homo sapiens
tcctccgcatgccaa

SEQ ID NO: 6456172 - DNA, 15 bp, Homo sapiens
tcctccgctcccctt

SEQ ID NO: 6456173 - DNA, 17 bp, Homo sapiens
tcctccgctcccctttc

SEQ ID NO: 6456174 - DNA, 14 bp, Homo sapiens
tcctccggctggac

SEQ ID NO: 6456175 - DNA, 15 bp, Homo sapiens
tcctccggggctcag

SEQ ID NO: 6456176 - DNA, 19 bp, Homo sapiens
tcctccggggctcagccct

SEQ ID NO: 6456177 - DNA, 15 bp, Homo sapiens
tcctccgtagggtct

SEQ ID NO: 6456178 - DNA, 17 bp, Homo sapiens
tcctccgtcacctcaga

SEQ ID NO: 6456179 - DNA, 19 bp, Homo sapiens
tcctccgtccacccaggct

SEQ ID NO: 6456180 - DNA, 20 bp, Homo sapiens
tcctccgtccacccaggctg

SEQ ID NO: 6456181 - DNA, 23 bp, Homo sapiens
tcctccgtccacccaggctgcac

SEQ ID NO: 6456182 - DNA, 16 bp, Homo sapiens
tcctccgtccagccgc

SEQ ID NO: 6456183 - DNA, 15 bp, Homo sapiens
tcctccgtctgaccc

SEQ ID NO: 6456184 - DNA, 15 bp, Homo sapiens
tcctccgtgaaaata

SEQ ID NO: 6456185 - DNA, 18 bp, Homo sapiens
tcctccgtgcttcctcag

SEQ ID NO: 6456186 - DNA, 14 bp, Homo sapiens
tcctccgtgggcag

SEQ ID NO: 6456187 - DNA, 20 bp, Homo sapiens
tcctcctaagtcccttccta

SEQ ID NO: 6456188 - DNA, 14 bp, Homo sapiens
tcctcctacctcag

SEQ ID NO: 6456189 - DNA, 14 bp, Homo sapiens
tcctcctacctggg

SEQ ID NO: 6456190 - DNA, 21 bp, Homo sapiens
tcctcctacctggggactcct

SEQ ID NO: 6456191 - DNA, 20 bp, Homo sapiens
tcctcctagaaaacccttcc

SEQ ID NO: 6456192 - DNA, 21 bp, Homo sapiens
tcctcctagaaaacccttccc

SEQ ID NO: 6456193 - DNA, 18 bp, Homo sapiens
tcctcctagaactccagt

SEQ ID NO: 6456194 - DNA, 17 bp, Homo sapiens
tcctcctagctggagtg

SEQ ID NO: 6456195 - DNA, 20 bp, Homo sapiens
tcctcctatctccctggctc

SEQ ID NO: 6456196 - DNA, 22 bp, Homo sapiens
tcctcctcacccacctctgggt

SEQ ID NO: 6456197 - DNA, 13 bp, Homo sapiens
tcctcctcaccct

SEQ ID NO: 6456198 - DNA, 17 bp, Homo sapiens
tcctcctcacccttccc

SEQ ID NO: 6456199 - DNA, 12 bp, Homo sapiens
tcctcctcacct

SEQ ID NO: 6456200 - DNA, 16 bp, Homo sapiens
tcctcctcacctcatg

SEQ ID NO: 6456201 - DNA, 12 bp, Homo sapiens
tcctcctcagat

SEQ ID NO: 6456202 - DNA, 12 bp, Homo sapiens
tcctcctcaggc

SEQ ID NO: 6456203 - DNA, 13 bp, Homo sapiens
tcctcctccacag

SEQ ID NO: 6456204 - DNA, 14 bp, Homo sapiens
tcctcctccaccac

SEQ ID NO: 6456205 - DNA, 15 bp, Homo sapiens
tcctcctccacccac

SEQ ID NO: 6456206 - DNA, 13 bp, Homo sapiens
tcctcctccaggg

SEQ ID NO: 6456207 - DNA, 14 bp, Homo sapiens
tcctcctccaggga

SEQ ID NO: 6456208 - DNA, 11 bp, Homo sapiens
tcctcctccat

SEQ ID NO: 6456209 - DNA, 15 bp, Homo sapiens
tcctcctccatctca

SEQ ID NO: 6456210 - DNA, 14 bp, Homo sapiens
tcctcctcccaccc

SEQ ID NO: 6456211 - DNA, 20 bp, Homo sapiens
tcctcctcccacccggctgc

SEQ ID NO: 6456212 - DNA, 13 bp, Homo sapiens
tcctcctccccag

SEQ ID NO: 6456213 - DNA, 16 bp, Homo sapiens
tcctcctcccctcctc

SEQ ID NO: 6456214 - DNA, 17 bp, Homo sapiens
tcctcctccctgcatct

SEQ ID NO: 6456215 - DNA, 16 bp, Homo sapiens
tcctcctccttcctag

SEQ ID NO: 6456216 - DNA, 14 bp, Homo sapiens
tcctcctcctttct

SEQ ID NO: 6456217 - DNA, 20 bp, Homo sapiens
tcctcctcgctcctccttcc

SEQ ID NO: 6456218 - DNA, 21 bp, Homo sapiens
tcctcctcgctcctccttccc

SEQ ID NO: 6456219 - DNA, 17 bp, Homo sapiens
tcctcctctccatgcaa

SEQ ID NO: 6456220 - DNA, 17 bp, Homo sapiens
tcctcctctgaggaagc

SEQ ID NO: 6456221 - DNA, 21 bp, Homo sapiens
tcctcctctgaggaagcagtt

SEQ ID NO: 6456222 - DNA, 12 bp, Homo sapiens
tcctcctctgcc

SEQ ID NO: 6456223 - DNA, 15 bp, Homo sapiens
tcctcctctgcctac

SEQ ID NO: 6456224 - DNA, 11 bp, Homo sapiens
tcctcctctgt

SEQ ID NO: 6456225 - DNA, 13 bp, Homo sapiens
tcctcctctgtga

SEQ ID NO: 6456226 - DNA, 14 bp, Homo sapiens
tcctcctctttctc

SEQ ID NO: 6456227 - DNA, 15 bp, Homo sapiens
tcctcctctttctct

SEQ ID NO: 6456228 - DNA, 16 bp, Homo sapiens
tcctcctgaagcctct

SEQ ID NO: 6456229 - DNA, 24 bp, Homo sapiens
tcctcctgaagcctctgccctgcc

SEQ ID NO: 6456230 - DNA, 16 bp, Homo sapiens
tcctcctgacacccca

SEQ ID NO: 6456231 - DNA, 18 bp, Homo sapiens
tcctcctgacaccccact

SEQ ID NO: 6456232 - DNA, 22 bp, Homo sapiens
tcctcctgagtgatcccatttc

SEQ ID NO: 6456233 - DNA, 18 bp, Homo sapiens
tcctcctgatggagtgtg

SEQ ID NO: 6456234 - DNA, 20 bp, Homo sapiens
tcctcctgatggccaagagc

SEQ ID NO: 6456235 - DNA, 23 bp, Homo sapiens
tcctcctgcccccaccccaggct

SEQ ID NO: 6456236 - DNA, 16 bp, Homo sapiens
tcctcctgccctccgc

SEQ ID NO: 6456237 - DNA, 15 bp, Homo sapiens
tcctcctgcctttct

SEQ ID NO: 6456238 - DNA, 17 bp, Homo sapiens
tcctcctgcctttctca

SEQ ID NO: 6456239 - DNA, 10 bp, Homo sapiens
tcctcctgct

SEQ ID NO: 6456240 - DNA, 12 bp, Homo sapiens
tcctcctgctca

SEQ ID NO: 6456241 - DNA, 17 bp, Homo sapiens
tcctcctgctctgcttc

SEQ ID NO: 6456242 - DNA, 13 bp, Homo sapiens
tcctcctgctgct

SEQ ID NO: 6456243 - DNA, 14 bp, Homo sapiens
tcctcctgctgctc

SEQ ID NO: 6456244 - DNA, 15 bp, Homo sapiens
tcctcctgctgctca

SEQ ID NO: 6456245 - DNA, 12 bp, Homo sapiens
tcctcctgctgt

SEQ ID NO: 6456246 - DNA, 13 bp, Homo sapiens
tcctcctgctgta

SEQ ID NO: 6456247 - DNA, 18 bp, Homo sapiens
tcctcctggaaccttgct

SEQ ID NO: 6456248 - DNA, 20 bp, Homo sapiens
tcctcctggaaccttgctgt

SEQ ID NO: 6456249 - DNA, 21 bp, Homo sapiens
tcctcctggaaccttgctgtc

SEQ ID NO: 6456250 - DNA, 13 bp, Homo sapiens
tcctcctggaagg

SEQ ID NO: 6456251 - DNA, 23 bp, Homo sapiens
tcctcctggacccagcaggggca

SEQ ID NO: 6456252 - DNA, 13 bp, Homo sapiens
tcctcctggcaga

SEQ ID NO: 6456253 - DNA, 14 bp, Homo sapiens
tcctcctgggccct

SEQ ID NO: 6456254 - DNA, 16 bp, Homo sapiens
tcctcctgggggctgg

SEQ ID NO: 6456255 - DNA, 17 bp, Homo sapiens
tcctcctgggggctggc

SEQ ID NO: 6456256 - DNA, 16 bp, Homo sapiens
tcctcctgtattcctg

SEQ ID NO: 6456257 - DNA, 19 bp, Homo sapiens
tcctcctgtctcctctgtc

SEQ ID NO: 6456258 - DNA, 17 bp, Homo sapiens
tcctcctgttcctgcct

SEQ ID NO: 6456259 - DNA, 19 bp, Homo sapiens
tcctcctgttcctgccttc

SEQ ID NO: 6456260 - DNA, 20 bp, Homo sapiens
tcctcctgttcctgccttct

SEQ ID NO: 6456261 - DNA, 19 bp, Homo sapiens
tcctccttcactccctgtc

SEQ ID NO: 6456262 - DNA, 17 bp, Homo sapiens
tcctccttccagatgcc

SEQ ID NO: 6456263 - DNA, 11 bp, Homo sapiens
tcctccttccc

SEQ ID NO: 6456264 - DNA, 12 bp, Homo sapiens
tcctccttccca

SEQ ID NO: 6456265 - DNA, 14 bp, Homo sapiens
tcctccttcccagc

SEQ ID NO: 6456266 - DNA, 15 bp, Homo sapiens
tcctccttcccagct

SEQ ID NO: 6456267 - DNA, 15 bp, Homo sapiens
tcctccttcccaggg

SEQ ID NO: 6456268 - DNA, 16 bp, Homo sapiens
tcctccttcccaggga

SEQ ID NO: 6456269 - DNA, 12 bp, Homo sapiens
tcctccttcccc

SEQ ID NO: 6456270 - DNA, 23 bp, Homo sapiens
tcctccttccccccatctctgag

SEQ ID NO: 6456271 - DNA, 15 bp, Homo sapiens
tcctccttcccctgt

SEQ ID NO: 6456272 - DNA, 14 bp, Homo sapiens
tcctccttcctcat

SEQ ID NO: 6456273 - DNA, 15 bp, Homo sapiens
tcctccttcctcatc

SEQ ID NO: 6456274 - DNA, 16 bp, Homo sapiens
tcctccttcctcatcc

SEQ ID NO: 6456275 - DNA, 15 bp, Homo sapiens
tcctccttcctggga

SEQ ID NO: 6456276 - DNA, 16 bp, Homo sapiens
tcctccttcctgggac

SEQ ID NO: 6456277 - DNA, 23 bp, Homo sapiens
tcctccttgcccagactacaggg

SEQ ID NO: 6456278 - DNA, 14 bp, Homo sapiens
tcctccttgctgat

SEQ ID NO: 6456279 - DNA, 16 bp, Homo sapiens
tcctcctttcctcctc

SEQ ID NO: 6456280 - DNA, 13 bp, Homo sapiens
tcctcctttctcc

SEQ ID NO: 6456281 - DNA, 14 bp, Homo sapiens
tcctcctttctctg

SEQ ID NO: 6456282 - DNA, 15 bp, Homo sapiens
tcctcctttctctgt

SEQ ID NO: 6456283 - DNA, 17 bp, Homo sapiens
tcctcctttctgagggc

SEQ ID NO: 6456284 - DNA, 14 bp, Homo sapiens
tcctcctttttcca

SEQ ID NO: 6456285 - DNA, 15 bp, Homo sapiens
tcctcgaacccactc

SEQ ID NO: 6456286 - DNA, 14 bp, Homo sapiens
tcctcgaagccatg

SEQ ID NO: 6456287 - DNA, 21 bp, Homo sapiens
tcctcgaattttatctgtgga

SEQ ID NO: 6456288 - DNA, 21 bp, Homo sapiens
tcctcgacttatcaccacacc

SEQ ID NO: 6456289 - DNA, 22 bp, Homo sapiens
tcctcgatggtaatacccgtcc

SEQ ID NO: 6456290 - DNA, 17 bp, Homo sapiens
tcctcgcacagggcatg

SEQ ID NO: 6456291 - DNA, 14 bp, Homo sapiens
tcctcgcagagagg

SEQ ID NO: 6456292 - DNA, 16 bp, Homo sapiens
tcctcgcagatgataa

SEQ ID NO: 6456293 - DNA, 19 bp, Homo sapiens
tcctcgcagcctctcagtg

SEQ ID NO: 6456294 - DNA, 14 bp, Homo sapiens
tgagagccagtggc

SEQ ID NO: 6456295 - DNA, 16 bp, Homo sapiens
tgagagcccagaggta

SEQ ID NO: 6456296 - DNA, 20 bp, Homo sapiens
tgagagcccagaggtaacag

SEQ ID NO: 6456297 - DNA, 16 bp, Homo sapiens
tgagagccccagctga

SEQ ID NO: 6456298 - DNA, 19 bp, Homo sapiens
tgagagccccagctgacat

SEQ ID NO: 6456299 - DNA, 22 bp, Homo sapiens
tgagagccccagctgacatgga

SEQ ID NO: 6456300 - DNA, 12 bp, Homo sapiens
tgagagccccca

SEQ ID NO: 6456301 - DNA, 16 bp, Homo sapiens
tgagagcccccacctt

SEQ ID NO: 6456302 - DNA, 15 bp, Homo sapiens
tgagagccccttggt

SEQ ID NO: 6456303 - DNA, 17 bp, Homo sapiens
tgagagccctgctgtgg

SEQ ID NO: 6456304 - DNA, 22 bp, Homo sapiens
tgagagccctgctgtgggagag

SEQ ID NO: 6456305 - DNA, 12 bp, Homo sapiens
tgagagcctgtg

SEQ ID NO: 6456306 - DNA, 15 bp, Homo sapiens
tgagagcgacacaga

SEQ ID NO: 6456307 - DNA, 16 bp, Homo sapiens
tgagagcgagatggga

SEQ ID NO: 6456308 - DNA, 15 bp, Homo sapiens
tgagagctaatttaa

SEQ ID NO: 6456309 - DNA, 19 bp, Homo sapiens
tgagagctcagcctgcctg

SEQ ID NO: 6456310 - DNA, 16 bp, Homo sapiens
tgagagctgcatgtgt

SEQ ID NO: 6456311 - DNA, 16 bp, Homo sapiens
tgagagctgctctgga

SEQ ID NO: 6456312 - DNA, 14 bp, Homo sapiens
tgagagctgggtgt

SEQ ID NO: 6456313 - DNA, 13 bp, Homo sapiens
tgagagctgttcc

SEQ ID NO: 6456314 - DNA, 16 bp, Homo sapiens
tgagagctttctgcct

SEQ ID NO: 6456315 - DNA, 14 bp, Homo sapiens
tgagagctttgctt

SEQ ID NO: 6456316 - DNA, 14 bp, Homo sapiens
tgagaggaaatcac

SEQ ID NO: 6456317 - DNA, 16 bp, Homo sapiens
tgagaggaaatgttga

SEQ ID NO: 6456318 - DNA, 15 bp, Homo sapiens
tgagaggaacaagaa

SEQ ID NO: 6456319 - DNA, 21 bp, Homo sapiens
tgagaggaagatgaagagaag

SEQ ID NO: 6456320 - DNA, 16 bp, Homo sapiens
tgagaggacactcccg

SEQ ID NO: 6456321 - DNA, 20 bp, Homo sapiens
tgagaggaggacttggttga

SEQ ID NO: 6456322 - DNA, 20 bp, Homo sapiens
tgagaggaggcagcaggact

SEQ ID NO: 6456323 - DNA, 21 bp, Homo sapiens
tgagaggaggggtaaatatat

SEQ ID NO: 6456324 - DNA, 23 bp, Homo sapiens
tgagaggaggggtaaatatatgt

SEQ ID NO: 6456325 - DNA, 15 bp, Homo sapiens
tgagaggatgaatgt

SEQ ID NO: 6456326 - DNA, 23 bp, Homo sapiens
tgagaggatgaatgtatgtgcac

SEQ ID NO: 6456327 - DNA, 18 bp, Homo sapiens
tgagaggcaccagtccag

SEQ ID NO: 6456328 - DNA, 14 bp, Homo sapiens
tgagaggcagaagt

SEQ ID NO: 6456329 - DNA, 19 bp, Homo sapiens
tgagaggcagctatctgca

SEQ ID NO: 6456330 - DNA, 14 bp, Homo sapiens
tgagaggcaggaat

SEQ ID NO: 6456331 - DNA, 15 bp, Homo sapiens
tgagaggcaggaatg

SEQ ID NO: 6456332 - DNA, 23 bp, Homo sapiens
tgagaggcaggaatgggggtcag

SEQ ID NO: 6456333 - DNA, 12 bp, Homo sapiens
tgagaggcaggc

SEQ ID NO: 6456334 - DNA, 14 bp, Homo sapiens
tgagaggcaggcat

SEQ ID NO: 6456335 - DNA, 23 bp, Homo sapiens
tgagaggcatccagtatcttgaa

SEQ ID NO: 6456336 - DNA, 20 bp, Homo sapiens
tgagaggcatgacagctgtt

SEQ ID NO: 6456337 - DNA, 15 bp, Homo sapiens
tgagaggcccccacc

SEQ ID NO: 6456338 - DNA, 20 bp, Homo sapiens
tgagaggcccccacccttgg

SEQ ID NO: 6456339 - DNA, 23 bp, Homo sapiens
tgagaggccctggatcagcgtgg

SEQ ID NO: 6456340 - DNA, 13 bp, Homo sapiens
tgagaggcctgga

SEQ ID NO: 6456341 - DNA, 17 bp, Homo sapiens
tgagaggcctggagccc

SEQ ID NO: 6456342 - DNA, 22 bp, Homo sapiens
tgagaggcgagtcaccctcctc

SEQ ID NO: 6456343 - DNA, 14 bp, Homo sapiens
tgagaggctgaggt

SEQ ID NO: 6456344 - DNA, 19 bp, Homo sapiens
tgagaggctgggaatggag

SEQ ID NO: 6456345 - DNA, 19 bp, Homo sapiens
tgagaggctgtctgttgta

SEQ ID NO: 6456346 - DNA, 22 bp, Homo sapiens
tgagagggctcgaggggtgggc

SEQ ID NO: 6456347 - DNA, 17 bp, Homo sapiens
tgagagggctgtggctg

SEQ ID NO: 6456348 - DNA, 14 bp, Homo sapiens
tgagaggggaacag

SEQ ID NO: 6456349 - DNA, 19 bp, Homo sapiens
tgagaggggaacagactgg

SEQ ID NO: 6456350 - DNA, 12 bp, Homo sapiens
tgagaggggaag

SEQ ID NO: 6456351 - DNA, 17 bp, Homo sapiens
tgagaggggaggccaag

SEQ ID NO: 6456352 - DNA, 16 bp, Homo sapiens
tgagaggggagggagg

SEQ ID NO: 6456353 - DNA, 16 bp, Homo sapiens
tgagaggggagggctc

SEQ ID NO: 6456354 - DNA, 19 bp, Homo sapiens
tgagaggggagggctcctg

SEQ ID NO: 6456355 - DNA, 22 bp, Homo sapiens
tgagaggggagggctcctgggg

SEQ ID NO: 6456356 - DNA, 23 bp, Homo sapiens
tgagaggggagggctcctggggc

SEQ ID NO: 6456357 - DNA, 18 bp, Homo sapiens
tgagaggggctgtccagt

SEQ ID NO: 6456358 - DNA, 20 bp, Homo sapiens
tgagagggtgtgggtgccct

SEQ ID NO: 6456359 - DNA, 19 bp, Homo sapiens
tgagaggtagccgggctct

SEQ ID NO: 6456360 - DNA, 18 bp, Homo sapiens
tgagaggtggcttttgcg

SEQ ID NO: 6456361 - DNA, 19 bp, Homo sapiens
tgagaggtgggggatgctg

SEQ ID NO: 6456362 - DNA, 14 bp, Homo sapiens
tgagaggtttgact

SEQ ID NO: 6456363 - DNA, 22 bp, Homo sapiens
tgagagtaattcatctgtgaat

SEQ ID NO: 6456364 - DNA, 22 bp, Homo sapiens
tgagagtacaggtgcatattaa

SEQ ID NO: 6456365 - DNA, 15 bp, Homo sapiens
tgagagtagggccct

SEQ ID NO: 6456366 - DNA, 17 bp, Homo sapiens
tgagagtatcaggtctc

SEQ ID NO: 6456367 - DNA, 16 bp, Homo sapiens
tgagagtcaaagctga

SEQ ID NO: 6456368 - DNA, 17 bp, Homo sapiens
tgagagtcagctctctg

SEQ ID NO: 6456369 - DNA, 19 bp, Homo sapiens
tgagagtcagctctctgcc

SEQ ID NO: 6456370 - DNA, 16 bp, Homo sapiens
tgagagtcatctcaaa

SEQ ID NO: 6456371 - DNA, 20 bp, Homo sapiens
tgagagtcatctcaaacact

SEQ ID NO: 6456372 - DNA, 14 bp, Homo sapiens
tgagagtctagatt

SEQ ID NO: 6456373 - DNA, 16 bp, Homo sapiens
tgagagtctagattct

SEQ ID NO: 6456374 - DNA, 17 bp, Homo sapiens
tgagagtctagattctc

SEQ ID NO: 6456375 - DNA, 19 bp, Homo sapiens
tgagagtctagcactcatt

SEQ ID NO: 6456376 - DNA, 20 bp, Homo sapiens
tgagagtctgaaagacagaa

SEQ ID NO: 6456377 - DNA, 20 bp, Homo sapiens
tgagagtctgcacttaacaa

SEQ ID NO: 6456378 - DNA, 18 bp, Homo sapiens
tgagagtgacggctggca

SEQ ID NO: 6456379 - DNA, 13 bp, Homo sapiens
tgagagtgaggcc

SEQ ID NO: 6456380 - DNA, 23 bp, Homo sapiens
tgagagtggggctagactgggct

SEQ ID NO: 6456381 - DNA, 21 bp, Homo sapiens
tgagagtggtacaagggagaa

SEQ ID NO: 6456382 - DNA, 12 bp, Homo sapiens
tgagagtgtgac

SEQ ID NO: 6456383 - DNA, 17 bp, Homo sapiens
tgagagtgtgagcaggg

SEQ ID NO: 6456384 - DNA, 16 bp, Homo sapiens
tgagagtgttcctgag

SEQ ID NO: 6456385 - DNA, 19 bp, Homo sapiens
tgagagttccggggagaaa

SEQ ID NO: 6456386 - DNA, 18 bp, Homo sapiens
tgagagttccttctcact

SEQ ID NO: 6456387 - DNA, 14 bp, Homo sapiens
tgagagttggctca

SEQ ID NO: 6456388 - DNA, 21 bp, Homo sapiens
tgagagttggctcaggcagac

SEQ ID NO: 6456389 - DNA, 14 bp, Homo sapiens
tgagagttgtctct

SEQ ID NO: 6456390 - DNA, 12 bp, Homo sapiens
tgagagtttcct

SEQ ID NO: 6456391 - DNA, 16 bp, Homo sapiens
tgagagtttcctcaga

SEQ ID NO: 6456392 - DNA, 15 bp, Homo sapiens
tgagagttttggatg

SEQ ID NO: 6456393 - DNA, 17 bp, Homo sapiens
tgagataaatatcatta

SEQ ID NO: 6456394 - DNA, 19 bp, Homo sapiens
tgagatacaaggcccagaa

SEQ ID NO: 6456395 - DNA, 21 bp, Homo sapiens
tgagatacaaggcccagaagc

SEQ ID NO: 6456396 - DNA, 13 bp, Homo sapiens
tgagatacactga

SEQ ID NO: 6456397 - DNA, 14 bp, Homo sapiens
tgagatacatacag

SEQ ID NO: 6456398 - DNA, 15 bp, Homo sapiens
tgagatacatacaga

SEQ ID NO: 6456399 - DNA, 18 bp, Homo sapiens
tgagataccacaaaccct

SEQ ID NO: 6456400 - DNA, 22 bp, Homo sapiens
tgagataccacaaaccctgctg

SEQ ID NO: 6456401 - DNA, 21 bp, Homo sapiens
tgagataccagcgaggaggct

SEQ ID NO: 6456402 - DNA, 16 bp, Homo sapiens
tgagatactgtgtata

SEQ ID NO: 6456403 - DNA, 21 bp, Homo sapiens
tgagatactttgcattgtctg

SEQ ID NO: 6456404 - DNA, 15 bp, Homo sapiens
tgagatactttttct

SEQ ID NO: 6456405 - DNA, 21 bp, Homo sapiens
tgagatactttttcttttgta

SEQ ID NO: 6456406 - DNA, 19 bp, Homo sapiens
tgagatagaagaactgcaa

SEQ ID NO: 6456407 - DNA, 18 bp, Homo sapiens
tgagatagaatacatgta

SEQ ID NO: 6456408 - DNA, 18 bp, Homo sapiens
tgagatagcattgtgaac

SEQ ID NO: 6456409 - DNA, 19 bp, Homo sapiens
tgagatagcattgtgaact

SEQ ID NO: 6456410 - DNA, 16 bp, Homo sapiens
tgagatagttttcatt

SEQ ID NO: 6456411 - DNA, 20 bp, Homo sapiens
tgagatatgcaataaatatt

SEQ ID NO: 6456412 - DNA, 12 bp, Homo sapiens
tgagatattaaa

SEQ ID NO: 6456413 - DNA, 22 bp, Homo sapiens
tgagatattaaagattggaatg

SEQ ID NO: 6456414 - DNA, 16 bp, Homo sapiens
tgagatattaaattct

SEQ ID NO: 6456415 - DNA, 20 bp, Homo sapiens
tgagatattgggacacacat

SEQ ID NO: 6456416 - DNA, 21 bp, Homo sapiens
tgagatcaaaaaaatatatga

SEQ ID NO: 6456417 - DNA, 13 bp, Homo sapiens
tgagatcaatgtg

SEQ ID NO: 6456418 - DNA, 18 bp, Homo sapiens
tgagatcacaccactgca

SEQ ID NO: 6456419 - DNA, 16 bp, Homo sapiens
tgagatcacagcctcc

SEQ ID NO: 6456420 - DNA, 14 bp, Homo sapiens
tgagatcaggctct

SEQ ID NO: 6456421 - DNA, 18 bp, Homo sapiens
tgagatcagggcctgccc

SEQ ID NO: 6456422 - DNA, 18 bp, Homo sapiens
tgagatccagagaggctg

SEQ ID NO: 6456423 - DNA, 15 bp, Homo sapiens
tgagatccagcacaa

SEQ ID NO: 6456424 - DNA, 22 bp, Homo sapiens
tgagatcccagagttatttccc

SEQ ID NO: 6456425 - DNA, 18 bp, Homo sapiens
tgagatcccgtctccgaa

SEQ ID NO: 6456426 - DNA, 17 bp, Homo sapiens
tgagatccgtgaattct

SEQ ID NO: 6456427 - DNA, 23 bp, Homo sapiens
tgagatcctcaaaaatcatcaaa

SEQ ID NO: 6456428 - DNA, 20 bp, Homo sapiens
tgagatccttcacaggcagt

SEQ ID NO: 6456429 - DNA, 22 bp, Homo sapiens
tgagatccttcacaggcagtgc

SEQ ID NO: 6456430 - DNA, 20 bp, Homo sapiens
tgagatcgtgctactgcact

SEQ ID NO: 6456431 - DNA, 21 bp, Homo sapiens
tgagatcgtgctactgcactc

SEQ ID NO: 6456432 - DNA, 16 bp, Homo sapiens
tgagatctaaaaataa

SEQ ID NO: 6456433 - DNA, 16 bp, Homo sapiens
tgagatctaagccttt

SEQ ID NO: 6456434 - DNA, 21 bp, Homo sapiens
tgagatctaagcctttccata

SEQ ID NO: 6456435 - DNA, 22 bp, Homo sapiens
tgagatctaagcctttccataa

SEQ ID NO: 6456436 - DNA, 23 bp, Homo sapiens
tgagatctgcacagtcagaagga

SEQ ID NO: 6456437 - DNA, 20 bp, Homo sapiens
tgagatctgtataaataaga

SEQ ID NO: 6456438 - DNA, 17 bp, Homo sapiens
tgagatcttcctgctga

SEQ ID NO: 6456439 - DNA, 18 bp, Homo sapiens
tgagatcttcctgctgag

SEQ ID NO: 6456440 - DNA, 14 bp, Homo sapiens
tgagatctttctaa

SEQ ID NO: 6456441 - DNA, 15 bp, Homo sapiens
tgagatgagagtggg

SEQ ID NO: 6456442 - DNA, 17 bp, Homo sapiens
tgagatgagatgaccac

SEQ ID NO: 6456443 - DNA, 21 bp, Homo sapiens
tgagatgagggatgggcctgg

SEQ ID NO: 6456444 - DNA, 15 bp, Homo sapiens
tgagatgagtttctg

SEQ ID NO: 6456445 - DNA, 21 bp, Homo sapiens
tgagatgatcgtagacacagg

SEQ ID NO: 6456446 - DNA, 18 bp, Homo sapiens
tgagatgattcagaaggg

SEQ ID NO: 6456447 - DNA, 16 bp, Homo sapiens
tgagatgatttccaag

SEQ ID NO: 6456448 - DNA, 15 bp, Homo sapiens
tgagatgatttgtac

SEQ ID NO: 6456449 - DNA, 16 bp, Homo sapiens
tgagatgcaccaagta

SEQ ID NO: 6456450 - DNA, 14 bp, Homo sapiens
tgagatgcagctgg

SEQ ID NO: 6456451 - DNA, 22 bp, Homo sapiens
tgagatgcgttgttacaggaag

SEQ ID NO: 6456452 - DNA, 14 bp, Homo sapiens
tgagatgctaattt

SEQ ID NO: 6456453 - DNA, 17 bp, Homo sapiens
tgagatgctaatttatt

SEQ ID NO: 6456454 - DNA, 21 bp, Homo sapiens
tgagatgctaatttatttccc

SEQ ID NO: 6456455 - DNA, 14 bp, Homo sapiens
tgagatgctagaac

SEQ ID NO: 6456456 - DNA, 16 bp, Homo sapiens
tgagatgctagaactc

SEQ ID NO: 6456457 - DNA, 16 bp, Homo sapiens
tgagatgctggagaag

SEQ ID NO: 6456458 - DNA, 20 bp, Homo sapiens
tgagatgctggagaagagag

SEQ ID NO: 6456459 - DNA, 12 bp, Homo sapiens
tgagatgctggc

SEQ ID NO: 6456460 - DNA, 17 bp, Homo sapiens
tgagatgctggcttggg

SEQ ID NO: 6456461 - DNA, 18 bp, Homo sapiens
tgagatgctgggagggct

SEQ ID NO: 6456462 - DNA, 20 bp, Homo sapiens
tgagatgctgggagggctga

SEQ ID NO: 6456463 - DNA, 17 bp, Homo sapiens
tgagatgctggttttct

SEQ ID NO: 6456464 - DNA, 21 bp, Homo sapiens
tgagatggaaaagtgtccttc

SEQ ID NO: 6456465 - DNA, 21 bp, Homo sapiens
tgagatggaacccttttggcc

SEQ ID NO: 6456466 - DNA, 19 bp, Homo sapiens
tgagatggacttggggcct

SEQ ID NO: 6456467 - DNA, 23 bp, Homo sapiens
tgagatggagtctcgctctgctg

SEQ ID NO: 6456468 - DNA, 17 bp, Homo sapiens
tgagatggagtcttgct

SEQ ID NO: 6456469 - DNA, 17 bp, Homo sapiens
tgagatggatggacaga

SEQ ID NO: 6456470 - DNA, 16 bp, Homo sapiens
tgagatggccatgctc

SEQ ID NO: 6456471 - DNA, 18 bp, Homo sapiens
tgagatggccctctggta

SEQ ID NO: 6456472 - DNA, 14 bp, Homo sapiens
tcctcgcccccacc

SEQ ID NO: 6456473 - DNA, 15 bp, Homo sapiens
tcctcgcccccacca

SEQ ID NO: 6456474 - DNA, 17 bp, Homo sapiens
tcctcgccccccgcccg

SEQ ID NO: 6456475 - DNA, 22 bp, Homo sapiens
tcctcgccccccgcccggcctc

SEQ ID NO: 6456476 - DNA, 22 bp, Homo sapiens
tcctcgcccctcttctctccct

SEQ ID NO: 6456477 - DNA, 20 bp, Homo sapiens
tcctcgctcctccttcccag

SEQ ID NO: 6456478 - DNA, 13 bp, Homo sapiens
tcctcgctctcct

SEQ ID NO: 6456479 - DNA, 13 bp, Homo sapiens
tcctcgctgtgcc

SEQ ID NO: 6456480 - DNA, 14 bp, Homo sapiens
tcctcgctgtgcca

SEQ ID NO: 6456481 - DNA, 15 bp, Homo sapiens
tcctcgctgtgccac

SEQ ID NO: 6456482 - DNA, 19 bp, Homo sapiens
tcctcgctgtgccaccacc

SEQ ID NO: 6456483 - DNA, 14 bp, Homo sapiens
tcctcggaaccgct

SEQ ID NO: 6456484 - DNA, 15 bp, Homo sapiens
tcctcggacacccag

SEQ ID NO: 6456485 - DNA, 16 bp, Homo sapiens
tcctcggatcaccgag

SEQ ID NO: 6456486 - DNA, 19 bp, Homo sapiens
tcctcggcccatctgtcca

SEQ ID NO: 6456487 - DNA, 15 bp, Homo sapiens
tcctcggccccctcc

SEQ ID NO: 6456488 - DNA, 19 bp, Homo sapiens
tcctcggccccctccatcg

SEQ ID NO: 6456489 - DNA, 12 bp, Homo sapiens
tcctcggccctg

SEQ ID NO: 6456490 - DNA, 14 bp, Homo sapiens
tcctcggccctgta

SEQ ID NO: 6456491 - DNA, 15 bp, Homo sapiens
tcctcggcctggctc

SEQ ID NO: 6456492 - DNA, 22 bp, Homo sapiens
tcctcgggatgaaaagccatat

SEQ ID NO: 6456493 - DNA, 14 bp, Homo sapiens
tcctcgggcccctg

SEQ ID NO: 6456494 - DNA, 19 bp, Homo sapiens
tcctcgggcccctgagcct

SEQ ID NO: 6456495 - DNA, 21 bp, Homo sapiens
tcctcgggccctgtggtgctg

SEQ ID NO: 6456496 - DNA, 15 bp, Homo sapiens
tcctcgggcgcctgc

SEQ ID NO: 6456497 - DNA, 15 bp, Homo sapiens
tcctcggtactccca

SEQ ID NO: 6456498 - DNA, 16 bp, Homo sapiens
tcctcggtactcccat

SEQ ID NO: 6456499 - DNA, 14 bp, Homo sapiens
tcctcggtcgcccc

SEQ ID NO: 6456500 - DNA, 22 bp, Homo sapiens
tcctcggtctcccttccgtcca

SEQ ID NO: 6456501 - DNA, 23 bp, Homo sapiens
tcctcggtctcccttccgtccat

SEQ ID NO: 6456502 - DNA, 20 bp, Homo sapiens
tcctcggtgggccagagctg

SEQ ID NO: 6456503 - DNA, 15 bp, Homo sapiens
tcctcgtgcagagct

SEQ ID NO: 6456504 - DNA, 21 bp, Homo sapiens
tcctcgtggcggggcagcagg

SEQ ID NO: 6456505 - DNA, 17 bp, Homo sapiens
tcctcgtgggtcccaga

SEQ ID NO: 6456506 - DNA, 18 bp, Homo sapiens
tcctcgttcaaaacattc

SEQ ID NO: 6456507 - DNA, 20 bp, Homo sapiens
tcctcgttcaaaacattcca

SEQ ID NO: 6456508 - DNA, 16 bp, Homo sapiens
tcctcgttctccctgg

SEQ ID NO: 6456509 - DNA, 19 bp, Homo sapiens
tcctcgttctccctgggag

SEQ ID NO: 6456510 - DNA, 15 bp, Homo sapiens
tcctcgttgggccgc

SEQ ID NO: 6456511 - DNA, 14 bp, Homo sapiens
tcctctaactcatt

SEQ ID NO: 6456512 - DNA, 20 bp, Homo sapiens
tcctctaagccactcttcca

SEQ ID NO: 6456513 - DNA, 14 bp, Homo sapiens
tcctctaattaaaa

SEQ ID NO: 6456514 - DNA, 22 bp, Homo sapiens
tcctctacctctctcctctccg

SEQ ID NO: 6456515 - DNA, 17 bp, Homo sapiens
tcctctactaacaatca

SEQ ID NO: 6456516 - DNA, 18 bp, Homo sapiens
tcctctactcacagctga

SEQ ID NO: 6456517 - DNA, 18 bp, Homo sapiens
tcctctacttaatgagat

SEQ ID NO: 6456518 - DNA, 19 bp, Homo sapiens
tcctctacttaatgagata

SEQ ID NO: 6456519 - DNA, 16 bp, Homo sapiens
tcctctagaagccaag

SEQ ID NO: 6456520 - DNA, 18 bp, Homo sapiens
tcctctagaagccaaggg

SEQ ID NO: 6456521 - DNA, 19 bp, Homo sapiens
tcctctagaagccaaggga

SEQ ID NO: 6456522 - DNA, 13 bp, Homo sapiens
tcctctagccatc

SEQ ID NO: 6456523 - DNA, 15 bp, Homo sapiens
tcctctagccatccc

SEQ ID NO: 6456524 - DNA, 21 bp, Homo sapiens
tcctctagccatcccttgggg

SEQ ID NO: 6456525 - DNA, 22 bp, Homo sapiens
tcctctagcccactccctgcct

SEQ ID NO: 6456526 - DNA, 14 bp, Homo sapiens
tcctctagctctgg

SEQ ID NO: 6456527 - DNA, 17 bp, Homo sapiens
tcctctagctctggtgg

SEQ ID NO: 6456528 - DNA, 15 bp, Homo sapiens
tcctctagcttttct

SEQ ID NO: 6456529 - DNA, 17 bp, Homo sapiens
tcctctagcttttctat

SEQ ID NO: 6456530 - DNA, 17 bp, Homo sapiens
tcctctaggcaagcagg

SEQ ID NO: 6456531 - DNA, 21 bp, Homo sapiens
tcctctaggcaagcaggacct

SEQ ID NO: 6456532 - DNA, 18 bp, Homo sapiens
tcctctaggccctgtgag

SEQ ID NO: 6456533 - DNA, 19 bp, Homo sapiens
tcctctaggggcagcctcc

SEQ ID NO: 6456534 - DNA, 21 bp, Homo sapiens
tcctctagttgagtttctggc

SEQ ID NO: 6456535 - DNA, 17 bp, Homo sapiens
tcctctatacatctctc

SEQ ID NO: 6456536 - DNA, 22 bp, Homo sapiens
tcctctatactttgttctgttg

SEQ ID NO: 6456537 - DNA, 23 bp, Homo sapiens
tcctctatactttgttctgttgt

SEQ ID NO: 6456538 - DNA, 19 bp, Homo sapiens
tcctctatccttttttcct

SEQ ID NO: 6456539 - DNA, 19 bp, Homo sapiens
tcctctattgatgtacagt

SEQ ID NO: 6456540 - DNA, 11 bp, Homo sapiens
tcctctatttt

SEQ ID NO: 6456541 - DNA, 17 bp, Homo sapiens
tcctctcaaacctggca

SEQ ID NO: 6456542 - DNA, 17 bp, Homo sapiens
tcctctcaaattcagct

SEQ ID NO: 6456543 - DNA, 16 bp, Homo sapiens
tcctctcaccccactc

SEQ ID NO: 6456544 - DNA, 18 bp, Homo sapiens
tcctctcaccccactcct

SEQ ID NO: 6456545 - DNA, 18 bp, Homo sapiens
tcctctcacctctccctc

SEQ ID NO: 6456546 - DNA, 18 bp, Homo sapiens
tcctctcactaaacttta

SEQ ID NO: 6456547 - DNA, 19 bp, Homo sapiens
tcctctcagaactcctgtg

SEQ ID NO: 6456548 - DNA, 16 bp, Homo sapiens
tcctctcagagcctca

SEQ ID NO: 6456549 - DNA, 17 bp, Homo sapiens
tcctctcagagcctcag

SEQ ID NO: 6456550 - DNA, 14 bp, Homo sapiens
tcctctcagcttct

SEQ ID NO: 6456551 - DNA, 18 bp, Homo sapiens
tcctctcagcttctaatt

SEQ ID NO: 6456552 - DNA, 15 bp, Homo sapiens
tcctctcaggctctt

SEQ ID NO: 6456553 - DNA, 16 bp, Homo sapiens
tcctctcaggctgggc

SEQ ID NO: 6456554 - DNA, 22 bp, Homo sapiens
tcctctcatcatttgcattggg

SEQ ID NO: 6456555 - DNA, 17 bp, Homo sapiens
tcctctcatttccagct

SEQ ID NO: 6456556 - DNA, 17 bp, Homo sapiens
tcctctccaattgtaaa

SEQ ID NO: 6456557 - DNA, 22 bp, Homo sapiens
tcctctccacaggagcctctgc

SEQ ID NO: 6456558 - DNA, 15 bp, Homo sapiens
tcctctccaccagac

SEQ ID NO: 6456559 - DNA, 16 bp, Homo sapiens
tcctctccaccctccc

SEQ ID NO: 6456560 - DNA, 17 bp, Homo sapiens
tcctctccacctagtgg

SEQ ID NO: 6456561 - DNA, 18 bp, Homo sapiens
tcctctccactgccttcg

SEQ ID NO: 6456562 - DNA, 11 bp, Homo sapiens
tcctctccaga

SEQ ID NO: 6456563 - DNA, 13 bp, Homo sapiens
tcctctccagaca

SEQ ID NO: 6456564 - DNA, 13 bp, Homo sapiens
tcctctccagccc

SEQ ID NO: 6456565 - DNA, 21 bp, Homo sapiens
tcctctccagccttctctctc

SEQ ID NO: 6456566 - DNA, 14 bp, Homo sapiens
tcctctccaggcac

SEQ ID NO: 6456567 - DNA, 15 bp, Homo sapiens
tcctctccaggcacc

SEQ ID NO: 6456568 - DNA, 18 bp, Homo sapiens
tcctctccatgcaagtgc

SEQ ID NO: 6456569 - DNA, 21 bp, Homo sapiens
tcctctccatgcaagtgctgt

SEQ ID NO: 6456570 - DNA, 19 bp, Homo sapiens
tcctctccattttagccca

SEQ ID NO: 6456571 - DNA, 23 bp, Homo sapiens
tcctctccattttagcccagtgt

SEQ ID NO: 6456572 - DNA, 13 bp, Homo sapiens
tcctctcccatcc

SEQ ID NO: 6456573 - DNA, 14 bp, Homo sapiens
tcctctcccatccc

SEQ ID NO: 6456574 - DNA, 18 bp, Homo sapiens
tcctctcccatccccctg

SEQ ID NO: 6456575 - DNA, 22 bp, Homo sapiens
tcctctcccatccccctgccct

SEQ ID NO: 6456576 - DNA, 23 bp, Homo sapiens
tcctctcccatccccctgccctc

SEQ ID NO: 6456577 - DNA, 17 bp, Homo sapiens
tcctctcccatccttga

SEQ ID NO: 6456578 - DNA, 23 bp, Homo sapiens
tcctctccccagcccagagacat

SEQ ID NO: 6456579 - DNA, 16 bp, Homo sapiens
tcctctcccccttcag

SEQ ID NO: 6456580 - DNA, 21 bp, Homo sapiens
tcctctcccccttcagctcct

SEQ ID NO: 6456581 - DNA, 23 bp, Homo sapiens
tcctctcccctagagccctctcc

SEQ ID NO: 6456582 - DNA, 17 bp, Homo sapiens
tcctctcccctctaagg

SEQ ID NO: 6456583 - DNA, 22 bp, Homo sapiens
tcctctcccctttgtggattct

SEQ ID NO: 6456584 - DNA, 19 bp, Homo sapiens
tcctctcccgtctcgcctg

SEQ ID NO: 6456585 - DNA, 14 bp, Homo sapiens
tcctctccctcaca

SEQ ID NO: 6456586 - DNA, 15 bp, Homo sapiens
tcctctccctcaggg

SEQ ID NO: 6456587 - DNA, 16 bp, Homo sapiens
tcctctccctctctct

SEQ ID NO: 6456588 - DNA, 14 bp, Homo sapiens
tcctctccctgcca

SEQ ID NO: 6456589 - DNA, 15 bp, Homo sapiens
tcctctcccttctta

SEQ ID NO: 6456590 - DNA, 20 bp, Homo sapiens
tcctctcctagccctcctga

SEQ ID NO: 6456591 - DNA, 16 bp, Homo sapiens
tcctctcctcctcagc

SEQ ID NO: 6456592 - DNA, 17 bp, Homo sapiens
tcctctcctcctcagct

SEQ ID NO: 6456593 - DNA, 14 bp, Homo sapiens
tcctctcctcgtcc

SEQ ID NO: 6456594 - DNA, 23 bp, Homo sapiens
tcctctcctctgccctcccttct

SEQ ID NO: 6456595 - DNA, 13 bp, Homo sapiens
tcctctcctgccc

SEQ ID NO: 6456596 - DNA, 13 bp, Homo sapiens
tcctctcctgtct

SEQ ID NO: 6456597 - DNA, 15 bp, Homo sapiens
tcctctccttcccac

SEQ ID NO: 6456598 - DNA, 16 bp, Homo sapiens
tcctctccttgggctc

SEQ ID NO: 6456599 - DNA, 17 bp, Homo sapiens
tcctctcctttgaaacc

SEQ ID NO: 6456600 - DNA, 17 bp, Homo sapiens
tcctctcgagatagttt

SEQ ID NO: 6456601 - DNA, 22 bp, Homo sapiens
tcctctcgagatagttttttct

SEQ ID NO: 6456602 - DNA, 15 bp, Homo sapiens
tcctctcgagcccag

SEQ ID NO: 6456603 - DNA, 16 bp, Homo sapiens
tcctctcggctgccag

SEQ ID NO: 6456604 - DNA, 18 bp, Homo sapiens
tcctctcggctgccaggg

SEQ ID NO: 6456605 - DNA, 17 bp, Homo sapiens
tcctctcggctggaaga

SEQ ID NO: 6456606 - DNA, 20 bp, Homo sapiens
tcctctcggctggaagaaca

SEQ ID NO: 6456607 - DNA, 21 bp, Homo sapiens
tcctctcggctggaagaacat

SEQ ID NO: 6456608 - DNA, 22 bp, Homo sapiens
tcctctcgtagaacctgcgcac

SEQ ID NO: 6456609 - DNA, 14 bp, Homo sapiens
tcctctcgttggta

SEQ ID NO: 6456610 - DNA, 20 bp, Homo sapiens
tcctctcgttggtagttgag

SEQ ID NO: 6456611 - DNA, 21 bp, Homo sapiens
tcctctcgttggtagttgaga

SEQ ID NO: 6456612 - DNA, 17 bp, Homo sapiens
tcctctctaacctcctt

SEQ ID NO: 6456613 - DNA, 18 bp, Homo sapiens
tcctctctaacctccttt

SEQ ID NO: 6456614 - DNA, 14 bp, Homo sapiens
tcctctctaccccc

SEQ ID NO: 6456615 - DNA, 20 bp, Homo sapiens
tcctctctcccaccctaagg

SEQ ID NO: 6456616 - DNA, 21 bp, Homo sapiens
tcctctctcccaccctaaggg

SEQ ID NO: 6456617 - DNA, 14 bp, Homo sapiens
tcctctctccctgc

SEQ ID NO: 6456618 - DNA, 16 bp, Homo sapiens
tcctctctccctgcct

SEQ ID NO: 6456619 - DNA, 10 bp, Homo sapiens
tcctctctct

SEQ ID NO: 6456620 - DNA, 18 bp, Homo sapiens
tcctctctctccctccac

SEQ ID NO: 6456621 - DNA, 21 bp, Homo sapiens
tcctctctctccctctttcta

SEQ ID NO: 6456622 - DNA, 15 bp, Homo sapiens
tcctctctctctctc

SEQ ID NO: 6456623 - DNA, 11 bp, Homo sapiens
tcctctctctg

SEQ ID NO: 6456624 - DNA, 13 bp, Homo sapiens
tcctctctcttgg

SEQ ID NO: 6456625 - DNA, 19 bp, Homo sapiens
tcctctctctttcctccac

SEQ ID NO: 6456626 - DNA, 16 bp, Homo sapiens
tcctctctgagtcaaa

SEQ ID NO: 6456627 - DNA, 13 bp, Homo sapiens
tcctctctgcttc

SEQ ID NO: 6456628 - DNA, 14 bp, Homo sapiens
tcctctctgcttca

SEQ ID NO: 6456629 - DNA, 23 bp, Homo sapiens
tcctctctggggctgtgttttga

SEQ ID NO: 6456630 - DNA, 20 bp, Homo sapiens
tcctctctggtggctgggct

SEQ ID NO: 6456631 - DNA, 12 bp, Homo sapiens
tcctctctgtct

SEQ ID NO: 6456632 - DNA, 13 bp, Homo sapiens
tcctctctgtctg

SEQ ID NO: 6456633 - DNA, 16 bp, Homo sapiens
tcctctcttccacagt

SEQ ID NO: 6456634 - DNA, 17 bp, Homo sapiens
tcctctcttccacagtg

SEQ ID NO: 6456635 - DNA, 14 bp, Homo sapiens
tcctctctttgtgg

SEQ ID NO: 6456636 - DNA, 15 bp, Homo sapiens
tcctctctttgttct

SEQ ID NO: 6456637 - DNA, 19 bp, Homo sapiens
tcctctctttgttctcagc

SEQ ID NO: 6456638 - DNA, 20 bp, Homo sapiens
tcctctcttttttgggggga

SEQ ID NO: 6456639 - DNA, 15 bp, Homo sapiens
tcctctgaaacagct

SEQ ID NO: 6456640 - DNA, 16 bp, Homo sapiens
tcctctgaaacagctg

SEQ ID NO: 6456641 - DNA, 17 bp, Homo sapiens
tcctctgaaacagctgc

SEQ ID NO: 6456642 - DNA, 21 bp, Homo sapiens
tcctctgaatttaattctttc

SEQ ID NO: 6456643 - DNA, 22 bp, Homo sapiens
tcctctgaatttaattctttca

SEQ ID NO: 6456644 - DNA, 18 bp, Homo sapiens
tcctctgaccctccttct

SEQ ID NO: 6456645 - DNA, 16 bp, Homo sapiens
tcctctgactcagggc

SEQ ID NO: 6456646 - DNA, 17 bp, Homo sapiens
tcctctgactcagggct

SEQ ID NO: 6456647 - DNA, 18 bp, Homo sapiens
tcctctgactcagggctc

SEQ ID NO: 6456648 - DNA, 13 bp, Homo sapiens
tcctctgactcca

SEQ ID NO: 6456649 - DNA, 15 bp, Homo sapiens
tcctctgagattcta

SEQ ID NO: 6456650 - DNA, 13 bp, Homo sapiens
tcctctgagccca

SEQ ID NO: 6456651 - DNA, 18 bp, Homo sapiens
tcctctgagcccagctgc

SEQ ID NO: 6456652 - DNA, 16 bp, Homo sapiens
tgagatggctcccagg

SEQ ID NO: 6456653 - DNA, 21 bp, Homo sapiens
tgagatgggagagcaacaagt

SEQ ID NO: 6456654 - DNA, 17 bp, Homo sapiens
tgagatggggataaaat

SEQ ID NO: 6456655 - DNA, 21 bp, Homo sapiens
tgagatggggataaaatgact

SEQ ID NO: 6456656 - DNA, 20 bp, Homo sapiens
tgagatggtatgcacaattc

SEQ ID NO: 6456657 - DNA, 16 bp, Homo sapiens
tgagatggttaaaaag

SEQ ID NO: 6456658 - DNA, 16 bp, Homo sapiens
tgagatgtagaaagtt

SEQ ID NO: 6456659 - DNA, 24 bp, Homo sapiens
tgagatgtgaacacatcagcttgc

SEQ ID NO: 6456660 - DNA, 16 bp, Homo sapiens
tgagatgtgagccttg

SEQ ID NO: 6456661 - DNA, 14 bp, Homo sapiens
tgagatgtgctttg

SEQ ID NO: 6456662 - DNA, 20 bp, Homo sapiens
tgagatgtgctttgctgcac

SEQ ID NO: 6456663 - DNA, 22 bp, Homo sapiens
tgagatgtgctttgctgcacaa

SEQ ID NO: 6456664 - DNA, 17 bp, Homo sapiens
tgagatgtgtatcagtg

SEQ ID NO: 6456665 - DNA, 18 bp, Homo sapiens
tgagatgtgtatcagtgt

SEQ ID NO: 6456666 - DNA, 20 bp, Homo sapiens
tgagatgtgtggactgtggc

SEQ ID NO: 6456667 - DNA, 14 bp, Homo sapiens
tgagatgtgttcac

SEQ ID NO: 6456668 - DNA, 18 bp, Homo sapiens
tgagatgtttaaataaat

SEQ ID NO: 6456669 - DNA, 17 bp, Homo sapiens
tgagatgtttagtagct

SEQ ID NO: 6456670 - DNA, 15 bp, Homo sapiens
tgagatgttttacca

SEQ ID NO: 6456671 - DNA, 14 bp, Homo sapiens
tgagattaattcct

SEQ ID NO: 6456672 - DNA, 16 bp, Homo sapiens
tgagattaattccttt

SEQ ID NO: 6456673 - DNA, 19 bp, Homo sapiens
tgagattacagaggaagtt

SEQ ID NO: 6456674 - DNA, 17 bp, Homo sapiens
tgagattacaggtgtga

SEQ ID NO: 6456675 - DNA, 14 bp, Homo sapiens
tgagattaggctga

SEQ ID NO: 6456676 - DNA, 15 bp, Homo sapiens
tgagattcaagacaa

SEQ ID NO: 6456677 - DNA, 16 bp, Homo sapiens
tgagattcaagacaag

SEQ ID NO: 6456678 - DNA, 20 bp, Homo sapiens
tgagattcaagacaagagct

SEQ ID NO: 6456679 - DNA, 18 bp, Homo sapiens
tgagattcaatattgaat

SEQ ID NO: 6456680 - DNA, 22 bp, Homo sapiens
tgagattcacatgctggctcct

SEQ ID NO: 6456681 - DNA, 22 bp, Homo sapiens
tgagattccagaacgccctgtg

SEQ ID NO: 6456682 - DNA, 20 bp, Homo sapiens
tgagattcctctgtattgtg

SEQ ID NO: 6456683 - DNA, 20 bp, Homo sapiens
tgagattcctgtaaatgtga

SEQ ID NO: 6456684 - DNA, 13 bp, Homo sapiens
tgagattctaaat

SEQ ID NO: 6456685 - DNA, 15 bp, Homo sapiens
tgagattctcaaagg

SEQ ID NO: 6456686 - DNA, 22 bp, Homo sapiens
tgagattctcaaaggagcgagc

SEQ ID NO: 6456687 - DNA, 14 bp, Homo sapiens
tgagattctgaagt

SEQ ID NO: 6456688 - DNA, 18 bp, Homo sapiens
tgagattctgaagtatga

SEQ ID NO: 6456689 - DNA, 13 bp, Homo sapiens
tgagattctggga

SEQ ID NO: 6456690 - DNA, 18 bp, Homo sapiens
tgagattctgggaaaggt

SEQ ID NO: 6456691 - DNA, 22 bp, Homo sapiens
tgagattctggtccctggaaat

SEQ ID NO: 6456692 - DNA, 16 bp, Homo sapiens
tgagattctttaagga

SEQ ID NO: 6456693 - DNA, 22 bp, Homo sapiens
tgagattctttaaggagataga

SEQ ID NO: 6456694 - DNA, 18 bp, Homo sapiens
tgagattgccccaggtct

SEQ ID NO: 6456695 - DNA, 19 bp, Homo sapiens
tgagattgccccaggtctg

SEQ ID NO: 6456696 - DNA, 16 bp, Homo sapiens
tgagattggcatggct

SEQ ID NO: 6456697 - DNA, 17 bp, Homo sapiens
tgagattggcatggctt

SEQ ID NO: 6456698 - DNA, 21 bp, Homo sapiens
tgagattggtcattaaatact

SEQ ID NO: 6456699 - DNA, 13 bp, Homo sapiens
tgagattgtgttt

SEQ ID NO: 6456700 - DNA, 23 bp, Homo sapiens
tgagattgttttctttttctacc

SEQ ID NO: 6456701 - DNA, 22 bp, Homo sapiens
tgagatttaagttcctgctgcc

SEQ ID NO: 6456702 - DNA, 19 bp, Homo sapiens
tgagatttagggttctata

SEQ ID NO: 6456703 - DNA, 17 bp, Homo sapiens
tgagatttattaaagaa

SEQ ID NO: 6456704 - DNA, 21 bp, Homo sapiens
tgagatttattaaagaaaaaa

SEQ ID NO: 6456705 - DNA, 19 bp, Homo sapiens
tgagatttcatctgctctc

SEQ ID NO: 6456706 - DNA, 21 bp, Homo sapiens
tgagatttcatctgctctcct

SEQ ID NO: 6456707 - DNA, 22 bp, Homo sapiens
tgagatttcatctgctctcctt

SEQ ID NO: 6456708 - DNA, 14 bp, Homo sapiens
tgagatttccttat

SEQ ID NO: 6456709 - DNA, 18 bp, Homo sapiens
tgagatttctttgaatgt

SEQ ID NO: 6456710 - DNA, 15 bp, Homo sapiens
tgagatttgccagca

SEQ ID NO: 6456711 - DNA, 14 bp, Homo sapiens
tgagatttgtaaat

SEQ ID NO: 6456712 - DNA, 12 bp, Homo sapiens
tgagatttgtat

SEQ ID NO: 6456713 - DNA, 19 bp, Homo sapiens
tgagatttgtatttatatt

SEQ ID NO: 6456714 - DNA, 20 bp, Homo sapiens
tgagatttgtatttatatta

SEQ ID NO: 6456715 - DNA, 17 bp, Homo sapiens
tgagattttgcttgagc

SEQ ID NO: 6456716 - DNA, 22 bp, Homo sapiens
tgagatttttaaaaaatatttt

SEQ ID NO: 6456717 - DNA, 16 bp, Homo sapiens
tgagatttttaagaac

SEQ ID NO: 6456718 - DNA, 19 bp, Homo sapiens
tgagatttttaagaacttc

SEQ ID NO: 6456719 - DNA, 16 bp, Homo sapiens
tgagatttttggtttt

SEQ ID NO: 6456720 - DNA, 21 bp, Homo sapiens
tgagatttttggttttttgat

SEQ ID NO: 6456721 - DNA, 21 bp, Homo sapiens
tgagattttttagatcttcct

SEQ ID NO: 6456722 - DNA, 16 bp, Homo sapiens
tgagattttttattgc

SEQ ID NO: 6456723 - DNA, 21 bp, Homo sapiens
tgagatttttttgtgtatgtt

SEQ ID NO: 6456724 - DNA, 20 bp, Homo sapiens
tgagattttttttaaaagtt

SEQ ID NO: 6456725 - DNA, 17 bp, Homo sapiens
tgagattttttttccgt

SEQ ID NO: 6456726 - DNA, 16 bp, Homo sapiens
tgagatttttttttct

SEQ ID NO: 6456727 - DNA, 22 bp, Homo sapiens
tgagcaaacagaggaggccagc

SEQ ID NO: 6456728 - DNA, 16 bp, Homo sapiens
tgagcaaacctgcccc

SEQ ID NO: 6456729 - DNA, 19 bp, Homo sapiens
tgagcaaacctgccccatc

SEQ ID NO: 6456730 - DNA, 18 bp, Homo sapiens
tgagcaaactaacttgac

SEQ ID NO: 6456731 - DNA, 18 bp, Homo sapiens
tgagcaaagaactaagga

SEQ ID NO: 6456732 - DNA, 14 bp, Homo sapiens
tgagcaaaggccct

SEQ ID NO: 6456733 - DNA, 16 bp, Homo sapiens
tgagcaaaggccctgg

SEQ ID NO: 6456734 - DNA, 15 bp, Homo sapiens
tgagcaaatgtggct

SEQ ID NO: 6456735 - DNA, 16 bp, Homo sapiens
tgagcaaatgtggctc

SEQ ID NO: 6456736 - DNA, 19 bp, Homo sapiens
tgagcaaatgtggctcctg

SEQ ID NO: 6456737 - DNA, 20 bp, Homo sapiens
tgagcaacctcttcagctgg

SEQ ID NO: 6456738 - DNA, 18 bp, Homo sapiens
tgagcaactcttgattat

SEQ ID NO: 6456739 - DNA, 17 bp, Homo sapiens
tgagcaactgcgacaaa

SEQ ID NO: 6456740 - DNA, 17 bp, Homo sapiens
tgagcaagacgccctct

SEQ ID NO: 6456741 - DNA, 13 bp, Homo sapiens
tgagcaagagcca

SEQ ID NO: 6456742 - DNA, 15 bp, Homo sapiens
tgagcaagagccagg

SEQ ID NO: 6456743 - DNA, 17 bp, Homo sapiens
tgagcaagatcttgtct

SEQ ID NO: 6456744 - DNA, 17 bp, Homo sapiens
tgagcaagatgatgtaa

SEQ ID NO: 6456745 - DNA, 18 bp, Homo sapiens
tgagcaagcaccaacctc

SEQ ID NO: 6456746 - DNA, 14 bp, Homo sapiens
tgagcaagcccagg

SEQ ID NO: 6456747 - DNA, 21 bp, Homo sapiens
tgagcaaggagcacaagccac

SEQ ID NO: 6456748 - DNA, 23 bp, Homo sapiens
tgagcaaggagcacaagccacaa

SEQ ID NO: 6456749 - DNA, 16 bp, Homo sapiens
tgagcaaggcaagaag

SEQ ID NO: 6456750 - DNA, 21 bp, Homo sapiens
tgagcaaggcaagaagtggga

SEQ ID NO: 6456751 - DNA, 21 bp, Homo sapiens
tgagcaagtatccttcattgt

SEQ ID NO: 6456752 - DNA, 20 bp, Homo sapiens
tgagcaataaagtggaaaca

SEQ ID NO: 6456753 - DNA, 15 bp, Homo sapiens
tgagcaatcctgcaa

SEQ ID NO: 6456754 - DNA, 20 bp, Homo sapiens
tgagcaatgtctgtgctagg

SEQ ID NO: 6456755 - DNA, 14 bp, Homo sapiens
tgagcaatgttttt

SEQ ID NO: 6456756 - DNA, 20 bp, Homo sapiens
tgagcaatgtttttctcaaa

SEQ ID NO: 6456757 - DNA, 14 bp, Homo sapiens
tgagcaattctcct

SEQ ID NO: 6456758 - DNA, 14 bp, Homo sapiens
tgagcacaatctgt

SEQ ID NO: 6456759 - DNA, 17 bp, Homo sapiens
tgagcacacaacaggct

SEQ ID NO: 6456760 - DNA, 13 bp, Homo sapiens
tgagcacacttta

SEQ ID NO: 6456761 - DNA, 20 bp, Homo sapiens
tgagcacactttagtggccg

SEQ ID NO: 6456762 - DNA, 13 bp, Homo sapiens
tgagcacaggtga

SEQ ID NO: 6456763 - DNA, 18 bp, Homo sapiens
tgagcacagtcaggggct

SEQ ID NO: 6456764 - DNA, 21 bp, Homo sapiens
tgagcacagtcaggggctggg

SEQ ID NO: 6456765 - DNA, 13 bp, Homo sapiens
tgagcacatctct

SEQ ID NO: 6456766 - DNA, 23 bp, Homo sapiens
tgagcacatgcgtatatgtgcgt

SEQ ID NO: 6456767 - DNA, 13 bp, Homo sapiens
tgagcacattctg

SEQ ID NO: 6456768 - DNA, 19 bp, Homo sapiens
tgagcaccaccagggctcc

SEQ ID NO: 6456769 - DNA, 14 bp, Homo sapiens
tgagcaccagggga

SEQ ID NO: 6456770 - DNA, 21 bp, Homo sapiens
tgagcaccaggtgttaaaaac

SEQ ID NO: 6456771 - DNA, 23 bp, Homo sapiens
tgagcaccccctcattcccctcg

SEQ ID NO: 6456772 - DNA, 15 bp, Homo sapiens
tgagcaccctctgga

SEQ ID NO: 6456773 - DNA, 16 bp, Homo sapiens
tgagcaccctctggat

SEQ ID NO: 6456774 - DNA, 19 bp, Homo sapiens
tgagcaccgtcatggctta

SEQ ID NO: 6456775 - DNA, 22 bp, Homo sapiens
tgagcaccgtgtcaagctgctc

SEQ ID NO: 6456776 - DNA, 12 bp, Homo sapiens
tgagcacctgct

SEQ ID NO: 6456777 - DNA, 21 bp, Homo sapiens
tgagcacctttctggctttta

SEQ ID NO: 6456778 - DNA, 15 bp, Homo sapiens
tgagcacgctaccaa

SEQ ID NO: 6456779 - DNA, 20 bp, Homo sapiens
tgagcacggccaacaaagct

SEQ ID NO: 6456780 - DNA, 19 bp, Homo sapiens
tgagcacgggcaaagaaaa

SEQ ID NO: 6456781 - DNA, 22 bp, Homo sapiens
tgagcacgttggcgaggaaaaa

SEQ ID NO: 6456782 - DNA, 22 bp, Homo sapiens
tgagcactcagtctagtgaaga

SEQ ID NO: 6456783 - DNA, 15 bp, Homo sapiens
tgagcactcctgatt

SEQ ID NO: 6456784 - DNA, 17 bp, Homo sapiens
tgagcactcctggtgca

SEQ ID NO: 6456785 - DNA, 18 bp, Homo sapiens
tgagcactcctggtgcag

SEQ ID NO: 6456786 - DNA, 17 bp, Homo sapiens
tgagcactctactgcaa

SEQ ID NO: 6456787 - DNA, 21 bp, Homo sapiens
tgagcactgaaacattatttt

SEQ ID NO: 6456788 - DNA, 14 bp, Homo sapiens
tgagcactgccagg

SEQ ID NO: 6456789 - DNA, 16 bp, Homo sapiens
tgagcactgccaggag

SEQ ID NO: 6456790 - DNA, 18 bp, Homo sapiens
tgagcactgccaggaggg

SEQ ID NO: 6456791 - DNA, 19 bp, Homo sapiens
tgagcactgccaggaggga

SEQ ID NO: 6456792 - DNA, 15 bp, Homo sapiens
tgagcactgttttct

SEQ ID NO: 6456793 - DNA, 21 bp, Homo sapiens
tgagcactgttttctagtgta

SEQ ID NO: 6456794 - DNA, 15 bp, Homo sapiens
tgagcacttagcagg

SEQ ID NO: 6456795 - DNA, 16 bp, Homo sapiens
tgagcagaacaggtag

SEQ ID NO: 6456796 - DNA, 21 bp, Homo sapiens
tgagcagaactgaaaaattac

SEQ ID NO: 6456797 - DNA, 15 bp, Homo sapiens
tgagcagaagactat

SEQ ID NO: 6456798 - DNA, 19 bp, Homo sapiens
tgagcagaagactatttac

SEQ ID NO: 6456799 - DNA, 21 bp, Homo sapiens
tgagcagaagactatttacca

SEQ ID NO: 6456800 - DNA, 13 bp, Homo sapiens
tgagcagaaggaa

SEQ ID NO: 6456801 - DNA, 16 bp, Homo sapiens
tgagcagaatgttgta

SEQ ID NO: 6456802 - DNA, 17 bp, Homo sapiens
tgagcagactggtgagc

SEQ ID NO: 6456803 - DNA, 19 bp, Homo sapiens
tgagcagactggtgagcag

SEQ ID NO: 6456804 - DNA, 14 bp, Homo sapiens
tgagcagagcccgg

SEQ ID NO: 6456805 - DNA, 20 bp, Homo sapiens
tgagcagagcccggagctcc

SEQ ID NO: 6456806 - DNA, 21 bp, Homo sapiens
tgagcagagcccggagctccg

SEQ ID NO: 6456807 - DNA, 12 bp, Homo sapiens
tgagcagagtct

SEQ ID NO: 6456808 - DNA, 20 bp, Homo sapiens
tgagcagatcgtgccgtgga

SEQ ID NO: 6456809 - DNA, 19 bp, Homo sapiens
tgagcagcatctagtttcc

SEQ ID NO: 6456810 - DNA, 23 bp, Homo sapiens
tgagcagcccttacagtattgtt

SEQ ID NO: 6456811 - DNA, 20 bp, Homo sapiens
tgagcagcctccactgtgtc

SEQ ID NO: 6456812 - DNA, 18 bp, Homo sapiens
tgagcagcctctgccagg

SEQ ID NO: 6456813 - DNA, 20 bp, Homo sapiens
tgagcagcctctgccaggcc

SEQ ID NO: 6456814 - DNA, 22 bp, Homo sapiens
tgagcagcctctggacagccag

SEQ ID NO: 6456815 - DNA, 18 bp, Homo sapiens
tgagcagcctggagccct

SEQ ID NO: 6456816 - DNA, 16 bp, Homo sapiens
tgagcagctactgtaa

SEQ ID NO: 6456817 - DNA, 20 bp, Homo sapiens
tgagcagctactgtaacttt

SEQ ID NO: 6456818 - DNA, 15 bp, Homo sapiens
tgagcagctgaataa

SEQ ID NO: 6456819 - DNA, 21 bp, Homo sapiens
tgagcaggaaagactggccct

SEQ ID NO: 6456820 - DNA, 16 bp, Homo sapiens
tgagcaggaaggcctg

SEQ ID NO: 6456821 - DNA, 13 bp, Homo sapiens
tgagcaggagcag

SEQ ID NO: 6456822 - DNA, 19 bp, Homo sapiens
tgagcaggagcagaaagat

SEQ ID NO: 6456823 - DNA, 13 bp, Homo sapiens
tgagcaggagctt

SEQ ID NO: 6456824 - DNA, 23 bp, Homo sapiens
tgagcaggagcttgggtctctct

SEQ ID NO: 6456825 - DNA, 12 bp, Homo sapiens
tgagcaggcagg

SEQ ID NO: 6456826 - DNA, 23 bp, Homo sapiens
tgagcaggcaggggcttggctgc

SEQ ID NO: 6456827 - DNA, 13 bp, Homo sapiens
tgagcaggcccga

SEQ ID NO: 6456828 - DNA, 18 bp, Homo sapiens
tgagcaggcccgacagag

SEQ ID NO: 6456829 - DNA, 20 bp, Homo sapiens
tcctctgagcccagctgcct

SEQ ID NO: 6456830 - DNA, 17 bp, Homo sapiens
tcctctgaggaagaagg

SEQ ID NO: 6456831 - DNA, 14 bp, Homo sapiens
tcctctgaggctga

SEQ ID NO: 6456832 - DNA, 22 bp, Homo sapiens
tcctctgataatatattttcaa

SEQ ID NO: 6456833 - DNA, 15 bp, Homo sapiens
tcctctgattatcag

SEQ ID NO: 6456834 - DNA, 16 bp, Homo sapiens
tcctctgattatcagg

SEQ ID NO: 6456835 - DNA, 15 bp, Homo sapiens
tcctctgatttcaag

SEQ ID NO: 6456836 - DNA, 15 bp, Homo sapiens
tcctctgcaaaaaga

SEQ ID NO: 6456837 - DNA, 13 bp, Homo sapiens
tcctctgcaagct

SEQ ID NO: 6456838 - DNA, 22 bp, Homo sapiens
tcctctgcaagcttcttgctga

SEQ ID NO: 6456839 - DNA, 18 bp, Homo sapiens
tcctctgcaagtgctcag

SEQ ID NO: 6456840 - DNA, 23 bp, Homo sapiens
tcctctgcacgctcaatgcccag

SEQ ID NO: 6456841 - DNA, 17 bp, Homo sapiens
tcctctgcagcctgagc

SEQ ID NO: 6456842 - DNA, 20 bp, Homo sapiens
tcctctgcagctgacctctg

SEQ ID NO: 6456843 - DNA, 22 bp, Homo sapiens
tcctctgcaggacacagatctg

SEQ ID NO: 6456844 - DNA, 13 bp, Homo sapiens
tcctctgcagtgc

SEQ ID NO: 6456845 - DNA, 15 bp, Homo sapiens
tcctctgcagtgcct

SEQ ID NO: 6456846 - DNA, 17 bp, Homo sapiens
tcctctgcagtgtggca

SEQ ID NO: 6456847 - DNA, 15 bp, Homo sapiens
tcctctgcatcttgc

SEQ ID NO: 6456848 - DNA, 14 bp, Homo sapiens
tcctctgccacctc

SEQ ID NO: 6456849 - DNA, 23 bp, Homo sapiens
tcctctgccagcaggaataaaga

SEQ ID NO: 6456850 - DNA, 12 bp, Homo sapiens
tcctctgccccc

SEQ ID NO: 6456851 - DNA, 18 bp, Homo sapiens
tcctctgccccctccccc

SEQ ID NO: 6456852 - DNA, 14 bp, Homo sapiens
tcctctgcctacag

SEQ ID NO: 6456853 - DNA, 11 bp, Homo sapiens
tcctctgcctc

SEQ ID NO: 6456854 - DNA, 13 bp, Homo sapiens
tcctctgcctcaa

SEQ ID NO: 6456855 - DNA, 17 bp, Homo sapiens
tcctctgcctgggctct

SEQ ID NO: 6456856 - DNA, 22 bp, Homo sapiens
tcctctgcctgggctctggaag

SEQ ID NO: 6456857 - DNA, 21 bp, Homo sapiens
tcctctgcctgtgcccgctgc

SEQ ID NO: 6456858 - DNA, 11 bp, Homo sapiens
tcctctgcctt

SEQ ID NO: 6456859 - DNA, 12 bp, Homo sapiens
tcctctgccttg

SEQ ID NO: 6456860 - DNA, 13 bp, Homo sapiens
tcctctgccttgg

SEQ ID NO: 6456861 - DNA, 15 bp, Homo sapiens
tcctctgctaaattg

SEQ ID NO: 6456862 - DNA, 18 bp, Homo sapiens
tcctctgctaaattgatg

SEQ ID NO: 6456863 - DNA, 22 bp, Homo sapiens
tcctctgctatgcattttcttc

SEQ ID NO: 6456864 - DNA, 23 bp, Homo sapiens
tcctctgctccaacagacaccct

SEQ ID NO: 6456865 - DNA, 12 bp, Homo sapiens
tcctctgctgca

SEQ ID NO: 6456866 - DNA, 20 bp, Homo sapiens
tcctctgctgcatccccttc

SEQ ID NO: 6456867 - DNA, 12 bp, Homo sapiens
tcctctgctggg

SEQ ID NO: 6456868 - DNA, 13 bp, Homo sapiens
tcctctgctggga

SEQ ID NO: 6456869 - DNA, 12 bp, Homo sapiens
tcctctgctggt

SEQ ID NO: 6456870 - DNA, 18 bp, Homo sapiens
tcctctgctggttcctga

SEQ ID NO: 6456871 - DNA, 16 bp, Homo sapiens
tcctctgcttgccatc

SEQ ID NO: 6456872 - DNA, 19 bp, Homo sapiens
tcctctgcttgccatccct

SEQ ID NO: 6456873 - DNA, 14 bp, Homo sapiens
tcctctgctttgct

SEQ ID NO: 6456874 - DNA, 13 bp, Homo sapiens
tcctctggacacg

SEQ ID NO: 6456875 - DNA, 15 bp, Homo sapiens
tcctctggacggcag

SEQ ID NO: 6456876 - DNA, 17 bp, Homo sapiens
tcctctggagccagccg

SEQ ID NO: 6456877 - DNA, 19 bp, Homo sapiens
tcctctggatggcaccaga

SEQ ID NO: 6456878 - DNA, 21 bp, Homo sapiens
tcctctggcaggcttccccct

SEQ ID NO: 6456879 - DNA, 22 bp, Homo sapiens
tcctctggcaggcttccccctt

SEQ ID NO: 6456880 - DNA, 15 bp, Homo sapiens
tcctctggcccagcc

SEQ ID NO: 6456881 - DNA, 16 bp, Homo sapiens
tcctctggcccagcct

SEQ ID NO: 6456882 - DNA, 16 bp, Homo sapiens
tcctctggccgcagag

SEQ ID NO: 6456883 - DNA, 19 bp, Homo sapiens
tcctctggccgcagaggtg

SEQ ID NO: 6456884 - DNA, 17 bp, Homo sapiens
tcctctggctccccaag

SEQ ID NO: 6456885 - DNA, 23 bp, Homo sapiens
tcctctggctggctaactggaag

SEQ ID NO: 6456886 - DNA, 14 bp, Homo sapiens
tcctctggctttcc

SEQ ID NO: 6456887 - DNA, 18 bp, Homo sapiens
tcctctggctttcccagg

SEQ ID NO: 6456888 - DNA, 12 bp, Homo sapiens
tcctctgggcag

SEQ ID NO: 6456889 - DNA, 21 bp, Homo sapiens
tcctctgggccctgtcgcccc

SEQ ID NO: 6456890 - DNA, 12 bp, Homo sapiens
tcctctgggcct

SEQ ID NO: 6456891 - DNA, 23 bp, Homo sapiens
tcctctggggttcatctagggac

SEQ ID NO: 6456892 - DNA, 20 bp, Homo sapiens
tcctctgggtttctaagcag

SEQ ID NO: 6456893 - DNA, 15 bp, Homo sapiens
tcctctggtgtttat

SEQ ID NO: 6456894 - DNA, 21 bp, Homo sapiens
tcctctggtgtttattataaa

SEQ ID NO: 6456895 - DNA, 14 bp, Homo sapiens
tcctctggttcctt

SEQ ID NO: 6456896 - DNA, 16 bp, Homo sapiens
tcctctggtttctgtg

SEQ ID NO: 6456897 - DNA, 21 bp, Homo sapiens
tcctctggtttctgtgtgtcc

SEQ ID NO: 6456898 - DNA, 17 bp, Homo sapiens
tcctctgtagtattttt

SEQ ID NO: 6456899 - DNA, 12 bp, Homo sapiens
tcctctgtcagt

SEQ ID NO: 6456900 - DNA, 18 bp, Homo sapiens
tcctctgtcagtttgtga

SEQ ID NO: 6456901 - DNA, 22 bp, Homo sapiens
tcctctgtccaggcactgctgc

SEQ ID NO: 6456902 - DNA, 16 bp, Homo sapiens
tcctctgtccagggcc

SEQ ID NO: 6456903 - DNA, 23 bp, Homo sapiens
tcctctgtccagggccctgagct

SEQ ID NO: 6456904 - DNA, 16 bp, Homo sapiens
tcctctgtccccgagc

SEQ ID NO: 6456905 - DNA, 23 bp, Homo sapiens
tcctctgtccgtctgtcctgcgc

SEQ ID NO: 6456906 - DNA, 23 bp, Homo sapiens
tcctctgtctcgagcgccctgca

SEQ ID NO: 6456907 - DNA, 12 bp, Homo sapiens
tcctctgtctgc

SEQ ID NO: 6456908 - DNA, 11 bp, Homo sapiens
tcctctgtgaa

SEQ ID NO: 6456909 - DNA, 12 bp, Homo sapiens
tcctctgtgcca

SEQ ID NO: 6456910 - DNA, 12 bp, Homo sapiens
tcctctgtgctc

SEQ ID NO: 6456911 - DNA, 17 bp, Homo sapiens
tcctctgtgctccctcg

SEQ ID NO: 6456912 - DNA, 21 bp, Homo sapiens
tcctctgttaatgtggactgg

SEQ ID NO: 6456913 - DNA, 18 bp, Homo sapiens
tcctctgttacccgcaga

SEQ ID NO: 6456914 - DNA, 12 bp, Homo sapiens
tcctctgttcta

SEQ ID NO: 6456915 - DNA, 22 bp, Homo sapiens
tcctctgtttctccttctgaaa

SEQ ID NO: 6456916 - DNA, 16 bp, Homo sapiens
tcctcttaagacacta

SEQ ID NO: 6456917 - DNA, 19 bp, Homo sapiens
tcctcttaccgtagcctcc

SEQ ID NO: 6456918 - DNA, 17 bp, Homo sapiens
tcctcttactttcagtt

SEQ ID NO: 6456919 - DNA, 16 bp, Homo sapiens
tcctcttagctcagct

SEQ ID NO: 6456920 - DNA, 17 bp, Homo sapiens
tcctcttaggtcccggg

SEQ ID NO: 6456921 - DNA, 19 bp, Homo sapiens
tcctcttataacttctgaa

SEQ ID NO: 6456922 - DNA, 13 bp, Homo sapiens
tcctcttatttgc

SEQ ID NO: 6456923 - DNA, 11 bp, Homo sapiens
tcctcttcaga

SEQ ID NO: 6456924 - DNA, 19 bp, Homo sapiens
tcctcttcagaacttgtca

SEQ ID NO: 6456925 - DNA, 12 bp, Homo sapiens
tcctcttcccca

SEQ ID NO: 6456926 - DNA, 13 bp, Homo sapiens
tcctcttccccag

SEQ ID NO: 6456927 - DNA, 18 bp, Homo sapiens
tcctcttccccagacgcc

SEQ ID NO: 6456928 - DNA, 15 bp, Homo sapiens
tcctcttccccttgc

SEQ ID NO: 6456929 - DNA, 14 bp, Homo sapiens
tcctcttccctctc

SEQ ID NO: 6456930 - DNA, 22 bp, Homo sapiens
tcctcttcccttagcctctccc

SEQ ID NO: 6456931 - DNA, 14 bp, Homo sapiens
tcctcttcctctga

SEQ ID NO: 6456932 - DNA, 12 bp, Homo sapiens
tcctcttccttc

SEQ ID NO: 6456933 - DNA, 22 bp, Homo sapiens
tcctcttctaaaatagcaataa

SEQ ID NO: 6456934 - DNA, 20 bp, Homo sapiens
tcctcttctaccatttccca

SEQ ID NO: 6456935 - DNA, 20 bp, Homo sapiens
tcctcttctactcacttttc

SEQ ID NO: 6456936 - DNA, 19 bp, Homo sapiens
tcctcttctattttgtaaa

SEQ ID NO: 6456937 - DNA, 21 bp, Homo sapiens
tcctcttctcaaagctgggat

SEQ ID NO: 6456938 - DNA, 21 bp, Homo sapiens
tcctcttctgctcttttcctg

SEQ ID NO: 6456939 - DNA, 15 bp, Homo sapiens
tcctcttgagagaaa

SEQ ID NO: 6456940 - DNA, 21 bp, Homo sapiens
tcctcttgattcctggtttga

SEQ ID NO: 6456941 - DNA, 22 bp, Homo sapiens
tcctcttgccacatcttgaaaa

SEQ ID NO: 6456942 - DNA, 14 bp, Homo sapiens
tcctcttgccatct

SEQ ID NO: 6456943 - DNA, 18 bp, Homo sapiens
tcctcttgcctctctcag

SEQ ID NO: 6456944 - DNA, 21 bp, Homo sapiens
tcctcttggagtctagaacat

SEQ ID NO: 6456945 - DNA, 21 bp, Homo sapiens
tcctcttggcaagatgtttct

SEQ ID NO: 6456946 - DNA, 22 bp, Homo sapiens
tcctcttggcaagatgtttctt

SEQ ID NO: 6456947 - DNA, 20 bp, Homo sapiens
tcctcttgtaaataaagccc

SEQ ID NO: 6456948 - DNA, 13 bp, Homo sapiens
tcctcttgtccta

SEQ ID NO: 6456949 - DNA, 17 bp, Homo sapiens
tcctcttgtcctggccc

SEQ ID NO: 6456950 - DNA, 20 bp, Homo sapiens
tcctcttgtgatttctttaa

SEQ ID NO: 6456951 - DNA, 17 bp, Homo sapiens
tcctctttactctgggc

SEQ ID NO: 6456952 - DNA, 21 bp, Homo sapiens
tcctctttagagttagactgt

SEQ ID NO: 6456953 - DNA, 18 bp, Homo sapiens
tcctctttagtttttggt

SEQ ID NO: 6456954 - DNA, 19 bp, Homo sapiens
tcctctttagtttttggtt

SEQ ID NO: 6456955 - DNA, 17 bp, Homo sapiens
tcctctttcagaaaaca

SEQ ID NO: 6456956 - DNA, 16 bp, Homo sapiens
tcctctttcagctcct

SEQ ID NO: 6456957 - DNA, 18 bp, Homo sapiens
tcctctttcagctcctga

SEQ ID NO: 6456958 - DNA, 11 bp, Homo sapiens
tcctctttcca

SEQ ID NO: 6456959 - DNA, 12 bp, Homo sapiens
tcctctttccat

SEQ ID NO: 6456960 - DNA, 13 bp, Homo sapiens
tcctctttcccca

SEQ ID NO: 6456961 - DNA, 14 bp, Homo sapiens
tcctctttccccac

SEQ ID NO: 6456962 - DNA, 16 bp, Homo sapiens
tcctctttccccactg

SEQ ID NO: 6456963 - DNA, 14 bp, Homo sapiens
tcctctttcccctc

SEQ ID NO: 6456964 - DNA, 16 bp, Homo sapiens
tcctctttcccctcct

SEQ ID NO: 6456965 - DNA, 13 bp, Homo sapiens
tcctctttctctc

SEQ ID NO: 6456966 - DNA, 15 bp, Homo sapiens
tcctctttctctccc

SEQ ID NO: 6456967 - DNA, 16 bp, Homo sapiens
tcctctttctctcccc

SEQ ID NO: 6456968 - DNA, 11 bp, Homo sapiens
tcctctttctg

SEQ ID NO: 6456969 - DNA, 14 bp, Homo sapiens
tcctctttctgctc

SEQ ID NO: 6456970 - DNA, 20 bp, Homo sapiens
tcctctttctgctctgccat

SEQ ID NO: 6456971 - DNA, 13 bp, Homo sapiens
tcctctttgagac

SEQ ID NO: 6456972 - DNA, 15 bp, Homo sapiens
tcctctttgatgtca

SEQ ID NO: 6456973 - DNA, 15 bp, Homo sapiens
tcctctttgcccaaa

SEQ ID NO: 6456974 - DNA, 23 bp, Homo sapiens
tcctctttgcccaaaatacttgc

SEQ ID NO: 6456975 - DNA, 14 bp, Homo sapiens
tcctctttgccctg

SEQ ID NO: 6456976 - DNA, 12 bp, Homo sapiens
tcctctttgtaa

SEQ ID NO: 6456977 - DNA, 22 bp, Homo sapiens
tcctctttgtaatttaatgaaa

SEQ ID NO: 6456978 - DNA, 11 bp, Homo sapiens
tcctctttgtt

SEQ ID NO: 6456979 - DNA, 18 bp, Homo sapiens
tcctcttttcctggcagc

SEQ ID NO: 6456980 - DNA, 21 bp, Homo sapiens
tcctcttttcctggcagctgc

SEQ ID NO: 6456981 - DNA, 13 bp, Homo sapiens
tcctcttttgtat

SEQ ID NO: 6456982 - DNA, 20 bp, Homo sapiens
tcctcttttgttgtttctta

SEQ ID NO: 6456983 - DNA, 22 bp, Homo sapiens
tcctctttttgctcccccattt

SEQ ID NO: 6456984 - DNA, 22 bp, Homo sapiens
tcctctttttttaaaaataaat

SEQ ID NO: 6456985 - DNA, 12 bp, Homo sapiens
tcctgaaaaaat

SEQ ID NO: 6456986 - DNA, 23 bp, Homo sapiens
tcctgaaaaggtttatgaaaaag

SEQ ID NO: 6456987 - DNA, 17 bp, Homo sapiens
tcctgaaacccaaagcc

SEQ ID NO: 6456988 - DNA, 19 bp, Homo sapiens
tcctgaaacctcttcctag

SEQ ID NO: 6456989 - DNA, 21 bp, Homo sapiens
tcctgaaacgctcctttgtgt

SEQ ID NO: 6456990 - DNA, 16 bp, Homo sapiens
tcctgaaactatattt

SEQ ID NO: 6456991 - DNA, 18 bp, Homo sapiens
tcctgaaagcattatttt

SEQ ID NO: 6456992 - DNA, 13 bp, Homo sapiens
tcctgaaagccag

SEQ ID NO: 6456993 - DNA, 20 bp, Homo sapiens
tcctgaaagccagcaaagcc

SEQ ID NO: 6456994 - DNA, 17 bp, Homo sapiens
tcctgaaagcggctgcc

SEQ ID NO: 6456995 - DNA, 18 bp, Homo sapiens
tcctgaaagcggctgcct

SEQ ID NO: 6456996 - DNA, 21 bp, Homo sapiens
tcctgaaagcggctgcctcca

SEQ ID NO: 6456997 - DNA, 13 bp, Homo sapiens
tcctgaaagctgt

SEQ ID NO: 6456998 - DNA, 15 bp, Homo sapiens
tcctgaaataaaact

SEQ ID NO: 6456999 - DNA, 14 bp, Homo sapiens
tcctgaaataaaca

SEQ ID NO: 6457000 - DNA, 16 bp, Homo sapiens
tcctgaaataaacact

SEQ ID NO: 6457001 - DNA, 19 bp, Homo sapiens
tcctgaaataaacactggt

SEQ ID NO: 6457002 - DNA, 14 bp, Homo sapiens
tcctgaaatataaa

SEQ ID NO: 6457003 - DNA, 12 bp, Homo sapiens
tcctgaaatcaa

SEQ ID NO: 6457004 - DNA, 18 bp, Homo sapiens
tcctgaaatgtgtttcct

SEQ ID NO: 6457005 - DNA, 20 bp, Homo sapiens
tcctgaaatgtgtttccttt

SEQ ID NO: 6457006 - DNA, 18 bp, Homo sapiens
tcctgaacagcatggcac

SEQ ID NO: 6457007 - DNA, 13 bp, Homo sapiens
tcctgaacagctg

SEQ ID NO: 6457008 - DNA, 14 bp, Homo sapiens
tcctgaacagctgg

SEQ ID NO: 6457009 - DNA, 19 bp, Homo sapiens
tcctgaaccgcacagctca

SEQ ID NO: 6457010 - DNA, 23 bp, Homo sapiens
tgagcaggcggggaggaggctgc

SEQ ID NO: 6457011 - DNA, 15 bp, Homo sapiens
tgagcagggatctgc

SEQ ID NO: 6457012 - DNA, 16 bp, Homo sapiens
tgagcagggccgggga

SEQ ID NO: 6457013 - DNA, 12 bp, Homo sapiens
tgagcagggctc

SEQ ID NO: 6457014 - DNA, 17 bp, Homo sapiens
tgagcagggctcagcgg

SEQ ID NO: 6457015 - DNA, 13 bp, Homo sapiens
tgagcagggcttg

SEQ ID NO: 6457016 - DNA, 17 bp, Homo sapiens
tgagcaggggcaggcgc

SEQ ID NO: 6457017 - DNA, 21 bp, Homo sapiens
tgagcaggggcaggcgcagag

SEQ ID NO: 6457018 - DNA, 22 bp, Homo sapiens
tgagcaggggcaggcgcagagg

SEQ ID NO: 6457019 - DNA, 23 bp, Homo sapiens
tgagcaggggcaggcgcagaggt

SEQ ID NO: 6457020 - DNA, 19 bp, Homo sapiens
tgagcagggtcaagcctct

SEQ ID NO: 6457021 - DNA, 16 bp, Homo sapiens
tgagcagggtccacag

SEQ ID NO: 6457022 - DNA, 19 bp, Homo sapiens
tgagcagggtccacagctg

SEQ ID NO: 6457023 - DNA, 20 bp, Homo sapiens
tgagcagggtccacagctgg

SEQ ID NO: 6457024 - DNA, 21 bp, Homo sapiens
tgagcagggtccacagctgga

SEQ ID NO: 6457025 - DNA, 17 bp, Homo sapiens
tgagcagggtgacccct

SEQ ID NO: 6457026 - DNA, 13 bp, Homo sapiens
tgagcagggtggg

SEQ ID NO: 6457027 - DNA, 18 bp, Homo sapiens
tgagcagggtggggtctg

SEQ ID NO: 6457028 - DNA, 19 bp, Homo sapiens
tgagcaggtacatttctga

SEQ ID NO: 6457029 - DNA, 20 bp, Homo sapiens
tgagcaggtacatttctgat

SEQ ID NO: 6457030 - DNA, 21 bp, Homo sapiens
tgagcagtaaatgtatattga

SEQ ID NO: 6457031 - DNA, 14 bp, Homo sapiens
tgagcagtaactgt

SEQ ID NO: 6457032 - DNA, 20 bp, Homo sapiens
tgagcagtaactgtccctgc

SEQ ID NO: 6457033 - DNA, 13 bp, Homo sapiens
tgagcagtccaga

SEQ ID NO: 6457034 - DNA, 16 bp, Homo sapiens
tgagcagtccctgctt

SEQ ID NO: 6457035 - DNA, 17 bp, Homo sapiens
tgagcagtccctgctta

SEQ ID NO: 6457036 - DNA, 19 bp, Homo sapiens
tgagcagtgagcactgaaa

SEQ ID NO: 6457037 - DNA, 17 bp, Homo sapiens
tgagcagtgatattctt

SEQ ID NO: 6457038 - DNA, 23 bp, Homo sapiens
tgagcagtgatattctttgttaa

SEQ ID NO: 6457039 - DNA, 17 bp, Homo sapiens
tgagcagtgcctcttgt

SEQ ID NO: 6457040 - DNA, 12 bp, Homo sapiens
tgagcagtggct

SEQ ID NO: 6457041 - DNA, 14 bp, Homo sapiens
tgagcagtggctgg

SEQ ID NO: 6457042 - DNA, 18 bp, Homo sapiens
tgagcagttttccaggag

SEQ ID NO: 6457043 - DNA, 22 bp, Homo sapiens
tgagcatacctgtctcagctgt

SEQ ID NO: 6457044 - DNA, 19 bp, Homo sapiens
tgagcatatctggtatatg

SEQ ID NO: 6457045 - DNA, 22 bp, Homo sapiens
tgagcatatctggtatatgtca

SEQ ID NO: 6457046 - DNA, 15 bp, Homo sapiens
tgagcatatgttcca

SEQ ID NO: 6457047 - DNA, 20 bp, Homo sapiens
tgagcatatgttccatgcct

SEQ ID NO: 6457048 - DNA, 23 bp, Homo sapiens
tgagcatattttcttacttttat

SEQ ID NO: 6457049 - DNA, 12 bp, Homo sapiens
tgagcatcacag

SEQ ID NO: 6457050 - DNA, 15 bp, Homo sapiens
tgagcatcacagaat

SEQ ID NO: 6457051 - DNA, 13 bp, Homo sapiens
tgagcatcaggcc

SEQ ID NO: 6457052 - DNA, 14 bp, Homo sapiens
tgagcatcaggcca

SEQ ID NO: 6457053 - DNA, 15 bp, Homo sapiens
tgagcatcaggccag

SEQ ID NO: 6457054 - DNA, 19 bp, Homo sapiens
tgagcatcaggccaggccc

SEQ ID NO: 6457055 - DNA, 20 bp, Homo sapiens
tgagcatcaggccaggccct

SEQ ID NO: 6457056 - DNA, 24 bp, Homo sapiens
tgagcatcaggccaggccctctgc

SEQ ID NO: 6457057 - DNA, 16 bp, Homo sapiens
tgagcatccagacctg

SEQ ID NO: 6457058 - DNA, 15 bp, Homo sapiens
tgagcatcctgagcc

SEQ ID NO: 6457059 - DNA, 19 bp, Homo sapiens
tgagcatctcaaatgtttt

SEQ ID NO: 6457060 - DNA, 12 bp, Homo sapiens
tgagcatctctg

SEQ ID NO: 6457061 - DNA, 16 bp, Homo sapiens
tgagcatctctgtgta

SEQ ID NO: 6457062 - DNA, 21 bp, Homo sapiens
tgagcatctctgtgtacccac

SEQ ID NO: 6457063 - DNA, 23 bp, Homo sapiens
tgagcatctctgtgtacccactc

SEQ ID NO: 6457064 - DNA, 18 bp, Homo sapiens
tgagcatcttgccagcct

SEQ ID NO: 6457065 - DNA, 15 bp, Homo sapiens
tgagcatgctccctc

SEQ ID NO: 6457066 - DNA, 15 bp, Homo sapiens
tgagcatggagctgg

SEQ ID NO: 6457067 - DNA, 16 bp, Homo sapiens
tgagcatggagctggc

SEQ ID NO: 6457068 - DNA, 18 bp, Homo sapiens
tgagcatggagctggccg

SEQ ID NO: 6457069 - DNA, 19 bp, Homo sapiens
tgagcatggccagactatt

SEQ ID NO: 6457070 - DNA, 20 bp, Homo sapiens
tgagcatggggcgctcccac

SEQ ID NO: 6457071 - DNA, 22 bp, Homo sapiens
tgagcatggggcgctcccactc

SEQ ID NO: 6457072 - DNA, 19 bp, Homo sapiens
tgagcatgtaagtgttaag

SEQ ID NO: 6457073 - DNA, 24 bp, Homo sapiens
tgagcatgtttagactttaacata

SEQ ID NO: 6457074 - DNA, 16 bp, Homo sapiens
tgagcattacaggcaa

SEQ ID NO: 6457075 - DNA, 14 bp, Homo sapiens
tgagcattcaggca

SEQ ID NO: 6457076 - DNA, 19 bp, Homo sapiens
tgagcattggatacagcag

SEQ ID NO: 6457077 - DNA, 23 bp, Homo sapiens
tgagcattgtggctgtcagcagg

SEQ ID NO: 6457078 - DNA, 17 bp, Homo sapiens
tgagcatttagcacaat

SEQ ID NO: 6457079 - DNA, 20 bp, Homo sapiens
tgagcatttgaaaggtgtgc

SEQ ID NO: 6457080 - DNA, 16 bp, Homo sapiens
tgagccaaatttcttt

SEQ ID NO: 6457081 - DNA, 23 bp, Homo sapiens
tgagccaaccttaaacctcttct

SEQ ID NO: 6457082 - DNA, 23 bp, Homo sapiens
tgagccaaggacagggctggctc

SEQ ID NO: 6457083 - DNA, 21 bp, Homo sapiens
tgagccaagggagggaagggc

SEQ ID NO: 6457084 - DNA, 20 bp, Homo sapiens
tgagccaaggggtctgctcc

SEQ ID NO: 6457085 - DNA, 22 bp, Homo sapiens
tgagccaataaagctcacactt

SEQ ID NO: 6457086 - DNA, 20 bp, Homo sapiens
tgagccacagaaagctcctt

SEQ ID NO: 6457087 - DNA, 15 bp, Homo sapiens
tgagccacagaccac

SEQ ID NO: 6457088 - DNA, 17 bp, Homo sapiens
tgagccacagaccacct

SEQ ID NO: 6457089 - DNA, 14 bp, Homo sapiens
tgagccacagcact

SEQ ID NO: 6457090 - DNA, 16 bp, Homo sapiens
tgagccacagcagcat

SEQ ID NO: 6457091 - DNA, 23 bp, Homo sapiens
tgagccacagtggggcccatggc

SEQ ID NO: 6457092 - DNA, 16 bp, Homo sapiens
tgagccaccacacctg

SEQ ID NO: 6457093 - DNA, 15 bp, Homo sapiens
tgagccaccacgccc

SEQ ID NO: 6457094 - DNA, 19 bp, Homo sapiens
tgagccaccgcgagggcct

SEQ ID NO: 6457095 - DNA, 20 bp, Homo sapiens
tgagccaccgcgagggcctg

SEQ ID NO: 6457096 - DNA, 21 bp, Homo sapiens
tgagccaccgcgcctggccca

SEQ ID NO: 6457097 - DNA, 23 bp, Homo sapiens
tgagccaccgctgccagcacaga

SEQ ID NO: 6457098 - DNA, 14 bp, Homo sapiens
tgagccaccgtgcc

SEQ ID NO: 6457099 - DNA, 15 bp, Homo sapiens
tgagccaccgtgcct

SEQ ID NO: 6457100 - DNA, 17 bp, Homo sapiens
tgagccaccgtgcctgg

SEQ ID NO: 6457101 - DNA, 18 bp, Homo sapiens
tgagccaccgtgcctggc

SEQ ID NO: 6457102 - DNA, 19 bp, Homo sapiens
tgagccaccgtgcctggcc

SEQ ID NO: 6457103 - DNA, 20 bp, Homo sapiens
tgagccaccgtgcctggcca

SEQ ID NO: 6457104 - DNA, 23 bp, Homo sapiens
tgagccaccgtgcctggccagat

SEQ ID NO: 6457105 - DNA, 13 bp, Homo sapiens
tgagccacctgcc

SEQ ID NO: 6457106 - DNA, 19 bp, Homo sapiens
tgagccacctgcccttttt

SEQ ID NO: 6457107 - DNA, 16 bp, Homo sapiens
tgagccactccttcct

SEQ ID NO: 6457108 - DNA, 16 bp, Homo sapiens
tgagccactctcttcc

SEQ ID NO: 6457109 - DNA, 21 bp, Homo sapiens
tgagccactgcaccgggccac

SEQ ID NO: 6457110 - DNA, 21 bp, Homo sapiens
tgagccactgcacctgcccag

SEQ ID NO: 6457111 - DNA, 19 bp, Homo sapiens
tgagccactgcgcccagcc

SEQ ID NO: 6457112 - DNA, 21 bp, Homo sapiens
tgagccactgcgcccagcctg

SEQ ID NO: 6457113 - DNA, 15 bp, Homo sapiens
tgagccactgttccc

SEQ ID NO: 6457114 - DNA, 14 bp, Homo sapiens
tgagccagaaattg

SEQ ID NO: 6457115 - DNA, 14 bp, Homo sapiens
tgagccagacaaat

SEQ ID NO: 6457116 - DNA, 13 bp, Homo sapiens
tgagccagaggga

SEQ ID NO: 6457117 - DNA, 16 bp, Homo sapiens
tgagccagattacagg

SEQ ID NO: 6457118 - DNA, 13 bp, Homo sapiens
tgagccagatttc

SEQ ID NO: 6457119 - DNA, 15 bp, Homo sapiens
tgagccagcaccgcc

SEQ ID NO: 6457120 - DNA, 14 bp, Homo sapiens
tgagccagcagggc

SEQ ID NO: 6457121 - DNA, 21 bp, Homo sapiens
tgagccagccaggccctgcca

SEQ ID NO: 6457122 - DNA, 17 bp, Homo sapiens
tgagccagcccaagggc

SEQ ID NO: 6457123 - DNA, 14 bp, Homo sapiens
tgagccagctgcag

SEQ ID NO: 6457124 - DNA, 13 bp, Homo sapiens
tgagccaggagcc

SEQ ID NO: 6457125 - DNA, 21 bp, Homo sapiens
tgagccaggctagctggagcc

SEQ ID NO: 6457126 - DNA, 23 bp, Homo sapiens
tgagccagggaacagccccaggg

SEQ ID NO: 6457127 - DNA, 19 bp, Homo sapiens
tgagccagtcccaggggca

SEQ ID NO: 6457128 - DNA, 22 bp, Homo sapiens
tgagccagttacctttgctgtc

SEQ ID NO: 6457129 - DNA, 23 bp, Homo sapiens
tgagccagttacctttgctgtca

SEQ ID NO: 6457130 - DNA, 22 bp, Homo sapiens
tgagccatagagatatttaaaa

SEQ ID NO: 6457131 - DNA, 22 bp, Homo sapiens
tgagccatcactagaagaaaag

SEQ ID NO: 6457132 - DNA, 21 bp, Homo sapiens
tgagccatccagcatgaaaga

SEQ ID NO: 6457133 - DNA, 22 bp, Homo sapiens
tgagccatccagcatgaaagat

SEQ ID NO: 6457134 - DNA, 20 bp, Homo sapiens
tgagccatgaggagcgtgga

SEQ ID NO: 6457135 - DNA, 13 bp, Homo sapiens
tgagccatgcctc

SEQ ID NO: 6457136 - DNA, 20 bp, Homo sapiens
tgagccatgcctccctgggc

SEQ ID NO: 6457137 - DNA, 23 bp, Homo sapiens
tgagccatgggggtttggggcta

SEQ ID NO: 6457138 - DNA, 13 bp, Homo sapiens
tgagccatttaaa

SEQ ID NO: 6457139 - DNA, 21 bp, Homo sapiens
tgagcccaaacaccctcctgg

SEQ ID NO: 6457140 - DNA, 22 bp, Homo sapiens
tgagcccaaccaggccctgcca

SEQ ID NO: 6457141 - DNA, 17 bp, Homo sapiens
tgagcccaagctaagcc

SEQ ID NO: 6457142 - DNA, 17 bp, Homo sapiens
tgagcccacaaagcctt

SEQ ID NO: 6457143 - DNA, 12 bp, Homo sapiens
tgagcccactcc

SEQ ID NO: 6457144 - DNA, 13 bp, Homo sapiens
tgagcccactcct

SEQ ID NO: 6457145 - DNA, 20 bp, Homo sapiens
tgagcccactgcccaccccc

SEQ ID NO: 6457146 - DNA, 21 bp, Homo sapiens
tgagcccactgcccaccccct

SEQ ID NO: 6457147 - DNA, 16 bp, Homo sapiens
tgagcccagaacttca

SEQ ID NO: 6457148 - DNA, 15 bp, Homo sapiens
tgagcccagagaaca

SEQ ID NO: 6457149 - DNA, 16 bp, Homo sapiens
tgagcccagagaacag

SEQ ID NO: 6457150 - DNA, 17 bp, Homo sapiens
tgagcccagagaacagc

SEQ ID NO: 6457151 - DNA, 13 bp, Homo sapiens
tgagcccagccac

SEQ ID NO: 6457152 - DNA, 21 bp, Homo sapiens
tgagcccagccacctcccaag

SEQ ID NO: 6457153 - DNA, 17 bp, Homo sapiens
tgagcccagctgcctgg

SEQ ID NO: 6457154 - DNA, 18 bp, Homo sapiens
tgagcccagctgcctgga

SEQ ID NO: 6457155 - DNA, 12 bp, Homo sapiens
tgagcccaggaa

SEQ ID NO: 6457156 - DNA, 22 bp, Homo sapiens
tgagcccaggaagtccagaacg

SEQ ID NO: 6457157 - DNA, 13 bp, Homo sapiens
tgagcccaggccg

SEQ ID NO: 6457158 - DNA, 14 bp, Homo sapiens
tgagcccaggccgt

SEQ ID NO: 6457159 - DNA, 17 bp, Homo sapiens
tgagcccagggaggccg

SEQ ID NO: 6457160 - DNA, 21 bp, Homo sapiens
tgagcccatgttctgccccca

SEQ ID NO: 6457161 - DNA, 16 bp, Homo sapiens
tgagcccatttctggg

SEQ ID NO: 6457162 - DNA, 17 bp, Homo sapiens
tgagcccatttctgggg

SEQ ID NO: 6457163 - DNA, 17 bp, Homo sapiens
tgagccccaagtcctga

SEQ ID NO: 6457164 - DNA, 22 bp, Homo sapiens
tgagccccaagtcctgaagagg

SEQ ID NO: 6457165 - DNA, 20 bp, Homo sapiens
tgagccccacctctccaagt

SEQ ID NO: 6457166 - DNA, 18 bp, Homo sapiens
tgagccccacgtggagct

SEQ ID NO: 6457167 - DNA, 17 bp, Homo sapiens
tgagccccagccccaat

SEQ ID NO: 6457168 - DNA, 21 bp, Homo sapiens
tgagccccagcgggctggcgg

SEQ ID NO: 6457169 - DNA, 12 bp, Homo sapiens
tgagccccaggg

SEQ ID NO: 6457170 - DNA, 14 bp, Homo sapiens
tgagccccagggag

SEQ ID NO: 6457171 - DNA, 19 bp, Homo sapiens
tgagccccaggggggcctc

SEQ ID NO: 6457172 - DNA, 18 bp, Homo sapiens
tgagccccagggtgccca

SEQ ID NO: 6457173 - DNA, 19 bp, Homo sapiens
tgagccccagggtgcccag

SEQ ID NO: 6457174 - DNA, 21 bp, Homo sapiens
tgagccccagggtgcccagaa

SEQ ID NO: 6457175 - DNA, 14 bp, Homo sapiens
tgagccccatcttc

SEQ ID NO: 6457176 - DNA, 21 bp, Homo sapiens
tgagccccatcttcacccagg

SEQ ID NO: 6457177 - DNA, 20 bp, Homo sapiens
tgagcccccaccggaactgg

SEQ ID NO: 6457178 - DNA, 19 bp, Homo sapiens
tgagcccccacgctggcct

SEQ ID NO: 6457179 - DNA, 15 bp, Homo sapiens
tgagcccccagcttc

SEQ ID NO: 6457180 - DNA, 13 bp, Homo sapiens
tgagccccccatg

SEQ ID NO: 6457181 - DNA, 15 bp, Homo sapiens
tgagccccccatgcc

SEQ ID NO: 6457182 - DNA, 22 bp, Homo sapiens
tgagcccccccaacactgtgcc

SEQ ID NO: 6457183 - DNA, 23 bp, Homo sapiens
tgagccccctgagttcccaaagg

SEQ ID NO: 6457184 - DNA, 16 bp, Homo sapiens
tgagccccctgcaccc

SEQ ID NO: 6457185 - DNA, 18 bp, Homo sapiens
tgagccccctgcacccac

SEQ ID NO: 6457186 - DNA, 23 bp, Homo sapiens
tcctgaaccgcacagctcaggag

SEQ ID NO: 6457187 - DNA, 16 bp, Homo sapiens
tcctgaacctgatgct

SEQ ID NO: 6457188 - DNA, 20 bp, Homo sapiens
tcctgaacctgatgctgact

SEQ ID NO: 6457189 - DNA, 15 bp, Homo sapiens
tcctgaacctggaaa

SEQ ID NO: 6457190 - DNA, 18 bp, Homo sapiens
tcctgaacctttcaaaat

SEQ ID NO: 6457191 - DNA, 19 bp, Homo sapiens
tcctgaactcttctgcaaa

SEQ ID NO: 6457192 - DNA, 15 bp, Homo sapiens
tcctgaactggccac

SEQ ID NO: 6457193 - DNA, 19 bp, Homo sapiens
tcctgaactttctccctca

SEQ ID NO: 6457194 - DNA, 16 bp, Homo sapiens
tcctgaagaaccagtc

SEQ ID NO: 6457195 - DNA, 23 bp, Homo sapiens
tcctgaagaaccagtccccccac

SEQ ID NO: 6457196 - DNA, 14 bp, Homo sapiens
tcctgaagaattaa

SEQ ID NO: 6457197 - DNA, 15 bp, Homo sapiens
tcctgaagaattgaa

SEQ ID NO: 6457198 - DNA, 21 bp, Homo sapiens
tcctgaagaggcgggccagcc

SEQ ID NO: 6457199 - DNA, 22 bp, Homo sapiens
tcctgaagaggcgggccagcca

SEQ ID NO: 6457200 - DNA, 16 bp, Homo sapiens
tcctgaagcagtgtcg

SEQ ID NO: 6457201 - DNA, 13 bp, Homo sapiens
tcctgaagcctct

SEQ ID NO: 6457202 - DNA, 17 bp, Homo sapiens
tcctgaagctgctgtgt

SEQ ID NO: 6457203 - DNA, 15 bp, Homo sapiens
tcctgaagggaaggc

SEQ ID NO: 6457204 - DNA, 20 bp, Homo sapiens
tcctgaagtgtcgagtccag

SEQ ID NO: 6457205 - DNA, 21 bp, Homo sapiens
tcctgaagtgtcgagtccagt

SEQ ID NO: 6457206 - DNA, 18 bp, Homo sapiens
tcctgaatatcagtcact

SEQ ID NO: 6457207 - DNA, 19 bp, Homo sapiens
tcctgaatgaaatatcaga

SEQ ID NO: 6457208 - DNA, 19 bp, Homo sapiens
tcctgaatgtagcgtgtaa

SEQ ID NO: 6457209 - DNA, 21 bp, Homo sapiens
tcctgaattttattttttggg

SEQ ID NO: 6457210 - DNA, 22 bp, Homo sapiens
tcctgacaaatattttagaagc

SEQ ID NO: 6457211 - DNA, 18 bp, Homo sapiens
tcctgacaacgtctcttc

SEQ ID NO: 6457212 - DNA, 19 bp, Homo sapiens
tcctgacaacgtctcttca

SEQ ID NO: 6457213 - DNA, 16 bp, Homo sapiens
tcctgacaccccactt

SEQ ID NO: 6457214 - DNA, 20 bp, Homo sapiens
tcctgacaccccacttagcc

SEQ ID NO: 6457215 - DNA, 19 bp, Homo sapiens
tcctgacacccttctccca

SEQ ID NO: 6457216 - DNA, 21 bp, Homo sapiens
tcctgacacccttctcccact

SEQ ID NO: 6457217 - DNA, 19 bp, Homo sapiens
tcctgacactcaataaaca

SEQ ID NO: 6457218 - DNA, 21 bp, Homo sapiens
tcctgacactcaataaacagt

SEQ ID NO: 6457219 - DNA, 22 bp, Homo sapiens
tcctgacactcaataaacagtc

SEQ ID NO: 6457220 - DNA, 17 bp, Homo sapiens
tcctgacactgctggag

SEQ ID NO: 6457221 - DNA, 15 bp, Homo sapiens
tcctgacagaaggtg

SEQ ID NO: 6457222 - DNA, 16 bp, Homo sapiens
tcctgacagaaggtgc

SEQ ID NO: 6457223 - DNA, 14 bp, Homo sapiens
tcctgacagatgcc

SEQ ID NO: 6457224 - DNA, 16 bp, Homo sapiens
tcctgacagccacacg

SEQ ID NO: 6457225 - DNA, 22 bp, Homo sapiens
tcctgacagcgccatgtgtgtc

SEQ ID NO: 6457226 - DNA, 19 bp, Homo sapiens
tcctgacatattcaagtga

SEQ ID NO: 6457227 - DNA, 14 bp, Homo sapiens
tcctgacattgtct

SEQ ID NO: 6457228 - DNA, 12 bp, Homo sapiens
tcctgaccaaag

SEQ ID NO: 6457229 - DNA, 14 bp, Homo sapiens
tcctgaccaaagac

SEQ ID NO: 6457230 - DNA, 14 bp, Homo sapiens
tcctgaccaaagga

SEQ ID NO: 6457231 - DNA, 20 bp, Homo sapiens
tcctgaccaagactgagcca

SEQ ID NO: 6457232 - DNA, 13 bp, Homo sapiens
tcctgaccaccct

SEQ ID NO: 6457233 - DNA, 11 bp, Homo sapiens
tcctgaccagc

SEQ ID NO: 6457234 - DNA, 12 bp, Homo sapiens
tcctgacccagg

SEQ ID NO: 6457235 - DNA, 14 bp, Homo sapiens
tcctgacccaggcc

SEQ ID NO: 6457236 - DNA, 14 bp, Homo sapiens
tcctgacccagtcc

SEQ ID NO: 6457237 - DNA, 16 bp, Homo sapiens
tcctgacccagtcccc

SEQ ID NO: 6457238 - DNA, 17 bp, Homo sapiens
tcctgacccattgctgt

SEQ ID NO: 6457239 - DNA, 21 bp, Homo sapiens
tcctgaccccaagttatccac

SEQ ID NO: 6457240 - DNA, 21 bp, Homo sapiens
tcctgacccctccctgcaggg

SEQ ID NO: 6457241 - DNA, 23 bp, Homo sapiens
tcctgacccctccctgcaggggc

SEQ ID NO: 6457242 - DNA, 15 bp, Homo sapiens
tcctgacccctgcct

SEQ ID NO: 6457243 - DNA, 16 bp, Homo sapiens
tcctgacccctgcctg

SEQ ID NO: 6457244 - DNA, 14 bp, Homo sapiens
tcctgaccctcact

SEQ ID NO: 6457245 - DNA, 12 bp, Homo sapiens
tcctgaccctcc

SEQ ID NO: 6457246 - DNA, 20 bp, Homo sapiens
tcctgaccctcccactccca

SEQ ID NO: 6457247 - DNA, 18 bp, Homo sapiens
tcctgaccctccgctgca

SEQ ID NO: 6457248 - DNA, 19 bp, Homo sapiens
tcctgacctcaggtgatcc

SEQ ID NO: 6457249 - DNA, 18 bp, Homo sapiens
tcctgacctcatgatcca

SEQ ID NO: 6457250 - DNA, 15 bp, Homo sapiens
tcctgacctccgcca

SEQ ID NO: 6457251 - DNA, 20 bp, Homo sapiens
tcctgacctccgccatccac

SEQ ID NO: 6457252 - DNA, 21 bp, Homo sapiens
tcctgacctcctcctgccctc

SEQ ID NO: 6457253 - DNA, 18 bp, Homo sapiens
tcctgacctcgtgatcca

SEQ ID NO: 6457254 - DNA, 23 bp, Homo sapiens
tcctgacctgcgggtcctcagct

SEQ ID NO: 6457255 - DNA, 15 bp, Homo sapiens
tcctgacctgtctca

SEQ ID NO: 6457256 - DNA, 15 bp, Homo sapiens
tcctgaccttgtgat

SEQ ID NO: 6457257 - DNA, 14 bp, Homo sapiens
tcctgacgccctgc

SEQ ID NO: 6457258 - DNA, 18 bp, Homo sapiens
tcctgacggcgccttttt

SEQ ID NO: 6457259 - DNA, 17 bp, Homo sapiens
tcctgactattatgttg

SEQ ID NO: 6457260 - DNA, 21 bp, Homo sapiens
tcctgactccagtgagctgga

SEQ ID NO: 6457261 - DNA, 19 bp, Homo sapiens
tcctgactccgtcaagctg

SEQ ID NO: 6457262 - DNA, 17 bp, Homo sapiens
tcctgactctgccccct

SEQ ID NO: 6457263 - DNA, 14 bp, Homo sapiens
tcctgactgacaca

SEQ ID NO: 6457264 - DNA, 16 bp, Homo sapiens
tcctgactgacacagg

SEQ ID NO: 6457265 - DNA, 23 bp, Homo sapiens
tcctgactgacacaggccagccc

SEQ ID NO: 6457266 - DNA, 17 bp, Homo sapiens
tcctgactgggctgggt

SEQ ID NO: 6457267 - DNA, 14 bp, Homo sapiens
tcctgactggtgct

SEQ ID NO: 6457268 - DNA, 16 bp, Homo sapiens
tcctgactgtctgcta

SEQ ID NO: 6457269 - DNA, 15 bp, Homo sapiens
tcctgactgttctct

SEQ ID NO: 6457270 - DNA, 18 bp, Homo sapiens
tcctgacttaacgttcta

SEQ ID NO: 6457271 - DNA, 17 bp, Homo sapiens
tcctgacttgagtgttc

SEQ ID NO: 6457272 - DNA, 17 bp, Homo sapiens
tcctgactttgccccct

SEQ ID NO: 6457273 - DNA, 23 bp, Homo sapiens
tcctgagaaacgtccatctctct

SEQ ID NO: 6457274 - DNA, 21 bp, Homo sapiens
tcctgagaaagcccacctggg

SEQ ID NO: 6457275 - DNA, 16 bp, Homo sapiens
tcctgagaaagctcaa

SEQ ID NO: 6457276 - DNA, 18 bp, Homo sapiens
tcctgagaaagctcaaag

SEQ ID NO: 6457277 - DNA, 13 bp, Homo sapiens
tcctgagaagcat

SEQ ID NO: 6457278 - DNA, 16 bp, Homo sapiens
tcctgagaaggcgagg

SEQ ID NO: 6457279 - DNA, 17 bp, Homo sapiens
tcctgagaaggcgagga

SEQ ID NO: 6457280 - DNA, 16 bp, Homo sapiens
tcctgagaagtagagt

SEQ ID NO: 6457281 - DNA, 21 bp, Homo sapiens
tcctgagacacatgggtgcta

SEQ ID NO: 6457282 - DNA, 16 bp, Homo sapiens
tcctgagacagaatta

SEQ ID NO: 6457283 - DNA, 17 bp, Homo sapiens
tcctgagacccctggcc

SEQ ID NO: 6457284 - DNA, 23 bp, Homo sapiens
tcctgagagacctgccctctctg

SEQ ID NO: 6457285 - DNA, 18 bp, Homo sapiens
tcctgagagctgcatgtg

SEQ ID NO: 6457286 - DNA, 15 bp, Homo sapiens
tcctgagagctgttc

SEQ ID NO: 6457287 - DNA, 15 bp, Homo sapiens
tcctgagaggtgctg

SEQ ID NO: 6457288 - DNA, 16 bp, Homo sapiens
tcctgagattctggga

SEQ ID NO: 6457289 - DNA, 20 bp, Homo sapiens
tcctgagattctgggaaagg

SEQ ID NO: 6457290 - DNA, 15 bp, Homo sapiens
tcctgagcacccgct

SEQ ID NO: 6457291 - DNA, 13 bp, Homo sapiens
tcctgagcactgc

SEQ ID NO: 6457292 - DNA, 15 bp, Homo sapiens
tcctgagcactgcca

SEQ ID NO: 6457293 - DNA, 18 bp, Homo sapiens
tcctgagcactgccagga

SEQ ID NO: 6457294 - DNA, 19 bp, Homo sapiens
tcctgagcactgccaggag

SEQ ID NO: 6457295 - DNA, 22 bp, Homo sapiens
tcctgagcactgccaggaggga

SEQ ID NO: 6457296 - DNA, 23 bp, Homo sapiens
tcctgagcactgccaggagggac

SEQ ID NO: 6457297 - DNA, 18 bp, Homo sapiens
tcctgagcagtccctgct

SEQ ID NO: 6457298 - DNA, 21 bp, Homo sapiens
tcctgagcccaaccaggccct

SEQ ID NO: 6457299 - DNA, 23 bp, Homo sapiens
tcctgagcccaaccaggccctgc

SEQ ID NO: 6457300 - DNA, 16 bp, Homo sapiens
tcctgagccccaggga

SEQ ID NO: 6457301 - DNA, 17 bp, Homo sapiens
tcctgagcccccagctt

SEQ ID NO: 6457302 - DNA, 19 bp, Homo sapiens
tcctgagcccccagcttcc

SEQ ID NO: 6457303 - DNA, 18 bp, Homo sapiens
tcctgagccccctgcacc

SEQ ID NO: 6457304 - DNA, 19 bp, Homo sapiens
tcctgagccccctgcaccc

SEQ ID NO: 6457305 - DNA, 22 bp, Homo sapiens
tcctgagctagcaaatacagga

SEQ ID NO: 6457306 - DNA, 18 bp, Homo sapiens
tcctgagctcagcgtgga

SEQ ID NO: 6457307 - DNA, 19 bp, Homo sapiens
tcctgagctcagcgtggag

SEQ ID NO: 6457308 - DNA, 22 bp, Homo sapiens
tcctgagctcggggggctctgc

SEQ ID NO: 6457309 - DNA, 14 bp, Homo sapiens
tcctgagctggcct

SEQ ID NO: 6457310 - DNA, 16 bp, Homo sapiens
tcctgagctggcctgt

SEQ ID NO: 6457311 - DNA, 20 bp, Homo sapiens
tcctgagctgtcgctgcctc

SEQ ID NO: 6457312 - DNA, 15 bp, Homo sapiens
tcctgagctttatgg

SEQ ID NO: 6457313 - DNA, 14 bp, Homo sapiens
tcctgaggaataaa

SEQ ID NO: 6457314 - DNA, 18 bp, Homo sapiens
tcctgaggacagctgtcc

SEQ ID NO: 6457315 - DNA, 13 bp, Homo sapiens
tcctgaggagcag

SEQ ID NO: 6457316 - DNA, 21 bp, Homo sapiens
tcctgaggagtgtcctgtctg

SEQ ID NO: 6457317 - DNA, 23 bp, Homo sapiens
tcctgaggagtgtcctgtctgct

SEQ ID NO: 6457318 - DNA, 16 bp, Homo sapiens
tcctgaggcagaacct

SEQ ID NO: 6457319 - DNA, 12 bp, Homo sapiens
tcctgaggccag

SEQ ID NO: 6457320 - DNA, 15 bp, Homo sapiens
tcctgaggccagtgg

SEQ ID NO: 6457321 - DNA, 16 bp, Homo sapiens
tcctgaggcctccaag

SEQ ID NO: 6457322 - DNA, 20 bp, Homo sapiens
tcctgaggctccacttggtc

SEQ ID NO: 6457323 - DNA, 15 bp, Homo sapiens
tcctgaggctgggct

SEQ ID NO: 6457324 - DNA, 16 bp, Homo sapiens
tcctgaggctttggat

SEQ ID NO: 6457325 - DNA, 17 bp, Homo sapiens
tcctgaggctttggatt

SEQ ID NO: 6457326 - DNA, 17 bp, Homo sapiens
tcctgagggaggacctg

SEQ ID NO: 6457327 - DNA, 12 bp, Homo sapiens
tcctgagggcta

SEQ ID NO: 6457328 - DNA, 23 bp, Homo sapiens
tcctgaggggagacagagcaacc

SEQ ID NO: 6457329 - DNA, 15 bp, Homo sapiens
tcctgaggggcatct

SEQ ID NO: 6457330 - DNA, 19 bp, Homo sapiens
tcctgaggggcatctgccc

SEQ ID NO: 6457331 - DNA, 22 bp, Homo sapiens
tcctgaggggcatctgcccctc

SEQ ID NO: 6457332 - DNA, 17 bp, Homo sapiens
tcctgagggtccccacc

SEQ ID NO: 6457333 - DNA, 16 bp, Homo sapiens
tcctgagggtcctgct

SEQ ID NO: 6457334 - DNA, 16 bp, Homo sapiens
tcctgaggtcatctgt

SEQ ID NO: 6457335 - DNA, 18 bp, Homo sapiens
tcctgaggtcatctgtaa

SEQ ID NO: 6457336 - DNA, 18 bp, Homo sapiens
tcctgaggtgcctcccag

SEQ ID NO: 6457337 - DNA, 22 bp, Homo sapiens
tcctgaggtgcctcccagtggc

SEQ ID NO: 6457338 - DNA, 19 bp, Homo sapiens
tcctgaggtggatttactg

SEQ ID NO: 6457339 - DNA, 13 bp, Homo sapiens
tcctgagtagctg

SEQ ID NO: 6457340 - DNA, 14 bp, Homo sapiens
tcctgagtagctgg

SEQ ID NO: 6457341 - DNA, 15 bp, Homo sapiens
tcctgagtagctggg

SEQ ID NO: 6457342 - DNA, 17 bp, Homo sapiens
tcctgagtagctgggac

SEQ ID NO: 6457343 - DNA, 20 bp, Homo sapiens
tcctgagtagctgggactac

SEQ ID NO: 6457344 - DNA, 20 bp, Homo sapiens
tcctgagtagctgggattac

SEQ ID NO: 6457345 - DNA, 17 bp, Homo sapiens
tcctgagtagctgggcc

SEQ ID NO: 6457346 - DNA, 20 bp, Homo sapiens
tcctgagtagctgggcctgt

SEQ ID NO: 6457347 - DNA, 23 bp, Homo sapiens
tcctgagtagctgggcctgtgca

SEQ ID NO: 6457348 - DNA, 18 bp, Homo sapiens
tcctgagtgccccacttc

SEQ ID NO: 6457349 - DNA, 16 bp, Homo sapiens
tcctgagtggccaggg

SEQ ID NO: 6457350 - DNA, 19 bp, Homo sapiens
tcctgagttgtataaaagt

SEQ ID NO: 6457351 - DNA, 21 bp, Homo sapiens
tcctgataaaacaacagctcg

SEQ ID NO: 6457352 - DNA, 15 bp, Homo sapiens
tcctgataaagcaca

SEQ ID NO: 6457353 - DNA, 15 bp, Homo sapiens
tcctgataataaagg

SEQ ID NO: 6457354 - DNA, 18 bp, Homo sapiens
tcctgataataaaggaac

SEQ ID NO: 6457355 - DNA, 22 bp, Homo sapiens
tcctgataataaagtgactgaa

SEQ ID NO: 6457356 - DNA, 18 bp, Homo sapiens
tcctgatagtcacctgct

SEQ ID NO: 6457357 - DNA, 21 bp, Homo sapiens
tcctgatagtcacctgctggt

SEQ ID NO: 6457358 - DNA, 23 bp, Homo sapiens
tcctgatatgatttaaaacatgt

SEQ ID NO: 6457359 - DNA, 14 bp, Homo sapiens
tcctgatcagagcc

SEQ ID NO: 6457360 - DNA, 15 bp, Homo sapiens
tcctgatcagagccg

SEQ ID NO: 6457361 - DNA, 14 bp, Homo sapiens
tcctgatcagaggc

SEQ ID NO: 6457362 - DNA, 16 bp, Homo sapiens
tcctgatcagaggcat

SEQ ID NO: 6457363 - DNA, 22 bp, Homo sapiens
tcctgatcccagacccattcct

SEQ ID NO: 6457364 - DNA, 16 bp, Homo sapiens
tgagccccctgtgccc

SEQ ID NO: 6457365 - DNA, 19 bp, Homo sapiens
tgagccccctgtgcccacc

SEQ ID NO: 6457366 - DNA, 14 bp, Homo sapiens
tgagccccgccctc

SEQ ID NO: 6457367 - DNA, 19 bp, Homo sapiens
tgagcccctaccccacacc

SEQ ID NO: 6457368 - DNA, 17 bp, Homo sapiens
tgagcccctccccagcc

SEQ ID NO: 6457369 - DNA, 20 bp, Homo sapiens
tgagcccctccctcctgtgt

SEQ ID NO: 6457370 - DNA, 21 bp, Homo sapiens
tgagcccctccctcctgtgtt

SEQ ID NO: 6457371 - DNA, 14 bp, Homo sapiens
tgagcccctcctct

SEQ ID NO: 6457372 - DNA, 15 bp, Homo sapiens
tgagcccctcctctc

SEQ ID NO: 6457373 - DNA, 13 bp, Homo sapiens
tgagcccctggga

SEQ ID NO: 6457374 - DNA, 14 bp, Homo sapiens
tgagcccctgggac

SEQ ID NO: 6457375 - DNA, 14 bp, Homo sapiens
tgagcccctgggga

SEQ ID NO: 6457376 - DNA, 21 bp, Homo sapiens
tgagcccctgtctagagaggg

SEQ ID NO: 6457377 - DNA, 23 bp, Homo sapiens
tgagccccttcatccgcctgtgg

SEQ ID NO: 6457378 - DNA, 19 bp, Homo sapiens
tgagcccgaatttctcact

SEQ ID NO: 6457379 - DNA, 15 bp, Homo sapiens
tgagcccgcagccca

SEQ ID NO: 6457380 - DNA, 13 bp, Homo sapiens
tgagcccgggctg

SEQ ID NO: 6457381 - DNA, 22 bp, Homo sapiens
tgagcccgggctgcctgggctg

SEQ ID NO: 6457382 - DNA, 17 bp, Homo sapiens
tgagccctcagaaccct

SEQ ID NO: 6457383 - DNA, 14 bp, Homo sapiens
tgagccctccccag

SEQ ID NO: 6457384 - DNA, 16 bp, Homo sapiens
tgagccctccccagga

SEQ ID NO: 6457385 - DNA, 18 bp, Homo sapiens
tgagccctccctcttccc

SEQ ID NO: 6457386 - DNA, 10 bp, Homo sapiens
tgagccctgc

SEQ ID NO: 6457387 - DNA, 12 bp, Homo sapiens
tgagccctgctc

SEQ ID NO: 6457388 - DNA, 21 bp, Homo sapiens
tgagccctggaccccaggctc

SEQ ID NO: 6457389 - DNA, 22 bp, Homo sapiens
tgagccctggaccccaggctct

SEQ ID NO: 6457390 - DNA, 19 bp, Homo sapiens
tgagccctggctcccacct

SEQ ID NO: 6457391 - DNA, 20 bp, Homo sapiens
tgagccctggctcccacctg

SEQ ID NO: 6457392 - DNA, 22 bp, Homo sapiens
tgagccctgtacccaccccagc

SEQ ID NO: 6457393 - DNA, 24 bp, Homo sapiens
tgagcccttcggaggaccagggct

SEQ ID NO: 6457394 - DNA, 14 bp, Homo sapiens
tgagcccttgcaca

SEQ ID NO: 6457395 - DNA, 15 bp, Homo sapiens
tgagcccttgcacag

SEQ ID NO: 6457396 - DNA, 23 bp, Homo sapiens
tgagcccttgcacaggccacttg

SEQ ID NO: 6457397 - DNA, 18 bp, Homo sapiens
tgagccgagattgcacca

SEQ ID NO: 6457398 - DNA, 21 bp, Homo sapiens
tgagccgagattgcgccactg

SEQ ID NO: 6457399 - DNA, 20 bp, Homo sapiens
tgagccgcatcttctccatc

SEQ ID NO: 6457400 - DNA, 21 bp, Homo sapiens
tgagccgcatcttctccatct

SEQ ID NO: 6457401 - DNA, 23 bp, Homo sapiens
tgagccgcctcggagtgtggcct

SEQ ID NO: 6457402 - DNA, 15 bp, Homo sapiens
tgagccgcggggaag

SEQ ID NO: 6457403 - DNA, 23 bp, Homo sapiens
tgagccgcggggaagctggcttt

SEQ ID NO: 6457404 - DNA, 21 bp, Homo sapiens
tgagccgctgtgagcccctgg

SEQ ID NO: 6457405 - DNA, 17 bp, Homo sapiens
tgagccgggcccctggg

SEQ ID NO: 6457406 - DNA, 21 bp, Homo sapiens
tgagccggggccgtctgtgtg

SEQ ID NO: 6457407 - DNA, 23 bp, Homo sapiens
tgagccgtgacctccaggaaggg

SEQ ID NO: 6457408 - DNA, 18 bp, Homo sapiens
tgagccgtgcagctggga

SEQ ID NO: 6457409 - DNA, 13 bp, Homo sapiens
tgagcctaaaaat

SEQ ID NO: 6457410 - DNA, 16 bp, Homo sapiens
tgagcctaaaaataaa

SEQ ID NO: 6457411 - DNA, 16 bp, Homo sapiens
tgagcctactgtctcc

SEQ ID NO: 6457412 - DNA, 20 bp, Homo sapiens
tgagcctactgtctccttcc

SEQ ID NO: 6457413 - DNA, 22 bp, Homo sapiens
tgagcctactgtctccttccca

SEQ ID NO: 6457414 - DNA, 19 bp, Homo sapiens
tgagcctatatcagtcgtt

SEQ ID NO: 6457415 - DNA, 15 bp, Homo sapiens
tgagcctcacagcag

SEQ ID NO: 6457416 - DNA, 18 bp, Homo sapiens
tgagcctcagcatcctgg

SEQ ID NO: 6457417 - DNA, 15 bp, Homo sapiens
tgagcctcctgtgcc

SEQ ID NO: 6457418 - DNA, 24 bp, Homo sapiens
tgagcctcctgtgcctggccccag

SEQ ID NO: 6457419 - DNA, 16 bp, Homo sapiens
tgagcctcgtgtccag

SEQ ID NO: 6457420 - DNA, 12 bp, Homo sapiens
tgagcctctcct

SEQ ID NO: 6457421 - DNA, 20 bp, Homo sapiens
tgagcctctccttgccccag

SEQ ID NO: 6457422 - DNA, 14 bp, Homo sapiens
tgagcctctgctcc

SEQ ID NO: 6457423 - DNA, 18 bp, Homo sapiens
tgagcctctgctccccag

SEQ ID NO: 6457424 - DNA, 23 bp, Homo sapiens
tgagcctctttaacagctttctc

SEQ ID NO: 6457425 - DNA, 12 bp, Homo sapiens
tgagcctctttg

SEQ ID NO: 6457426 - DNA, 14 bp, Homo sapiens
tgagcctgagcaga

SEQ ID NO: 6457427 - DNA, 17 bp, Homo sapiens
tgagcctgcagggaagc

SEQ ID NO: 6457428 - DNA, 22 bp, Homo sapiens
tgagcctgccaaagtgcctggg

SEQ ID NO: 6457429 - DNA, 21 bp, Homo sapiens
tgagcctgcccgctgcaatgc

SEQ ID NO: 6457430 - DNA, 10 bp, Homo sapiens
tgagcctggc

SEQ ID NO: 6457431 - DNA, 20 bp, Homo sapiens
tgagcctggcaggtcccctg

SEQ ID NO: 6457432 - DNA, 12 bp, Homo sapiens
tgagcctggcca

SEQ ID NO: 6457433 - DNA, 16 bp, Homo sapiens
tgagcctggccagcct

SEQ ID NO: 6457434 - DNA, 16 bp, Homo sapiens
tgagcctggctgtcca

SEQ ID NO: 6457435 - DNA, 14 bp, Homo sapiens
tgagcctgggaggt

SEQ ID NO: 6457436 - DNA, 19 bp, Homo sapiens
tgagcctgtcacgtggtca

SEQ ID NO: 6457437 - DNA, 22 bp, Homo sapiens
tgagcctgtcacgtggtcaagg

SEQ ID NO: 6457438 - DNA, 11 bp, Homo sapiens
tgagcctgtct

SEQ ID NO: 6457439 - DNA, 21 bp, Homo sapiens
tgagcctgtgggtccccactc

SEQ ID NO: 6457440 - DNA, 12 bp, Homo sapiens
tgagcctgtgtc

SEQ ID NO: 6457441 - DNA, 15 bp, Homo sapiens
tgagcctgtgtcctg

SEQ ID NO: 6457442 - DNA, 18 bp, Homo sapiens
tgagcctgtttattgcca

SEQ ID NO: 6457443 - DNA, 15 bp, Homo sapiens
tgagccttaagaaat

SEQ ID NO: 6457444 - DNA, 21 bp, Homo sapiens
tgagccttagaatctgtagag

SEQ ID NO: 6457445 - DNA, 18 bp, Homo sapiens
tgagccttagctcccagc

SEQ ID NO: 6457446 - DNA, 16 bp, Homo sapiens
tgagccttcaggccag

SEQ ID NO: 6457447 - DNA, 19 bp, Homo sapiens
tgagccttcaggccagctg

SEQ ID NO: 6457448 - DNA, 13 bp, Homo sapiens
tgagccttcagtc

SEQ ID NO: 6457449 - DNA, 15 bp, Homo sapiens
tgagccttcagtcag

SEQ ID NO: 6457450 - DNA, 14 bp, Homo sapiens
tgagccttgaactt

SEQ ID NO: 6457451 - DNA, 15 bp, Homo sapiens
tgagccttgaacttt

SEQ ID NO: 6457452 - DNA, 21 bp, Homo sapiens
tgagccttgcatgtacttgaa

SEQ ID NO: 6457453 - DNA, 21 bp, Homo sapiens
tgagccttttcttatataaga

SEQ ID NO: 6457454 - DNA, 16 bp, Homo sapiens
tgagcgaaatccaaga

SEQ ID NO: 6457455 - DNA, 16 bp, Homo sapiens
tgagcgacaaagatga

SEQ ID NO: 6457456 - DNA, 17 bp, Homo sapiens
tgagcgacaaagatgat

SEQ ID NO: 6457457 - DNA, 20 bp, Homo sapiens
tgagcgaggaaaaacaacaa

SEQ ID NO: 6457458 - DNA, 14 bp, Homo sapiens
tgagcgagtgacag

SEQ ID NO: 6457459 - DNA, 15 bp, Homo sapiens
tgagcgagtgacaga

SEQ ID NO: 6457460 - DNA, 20 bp, Homo sapiens
tgagcgagtgacagaaggcc

SEQ ID NO: 6457461 - DNA, 23 bp, Homo sapiens
tgagcgagtggagtctgccaccc

SEQ ID NO: 6457462 - DNA, 19 bp, Homo sapiens
tgagcgagtggatgctgtg

SEQ ID NO: 6457463 - DNA, 23 bp, Homo sapiens
tgagcgattattatctaaagtgt

SEQ ID NO: 6457464 - DNA, 20 bp, Homo sapiens
tgagcgcagcgcctccaccc

SEQ ID NO: 6457465 - DNA, 14 bp, Homo sapiens
tgagcgccacctct

SEQ ID NO: 6457466 - DNA, 22 bp, Homo sapiens
tgagcgcccccgagccctgact

SEQ ID NO: 6457467 - DNA, 23 bp, Homo sapiens
tgagcgccccgcccccaccccta

SEQ ID NO: 6457468 - DNA, 13 bp, Homo sapiens
tgagcgccttggt

SEQ ID NO: 6457469 - DNA, 18 bp, Homo sapiens
tgagcgctcctgccgcag

SEQ ID NO: 6457470 - DNA, 18 bp, Homo sapiens
tgagcgctggctccctgg

SEQ ID NO: 6457471 - DNA, 22 bp, Homo sapiens
tgagcggaggctcggccgtggg

SEQ ID NO: 6457472 - DNA, 15 bp, Homo sapiens
tgagcggcaccctgg

SEQ ID NO: 6457473 - DNA, 20 bp, Homo sapiens
tgagcggccgcagagactgg

SEQ ID NO: 6457474 - DNA, 21 bp, Homo sapiens
tgagcgggtctagtggaaaga

SEQ ID NO: 6457475 - DNA, 14 bp, Homo sapiens
tgagcgggtggggt

SEQ ID NO: 6457476 - DNA, 15 bp, Homo sapiens
tgagcgggtggggtg

SEQ ID NO: 6457477 - DNA, 15 bp, Homo sapiens
tgagcgtcaaagaaa

SEQ ID NO: 6457478 - DNA, 16 bp, Homo sapiens
tgagcgtccaggtgat

SEQ ID NO: 6457479 - DNA, 18 bp, Homo sapiens
tgagcgtgcgtctgtgtg

SEQ ID NO: 6457480 - DNA, 15 bp, Homo sapiens
tgagcgtggaagggg

SEQ ID NO: 6457481 - DNA, 15 bp, Homo sapiens
tgagcgtggccttgg

SEQ ID NO: 6457482 - DNA, 16 bp, Homo sapiens
tgagcgtggccttggg

SEQ ID NO: 6457483 - DNA, 15 bp, Homo sapiens
tgagcgtgtccacag

SEQ ID NO: 6457484 - DNA, 21 bp, Homo sapiens
tgagcgttcagttgacacatt

SEQ ID NO: 6457485 - DNA, 16 bp, Homo sapiens
tgagcgtttgcacggt

SEQ ID NO: 6457486 - DNA, 18 bp, Homo sapiens
tgagctaactgagagaag

SEQ ID NO: 6457487 - DNA, 14 bp, Homo sapiens
tgagctacatgtgt

SEQ ID NO: 6457488 - DNA, 23 bp, Homo sapiens
tgagctaccgtggatctccttcc

SEQ ID NO: 6457489 - DNA, 16 bp, Homo sapiens
tgagctacttcttatt

SEQ ID NO: 6457490 - DNA, 17 bp, Homo sapiens
tgagctagaccaaggtc

SEQ ID NO: 6457491 - DNA, 20 bp, Homo sapiens
tgagctagaccaaggtcaga

SEQ ID NO: 6457492 - DNA, 19 bp, Homo sapiens
tgagctagcaaatacagga

SEQ ID NO: 6457493 - DNA, 16 bp, Homo sapiens
tgagctaggaagagtc

SEQ ID NO: 6457494 - DNA, 15 bp, Homo sapiens
tgagctaggagaagg

SEQ ID NO: 6457495 - DNA, 13 bp, Homo sapiens
tgagctaggcatg

SEQ ID NO: 6457496 - DNA, 15 bp, Homo sapiens
tgagctagtgtctta

SEQ ID NO: 6457497 - DNA, 17 bp, Homo sapiens
tgagctagtgtcttatg

SEQ ID NO: 6457498 - DNA, 18 bp, Homo sapiens
tgagctataatgtttccc

SEQ ID NO: 6457499 - DNA, 17 bp, Homo sapiens
tgagctatgagcccagc

SEQ ID NO: 6457500 - DNA, 18 bp, Homo sapiens
tgagctatgatatgtgct

SEQ ID NO: 6457501 - DNA, 16 bp, Homo sapiens
tgagctattgctgttc

SEQ ID NO: 6457502 - DNA, 15 bp, Homo sapiens
tgagctatttcatct

SEQ ID NO: 6457503 - DNA, 15 bp, Homo sapiens
tgagctattttcctc

SEQ ID NO: 6457504 - DNA, 20 bp, Homo sapiens
tgagctattttcctctggcc

SEQ ID NO: 6457505 - DNA, 21 bp, Homo sapiens
tgagctcaaactggccttggt

SEQ ID NO: 6457506 - DNA, 18 bp, Homo sapiens
tgagctcacaaggcagca

SEQ ID NO: 6457507 - DNA, 20 bp, Homo sapiens
tgagctcacaaggcagcaag

SEQ ID NO: 6457508 - DNA, 22 bp, Homo sapiens
tgagctcacaaggcagcaaggc

SEQ ID NO: 6457509 - DNA, 23 bp, Homo sapiens
tgagctcacaaggcagcaaggcc

SEQ ID NO: 6457510 - DNA, 12 bp, Homo sapiens
tgagctcagccc

SEQ ID NO: 6457511 - DNA, 17 bp, Homo sapiens
tgagctcaggagagagc

SEQ ID NO: 6457512 - DNA, 19 bp, Homo sapiens
tgagctcaggaggtcaaga

SEQ ID NO: 6457513 - DNA, 19 bp, Homo sapiens
tgagctcaggagtttgaga

SEQ ID NO: 6457514 - DNA, 13 bp, Homo sapiens
tgagctcaggcat

SEQ ID NO: 6457515 - DNA, 14 bp, Homo sapiens
tgagctcaggctga

SEQ ID NO: 6457516 - DNA, 17 bp, Homo sapiens
tgagctcaggctgagcc

SEQ ID NO: 6457517 - DNA, 18 bp, Homo sapiens
tgagctcaggctgagccc

SEQ ID NO: 6457518 - DNA, 13 bp, Homo sapiens
tgagctccacctc

SEQ ID NO: 6457519 - DNA, 12 bp, Homo sapiens
tgagctccagac

SEQ ID NO: 6457520 - DNA, 16 bp, Homo sapiens
tgagctccagaccccc

SEQ ID NO: 6457521 - DNA, 18 bp, Homo sapiens
tgagctccagacccccag

SEQ ID NO: 6457522 - DNA, 19 bp, Homo sapiens
tgagctccagacccccagc

SEQ ID NO: 6457523 - DNA, 21 bp, Homo sapiens
tgagctccagacccccagcaa

SEQ ID NO: 6457524 - DNA, 14 bp, Homo sapiens
tgagctccagccac

SEQ ID NO: 6457525 - DNA, 15 bp, Homo sapiens
tgagctccagccacc

SEQ ID NO: 6457526 - DNA, 16 bp, Homo sapiens
tgagctccatgtgccc

SEQ ID NO: 6457527 - DNA, 14 bp, Homo sapiens
tgagctcccacctc

SEQ ID NO: 6457528 - DNA, 16 bp, Homo sapiens
tgagctcccacctccc

SEQ ID NO: 6457529 - DNA, 20 bp, Homo sapiens
tgagctcccacttctgccag

SEQ ID NO: 6457530 - DNA, 21 bp, Homo sapiens
tgagctcccacttctgccaga

SEQ ID NO: 6457531 - DNA, 21 bp, Homo sapiens
tgagctccccaaaaacctcac

SEQ ID NO: 6457532 - DNA, 20 bp, Homo sapiens
tgagctccccaccaccccag

SEQ ID NO: 6457533 - DNA, 23 bp, Homo sapiens
tgagctccccaccaccccagctg

SEQ ID NO: 6457534 - DNA, 13 bp, Homo sapiens
tgagctcctctgg

SEQ ID NO: 6457535 - DNA, 14 bp, Homo sapiens
tgagctcctctggg

SEQ ID NO: 6457536 - DNA, 19 bp, Homo sapiens
tgagctcctctgggcagga

SEQ ID NO: 6457537 - DNA, 15 bp, Homo sapiens
tgagctcctgctgcg

SEQ ID NO: 6457538 - DNA, 16 bp, Homo sapiens
tgagctcctgctgcgg

SEQ ID NO: 6457539 - DNA, 20 bp, Homo sapiens
tgagctcctgtcccctgcta

SEQ ID NO: 6457540 - DNA, 22 bp, Homo sapiens
tgagctcctgtcccctgctaca

SEQ ID NO: 6457541 - DNA, 21 bp, Homo sapiens
tgagctccttaaggctctttt

SEQ ID NO: 6457542 - DNA, 21 bp, Homo sapiens
tcctgatcctaaccctgggct

SEQ ID NO: 6457543 - DNA, 22 bp, Homo sapiens
tcctgatctagcactcctcaag

SEQ ID NO: 6457544 - DNA, 17 bp, Homo sapiens
tcctgatgacccaggct

SEQ ID NO: 6457545 - DNA, 17 bp, Homo sapiens
tcctgatgatgattctt

SEQ ID NO: 6457546 - DNA, 16 bp, Homo sapiens
tcctgatgatgctggc

SEQ ID NO: 6457547 - DNA, 19 bp, Homo sapiens
tcctgatgatgctggccct

SEQ ID NO: 6457548 - DNA, 14 bp, Homo sapiens
tcctgatgctggat

SEQ ID NO: 6457549 - DNA, 19 bp, Homo sapiens
tcctgatggacctgccccg

SEQ ID NO: 6457550 - DNA, 18 bp, Homo sapiens
tcctgatggagtgtgcag

SEQ ID NO: 6457551 - DNA, 21 bp, Homo sapiens
tcctgatggagtgtgcagaca

SEQ ID NO: 6457552 - DNA, 18 bp, Homo sapiens
tcctgatggtacaggaaa

SEQ ID NO: 6457553 - DNA, 17 bp, Homo sapiens
tcctgatggtcagctcc

SEQ ID NO: 6457554 - DNA, 19 bp, Homo sapiens
tcctgatggtcagctccct

SEQ ID NO: 6457555 - DNA, 15 bp, Homo sapiens
tcctgattaaatgtc

SEQ ID NO: 6457556 - DNA, 21 bp, Homo sapiens
tcctgattaaggcgtggcttc

SEQ ID NO: 6457557 - DNA, 14 bp, Homo sapiens
tcctgattattgaa

SEQ ID NO: 6457558 - DNA, 21 bp, Homo sapiens
tcctgattattgaatgttata

SEQ ID NO: 6457559 - DNA, 15 bp, Homo sapiens
tcctgattattttca

SEQ ID NO: 6457560 - DNA, 22 bp, Homo sapiens
tcctgattcccgcatggttttt

SEQ ID NO: 6457561 - DNA, 16 bp, Homo sapiens
tcctgattctaaaatg

SEQ ID NO: 6457562 - DNA, 22 bp, Homo sapiens
tcctgattctaaaatgtctcaa

SEQ ID NO: 6457563 - DNA, 14 bp, Homo sapiens
tcctgattgctctg

SEQ ID NO: 6457564 - DNA, 23 bp, Homo sapiens
tcctgattggtttctcttctccc

SEQ ID NO: 6457565 - DNA, 17 bp, Homo sapiens
tcctgcaaaattttata

SEQ ID NO: 6457566 - DNA, 13 bp, Homo sapiens
tcctgcaaaggcc

SEQ ID NO: 6457567 - DNA, 18 bp, Homo sapiens
tcctgcaaaggcccttgt

SEQ ID NO: 6457568 - DNA, 11 bp, Homo sapiens
tcctgcaaagt

SEQ ID NO: 6457569 - DNA, 18 bp, Homo sapiens
tcctgcaactcaaggact

SEQ ID NO: 6457570 - DNA, 19 bp, Homo sapiens
tcctgcaagggacaggaag

SEQ ID NO: 6457571 - DNA, 20 bp, Homo sapiens
tcctgcaagggacaggaagg

SEQ ID NO: 6457572 - DNA, 16 bp, Homo sapiens
tcctgcaatctccagg

SEQ ID NO: 6457573 - DNA, 17 bp, Homo sapiens
tcctgcaatctccaggg

SEQ ID NO: 6457574 - DNA, 18 bp, Homo sapiens
tcctgcaatctccagggc

SEQ ID NO: 6457575 - DNA, 19 bp, Homo sapiens
tcctgcaatctccagggct

SEQ ID NO: 6457576 - DNA, 21 bp, Homo sapiens
tcctgcaatgaagtctctgaa

SEQ ID NO: 6457577 - DNA, 16 bp, Homo sapiens
tcctgcaatttctccc

SEQ ID NO: 6457578 - DNA, 15 bp, Homo sapiens
tcctgcacacagaat

SEQ ID NO: 6457579 - DNA, 15 bp, Homo sapiens
tcctgcacaccctgg

SEQ ID NO: 6457580 - DNA, 14 bp, Homo sapiens
tcctgcacacgctc

SEQ ID NO: 6457581 - DNA, 11 bp, Homo sapiens
tcctgcacatg

SEQ ID NO: 6457582 - DNA, 12 bp, Homo sapiens
tcctgcacatga

SEQ ID NO: 6457583 - DNA, 13 bp, Homo sapiens
tcctgcaccccag

SEQ ID NO: 6457584 - DNA, 16 bp, Homo sapiens
tcctgcaccccagcat

SEQ ID NO: 6457585 - DNA, 20 bp, Homo sapiens
tcctgcaccccagcattcca

SEQ ID NO: 6457586 - DNA, 13 bp, Homo sapiens
tcctgcaccctct

SEQ ID NO: 6457587 - DNA, 15 bp, Homo sapiens
tcctgcaccctctgc

SEQ ID NO: 6457588 - DNA, 21 bp, Homo sapiens
tcctgcaccctctgctatgtc

SEQ ID NO: 6457589 - DNA, 20 bp, Homo sapiens
tcctgcacgccgtggagcat

SEQ ID NO: 6457590 - DNA, 14 bp, Homo sapiens
tcctgcactccaga

SEQ ID NO: 6457591 - DNA, 16 bp, Homo sapiens
tcctgcactgactctg

SEQ ID NO: 6457592 - DNA, 21 bp, Homo sapiens
tcctgcactgactctggaaaa

SEQ ID NO: 6457593 - DNA, 15 bp, Homo sapiens
tcctgcactgtttaa

SEQ ID NO: 6457594 - DNA, 16 bp, Homo sapiens
tcctgcagaagaagct

SEQ ID NO: 6457595 - DNA, 12 bp, Homo sapiens
tcctgcagacct

SEQ ID NO: 6457596 - DNA, 13 bp, Homo sapiens
tcctgcagagctg

SEQ ID NO: 6457597 - DNA, 14 bp, Homo sapiens
tcctgcagagctgg

SEQ ID NO: 6457598 - DNA, 15 bp, Homo sapiens
tcctgcagagctggg

SEQ ID NO: 6457599 - DNA, 17 bp, Homo sapiens
tcctgcagagctggggg

SEQ ID NO: 6457600 - DNA, 23 bp, Homo sapiens
tcctgcagagctggggggaaggc

SEQ ID NO: 6457601 - DNA, 19 bp, Homo sapiens
tcctgcagaggcccagcca

SEQ ID NO: 6457602 - DNA, 16 bp, Homo sapiens
tcctgcagcagagcct

SEQ ID NO: 6457603 - DNA, 12 bp, Homo sapiens
tcctgcagcccc

SEQ ID NO: 6457604 - DNA, 13 bp, Homo sapiens
tcctgcagcccca

SEQ ID NO: 6457605 - DNA, 20 bp, Homo sapiens
tcctgcagccccagaagaaa

SEQ ID NO: 6457606 - DNA, 12 bp, Homo sapiens
tcctgcagcctc

SEQ ID NO: 6457607 - DNA, 15 bp, Homo sapiens
tcctgcagcctcctc

SEQ ID NO: 6457608 - DNA, 16 bp, Homo sapiens
tcctgcagcctcctcc

SEQ ID NO: 6457609 - DNA, 23 bp, Homo sapiens
tcctgcagcctgaccccaggcag

SEQ ID NO: 6457610 - DNA, 24 bp, Homo sapiens
tcctgcagcctgaccccaggcagc

SEQ ID NO: 6457611 - DNA, 17 bp, Homo sapiens
tcctgcaggaaatataa

SEQ ID NO: 6457612 - DNA, 17 bp, Homo sapiens
tcctgcaggaacgagca

SEQ ID NO: 6457613 - DNA, 17 bp, Homo sapiens
tcctgcaggagtgctgg

SEQ ID NO: 6457614 - DNA, 14 bp, Homo sapiens
tcctgcaggcagcc

SEQ ID NO: 6457615 - DNA, 22 bp, Homo sapiens
tcctgcaggcaggaacaaacag

SEQ ID NO: 6457616 - DNA, 15 bp, Homo sapiens
tcctgcaggctggct

SEQ ID NO: 6457617 - DNA, 21 bp, Homo sapiens
tcctgcagggagccttctgcc

SEQ ID NO: 6457618 - DNA, 15 bp, Homo sapiens
tcctgcagggcttct

SEQ ID NO: 6457619 - DNA, 11 bp, Homo sapiens
tcctgcagggg

SEQ ID NO: 6457620 - DNA, 15 bp, Homo sapiens
tcctgcagggggagg

SEQ ID NO: 6457621 - DNA, 19 bp, Homo sapiens
tcctgcaggtcctggtggg

SEQ ID NO: 6457622 - DNA, 15 bp, Homo sapiens
tcctgcatccctcca

SEQ ID NO: 6457623 - DNA, 18 bp, Homo sapiens
tcctgcatccctccaccc

SEQ ID NO: 6457624 - DNA, 14 bp, Homo sapiens
tcctgcatctctgt

SEQ ID NO: 6457625 - DNA, 11 bp, Homo sapiens
tcctgcatgca

SEQ ID NO: 6457626 - DNA, 19 bp, Homo sapiens
tcctgcatgggaaaaatgt

SEQ ID NO: 6457627 - DNA, 20 bp, Homo sapiens
tcctgcatggggcagaggct

SEQ ID NO: 6457628 - DNA, 20 bp, Homo sapiens
tcctgcatggtagggagaga

SEQ ID NO: 6457629 - DNA, 15 bp, Homo sapiens
tcctgcatgtatgcc

SEQ ID NO: 6457630 - DNA, 22 bp, Homo sapiens
tcctgcattcacccagacagct

SEQ ID NO: 6457631 - DNA, 12 bp, Homo sapiens
tcctgcatttct

SEQ ID NO: 6457632 - DNA, 14 bp, Homo sapiens
tcctgcatttgata

SEQ ID NO: 6457633 - DNA, 21 bp, Homo sapiens
tcctgcatttgatagcaatgt

SEQ ID NO: 6457634 - DNA, 12 bp, Homo sapiens
tcctgcatttta

SEQ ID NO: 6457635 - DNA, 18 bp, Homo sapiens
tcctgccaagtggtttct

SEQ ID NO: 6457636 - DNA, 15 bp, Homo sapiens
tcctgccacaacaga

SEQ ID NO: 6457637 - DNA, 20 bp, Homo sapiens
tcctgccacaacagaataaa

SEQ ID NO: 6457638 - DNA, 22 bp, Homo sapiens
tcctgccacaacagaataaagc

SEQ ID NO: 6457639 - DNA, 13 bp, Homo sapiens
tcctgccacagga

SEQ ID NO: 6457640 - DNA, 20 bp, Homo sapiens
tcctgccacattagaacttc

SEQ ID NO: 6457641 - DNA, 19 bp, Homo sapiens
tcctgccaccaccctgtct

SEQ ID NO: 6457642 - DNA, 21 bp, Homo sapiens
tcctgccaccaccctgtcttc

SEQ ID NO: 6457643 - DNA, 22 bp, Homo sapiens
tcctgccaccagtcactgtccc

SEQ ID NO: 6457644 - DNA, 20 bp, Homo sapiens
tcctgccacccagccccagc

SEQ ID NO: 6457645 - DNA, 16 bp, Homo sapiens
tcctgccaccctgtag

SEQ ID NO: 6457646 - DNA, 18 bp, Homo sapiens
tcctgccacctggggcag

SEQ ID NO: 6457647 - DNA, 12 bp, Homo sapiens
tcctgccactga

SEQ ID NO: 6457648 - DNA, 10 bp, Homo sapiens
tcctgccagc

SEQ ID NO: 6457649 - DNA, 11 bp, Homo sapiens
tcctgccagcc

SEQ ID NO: 6457650 - DNA, 14 bp, Homo sapiens
tcctgccagcccca

SEQ ID NO: 6457651 - DNA, 22 bp, Homo sapiens
tcctgccagccccacacagcta

SEQ ID NO: 6457652 - DNA, 13 bp, Homo sapiens
tcctgccagcccg

SEQ ID NO: 6457653 - DNA, 11 bp, Homo sapiens
tcctgccagct

SEQ ID NO: 6457654 - DNA, 12 bp, Homo sapiens
tcctgccagctc

SEQ ID NO: 6457655 - DNA, 13 bp, Homo sapiens
tcctgccagctct

SEQ ID NO: 6457656 - DNA, 13 bp, Homo sapiens
tcctgccagctgc

SEQ ID NO: 6457657 - DNA, 16 bp, Homo sapiens
tcctgccagctgcctt

SEQ ID NO: 6457658 - DNA, 21 bp, Homo sapiens
tcctgccagggaactggcctg

SEQ ID NO: 6457659 - DNA, 17 bp, Homo sapiens
tcctgccagtgtggaac

SEQ ID NO: 6457660 - DNA, 14 bp, Homo sapiens
tcctgccatcctca

SEQ ID NO: 6457661 - DNA, 14 bp, Homo sapiens
tcctgcccaaaatg

SEQ ID NO: 6457662 - DNA, 18 bp, Homo sapiens
tcctgcccaaaatgtgaa

SEQ ID NO: 6457663 - DNA, 23 bp, Homo sapiens
tcctgcccaaacagctgtattta

SEQ ID NO: 6457664 - DNA, 20 bp, Homo sapiens
tcctgcccaccctaccagct

SEQ ID NO: 6457665 - DNA, 11 bp, Homo sapiens
tcctgcccacg

SEQ ID NO: 6457666 - DNA, 15 bp, Homo sapiens
tcctgcccactgata

SEQ ID NO: 6457667 - DNA, 12 bp, Homo sapiens
tcctgcccagat

SEQ ID NO: 6457668 - DNA, 14 bp, Homo sapiens
tcctgcccagccac

SEQ ID NO: 6457669 - DNA, 17 bp, Homo sapiens
tcctgcccagcctgggg

SEQ ID NO: 6457670 - DNA, 14 bp, Homo sapiens
tcctgcccagctcc

SEQ ID NO: 6457671 - DNA, 17 bp, Homo sapiens
tcctgcccagctcctca

SEQ ID NO: 6457672 - DNA, 18 bp, Homo sapiens
tcctgcccagctcctcac

SEQ ID NO: 6457673 - DNA, 19 bp, Homo sapiens
tcctgcccagctctgaccc

SEQ ID NO: 6457674 - DNA, 20 bp, Homo sapiens
tcctgcccagctctgaccct

SEQ ID NO: 6457675 - DNA, 12 bp, Homo sapiens
tcctgcccagga

SEQ ID NO: 6457676 - DNA, 18 bp, Homo sapiens
tcctgcccaggagagcca

SEQ ID NO: 6457677 - DNA, 19 bp, Homo sapiens
tcctgcccaggagagccag

SEQ ID NO: 6457678 - DNA, 22 bp, Homo sapiens
tcctgcccaggagagccagccc

SEQ ID NO: 6457679 - DNA, 16 bp, Homo sapiens
tcctgcccaggagcag

SEQ ID NO: 6457680 - DNA, 12 bp, Homo sapiens
tcctgcccaggc

SEQ ID NO: 6457681 - DNA, 15 bp, Homo sapiens
tcctgcccaggccac

SEQ ID NO: 6457682 - DNA, 20 bp, Homo sapiens
tcctgcccaggccacagaga

SEQ ID NO: 6457683 - DNA, 13 bp, Homo sapiens
tcctgcccagtcc

SEQ ID NO: 6457684 - DNA, 15 bp, Homo sapiens
tcctgcccagtcccc

SEQ ID NO: 6457685 - DNA, 14 bp, Homo sapiens
tcctgcccagtgtt

SEQ ID NO: 6457686 - DNA, 20 bp, Homo sapiens
tcctgccccaagggcccaga

SEQ ID NO: 6457687 - DNA, 22 bp, Homo sapiens
tcctgccccaagggcccagacc

SEQ ID NO: 6457688 - DNA, 19 bp, Homo sapiens
tcctgccccacactccccg

SEQ ID NO: 6457689 - DNA, 21 bp, Homo sapiens
tcctgccccagatggctttgt

SEQ ID NO: 6457690 - DNA, 10 bp, Homo sapiens
tcctgccccc

SEQ ID NO: 6457691 - DNA, 11 bp, Homo sapiens
tcctgccccca

SEQ ID NO: 6457692 - DNA, 14 bp, Homo sapiens
tcctgcccccaagt

SEQ ID NO: 6457693 - DNA, 16 bp, Homo sapiens
tcctgcccccacacct

SEQ ID NO: 6457694 - DNA, 17 bp, Homo sapiens
tcctgcccccaccccag

SEQ ID NO: 6457695 - DNA, 19 bp, Homo sapiens
tcctgcccccaccccaggc

SEQ ID NO: 6457696 - DNA, 15 bp, Homo sapiens
tcctgcccccagcca

SEQ ID NO: 6457697 - DNA, 15 bp, Homo sapiens
tcctgccccctgcca

SEQ ID NO: 6457698 - DNA, 21 bp, Homo sapiens
tcctgccccctgccagtgaag

SEQ ID NO: 6457699 - DNA, 14 bp, Homo sapiens
tcctgcccctcgcc

SEQ ID NO: 6457700 - DNA, 15 bp, Homo sapiens
tcctgcccctctttc

SEQ ID NO: 6457701 - DNA, 16 bp, Homo sapiens
tcctgcccctctttct

SEQ ID NO: 6457702 - DNA, 20 bp, Homo sapiens
tcctgcccgcagacctctgg

SEQ ID NO: 6457703 - DNA, 21 bp, Homo sapiens
tcctgcccgcagacctctgga

SEQ ID NO: 6457704 - DNA, 22 bp, Homo sapiens
tcctgcccgccacacagaccac

SEQ ID NO: 6457705 - DNA, 14 bp, Homo sapiens
tcctgccctcccct

SEQ ID NO: 6457706 - DNA, 12 bp, Homo sapiens
tcctgccctccg

SEQ ID NO: 6457707 - DNA, 16 bp, Homo sapiens
tcctgccctccggagg

SEQ ID NO: 6457708 - DNA, 18 bp, Homo sapiens
tcctgccctcctctcccc

SEQ ID NO: 6457709 - DNA, 18 bp, Homo sapiens
tcctgccctctgctctgc

SEQ ID NO: 6457710 - DNA, 21 bp, Homo sapiens
tcctgccctctgctctgcctg

SEQ ID NO: 6457711 - DNA, 13 bp, Homo sapiens
tcctgccctgcag

SEQ ID NO: 6457712 - DNA, 12 bp, Homo sapiens
tcctgccctgcc

SEQ ID NO: 6457713 - DNA, 18 bp, Homo sapiens
tcctgccctgccctcctg

SEQ ID NO: 6457714 - DNA, 13 bp, Homo sapiens
tcctgccctgcct

SEQ ID NO: 6457715 - DNA, 14 bp, Homo sapiens
tcctgccctgggag

SEQ ID NO: 6457716 - DNA, 21 bp, Homo sapiens
tcctgccctgggaggcagtga

SEQ ID NO: 6457717 - DNA, 12 bp, Homo sapiens
tcctgccctgta

SEQ ID NO: 6457718 - DNA, 19 bp, Homo sapiens
tcctgccctgtacctctct

SEQ ID NO: 6457719 - DNA, 20 bp, Homo sapiens
tcctgccctgtcaagcttct

SEQ ID NO: 6457720 - DNA, 22 bp, Homo sapiens
tcctgccctgtgatatgtctgc

SEQ ID NO: 6457721 - DNA, 18 bp, Homo sapiens
tcctgccctgtggcccac

SEQ ID NO: 6457722 - DNA, 10 bp, Homo sapiens
tcctgccctt

SEQ ID NO: 6457723 - DNA, 17 bp, Homo sapiens
tcctgcccttacctgcc

SEQ ID NO: 6457724 - DNA, 18 bp, Homo sapiens
tgagctcgcagcccccgc

SEQ ID NO: 6457725 - DNA, 16 bp, Homo sapiens
tgagctcggggacagg

SEQ ID NO: 6457726 - DNA, 18 bp, Homo sapiens
tgagctcggggggctctg

SEQ ID NO: 6457727 - DNA, 19 bp, Homo sapiens
tgagctcggggggctctgc

SEQ ID NO: 6457728 - DNA, 20 bp, Homo sapiens
tgagctcggggggctctgcc

SEQ ID NO: 6457729 - DNA, 14 bp, Homo sapiens
tgagctcggggtcc

SEQ ID NO: 6457730 - DNA, 18 bp, Homo sapiens
tgagctctacccagggcc

SEQ ID NO: 6457731 - DNA, 19 bp, Homo sapiens
tgagctctacccagggcct

SEQ ID NO: 6457732 - DNA, 18 bp, Homo sapiens
tgagctctcaggccgaga

SEQ ID NO: 6457733 - DNA, 23 bp, Homo sapiens
tgagctctcaggccgagagcctt

SEQ ID NO: 6457734 - DNA, 15 bp, Homo sapiens
tgagctctccaggcc

SEQ ID NO: 6457735 - DNA, 17 bp, Homo sapiens
tgagctctccaggccag

SEQ ID NO: 6457736 - DNA, 20 bp, Homo sapiens
tgagctctccaggccaggtg

SEQ ID NO: 6457737 - DNA, 21 bp, Homo sapiens
tgagctctcggaactgcatgc

SEQ ID NO: 6457738 - DNA, 16 bp, Homo sapiens
tgagctctctcagacc

SEQ ID NO: 6457739 - DNA, 15 bp, Homo sapiens
tgagctctgaaatct

SEQ ID NO: 6457740 - DNA, 16 bp, Homo sapiens
tgagctctgaaatctt

SEQ ID NO: 6457741 - DNA, 23 bp, Homo sapiens
tgagctctgacctgcccccgctc

SEQ ID NO: 6457742 - DNA, 15 bp, Homo sapiens
tgagctctgagaggc

SEQ ID NO: 6457743 - DNA, 18 bp, Homo sapiens
tgagctctgcagcccagg

SEQ ID NO: 6457744 - DNA, 21 bp, Homo sapiens
tgagctctgcagcccagggac

SEQ ID NO: 6457745 - DNA, 14 bp, Homo sapiens
tgagctctgcctca

SEQ ID NO: 6457746 - DNA, 12 bp, Homo sapiens
tgagctcttcat

SEQ ID NO: 6457747 - DNA, 13 bp, Homo sapiens
tgagctcttccag

SEQ ID NO: 6457748 - DNA, 15 bp, Homo sapiens
tgagctcttccctta

SEQ ID NO: 6457749 - DNA, 23 bp, Homo sapiens
tgagctcttcccttattcctaat

SEQ ID NO: 6457750 - DNA, 18 bp, Homo sapiens
tgagctcttgctatctct

SEQ ID NO: 6457751 - DNA, 18 bp, Homo sapiens
tgagctcttgtgaggaaa

SEQ ID NO: 6457752 - DNA, 22 bp, Homo sapiens
tgagctcttgttccgtgccagg

SEQ ID NO: 6457753 - DNA, 17 bp, Homo sapiens
tgagctgaaagaggcca

SEQ ID NO: 6457754 - DNA, 17 bp, Homo sapiens
tgagctgaaatgctgca

SEQ ID NO: 6457755 - DNA, 14 bp, Homo sapiens
tgagctgaatgttt

SEQ ID NO: 6457756 - DNA, 14 bp, Homo sapiens
tgagctgagcaggg

SEQ ID NO: 6457757 - DNA, 16 bp, Homo sapiens
tgagctgagccaggct

SEQ ID NO: 6457758 - DNA, 14 bp, Homo sapiens
tgagctgaggcagc

SEQ ID NO: 6457759 - DNA, 14 bp, Homo sapiens
tgagctgagtggcc

SEQ ID NO: 6457760 - DNA, 17 bp, Homo sapiens
tgagctgagtggccagc

SEQ ID NO: 6457761 - DNA, 21 bp, Homo sapiens
tgagctgagttccttataaga

SEQ ID NO: 6457762 - DNA, 21 bp, Homo sapiens
tgagctgatataaattctgtg

SEQ ID NO: 6457763 - DNA, 15 bp, Homo sapiens
tgagctgcaccaggt

SEQ ID NO: 6457764 - DNA, 15 bp, Homo sapiens
tgagctgcactgacc

SEQ ID NO: 6457765 - DNA, 12 bp, Homo sapiens
tgagctgccagt

SEQ ID NO: 6457766 - DNA, 12 bp, Homo sapiens
tgagctgcccct

SEQ ID NO: 6457767 - DNA, 14 bp, Homo sapiens
tgagctgcccctgc

SEQ ID NO: 6457768 - DNA, 16 bp, Homo sapiens
tgagctgcccctgctg

SEQ ID NO: 6457769 - DNA, 17 bp, Homo sapiens
tgagctgcccctgctgc

SEQ ID NO: 6457770 - DNA, 19 bp, Homo sapiens
tgagctgcccctgctgctt

SEQ ID NO: 6457771 - DNA, 19 bp, Homo sapiens
tgagctgcccggcgcctgc

SEQ ID NO: 6457772 - DNA, 22 bp, Homo sapiens
tgagctgcccggcgcctgccct

SEQ ID NO: 6457773 - DNA, 14 bp, Homo sapiens
tgagctgcctccag

SEQ ID NO: 6457774 - DNA, 17 bp, Homo sapiens
tgagctgcctccagcct

SEQ ID NO: 6457775 - DNA, 18 bp, Homo sapiens
tgagctgcctccagcctg

SEQ ID NO: 6457776 - DNA, 16 bp, Homo sapiens
tgagctgcctctgaga

SEQ ID NO: 6457777 - DNA, 17 bp, Homo sapiens
tgagctgcctgctctgc

SEQ ID NO: 6457778 - DNA, 18 bp, Homo sapiens
tgagctgcctgctctgca

SEQ ID NO: 6457779 - DNA, 12 bp, Homo sapiens
tgagctgctcat

SEQ ID NO: 6457780 - DNA, 21 bp, Homo sapiens
tgagctgctcattacagttct

SEQ ID NO: 6457781 - DNA, 15 bp, Homo sapiens
tgagctgctgtgccc

SEQ ID NO: 6457782 - DNA, 12 bp, Homo sapiens
tgagctgctgtt

SEQ ID NO: 6457783 - DNA, 21 bp, Homo sapiens
tgagctgcttatttattgaaa

SEQ ID NO: 6457784 - DNA, 11 bp, Homo sapiens
tgagctgcttc

SEQ ID NO: 6457785 - DNA, 17 bp, Homo sapiens
tgagctgctttttttga

SEQ ID NO: 6457786 - DNA, 19 bp, Homo sapiens
tgagctgctttttttgaaa

SEQ ID NO: 6457787 - DNA, 19 bp, Homo sapiens
tgagctggaaggggccacg

SEQ ID NO: 6457788 - DNA, 20 bp, Homo sapiens
tgagctggagctaaggccag

SEQ ID NO: 6457789 - DNA, 17 bp, Homo sapiens
tgagctggcaaccagcc

SEQ ID NO: 6457790 - DNA, 10 bp, Homo sapiens
tgagctggcc

SEQ ID NO: 6457791 - DNA, 13 bp, Homo sapiens
tgagctggccctt

SEQ ID NO: 6457792 - DNA, 21 bp, Homo sapiens
tgagctggcctctctagcaca

SEQ ID NO: 6457793 - DNA, 21 bp, Homo sapiens
tgagctgggaagctgtactca

SEQ ID NO: 6457794 - DNA, 19 bp, Homo sapiens
tgagctgggcagctggaag

SEQ ID NO: 6457795 - DNA, 13 bp, Homo sapiens
tgagctgggccca

SEQ ID NO: 6457796 - DNA, 14 bp, Homo sapiens
tgagctgggcccag

SEQ ID NO: 6457797 - DNA, 17 bp, Homo sapiens
tgagctgggccctgggt

SEQ ID NO: 6457798 - DNA, 22 bp, Homo sapiens
tgagctggggacctggtaccct

SEQ ID NO: 6457799 - DNA, 17 bp, Homo sapiens
tgagctggggactcagg

SEQ ID NO: 6457800 - DNA, 13 bp, Homo sapiens
tgagctggggagg

SEQ ID NO: 6457801 - DNA, 16 bp, Homo sapiens
tgagctggggagggag

SEQ ID NO: 6457802 - DNA, 16 bp, Homo sapiens
tgagctggggaggtgg

SEQ ID NO: 6457803 - DNA, 21 bp, Homo sapiens
tgagctggggtgggagctcct

SEQ ID NO: 6457804 - DNA, 22 bp, Homo sapiens
tgagctgtatatatatatgtgt

SEQ ID NO: 6457805 - DNA, 18 bp, Homo sapiens
tgagctgtatcttgatgt

SEQ ID NO: 6457806 - DNA, 13 bp, Homo sapiens
tgagctgtcccaa

SEQ ID NO: 6457807 - DNA, 23 bp, Homo sapiens
tgagctgtcgctgcctccatggc

SEQ ID NO: 6457808 - DNA, 18 bp, Homo sapiens
tgagctgtctgaagccca

SEQ ID NO: 6457809 - DNA, 21 bp, Homo sapiens
tgagctgtgacattgctggtc

SEQ ID NO: 6457810 - DNA, 23 bp, Homo sapiens
tgagctgtgacattgctggtcat

SEQ ID NO: 6457811 - DNA, 17 bp, Homo sapiens
tgagctgtgacccagag

SEQ ID NO: 6457812 - DNA, 12 bp, Homo sapiens
tgagctgtgcca

SEQ ID NO: 6457813 - DNA, 21 bp, Homo sapiens
tgagctgtgttttgtctgagc

SEQ ID NO: 6457814 - DNA, 23 bp, Homo sapiens
tgagctgtgttttgtctgagcct

SEQ ID NO: 6457815 - DNA, 15 bp, Homo sapiens
tgagcttaaacagaa

SEQ ID NO: 6457816 - DNA, 23 bp, Homo sapiens
tgagcttagccttgtgccctgcc

SEQ ID NO: 6457817 - DNA, 16 bp, Homo sapiens
tgagcttagtgaaatt

SEQ ID NO: 6457818 - DNA, 16 bp, Homo sapiens
tgagcttcaatataag

SEQ ID NO: 6457819 - DNA, 18 bp, Homo sapiens
tgagcttcaatataagaa

SEQ ID NO: 6457820 - DNA, 17 bp, Homo sapiens
tgagcttcggttctcca

SEQ ID NO: 6457821 - DNA, 20 bp, Homo sapiens
tgagcttctaaactgaagct

SEQ ID NO: 6457822 - DNA, 12 bp, Homo sapiens
tgagcttctcct

SEQ ID NO: 6457823 - DNA, 16 bp, Homo sapiens
tgagcttctcctctgc

SEQ ID NO: 6457824 - DNA, 15 bp, Homo sapiens
tgagcttgagctccc

SEQ ID NO: 6457825 - DNA, 22 bp, Homo sapiens
tgagcttgattctaaaggggac

SEQ ID NO: 6457826 - DNA, 20 bp, Homo sapiens
tgagcttgctggagagtggc

SEQ ID NO: 6457827 - DNA, 18 bp, Homo sapiens
tgagcttggaggaagtat

SEQ ID NO: 6457828 - DNA, 14 bp, Homo sapiens
tgagcttggccaga

SEQ ID NO: 6457829 - DNA, 15 bp, Homo sapiens
tgagcttggccagaa

SEQ ID NO: 6457830 - DNA, 16 bp, Homo sapiens
tgagcttggccagaag

SEQ ID NO: 6457831 - DNA, 14 bp, Homo sapiens
tgagcttgtaaata

SEQ ID NO: 6457832 - DNA, 12 bp, Homo sapiens
tgagctttaaaa

SEQ ID NO: 6457833 - DNA, 16 bp, Homo sapiens
tgagctttagacagca

SEQ ID NO: 6457834 - DNA, 18 bp, Homo sapiens
tgagctttccggggagga

SEQ ID NO: 6457835 - DNA, 22 bp, Homo sapiens
tgagctttcgttgactgcttct

SEQ ID NO: 6457836 - DNA, 14 bp, Homo sapiens
tgagctttctgaac

SEQ ID NO: 6457837 - DNA, 23 bp, Homo sapiens
tgagctttctgaacagctggtgt

SEQ ID NO: 6457838 - DNA, 16 bp, Homo sapiens
tgagctttgctgctac

SEQ ID NO: 6457839 - DNA, 21 bp, Homo sapiens
tgagctttggacacacacagc

SEQ ID NO: 6457840 - DNA, 12 bp, Homo sapiens
tgagctttgggc

SEQ ID NO: 6457841 - DNA, 17 bp, Homo sapiens
tgagcttttcatggaag

SEQ ID NO: 6457842 - DNA, 12 bp, Homo sapiens
tgagcttttcta

SEQ ID NO: 6457843 - DNA, 12 bp, Homo sapiens
tgagctttttgt

SEQ ID NO: 6457844 - DNA, 17 bp, Homo sapiens
tgagctttttttaaata

SEQ ID NO: 6457845 - DNA, 14 bp, Homo sapiens
tgaggaaaaaatgg

SEQ ID NO: 6457846 - DNA, 15 bp, Homo sapiens
tgaggaaaaactgac

SEQ ID NO: 6457847 - DNA, 16 bp, Homo sapiens
tgaggaaaataatgta

SEQ ID NO: 6457848 - DNA, 12 bp, Homo sapiens
tgaggaaaatat

SEQ ID NO: 6457849 - DNA, 22 bp, Homo sapiens
tgaggaaaatggaagacctaag

SEQ ID NO: 6457850 - DNA, 16 bp, Homo sapiens
tgaggaaactcataca

SEQ ID NO: 6457851 - DNA, 19 bp, Homo sapiens
tgaggaaactgagtcactc

SEQ ID NO: 6457852 - DNA, 15 bp, Homo sapiens
tgaggaaagacacag

SEQ ID NO: 6457853 - DNA, 23 bp, Homo sapiens
tgaggaaagcctcctatggaatg

SEQ ID NO: 6457854 - DNA, 15 bp, Homo sapiens
tgaggaaaggccagc

SEQ ID NO: 6457855 - DNA, 15 bp, Homo sapiens
tgaggaaagtcattg

SEQ ID NO: 6457856 - DNA, 21 bp, Homo sapiens
tgaggaaagtgcgttctccca

SEQ ID NO: 6457857 - DNA, 22 bp, Homo sapiens
tgaggaaagtgcgttctcccag

SEQ ID NO: 6457858 - DNA, 15 bp, Homo sapiens
tgaggaaatcaaagt

SEQ ID NO: 6457859 - DNA, 16 bp, Homo sapiens
tgaggaaatcaaagtg

SEQ ID NO: 6457860 - DNA, 22 bp, Homo sapiens
tgaggaaatcaaagtgctatta

SEQ ID NO: 6457861 - DNA, 18 bp, Homo sapiens
tgaggaaatccattgttt

SEQ ID NO: 6457862 - DNA, 20 bp, Homo sapiens
tgaggaaatccattgtttaa

SEQ ID NO: 6457863 - DNA, 23 bp, Homo sapiens
tgaggaaatccattgtttaaaga

SEQ ID NO: 6457864 - DNA, 15 bp, Homo sapiens
tgaggaaatttgcag

SEQ ID NO: 6457865 - DNA, 17 bp, Homo sapiens
tgaggaacaatcacaaa

SEQ ID NO: 6457866 - DNA, 17 bp, Homo sapiens
tgaggaacaggttcctg

SEQ ID NO: 6457867 - DNA, 19 bp, Homo sapiens
tgaggaacaggttcctgtg

SEQ ID NO: 6457868 - DNA, 18 bp, Homo sapiens
tgaggaacctcaaactgg

SEQ ID NO: 6457869 - DNA, 19 bp, Homo sapiens
tgaggaagaacggggctct

SEQ ID NO: 6457870 - DNA, 23 bp, Homo sapiens
tgaggaagaacggggctcttctc

SEQ ID NO: 6457871 - DNA, 23 bp, Homo sapiens
tgaggaagaatccatctgtgagg

SEQ ID NO: 6457872 - DNA, 23 bp, Homo sapiens
tgaggaagccaggtccacggtct

SEQ ID NO: 6457873 - DNA, 17 bp, Homo sapiens
tgaggaagccgctgggg

SEQ ID NO: 6457874 - DNA, 18 bp, Homo sapiens
tgaggaagccgctggggc

SEQ ID NO: 6457875 - DNA, 19 bp, Homo sapiens
tgaggaagctccagtcctg

SEQ ID NO: 6457876 - DNA, 23 bp, Homo sapiens
tgaggaagctgttggggggctga

SEQ ID NO: 6457877 - DNA, 20 bp, Homo sapiens
tgaggaaggaaatctggccc

SEQ ID NO: 6457878 - DNA, 19 bp, Homo sapiens
tgaggaaggcaggaagaga

SEQ ID NO: 6457879 - DNA, 18 bp, Homo sapiens
tgaggaagtgtggaaaaa

SEQ ID NO: 6457880 - DNA, 16 bp, Homo sapiens
tgaggaagttttgtct

SEQ ID NO: 6457881 - DNA, 15 bp, Homo sapiens
tgaggaataaagctt

SEQ ID NO: 6457882 - DNA, 17 bp, Homo sapiens
tgaggaataaagcttct

SEQ ID NO: 6457883 - DNA, 19 bp, Homo sapiens
tgaggaataaatgccttta

SEQ ID NO: 6457884 - DNA, 17 bp, Homo sapiens
tgaggaataattattta

SEQ ID NO: 6457885 - DNA, 19 bp, Homo sapiens
tgaggaatacagaagcagt

SEQ ID NO: 6457886 - DNA, 19 bp, Homo sapiens
tgaggaatagttttctcct

SEQ ID NO: 6457887 - DNA, 20 bp, Homo sapiens
tgaggaatcaacagggcagc

SEQ ID NO: 6457888 - DNA, 21 bp, Homo sapiens
tgaggaatccagacccggctg

SEQ ID NO: 6457889 - DNA, 16 bp, Homo sapiens
tgaggaatgatgaagc

SEQ ID NO: 6457890 - DNA, 18 bp, Homo sapiens
tgaggaatggacatttct

SEQ ID NO: 6457891 - DNA, 16 bp, Homo sapiens
tgaggaattctgtata

SEQ ID NO: 6457892 - DNA, 18 bp, Homo sapiens
tgaggaattttctttgtg

SEQ ID NO: 6457893 - DNA, 13 bp, Homo sapiens
tgaggacaaagaa

SEQ ID NO: 6457894 - DNA, 16 bp, Homo sapiens
tgaggacaaattgaga

SEQ ID NO: 6457895 - DNA, 20 bp, Homo sapiens
tgaggacaaattgagacagt

SEQ ID NO: 6457896 - DNA, 20 bp, Homo sapiens
tgaggacaaccattccagac

SEQ ID NO: 6457897 - DNA, 22 bp, Homo sapiens
tgaggacaagagaaaaaagcca

SEQ ID NO: 6457898 - DNA, 16 bp, Homo sapiens
tgaggacacatgtcca

SEQ ID NO: 6457899 - DNA, 22 bp, Homo sapiens
tgaggacacccaggaatgaccc

SEQ ID NO: 6457900 - DNA, 21 bp, Homo sapiens
tgaggacactaaccacgctgg

SEQ ID NO: 6457901 - DNA, 15 bp, Homo sapiens
tgaggacactgatat

SEQ ID NO: 6457902 - DNA, 17 bp, Homo sapiens
tcctgcccttcctcagt

SEQ ID NO: 6457903 - DNA, 17 bp, Homo sapiens
tcctgcccttttcctgg

SEQ ID NO: 6457904 - DNA, 16 bp, Homo sapiens
tcctgccgacggagcc

SEQ ID NO: 6457905 - DNA, 18 bp, Homo sapiens
tcctgccgacggagccac

SEQ ID NO: 6457906 - DNA, 20 bp, Homo sapiens
tcctgccgacggagccactg

SEQ ID NO: 6457907 - DNA, 14 bp, Homo sapiens
tcctgccgactcct

SEQ ID NO: 6457908 - DNA, 20 bp, Homo sapiens
tcctgccgcagacgggcaca

SEQ ID NO: 6457909 - DNA, 21 bp, Homo sapiens
tcctgccgcagacgggcacag

SEQ ID NO: 6457910 - DNA, 22 bp, Homo sapiens
tcctgccgcagacgggcacaga

SEQ ID NO: 6457911 - DNA, 13 bp, Homo sapiens
tcctgccgcagag

SEQ ID NO: 6457912 - DNA, 16 bp, Homo sapiens
tcctgccgcagagctg

SEQ ID NO: 6457913 - DNA, 18 bp, Homo sapiens
tcctgccgcagagctggc

SEQ ID NO: 6457914 - DNA, 14 bp, Homo sapiens
tcctgccggctcct

SEQ ID NO: 6457915 - DNA, 17 bp, Homo sapiens
tcctgccggctccttgg

SEQ ID NO: 6457916 - DNA, 16 bp, Homo sapiens
tcctgccggtgggacc

SEQ ID NO: 6457917 - DNA, 17 bp, Homo sapiens
tcctgccgtccctcctg

SEQ ID NO: 6457918 - DNA, 15 bp, Homo sapiens
tcctgcctaaatttc

SEQ ID NO: 6457919 - DNA, 13 bp, Homo sapiens
tcctgcctaaggt

SEQ ID NO: 6457920 - DNA, 20 bp, Homo sapiens
tcctgcctaagtgcagcccc

SEQ ID NO: 6457921 - DNA, 23 bp, Homo sapiens
tcctgcctacattccctggcctg

SEQ ID NO: 6457922 - DNA, 11 bp, Homo sapiens
tcctgcctact

SEQ ID NO: 6457923 - DNA, 18 bp, Homo sapiens
tcctgcctactgcccctg

SEQ ID NO: 6457924 - DNA, 22 bp, Homo sapiens
tcctgcctactggatgcttaca

SEQ ID NO: 6457925 - DNA, 12 bp, Homo sapiens
tcctgcctcagc

SEQ ID NO: 6457926 - DNA, 19 bp, Homo sapiens
tcctgcctcagcctcccaa

SEQ ID NO: 6457927 - DNA, 17 bp, Homo sapiens
tcctgcctcagcctccg

SEQ ID NO: 6457928 - DNA, 17 bp, Homo sapiens
tcctgcctcagcctcct

SEQ ID NO: 6457929 - DNA, 19 bp, Homo sapiens
tcctgcctcagcctcctga

SEQ ID NO: 6457930 - DNA, 21 bp, Homo sapiens
tcctgcctcagcctcctgagt

SEQ ID NO: 6457931 - DNA, 16 bp, Homo sapiens
tcctgcctcagccttc

SEQ ID NO: 6457932 - DNA, 18 bp, Homo sapiens
tcctgcctcagccttcca

SEQ ID NO: 6457933 - DNA, 14 bp, Homo sapiens
tcctgcctcatgcg

SEQ ID NO: 6457934 - DNA, 19 bp, Homo sapiens
tcctgcctccccattcctt

SEQ ID NO: 6457935 - DNA, 14 bp, Homo sapiens
tcctgcctccgcct

SEQ ID NO: 6457936 - DNA, 13 bp, Homo sapiens
tcctgcctcctca

SEQ ID NO: 6457937 - DNA, 21 bp, Homo sapiens
tcctgcctccttgatatttgt

SEQ ID NO: 6457938 - DNA, 21 bp, Homo sapiens
tcctgcctcgaactggctgca

SEQ ID NO: 6457939 - DNA, 16 bp, Homo sapiens
tcctgcctctactggg

SEQ ID NO: 6457940 - DNA, 17 bp, Homo sapiens
tcctgcctctactggga

SEQ ID NO: 6457941 - DNA, 11 bp, Homo sapiens
tcctgcctctc

SEQ ID NO: 6457942 - DNA, 14 bp, Homo sapiens
tcctgcctctctgc

SEQ ID NO: 6457943 - DNA, 15 bp, Homo sapiens
tcctgcctctctgct

SEQ ID NO: 6457944 - DNA, 22 bp, Homo sapiens
tcctgcctcttgtttctgtgcc

SEQ ID NO: 6457945 - DNA, 14 bp, Homo sapiens
tcctgcctgcagta

SEQ ID NO: 6457946 - DNA, 15 bp, Homo sapiens
tcctgcctgccccca

SEQ ID NO: 6457947 - DNA, 20 bp, Homo sapiens
tcctgcctgcgcagctcctt

SEQ ID NO: 6457948 - DNA, 10 bp, Homo sapiens
tcctgcctgg

SEQ ID NO: 6457949 - DNA, 14 bp, Homo sapiens
tcctgcctggcact

SEQ ID NO: 6457950 - DNA, 13 bp, Homo sapiens
tcctgcctggcca

SEQ ID NO: 6457951 - DNA, 11 bp, Homo sapiens
tcctgcctggg

SEQ ID NO: 6457952 - DNA, 14 bp, Homo sapiens
tcctgcctgggtgg

SEQ ID NO: 6457953 - DNA, 15 bp, Homo sapiens
tcctgcctgggtggg

SEQ ID NO: 6457954 - DNA, 22 bp, Homo sapiens
tcctgcctgggtgggacagcct

SEQ ID NO: 6457955 - DNA, 21 bp, Homo sapiens
tcctgcctggtcctccctccc

SEQ ID NO: 6457956 - DNA, 23 bp, Homo sapiens
tcctgcctggtctcctgccccca

SEQ ID NO: 6457957 - DNA, 18 bp, Homo sapiens
tcctgcctgtggccatga

SEQ ID NO: 6457958 - DNA, 17 bp, Homo sapiens
tcctgccttagagccag

SEQ ID NO: 6457959 - DNA, 14 bp, Homo sapiens
tcctgccttctgtc

SEQ ID NO: 6457960 - DNA, 19 bp, Homo sapiens
tcctgccttggcctcccaa

SEQ ID NO: 6457961 - DNA, 21 bp, Homo sapiens
tcctgccttggcctcccaagt

SEQ ID NO: 6457962 - DNA, 17 bp, Homo sapiens
tcctgcctttaagccaa

SEQ ID NO: 6457963 - DNA, 12 bp, Homo sapiens
tcctgcctttgg

SEQ ID NO: 6457964 - DNA, 17 bp, Homo sapiens
tcctgcgcctgcgcctc

SEQ ID NO: 6457965 - DNA, 19 bp, Homo sapiens
tcctgcgcctgcgcctcct

SEQ ID NO: 6457966 - DNA, 24 bp, Homo sapiens
tcctgcgcctgcgcctcctcctgc

SEQ ID NO: 6457967 - DNA, 21 bp, Homo sapiens
tcctgcgctgccccagagcct

SEQ ID NO: 6457968 - DNA, 20 bp, Homo sapiens
tcctgcggctcagccttgca

SEQ ID NO: 6457969 - DNA, 15 bp, Homo sapiens
tcctgcggctgcctg

SEQ ID NO: 6457970 - DNA, 19 bp, Homo sapiens
tcctgcgggagtagttgga

SEQ ID NO: 6457971 - DNA, 17 bp, Homo sapiens
tcctgcgggggcgaggc

SEQ ID NO: 6457972 - DNA, 16 bp, Homo sapiens
tcctgcgggttttaat

SEQ ID NO: 6457973 - DNA, 21 bp, Homo sapiens
tcctgcgggttttaatttatt

SEQ ID NO: 6457974 - DNA, 16 bp, Homo sapiens
tcctgcgtcccagcct

SEQ ID NO: 6457975 - DNA, 17 bp, Homo sapiens
tcctgcgtcccagcctg

SEQ ID NO: 6457976 - DNA, 16 bp, Homo sapiens
tcctgcgtcctcctca

SEQ ID NO: 6457977 - DNA, 17 bp, Homo sapiens
tcctgcgttcagcccct

SEQ ID NO: 6457978 - DNA, 14 bp, Homo sapiens
tcctgcgttttctc

SEQ ID NO: 6457979 - DNA, 18 bp, Homo sapiens
tcctgctaagttaatgtt

SEQ ID NO: 6457980 - DNA, 19 bp, Homo sapiens
tcctgctacaacttcagca

SEQ ID NO: 6457981 - DNA, 18 bp, Homo sapiens
tcctgctacaagtgtttt

SEQ ID NO: 6457982 - DNA, 13 bp, Homo sapiens
tcctgctacagga

SEQ ID NO: 6457983 - DNA, 17 bp, Homo sapiens
tcctgctacaggagggg

SEQ ID NO: 6457984 - DNA, 18 bp, Homo sapiens
tcctgctactctgttcct

SEQ ID NO: 6457985 - DNA, 14 bp, Homo sapiens
tcctgctagaaatg

SEQ ID NO: 6457986 - DNA, 17 bp, Homo sapiens
tcctgctagcacctccc

SEQ ID NO: 6457987 - DNA, 15 bp, Homo sapiens
tcctgctagcaggcc

SEQ ID NO: 6457988 - DNA, 16 bp, Homo sapiens
tcctgctagcaggccc

SEQ ID NO: 6457989 - DNA, 17 bp, Homo sapiens
tcctgctagcaggcccc

SEQ ID NO: 6457990 - DNA, 19 bp, Homo sapiens
tcctgctagcaggccccct

SEQ ID NO: 6457991 - DNA, 22 bp, Homo sapiens
tcctgctagcaggccccctagg

SEQ ID NO: 6457992 - DNA, 16 bp, Homo sapiens
tcctgctagctgtaga

SEQ ID NO: 6457993 - DNA, 20 bp, Homo sapiens
tcctgctagctgtctctctt

SEQ ID NO: 6457994 - DNA, 20 bp, Homo sapiens
tcctgctatattaacatcat

SEQ ID NO: 6457995 - DNA, 22 bp, Homo sapiens
tcctgctatttcccaagctgga

SEQ ID NO: 6457996 - DNA, 15 bp, Homo sapiens
tcctgctcaccacct

SEQ ID NO: 6457997 - DNA, 16 bp, Homo sapiens
tcctgctcacctgtgt

SEQ ID NO: 6457998 - DNA, 20 bp, Homo sapiens
tcctgctcacgtctgtgagt

SEQ ID NO: 6457999 - DNA, 21 bp, Homo sapiens
tcctgctcacgtctgtgagtc

SEQ ID NO: 6458000 - DNA, 13 bp, Homo sapiens
tcctgctcagatg

SEQ ID NO: 6458001 - DNA, 19 bp, Homo sapiens
tcctgctcagatgctggtc

SEQ ID NO: 6458002 - DNA, 15 bp, Homo sapiens
tcctgctcatattgt

SEQ ID NO: 6458003 - DNA, 16 bp, Homo sapiens
tcctgctcatattgtg

SEQ ID NO: 6458004 - DNA, 18 bp, Homo sapiens
tcctgctccacagccatc

SEQ ID NO: 6458005 - DNA, 14 bp, Homo sapiens
tcctgctccagaat

SEQ ID NO: 6458006 - DNA, 20 bp, Homo sapiens
tcctgctccagaatttggaa

SEQ ID NO: 6458007 - DNA, 21 bp, Homo sapiens
tcctgctccatcggggaatga

SEQ ID NO: 6458008 - DNA, 16 bp, Homo sapiens
tcctgctccgctgcct

SEQ ID NO: 6458009 - DNA, 17 bp, Homo sapiens
tcctgctccgctgcctg

SEQ ID NO: 6458010 - DNA, 22 bp, Homo sapiens
tcctgctccgctgcctggaaca

SEQ ID NO: 6458011 - DNA, 18 bp, Homo sapiens
tcctgctccgtggactgc

SEQ ID NO: 6458012 - DNA, 15 bp, Homo sapiens
tcctgctcctcaccc

SEQ ID NO: 6458013 - DNA, 14 bp, Homo sapiens
tcctgctcctccct

SEQ ID NO: 6458014 - DNA, 17 bp, Homo sapiens
tcctgctcctccctgcc

SEQ ID NO: 6458015 - DNA, 20 bp, Homo sapiens
tcctgctcctccctgccccc

SEQ ID NO: 6458016 - DNA, 13 bp, Homo sapiens
tcctgctcctttc

SEQ ID NO: 6458017 - DNA, 20 bp, Homo sapiens
tcctgctcctttctgcccag

SEQ ID NO: 6458018 - DNA, 15 bp, Homo sapiens
tcctgctccttttgt

SEQ ID NO: 6458019 - DNA, 22 bp, Homo sapiens
tcctgctcgccctgtgccctct

SEQ ID NO: 6458020 - DNA, 24 bp, Homo sapiens
tcctgctctctacccagcccatct

SEQ ID NO: 6458021 - DNA, 13 bp, Homo sapiens
tcctgctctctgc

SEQ ID NO: 6458022 - DNA, 15 bp, Homo sapiens
tcctgctctgcttcc

SEQ ID NO: 6458023 - DNA, 20 bp, Homo sapiens
tcctgctctgcttcctcagg

SEQ ID NO: 6458024 - DNA, 13 bp, Homo sapiens
tcctgctctggga

SEQ ID NO: 6458025 - DNA, 14 bp, Homo sapiens
tcctgctctgggac

SEQ ID NO: 6458026 - DNA, 13 bp, Homo sapiens
tcctgctctgttt

SEQ ID NO: 6458027 - DNA, 18 bp, Homo sapiens
tcctgctctgtttggtgg

SEQ ID NO: 6458028 - DNA, 22 bp, Homo sapiens
tcctgctgaaacacctcccagg

SEQ ID NO: 6458029 - DNA, 13 bp, Homo sapiens
tcctgctgacctc

SEQ ID NO: 6458030 - DNA, 22 bp, Homo sapiens
tcctgctgacctcactgtcctg

SEQ ID NO: 6458031 - DNA, 17 bp, Homo sapiens
tcctgctgaccttctgc

SEQ ID NO: 6458032 - DNA, 20 bp, Homo sapiens
tcctgctgagcctcacagca

SEQ ID NO: 6458033 - DNA, 12 bp, Homo sapiens
tcctgctgagct

SEQ ID NO: 6458034 - DNA, 13 bp, Homo sapiens
tcctgctgagctg

SEQ ID NO: 6458035 - DNA, 15 bp, Homo sapiens
tcctgctgagtcctt

SEQ ID NO: 6458036 - DNA, 20 bp, Homo sapiens
tcctgctgagtggtccacat

SEQ ID NO: 6458037 - DNA, 15 bp, Homo sapiens
tcctgctgcacaggc

SEQ ID NO: 6458038 - DNA, 18 bp, Homo sapiens
tcctgctgcacaggccct

SEQ ID NO: 6458039 - DNA, 12 bp, Homo sapiens
tcctgctgcacc

SEQ ID NO: 6458040 - DNA, 14 bp, Homo sapiens
tcctgctgcaccct

SEQ ID NO: 6458041 - DNA, 23 bp, Homo sapiens
tcctgctgcaccctgcgcctcca

SEQ ID NO: 6458042 - DNA, 21 bp, Homo sapiens
tcctgctgcagaggggcaggc

SEQ ID NO: 6458043 - DNA, 16 bp, Homo sapiens
tcctgctgcatgacct

SEQ ID NO: 6458044 - DNA, 12 bp, Homo sapiens
tcctgctgccag

SEQ ID NO: 6458045 - DNA, 13 bp, Homo sapiens
tcctgctgccaga

SEQ ID NO: 6458046 - DNA, 19 bp, Homo sapiens
tcctgctgccagagaacca

SEQ ID NO: 6458047 - DNA, 15 bp, Homo sapiens
tcctgctgcctaata

SEQ ID NO: 6458048 - DNA, 21 bp, Homo sapiens
tcctgctgcctaataaagaga

SEQ ID NO: 6458049 - DNA, 18 bp, Homo sapiens
tcctgctgcctctctttc

SEQ ID NO: 6458050 - DNA, 12 bp, Homo sapiens
tcctgctgcctg

SEQ ID NO: 6458051 - DNA, 13 bp, Homo sapiens
tcctgctgcctgg

SEQ ID NO: 6458052 - DNA, 15 bp, Homo sapiens
tcctgctgcctgggt

SEQ ID NO: 6458053 - DNA, 21 bp, Homo sapiens
tcctgctgcctgtattctcta

SEQ ID NO: 6458054 - DNA, 22 bp, Homo sapiens
tcctgctgcggaggagctgcct

SEQ ID NO: 6458055 - DNA, 12 bp, Homo sapiens
tcctgctgctca

SEQ ID NO: 6458056 - DNA, 18 bp, Homo sapiens
tcctgctgctccctcaga

SEQ ID NO: 6458057 - DNA, 20 bp, Homo sapiens
tcctgctgctccctcagact

SEQ ID NO: 6458058 - DNA, 19 bp, Homo sapiens
tcctgctgctgacctgatc

SEQ ID NO: 6458059 - DNA, 12 bp, Homo sapiens
tcctgctgctgc

SEQ ID NO: 6458060 - DNA, 14 bp, Homo sapiens
tcctgctgctgtct

SEQ ID NO: 6458061 - DNA, 19 bp, Homo sapiens
tcctgctgctttgggctgg

SEQ ID NO: 6458062 - DNA, 12 bp, Homo sapiens
tcctgctggcac

SEQ ID NO: 6458063 - DNA, 15 bp, Homo sapiens
tcctgctggcacctc

SEQ ID NO: 6458064 - DNA, 17 bp, Homo sapiens
tcctgctggcacctcag

SEQ ID NO: 6458065 - DNA, 18 bp, Homo sapiens
tcctgctggcacctcaga

SEQ ID NO: 6458066 - DNA, 13 bp, Homo sapiens
tcctgctggcctg

SEQ ID NO: 6458067 - DNA, 14 bp, Homo sapiens
tcctgctggcctgc

SEQ ID NO: 6458068 - DNA, 21 bp, Homo sapiens
tcctgctggcctgctcttact

SEQ ID NO: 6458069 - DNA, 14 bp, Homo sapiens
tcctgctggcttcc

SEQ ID NO: 6458070 - DNA, 17 bp, Homo sapiens
tcctgctggggccgcca

SEQ ID NO: 6458071 - DNA, 19 bp, Homo sapiens
tcctgctggggctgaacat

SEQ ID NO: 6458072 - DNA, 23 bp, Homo sapiens
tcctgctgtagtcctttctgcct

SEQ ID NO: 6458073 - DNA, 15 bp, Homo sapiens
tcctgctgtatttcc

SEQ ID NO: 6458074 - DNA, 18 bp, Homo sapiens
tcctgctgtatttcctgc

SEQ ID NO: 6458075 - DNA, 17 bp, Homo sapiens
tcctgctgtccctgtca

SEQ ID NO: 6458076 - DNA, 19 bp, Homo sapiens
tcctgctgtccctgtcagg

SEQ ID NO: 6458077 - DNA, 10 bp, Homo sapiens
tcctgctgtg

SEQ ID NO: 6458078 - DNA, 13 bp, Homo sapiens
tcctgctgtgcct

SEQ ID NO: 6458079 - DNA, 12 bp, Homo sapiens
tcctgctgtgct

SEQ ID NO: 6458080 - DNA, 13 bp, Homo sapiens
tcctgctgtgctg

SEQ ID NO: 6458081 - DNA, 14 bp, Homo sapiens
tcctgctgtgctgg

SEQ ID NO: 6458082 - DNA, 15 bp, Homo sapiens
tcctgctgtgctgga

SEQ ID NO: 6458083 - DNA, 13 bp, Homo sapiens
tgaggacagacag

SEQ ID NO: 6458084 - DNA, 14 bp, Homo sapiens
tgaggacagagtgg

SEQ ID NO: 6458085 - DNA, 13 bp, Homo sapiens
tgaggacagctgt

SEQ ID NO: 6458086 - DNA, 14 bp, Homo sapiens
tgaggacaggctct

SEQ ID NO: 6458087 - DNA, 23 bp, Homo sapiens
tgaggacaggctctagagagagg

SEQ ID NO: 6458088 - DNA, 14 bp, Homo sapiens
tgaggacagggccc

SEQ ID NO: 6458089 - DNA, 19 bp, Homo sapiens
tgaggacatggagagagac

SEQ ID NO: 6458090 - DNA, 21 bp, Homo sapiens
tgaggacatgtttttgttttc

SEQ ID NO: 6458091 - DNA, 20 bp, Homo sapiens
tgaggacattccaagacagt

SEQ ID NO: 6458092 - DNA, 17 bp, Homo sapiens
tgaggaccagggtggag

SEQ ID NO: 6458093 - DNA, 16 bp, Homo sapiens
tgaggaccatgaaaca

SEQ ID NO: 6458094 - DNA, 22 bp, Homo sapiens
tgaggaccctcagccccaggag

SEQ ID NO: 6458095 - DNA, 14 bp, Homo sapiens
tgaggaccgcccca

SEQ ID NO: 6458096 - DNA, 16 bp, Homo sapiens
tgaggaccgctgataa

SEQ ID NO: 6458097 - DNA, 23 bp, Homo sapiens
tgaggacctccacctgggagatg

SEQ ID NO: 6458098 - DNA, 15 bp, Homo sapiens
tgaggacctccctgt

SEQ ID NO: 6458099 - DNA, 21 bp, Homo sapiens
tgaggacctgcggccttgggt

SEQ ID NO: 6458100 - DNA, 15 bp, Homo sapiens
tgaggacctttatat

SEQ ID NO: 6458101 - DNA, 18 bp, Homo sapiens
tgaggacctttatatctg

SEQ ID NO: 6458102 - DNA, 19 bp, Homo sapiens
tgaggacgagacccccatc

SEQ ID NO: 6458103 - DNA, 18 bp, Homo sapiens
tgaggacggggcagagct

SEQ ID NO: 6458104 - DNA, 14 bp, Homo sapiens
tgaggacgtgtctg

SEQ ID NO: 6458105 - DNA, 21 bp, Homo sapiens
tgaggactcatatatttaagc

SEQ ID NO: 6458106 - DNA, 13 bp, Homo sapiens
tgaggactctgga

SEQ ID NO: 6458107 - DNA, 24 bp, Homo sapiens
tgaggactctttccgactgcccag

SEQ ID NO: 6458108 - DNA, 14 bp, Homo sapiens
tgaggactgaagct

SEQ ID NO: 6458109 - DNA, 14 bp, Homo sapiens
tgaggactgtcctc

SEQ ID NO: 6458110 - DNA, 15 bp, Homo sapiens
tgaggactgtcctcc

SEQ ID NO: 6458111 - DNA, 24 bp, Homo sapiens
tgaggactgtcctcccacagacct

SEQ ID NO: 6458112 - DNA, 17 bp, Homo sapiens
tgaggactgttggctga

SEQ ID NO: 6458113 - DNA, 21 bp, Homo sapiens
tgaggactgttggctgattgg

SEQ ID NO: 6458114 - DNA, 20 bp, Homo sapiens
tgaggagaagctgatccagt

SEQ ID NO: 6458115 - DNA, 11 bp, Homo sapiens
tgaggagaagg

SEQ ID NO: 6458116 - DNA, 19 bp, Homo sapiens
tgaggagacacacctgagg

SEQ ID NO: 6458117 - DNA, 13 bp, Homo sapiens
tgaggagacagaa

SEQ ID NO: 6458118 - DNA, 16 bp, Homo sapiens
tgaggagacagaaagc

SEQ ID NO: 6458119 - DNA, 18 bp, Homo sapiens
tgaggagacagaaagcct

SEQ ID NO: 6458120 - DNA, 17 bp, Homo sapiens
tgaggagagaaaatata

SEQ ID NO: 6458121 - DNA, 17 bp, Homo sapiens
tgaggagagaggaggaa

SEQ ID NO: 6458122 - DNA, 21 bp, Homo sapiens
tgaggagatgaccagggatgc

SEQ ID NO: 6458123 - DNA, 14 bp, Homo sapiens
tgaggagattccca

SEQ ID NO: 6458124 - DNA, 17 bp, Homo sapiens
tgaggagcaagggtggc

SEQ ID NO: 6458125 - DNA, 22 bp, Homo sapiens
tgaggagcagcaggagggggga

SEQ ID NO: 6458126 - DNA, 15 bp, Homo sapiens
tgaggagcagccagg

SEQ ID NO: 6458127 - DNA, 18 bp, Homo sapiens
tgaggagcagccaggacc

SEQ ID NO: 6458128 - DNA, 20 bp, Homo sapiens
tgaggagcagccaggacccg

SEQ ID NO: 6458129 - DNA, 19 bp, Homo sapiens
tgaggagcagcccacctgc

SEQ ID NO: 6458130 - DNA, 13 bp, Homo sapiens
tgaggagcagctg

SEQ ID NO: 6458131 - DNA, 15 bp, Homo sapiens
tgaggagcatgtttt

SEQ ID NO: 6458132 - DNA, 19 bp, Homo sapiens
tgaggagcattaaggtatt

SEQ ID NO: 6458133 - DNA, 23 bp, Homo sapiens
tgaggagcccacggggcaaagct

SEQ ID NO: 6458134 - DNA, 11 bp, Homo sapiens
tgaggagcccc

SEQ ID NO: 6458135 - DNA, 20 bp, Homo sapiens
tgaggagccccatctgtcta

SEQ ID NO: 6458136 - DNA, 18 bp, Homo sapiens
tgaggagccctgaggacc

SEQ ID NO: 6458137 - DNA, 19 bp, Homo sapiens
tgaggagccctgaggacct

SEQ ID NO: 6458138 - DNA, 24 bp, Homo sapiens
tgaggagcgtggactctgctagac

SEQ ID NO: 6458139 - DNA, 18 bp, Homo sapiens
tgaggagctagtgttaat

SEQ ID NO: 6458140 - DNA, 22 bp, Homo sapiens
tgaggagctcagggctggattg

SEQ ID NO: 6458141 - DNA, 12 bp, Homo sapiens
tgaggagctgct

SEQ ID NO: 6458142 - DNA, 14 bp, Homo sapiens
tgaggagctgctgg

SEQ ID NO: 6458143 - DNA, 15 bp, Homo sapiens
tgaggagctggaggg

SEQ ID NO: 6458144 - DNA, 16 bp, Homo sapiens
tgaggagctggagggg

SEQ ID NO: 6458145 - DNA, 13 bp, Homo sapiens
tgaggagctgggg

SEQ ID NO: 6458146 - DNA, 20 bp, Homo sapiens
tgaggagctgttggcctggg

SEQ ID NO: 6458147 - DNA, 16 bp, Homo sapiens
tgaggagcttgaaacc

SEQ ID NO: 6458148 - DNA, 15 bp, Homo sapiens
tgaggaggaaaagga

SEQ ID NO: 6458149 - DNA, 18 bp, Homo sapiens
tgaggaggaaaaggaaaa

SEQ ID NO: 6458150 - DNA, 20 bp, Homo sapiens
tgaggaggaaaaggaaaaaa

SEQ ID NO: 6458151 - DNA, 14 bp, Homo sapiens
tgaggaggaagcag

SEQ ID NO: 6458152 - DNA, 12 bp, Homo sapiens
tgaggaggaagg

SEQ ID NO: 6458153 - DNA, 14 bp, Homo sapiens
tgaggaggacaaga

SEQ ID NO: 6458154 - DNA, 21 bp, Homo sapiens
tgaggaggactactatttgaa

SEQ ID NO: 6458155 - DNA, 15 bp, Homo sapiens
tgaggaggagctggc

SEQ ID NO: 6458156 - DNA, 16 bp, Homo sapiens
tgaggaggaggcagaa

SEQ ID NO: 6458157 - DNA, 20 bp, Homo sapiens
tgaggaggatgtccctgggc

SEQ ID NO: 6458158 - DNA, 16 bp, Homo sapiens
tgaggagggatgtggg

SEQ ID NO: 6458159 - DNA, 21 bp, Homo sapiens
tgaggagggccctgaggaata

SEQ ID NO: 6458160 - DNA, 22 bp, Homo sapiens
tgaggaggggagcaaggctgct

SEQ ID NO: 6458161 - DNA, 12 bp, Homo sapiens
tgaggaggggca

SEQ ID NO: 6458162 - DNA, 19 bp, Homo sapiens
tgaggaggggcacctgcca

SEQ ID NO: 6458163 - DNA, 22 bp, Homo sapiens
tgaggaggggcccccctgccct

SEQ ID NO: 6458164 - DNA, 15 bp, Homo sapiens
tgaggaggggcggga

SEQ ID NO: 6458165 - DNA, 17 bp, Homo sapiens
tgaggagggtggaggaa

SEQ ID NO: 6458166 - DNA, 18 bp, Homo sapiens
tgaggagggtggaggaag

SEQ ID NO: 6458167 - DNA, 16 bp, Homo sapiens
tgaggagtaaaattca

SEQ ID NO: 6458168 - DNA, 15 bp, Homo sapiens
tgaggagtaagtgta

SEQ ID NO: 6458169 - DNA, 18 bp, Homo sapiens
tgaggagtaagtgtacaa

SEQ ID NO: 6458170 - DNA, 15 bp, Homo sapiens
tgaggagtagctgag

SEQ ID NO: 6458171 - DNA, 18 bp, Homo sapiens
tgaggagtctgaggactg

SEQ ID NO: 6458172 - DNA, 15 bp, Homo sapiens
tgaggagtctgaggt

SEQ ID NO: 6458173 - DNA, 16 bp, Homo sapiens
tgaggagtctgaggtc

SEQ ID NO: 6458174 - DNA, 21 bp, Homo sapiens
tgaggagtctgaggtcctgag

SEQ ID NO: 6458175 - DNA, 22 bp, Homo sapiens
tgaggagtctgaggtcctgagc

SEQ ID NO: 6458176 - DNA, 14 bp, Homo sapiens
tgaggagtgtcctg

SEQ ID NO: 6458177 - DNA, 15 bp, Homo sapiens
tgaggagtgtcctgt

SEQ ID NO: 6458178 - DNA, 20 bp, Homo sapiens
tgaggagtgtcctgtctgct

SEQ ID NO: 6458179 - DNA, 19 bp, Homo sapiens
tgaggagtttcctaaaagt

SEQ ID NO: 6458180 - DNA, 19 bp, Homo sapiens
tgaggataaaaaggaagga

SEQ ID NO: 6458181 - DNA, 21 bp, Homo sapiens
tgaggataaaaaggaaggaga

SEQ ID NO: 6458182 - DNA, 21 bp, Homo sapiens
tgaggataaattgccataata

SEQ ID NO: 6458183 - DNA, 18 bp, Homo sapiens
tgaggataaggggtgggg

SEQ ID NO: 6458184 - DNA, 17 bp, Homo sapiens
tgaggataccccaaagt

SEQ ID NO: 6458185 - DNA, 22 bp, Homo sapiens
tgaggataccccaaagtccagg

SEQ ID NO: 6458186 - DNA, 17 bp, Homo sapiens
tgaggatataatgtgtg

SEQ ID NO: 6458187 - DNA, 17 bp, Homo sapiens
tgaggatatagtagcca

SEQ ID NO: 6458188 - DNA, 18 bp, Homo sapiens
tgaggatattcagatgta

SEQ ID NO: 6458189 - DNA, 16 bp, Homo sapiens
tgaggatcagaaagta

SEQ ID NO: 6458190 - DNA, 19 bp, Homo sapiens
tgaggatcagagtaatcca

SEQ ID NO: 6458191 - DNA, 12 bp, Homo sapiens
tgaggatccagg

SEQ ID NO: 6458192 - DNA, 22 bp, Homo sapiens
tgaggatccagggcagcaggcc

SEQ ID NO: 6458193 - DNA, 23 bp, Homo sapiens
tgaggatccagggcagcaggcca

SEQ ID NO: 6458194 - DNA, 22 bp, Homo sapiens
tgaggatgacagtgacacccag

SEQ ID NO: 6458195 - DNA, 23 bp, Homo sapiens
tgaggatgacagtgacacccaga

SEQ ID NO: 6458196 - DNA, 16 bp, Homo sapiens
tgaggatgagacccag

SEQ ID NO: 6458197 - DNA, 17 bp, Homo sapiens
tgaggatgagacccagc

SEQ ID NO: 6458198 - DNA, 18 bp, Homo sapiens
tgaggatgagacccagcc

SEQ ID NO: 6458199 - DNA, 20 bp, Homo sapiens
tgaggatgagacccagcccc

SEQ ID NO: 6458200 - DNA, 21 bp, Homo sapiens
tgaggatgagacccagcccct

SEQ ID NO: 6458201 - DNA, 15 bp, Homo sapiens
tgaggatgagctgga

SEQ ID NO: 6458202 - DNA, 13 bp, Homo sapiens
tgaggatgatgta

SEQ ID NO: 6458203 - DNA, 23 bp, Homo sapiens
tgaggatgcactggcctgttctg

SEQ ID NO: 6458204 - DNA, 17 bp, Homo sapiens
tgaggatgggatgtatt

SEQ ID NO: 6458205 - DNA, 19 bp, Homo sapiens
tgaggatgggatgtatttt

SEQ ID NO: 6458206 - DNA, 23 bp, Homo sapiens
tgaggatgggatgtatttttctt

SEQ ID NO: 6458207 - DNA, 22 bp, Homo sapiens
tgaggatgtaaagatcaataaa

SEQ ID NO: 6458208 - DNA, 21 bp, Homo sapiens
tgaggatgtagagagaacagg

SEQ ID NO: 6458209 - DNA, 17 bp, Homo sapiens
tgaggatgtatgtgtat

SEQ ID NO: 6458210 - DNA, 17 bp, Homo sapiens
tgaggatgtcactcaga

SEQ ID NO: 6458211 - DNA, 19 bp, Homo sapiens
tgaggattagtttagaaca

SEQ ID NO: 6458212 - DNA, 23 bp, Homo sapiens
tgaggattatgggtcctgcaatt

SEQ ID NO: 6458213 - DNA, 20 bp, Homo sapiens
tgaggattattgatagtact

SEQ ID NO: 6458214 - DNA, 14 bp, Homo sapiens
tgaggattgtggaa

SEQ ID NO: 6458215 - DNA, 22 bp, Homo sapiens
tgaggattgtggaaaaccagga

SEQ ID NO: 6458216 - DNA, 18 bp, Homo sapiens
tgaggatttcctggagtg

SEQ ID NO: 6458217 - DNA, 22 bp, Homo sapiens
tgaggatttcctggagtgccct

SEQ ID NO: 6458218 - DNA, 22 bp, Homo sapiens
tgaggatttctttttggtttgc

SEQ ID NO: 6458219 - DNA, 12 bp, Homo sapiens
tgaggcaaaaga

SEQ ID NO: 6458220 - DNA, 21 bp, Homo sapiens
tgaggcaaaggccagcagcag

SEQ ID NO: 6458221 - DNA, 17 bp, Homo sapiens
tgaggcaaattaactgt

SEQ ID NO: 6458222 - DNA, 20 bp, Homo sapiens
tgaggcaaccacaggcagca

SEQ ID NO: 6458223 - DNA, 13 bp, Homo sapiens
tgaggcaagagaa

SEQ ID NO: 6458224 - DNA, 18 bp, Homo sapiens
tgaggcaagagaaatgag

SEQ ID NO: 6458225 - DNA, 21 bp, Homo sapiens
tgaggcaaggcccagacctgg

SEQ ID NO: 6458226 - DNA, 23 bp, Homo sapiens
tgaggcaaggcccagacctggcc

SEQ ID NO: 6458227 - DNA, 20 bp, Homo sapiens
tgaggcaataaaaatcatag

SEQ ID NO: 6458228 - DNA, 21 bp, Homo sapiens
tgaggcaatgtcaggaacaga

SEQ ID NO: 6458229 - DNA, 12 bp, Homo sapiens
tgaggcacatga

SEQ ID NO: 6458230 - DNA, 17 bp, Homo sapiens
tgaggcaccgtccaggc

SEQ ID NO: 6458231 - DNA, 17 bp, Homo sapiens
tgaggcagaacctggtg

SEQ ID NO: 6458232 - DNA, 14 bp, Homo sapiens
tgaggcagacagca

SEQ ID NO: 6458233 - DNA, 22 bp, Homo sapiens
tgaggcagatggccactgctct

SEQ ID NO: 6458234 - DNA, 18 bp, Homo sapiens
tgaggcagcagaattgct

SEQ ID NO: 6458235 - DNA, 22 bp, Homo sapiens
tgaggcagccgaggtccctgct

SEQ ID NO: 6458236 - DNA, 23 bp, Homo sapiens
tgaggcagccgaggtccctgctg

SEQ ID NO: 6458237 - DNA, 13 bp, Homo sapiens
tgaggcagccttg

SEQ ID NO: 6458238 - DNA, 17 bp, Homo sapiens
tgaggcaggagaatcac

SEQ ID NO: 6458239 - DNA, 16 bp, Homo sapiens
tgaggcaggagaattg

SEQ ID NO: 6458240 - DNA, 15 bp, Homo sapiens
tgaggcaggagggca

SEQ ID NO: 6458241 - DNA, 18 bp, Homo sapiens
tgaggcaggagggcatgt

SEQ ID NO: 6458242 - DNA, 15 bp, Homo sapiens
tgaggcaggggagtc

SEQ ID NO: 6458243 - DNA, 23 bp, Homo sapiens
tgaggcaggggagtctgcttgtc

SEQ ID NO: 6458244 - DNA, 20 bp, Homo sapiens
tgaggcagggtctcactctg

SEQ ID NO: 6458245 - DNA, 23 bp, Homo sapiens
tgaggcagggtctcactctgttg

SEQ ID NO: 6458246 - DNA, 22 bp, Homo sapiens
tgaggcaggtgagaacccagag

SEQ ID NO: 6458247 - DNA, 21 bp, Homo sapiens
tgaggcagtgggtcccacttc

SEQ ID NO: 6458248 - DNA, 19 bp, Homo sapiens
tgaggcatccgtgaggcag

SEQ ID NO: 6458249 - DNA, 21 bp, Homo sapiens
tgaggcatccgtgaggcaggg

SEQ ID NO: 6458250 - DNA, 15 bp, Homo sapiens
tgaggcatcctctga

SEQ ID NO: 6458251 - DNA, 16 bp, Homo sapiens
tgaggcatcctctgac

SEQ ID NO: 6458252 - DNA, 21 bp, Homo sapiens
tgaggcatcctctgactccac

SEQ ID NO: 6458253 - DNA, 23 bp, Homo sapiens
tgaggcatcgcaatgtaagactc

SEQ ID NO: 6458254 - DNA, 19 bp, Homo sapiens
tgaggcatctttacatcta

SEQ ID NO: 6458255 - DNA, 17 bp, Homo sapiens
tgaggcatgagttactg

SEQ ID NO: 6458256 - DNA, 22 bp, Homo sapiens
tgaggcatggcaattctggaag

SEQ ID NO: 6458257 - DNA, 23 bp, Homo sapiens
tgaggcattttactatgcctgtt

SEQ ID NO: 6458258 - DNA, 22 bp, Homo sapiens
tgaggccaaatgagttcccttg

SEQ ID NO: 6458259 - DNA, 13 bp, Homo sapiens
tcctgctgtggaa

SEQ ID NO: 6458260 - DNA, 14 bp, Homo sapiens
tcctgctgtggggc

SEQ ID NO: 6458261 - DNA, 22 bp, Homo sapiens
tcctgctgtgtgaattcccagg

SEQ ID NO: 6458262 - DNA, 14 bp, Homo sapiens
tcctgcttcccctc

SEQ ID NO: 6458263 - DNA, 11 bp, Homo sapiens
tcctgcttcct

SEQ ID NO: 6458264 - DNA, 21 bp, Homo sapiens
tcctgcttcctaggccccaga

SEQ ID NO: 6458265 - DNA, 13 bp, Homo sapiens
tcctgcttcctga

SEQ ID NO: 6458266 - DNA, 14 bp, Homo sapiens
tcctgcttcctgaa

SEQ ID NO: 6458267 - DNA, 23 bp, Homo sapiens
tcctgcttgatgggattctggac

SEQ ID NO: 6458268 - DNA, 24 bp, Homo sapiens
tcctgctttacaggatcatgtaaa

SEQ ID NO: 6458269 - DNA, 13 bp, Homo sapiens
tcctgctttctct

SEQ ID NO: 6458270 - DNA, 13 bp, Homo sapiens
tcctgctttggga

SEQ ID NO: 6458271 - DNA, 14 bp, Homo sapiens
tcctgcttttctaa

SEQ ID NO: 6458272 - DNA, 20 bp, Homo sapiens
tcctgcttttctgtcctggg

SEQ ID NO: 6458273 - DNA, 21 bp, Homo sapiens
tcctgcttttctgtcctgggc

SEQ ID NO: 6458274 - DNA, 19 bp, Homo sapiens
tcctgcttttggggctctt

SEQ ID NO: 6458275 - DNA, 21 bp, Homo sapiens
tcctggaaaagaagaaacttt

SEQ ID NO: 6458276 - DNA, 23 bp, Homo sapiens
tcctggaaaattctatggaatag

SEQ ID NO: 6458277 - DNA, 23 bp, Homo sapiens
tcctggaaacagacagggagaag

SEQ ID NO: 6458278 - DNA, 16 bp, Homo sapiens
tcctggaaacagcatg

SEQ ID NO: 6458279 - DNA, 19 bp, Homo sapiens
tcctggaaatttgtgtgct

SEQ ID NO: 6458280 - DNA, 20 bp, Homo sapiens
tcctggaacaatattttatg

SEQ ID NO: 6458281 - DNA, 21 bp, Homo sapiens
tcctggaacaatattttatgg

SEQ ID NO: 6458282 - DNA, 10 bp, Homo sapiens
tcctggaacc

SEQ ID NO: 6458283 - DNA, 22 bp, Homo sapiens
tcctggaaccaggcttgcctgg

SEQ ID NO: 6458284 - DNA, 20 bp, Homo sapiens
tcctggaaccggtcacagga

SEQ ID NO: 6458285 - DNA, 13 bp, Homo sapiens
tcctggaacctgg

SEQ ID NO: 6458286 - DNA, 14 bp, Homo sapiens
tcctggaacctgga

SEQ ID NO: 6458287 - DNA, 22 bp, Homo sapiens
tcctggaacctggaccccagcc

SEQ ID NO: 6458288 - DNA, 23 bp, Homo sapiens
tcctggaacctggcaggccctgc

SEQ ID NO: 6458289 - DNA, 19 bp, Homo sapiens
tcctggaaccttgctgtcc

SEQ ID NO: 6458290 - DNA, 12 bp, Homo sapiens
tcctggaagaca

SEQ ID NO: 6458291 - DNA, 14 bp, Homo sapiens
tcctggaagcacag

SEQ ID NO: 6458292 - DNA, 15 bp, Homo sapiens
tcctggaagcagagc

SEQ ID NO: 6458293 - DNA, 17 bp, Homo sapiens
tcctggaagcagagcaa

SEQ ID NO: 6458294 - DNA, 20 bp, Homo sapiens
tcctggaagcagagcaaaat

SEQ ID NO: 6458295 - DNA, 18 bp, Homo sapiens
tcctggaagccagctttc

SEQ ID NO: 6458296 - DNA, 14 bp, Homo sapiens
tcctggaagctgtg

SEQ ID NO: 6458297 - DNA, 21 bp, Homo sapiens
tcctggaagctgtgtccttgc

SEQ ID NO: 6458298 - DNA, 16 bp, Homo sapiens
tcctggaaggacacag

SEQ ID NO: 6458299 - DNA, 23 bp, Homo sapiens
tcctggaagtgctaattttgaaa

SEQ ID NO: 6458300 - DNA, 19 bp, Homo sapiens
tcctggaatgaagcatgta

SEQ ID NO: 6458301 - DNA, 20 bp, Homo sapiens
tcctggaatttggacaagtg

SEQ ID NO: 6458302 - DNA, 14 bp, Homo sapiens
tcctggacacactc

SEQ ID NO: 6458303 - DNA, 14 bp, Homo sapiens
tcctggacacctcc

SEQ ID NO: 6458304 - DNA, 16 bp, Homo sapiens
tcctggacacctccca

SEQ ID NO: 6458305 - DNA, 20 bp, Homo sapiens
tcctggacacctcccagggg

SEQ ID NO: 6458306 - DNA, 17 bp, Homo sapiens
tcctggacaggccaggt

SEQ ID NO: 6458307 - DNA, 14 bp, Homo sapiens
tcctggacatcacc

SEQ ID NO: 6458308 - DNA, 18 bp, Homo sapiens
tcctggacatcaccagtc

SEQ ID NO: 6458309 - DNA, 19 bp, Homo sapiens
tcctggacattttttcagt

SEQ ID NO: 6458310 - DNA, 18 bp, Homo sapiens
tcctggacccagcagggg

SEQ ID NO: 6458311 - DNA, 12 bp, Homo sapiens
tcctggaccctg

SEQ ID NO: 6458312 - DNA, 11 bp, Homo sapiens
tcctggaccta

SEQ ID NO: 6458313 - DNA, 16 bp, Homo sapiens
tcctggacctaaaggg

SEQ ID NO: 6458314 - DNA, 15 bp, Homo sapiens
tcctggacctgagtc

SEQ ID NO: 6458315 - DNA, 22 bp, Homo sapiens
tcctggacctgagtcggcccca

SEQ ID NO: 6458316 - DNA, 16 bp, Homo sapiens
tcctggactcctgcca

SEQ ID NO: 6458317 - DNA, 16 bp, Homo sapiens
tcctggagatagctgg

SEQ ID NO: 6458318 - DNA, 17 bp, Homo sapiens
tcctggagatagctggg

SEQ ID NO: 6458319 - DNA, 18 bp, Homo sapiens
tcctggagatagctgggg

SEQ ID NO: 6458320 - DNA, 19 bp, Homo sapiens
tcctggagatagctggggc

SEQ ID NO: 6458321 - DNA, 18 bp, Homo sapiens
tcctggagcaatcacaga

SEQ ID NO: 6458322 - DNA, 20 bp, Homo sapiens
tcctggagcaatcacagatg

SEQ ID NO: 6458323 - DNA, 19 bp, Homo sapiens
tcctggagcagaaagtgcc

SEQ ID NO: 6458324 - DNA, 20 bp, Homo sapiens
tcctggagcagaaagtgcct

SEQ ID NO: 6458325 - DNA, 19 bp, Homo sapiens
tcctggagcagaccacccc

SEQ ID NO: 6458326 - DNA, 18 bp, Homo sapiens
tcctggagcagcagctga

SEQ ID NO: 6458327 - DNA, 19 bp, Homo sapiens
tcctggagcatcccaggcg

SEQ ID NO: 6458328 - DNA, 13 bp, Homo sapiens
tcctggagccagc

SEQ ID NO: 6458329 - DNA, 15 bp, Homo sapiens
tcctggagcccagag

SEQ ID NO: 6458330 - DNA, 18 bp, Homo sapiens
tcctggagcccagaggag

SEQ ID NO: 6458331 - DNA, 22 bp, Homo sapiens
tcctggagcccagaggagggca

SEQ ID NO: 6458332 - DNA, 20 bp, Homo sapiens
tcctggagcccgaggcacca

SEQ ID NO: 6458333 - DNA, 18 bp, Homo sapiens
tcctggagcctttgaata

SEQ ID NO: 6458334 - DNA, 13 bp, Homo sapiens
tcctggaggcaga

SEQ ID NO: 6458335 - DNA, 14 bp, Homo sapiens
tcctggaggcaggg

SEQ ID NO: 6458336 - DNA, 15 bp, Homo sapiens
tcctggaggcagggg

SEQ ID NO: 6458337 - DNA, 14 bp, Homo sapiens
tcctggaggctgcc

SEQ ID NO: 6458338 - DNA, 16 bp, Homo sapiens
tcctggaggtcttttc

SEQ ID NO: 6458339 - DNA, 17 bp, Homo sapiens
tcctggagtctcactgt

SEQ ID NO: 6458340 - DNA, 17 bp, Homo sapiens
tcctggagtgccctgca

SEQ ID NO: 6458341 - DNA, 20 bp, Homo sapiens
tcctggagtgccctgcaggc

SEQ ID NO: 6458342 - DNA, 14 bp, Homo sapiens
tcctggataaaaaa

SEQ ID NO: 6458343 - DNA, 23 bp, Homo sapiens
tcctggatgggcctttgagcctg

SEQ ID NO: 6458344 - DNA, 19 bp, Homo sapiens
tcctggatggggcagagct

SEQ ID NO: 6458345 - DNA, 18 bp, Homo sapiens
tcctggatgttgtgtgta

SEQ ID NO: 6458346 - DNA, 17 bp, Homo sapiens
tcctggatgtttggaaa

SEQ ID NO: 6458347 - DNA, 14 bp, Homo sapiens
tcctggattcctct

SEQ ID NO: 6458348 - DNA, 16 bp, Homo sapiens
tcctggatttaaatta

SEQ ID NO: 6458349 - DNA, 23 bp, Homo sapiens
tcctggcaaacaccattattcca

SEQ ID NO: 6458350 - DNA, 16 bp, Homo sapiens
tcctggcaaataatac

SEQ ID NO: 6458351 - DNA, 22 bp, Homo sapiens
tcctggcaagtgacccagctct

SEQ ID NO: 6458352 - DNA, 20 bp, Homo sapiens
tcctggcaatagtgtgttct

SEQ ID NO: 6458353 - DNA, 12 bp, Homo sapiens
tcctggcacaga

SEQ ID NO: 6458354 - DNA, 19 bp, Homo sapiens
tcctggcacccggcccctg

SEQ ID NO: 6458355 - DNA, 21 bp, Homo sapiens
tcctggcacccggcccctgct

SEQ ID NO: 6458356 - DNA, 23 bp, Homo sapiens
tcctggcacccggcccctgctgg

SEQ ID NO: 6458357 - DNA, 16 bp, Homo sapiens
tcctggcacctgagtg

SEQ ID NO: 6458358 - DNA, 14 bp, Homo sapiens
tcctggcagaaggg

SEQ ID NO: 6458359 - DNA, 14 bp, Homo sapiens
tcctggcagcctgc

SEQ ID NO: 6458360 - DNA, 23 bp, Homo sapiens
tcctggcagggcaggcagagctc

SEQ ID NO: 6458361 - DNA, 19 bp, Homo sapiens
tcctggcagggccacctgc

SEQ ID NO: 6458362 - DNA, 22 bp, Homo sapiens
tcctggcagggccacctgcagg

SEQ ID NO: 6458363 - DNA, 18 bp, Homo sapiens
tcctggcagggcgccaag

SEQ ID NO: 6458364 - DNA, 20 bp, Homo sapiens
tcctggcaggtgccccagga

SEQ ID NO: 6458365 - DNA, 19 bp, Homo sapiens
tcctggcagtctcagtcca

SEQ ID NO: 6458366 - DNA, 14 bp, Homo sapiens
tcctggcatttgct

SEQ ID NO: 6458367 - DNA, 17 bp, Homo sapiens
tcctggcatttgctgat

SEQ ID NO: 6458368 - DNA, 22 bp, Homo sapiens
tcctggccaagcaggctggttt

SEQ ID NO: 6458369 - DNA, 23 bp, Homo sapiens
tcctggccaagcaggctggtttg

SEQ ID NO: 6458370 - DNA, 10 bp, Homo sapiens
tcctggccag

SEQ ID NO: 6458371 - DNA, 16 bp, Homo sapiens
tcctggccatcccaca

SEQ ID NO: 6458372 - DNA, 14 bp, Homo sapiens
tcctggcccagcct

SEQ ID NO: 6458373 - DNA, 15 bp, Homo sapiens
tcctggcccaggcct

SEQ ID NO: 6458374 - DNA, 22 bp, Homo sapiens
tcctggcccagggcatctggga

SEQ ID NO: 6458375 - DNA, 11 bp, Homo sapiens
tcctggcccat

SEQ ID NO: 6458376 - DNA, 17 bp, Homo sapiens
tcctggcccatcagtgt

SEQ ID NO: 6458377 - DNA, 15 bp, Homo sapiens
tcctggccccagccc

SEQ ID NO: 6458378 - DNA, 17 bp, Homo sapiens
tcctggccccagccccc

SEQ ID NO: 6458379 - DNA, 18 bp, Homo sapiens
tcctggcccctccagacc

SEQ ID NO: 6458380 - DNA, 22 bp, Homo sapiens
tcctggcccctccagaccctgc

SEQ ID NO: 6458381 - DNA, 15 bp, Homo sapiens
tcctggcccctgcct

SEQ ID NO: 6458382 - DNA, 18 bp, Homo sapiens
tcctggcccgccctcacc

SEQ ID NO: 6458383 - DNA, 19 bp, Homo sapiens
tcctggcccgggagccgca

SEQ ID NO: 6458384 - DNA, 13 bp, Homo sapiens
tcctggccctctg

SEQ ID NO: 6458385 - DNA, 13 bp, Homo sapiens
tcctggccctggg

SEQ ID NO: 6458386 - DNA, 19 bp, Homo sapiens
tcctggccctgggggtctg

SEQ ID NO: 6458387 - DNA, 23 bp, Homo sapiens
tcctggcctcaagccatcttccc

SEQ ID NO: 6458388 - DNA, 15 bp, Homo sapiens
tcctggcctcagact

SEQ ID NO: 6458389 - DNA, 21 bp, Homo sapiens
tcctggcctcagagcttcctg

SEQ ID NO: 6458390 - DNA, 12 bp, Homo sapiens
tcctggcctccc

SEQ ID NO: 6458391 - DNA, 18 bp, Homo sapiens
tcctggcctcgtgatctg

SEQ ID NO: 6458392 - DNA, 13 bp, Homo sapiens
tcctggcctgcct

SEQ ID NO: 6458393 - DNA, 13 bp, Homo sapiens
tcctggcctggca

SEQ ID NO: 6458394 - DNA, 23 bp, Homo sapiens
tcctggccttctaggaatggagg

SEQ ID NO: 6458395 - DNA, 15 bp, Homo sapiens
tcctggccttgctga

SEQ ID NO: 6458396 - DNA, 12 bp, Homo sapiens
tcctggcgcctg

SEQ ID NO: 6458397 - DNA, 17 bp, Homo sapiens
tcctggctacatcccag

SEQ ID NO: 6458398 - DNA, 20 bp, Homo sapiens
tcctggctacatcccagcct

SEQ ID NO: 6458399 - DNA, 21 bp, Homo sapiens
tcctggctacatcccagcctg

SEQ ID NO: 6458400 - DNA, 18 bp, Homo sapiens
tcctggctcacagccacc

SEQ ID NO: 6458401 - DNA, 13 bp, Homo sapiens
tcctggctcagcc

SEQ ID NO: 6458402 - DNA, 15 bp, Homo sapiens
tcctggctcccaggg

SEQ ID NO: 6458403 - DNA, 16 bp, Homo sapiens
tcctggctcccagggt

SEQ ID NO: 6458404 - DNA, 18 bp, Homo sapiens
tcctggctccgcaggggt

SEQ ID NO: 6458405 - DNA, 13 bp, Homo sapiens
tcctggctcctga

SEQ ID NO: 6458406 - DNA, 21 bp, Homo sapiens
tcctggctcggggtaaaaagt

SEQ ID NO: 6458407 - DNA, 14 bp, Homo sapiens
tcctggctctgggg

SEQ ID NO: 6458408 - DNA, 14 bp, Homo sapiens
tcctggctgcactc

SEQ ID NO: 6458409 - DNA, 14 bp, Homo sapiens
tcctggctgccagg

SEQ ID NO: 6458410 - DNA, 15 bp, Homo sapiens
tcctggctgccaggc

SEQ ID NO: 6458411 - DNA, 14 bp, Homo sapiens
tcctggctgctctc

SEQ ID NO: 6458412 - DNA, 15 bp, Homo sapiens
tcctggctggccgca

SEQ ID NO: 6458413 - DNA, 22 bp, Homo sapiens
tcctggctggctgtgtcctctc

SEQ ID NO: 6458414 - DNA, 13 bp, Homo sapiens
tcctggctgggcc

SEQ ID NO: 6458415 - DNA, 22 bp, Homo sapiens
tcctggctgtcctaccatcagc

SEQ ID NO: 6458416 - DNA, 17 bp, Homo sapiens
tcctggctgtgcccagc

SEQ ID NO: 6458417 - DNA, 21 bp, Homo sapiens
tcctggctgtgcccagcaggc

SEQ ID NO: 6458418 - DNA, 14 bp, Homo sapiens
tcctggcttcccat

SEQ ID NO: 6458419 - DNA, 15 bp, Homo sapiens
tcctggctttgccca

SEQ ID NO: 6458420 - DNA, 17 bp, Homo sapiens
tcctgggaaagggagat

SEQ ID NO: 6458421 - DNA, 20 bp, Homo sapiens
tcctgggaaatattccctag

SEQ ID NO: 6458422 - DNA, 21 bp, Homo sapiens
tcctgggaaatattccctaga

SEQ ID NO: 6458423 - DNA, 18 bp, Homo sapiens
tcctgggaagatgaggtt

SEQ ID NO: 6458424 - DNA, 23 bp, Homo sapiens
tcctgggaagatgaggttctgag

SEQ ID NO: 6458425 - DNA, 21 bp, Homo sapiens
tcctgggaaggagggagctgc

SEQ ID NO: 6458426 - DNA, 21 bp, Homo sapiens
tcctgggaaggccacctccca

SEQ ID NO: 6458427 - DNA, 17 bp, Homo sapiens
tcctgggaatggaataa

SEQ ID NO: 6458428 - DNA, 20 bp, Homo sapiens
tcctgggaccatggacacat

SEQ ID NO: 6458429 - DNA, 17 bp, Homo sapiens
tcctgggaccccctcgc

SEQ ID NO: 6458430 - DNA, 23 bp, Homo sapiens
tcctgggaccccctcgccagctt

SEQ ID NO: 6458431 - DNA, 17 bp, Homo sapiens
tcctgggagaacctcag

SEQ ID NO: 6458432 - DNA, 15 bp, Homo sapiens
tcctgggagacccat

SEQ ID NO: 6458433 - DNA, 21 bp, Homo sapiens
tcctgggagagaaggagatca

SEQ ID NO: 6458434 - DNA, 13 bp, Homo sapiens
tcctgggagagga

SEQ ID NO: 6458435 - DNA, 21 bp, Homo sapiens
tcctgggagaggacagggact

SEQ ID NO: 6458436 - DNA, 20 bp, Homo sapiens
tcctgggagctcatgtgtcc

SEQ ID NO: 6458437 - DNA, 16 bp, Homo sapiens
tcctgggaggacaggc

SEQ ID NO: 6458438 - DNA, 16 bp, Homo sapiens
tgaggccaagaatatt

SEQ ID NO: 6458439 - DNA, 19 bp, Homo sapiens
tgaggccaagatggctgct

SEQ ID NO: 6458440 - DNA, 21 bp, Homo sapiens
tgaggccaagatggctgctgc

SEQ ID NO: 6458441 - DNA, 23 bp, Homo sapiens
tgaggccaagatggctgctgcct

SEQ ID NO: 6458442 - DNA, 20 bp, Homo sapiens
tgaggccacactcagcacaa

SEQ ID NO: 6458443 - DNA, 23 bp, Homo sapiens
tgaggccacactcagcacaaggc

SEQ ID NO: 6458444 - DNA, 15 bp, Homo sapiens
tgaggccactgaaga

SEQ ID NO: 6458445 - DNA, 21 bp, Homo sapiens
tgaggccactgtgttccttcc

SEQ ID NO: 6458446 - DNA, 14 bp, Homo sapiens
tgaggccagaaagg

SEQ ID NO: 6458447 - DNA, 20 bp, Homo sapiens
tgaggccagagacacaagcc

SEQ ID NO: 6458448 - DNA, 14 bp, Homo sapiens
tgaggccagagtca

SEQ ID NO: 6458449 - DNA, 18 bp, Homo sapiens
tgaggccagcctgcggga

SEQ ID NO: 6458450 - DNA, 23 bp, Homo sapiens
tgaggccagcctgcgggaagctg

SEQ ID NO: 6458451 - DNA, 17 bp, Homo sapiens
tgaggccagcctggcct

SEQ ID NO: 6458452 - DNA, 18 bp, Homo sapiens
tgaggccaggactttgag

SEQ ID NO: 6458453 - DNA, 13 bp, Homo sapiens
tgaggccagggca

SEQ ID NO: 6458454 - DNA, 19 bp, Homo sapiens
tgaggccagtggcccccgg

SEQ ID NO: 6458455 - DNA, 15 bp, Homo sapiens
tgaggccatcagggc

SEQ ID NO: 6458456 - DNA, 18 bp, Homo sapiens
tgaggccatcagggccct

SEQ ID NO: 6458457 - DNA, 21 bp, Homo sapiens
tgaggccatcagggccctgcc

SEQ ID NO: 6458458 - DNA, 20 bp, Homo sapiens
tgaggccatctcaggagatg

SEQ ID NO: 6458459 - DNA, 20 bp, Homo sapiens
tgaggccatggactctgtcc

SEQ ID NO: 6458460 - DNA, 16 bp, Homo sapiens
tgaggccattccctgt

SEQ ID NO: 6458461 - DNA, 20 bp, Homo sapiens
tgaggccattccctgtagga

SEQ ID NO: 6458462 - DNA, 21 bp, Homo sapiens
tgaggccattccctgtaggag

SEQ ID NO: 6458463 - DNA, 15 bp, Homo sapiens
tgaggcccagagagc

SEQ ID NO: 6458464 - DNA, 16 bp, Homo sapiens
tgaggcccagagagct

SEQ ID NO: 6458465 - DNA, 20 bp, Homo sapiens
tgaggcccagagagggaaga

SEQ ID NO: 6458466 - DNA, 18 bp, Homo sapiens
tgaggcccagagggcctg

SEQ ID NO: 6458467 - DNA, 23 bp, Homo sapiens
tgaggcccagagggcctgcaagg

SEQ ID NO: 6458468 - DNA, 19 bp, Homo sapiens
tgaggcccagcctgtcctg

SEQ ID NO: 6458469 - DNA, 17 bp, Homo sapiens
tgaggcccagggagagg

SEQ ID NO: 6458470 - DNA, 23 bp, Homo sapiens
tgaggcccagggagaggccatga

SEQ ID NO: 6458471 - DNA, 15 bp, Homo sapiens
tgaggccccaggccc

SEQ ID NO: 6458472 - DNA, 16 bp, Homo sapiens
tgaggccccaggccct

SEQ ID NO: 6458473 - DNA, 13 bp, Homo sapiens
tgaggccccaggt

SEQ ID NO: 6458474 - DNA, 22 bp, Homo sapiens
tgaggcccccgcacgcaagcct

SEQ ID NO: 6458475 - DNA, 14 bp, Homo sapiens
tgaggcccccggag

SEQ ID NO: 6458476 - DNA, 23 bp, Homo sapiens
tgaggcccccggaggcgcccacc

SEQ ID NO: 6458477 - DNA, 15 bp, Homo sapiens
tgaggccccgaggct

SEQ ID NO: 6458478 - DNA, 19 bp, Homo sapiens
tgaggccccgatggactcc

SEQ ID NO: 6458479 - DNA, 23 bp, Homo sapiens
tgaggcccctaggtgcccagggc

SEQ ID NO: 6458480 - DNA, 14 bp, Homo sapiens
tgaggcccctgcct

SEQ ID NO: 6458481 - DNA, 13 bp, Homo sapiens
tgaggcccctgtg

SEQ ID NO: 6458482 - DNA, 17 bp, Homo sapiens
tgaggccctccacacct

SEQ ID NO: 6458483 - DNA, 21 bp, Homo sapiens
tgaggccctgggctgggtgct

SEQ ID NO: 6458484 - DNA, 19 bp, Homo sapiens
tgaggcccttctctccagc

SEQ ID NO: 6458485 - DNA, 24 bp, Homo sapiens
tgaggcccttctctccagcccctg

SEQ ID NO: 6458486 - DNA, 12 bp, Homo sapiens
tgaggccgcccg

SEQ ID NO: 6458487 - DNA, 18 bp, Homo sapiens
tgaggccgcggcctcccc

SEQ ID NO: 6458488 - DNA, 17 bp, Homo sapiens
tgaggccgctagaggcc

SEQ ID NO: 6458489 - DNA, 22 bp, Homo sapiens
tgaggccgctagaggcctgagg

SEQ ID NO: 6458490 - DNA, 23 bp, Homo sapiens
tgaggccgctagaggcctgagga

SEQ ID NO: 6458491 - DNA, 15 bp, Homo sapiens
tgaggccggccctgc

SEQ ID NO: 6458492 - DNA, 18 bp, Homo sapiens
tgaggccggccctgcccc

SEQ ID NO: 6458493 - DNA, 20 bp, Homo sapiens
tgaggccggccctgcccctc

SEQ ID NO: 6458494 - DNA, 21 bp, Homo sapiens
tgaggccggccctgcccctcc

SEQ ID NO: 6458495 - DNA, 23 bp, Homo sapiens
tgaggccggccctgcccctccct

SEQ ID NO: 6458496 - DNA, 21 bp, Homo sapiens
tgaggccgttgctgacttaga

SEQ ID NO: 6458497 - DNA, 22 bp, Homo sapiens
tgaggccgttgctgacttagaa

SEQ ID NO: 6458498 - DNA, 19 bp, Homo sapiens
tgaggcctaaaagtaaaca

SEQ ID NO: 6458499 - DNA, 15 bp, Homo sapiens
tgaggcctcagtgga

SEQ ID NO: 6458500 - DNA, 14 bp, Homo sapiens
tgaggcctcatccc

SEQ ID NO: 6458501 - DNA, 12 bp, Homo sapiens
tgaggcctccct

SEQ ID NO: 6458502 - DNA, 18 bp, Homo sapiens
tgaggcctgagacccagg

SEQ ID NO: 6458503 - DNA, 14 bp, Homo sapiens
tgaggcctgaggcc

SEQ ID NO: 6458504 - DNA, 17 bp, Homo sapiens
tgaggcctgccctcagg

SEQ ID NO: 6458505 - DNA, 21 bp, Homo sapiens
tgaggcctgccctcagggatc

SEQ ID NO: 6458506 - DNA, 11 bp, Homo sapiens
tgaggcctgga

SEQ ID NO: 6458507 - DNA, 19 bp, Homo sapiens
tgaggcctggactttcctg

SEQ ID NO: 6458508 - DNA, 20 bp, Homo sapiens
tgaggcctggactttcctgc

SEQ ID NO: 6458509 - DNA, 16 bp, Homo sapiens
tgaggcctggccaggc

SEQ ID NO: 6458510 - DNA, 14 bp, Homo sapiens
tgaggcctgtcctc

SEQ ID NO: 6458511 - DNA, 15 bp, Homo sapiens
tgaggcctgtgcctg

SEQ ID NO: 6458512 - DNA, 15 bp, Homo sapiens
tgaggcctgtgctct

SEQ ID NO: 6458513 - DNA, 22 bp, Homo sapiens
tgaggccttatcattcattctt

SEQ ID NO: 6458514 - DNA, 17 bp, Homo sapiens
tgaggcctttccccagt

SEQ ID NO: 6458515 - DNA, 21 bp, Homo sapiens
tgaggcgagcagggcaggccc

SEQ ID NO: 6458516 - DNA, 22 bp, Homo sapiens
tgaggcggagctccaggatggg

SEQ ID NO: 6458517 - DNA, 18 bp, Homo sapiens
tgaggcggaggctgtgct

SEQ ID NO: 6458518 - DNA, 15 bp, Homo sapiens
tgaggcggcagctgg

SEQ ID NO: 6458519 - DNA, 16 bp, Homo sapiens
tgaggcgggtggctgg

SEQ ID NO: 6458520 - DNA, 20 bp, Homo sapiens
tgaggcgtatgtggcaaaat

SEQ ID NO: 6458521 - DNA, 20 bp, Homo sapiens
tgaggcgtgggatccagaga

SEQ ID NO: 6458522 - DNA, 17 bp, Homo sapiens
tgaggctagtgtggtgt

SEQ ID NO: 6458523 - DNA, 20 bp, Homo sapiens
tgaggctatggagggtcctc

SEQ ID NO: 6458524 - DNA, 16 bp, Homo sapiens
tgaggctcaagaggcc

SEQ ID NO: 6458525 - DNA, 19 bp, Homo sapiens
tgaggctcaagaggcccag

SEQ ID NO: 6458526 - DNA, 13 bp, Homo sapiens
tgaggctcagaga

SEQ ID NO: 6458527 - DNA, 21 bp, Homo sapiens
tgaggctcagagaggtagcac

SEQ ID NO: 6458528 - DNA, 19 bp, Homo sapiens
tgaggctcagccctgagct

SEQ ID NO: 6458529 - DNA, 20 bp, Homo sapiens
tgaggctcagccctgagctg

SEQ ID NO: 6458530 - DNA, 16 bp, Homo sapiens
tgaggctcctgtgcta

SEQ ID NO: 6458531 - DNA, 23 bp, Homo sapiens
tgaggctccttagggttttctct

SEQ ID NO: 6458532 - DNA, 19 bp, Homo sapiens
tgaggctctattgagccaa

SEQ ID NO: 6458533 - DNA, 20 bp, Homo sapiens
tgaggctctattgagccaag

SEQ ID NO: 6458534 - DNA, 16 bp, Homo sapiens
tgaggctctctaagaa

SEQ ID NO: 6458535 - DNA, 13 bp, Homo sapiens
tgaggctctgccc

SEQ ID NO: 6458536 - DNA, 14 bp, Homo sapiens
tgaggctctgccct

SEQ ID NO: 6458537 - DNA, 15 bp, Homo sapiens
tgaggctctgccctt

SEQ ID NO: 6458538 - DNA, 16 bp, Homo sapiens
tgaggctctgcccttg

SEQ ID NO: 6458539 - DNA, 21 bp, Homo sapiens
tgaggctctgtcactgagcaa

SEQ ID NO: 6458540 - DNA, 16 bp, Homo sapiens
tgaggctctttctggg

SEQ ID NO: 6458541 - DNA, 18 bp, Homo sapiens
tgaggctgacatgctcac

SEQ ID NO: 6458542 - DNA, 18 bp, Homo sapiens
tgaggctgagactgcggg

SEQ ID NO: 6458543 - DNA, 16 bp, Homo sapiens
tgaggctgaggcagga

SEQ ID NO: 6458544 - DNA, 17 bp, Homo sapiens
tgaggctgctgccaggc

SEQ ID NO: 6458545 - DNA, 13 bp, Homo sapiens
tgaggctggactc

SEQ ID NO: 6458546 - DNA, 15 bp, Homo sapiens
tgaggctggcactcc

SEQ ID NO: 6458547 - DNA, 19 bp, Homo sapiens
tgaggctggcatcctggct

SEQ ID NO: 6458548 - DNA, 19 bp, Homo sapiens
tgaggctggcggggtctgc

SEQ ID NO: 6458549 - DNA, 15 bp, Homo sapiens
tgaggctggctgggg

SEQ ID NO: 6458550 - DNA, 18 bp, Homo sapiens
tgaggctggctgggggca

SEQ ID NO: 6458551 - DNA, 16 bp, Homo sapiens
tgaggctgggcagggc

SEQ ID NO: 6458552 - DNA, 17 bp, Homo sapiens
tgaggctgggcagggcc

SEQ ID NO: 6458553 - DNA, 10 bp, Homo sapiens
tgaggctgta

SEQ ID NO: 6458554 - DNA, 13 bp, Homo sapiens
tgaggctgtagga

SEQ ID NO: 6458555 - DNA, 14 bp, Homo sapiens
tgaggctgtcctgt

SEQ ID NO: 6458556 - DNA, 16 bp, Homo sapiens
tgaggcttaacaatgt

SEQ ID NO: 6458557 - DNA, 20 bp, Homo sapiens
tgaggcttaacaatgtcttg

SEQ ID NO: 6458558 - DNA, 13 bp, Homo sapiens
tgaggcttagaga

SEQ ID NO: 6458559 - DNA, 17 bp, Homo sapiens
tgaggcttcataatcat

SEQ ID NO: 6458560 - DNA, 15 bp, Homo sapiens
tgaggcttccaggct

SEQ ID NO: 6458561 - DNA, 18 bp, Homo sapiens
tgaggcttccaggctctt

SEQ ID NO: 6458562 - DNA, 19 bp, Homo sapiens
tgaggcttctccttctcct

SEQ ID NO: 6458563 - DNA, 19 bp, Homo sapiens
tgaggcttgcccaggagca

SEQ ID NO: 6458564 - DNA, 16 bp, Homo sapiens
tgaggcttgggcccag

SEQ ID NO: 6458565 - DNA, 18 bp, Homo sapiens
tgaggctttcaggtttta

SEQ ID NO: 6458566 - DNA, 19 bp, Homo sapiens
tgaggctttccatgggacc

SEQ ID NO: 6458567 - DNA, 17 bp, Homo sapiens
tgaggctttgtgttgta

SEQ ID NO: 6458568 - DNA, 22 bp, Homo sapiens
tgaggcttttcccaccagctcc

SEQ ID NO: 6458569 - DNA, 23 bp, Homo sapiens
tgaggcttttcccaccagctccc

SEQ ID NO: 6458570 - DNA, 18 bp, Homo sapiens
tgagggaaacaaaatatt

SEQ ID NO: 6458571 - DNA, 16 bp, Homo sapiens
tgagggaacagacagg

SEQ ID NO: 6458572 - DNA, 18 bp, Homo sapiens
tgagggaagcccacccgc

SEQ ID NO: 6458573 - DNA, 20 bp, Homo sapiens
tgagggaagcccacccgccc

SEQ ID NO: 6458574 - DNA, 15 bp, Homo sapiens
tgagggaagcgaagg

SEQ ID NO: 6458575 - DNA, 14 bp, Homo sapiens
tgagggaaggagac

SEQ ID NO: 6458576 - DNA, 17 bp, Homo sapiens
tgagggaaggagacagg

SEQ ID NO: 6458577 - DNA, 16 bp, Homo sapiens
tgagggaaggagccca

SEQ ID NO: 6458578 - DNA, 21 bp, Homo sapiens
tgagggacaaatttaaaacaa

SEQ ID NO: 6458579 - DNA, 22 bp, Homo sapiens
tgagggacaaatttaaaacaaa

SEQ ID NO: 6458580 - DNA, 23 bp, Homo sapiens
tgagggacaaatttaaaacaaac

SEQ ID NO: 6458581 - DNA, 15 bp, Homo sapiens
tgagggacagagccc

SEQ ID NO: 6458582 - DNA, 20 bp, Homo sapiens
tgagggacatgctcacctct

SEQ ID NO: 6458583 - DNA, 16 bp, Homo sapiens
tgagggacgaggtcaa

SEQ ID NO: 6458584 - DNA, 22 bp, Homo sapiens
tgagggacgtcagacttggctc

SEQ ID NO: 6458585 - DNA, 18 bp, Homo sapiens
tgagggactggaaccagg

SEQ ID NO: 6458586 - DNA, 14 bp, Homo sapiens
tgagggagacagga

SEQ ID NO: 6458587 - DNA, 14 bp, Homo sapiens
tgagggagatccca

SEQ ID NO: 6458588 - DNA, 16 bp, Homo sapiens
tgagggagatgccatg

SEQ ID NO: 6458589 - DNA, 14 bp, Homo sapiens
tgagggagcctggc

SEQ ID NO: 6458590 - DNA, 23 bp, Homo sapiens
tgagggaggacctggggcacagt

SEQ ID NO: 6458591 - DNA, 12 bp, Homo sapiens
tgagggaggagg

SEQ ID NO: 6458592 - DNA, 14 bp, Homo sapiens
tgagggaggcctga

SEQ ID NO: 6458593 - DNA, 15 bp, Homo sapiens
tgagggagggagcca

SEQ ID NO: 6458594 - DNA, 18 bp, Homo sapiens
tgagggagggagccatgg

SEQ ID NO: 6458595 - DNA, 22 bp, Homo sapiens
tgagggagtgcagaacacctgg

SEQ ID NO: 6458596 - DNA, 14 bp, Homo sapiens
tgagggagtgggga

SEQ ID NO: 6458597 - DNA, 21 bp, Homo sapiens
tgagggagttagggagagaga

SEQ ID NO: 6458598 - DNA, 16 bp, Homo sapiens
tgagggataagcaaaa

SEQ ID NO: 6458599 - DNA, 17 bp, Homo sapiens
tgagggatcacagggcc

SEQ ID NO: 6458600 - DNA, 23 bp, Homo sapiens
tgagggatctatacttgctttgt

SEQ ID NO: 6458601 - DNA, 14 bp, Homo sapiens
tgagggatgctgga

SEQ ID NO: 6458602 - DNA, 21 bp, Homo sapiens
tgagggatggggagcagctgg

SEQ ID NO: 6458603 - DNA, 15 bp, Homo sapiens
tgagggattatcttt

SEQ ID NO: 6458604 - DNA, 13 bp, Homo sapiens
tgagggcaagcca

SEQ ID NO: 6458605 - DNA, 17 bp, Homo sapiens
tgagggcaagccaccaa

SEQ ID NO: 6458606 - DNA, 19 bp, Homo sapiens
tgagggcactctctgccag

SEQ ID NO: 6458607 - DNA, 22 bp, Homo sapiens
tgagggcagaaaccttgtttgt

SEQ ID NO: 6458608 - DNA, 12 bp, Homo sapiens
tgagggcagcag

SEQ ID NO: 6458609 - DNA, 13 bp, Homo sapiens
tgagggcagcagc

SEQ ID NO: 6458610 - DNA, 20 bp, Homo sapiens
tgagggcagcagccagccct

SEQ ID NO: 6458611 - DNA, 21 bp, Homo sapiens
tgagggcagcagccagccctg

SEQ ID NO: 6458612 - DNA, 17 bp, Homo sapiens
tgagggcaggaggctcc

SEQ ID NO: 6458613 - DNA, 16 bp, Homo sapiens
tgagggcagggttcta

SEQ ID NO: 6458614 - DNA, 16 bp, Homo sapiens
tgagggcagtgccctt

SEQ ID NO: 6458615 - DNA, 12 bp, Homo sapiens
tcctgggaggat

SEQ ID NO: 6458616 - DNA, 16 bp, Homo sapiens
tcctgggaggctgcag

SEQ ID NO: 6458617 - DNA, 20 bp, Homo sapiens
tcctgggaggctgcagccag

SEQ ID NO: 6458618 - DNA, 21 bp, Homo sapiens
tcctgggaggctgcagccagg

SEQ ID NO: 6458619 - DNA, 12 bp, Homo sapiens
tcctgggagtga

SEQ ID NO: 6458620 - DNA, 14 bp, Homo sapiens
tcctgggagtgagc

SEQ ID NO: 6458621 - DNA, 18 bp, Homo sapiens
tcctgggagtgagctggt

SEQ ID NO: 6458622 - DNA, 21 bp, Homo sapiens
tcctgggatggcgatggggac

SEQ ID NO: 6458623 - DNA, 22 bp, Homo sapiens
tcctgggatgtttaatcaagag

SEQ ID NO: 6458624 - DNA, 16 bp, Homo sapiens
tcctgggcaaaggtat

SEQ ID NO: 6458625 - DNA, 22 bp, Homo sapiens
tcctgggcaccccaggcagctc

SEQ ID NO: 6458626 - DNA, 17 bp, Homo sapiens
tcctgggcagcccagag

SEQ ID NO: 6458627 - DNA, 19 bp, Homo sapiens
tcctgggcagcccagagag

SEQ ID NO: 6458628 - DNA, 14 bp, Homo sapiens
tcctgggcagcttg

SEQ ID NO: 6458629 - DNA, 20 bp, Homo sapiens
tcctgggcagcttgggctgg

SEQ ID NO: 6458630 - DNA, 21 bp, Homo sapiens
tcctgggcagcttgggctggc

SEQ ID NO: 6458631 - DNA, 12 bp, Homo sapiens
tcctgggcaggt

SEQ ID NO: 6458632 - DNA, 20 bp, Homo sapiens
tcctgggcagttggggcggc

SEQ ID NO: 6458633 - DNA, 23 bp, Homo sapiens
tcctgggcagttggggcggccca

SEQ ID NO: 6458634 - DNA, 15 bp, Homo sapiens
tcctgggcatcccca

SEQ ID NO: 6458635 - DNA, 23 bp, Homo sapiens
tcctgggcatctggccctgctgc

SEQ ID NO: 6458636 - DNA, 18 bp, Homo sapiens
tcctgggcatgggtccag

SEQ ID NO: 6458637 - DNA, 21 bp, Homo sapiens
tcctgggcatgggtccagggc

SEQ ID NO: 6458638 - DNA, 17 bp, Homo sapiens
tcctgggcatgtcccca

SEQ ID NO: 6458639 - DNA, 22 bp, Homo sapiens
tcctgggcatgtttgtctgtgt

SEQ ID NO: 6458640 - DNA, 22 bp, Homo sapiens
tcctgggcattagcaaggcaga

SEQ ID NO: 6458641 - DNA, 16 bp, Homo sapiens
tcctgggccagggtct

SEQ ID NO: 6458642 - DNA, 10 bp, Homo sapiens
tcctgggccc

SEQ ID NO: 6458643 - DNA, 19 bp, Homo sapiens
tcctgggccccagaaagcc

SEQ ID NO: 6458644 - DNA, 14 bp, Homo sapiens
tcctgggcccccag

SEQ ID NO: 6458645 - DNA, 19 bp, Homo sapiens
tcctgggcccccagagacc

SEQ ID NO: 6458646 - DNA, 22 bp, Homo sapiens
tcctgggccccctgggagagtg

SEQ ID NO: 6458647 - DNA, 19 bp, Homo sapiens
tcctgggcccctccctacc

SEQ ID NO: 6458648 - DNA, 21 bp, Homo sapiens
tcctgggcccctccctacctc

SEQ ID NO: 6458649 - DNA, 23 bp, Homo sapiens
tcctgggcccctccctacctcaa

SEQ ID NO: 6458650 - DNA, 19 bp, Homo sapiens
tcctgggcccgctttgcct

SEQ ID NO: 6458651 - DNA, 17 bp, Homo sapiens
tcctgggccctctctgc

SEQ ID NO: 6458652 - DNA, 23 bp, Homo sapiens
tcctgggccctctctgctctgcg

SEQ ID NO: 6458653 - DNA, 12 bp, Homo sapiens
tcctgggccctg

SEQ ID NO: 6458654 - DNA, 14 bp, Homo sapiens
tcctgggccctggg

SEQ ID NO: 6458655 - DNA, 17 bp, Homo sapiens
tcctgggccctgggctg

SEQ ID NO: 6458656 - DNA, 19 bp, Homo sapiens
tcctgggccctgggctggc

SEQ ID NO: 6458657 - DNA, 23 bp, Homo sapiens
tcctgggccgttacatctgtgca

SEQ ID NO: 6458658 - DNA, 12 bp, Homo sapiens
tcctgggcctgc

SEQ ID NO: 6458659 - DNA, 13 bp, Homo sapiens
tcctgggcctgca

SEQ ID NO: 6458660 - DNA, 15 bp, Homo sapiens
tcctgggcctgcccc

SEQ ID NO: 6458661 - DNA, 22 bp, Homo sapiens
tcctgggccttacctcccctgc

SEQ ID NO: 6458662 - DNA, 15 bp, Homo sapiens
tcctgggccttctca

SEQ ID NO: 6458663 - DNA, 18 bp, Homo sapiens
tcctgggccttctcagct

SEQ ID NO: 6458664 - DNA, 22 bp, Homo sapiens
tcctgggccttctcagctctcc

SEQ ID NO: 6458665 - DNA, 15 bp, Homo sapiens
tcctgggcgtgaccc

SEQ ID NO: 6458666 - DNA, 19 bp, Homo sapiens
tcctgggcgtgacccgtcc

SEQ ID NO: 6458667 - DNA, 13 bp, Homo sapiens
tcctgggctcagg

SEQ ID NO: 6458668 - DNA, 19 bp, Homo sapiens
tcctgggctctgaacacac

SEQ ID NO: 6458669 - DNA, 12 bp, Homo sapiens
tcctgggctggt

SEQ ID NO: 6458670 - DNA, 23 bp, Homo sapiens
tcctgggcttttgttttgctttt

SEQ ID NO: 6458671 - DNA, 16 bp, Homo sapiens
tcctggggaccaagat

SEQ ID NO: 6458672 - DNA, 23 bp, Homo sapiens
tcctggggagctcctgggaccct

SEQ ID NO: 6458673 - DNA, 21 bp, Homo sapiens
tcctggggaggctgagactgc

SEQ ID NO: 6458674 - DNA, 17 bp, Homo sapiens
tcctggggatggccagg

SEQ ID NO: 6458675 - DNA, 18 bp, Homo sapiens
tcctggggatggccaggt

SEQ ID NO: 6458676 - DNA, 23 bp, Homo sapiens
tcctggggatggccaggtacaac

SEQ ID NO: 6458677 - DNA, 15 bp, Homo sapiens
tcctggggatgtcat

SEQ ID NO: 6458678 - DNA, 10 bp, Homo sapiens
tcctggggca

SEQ ID NO: 6458679 - DNA, 13 bp, Homo sapiens
tcctggggcagca

SEQ ID NO: 6458680 - DNA, 19 bp, Homo sapiens
tcctggggcatccatgggg

SEQ ID NO: 6458681 - DNA, 11 bp, Homo sapiens
tcctggggccg

SEQ ID NO: 6458682 - DNA, 16 bp, Homo sapiens
tcctggggccgcctgc

SEQ ID NO: 6458683 - DNA, 18 bp, Homo sapiens
tcctggggccgcctgccc

SEQ ID NO: 6458684 - DNA, 20 bp, Homo sapiens
tcctggggccgcctgccctg

SEQ ID NO: 6458685 - DNA, 21 bp, Homo sapiens
tcctggggctgggtgtgtttc

SEQ ID NO: 6458686 - DNA, 21 bp, Homo sapiens
tcctggggctggtcctgggag

SEQ ID NO: 6458687 - DNA, 23 bp, Homo sapiens
tcctgggggaagaggagatgtga

SEQ ID NO: 6458688 - DNA, 14 bp, Homo sapiens
tcctgggggacctt

SEQ ID NO: 6458689 - DNA, 19 bp, Homo sapiens
tcctgggggatgcaaataa

SEQ ID NO: 6458690 - DNA, 11 bp, Homo sapiens
tcctgggggcc

SEQ ID NO: 6458691 - DNA, 14 bp, Homo sapiens
tcctgggggcccat

SEQ ID NO: 6458692 - DNA, 23 bp, Homo sapiens
tcctgggggcccattctgcatgc

SEQ ID NO: 6458693 - DNA, 18 bp, Homo sapiens
tcctgggggcctgacctc

SEQ ID NO: 6458694 - DNA, 17 bp, Homo sapiens
tcctgggggctgctgca

SEQ ID NO: 6458695 - DNA, 14 bp, Homo sapiens
tcctgggggctggc

SEQ ID NO: 6458696 - DNA, 23 bp, Homo sapiens
tcctgggggctggctcccagggt

SEQ ID NO: 6458697 - DNA, 22 bp, Homo sapiens
tcctgggggtaaagccctcaga

SEQ ID NO: 6458698 - DNA, 16 bp, Homo sapiens
tcctgggggtggcagg

SEQ ID NO: 6458699 - DNA, 22 bp, Homo sapiens
tcctgggggttctttcttcctc

SEQ ID NO: 6458700 - DNA, 23 bp, Homo sapiens
tcctgggggttctttcttcctct

SEQ ID NO: 6458701 - DNA, 17 bp, Homo sapiens
tcctggggtgccctcca

SEQ ID NO: 6458702 - DNA, 19 bp, Homo sapiens
tcctggggtgccctccact

SEQ ID NO: 6458703 - DNA, 17 bp, Homo sapiens
tcctggggttggggagg

SEQ ID NO: 6458704 - DNA, 13 bp, Homo sapiens
tcctgggtgctca

SEQ ID NO: 6458705 - DNA, 24 bp, Homo sapiens
tcctgggtggctactctgtgccag

SEQ ID NO: 6458706 - DNA, 16 bp, Homo sapiens
tcctgggtgggtgggg

SEQ ID NO: 6458707 - DNA, 22 bp, Homo sapiens
tcctgggtgggtggggtacagg

SEQ ID NO: 6458708 - DNA, 21 bp, Homo sapiens
tcctgggtgtgtttggcttgg

SEQ ID NO: 6458709 - DNA, 22 bp, Homo sapiens
tcctgggttctggggcatcagc

SEQ ID NO: 6458710 - DNA, 19 bp, Homo sapiens
tcctgggttgtttccagga

SEQ ID NO: 6458711 - DNA, 20 bp, Homo sapiens
tcctgggtttcatgttctgt

SEQ ID NO: 6458712 - DNA, 14 bp, Homo sapiens
tcctgggtttccat

SEQ ID NO: 6458713 - DNA, 16 bp, Homo sapiens
tcctgggtttcctgca

SEQ ID NO: 6458714 - DNA, 17 bp, Homo sapiens
tcctgggtttcctgcag

SEQ ID NO: 6458715 - DNA, 18 bp, Homo sapiens
tcctgggtttcctgcagg

SEQ ID NO: 6458716 - DNA, 17 bp, Homo sapiens
tcctgggttttgtattc

SEQ ID NO: 6458717 - DNA, 16 bp, Homo sapiens
tcctggtaattcctct

SEQ ID NO: 6458718 - DNA, 23 bp, Homo sapiens
tcctggtaattcctctccaggcc

SEQ ID NO: 6458719 - DNA, 15 bp, Homo sapiens
tcctggtacagcagg

SEQ ID NO: 6458720 - DNA, 18 bp, Homo sapiens
tcctggtacagcagggtc

SEQ ID NO: 6458721 - DNA, 23 bp, Homo sapiens
tcctggtacagcagggtcttgct

SEQ ID NO: 6458722 - DNA, 15 bp, Homo sapiens
tcctggtacccagcc

SEQ ID NO: 6458723 - DNA, 19 bp, Homo sapiens
tcctggtagaggggccggc

SEQ ID NO: 6458724 - DNA, 22 bp, Homo sapiens
tcctggtatgggtttctcccag

SEQ ID NO: 6458725 - DNA, 14 bp, Homo sapiens
tcctggtccctctg

SEQ ID NO: 6458726 - DNA, 15 bp, Homo sapiens
tcctggtccctctga

SEQ ID NO: 6458727 - DNA, 17 bp, Homo sapiens
tcctggtccctctgagg

SEQ ID NO: 6458728 - DNA, 20 bp, Homo sapiens
tcctggtccctctgaggcag

SEQ ID NO: 6458729 - DNA, 23 bp, Homo sapiens
tcctggtcctgatgcccgttgtc

SEQ ID NO: 6458730 - DNA, 15 bp, Homo sapiens
tcctggtcctggctg

SEQ ID NO: 6458731 - DNA, 20 bp, Homo sapiens
tcctggtcctggctgcactc

SEQ ID NO: 6458732 - DNA, 13 bp, Homo sapiens
tcctggtctgtga

SEQ ID NO: 6458733 - DNA, 15 bp, Homo sapiens
tcctggtctgtgctg

SEQ ID NO: 6458734 - DNA, 20 bp, Homo sapiens
tcctggtcttgagatgtctt

SEQ ID NO: 6458735 - DNA, 13 bp, Homo sapiens
tcctggtcttttt

SEQ ID NO: 6458736 - DNA, 15 bp, Homo sapiens
tcctggtgactcaaa

SEQ ID NO: 6458737 - DNA, 17 bp, Homo sapiens
tcctggtgagaaaatat

SEQ ID NO: 6458738 - DNA, 23 bp, Homo sapiens
tcctggtgagaaaatatatgcct

SEQ ID NO: 6458739 - DNA, 14 bp, Homo sapiens
tcctggtgaggaca

SEQ ID NO: 6458740 - DNA, 21 bp, Homo sapiens
tcctggtgaggcccagcctgt

SEQ ID NO: 6458741 - DNA, 13 bp, Homo sapiens
tcctggtgccacc

SEQ ID NO: 6458742 - DNA, 17 bp, Homo sapiens
tcctggtgcccctcgcc

SEQ ID NO: 6458743 - DNA, 19 bp, Homo sapiens
tcctggtgcctatctgcct

SEQ ID NO: 6458744 - DNA, 21 bp, Homo sapiens
tcctggtgcctatctgcctgg

SEQ ID NO: 6458745 - DNA, 10 bp, Homo sapiens
tcctggtgct

SEQ ID NO: 6458746 - DNA, 20 bp, Homo sapiens
tcctggtgctctctgccact

SEQ ID NO: 6458747 - DNA, 16 bp, Homo sapiens
tcctggtgctgccgag

SEQ ID NO: 6458748 - DNA, 19 bp, Homo sapiens
tcctggtggccttctgctg

SEQ ID NO: 6458749 - DNA, 17 bp, Homo sapiens
tcctggtggctgggccc

SEQ ID NO: 6458750 - DNA, 22 bp, Homo sapiens
tcctggtggctgggcccagcag

SEQ ID NO: 6458751 - DNA, 21 bp, Homo sapiens
tcctggtggggcagctcctct

SEQ ID NO: 6458752 - DNA, 18 bp, Homo sapiens
tcctggtggggctgagcc

SEQ ID NO: 6458753 - DNA, 20 bp, Homo sapiens
tcctggtgggtcagcccagc

SEQ ID NO: 6458754 - DNA, 19 bp, Homo sapiens
tcctggtggtattttcaat

SEQ ID NO: 6458755 - DNA, 15 bp, Homo sapiens
tcctggtgtcacccc

SEQ ID NO: 6458756 - DNA, 24 bp, Homo sapiens
tcctggtgtcaccccagagccaca

SEQ ID NO: 6458757 - DNA, 14 bp, Homo sapiens
tcctggtgtgaagg

SEQ ID NO: 6458758 - DNA, 23 bp, Homo sapiens
tcctggttcaaacgggtgcctgg

SEQ ID NO: 6458759 - DNA, 15 bp, Homo sapiens
tcctggttcccgttt

SEQ ID NO: 6458760 - DNA, 23 bp, Homo sapiens
tcctggttcccgtttctccacct

SEQ ID NO: 6458761 - DNA, 15 bp, Homo sapiens
tcctggttgtctgaa

SEQ ID NO: 6458762 - DNA, 18 bp, Homo sapiens
tcctggttgttcctgcat

SEQ ID NO: 6458763 - DNA, 21 bp, Homo sapiens
tcctggtttaattcagcagag

SEQ ID NO: 6458764 - DNA, 18 bp, Homo sapiens
tcctggtttcctcagcct

SEQ ID NO: 6458765 - DNA, 15 bp, Homo sapiens
tcctggtttcgtgtg

SEQ ID NO: 6458766 - DNA, 20 bp, Homo sapiens
tcctggtttgaatcctggct

SEQ ID NO: 6458767 - DNA, 14 bp, Homo sapiens
tcctggtttgtaat

SEQ ID NO: 6458768 - DNA, 20 bp, Homo sapiens
tcctggttttgtacactgct

SEQ ID NO: 6458769 - DNA, 22 bp, Homo sapiens
tcctgtaaaaaaaaaaaagtta

SEQ ID NO: 6458770 - DNA, 20 bp, Homo sapiens
tcctgtaaacactcagctgt

SEQ ID NO: 6458771 - DNA, 21 bp, Homo sapiens
tcctgtaaacactcagctgtt

SEQ ID NO: 6458772 - DNA, 21 bp, Homo sapiens
tcctgtaaagaaacatttcct

SEQ ID NO: 6458773 - DNA, 19 bp, Homo sapiens
tcctgtaactacaatgatg

SEQ ID NO: 6458774 - DNA, 20 bp, Homo sapiens
tcctgtaactacaatgatgg

SEQ ID NO: 6458775 - DNA, 19 bp, Homo sapiens
tcctgtaactgttacagta

SEQ ID NO: 6458776 - DNA, 21 bp, Homo sapiens
tcctgtaactgttacagtaat

SEQ ID NO: 6458777 - DNA, 15 bp, Homo sapiens
tcctgtaacttttaa

SEQ ID NO: 6458778 - DNA, 24 bp, Homo sapiens
tcctgtaagaagcggcatagcacc

SEQ ID NO: 6458779 - DNA, 21 bp, Homo sapiens
tcctgtaagagtattaacaaa

SEQ ID NO: 6458780 - DNA, 23 bp, Homo sapiens
tcctgtaagccaaagaaatgaac

SEQ ID NO: 6458781 - DNA, 15 bp, Homo sapiens
tcctgtaataaagct

SEQ ID NO: 6458782 - DNA, 13 bp, Homo sapiens
tcctgtaattcct

SEQ ID NO: 6458783 - DNA, 17 bp, Homo sapiens
tcctgtacactgaatat

SEQ ID NO: 6458784 - DNA, 17 bp, Homo sapiens
tcctgtacctcagtgga

SEQ ID NO: 6458785 - DNA, 20 bp, Homo sapiens
tcctgtacctcttgagcctt

SEQ ID NO: 6458786 - DNA, 14 bp, Homo sapiens
tcctgtacttgtcc

SEQ ID NO: 6458787 - DNA, 19 bp, Homo sapiens
tcctgtacttgtcctcagc

SEQ ID NO: 6458788 - DNA, 21 bp, Homo sapiens
tcctgtacttgtcctcagctt

SEQ ID NO: 6458789 - DNA, 20 bp, Homo sapiens
tcctgtagacctagggagga

SEQ ID NO: 6458790 - DNA, 21 bp, Homo sapiens
tcctgtagaggttttgttgtt

SEQ ID NO: 6458791 - DNA, 21 bp, Homo sapiens
tgagggcagttctgcacccag

SEQ ID NO: 6458792 - DNA, 19 bp, Homo sapiens
tgagggcatttggcttcct

SEQ ID NO: 6458793 - DNA, 22 bp, Homo sapiens
tgagggccaaaatatttggaat

SEQ ID NO: 6458794 - DNA, 18 bp, Homo sapiens
tgagggccaagaaagagt

SEQ ID NO: 6458795 - DNA, 15 bp, Homo sapiens
tgagggccagggacc

SEQ ID NO: 6458796 - DNA, 19 bp, Homo sapiens
tgagggccagggacccagg

SEQ ID NO: 6458797 - DNA, 19 bp, Homo sapiens
tgagggccagtgatgatgt

SEQ ID NO: 6458798 - DNA, 17 bp, Homo sapiens
tgagggcccagagcagg

SEQ ID NO: 6458799 - DNA, 13 bp, Homo sapiens
tgagggcctcaga

SEQ ID NO: 6458800 - DNA, 13 bp, Homo sapiens
tgagggcctgctg

SEQ ID NO: 6458801 - DNA, 21 bp, Homo sapiens
tgagggcctgctggaggcctc

SEQ ID NO: 6458802 - DNA, 12 bp, Homo sapiens
tgagggccttct

SEQ ID NO: 6458803 - DNA, 13 bp, Homo sapiens
tgagggccttctt

SEQ ID NO: 6458804 - DNA, 17 bp, Homo sapiens
tgagggcgaggggaggg

SEQ ID NO: 6458805 - DNA, 17 bp, Homo sapiens
tgagggcggagcgcctc

SEQ ID NO: 6458806 - DNA, 18 bp, Homo sapiens
tgagggcgtgaaacacaa

SEQ ID NO: 6458807 - DNA, 20 bp, Homo sapiens
tgagggctaattctgggaag

SEQ ID NO: 6458808 - DNA, 12 bp, Homo sapiens
tgagggctcctc

SEQ ID NO: 6458809 - DNA, 21 bp, Homo sapiens
tgagggctctgtttgtgggac

SEQ ID NO: 6458810 - DNA, 17 bp, Homo sapiens
tgagggctgagagggct

SEQ ID NO: 6458811 - DNA, 15 bp, Homo sapiens
tgagggctgatcttt

SEQ ID NO: 6458812 - DNA, 18 bp, Homo sapiens
tgagggctgccagcagcc

SEQ ID NO: 6458813 - DNA, 19 bp, Homo sapiens
tgagggctgggtaggcagg

SEQ ID NO: 6458814 - DNA, 18 bp, Homo sapiens
tgaggggaagctagtctt

SEQ ID NO: 6458815 - DNA, 18 bp, Homo sapiens
tgaggggaccaggagtgg

SEQ ID NO: 6458816 - DNA, 13 bp, Homo sapiens
tgaggggacccag

SEQ ID NO: 6458817 - DNA, 18 bp, Homo sapiens
tgaggggacccagcgccg

SEQ ID NO: 6458818 - DNA, 17 bp, Homo sapiens
tgaggggacgggcaagt

SEQ ID NO: 6458819 - DNA, 13 bp, Homo sapiens
tgaggggagagga

SEQ ID NO: 6458820 - DNA, 16 bp, Homo sapiens
tgaggggagaggaaat

SEQ ID NO: 6458821 - DNA, 18 bp, Homo sapiens
tgaggggagaggcgccct

SEQ ID NO: 6458822 - DNA, 16 bp, Homo sapiens
tgaggggagcatgctt

SEQ ID NO: 6458823 - DNA, 21 bp, Homo sapiens
tgaggggaggaaactcacctg

SEQ ID NO: 6458824 - DNA, 22 bp, Homo sapiens
tgaggggaggatcactggagcc

SEQ ID NO: 6458825 - DNA, 20 bp, Homo sapiens
tgaggggaggcacctccagg

SEQ ID NO: 6458826 - DNA, 19 bp, Homo sapiens
tgaggggaggggcctcccc

SEQ ID NO: 6458827 - DNA, 16 bp, Homo sapiens
tgaggggcactctccc

SEQ ID NO: 6458828 - DNA, 12 bp, Homo sapiens
tgaggggcaggg

SEQ ID NO: 6458829 - DNA, 20 bp, Homo sapiens
tgaggggccactgggcccca

SEQ ID NO: 6458830 - DNA, 13 bp, Homo sapiens
tgaggggccaggc

SEQ ID NO: 6458831 - DNA, 20 bp, Homo sapiens
tgaggggccaggggcaggca

SEQ ID NO: 6458832 - DNA, 18 bp, Homo sapiens
tgaggggcccctggccca

SEQ ID NO: 6458833 - DNA, 19 bp, Homo sapiens
tgaggggcccctggcccag

SEQ ID NO: 6458834 - DNA, 22 bp, Homo sapiens
tgaggggcccctggcccaggag

SEQ ID NO: 6458835 - DNA, 19 bp, Homo sapiens
tgaggggctaccaggaaag

SEQ ID NO: 6458836 - DNA, 14 bp, Homo sapiens
tgaggggctcctgg

SEQ ID NO: 6458837 - DNA, 22 bp, Homo sapiens
tgaggggctggccttcctgccc

SEQ ID NO: 6458838 - DNA, 12 bp, Homo sapiens
tgaggggctggg

SEQ ID NO: 6458839 - DNA, 14 bp, Homo sapiens
tgaggggctgggct

SEQ ID NO: 6458840 - DNA, 16 bp, Homo sapiens
tgaggggctggggagg

SEQ ID NO: 6458841 - DNA, 14 bp, Homo sapiens
tgaggggcttccct

SEQ ID NO: 6458842 - DNA, 18 bp, Homo sapiens
tgaggggcttccctctgc

SEQ ID NO: 6458843 - DNA, 13 bp, Homo sapiens
tgaggggctttct

SEQ ID NO: 6458844 - DNA, 14 bp, Homo sapiens
tgaggggctttctc

SEQ ID NO: 6458845 - DNA, 19 bp, Homo sapiens
tgagggggaattcctggaa

SEQ ID NO: 6458846 - DNA, 18 bp, Homo sapiens
tgagggggagctgaaagg

SEQ ID NO: 6458847 - DNA, 14 bp, Homo sapiens
tgaggggggctggc

SEQ ID NO: 6458848 - DNA, 20 bp, Homo sapiens
tgagggggggctccctgggg

SEQ ID NO: 6458849 - DNA, 14 bp, Homo sapiens
tgagggggtaaagc

SEQ ID NO: 6458850 - DNA, 22 bp, Homo sapiens
tgaggggtccctagcagcccac

SEQ ID NO: 6458851 - DNA, 14 bp, Homo sapiens
tgaggggtccctga

SEQ ID NO: 6458852 - DNA, 11 bp, Homo sapiens
tgaggggtctc

SEQ ID NO: 6458853 - DNA, 20 bp, Homo sapiens
tgaggggtctccaggaggag

SEQ ID NO: 6458854 - DNA, 16 bp, Homo sapiens
tgaggggttcctcccc

SEQ ID NO: 6458855 - DNA, 23 bp, Homo sapiens
tgagggtaaccccaaacctccaa

SEQ ID NO: 6458856 - DNA, 13 bp, Homo sapiens
tgagggtcagggc

SEQ ID NO: 6458857 - DNA, 20 bp, Homo sapiens
tgagggtcattctttattct

SEQ ID NO: 6458858 - DNA, 15 bp, Homo sapiens
tgagggtccacctgg

SEQ ID NO: 6458859 - DNA, 18 bp, Homo sapiens
tgagggtccacctggaga

SEQ ID NO: 6458860 - DNA, 15 bp, Homo sapiens
tgagggtccccacct

SEQ ID NO: 6458861 - DNA, 16 bp, Homo sapiens
tgagggtcctgctggt

SEQ ID NO: 6458862 - DNA, 15 bp, Homo sapiens
tgagggtctgggatc

SEQ ID NO: 6458863 - DNA, 19 bp, Homo sapiens
tgagggtcttcttacatgc

SEQ ID NO: 6458864 - DNA, 17 bp, Homo sapiens
tgagggtgacagaggga

SEQ ID NO: 6458865 - DNA, 13 bp, Homo sapiens
tgagggtgactgt

SEQ ID NO: 6458866 - DNA, 22 bp, Homo sapiens
tgagggtgccccgcctgagtca

SEQ ID NO: 6458867 - DNA, 18 bp, Homo sapiens
tgagggtgggccagcata

SEQ ID NO: 6458868 - DNA, 22 bp, Homo sapiens
tgagggtgggcttttccctggg

SEQ ID NO: 6458869 - DNA, 19 bp, Homo sapiens
tgagggtgtttcctctaaa

SEQ ID NO: 6458870 - DNA, 13 bp, Homo sapiens
tgagggtgttttt

SEQ ID NO: 6458871 - DNA, 17 bp, Homo sapiens
tgagggttaatttctag

SEQ ID NO: 6458872 - DNA, 20 bp, Homo sapiens
tgagggttgggctggtgtca

SEQ ID NO: 6458873 - DNA, 18 bp, Homo sapiens
tgagggtttcagagagcc

SEQ ID NO: 6458874 - DNA, 21 bp, Homo sapiens
tgagggtttcattgtgtgtta

SEQ ID NO: 6458875 - DNA, 23 bp, Homo sapiens
tgagggtttccttcggggaccag

SEQ ID NO: 6458876 - DNA, 16 bp, Homo sapiens
tgagggtttgagagag

SEQ ID NO: 6458877 - DNA, 14 bp, Homo sapiens
tgaggtaaagatat

SEQ ID NO: 6458878 - DNA, 22 bp, Homo sapiens
tgaggtaccagttgtatttaat

SEQ ID NO: 6458879 - DNA, 19 bp, Homo sapiens
tgaggtacctttccaccca

SEQ ID NO: 6458880 - DNA, 16 bp, Homo sapiens
tgaggtactggtccct

SEQ ID NO: 6458881 - DNA, 21 bp, Homo sapiens
tgaggtagaaatgcaaggggg

SEQ ID NO: 6458882 - DNA, 22 bp, Homo sapiens
tgaggtagaccaggatttctaa

SEQ ID NO: 6458883 - DNA, 13 bp, Homo sapiens
tgaggtagaggaa

SEQ ID NO: 6458884 - DNA, 24 bp, Homo sapiens
tgaggtatggccatgccctagacc

SEQ ID NO: 6458885 - DNA, 16 bp, Homo sapiens
tgaggtcaagaaatgt

SEQ ID NO: 6458886 - DNA, 20 bp, Homo sapiens
tgaggtcacatgttggtgct

SEQ ID NO: 6458887 - DNA, 22 bp, Homo sapiens
tgaggtcaccaggggaggagcc

SEQ ID NO: 6458888 - DNA, 13 bp, Homo sapiens
tgaggtcactgct

SEQ ID NO: 6458889 - DNA, 14 bp, Homo sapiens
tgaggtcactgcta

SEQ ID NO: 6458890 - DNA, 14 bp, Homo sapiens
tgaggtcagagcct

SEQ ID NO: 6458891 - DNA, 18 bp, Homo sapiens
tgaggtcagagcctgcag

SEQ ID NO: 6458892 - DNA, 22 bp, Homo sapiens
tgaggtcagcacatctcaacag

SEQ ID NO: 6458893 - DNA, 14 bp, Homo sapiens
tgaggtcagtgttt

SEQ ID NO: 6458894 - DNA, 15 bp, Homo sapiens
tgaggtcagtgtttg

SEQ ID NO: 6458895 - DNA, 18 bp, Homo sapiens
tgaggtcatagcagtgct

SEQ ID NO: 6458896 - DNA, 13 bp, Homo sapiens
tgaggtcatcccg

SEQ ID NO: 6458897 - DNA, 15 bp, Homo sapiens
tgaggtcatcccggg

SEQ ID NO: 6458898 - DNA, 23 bp, Homo sapiens
tgaggtcatcccggggccatgga

SEQ ID NO: 6458899 - DNA, 15 bp, Homo sapiens
tgaggtcatctgtaa

SEQ ID NO: 6458900 - DNA, 19 bp, Homo sapiens
tgaggtccaaaaaaggctg

SEQ ID NO: 6458901 - DNA, 12 bp, Homo sapiens
tgaggtccacag

SEQ ID NO: 6458902 - DNA, 21 bp, Homo sapiens
tgaggtccagccctggctgaa

SEQ ID NO: 6458903 - DNA, 23 bp, Homo sapiens
tgaggtccagccctggctgaagg

SEQ ID NO: 6458904 - DNA, 15 bp, Homo sapiens
tgaggtcccaggaag

SEQ ID NO: 6458905 - DNA, 17 bp, Homo sapiens
tgaggtcccaggcagag

SEQ ID NO: 6458906 - DNA, 16 bp, Homo sapiens
tgaggtcccgggctta

SEQ ID NO: 6458907 - DNA, 19 bp, Homo sapiens
tgaggtcccttcaaggcct

SEQ ID NO: 6458908 - DNA, 19 bp, Homo sapiens
tgaggtcctcaggtcagct

SEQ ID NO: 6458909 - DNA, 21 bp, Homo sapiens
tgaggtcctgagcactgccag

SEQ ID NO: 6458910 - DNA, 21 bp, Homo sapiens
tgaggtcctgggggcctgacc

SEQ ID NO: 6458911 - DNA, 16 bp, Homo sapiens
tgaggtctagagagaa

SEQ ID NO: 6458912 - DNA, 14 bp, Homo sapiens
tgaggtctcagccc

SEQ ID NO: 6458913 - DNA, 15 bp, Homo sapiens
tgaggtctcagcccc

SEQ ID NO: 6458914 - DNA, 14 bp, Homo sapiens
tgaggtctcgctga

SEQ ID NO: 6458915 - DNA, 18 bp, Homo sapiens
tgaggtctcgctgatgct

SEQ ID NO: 6458916 - DNA, 22 bp, Homo sapiens
tgaggtctcttttctctactcc

SEQ ID NO: 6458917 - DNA, 13 bp, Homo sapiens
tgaggtctgttcc

SEQ ID NO: 6458918 - DNA, 19 bp, Homo sapiens
tgaggtcttgagtttcatt

SEQ ID NO: 6458919 - DNA, 21 bp, Homo sapiens
tgaggtcttgagtttcatttt

SEQ ID NO: 6458920 - DNA, 16 bp, Homo sapiens
tgaggtctttctcctc

SEQ ID NO: 6458921 - DNA, 20 bp, Homo sapiens
tgaggtcttttgacatgtgg

SEQ ID NO: 6458922 - DNA, 17 bp, Homo sapiens
tgaggtgaaattcagtt

SEQ ID NO: 6458923 - DNA, 16 bp, Homo sapiens
tgaggtgaactccagg

SEQ ID NO: 6458924 - DNA, 17 bp, Homo sapiens
tgaggtgaactccaggc

SEQ ID NO: 6458925 - DNA, 15 bp, Homo sapiens
tgaggtgaatgtctt

SEQ ID NO: 6458926 - DNA, 20 bp, Homo sapiens
tgaggtgacttgcctggggc

SEQ ID NO: 6458927 - DNA, 22 bp, Homo sapiens
tgaggtgatatttttatgtgca

SEQ ID NO: 6458928 - DNA, 15 bp, Homo sapiens
tgaggtgcactggga

SEQ ID NO: 6458929 - DNA, 21 bp, Homo sapiens
tgaggtgcagagtgcccagaa

SEQ ID NO: 6458930 - DNA, 13 bp, Homo sapiens
tgaggtgcccagg

SEQ ID NO: 6458931 - DNA, 14 bp, Homo sapiens
tgaggtgcccagga

SEQ ID NO: 6458932 - DNA, 16 bp, Homo sapiens
tgaggtgcccaggaga

SEQ ID NO: 6458933 - DNA, 20 bp, Homo sapiens
tgaggtgcctgctcaggtgc

SEQ ID NO: 6458934 - DNA, 21 bp, Homo sapiens
tgaggtgcctgctcaggtgct

SEQ ID NO: 6458935 - DNA, 23 bp, Homo sapiens
tgaggtgcgctcacctcagagca

SEQ ID NO: 6458936 - DNA, 13 bp, Homo sapiens
tgaggtgctatga

SEQ ID NO: 6458937 - DNA, 16 bp, Homo sapiens
tgaggtgctatgttct

SEQ ID NO: 6458938 - DNA, 18 bp, Homo sapiens
tgaggtgctgatgagtga

SEQ ID NO: 6458939 - DNA, 17 bp, Homo sapiens
tgaggtgctgggaggga

SEQ ID NO: 6458940 - DNA, 20 bp, Homo sapiens
tgaggtggaagccctccttc

SEQ ID NO: 6458941 - DNA, 19 bp, Homo sapiens
tgaggtggatttactgaga

SEQ ID NO: 6458942 - DNA, 13 bp, Homo sapiens
tgaggtggcccag

SEQ ID NO: 6458943 - DNA, 15 bp, Homo sapiens
tgaggtggcccaggc

SEQ ID NO: 6458944 - DNA, 13 bp, Homo sapiens
tgaggtgggaggt

SEQ ID NO: 6458945 - DNA, 14 bp, Homo sapiens
tgaggtgggcccag

SEQ ID NO: 6458946 - DNA, 20 bp, Homo sapiens
tgaggtgggcccaggaccag

SEQ ID NO: 6458947 - DNA, 23 bp, Homo sapiens
tgaggtgggctggggctgctccc

SEQ ID NO: 6458948 - DNA, 22 bp, Homo sapiens
tgaggtgggggcagcggccccg

SEQ ID NO: 6458949 - DNA, 12 bp, Homo sapiens
tgaggtggtagg

SEQ ID NO: 6458950 - DNA, 13 bp, Homo sapiens
tgaggtggtctga

SEQ ID NO: 6458951 - DNA, 18 bp, Homo sapiens
tgaggtggtctgaatgtt

SEQ ID NO: 6458952 - DNA, 19 bp, Homo sapiens
tgaggtggtctgaatgttc

SEQ ID NO: 6458953 - DNA, 22 bp, Homo sapiens
tgaggtggtctgaatgttctga

SEQ ID NO: 6458954 - DNA, 16 bp, Homo sapiens
tgaggtggtggacatc

SEQ ID NO: 6458955 - DNA, 23 bp, Homo sapiens
tgaggtgtattggtgttgcagcc

SEQ ID NO: 6458956 - DNA, 17 bp, Homo sapiens
tgaggtgtctggcctga

SEQ ID NO: 6458957 - DNA, 20 bp, Homo sapiens
tgaggtgtgcctggcctctg

SEQ ID NO: 6458958 - DNA, 14 bp, Homo sapiens
tgaggtgtgggggc

SEQ ID NO: 6458959 - DNA, 21 bp, Homo sapiens
tgaggtgtgggggctgcagca

SEQ ID NO: 6458960 - DNA, 23 bp, Homo sapiens
tgaggtgtgggggctgcagcatg

SEQ ID NO: 6458961 - DNA, 17 bp, Homo sapiens
tgaggtgttgtgcattt

SEQ ID NO: 6458962 - DNA, 18 bp, Homo sapiens
tgaggtgttgtgcatttg

SEQ ID NO: 6458963 - DNA, 16 bp, Homo sapiens
tgaggttaaaatataa

SEQ ID NO: 6458964 - DNA, 22 bp, Homo sapiens
tgaggttaaaatataaattaag

SEQ ID NO: 6458965 - DNA, 18 bp, Homo sapiens
tgaggttaaggggatcta

SEQ ID NO: 6458966 - DNA, 17 bp, Homo sapiens
tgaggttactggaaatt

SEQ ID NO: 6458967 - DNA, 23 bp, Homo sapiens
tgaggttagagagattggccagc

SEQ ID NO: 6458968 - DNA, 12 bp, Homo sapiens
tgaggttaggag

SEQ ID NO: 6458969 - DNA, 17 bp, Homo sapiens
tcctgtagcatcttctg

SEQ ID NO: 6458970 - DNA, 22 bp, Homo sapiens
tcctgtagcatcttctggagtc

SEQ ID NO: 6458971 - DNA, 18 bp, Homo sapiens
tcctgtagccactggcat

SEQ ID NO: 6458972 - DNA, 22 bp, Homo sapiens
tcctgtagctctcctggggttc

SEQ ID NO: 6458973 - DNA, 20 bp, Homo sapiens
tcctgtaggaaggtactgta

SEQ ID NO: 6458974 - DNA, 21 bp, Homo sapiens
tcctgtaggaaggtactgtat

SEQ ID NO: 6458975 - DNA, 23 bp, Homo sapiens
tcctgtagtggcaaaaaagaaca

SEQ ID NO: 6458976 - DNA, 21 bp, Homo sapiens
tcctgtagttgcgtggactct

SEQ ID NO: 6458977 - DNA, 22 bp, Homo sapiens
tcctgtagttgcgtggactctg

SEQ ID NO: 6458978 - DNA, 22 bp, Homo sapiens
tcctgtataagcactgaaaaac

SEQ ID NO: 6458979 - DNA, 16 bp, Homo sapiens
tcctgtataatttaac

SEQ ID NO: 6458980 - DNA, 20 bp, Homo sapiens
tcctgtatggtggaagctgg

SEQ ID NO: 6458981 - DNA, 23 bp, Homo sapiens
tcctgtatggtggaagctgggtg

SEQ ID NO: 6458982 - DNA, 16 bp, Homo sapiens
tcctgtattcagacag

SEQ ID NO: 6458983 - DNA, 21 bp, Homo sapiens
tcctgtattcagacagatgag

SEQ ID NO: 6458984 - DNA, 18 bp, Homo sapiens
tcctgtattcttgtttga

SEQ ID NO: 6458985 - DNA, 17 bp, Homo sapiens
tcctgtattgctttagt

SEQ ID NO: 6458986 - DNA, 20 bp, Homo sapiens
tcctgtatttgttcccaaga

SEQ ID NO: 6458987 - DNA, 19 bp, Homo sapiens
tcctgtcaagcaatcaaga

SEQ ID NO: 6458988 - DNA, 18 bp, Homo sapiens
tcctgtcaatgtttgctt

SEQ ID NO: 6458989 - DNA, 15 bp, Homo sapiens
tcctgtcaccctggc

SEQ ID NO: 6458990 - DNA, 17 bp, Homo sapiens
tcctgtcaccctggccc

SEQ ID NO: 6458991 - DNA, 14 bp, Homo sapiens
tcctgtcaccggcc

SEQ ID NO: 6458992 - DNA, 18 bp, Homo sapiens
tcctgtcactcactgagg

SEQ ID NO: 6458993 - DNA, 15 bp, Homo sapiens
tcctgtcactgatgg

SEQ ID NO: 6458994 - DNA, 15 bp, Homo sapiens
tcctgtcagctcctt

SEQ ID NO: 6458995 - DNA, 14 bp, Homo sapiens
tcctgtcagtgccg

SEQ ID NO: 6458996 - DNA, 14 bp, Homo sapiens
tcctgtcagtgtca

SEQ ID NO: 6458997 - DNA, 20 bp, Homo sapiens
tcctgtcagtgtcaccttgg

SEQ ID NO: 6458998 - DNA, 16 bp, Homo sapiens
tcctgtcagtgttttt

SEQ ID NO: 6458999 - DNA, 22 bp, Homo sapiens
tcctgtcatcatcatggccagc

SEQ ID NO: 6459000 - DNA, 15 bp, Homo sapiens
tcctgtcatctgaga

SEQ ID NO: 6459001 - DNA, 15 bp, Homo sapiens
tcctgtcattcctct

SEQ ID NO: 6459002 - DNA, 15 bp, Homo sapiens
tcctgtccagcaggt

SEQ ID NO: 6459003 - DNA, 16 bp, Homo sapiens
tcctgtccagctccaa

SEQ ID NO: 6459004 - DNA, 16 bp, Homo sapiens
tcctgtcccatgggct

SEQ ID NO: 6459005 - DNA, 22 bp, Homo sapiens
tcctgtcccatgggctctggcc

SEQ ID NO: 6459006 - DNA, 23 bp, Homo sapiens
tcctgtcccatgggctctggccc

SEQ ID NO: 6459007 - DNA, 14 bp, Homo sapiens
tcctgtccccaggg

SEQ ID NO: 6459008 - DNA, 15 bp, Homo sapiens
tcctgtccccagggg

SEQ ID NO: 6459009 - DNA, 20 bp, Homo sapiens
tcctgtccccatctgtcggc

SEQ ID NO: 6459010 - DNA, 22 bp, Homo sapiens
tcctgtcccctccttccagcct

SEQ ID NO: 6459011 - DNA, 14 bp, Homo sapiens
tcctgtccctaccc

SEQ ID NO: 6459012 - DNA, 17 bp, Homo sapiens
tcctgtccctacccact

SEQ ID NO: 6459013 - DNA, 23 bp, Homo sapiens
tcctgtccctacccactctttgc

SEQ ID NO: 6459014 - DNA, 11 bp, Homo sapiens
tcctgtccctg

SEQ ID NO: 6459015 - DNA, 15 bp, Homo sapiens
tcctgtccctgaggt

SEQ ID NO: 6459016 - DNA, 22 bp, Homo sapiens
tcctgtccctgcgcctttcctt

SEQ ID NO: 6459017 - DNA, 12 bp, Homo sapiens
tcctgtccctgt

SEQ ID NO: 6459018 - DNA, 15 bp, Homo sapiens
tcctgtccctgtagc

SEQ ID NO: 6459019 - DNA, 22 bp, Homo sapiens
tcctgtccctgtagctcagtca

SEQ ID NO: 6459020 - DNA, 14 bp, Homo sapiens
tcctgtccctttgt

SEQ ID NO: 6459021 - DNA, 19 bp, Homo sapiens
tcctgtccggagcgaccct

SEQ ID NO: 6459022 - DNA, 10 bp, Homo sapiens
tcctgtcctc

SEQ ID NO: 6459023 - DNA, 11 bp, Homo sapiens
tcctgtcctcc

SEQ ID NO: 6459024 - DNA, 13 bp, Homo sapiens
tcctgtcctccct

SEQ ID NO: 6459025 - DNA, 20 bp, Homo sapiens
tcctgtcctctttcagctcc

SEQ ID NO: 6459026 - DNA, 14 bp, Homo sapiens
tcctgtcctgcctc

SEQ ID NO: 6459027 - DNA, 14 bp, Homo sapiens
tcctgtcctgctca

SEQ ID NO: 6459028 - DNA, 24 bp, Homo sapiens
tcctgtcctgctcattatgccact

SEQ ID NO: 6459029 - DNA, 16 bp, Homo sapiens
tcctgtcctggctccc

SEQ ID NO: 6459030 - DNA, 12 bp, Homo sapiens
tcctgtccttgt

SEQ ID NO: 6459031 - DNA, 19 bp, Homo sapiens
tcctgtcctttaccaaaga

SEQ ID NO: 6459032 - DNA, 22 bp, Homo sapiens
tcctgtcctttaccaaagatga

SEQ ID NO: 6459033 - DNA, 14 bp, Homo sapiens
tcctgtccttttaa

SEQ ID NO: 6459034 - DNA, 19 bp, Homo sapiens
tcctgtctaacttggggaa

SEQ ID NO: 6459035 - DNA, 22 bp, Homo sapiens
tcctgtctaacttggggaaggg

SEQ ID NO: 6459036 - DNA, 17 bp, Homo sapiens
tcctgtctcaatagctc

SEQ ID NO: 6459037 - DNA, 19 bp, Homo sapiens
tcctgtctcagcctcctga

SEQ ID NO: 6459038 - DNA, 21 bp, Homo sapiens
tcctgtctcagcctcctgagt

SEQ ID NO: 6459039 - DNA, 24 bp, Homo sapiens
tcctgtctccaagaatgttttgct

SEQ ID NO: 6459040 - DNA, 15 bp, Homo sapiens
tcctgtctcccactt

SEQ ID NO: 6459041 - DNA, 13 bp, Homo sapiens
tcctgtctcccct

SEQ ID NO: 6459042 - DNA, 14 bp, Homo sapiens
tcctgtctcccctc

SEQ ID NO: 6459043 - DNA, 11 bp, Homo sapiens
tcctgtctccg

SEQ ID NO: 6459044 - DNA, 18 bp, Homo sapiens
tcctgtctcctctgtcag

SEQ ID NO: 6459045 - DNA, 14 bp, Homo sapiens
tcctgtctcgccag

SEQ ID NO: 6459046 - DNA, 14 bp, Homo sapiens
tcctgtctctgcac

SEQ ID NO: 6459047 - DNA, 22 bp, Homo sapiens
tcctgtctcttgggaagcagtt

SEQ ID NO: 6459048 - DNA, 16 bp, Homo sapiens
tcctgtctgaacaaaa

SEQ ID NO: 6459049 - DNA, 12 bp, Homo sapiens
tcctgtctgagg

SEQ ID NO: 6459050 - DNA, 13 bp, Homo sapiens
tcctgtctgctgg

SEQ ID NO: 6459051 - DNA, 14 bp, Homo sapiens
tcctgtctgctggg

SEQ ID NO: 6459052 - DNA, 12 bp, Homo sapiens
tcctgtctggcc

SEQ ID NO: 6459053 - DNA, 16 bp, Homo sapiens
tcctgtctggctcgga

SEQ ID NO: 6459054 - DNA, 13 bp, Homo sapiens
tcctgtctgtcct

SEQ ID NO: 6459055 - DNA, 13 bp, Homo sapiens
tcctgtctgttca

SEQ ID NO: 6459056 - DNA, 21 bp, Homo sapiens
tcctgtcttatcctccaccgt

SEQ ID NO: 6459057 - DNA, 23 bp, Homo sapiens
tcctgtcttatggtccagaaact

SEQ ID NO: 6459058 - DNA, 14 bp, Homo sapiens
tcctgtcttcccag

SEQ ID NO: 6459059 - DNA, 16 bp, Homo sapiens
tcctgtcttcccaggg

SEQ ID NO: 6459060 - DNA, 15 bp, Homo sapiens
tcctgtcttcctgca

SEQ ID NO: 6459061 - DNA, 12 bp, Homo sapiens
tcctgtcttctg

SEQ ID NO: 6459062 - DNA, 23 bp, Homo sapiens
tcctgtcttctttctccatggag

SEQ ID NO: 6459063 - DNA, 19 bp, Homo sapiens
tcctgtcttctttctcctg

SEQ ID NO: 6459064 - DNA, 19 bp, Homo sapiens
tcctgtcttggcctcccaa

SEQ ID NO: 6459065 - DNA, 18 bp, Homo sapiens
tcctgtctttaaggaaaa

SEQ ID NO: 6459066 - DNA, 16 bp, Homo sapiens
tcctgtctttacaaat

SEQ ID NO: 6459067 - DNA, 22 bp, Homo sapiens
tcctgtgaagtttaattgtctc

SEQ ID NO: 6459068 - DNA, 11 bp, Homo sapiens
tcctgtgaatg

SEQ ID NO: 6459069 - DNA, 20 bp, Homo sapiens
tcctgtgaatgccactgcct

SEQ ID NO: 6459070 - DNA, 22 bp, Homo sapiens
tcctgtgaatgccactgccttc

SEQ ID NO: 6459071 - DNA, 19 bp, Homo sapiens
tcctgtgaatggaggcaga

SEQ ID NO: 6459072 - DNA, 19 bp, Homo sapiens
tcctgtgaccccaccttga

SEQ ID NO: 6459073 - DNA, 23 bp, Homo sapiens
tcctgtgacccgtgaatgtgcct

SEQ ID NO: 6459074 - DNA, 11 bp, Homo sapiens
tcctgtgactg

SEQ ID NO: 6459075 - DNA, 18 bp, Homo sapiens
tcctgtgacttcagctct

SEQ ID NO: 6459076 - DNA, 22 bp, Homo sapiens
tcctgtgagatgtgtatcagtg

SEQ ID NO: 6459077 - DNA, 12 bp, Homo sapiens
tcctgtgagcaa

SEQ ID NO: 6459078 - DNA, 22 bp, Homo sapiens
tcctgtgaggagccccatctgt

SEQ ID NO: 6459079 - DNA, 20 bp, Homo sapiens
tcctgtgaggcttttaattg

SEQ ID NO: 6459080 - DNA, 18 bp, Homo sapiens
tcctgtgatacatttctg

SEQ ID NO: 6459081 - DNA, 19 bp, Homo sapiens
tcctgtgatcctttgatgg

SEQ ID NO: 6459082 - DNA, 19 bp, Homo sapiens
tcctgtgatgtcagcggtg

SEQ ID NO: 6459083 - DNA, 15 bp, Homo sapiens
tcctgtgcagatgct

SEQ ID NO: 6459084 - DNA, 15 bp, Homo sapiens
tcctgtgcatgggtg

SEQ ID NO: 6459085 - DNA, 13 bp, Homo sapiens
tcctgtgccagga

SEQ ID NO: 6459086 - DNA, 13 bp, Homo sapiens
tcctgtgccaggt

SEQ ID NO: 6459087 - DNA, 22 bp, Homo sapiens
tcctgtgcccatcatctctgcc

SEQ ID NO: 6459088 - DNA, 11 bp, Homo sapiens
tcctgtgcccc

SEQ ID NO: 6459089 - DNA, 18 bp, Homo sapiens
tcctgtgccccagctgcc

SEQ ID NO: 6459090 - DNA, 20 bp, Homo sapiens
tcctgtgccccagctgccag

SEQ ID NO: 6459091 - DNA, 21 bp, Homo sapiens
tcctgtgccccagctgccagg

SEQ ID NO: 6459092 - DNA, 22 bp, Homo sapiens
tcctgtgccccagctgccaggc

SEQ ID NO: 6459093 - DNA, 13 bp, Homo sapiens
tcctgtgcccctc

SEQ ID NO: 6459094 - DNA, 16 bp, Homo sapiens
tcctgtgcccctcaga

SEQ ID NO: 6459095 - DNA, 20 bp, Homo sapiens
tcctgtgcccctcagagagg

SEQ ID NO: 6459096 - DNA, 14 bp, Homo sapiens
tcctgtgccctaga

SEQ ID NO: 6459097 - DNA, 16 bp, Homo sapiens
tcctgtgcctggcccc

SEQ ID NO: 6459098 - DNA, 18 bp, Homo sapiens
tcctgtgctactttgcct

SEQ ID NO: 6459099 - DNA, 14 bp, Homo sapiens
tcctgtgctatttg

SEQ ID NO: 6459100 - DNA, 18 bp, Homo sapiens
tcctgtgctcaaaaatga

SEQ ID NO: 6459101 - DNA, 17 bp, Homo sapiens
tcctgtgctcaccctct

SEQ ID NO: 6459102 - DNA, 19 bp, Homo sapiens
tcctgtgctcaccctctct

SEQ ID NO: 6459103 - DNA, 23 bp, Homo sapiens
tcctgtgctcaccctctcttggt

SEQ ID NO: 6459104 - DNA, 16 bp, Homo sapiens
tcctgtgctcagccct

SEQ ID NO: 6459105 - DNA, 18 bp, Homo sapiens
tcctgtgctcagccctga

SEQ ID NO: 6459106 - DNA, 19 bp, Homo sapiens
tcctgtgctctggaggctg

SEQ ID NO: 6459107 - DNA, 14 bp, Homo sapiens
tcctgtgctttctg

SEQ ID NO: 6459108 - DNA, 16 bp, Homo sapiens
tcctgtgctttctgca

SEQ ID NO: 6459109 - DNA, 18 bp, Homo sapiens
tcctgtggaacccagcag

SEQ ID NO: 6459110 - DNA, 11 bp, Homo sapiens
tcctgtggaat

SEQ ID NO: 6459111 - DNA, 21 bp, Homo sapiens
tcctgtggatgggatcctctc

SEQ ID NO: 6459112 - DNA, 15 bp, Homo sapiens
tcctgtggcagctgc

SEQ ID NO: 6459113 - DNA, 17 bp, Homo sapiens
tcctgtggcagctgccc

SEQ ID NO: 6459114 - DNA, 19 bp, Homo sapiens
tcctgtggcagctgcccct

SEQ ID NO: 6459115 - DNA, 16 bp, Homo sapiens
tcctgtggcaggcagc

SEQ ID NO: 6459116 - DNA, 20 bp, Homo sapiens
tcctgtggcataaattgcat

SEQ ID NO: 6459117 - DNA, 18 bp, Homo sapiens
tcctgtggcatgcaaaag

SEQ ID NO: 6459118 - DNA, 21 bp, Homo sapiens
tcctgtggcatgcaaaagaaa

SEQ ID NO: 6459119 - DNA, 22 bp, Homo sapiens
tcctgtggccccaccctgggcc

SEQ ID NO: 6459120 - DNA, 19 bp, Homo sapiens
tcctgtggcctgccagtca

SEQ ID NO: 6459121 - DNA, 18 bp, Homo sapiens
tcctgtggcggtgcagtg

SEQ ID NO: 6459122 - DNA, 21 bp, Homo sapiens
tcctgtggcggtgcagtggca

SEQ ID NO: 6459123 - DNA, 12 bp, Homo sapiens
tcctgtggctcc

SEQ ID NO: 6459124 - DNA, 13 bp, Homo sapiens
tcctgtggctccc

SEQ ID NO: 6459125 - DNA, 17 bp, Homo sapiens
tcctgtgggacctgggc

SEQ ID NO: 6459126 - DNA, 13 bp, Homo sapiens
tcctgtggggaaa

SEQ ID NO: 6459127 - DNA, 15 bp, Homo sapiens
tcctgtggggaaagg

SEQ ID NO: 6459128 - DNA, 23 bp, Homo sapiens
tcctgtgggggaagagcacagcc

SEQ ID NO: 6459129 - DNA, 16 bp, Homo sapiens
tcctgtggtagtcctc

SEQ ID NO: 6459130 - DNA, 14 bp, Homo sapiens
tcctgtgtaacact

SEQ ID NO: 6459131 - DNA, 22 bp, Homo sapiens
tcctgtgtaacacttggctctt

SEQ ID NO: 6459132 - DNA, 19 bp, Homo sapiens
tcctgtgtaacatctgcca

SEQ ID NO: 6459133 - DNA, 18 bp, Homo sapiens
tcctgtgtacctctagaa

SEQ ID NO: 6459134 - DNA, 16 bp, Homo sapiens
tcctgtgtactgtgtc

SEQ ID NO: 6459135 - DNA, 23 bp, Homo sapiens
tcctgtgtcagaaaccctggtct

SEQ ID NO: 6459136 - DNA, 14 bp, Homo sapiens
tcctgtgtcagttt

SEQ ID NO: 6459137 - DNA, 19 bp, Homo sapiens
tcctgtgtcatctgtcagc

SEQ ID NO: 6459138 - DNA, 15 bp, Homo sapiens
tcctgtgtcccctga

SEQ ID NO: 6459139 - DNA, 15 bp, Homo sapiens
tcctgtgtctccaag

SEQ ID NO: 6459140 - DNA, 19 bp, Homo sapiens
tcctgtgtgaccctgggca

SEQ ID NO: 6459141 - DNA, 21 bp, Homo sapiens
tcctgtgtggagagggaatgt

SEQ ID NO: 6459142 - DNA, 22 bp, Homo sapiens
tcctgtgtgtccaaaactgcct

SEQ ID NO: 6459143 - DNA, 18 bp, Homo sapiens
tcctgtgtgttaagctct

SEQ ID NO: 6459144 - DNA, 19 bp, Homo sapiens
tcctgtgtgttaagctctg

SEQ ID NO: 6459145 - DNA, 21 bp, Homo sapiens
tcctgtgtgttaagctctgct

SEQ ID NO: 6459146 - DNA, 22 bp, Homo sapiens
tcctgtgtgttaagctctgcta

SEQ ID NO: 6459147 - DNA, 19 bp, Homo sapiens
tgaggttatgagaaaaaaa

SEQ ID NO: 6459148 - DNA, 21 bp, Homo sapiens
tgaggttatgagaaaaaaaca

SEQ ID NO: 6459149 - DNA, 18 bp, Homo sapiens
tgaggttcccgacaccag

SEQ ID NO: 6459150 - DNA, 21 bp, Homo sapiens
tgaggttcctctgcctgcccc

SEQ ID NO: 6459151 - DNA, 13 bp, Homo sapiens
tgaggttctgaga

SEQ ID NO: 6459152 - DNA, 15 bp, Homo sapiens
tgaggttggatttgc

SEQ ID NO: 6459153 - DNA, 17 bp, Homo sapiens
tgaggttgggaaggcac

SEQ ID NO: 6459154 - DNA, 20 bp, Homo sapiens
tgaggttgggggaaccagca

SEQ ID NO: 6459155 - DNA, 16 bp, Homo sapiens
tgaggttgttcaaagt

SEQ ID NO: 6459156 - DNA, 19 bp, Homo sapiens
tgaggtttcaaacctccct

SEQ ID NO: 6459157 - DNA, 17 bp, Homo sapiens
tgaggtttcacctccgt

SEQ ID NO: 6459158 - DNA, 16 bp, Homo sapiens
tgaggttttgaataaa

SEQ ID NO: 6459159 - DNA, 19 bp, Homo sapiens
tgaggttttgaataaaaag

SEQ ID NO: 6459160 - DNA, 20 bp, Homo sapiens
tgaggttttgtaaaactgtt

SEQ ID NO: 6459161 - DNA, 16 bp, Homo sapiens
tgaggtttttaaatat

SEQ ID NO: 6459162 - DNA, 20 bp, Homo sapiens
tgagtaaaaagtttctaaag

SEQ ID NO: 6459163 - DNA, 15 bp, Homo sapiens
tgagtaaaacacata

SEQ ID NO: 6459164 - DNA, 13 bp, Homo sapiens
tgagtaaacataa

SEQ ID NO: 6459165 - DNA, 18 bp, Homo sapiens
tgagtaaactgtttctca

SEQ ID NO: 6459166 - DNA, 21 bp, Homo sapiens
tgagtaaaggagtaagaacct

SEQ ID NO: 6459167 - DNA, 18 bp, Homo sapiens
tgagtaaataaactcttc

SEQ ID NO: 6459168 - DNA, 16 bp, Homo sapiens
tgagtaaatctaaaga

SEQ ID NO: 6459169 - DNA, 18 bp, Homo sapiens
tgagtaaattggaaacat

SEQ ID NO: 6459170 - DNA, 22 bp, Homo sapiens
tgagtaaattggaaacattttc

SEQ ID NO: 6459171 - DNA, 23 bp, Homo sapiens
tgagtaacagctaatctttaata

SEQ ID NO: 6459172 - DNA, 17 bp, Homo sapiens
tgagtaacatttgctgt

SEQ ID NO: 6459173 - DNA, 19 bp, Homo sapiens
tgagtaagaaatgctgccc

SEQ ID NO: 6459174 - DNA, 17 bp, Homo sapiens
tgagtaagagctggtgt

SEQ ID NO: 6459175 - DNA, 15 bp, Homo sapiens
tgagtaagtgtgttc

SEQ ID NO: 6459176 - DNA, 15 bp, Homo sapiens
tgagtaatagattgt

SEQ ID NO: 6459177 - DNA, 15 bp, Homo sapiens
tgagtaatattacat

SEQ ID NO: 6459178 - DNA, 21 bp, Homo sapiens
tgagtaatattacatttcatt

SEQ ID NO: 6459179 - DNA, 23 bp, Homo sapiens
tgagtaatattacatttcattta

SEQ ID NO: 6459180 - DNA, 21 bp, Homo sapiens
tgagtaatcaatacagacaag

SEQ ID NO: 6459181 - DNA, 21 bp, Homo sapiens
tgagtaatgggatttgaatca

SEQ ID NO: 6459182 - DNA, 15 bp, Homo sapiens
tgagtaatggtgtag

SEQ ID NO: 6459183 - DNA, 15 bp, Homo sapiens
tgagtaattctttga

SEQ ID NO: 6459184 - DNA, 17 bp, Homo sapiens
tgagtaattttggattt

SEQ ID NO: 6459185 - DNA, 17 bp, Homo sapiens
tgagtacaaatgcctta

SEQ ID NO: 6459186 - DNA, 16 bp, Homo sapiens
tgagtacaaatgtgtg

SEQ ID NO: 6459187 - DNA, 17 bp, Homo sapiens
tgagtacaaatgtgtga

SEQ ID NO: 6459188 - DNA, 13 bp, Homo sapiens
tgagtacagatac

SEQ ID NO: 6459189 - DNA, 14 bp, Homo sapiens
tgagtacagatact

SEQ ID NO: 6459190 - DNA, 18 bp, Homo sapiens
tgagtacagatactgtga

SEQ ID NO: 6459191 - DNA, 18 bp, Homo sapiens
tgagtacagtgaggaggg

SEQ ID NO: 6459192 - DNA, 21 bp, Homo sapiens
tgagtacagtgaggagggtgg

SEQ ID NO: 6459193 - DNA, 14 bp, Homo sapiens
tgagtacattgaag

SEQ ID NO: 6459194 - DNA, 19 bp, Homo sapiens
tgagtacccctgctttggg

SEQ ID NO: 6459195 - DNA, 15 bp, Homo sapiens
tgagtacctgcaaaa

SEQ ID NO: 6459196 - DNA, 20 bp, Homo sapiens
tgagtacctgcaaaaatgag

SEQ ID NO: 6459197 - DNA, 21 bp, Homo sapiens
tgagtacctgcaaaaatgagt

SEQ ID NO: 6459198 - DNA, 21 bp, Homo sapiens
tgagtacgtgctttgagaaaa

SEQ ID NO: 6459199 - DNA, 17 bp, Homo sapiens
tgagtacgttgtgcatt

SEQ ID NO: 6459200 - DNA, 23 bp, Homo sapiens
tgagtactacagtcctcccatct

SEQ ID NO: 6459201 - DNA, 18 bp, Homo sapiens
tgagtactctttctctcc

SEQ ID NO: 6459202 - DNA, 20 bp, Homo sapiens
tgagtagaaaagtcggggat

SEQ ID NO: 6459203 - DNA, 18 bp, Homo sapiens
tgagtagaaaggccttta

SEQ ID NO: 6459204 - DNA, 19 bp, Homo sapiens
tgagtagatattactttat

SEQ ID NO: 6459205 - DNA, 20 bp, Homo sapiens
tgagtagatattactttatc

SEQ ID NO: 6459206 - DNA, 21 bp, Homo sapiens
tgagtagatgcgcagccccat

SEQ ID NO: 6459207 - DNA, 15 bp, Homo sapiens
tgagtagcagaaaac

SEQ ID NO: 6459208 - DNA, 20 bp, Homo sapiens
tgagtagcctatgaatgaaa

SEQ ID NO: 6459209 - DNA, 22 bp, Homo sapiens
tgagtagcctatgaatgaaatt

SEQ ID NO: 6459210 - DNA, 13 bp, Homo sapiens
tgagtagctggat

SEQ ID NO: 6459211 - DNA, 22 bp, Homo sapiens
tgagtagctgggactagaggca

SEQ ID NO: 6459212 - DNA, 16 bp, Homo sapiens
tgagtagctgggatta

SEQ ID NO: 6459213 - DNA, 16 bp, Homo sapiens
tgagtagctgggcctg

SEQ ID NO: 6459214 - DNA, 16 bp, Homo sapiens
tgagtaggatgtctct

SEQ ID NO: 6459215 - DNA, 21 bp, Homo sapiens
tgagtaggatgtctcttggaa

SEQ ID NO: 6459216 - DNA, 17 bp, Homo sapiens
tgagtagtcttatgtaa

SEQ ID NO: 6459217 - DNA, 13 bp, Homo sapiens
tgagtagtggcca

SEQ ID NO: 6459218 - DNA, 16 bp, Homo sapiens
tgagtagtggccactg

SEQ ID NO: 6459219 - DNA, 19 bp, Homo sapiens
tgagtagtggccactgggg

SEQ ID NO: 6459220 - DNA, 15 bp, Homo sapiens
tgagtagttactaaa

SEQ ID NO: 6459221 - DNA, 14 bp, Homo sapiens
tgagtagttatgaa

SEQ ID NO: 6459222 - DNA, 22 bp, Homo sapiens
tgagtagttgttggtctgtagc

SEQ ID NO: 6459223 - DNA, 19 bp, Homo sapiens
tgagtataaaaacttgaaa

SEQ ID NO: 6459224 - DNA, 14 bp, Homo sapiens
tgagtataatcaat

SEQ ID NO: 6459225 - DNA, 15 bp, Homo sapiens
tgagtatacaatata

SEQ ID NO: 6459226 - DNA, 13 bp, Homo sapiens
tgagtatatgtaa

SEQ ID NO: 6459227 - DNA, 22 bp, Homo sapiens
tgagtatatgtaacagtttaaa

SEQ ID NO: 6459228 - DNA, 14 bp, Homo sapiens
tgagtatattataa

SEQ ID NO: 6459229 - DNA, 13 bp, Homo sapiens
tgagtatcagaat

SEQ ID NO: 6459230 - DNA, 14 bp, Homo sapiens
tgagtatcagaatt

SEQ ID NO: 6459231 - DNA, 15 bp, Homo sapiens
tgagtatcagaattg

SEQ ID NO: 6459232 - DNA, 22 bp, Homo sapiens
tgagtatcagaattgaaacact

SEQ ID NO: 6459233 - DNA, 15 bp, Homo sapiens
tgagtatcataatat

SEQ ID NO: 6459234 - DNA, 17 bp, Homo sapiens
tgagtatcataatatat

SEQ ID NO: 6459235 - DNA, 14 bp, Homo sapiens
tgagtatctgtggg

SEQ ID NO: 6459236 - DNA, 22 bp, Homo sapiens
tgagtatgcttgggccctgcat

SEQ ID NO: 6459237 - DNA, 20 bp, Homo sapiens
tgagtatggagcagcctgga

SEQ ID NO: 6459238 - DNA, 13 bp, Homo sapiens
tgagtatgggaca

SEQ ID NO: 6459239 - DNA, 19 bp, Homo sapiens
tgagtatgtgaagatataa

SEQ ID NO: 6459240 - DNA, 11 bp, Homo sapiens
tgagtatgtgt

SEQ ID NO: 6459241 - DNA, 20 bp, Homo sapiens
tgagtattacacattaaagt

SEQ ID NO: 6459242 - DNA, 15 bp, Homo sapiens
tgagtattctatgta

SEQ ID NO: 6459243 - DNA, 22 bp, Homo sapiens
tgagtattctcataggagactg

SEQ ID NO: 6459244 - DNA, 22 bp, Homo sapiens
tgagtattggaagacttgggtt

SEQ ID NO: 6459245 - DNA, 15 bp, Homo sapiens
tgagtattgtttaaa

SEQ ID NO: 6459246 - DNA, 19 bp, Homo sapiens
tgagtattgtttaaaatgt

SEQ ID NO: 6459247 - DNA, 23 bp, Homo sapiens
tgagtattgtttaaaatgtaatt

SEQ ID NO: 6459248 - DNA, 20 bp, Homo sapiens
tgagtatttctgttcctttt

SEQ ID NO: 6459249 - DNA, 15 bp, Homo sapiens
tgagtatttggtcca

SEQ ID NO: 6459250 - DNA, 16 bp, Homo sapiens
tgagtattttttataa

SEQ ID NO: 6459251 - DNA, 17 bp, Homo sapiens
tgagtcaaaaaacatga

SEQ ID NO: 6459252 - DNA, 13 bp, Homo sapiens
tgagtcaaaacaa

SEQ ID NO: 6459253 - DNA, 14 bp, Homo sapiens
tgagtcaaaacaaa

SEQ ID NO: 6459254 - DNA, 18 bp, Homo sapiens
tgagtcaaaagcctgggt

SEQ ID NO: 6459255 - DNA, 15 bp, Homo sapiens
tgagtcaaatccagt

SEQ ID NO: 6459256 - DNA, 16 bp, Homo sapiens
tgagtcaaatccagtg

SEQ ID NO: 6459257 - DNA, 14 bp, Homo sapiens
tgagtcaattggaa

SEQ ID NO: 6459258 - DNA, 16 bp, Homo sapiens
tgagtcaccaagccca

SEQ ID NO: 6459259 - DNA, 15 bp, Homo sapiens
tgagtcacctcctcc

SEQ ID NO: 6459260 - DNA, 23 bp, Homo sapiens
tgagtcacctcctccactcactc

SEQ ID NO: 6459261 - DNA, 13 bp, Homo sapiens
tgagtcacctgct

SEQ ID NO: 6459262 - DNA, 18 bp, Homo sapiens
tgagtcacctgctccaga

SEQ ID NO: 6459263 - DNA, 19 bp, Homo sapiens
tgagtcacctgctccagaa

SEQ ID NO: 6459264 - DNA, 17 bp, Homo sapiens
tgagtcacgctggggct

SEQ ID NO: 6459265 - DNA, 23 bp, Homo sapiens
tgagtcactatgggatgagaaaa

SEQ ID NO: 6459266 - DNA, 15 bp, Homo sapiens
tgagtcactcacatt

SEQ ID NO: 6459267 - DNA, 14 bp, Homo sapiens
tgagtcacttgtgt

SEQ ID NO: 6459268 - DNA, 13 bp, Homo sapiens
tgagtcagaatgt

SEQ ID NO: 6459269 - DNA, 22 bp, Homo sapiens
tgagtcagaatgtgaaaaagga

SEQ ID NO: 6459270 - DNA, 21 bp, Homo sapiens
tgagtcagagccatgtcttct

SEQ ID NO: 6459271 - DNA, 14 bp, Homo sapiens
tgagtcagaggaca

SEQ ID NO: 6459272 - DNA, 22 bp, Homo sapiens
tgagtcagaggacaccatccaa

SEQ ID NO: 6459273 - DNA, 22 bp, Homo sapiens
tgagtcagcaccttggcccagg

SEQ ID NO: 6459274 - DNA, 23 bp, Homo sapiens
tgagtcagctgaccccctccccc

SEQ ID NO: 6459275 - DNA, 15 bp, Homo sapiens
tgagtcagggcccag

SEQ ID NO: 6459276 - DNA, 20 bp, Homo sapiens
tgagtcagtcagcgagtgct

SEQ ID NO: 6459277 - DNA, 17 bp, Homo sapiens
tgagtcagtgcatttca

SEQ ID NO: 6459278 - DNA, 18 bp, Homo sapiens
tgagtcatatcttaatat

SEQ ID NO: 6459279 - DNA, 21 bp, Homo sapiens
tgagtcatctgttagggcctt

SEQ ID NO: 6459280 - DNA, 22 bp, Homo sapiens
tgagtcatgatctccctgccgc

SEQ ID NO: 6459281 - DNA, 23 bp, Homo sapiens
tgagtcattgacttcattttata

SEQ ID NO: 6459282 - DNA, 23 bp, Homo sapiens
tgagtcatttgtttaaacaatct

SEQ ID NO: 6459283 - DNA, 20 bp, Homo sapiens
tgagtccaaactggaatgag

SEQ ID NO: 6459284 - DNA, 14 bp, Homo sapiens
tgagtccacgccca

SEQ ID NO: 6459285 - DNA, 20 bp, Homo sapiens
tgagtccacgcccaccagcc

SEQ ID NO: 6459286 - DNA, 23 bp, Homo sapiens
tgagtccagctttccttctgccc

SEQ ID NO: 6459287 - DNA, 12 bp, Homo sapiens
tgagtccagtgt

SEQ ID NO: 6459288 - DNA, 15 bp, Homo sapiens
tgagtccatgaaaat

SEQ ID NO: 6459289 - DNA, 15 bp, Homo sapiens
tgagtcccaggctga

SEQ ID NO: 6459290 - DNA, 19 bp, Homo sapiens
tgagtcccaggctgagcct

SEQ ID NO: 6459291 - DNA, 16 bp, Homo sapiens
tgagtccccacctgcg

SEQ ID NO: 6459292 - DNA, 20 bp, Homo sapiens
tgagtccccattgaggcttg

SEQ ID NO: 6459293 - DNA, 20 bp, Homo sapiens
tgagtcccccagagatgtca

SEQ ID NO: 6459294 - DNA, 15 bp, Homo sapiens
tgagtcccctactcc

SEQ ID NO: 6459295 - DNA, 19 bp, Homo sapiens
tgagtcccctactccctct

SEQ ID NO: 6459296 - DNA, 23 bp, Homo sapiens
tgagtccctcacgtttcttcccc

SEQ ID NO: 6459297 - DNA, 22 bp, Homo sapiens
tgagtccctgtgatggccaggc

SEQ ID NO: 6459298 - DNA, 12 bp, Homo sapiens
tgagtcctccag

SEQ ID NO: 6459299 - DNA, 14 bp, Homo sapiens
tgagtcctccagaa

SEQ ID NO: 6459300 - DNA, 15 bp, Homo sapiens
tgagtcctccagaac

SEQ ID NO: 6459301 - DNA, 16 bp, Homo sapiens
tgagtcctccagaact

SEQ ID NO: 6459302 - DNA, 17 bp, Homo sapiens
tgagtcctccagaactc

SEQ ID NO: 6459303 - DNA, 23 bp, Homo sapiens
tgagtcctgagcgaaaacaggag

SEQ ID NO: 6459304 - DNA, 14 bp, Homo sapiens
tgagtcctgatcct

SEQ ID NO: 6459305 - DNA, 19 bp, Homo sapiens
tgagtcctggatgatacta

SEQ ID NO: 6459306 - DNA, 19 bp, Homo sapiens
tgagtcctggcatgggaat

SEQ ID NO: 6459307 - DNA, 13 bp, Homo sapiens
tgagtcctggccc

SEQ ID NO: 6459308 - DNA, 14 bp, Homo sapiens
tgagtcctggccca

SEQ ID NO: 6459309 - DNA, 12 bp, Homo sapiens
tgagtcctgggg

SEQ ID NO: 6459310 - DNA, 15 bp, Homo sapiens
tgagtcctggtccct

SEQ ID NO: 6459311 - DNA, 17 bp, Homo sapiens
tgagtcctggtttcctg

SEQ ID NO: 6459312 - DNA, 21 bp, Homo sapiens
tgagtcctggtttcctggcag

SEQ ID NO: 6459313 - DNA, 18 bp, Homo sapiens
tgagtcctgtctctgcct

SEQ ID NO: 6459314 - DNA, 12 bp, Homo sapiens
tgagtcctgttc

SEQ ID NO: 6459315 - DNA, 15 bp, Homo sapiens
tgagtcctgttgaag

SEQ ID NO: 6459316 - DNA, 17 bp, Homo sapiens
tgagtcctgttgaagac

SEQ ID NO: 6459317 - DNA, 14 bp, Homo sapiens
tgagtccttaaaca

SEQ ID NO: 6459318 - DNA, 18 bp, Homo sapiens
tgagtccttgaaaatatt

SEQ ID NO: 6459319 - DNA, 14 bp, Homo sapiens
tgagtcctttgcta

SEQ ID NO: 6459320 - DNA, 18 bp, Homo sapiens
tgagtcgaggacagggag

SEQ ID NO: 6459321 - DNA, 19 bp, Homo sapiens
tgagtcggccccacatggg

SEQ ID NO: 6459322 - DNA, 15 bp, Homo sapiens
tgagtcggctgggca

SEQ ID NO: 6459323 - DNA, 17 bp, Homo sapiens
tgagtctatttttaatg

SEQ ID NO: 6459324 - DNA, 18 bp, Homo sapiens
tgagtctcaataaactga

SEQ ID NO: 6459325 - DNA, 15 bp, Homo sapiens
tgagtctccagggcc

SEQ ID NO: 6459326 - DNA, 15 bp, Homo sapiens
tgagtctcccaaggc

SEQ ID NO: 6459327 - DNA, 19 bp, Homo sapiens
tgagtctcctctctgagac

SEQ ID NO: 6459328 - DNA, 13 bp, Homo sapiens
tgagtctcgaggg

SEQ ID NO: 6459329 - DNA, 11 bp, Homo sapiens
tgagtctctga

SEQ ID NO: 6459330 - DNA, 15 bp, Homo sapiens
tgagtctcttcagaa

SEQ ID NO: 6459331 - DNA, 22 bp, Homo sapiens
tgagtctgaaccaatagaaagc

SEQ ID NO: 6459332 - DNA, 13 bp, Homo sapiens
tgagtctgaaggc

SEQ ID NO: 6459333 - DNA, 15 bp, Homo sapiens
tgagtctgagtcctg

SEQ ID NO: 6459334 - DNA, 13 bp, Homo sapiens
tgagtctggacct

SEQ ID NO: 6459335 - DNA, 14 bp, Homo sapiens
tgagtctggctagg

SEQ ID NO: 6459336 - DNA, 15 bp, Homo sapiens
tgagtctggctaggg

SEQ ID NO: 6459337 - DNA, 14 bp, Homo sapiens
tgagtctgggcagc

SEQ ID NO: 6459338 - DNA, 18 bp, Homo sapiens
tgagtctgtaggagcaag

SEQ ID NO: 6459339 - DNA, 18 bp, Homo sapiens
tgagtctgtcctttccca

SEQ ID NO: 6459340 - DNA, 22 bp, Homo sapiens
tgagtctgtgaataaagccaca

SEQ ID NO: 6459341 - DNA, 18 bp, Homo sapiens
tgagtctgtgtggccagc

SEQ ID NO: 6459342 - DNA, 14 bp, Homo sapiens
tgagtctgttctgg

SEQ ID NO: 6459343 - DNA, 16 bp, Homo sapiens
tgagtctgttctggta

SEQ ID NO: 6459344 - DNA, 15 bp, Homo sapiens
tgagtctgttgtgtg

SEQ ID NO: 6459345 - DNA, 15 bp, Homo sapiens
tgagtctgtttccca

SEQ ID NO: 6459346 - DNA, 23 bp, Homo sapiens
tgagtctgttttcccaacctcct

SEQ ID NO: 6459347 - DNA, 17 bp, Homo sapiens
tgagtctgttttgtaaa

SEQ ID NO: 6459348 - DNA, 19 bp, Homo sapiens
tgagtcttcacatttagaa

SEQ ID NO: 6459349 - DNA, 19 bp, Homo sapiens
tgagtcttcatgttcccac

SEQ ID NO: 6459350 - DNA, 15 bp, Homo sapiens
tgagtcttggcggca

SEQ ID NO: 6459351 - DNA, 18 bp, Homo sapiens
tgagtcttggcggcagca

SEQ ID NO: 6459352 - DNA, 21 bp, Homo sapiens
tgagtcttggcggcagcagcc

SEQ ID NO: 6459353 - DNA, 17 bp, Homo sapiens
tgagtcttggttctaaa

SEQ ID NO: 6459354 - DNA, 18 bp, Homo sapiens
tgagtctttaatcccagt

SEQ ID NO: 6459355 - DNA, 15 bp, Homo sapiens
tgagtctttgaagat

SEQ ID NO: 6459356 - DNA, 22 bp, Homo sapiens
tgagtcttttttttttaagtga

SEQ ID NO: 6459357 - DNA, 20 bp, Homo sapiens
tgagtgaaaatttttacatt

SEQ ID NO: 6459358 - DNA, 15 bp, Homo sapiens
tgagtgaaagttgcc

SEQ ID NO: 6459359 - DNA, 17 bp, Homo sapiens
tgagtgaacctgtataa

SEQ ID NO: 6459360 - DNA, 14 bp, Homo sapiens
tgagtgaagcaaaa

SEQ ID NO: 6459361 - DNA, 17 bp, Homo sapiens
tgagtgaagtccagtga

SEQ ID NO: 6459362 - DNA, 17 bp, Homo sapiens
tgagtgaatggcaaagc

SEQ ID NO: 6459363 - DNA, 20 bp, Homo sapiens
tgagtgaatgttaacatgcg

SEQ ID NO: 6459364 - DNA, 23 bp, Homo sapiens
tgagtgacacaagcactttaatg

SEQ ID NO: 6459365 - DNA, 21 bp, Homo sapiens
tgagtgacatagcctcatgtt

SEQ ID NO: 6459366 - DNA, 22 bp, Homo sapiens
tgagtgactttaggatgagcaa

SEQ ID NO: 6459367 - DNA, 23 bp, Homo sapiens
tgagtgactttaggatgagcaaa

SEQ ID NO: 6459368 - DNA, 15 bp, Homo sapiens
tgagtgagaggggag

SEQ ID NO: 6459369 - DNA, 15 bp, Homo sapiens
tgagtgagttttact

SEQ ID NO: 6459370 - DNA, 17 bp, Homo sapiens
tgagtgatcccatttct

SEQ ID NO: 6459371 - DNA, 22 bp, Homo sapiens
tgagtgatctcaaatccactga

SEQ ID NO: 6459372 - DNA, 20 bp, Homo sapiens
tgagtgatgcggcagattga

SEQ ID NO: 6459373 - DNA, 20 bp, Homo sapiens
tgagtgattatttgttattt

SEQ ID NO: 6459374 - DNA, 21 bp, Homo sapiens
tgagtgattgacacacagcac

SEQ ID NO: 6459375 - DNA, 23 bp, Homo sapiens
tgagtgattgacacacagcactc

SEQ ID NO: 6459376 - DNA, 18 bp, Homo sapiens
tgagtgcaaacttcagag

SEQ ID NO: 6459377 - DNA, 20 bp, Homo sapiens
tgagtgcaaacttcagagtt

SEQ ID NO: 6459378 - DNA, 13 bp, Homo sapiens
tgagtgcaacaag

SEQ ID NO: 6459379 - DNA, 14 bp, Homo sapiens
tgagtgcacctgcc

SEQ ID NO: 6459380 - DNA, 18 bp, Homo sapiens
tgagtgcacctgcctcca

SEQ ID NO: 6459381 - DNA, 16 bp, Homo sapiens
tgagtgcactgactgt

SEQ ID NO: 6459382 - DNA, 21 bp, Homo sapiens
tgagtgcagaccccttggcca

SEQ ID NO: 6459383 - DNA, 19 bp, Homo sapiens
tgagtgcagccgtttgaga

SEQ ID NO: 6459384 - DNA, 15 bp, Homo sapiens
tgagtgcaggcccac

SEQ ID NO: 6459385 - DNA, 15 bp, Homo sapiens
tgagtgcatcccagc

SEQ ID NO: 6459386 - DNA, 14 bp, Homo sapiens
tgagtgcatgtact

SEQ ID NO: 6459387 - DNA, 16 bp, Homo sapiens
tgagtgccaatttctt

SEQ ID NO: 6459388 - DNA, 14 bp, Homo sapiens
tgagtgccacaaaa

SEQ ID NO: 6459389 - DNA, 12 bp, Homo sapiens
tgagtgccatgc

SEQ ID NO: 6459390 - DNA, 15 bp, Homo sapiens
tgagtgccatgcttt

SEQ ID NO: 6459391 - DNA, 22 bp, Homo sapiens
tgagtgccccacttctggccac

SEQ ID NO: 6459392 - DNA, 23 bp, Homo sapiens
tgagtgccccacttctggccaca

SEQ ID NO: 6459393 - DNA, 12 bp, Homo sapiens
tgagtgcctgca

SEQ ID NO: 6459394 - DNA, 14 bp, Homo sapiens
tgagtgccttacac

SEQ ID NO: 6459395 - DNA, 13 bp, Homo sapiens
tgagtgccttctg

SEQ ID NO: 6459396 - DNA, 22 bp, Homo sapiens
tgagtgccttttgcagaagagg

SEQ ID NO: 6459397 - DNA, 20 bp, Homo sapiens
tgagtgcgaccaccacttga

SEQ ID NO: 6459398 - DNA, 23 bp, Homo sapiens
tgagtgcgcagatctgtgcctgg

SEQ ID NO: 6459399 - DNA, 22 bp, Homo sapiens
tgagtgcgggctgaggccagag

SEQ ID NO: 6459400 - DNA, 14 bp, Homo sapiens
tgagtgcgtctgag

SEQ ID NO: 6459401 - DNA, 15 bp, Homo sapiens
tgagtgctatgtgtg

SEQ ID NO: 6459402 - DNA, 14 bp, Homo sapiens
tgagtgctgggcac

SEQ ID NO: 6459403 - DNA, 15 bp, Homo sapiens
tgagtgctgggcact

SEQ ID NO: 6459404 - DNA, 17 bp, Homo sapiens
tgagtgctgggggaggc

SEQ ID NO: 6459405 - DNA, 19 bp, Homo sapiens
tgagtgcttgcttttcatg

SEQ ID NO: 6459406 - DNA, 23 bp, Homo sapiens
tgagtggaaagtcacctacagga

SEQ ID NO: 6459407 - DNA, 20 bp, Homo sapiens
tgagtggaagggaggagcag

SEQ ID NO: 6459408 - DNA, 17 bp, Homo sapiens
tgagtggaatgcaggga

SEQ ID NO: 6459409 - DNA, 18 bp, Homo sapiens
tgagtggaatgcagggaa

SEQ ID NO: 6459410 - DNA, 13 bp, Homo sapiens
tgagtggacagca

SEQ ID NO: 6459411 - DNA, 12 bp, Homo sapiens
tgagtggatgga

SEQ ID NO: 6459412 - DNA, 21 bp, Homo sapiens
tgagtggatggaggagaaata

SEQ ID NO: 6459413 - DNA, 17 bp, Homo sapiens
tgagtggcagcagcccc

SEQ ID NO: 6459414 - DNA, 13 bp, Homo sapiens
tgagtggcagggg

SEQ ID NO: 6459415 - DNA, 12 bp, Homo sapiens
tgagtggccagc

SEQ ID NO: 6459416 - DNA, 15 bp, Homo sapiens
tgagtggccagcgcc

SEQ ID NO: 6459417 - DNA, 20 bp, Homo sapiens
tgagtggccagcgccagggc

SEQ ID NO: 6459418 - DNA, 17 bp, Homo sapiens
tgagtggccagggaatc

SEQ ID NO: 6459419 - DNA, 23 bp, Homo sapiens
tgagtggccccacctgtgtcccc

SEQ ID NO: 6459420 - DNA, 12 bp, Homo sapiens
tgagtggccctt

SEQ ID NO: 6459421 - DNA, 12 bp, Homo sapiens
tgagtggcctgc

SEQ ID NO: 6459422 - DNA, 23 bp, Homo sapiens
tgagtggcctgtagtccatctcc

SEQ ID NO: 6459423 - DNA, 17 bp, Homo sapiens
tgagtgggagaaggcag

SEQ ID NO: 6459424 - DNA, 20 bp, Homo sapiens
tgagtgggaggagagggcag

SEQ ID NO: 6459425 - DNA, 16 bp, Homo sapiens
tgagtgggctgtagtt

SEQ ID NO: 6459426 - DNA, 22 bp, Homo sapiens
tgagtggggagacacctcagag

SEQ ID NO: 6459427 - DNA, 15 bp, Homo sapiens
tgagtggggagcagt

SEQ ID NO: 6459428 - DNA, 23 bp, Homo sapiens
tgagtgggggatcacagcctctg

SEQ ID NO: 6459429 - DNA, 21 bp, Homo sapiens
tgagtggggggaacgcccact

SEQ ID NO: 6459430 - DNA, 22 bp, Homo sapiens
tgagtggggttatctctgtgtt

SEQ ID NO: 6459431 - DNA, 18 bp, Homo sapiens
tgagtgggtatttcttat

SEQ ID NO: 6459432 - DNA, 20 bp, Homo sapiens
tgagtggtcactggtcaggg

SEQ ID NO: 6459433 - DNA, 15 bp, Homo sapiens
tgagtggtgtgactc

SEQ ID NO: 6459434 - DNA, 21 bp, Homo sapiens
tgagtggttttctttttcctt

SEQ ID NO: 6459435 - DNA, 12 bp, Homo sapiens
tgagtgtaaact

SEQ ID NO: 6459436 - DNA, 13 bp, Homo sapiens
tgagtgtaatgtt

SEQ ID NO: 6459437 - DNA, 16 bp, Homo sapiens
tgagtgtacagatttt

SEQ ID NO: 6459438 - DNA, 13 bp, Homo sapiens
tgagtgtactgtg

SEQ ID NO: 6459439 - DNA, 23 bp, Homo sapiens
tgagtgtatacatgtgtgggtgc

SEQ ID NO: 6459440 - DNA, 15 bp, Homo sapiens
tgagtgtatatatat

SEQ ID NO: 6459441 - DNA, 13 bp, Homo sapiens
tgagtgtatgtat

SEQ ID NO: 6459442 - DNA, 18 bp, Homo sapiens
tgagtgtatgtatacaca

SEQ ID NO: 6459443 - DNA, 21 bp, Homo sapiens
tgagtgtatgtatacacacac

SEQ ID NO: 6459444 - DNA, 10 bp, Homo sapiens
tgagtgtcaa

SEQ ID NO: 6459445 - DNA, 12 bp, Homo sapiens
tgagtgtcccaa

SEQ ID NO: 6459446 - DNA, 23 bp, Homo sapiens
tgagtgtcccaagccgggagcca

SEQ ID NO: 6459447 - DNA, 12 bp, Homo sapiens
tgagtgtctatt

SEQ ID NO: 6459448 - DNA, 15 bp, Homo sapiens
tgagtgtctctgcct

SEQ ID NO: 6459449 - DNA, 20 bp, Homo sapiens
tgagtgtcttctaactttat

SEQ ID NO: 6459450 - DNA, 12 bp, Homo sapiens
tgagtgtgacag

SEQ ID NO: 6459451 - DNA, 13 bp, Homo sapiens
tgagtgtgacagg

SEQ ID NO: 6459452 - DNA, 15 bp, Homo sapiens
tgagtgtgacagggc

SEQ ID NO: 6459453 - DNA, 16 bp, Homo sapiens
tgagtgtgacagggcc

SEQ ID NO: 6459454 - DNA, 17 bp, Homo sapiens
tgagtgtgacagggcca

SEQ ID NO: 6459455 - DNA, 22 bp, Homo sapiens
tgagtgtgagagatggggcggg

SEQ ID NO: 6459456 - DNA, 18 bp, Homo sapiens
tgagtgtgagtgtgagag

SEQ ID NO: 6459457 - DNA, 19 bp, Homo sapiens
tgagtgtgcaagcaaagaa

SEQ ID NO: 6459458 - DNA, 21 bp, Homo sapiens
tgagtgtgcaagcaaagaacc

SEQ ID NO: 6459459 - DNA, 15 bp, Homo sapiens
tgagtgtggaagccg

SEQ ID NO: 6459460 - DNA, 13 bp, Homo sapiens
tgagtgtggactt

SEQ ID NO: 6459461 - DNA, 15 bp, Homo sapiens
tgagtgtggcgggaa

SEQ ID NO: 6459462 - DNA, 16 bp, Homo sapiens
tgagtgtggctcccct

SEQ ID NO: 6459463 - DNA, 17 bp, Homo sapiens
tgagtgtggctcccctc

SEQ ID NO: 6459464 - DNA, 18 bp, Homo sapiens
tgagtgtggctcccctct

SEQ ID NO: 6459465 - DNA, 11 bp, Homo sapiens
tgagtgtgtga

SEQ ID NO: 6459466 - DNA, 15 bp, Homo sapiens
tgagtgtgtgaagcc

SEQ ID NO: 6459467 - DNA, 14 bp, Homo sapiens
tgagtgtgtgagcg

SEQ ID NO: 6459468 - DNA, 23 bp, Homo sapiens
tgagtgtgtgtgatgggatctgt

SEQ ID NO: 6459469 - DNA, 17 bp, Homo sapiens
tgagtgtgtgtgcatgg

SEQ ID NO: 6459470 - DNA, 18 bp, Homo sapiens
tgagtgtgtgtgtgcatg

SEQ ID NO: 6459471 - DNA, 20 bp, Homo sapiens
tgagtgtgtgtgtgtgtctg

SEQ ID NO: 6459472 - DNA, 22 bp, Homo sapiens
tgagtgttcccaatctgaaatt

SEQ ID NO: 6459473 - DNA, 24 bp, Homo sapiens
tgagtgttcctttttaaatgtgaa

SEQ ID NO: 6459474 - DNA, 12 bp, Homo sapiens
tgagtgttgaag

SEQ ID NO: 6459475 - DNA, 18 bp, Homo sapiens
tgagtgtttaataaagtt

SEQ ID NO: 6459476 - DNA, 13 bp, Homo sapiens
tgagttaaagaga

SEQ ID NO: 6459477 - DNA, 21 bp, Homo sapiens
tgagttaactttttgtaggat

SEQ ID NO: 6459478 - DNA, 23 bp, Homo sapiens
tgagttacaccagacctgttctg

SEQ ID NO: 6459479 - DNA, 22 bp, Homo sapiens
tgagttacctcatgccgctgtg

SEQ ID NO: 6459480 - DNA, 15 bp, Homo sapiens
tgagttactgaaggt

SEQ ID NO: 6459481 - DNA, 15 bp, Homo sapiens
tgagttactgtgcat

SEQ ID NO: 6459482 - DNA, 18 bp, Homo sapiens
tgagttacttgtctgagg

SEQ ID NO: 6459483 - DNA, 23 bp, Homo sapiens
tgagttagactcaagggggtgac

SEQ ID NO: 6459484 - DNA, 22 bp, Homo sapiens
tgagttagctgtttactgacat

SEQ ID NO: 6459485 - DNA, 13 bp, Homo sapiens
tgagttaggaaca

SEQ ID NO: 6459486 - DNA, 19 bp, Homo sapiens
tgagttattcataaagaga

SEQ ID NO: 6459487 - DNA, 22 bp, Homo sapiens
tgagttattccttgatcatttt

SEQ ID NO: 6459488 - DNA, 14 bp, Homo sapiens
tgagttattttaat

SEQ ID NO: 6459489 - DNA, 18 bp, Homo sapiens
tgagttcaacctttagta

SEQ ID NO: 6459490 - DNA, 20 bp, Homo sapiens
tgagttcaagggctgtaggt

SEQ ID NO: 6459491 - DNA, 15 bp, Homo sapiens
tgagttcaggtagct

SEQ ID NO: 6459492 - DNA, 16 bp, Homo sapiens
tgagttcaggtagctg

SEQ ID NO: 6459493 - DNA, 17 bp, Homo sapiens
tgagttcataccctgtt

SEQ ID NO: 6459494 - DNA, 19 bp, Homo sapiens
tgagttccagttgaagtta

SEQ ID NO: 6459495 - DNA, 19 bp, Homo sapiens
tgagttcccgggagctggg

SEQ ID NO: 6459496 - DNA, 21 bp, Homo sapiens
tgagttccttataagaattaa

SEQ ID NO: 6459497 - DNA, 20 bp, Homo sapiens
tgagttctacataagtaatt

SEQ ID NO: 6459498 - DNA, 11 bp, Homo sapiens
tgagttctcac

SEQ ID NO: 6459499 - DNA, 19 bp, Homo sapiens
tgagttctcactatgtttc

SEQ ID NO: 6459500 - DNA, 13 bp, Homo sapiens
tgagttctcaggg

SEQ ID NO: 6459501 - DNA, 16 bp, Homo sapiens
tgagttctcagggctc

SEQ ID NO: 6459502 - DNA, 19 bp, Homo sapiens
tgagttctcagggctcctg

SEQ ID NO: 6459503 - DNA, 15 bp, Homo sapiens
tgagttctgacactg

SEQ ID NO: 6459504 - DNA, 23 bp, Homo sapiens
tcctgtgttcaatatttagaaaa

SEQ ID NO: 6459505 - DNA, 20 bp, Homo sapiens
tcctgtgttgtgctgggagc

SEQ ID NO: 6459506 - DNA, 13 bp, Homo sapiens
tcctgtgtttcat

SEQ ID NO: 6459507 - DNA, 19 bp, Homo sapiens
tcctgtgtttgtcctgggt

SEQ ID NO: 6459508 - DNA, 14 bp, Homo sapiens
tcctgtgtttgtga

SEQ ID NO: 6459509 - DNA, 20 bp, Homo sapiens
tcctgtgttttttctgccac

SEQ ID NO: 6459510 - DNA, 17 bp, Homo sapiens
tcctgttaaattttctc

SEQ ID NO: 6459511 - DNA, 20 bp, Homo sapiens
tcctgttaacgtcatctcag

SEQ ID NO: 6459512 - DNA, 14 bp, Homo sapiens
tcctgttacctgtc

SEQ ID NO: 6459513 - DNA, 18 bp, Homo sapiens
tcctgttactctgtccca

SEQ ID NO: 6459514 - DNA, 18 bp, Homo sapiens
tcctgttactgagatgtc

SEQ ID NO: 6459515 - DNA, 19 bp, Homo sapiens
tcctgttacttgcttctgc

SEQ ID NO: 6459516 - DNA, 16 bp, Homo sapiens
tcctgttagctcctca

SEQ ID NO: 6459517 - DNA, 19 bp, Homo sapiens
tcctgttaggccaactgcc

SEQ ID NO: 6459518 - DNA, 24 bp, Homo sapiens
tcctgttattttttatttccacat

SEQ ID NO: 6459519 - DNA, 16 bp, Homo sapiens
tcctgttcaccttatg

SEQ ID NO: 6459520 - DNA, 21 bp, Homo sapiens
tcctgttcaccttatgtatta

SEQ ID NO: 6459521 - DNA, 23 bp, Homo sapiens
tcctgttcagaaaggggctcttc

SEQ ID NO: 6459522 - DNA, 20 bp, Homo sapiens
tcctgttcatgacagctact

SEQ ID NO: 6459523 - DNA, 20 bp, Homo sapiens
tcctgttccatttcagttca

SEQ ID NO: 6459524 - DNA, 19 bp, Homo sapiens
tcctgttcccatgagatga

SEQ ID NO: 6459525 - DNA, 15 bp, Homo sapiens
tcctgttccctcctg

SEQ ID NO: 6459526 - DNA, 17 bp, Homo sapiens
tcctgttccctcctggt

SEQ ID NO: 6459527 - DNA, 18 bp, Homo sapiens
tcctgttccctcctggtc

SEQ ID NO: 6459528 - DNA, 16 bp, Homo sapiens
tcctgttcctgccttc

SEQ ID NO: 6459529 - DNA, 19 bp, Homo sapiens
tcctgttcctgccttctct

SEQ ID NO: 6459530 - DNA, 21 bp, Homo sapiens
tcctgttcctgccttctcttc

SEQ ID NO: 6459531 - DNA, 19 bp, Homo sapiens
tcctgttctcagagctcca

SEQ ID NO: 6459532 - DNA, 18 bp, Homo sapiens
tcctgttctcagcatcca

SEQ ID NO: 6459533 - DNA, 22 bp, Homo sapiens
tcctgttctgaaaccttagttt

SEQ ID NO: 6459534 - DNA, 23 bp, Homo sapiens
tcctgttctgcgctgtgtacaat

SEQ ID NO: 6459535 - DNA, 14 bp, Homo sapiens
tcctgttctgtgac

SEQ ID NO: 6459536 - DNA, 17 bp, Homo sapiens
tcctgttctgtgtctgc

SEQ ID NO: 6459537 - DNA, 19 bp, Homo sapiens
tcctgttcttaagacgtga

SEQ ID NO: 6459538 - DNA, 18 bp, Homo sapiens
tcctgttctttgggctca

SEQ ID NO: 6459539 - DNA, 17 bp, Homo sapiens
tcctgttgaaaagccat

SEQ ID NO: 6459540 - DNA, 17 bp, Homo sapiens
tcctgttgaagacttcc

SEQ ID NO: 6459541 - DNA, 21 bp, Homo sapiens
tcctgttgaagacttcctctc

SEQ ID NO: 6459542 - DNA, 21 bp, Homo sapiens
tcctgttgcacccagccctgg

SEQ ID NO: 6459543 - DNA, 13 bp, Homo sapiens
tcctgttgccaca

SEQ ID NO: 6459544 - DNA, 22 bp, Homo sapiens
tcctgttggaaggtagagccca

SEQ ID NO: 6459545 - DNA, 17 bp, Homo sapiens
tcctgttggctgctgcc

SEQ ID NO: 6459546 - DNA, 18 bp, Homo sapiens
tcctgttggctgctgcca

SEQ ID NO: 6459547 - DNA, 19 bp, Homo sapiens
tcctgttggctgctgccac

SEQ ID NO: 6459548 - DNA, 15 bp, Homo sapiens
tcctgttggtttcat

SEQ ID NO: 6459549 - DNA, 17 bp, Homo sapiens
tcctgttgtgtaataac

SEQ ID NO: 6459550 - DNA, 21 bp, Homo sapiens
tcctgttgtgtaataacagaa

SEQ ID NO: 6459551 - DNA, 20 bp, Homo sapiens
tcctgttgttatggaaactg

SEQ ID NO: 6459552 - DNA, 17 bp, Homo sapiens
tcctgtttaactcccta

SEQ ID NO: 6459553 - DNA, 22 bp, Homo sapiens
tcctgtttataatctgaagata

SEQ ID NO: 6459554 - DNA, 18 bp, Homo sapiens
tcctgtttattcccatct

SEQ ID NO: 6459555 - DNA, 15 bp, Homo sapiens
tcctgtttccagggt

SEQ ID NO: 6459556 - DNA, 13 bp, Homo sapiens
tcctgtttccatg

SEQ ID NO: 6459557 - DNA, 22 bp, Homo sapiens
tcctgtttcccttcccttccac

SEQ ID NO: 6459558 - DNA, 18 bp, Homo sapiens
tcctgtttcctagctgtg

SEQ ID NO: 6459559 - DNA, 13 bp, Homo sapiens
tcctgtttctaag

SEQ ID NO: 6459560 - DNA, 21 bp, Homo sapiens
tcctgtttctgaaaagaaata

SEQ ID NO: 6459561 - DNA, 16 bp, Homo sapiens
tcctgtttctgtcaag

SEQ ID NO: 6459562 - DNA, 14 bp, Homo sapiens
tcctgtttgaaact

SEQ ID NO: 6459563 - DNA, 19 bp, Homo sapiens
tcctgtttgaacccaggag

SEQ ID NO: 6459564 - DNA, 23 bp, Homo sapiens
tcctgtttgggaagagcttagaa

SEQ ID NO: 6459565 - DNA, 20 bp, Homo sapiens
tcctgtttggtggggtggca

SEQ ID NO: 6459566 - DNA, 13 bp, Homo sapiens
tcctgtttgtatt

SEQ ID NO: 6459567 - DNA, 23 bp, Homo sapiens
tcctgtttgtatttttttccaag

SEQ ID NO: 6459568 - DNA, 18 bp, Homo sapiens
tcctgtttgtctgatgtg

SEQ ID NO: 6459569 - DNA, 13 bp, Homo sapiens
tcctgtttgtttt

SEQ ID NO: 6459570 - DNA, 20 bp, Homo sapiens
tcctgttttataatgaaccc

SEQ ID NO: 6459571 - DNA, 19 bp, Homo sapiens
tcctgttttcatggacagc

SEQ ID NO: 6459572 - DNA, 14 bp, Homo sapiens
tcctgttttctaaa

SEQ ID NO: 6459573 - DNA, 16 bp, Homo sapiens
tcctgttttctaaaaa

SEQ ID NO: 6459574 - DNA, 15 bp, Homo sapiens
tcctgttttctccct

SEQ ID NO: 6459575 - DNA, 18 bp, Homo sapiens
tcctgttttctccctctc

SEQ ID NO: 6459576 - DNA, 19 bp, Homo sapiens
tcctgttttctccctctca

SEQ ID NO: 6459577 - DNA, 17 bp, Homo sapiens
tcctgttttgcacagcc

SEQ ID NO: 6459578 - DNA, 21 bp, Homo sapiens
tcctgttttgcacagccaaat

SEQ ID NO: 6459579 - DNA, 16 bp, Homo sapiens
tcctgtttttattatt

SEQ ID NO: 6459580 - DNA, 21 bp, Homo sapiens
tcctgtttttattattaacaa

SEQ ID NO: 6459581 - DNA, 14 bp, Homo sapiens
tcctgtttttcaca

SEQ ID NO: 6459582 - DNA, 14 bp, Homo sapiens
tcctgtttttccta

SEQ ID NO: 6459583 - DNA, 19 bp, Homo sapiens
tccttaaaaagaccatgca

SEQ ID NO: 6459584 - DNA, 13 bp, Homo sapiens
tccttaaaatgtg

SEQ ID NO: 6459585 - DNA, 14 bp, Homo sapiens
tccttaaacatgaa

SEQ ID NO: 6459586 - DNA, 15 bp, Homo sapiens
tccttaaacatgaaa

SEQ ID NO: 6459587 - DNA, 14 bp, Homo sapiens
tccttaaactgtgt

SEQ ID NO: 6459588 - DNA, 18 bp, Homo sapiens
tccttaaagagtgtggca

SEQ ID NO: 6459589 - DNA, 23 bp, Homo sapiens
tccttaaagagtgtggcaaaata

SEQ ID NO: 6459590 - DNA, 14 bp, Homo sapiens
tccttaaagttctg

SEQ ID NO: 6459591 - DNA, 19 bp, Homo sapiens
tccttaaatcttaatgttc

SEQ ID NO: 6459592 - DNA, 11 bp, Homo sapiens
tccttaaatga

SEQ ID NO: 6459593 - DNA, 17 bp, Homo sapiens
tccttaaatgaactact

SEQ ID NO: 6459594 - DNA, 22 bp, Homo sapiens
tccttaaatgaactactgctat

SEQ ID NO: 6459595 - DNA, 22 bp, Homo sapiens
tccttaaatgacttttcttaag

SEQ ID NO: 6459596 - DNA, 15 bp, Homo sapiens
tccttaacatttctc

SEQ ID NO: 6459597 - DNA, 16 bp, Homo sapiens
tccttaacatttctct

SEQ ID NO: 6459598 - DNA, 15 bp, Homo sapiens
tccttaacccacctc

SEQ ID NO: 6459599 - DNA, 23 bp, Homo sapiens
tccttaaccgtggactcttcctt

SEQ ID NO: 6459600 - DNA, 12 bp, Homo sapiens
tccttaactgtc

SEQ ID NO: 6459601 - DNA, 23 bp, Homo sapiens
tccttaactgtccagtccagtga

SEQ ID NO: 6459602 - DNA, 13 bp, Homo sapiens
tccttaagaacac

SEQ ID NO: 6459603 - DNA, 16 bp, Homo sapiens
tccttaagaacacaaa

SEQ ID NO: 6459604 - DNA, 13 bp, Homo sapiens
tccttaagagatt

SEQ ID NO: 6459605 - DNA, 17 bp, Homo sapiens
tccttaagctgcagaga

SEQ ID NO: 6459606 - DNA, 19 bp, Homo sapiens
tccttaaggctcttttgta

SEQ ID NO: 6459607 - DNA, 11 bp, Homo sapiens
tccttaagtat

SEQ ID NO: 6459608 - DNA, 21 bp, Homo sapiens
tccttaagtatatcatgtaaa

SEQ ID NO: 6459609 - DNA, 14 bp, Homo sapiens
tccttaataactat

SEQ ID NO: 6459610 - DNA, 20 bp, Homo sapiens
tccttaatatgatctgtgga

SEQ ID NO: 6459611 - DNA, 18 bp, Homo sapiens
tccttaatcccagtacga

SEQ ID NO: 6459612 - DNA, 21 bp, Homo sapiens
tccttaatgaaaaatacatat

SEQ ID NO: 6459613 - DNA, 21 bp, Homo sapiens
tccttaatgaagagccagccc

SEQ ID NO: 6459614 - DNA, 23 bp, Homo sapiens
tccttaatggccttaattaattc

SEQ ID NO: 6459615 - DNA, 18 bp, Homo sapiens
tccttaatggtgttctct

SEQ ID NO: 6459616 - DNA, 22 bp, Homo sapiens
tccttaatttaattgctttgaa

SEQ ID NO: 6459617 - DNA, 14 bp, Homo sapiens
tccttacaatgtaa

SEQ ID NO: 6459618 - DNA, 20 bp, Homo sapiens
tccttacagaagggagtgaa

SEQ ID NO: 6459619 - DNA, 15 bp, Homo sapiens
tccttacagtcacta

SEQ ID NO: 6459620 - DNA, 15 bp, Homo sapiens
tccttacataaacat

SEQ ID NO: 6459621 - DNA, 13 bp, Homo sapiens
tccttacattaaa

SEQ ID NO: 6459622 - DNA, 15 bp, Homo sapiens
tccttacattaaaaa

SEQ ID NO: 6459623 - DNA, 20 bp, Homo sapiens
tccttaccaatagcctgaat

SEQ ID NO: 6459624 - DNA, 22 bp, Homo sapiens
tccttaccaatagcctgaattt

SEQ ID NO: 6459625 - DNA, 21 bp, Homo sapiens
tccttaccagagacgcccagc

SEQ ID NO: 6459626 - DNA, 22 bp, Homo sapiens
tccttaccagagacgcccagcc

SEQ ID NO: 6459627 - DNA, 14 bp, Homo sapiens
tccttaccagcaga

SEQ ID NO: 6459628 - DNA, 18 bp, Homo sapiens
tccttacctatttcctca

SEQ ID NO: 6459629 - DNA, 19 bp, Homo sapiens
tccttacctatttcctcag

SEQ ID NO: 6459630 - DNA, 11 bp, Homo sapiens
tccttacctcg

SEQ ID NO: 6459631 - DNA, 21 bp, Homo sapiens
tccttacctctggaacccccc

SEQ ID NO: 6459632 - DNA, 14 bp, Homo sapiens
tccttacctcttcc

SEQ ID NO: 6459633 - DNA, 17 bp, Homo sapiens
tccttacctcttccgga

SEQ ID NO: 6459634 - DNA, 18 bp, Homo sapiens
tccttacctggaaaaaca

SEQ ID NO: 6459635 - DNA, 21 bp, Homo sapiens
tccttacctttaccccatccc

SEQ ID NO: 6459636 - DNA, 15 bp, Homo sapiens
tccttacctttttat

SEQ ID NO: 6459637 - DNA, 22 bp, Homo sapiens
tccttactcagagctgcgggct

SEQ ID NO: 6459638 - DNA, 16 bp, Homo sapiens
tccttactcccaggca

SEQ ID NO: 6459639 - DNA, 14 bp, Homo sapiens
tccttactcctgtg

SEQ ID NO: 6459640 - DNA, 20 bp, Homo sapiens
tccttactcctgtgggagcc

SEQ ID NO: 6459641 - DNA, 22 bp, Homo sapiens
tccttactcctgtgggagcctc

SEQ ID NO: 6459642 - DNA, 14 bp, Homo sapiens
tccttactctgagc

SEQ ID NO: 6459643 - DNA, 15 bp, Homo sapiens
tccttactctgagcc

SEQ ID NO: 6459644 - DNA, 18 bp, Homo sapiens
tccttactctgagcccag

SEQ ID NO: 6459645 - DNA, 19 bp, Homo sapiens
tccttactctgagcccagg

SEQ ID NO: 6459646 - DNA, 16 bp, Homo sapiens
tccttacttgcactgt

SEQ ID NO: 6459647 - DNA, 21 bp, Homo sapiens
tccttacttgcactgttactc

SEQ ID NO: 6459648 - DNA, 14 bp, Homo sapiens
tccttacttttaaa

SEQ ID NO: 6459649 - DNA, 13 bp, Homo sapiens
tccttagaaaaga

SEQ ID NO: 6459650 - DNA, 13 bp, Homo sapiens
tccttagaatgag

SEQ ID NO: 6459651 - DNA, 17 bp, Homo sapiens
tccttagacccgccagg

SEQ ID NO: 6459652 - DNA, 18 bp, Homo sapiens
tccttagacctgagggac

SEQ ID NO: 6459653 - DNA, 23 bp, Homo sapiens
tccttagacctgagggacccttc

SEQ ID NO: 6459654 - DNA, 21 bp, Homo sapiens
tccttagactccttctcccca

SEQ ID NO: 6459655 - DNA, 18 bp, Homo sapiens
tccttagataccttgaaa

SEQ ID NO: 6459656 - DNA, 18 bp, Homo sapiens
tccttagatctggcatgt

SEQ ID NO: 6459657 - DNA, 14 bp, Homo sapiens
tccttagcaagggg

SEQ ID NO: 6459658 - DNA, 15 bp, Homo sapiens
tccttagccctgtct

SEQ ID NO: 6459659 - DNA, 16 bp, Homo sapiens
tccttagcctgggcct

SEQ ID NO: 6459660 - DNA, 20 bp, Homo sapiens
tccttagcctgggcctcctc

SEQ ID NO: 6459661 - DNA, 17 bp, Homo sapiens
tccttagctgtaaaatg

SEQ ID NO: 6459662 - DNA, 19 bp, Homo sapiens
tccttagcttagacctcag

SEQ ID NO: 6459663 - DNA, 23 bp, Homo sapiens
tccttagcttggtatgagacaga

SEQ ID NO: 6459664 - DNA, 24 bp, Homo sapiens
tccttagctttccctgtgccactt

SEQ ID NO: 6459665 - DNA, 19 bp, Homo sapiens
tccttaggaaaatgcttct

SEQ ID NO: 6459666 - DNA, 21 bp, Homo sapiens
tccttaggaaaatgcttctgt

SEQ ID NO: 6459667 - DNA, 23 bp, Homo sapiens
tccttaggaaaatgcttctgttg

SEQ ID NO: 6459668 - DNA, 20 bp, Homo sapiens
tccttaggtaatctataact

SEQ ID NO: 6459669 - DNA, 13 bp, Homo sapiens
tccttagtaaatt

SEQ ID NO: 6459670 - DNA, 22 bp, Homo sapiens
tccttagtatcagtcatgacag

SEQ ID NO: 6459671 - DNA, 22 bp, Homo sapiens
tccttagtgccaggagggcaca

SEQ ID NO: 6459672 - DNA, 14 bp, Homo sapiens
tccttataagaatt

SEQ ID NO: 6459673 - DNA, 18 bp, Homo sapiens
tccttatagacacttgct

SEQ ID NO: 6459674 - DNA, 19 bp, Homo sapiens
tccttatcctacagtacaa

SEQ ID NO: 6459675 - DNA, 14 bp, Homo sapiens
tccttatcctagcc

SEQ ID NO: 6459676 - DNA, 20 bp, Homo sapiens
tccttatcctagcctttggg

SEQ ID NO: 6459677 - DNA, 14 bp, Homo sapiens
tccttatctagctg

SEQ ID NO: 6459678 - DNA, 18 bp, Homo sapiens
tccttatgatattctcat

SEQ ID NO: 6459679 - DNA, 15 bp, Homo sapiens
tccttatgcatgaaa

SEQ ID NO: 6459680 - DNA, 21 bp, Homo sapiens
tccttatgggtagggctctga

SEQ ID NO: 6459681 - DNA, 12 bp, Homo sapiens
tgagttctgatt

SEQ ID NO: 6459682 - DNA, 21 bp, Homo sapiens
tgagttctgattgtgttgaag

SEQ ID NO: 6459683 - DNA, 15 bp, Homo sapiens
tgagttctgcacata

SEQ ID NO: 6459684 - DNA, 14 bp, Homo sapiens
tgagttctgggttt

SEQ ID NO: 6459685 - DNA, 16 bp, Homo sapiens
tgagttctgggtttct

SEQ ID NO: 6459686 - DNA, 17 bp, Homo sapiens
tgagttcttgtgtcctg

SEQ ID NO: 6459687 - DNA, 16 bp, Homo sapiens
tgagttcttgtttttt

SEQ ID NO: 6459688 - DNA, 17 bp, Homo sapiens
tgagttgaaatgttctg

SEQ ID NO: 6459689 - DNA, 21 bp, Homo sapiens
tgagttgaaatgttctgtcaa

SEQ ID NO: 6459690 - DNA, 22 bp, Homo sapiens
tgagttgaaatgttctgtcaaa

SEQ ID NO: 6459691 - DNA, 18 bp, Homo sapiens
tgagttgaagatctttga

SEQ ID NO: 6459692 - DNA, 17 bp, Homo sapiens
tgagttgacttctgaca

SEQ ID NO: 6459693 - DNA, 23 bp, Homo sapiens
tgagttgacttgacagaacactg

SEQ ID NO: 6459694 - DNA, 18 bp, Homo sapiens
tgagttgagtattacaca

SEQ ID NO: 6459695 - DNA, 16 bp, Homo sapiens
tgagttgatagcacag

SEQ ID NO: 6459696 - DNA, 16 bp, Homo sapiens
tgagttgattcagctc

SEQ ID NO: 6459697 - DNA, 15 bp, Homo sapiens
tgagttgcagttttt

SEQ ID NO: 6459698 - DNA, 15 bp, Homo sapiens
tgagttgcatgtttt

SEQ ID NO: 6459699 - DNA, 19 bp, Homo sapiens
tgagttgccaagacaaatc

SEQ ID NO: 6459700 - DNA, 23 bp, Homo sapiens
tgagttgctggaaaatcatattg

SEQ ID NO: 6459701 - DNA, 21 bp, Homo sapiens
tgagttggaacaacatgttct

SEQ ID NO: 6459702 - DNA, 16 bp, Homo sapiens
tgagttggacacactg

SEQ ID NO: 6459703 - DNA, 14 bp, Homo sapiens
tgagttggccaaga

SEQ ID NO: 6459704 - DNA, 14 bp, Homo sapiens
tgagttggctggga

SEQ ID NO: 6459705 - DNA, 19 bp, Homo sapiens
tgagttgggggagggaaga

SEQ ID NO: 6459706 - DNA, 23 bp, Homo sapiens
tgagttgggggagggaagaccag

SEQ ID NO: 6459707 - DNA, 20 bp, Homo sapiens
tgagttggtgttgacatgtg

SEQ ID NO: 6459708 - DNA, 14 bp, Homo sapiens
tgagttgtgatgaa

SEQ ID NO: 6459709 - DNA, 13 bp, Homo sapiens
tgagttgtgcctc

SEQ ID NO: 6459710 - DNA, 13 bp, Homo sapiens
tgagttgttctaa

SEQ ID NO: 6459711 - DNA, 16 bp, Homo sapiens
tgagttgttgtgggtt

SEQ ID NO: 6459712 - DNA, 13 bp, Homo sapiens
tgagttgtttaaa

SEQ ID NO: 6459713 - DNA, 22 bp, Homo sapiens
tgagttgttttggtgcctgcct

SEQ ID NO: 6459714 - DNA, 17 bp, Homo sapiens
tgagttgtttttgtata

SEQ ID NO: 6459715 - DNA, 20 bp, Homo sapiens
tgagttgtttttgtatattg

SEQ ID NO: 6459716 - DNA, 18 bp, Homo sapiens
tgagtttaaaaatcaact

SEQ ID NO: 6459717 - DNA, 19 bp, Homo sapiens
tgagtttaaaaatcaactt

SEQ ID NO: 6459718 - DNA, 20 bp, Homo sapiens
tgagtttaaaaatcaacttt

SEQ ID NO: 6459719 - DNA, 14 bp, Homo sapiens
tgagtttaaagcaa

SEQ ID NO: 6459720 - DNA, 21 bp, Homo sapiens
tgagtttaacaataataaaaa

SEQ ID NO: 6459721 - DNA, 18 bp, Homo sapiens
tgagtttaccatttgtaa

SEQ ID NO: 6459722 - DNA, 19 bp, Homo sapiens
tgagtttagtaaggctgtg

SEQ ID NO: 6459723 - DNA, 17 bp, Homo sapiens
tgagtttatatctctca

SEQ ID NO: 6459724 - DNA, 12 bp, Homo sapiens
tgagtttatggg

SEQ ID NO: 6459725 - DNA, 20 bp, Homo sapiens
tgagtttcactgtactgcat

SEQ ID NO: 6459726 - DNA, 12 bp, Homo sapiens
tgagtttcagaa

SEQ ID NO: 6459727 - DNA, 14 bp, Homo sapiens
tgagtttcatagct

SEQ ID NO: 6459728 - DNA, 21 bp, Homo sapiens
tgagtttcatatataagactg

SEQ ID NO: 6459729 - DNA, 19 bp, Homo sapiens
tgagtttcattctcctgcc

SEQ ID NO: 6459730 - DNA, 19 bp, Homo sapiens
tgagtttccagcctgctag

SEQ ID NO: 6459731 - DNA, 17 bp, Homo sapiens
tgagtttccagctgctc

SEQ ID NO: 6459732 - DNA, 16 bp, Homo sapiens
tgagtttcccttcctt

SEQ ID NO: 6459733 - DNA, 19 bp, Homo sapiens
tgagtttctggggaaaaaa

SEQ ID NO: 6459734 - DNA, 14 bp, Homo sapiens
tgagtttcttagac

SEQ ID NO: 6459735 - DNA, 13 bp, Homo sapiens
tgagtttctttca

SEQ ID NO: 6459736 - DNA, 16 bp, Homo sapiens
tgagtttgacatttaa

SEQ ID NO: 6459737 - DNA, 21 bp, Homo sapiens
tgagtttgagctgccttccct

SEQ ID NO: 6459738 - DNA, 13 bp, Homo sapiens
tgagtttgcttat

SEQ ID NO: 6459739 - DNA, 22 bp, Homo sapiens
tgagtttgggccccagaggctg

SEQ ID NO: 6459740 - DNA, 23 bp, Homo sapiens
tgagtttgggccccagaggctgg

SEQ ID NO: 6459741 - DNA, 19 bp, Homo sapiens
tgagtttggtccctaaatt

SEQ ID NO: 6459742 - DNA, 19 bp, Homo sapiens
tgagtttgtagaactttat

SEQ ID NO: 6459743 - DNA, 20 bp, Homo sapiens
tgagtttgtttcttgtgtgt

SEQ ID NO: 6459744 - DNA, 19 bp, Homo sapiens
tgagtttgtttctttgaat

SEQ ID NO: 6459745 - DNA, 20 bp, Homo sapiens
tgagtttgtttctttgaatt

SEQ ID NO: 6459746 - DNA, 15 bp, Homo sapiens
tgagttttaaagaag

SEQ ID NO: 6459747 - DNA, 17 bp, Homo sapiens
tgagttttaaagaagtc

SEQ ID NO: 6459748 - DNA, 13 bp, Homo sapiens
tgagttttaaatt

SEQ ID NO: 6459749 - DNA, 12 bp, Homo sapiens
tgagttttacca

SEQ ID NO: 6459750 - DNA, 19 bp, Homo sapiens
tgagttttactcttaaatc

SEQ ID NO: 6459751 - DNA, 17 bp, Homo sapiens
tgagttttatccaagac

SEQ ID NO: 6459752 - DNA, 17 bp, Homo sapiens
tgagttttatcttgaca

SEQ ID NO: 6459753 - DNA, 13 bp, Homo sapiens
tgagttttccatg

SEQ ID NO: 6459754 - DNA, 18 bp, Homo sapiens
tgagttttgataaagtaa

SEQ ID NO: 6459755 - DNA, 19 bp, Homo sapiens
tgagttttgggaagttaaa

SEQ ID NO: 6459756 - DNA, 17 bp, Homo sapiens
tgagttttgtttcactt

SEQ ID NO: 6459757 - DNA, 18 bp, Homo sapiens
tgagttttgtttcacttt

SEQ ID NO: 6459758 - DNA, 17 bp, Homo sapiens
tgagtttttaaatgcca

SEQ ID NO: 6459759 - DNA, 14 bp, Homo sapiens
tgagtttttcatta

SEQ ID NO: 6459760 - DNA, 14 bp, Homo sapiens
tgagtttttcctcc

SEQ ID NO: 6459761 - DNA, 18 bp, Homo sapiens
tgagtttttcctcccagt

SEQ ID NO: 6459762 - DNA, 15 bp, Homo sapiens
tgagttttttattcc

SEQ ID NO: 6459763 - DNA, 14 bp, Homo sapiens
tgagttttttcctt

SEQ ID NO: 6459764 - DNA, 14 bp, Homo sapiens
tgataaaaagagga

SEQ ID NO: 6459765 - DNA, 15 bp, Homo sapiens
tgataaaaataaagc

SEQ ID NO: 6459766 - DNA, 13 bp, Homo sapiens
tgataaaaatact

SEQ ID NO: 6459767 - DNA, 18 bp, Homo sapiens
tgataaaacaacagctcg

SEQ ID NO: 6459768 - DNA, 14 bp, Homo sapiens
tgataaaactgggt

SEQ ID NO: 6459769 - DNA, 18 bp, Homo sapiens
tgataaaagattttccta

SEQ ID NO: 6459770 - DNA, 14 bp, Homo sapiens
tgataaaatagcca

SEQ ID NO: 6459771 - DNA, 12 bp, Homo sapiens
tgataaaatatg

SEQ ID NO: 6459772 - DNA, 16 bp, Homo sapiens
tgataaaatattttaa

SEQ ID NO: 6459773 - DNA, 16 bp, Homo sapiens
tgataaaatgttcctt

SEQ ID NO: 6459774 - DNA, 14 bp, Homo sapiens
tgataaaattgtga

SEQ ID NO: 6459775 - DNA, 18 bp, Homo sapiens
tgataaaattgtgatgtt

SEQ ID NO: 6459776 - DNA, 21 bp, Homo sapiens
tgataaacataattatttcta

SEQ ID NO: 6459777 - DNA, 21 bp, Homo sapiens
tgataaacattaaacactgta

SEQ ID NO: 6459778 - DNA, 12 bp, Homo sapiens
tgataaacattc

SEQ ID NO: 6459779 - DNA, 19 bp, Homo sapiens
tgataaacctgccaagagt

SEQ ID NO: 6459780 - DNA, 16 bp, Homo sapiens
tgataaagaaaccttt

SEQ ID NO: 6459781 - DNA, 12 bp, Homo sapiens
tgataaagaaca

SEQ ID NO: 6459782 - DNA, 14 bp, Homo sapiens
tgataaagactttt

SEQ ID NO: 6459783 - DNA, 19 bp, Homo sapiens
tgataaagattttttaata

SEQ ID NO: 6459784 - DNA, 13 bp, Homo sapiens
tgataaagcctca

SEQ ID NO: 6459785 - DNA, 15 bp, Homo sapiens
tgataaagtaaaaaa

SEQ ID NO: 6459786 - DNA, 18 bp, Homo sapiens
tgataaagtaaaaaagtt

SEQ ID NO: 6459787 - DNA, 20 bp, Homo sapiens
tgataaagtaaaaaagttaa

SEQ ID NO: 6459788 - DNA, 14 bp, Homo sapiens
tgataaagtaataa

SEQ ID NO: 6459789 - DNA, 16 bp, Homo sapiens
tgataaagttccttaa

SEQ ID NO: 6459790 - DNA, 20 bp, Homo sapiens
tgataaagttgagagacagt

SEQ ID NO: 6459791 - DNA, 16 bp, Homo sapiens
tgataaagtttctcag

SEQ ID NO: 6459792 - DNA, 13 bp, Homo sapiens
tgataaataaagt

SEQ ID NO: 6459793 - DNA, 19 bp, Homo sapiens
tgataaatagtgttattga

SEQ ID NO: 6459794 - DNA, 18 bp, Homo sapiens
tgataaatatatatgatc

SEQ ID NO: 6459795 - DNA, 15 bp, Homo sapiens
tgataaatcagtcaa

SEQ ID NO: 6459796 - DNA, 14 bp, Homo sapiens
tgataaatcatttt

SEQ ID NO: 6459797 - DNA, 18 bp, Homo sapiens
tgataaatcgggaaattt

SEQ ID NO: 6459798 - DNA, 20 bp, Homo sapiens
tgataaatctagaaaattga

SEQ ID NO: 6459799 - DNA, 16 bp, Homo sapiens
tgataaattactaatt

SEQ ID NO: 6459800 - DNA, 19 bp, Homo sapiens
tgataaattccactggact

SEQ ID NO: 6459801 - DNA, 21 bp, Homo sapiens
tgataaatttggccatgaaag

SEQ ID NO: 6459802 - DNA, 18 bp, Homo sapiens
tgataaattttaaaattg

SEQ ID NO: 6459803 - DNA, 18 bp, Homo sapiens
tgataacaacctggagac

SEQ ID NO: 6459804 - DNA, 16 bp, Homo sapiens
tgataacaacctttta

SEQ ID NO: 6459805 - DNA, 22 bp, Homo sapiens
tgataacaaccttttacattgt

SEQ ID NO: 6459806 - DNA, 21 bp, Homo sapiens
tgataacaatgttttaacaag

SEQ ID NO: 6459807 - DNA, 14 bp, Homo sapiens
tgataacactggag

SEQ ID NO: 6459808 - DNA, 21 bp, Homo sapiens
tgataacagggattgatttta

SEQ ID NO: 6459809 - DNA, 23 bp, Homo sapiens
tgataacagggattgattttaaa

SEQ ID NO: 6459810 - DNA, 17 bp, Homo sapiens
tgataacgtattttgat

SEQ ID NO: 6459811 - DNA, 20 bp, Homo sapiens
tgataactactgacgaaaga

SEQ ID NO: 6459812 - DNA, 22 bp, Homo sapiens
tgataactagatggtgctgaga

SEQ ID NO: 6459813 - DNA, 23 bp, Homo sapiens
tgataactagatggtgctgagaa

SEQ ID NO: 6459814 - DNA, 16 bp, Homo sapiens
tgataactatttacat

SEQ ID NO: 6459815 - DNA, 15 bp, Homo sapiens
tgataactgcatttg

SEQ ID NO: 6459816 - DNA, 19 bp, Homo sapiens
tgataacttggggaggcaa

SEQ ID NO: 6459817 - DNA, 20 bp, Homo sapiens
tgataagaacccagggtgga

SEQ ID NO: 6459818 - DNA, 13 bp, Homo sapiens
tgataagattgaa

SEQ ID NO: 6459819 - DNA, 15 bp, Homo sapiens
tgataagattgaaat

SEQ ID NO: 6459820 - DNA, 16 bp, Homo sapiens
tgataagcaggaagga

SEQ ID NO: 6459821 - DNA, 22 bp, Homo sapiens
tgataagccgaggaggcattct

SEQ ID NO: 6459822 - DNA, 19 bp, Homo sapiens
tgataagggactgatgttt

SEQ ID NO: 6459823 - DNA, 23 bp, Homo sapiens
tgataaggggccttgctctgagc

SEQ ID NO: 6459824 - DNA, 16 bp, Homo sapiens
tgataagtacttcctc

SEQ ID NO: 6459825 - DNA, 15 bp, Homo sapiens
tgataagtggaaaaa

SEQ ID NO: 6459826 - DNA, 18 bp, Homo sapiens
tgataagtggaaaaaaga

SEQ ID NO: 6459827 - DNA, 15 bp, Homo sapiens
tgataagttcataca

SEQ ID NO: 6459828 - DNA, 17 bp, Homo sapiens
tgataagttcatacatt

SEQ ID NO: 6459829 - DNA, 15 bp, Homo sapiens
tgataataaaattca

SEQ ID NO: 6459830 - DNA, 22 bp, Homo sapiens
tgataataaaattcattccatt

SEQ ID NO: 6459831 - DNA, 13 bp, Homo sapiens
tgataataaagga

SEQ ID NO: 6459832 - DNA, 18 bp, Homo sapiens
tgataataaagtgactga

SEQ ID NO: 6459833 - DNA, 18 bp, Homo sapiens
tgataataaattgaaatt

SEQ ID NO: 6459834 - DNA, 17 bp, Homo sapiens
tgataataatattgttt

SEQ ID NO: 6459835 - DNA, 14 bp, Homo sapiens
tgataataatgctt

SEQ ID NO: 6459836 - DNA, 13 bp, Homo sapiens
tgataatacccac

SEQ ID NO: 6459837 - DNA, 16 bp, Homo sapiens
tgataatacccacatt

SEQ ID NO: 6459838 - DNA, 13 bp, Homo sapiens
tgataatacttga

SEQ ID NO: 6459839 - DNA, 19 bp, Homo sapiens
tgataatacttgacctctg

SEQ ID NO: 6459840 - DNA, 22 bp, Homo sapiens
tgataatacttgacctctgtga

SEQ ID NO: 6459841 - DNA, 16 bp, Homo sapiens
tgataatagctcacag

SEQ ID NO: 6459842 - DNA, 19 bp, Homo sapiens
tgataatagctcacagcac

SEQ ID NO: 6459843 - DNA, 22 bp, Homo sapiens
tgataatagctcacagcacatt

SEQ ID NO: 6459844 - DNA, 18 bp, Homo sapiens
tgataataggtcatatgt

SEQ ID NO: 6459845 - DNA, 14 bp, Homo sapiens
tgataatatatatt

SEQ ID NO: 6459846 - DNA, 19 bp, Homo sapiens
tgataatattgtggtgcca

SEQ ID NO: 6459847 - DNA, 12 bp, Homo sapiens
tgataatcttca

SEQ ID NO: 6459848 - DNA, 18 bp, Homo sapiens
tgataatgatgatgacga

SEQ ID NO: 6459849 - DNA, 18 bp, Homo sapiens
tgataatgatttcctctg

SEQ ID NO: 6459850 - DNA, 21 bp, Homo sapiens
tgataatgatttgctctttga

SEQ ID NO: 6459851 - DNA, 21 bp, Homo sapiens
tgataatgcagataaatacat

SEQ ID NO: 6459852 - DNA, 13 bp, Homo sapiens
tgataatgttaaa

SEQ ID NO: 6459853 - DNA, 17 bp, Homo sapiens
tgataatgttaaatttg

SEQ ID NO: 6459854 - DNA, 13 bp, Homo sapiens
tgataattcttac

SEQ ID NO: 6459855 - DNA, 16 bp, Homo sapiens
tgataattcttatttt

SEQ ID NO: 6459856 - DNA, 16 bp, Homo sapiens
tgataattgcattcat

SEQ ID NO: 6459857 - DNA, 14 bp, Homo sapiens
tgataattgtaaag

SEQ ID NO: 6459858 - DNA, 18 bp, Homo sapiens
tgataattgtaaaggtga

SEQ ID NO: 6459859 - DNA, 24 bp, Homo sapiens
tgataattgtaaaggtgatgaatt

SEQ ID NO: 6459860 - DNA, 23 bp, Homo sapiens
tgataattgtgtattttctttgg

SEQ ID NO: 6459861 - DNA, 22 bp, Homo sapiens
tccttatgtatatttaaaagaa

SEQ ID NO: 6459862 - DNA, 18 bp, Homo sapiens
tccttatgtcctgtcata

SEQ ID NO: 6459863 - DNA, 15 bp, Homo sapiens
tccttatgtgtgtag

SEQ ID NO: 6459864 - DNA, 23 bp, Homo sapiens
tccttatgtttgaagagaaacct

SEQ ID NO: 6459865 - DNA, 13 bp, Homo sapiens
tccttattcttct

SEQ ID NO: 6459866 - DNA, 18 bp, Homo sapiens
tccttattgactgggtct

SEQ ID NO: 6459867 - DNA, 14 bp, Homo sapiens
tccttatttaagac

SEQ ID NO: 6459868 - DNA, 16 bp, Homo sapiens
tccttatttagcctag

SEQ ID NO: 6459869 - DNA, 11 bp, Homo sapiens
tccttatttat

SEQ ID NO: 6459870 - DNA, 23 bp, Homo sapiens
tccttatttcaagggttgcttct

SEQ ID NO: 6459871 - DNA, 23 bp, Homo sapiens
tccttatttctctctcctggtgt

SEQ ID NO: 6459872 - DNA, 16 bp, Homo sapiens
tccttatttgccttct

SEQ ID NO: 6459873 - DNA, 19 bp, Homo sapiens
tccttatttgccttctact

SEQ ID NO: 6459874 - DNA, 18 bp, Homo sapiens
tccttattttcataattc

SEQ ID NO: 6459875 - DNA, 20 bp, Homo sapiens
tccttcaaaatccttccaaa

SEQ ID NO: 6459876 - DNA, 15 bp, Homo sapiens
tccttcaaataaaga

SEQ ID NO: 6459877 - DNA, 16 bp, Homo sapiens
tccttcaaataaagaa

SEQ ID NO: 6459878 - DNA, 20 bp, Homo sapiens
tccttcaacaaggcttgctg

SEQ ID NO: 6459879 - DNA, 20 bp, Homo sapiens
tccttcaacaattctaaaat

SEQ ID NO: 6459880 - DNA, 17 bp, Homo sapiens
tccttcaaccaccattt

SEQ ID NO: 6459881 - DNA, 20 bp, Homo sapiens
tccttcaagttagctcagga

SEQ ID NO: 6459882 - DNA, 23 bp, Homo sapiens
tccttcaagttagctcaggaggc

SEQ ID NO: 6459883 - DNA, 15 bp, Homo sapiens
tccttcaattccata

SEQ ID NO: 6459884 - DNA, 15 bp, Homo sapiens
tccttcaattttctt

SEQ ID NO: 6459885 - DNA, 16 bp, Homo sapiens
tccttcacaatttcaa

SEQ ID NO: 6459886 - DNA, 19 bp, Homo sapiens
tccttcacaatttcaatgc

SEQ ID NO: 6459887 - DNA, 18 bp, Homo sapiens
tccttcacagatgggtgc

SEQ ID NO: 6459888 - DNA, 19 bp, Homo sapiens
tccttcacagatgggtgct

SEQ ID NO: 6459889 - DNA, 15 bp, Homo sapiens
tccttcacatcaccc

SEQ ID NO: 6459890 - DNA, 20 bp, Homo sapiens
tccttcacatcctgtgtttc

SEQ ID NO: 6459891 - DNA, 18 bp, Homo sapiens
tccttcacatctcccatg

SEQ ID NO: 6459892 - DNA, 16 bp, Homo sapiens
tccttcaccaccccca

SEQ ID NO: 6459893 - DNA, 19 bp, Homo sapiens
tccttcacccaccaccccc

SEQ ID NO: 6459894 - DNA, 17 bp, Homo sapiens
tccttcacctcactgaa

SEQ ID NO: 6459895 - DNA, 22 bp, Homo sapiens
tccttcacctttgtccccaccg

SEQ ID NO: 6459896 - DNA, 16 bp, Homo sapiens
tccttcactcatccag

SEQ ID NO: 6459897 - DNA, 16 bp, Homo sapiens
tccttcactctaaaaa

SEQ ID NO: 6459898 - DNA, 17 bp, Homo sapiens
tccttcactctaaaaat

SEQ ID NO: 6459899 - DNA, 18 bp, Homo sapiens
tccttcactggcgccttc

SEQ ID NO: 6459900 - DNA, 20 bp, Homo sapiens
tccttcactggcgccttctc

SEQ ID NO: 6459901 - DNA, 21 bp, Homo sapiens
tccttcactggcgccttctcg

SEQ ID NO: 6459902 - DNA, 22 bp, Homo sapiens
tccttcactgttccctctggct

SEQ ID NO: 6459903 - DNA, 13 bp, Homo sapiens
tccttcactgttt

SEQ ID NO: 6459904 - DNA, 15 bp, Homo sapiens
tccttcactgtttca

SEQ ID NO: 6459905 - DNA, 18 bp, Homo sapiens
tccttcagaagtttcgtc

SEQ ID NO: 6459906 - DNA, 12 bp, Homo sapiens
tccttcagacac

SEQ ID NO: 6459907 - DNA, 13 bp, Homo sapiens
tccttcagagagc

SEQ ID NO: 6459908 - DNA, 13 bp, Homo sapiens
tccttcagagctc

SEQ ID NO: 6459909 - DNA, 18 bp, Homo sapiens
tccttcagagtgaatcat

SEQ ID NO: 6459910 - DNA, 15 bp, Homo sapiens
tccttcagatatttt

SEQ ID NO: 6459911 - DNA, 17 bp, Homo sapiens
tccttcagatattttta

SEQ ID NO: 6459912 - DNA, 21 bp, Homo sapiens
tccttcagcagctagagctca

SEQ ID NO: 6459913 - DNA, 15 bp, Homo sapiens
tccttcagccctcac

SEQ ID NO: 6459914 - DNA, 13 bp, Homo sapiens
tccttcagcctga

SEQ ID NO: 6459915 - DNA, 12 bp, Homo sapiens
tccttcaggact

SEQ ID NO: 6459916 - DNA, 15 bp, Homo sapiens
tccttcaggactctg

SEQ ID NO: 6459917 - DNA, 13 bp, Homo sapiens
tccttcaggcagc

SEQ ID NO: 6459918 - DNA, 13 bp, Homo sapiens
tccttcagggatt

SEQ ID NO: 6459919 - DNA, 13 bp, Homo sapiens
tccttcaggtttt

SEQ ID NO: 6459920 - DNA, 21 bp, Homo sapiens
tccttcagtgagcccctcccc

SEQ ID NO: 6459921 - DNA, 11 bp, Homo sapiens
tccttcagtgc

SEQ ID NO: 6459922 - DNA, 12 bp, Homo sapiens
tccttcagtgca

SEQ ID NO: 6459923 - DNA, 13 bp, Homo sapiens
tccttcagtgcct

SEQ ID NO: 6459924 - DNA, 16 bp, Homo sapiens
tccttcagtgccttat

SEQ ID NO: 6459925 - DNA, 19 bp, Homo sapiens
tccttcagttctgcttgct

SEQ ID NO: 6459926 - DNA, 16 bp, Homo sapiens
tccttcatgcttttct

SEQ ID NO: 6459927 - DNA, 18 bp, Homo sapiens
tccttcatgcttttctca

SEQ ID NO: 6459928 - DNA, 21 bp, Homo sapiens
tccttcatgcttttctcatgg

SEQ ID NO: 6459929 - DNA, 14 bp, Homo sapiens
tccttcattcatag

SEQ ID NO: 6459930 - DNA, 18 bp, Homo sapiens
tccttccaaaaaattaaa

SEQ ID NO: 6459931 - DNA, 14 bp, Homo sapiens
tccttccaacagga

SEQ ID NO: 6459932 - DNA, 20 bp, Homo sapiens
tccttccaacaggagctggg

SEQ ID NO: 6459933 - DNA, 14 bp, Homo sapiens
tccttccaactgct

SEQ ID NO: 6459934 - DNA, 19 bp, Homo sapiens
tccttccaaggtcactctt

SEQ ID NO: 6459935 - DNA, 17 bp, Homo sapiens
tccttccacatgtacat

SEQ ID NO: 6459936 - DNA, 15 bp, Homo sapiens
tccttccaccaagtt

SEQ ID NO: 6459937 - DNA, 12 bp, Homo sapiens
tccttccacctc

SEQ ID NO: 6459938 - DNA, 14 bp, Homo sapiens
tccttccacctcag

SEQ ID NO: 6459939 - DNA, 14 bp, Homo sapiens
tccttccacctccc

SEQ ID NO: 6459940 - DNA, 17 bp, Homo sapiens
tccttccacctccctcc

SEQ ID NO: 6459941 - DNA, 13 bp, Homo sapiens
tccttccacctgc

SEQ ID NO: 6459942 - DNA, 13 bp, Homo sapiens
tccttccactgta

SEQ ID NO: 6459943 - DNA, 15 bp, Homo sapiens
tccttccactgtagc

SEQ ID NO: 6459944 - DNA, 15 bp, Homo sapiens
tccttccactgtgca

SEQ ID NO: 6459945 - DNA, 17 bp, Homo sapiens
tccttccagcccatcca

SEQ ID NO: 6459946 - DNA, 13 bp, Homo sapiens
tccttccagcctt

SEQ ID NO: 6459947 - DNA, 16 bp, Homo sapiens
tccttccagctagtga

SEQ ID NO: 6459948 - DNA, 14 bp, Homo sapiens
tccttccaggcccc

SEQ ID NO: 6459949 - DNA, 19 bp, Homo sapiens
tccttccaggccccaggct

SEQ ID NO: 6459950 - DNA, 21 bp, Homo sapiens
tccttccagggctcttccaga

SEQ ID NO: 6459951 - DNA, 21 bp, Homo sapiens
tccttccagtgtccttagaac

SEQ ID NO: 6459952 - DNA, 17 bp, Homo sapiens
tccttccatatccctgc

SEQ ID NO: 6459953 - DNA, 14 bp, Homo sapiens
tccttccatcctga

SEQ ID NO: 6459954 - DNA, 15 bp, Homo sapiens
tccttccatctcttc

SEQ ID NO: 6459955 - DNA, 13 bp, Homo sapiens
tccttccatcttg

SEQ ID NO: 6459956 - DNA, 14 bp, Homo sapiens
tccttccatcttgt

SEQ ID NO: 6459957 - DNA, 15 bp, Homo sapiens
tccttccatgctccc

SEQ ID NO: 6459958 - DNA, 19 bp, Homo sapiens
tccttccatttcttctgca

SEQ ID NO: 6459959 - DNA, 15 bp, Homo sapiens
tccttccattttcat

SEQ ID NO: 6459960 - DNA, 23 bp, Homo sapiens
tccttcccaaaggactccaccca

SEQ ID NO: 6459961 - DNA, 17 bp, Homo sapiens
tccttcccaactcactg

SEQ ID NO: 6459962 - DNA, 21 bp, Homo sapiens
tccttcccaactcactgtgct

SEQ ID NO: 6459963 - DNA, 23 bp, Homo sapiens
tccttcccaagaagagagaactt

SEQ ID NO: 6459964 - DNA, 18 bp, Homo sapiens
tccttcccaaggcagctg

SEQ ID NO: 6459965 - DNA, 19 bp, Homo sapiens
tccttcccaaggcagctgg

SEQ ID NO: 6459966 - DNA, 22 bp, Homo sapiens
tccttcccaagtaagaggctgg

SEQ ID NO: 6459967 - DNA, 17 bp, Homo sapiens
tccttcccaatcttctt

SEQ ID NO: 6459968 - DNA, 14 bp, Homo sapiens
tccttcccacggcc

SEQ ID NO: 6459969 - DNA, 20 bp, Homo sapiens
tccttcccacggccactgca

SEQ ID NO: 6459970 - DNA, 12 bp, Homo sapiens
tccttcccactc

SEQ ID NO: 6459971 - DNA, 14 bp, Homo sapiens
tccttcccactctt

SEQ ID NO: 6459972 - DNA, 17 bp, Homo sapiens
tccttcccactcttctc

SEQ ID NO: 6459973 - DNA, 19 bp, Homo sapiens
tccttcccactcttctcat

SEQ ID NO: 6459974 - DNA, 19 bp, Homo sapiens
tccttcccactgtcctttc

SEQ ID NO: 6459975 - DNA, 19 bp, Homo sapiens
tccttcccagcaacactcc

SEQ ID NO: 6459976 - DNA, 14 bp, Homo sapiens
tccttcccagctct

SEQ ID NO: 6459977 - DNA, 13 bp, Homo sapiens
tccttcccagctg

SEQ ID NO: 6459978 - DNA, 16 bp, Homo sapiens
tccttcccagctgccc

SEQ ID NO: 6459979 - DNA, 16 bp, Homo sapiens
tccttcccaggacccc

SEQ ID NO: 6459980 - DNA, 16 bp, Homo sapiens
tccttcccagggacca

SEQ ID NO: 6459981 - DNA, 17 bp, Homo sapiens
tccttcccagggaccag

SEQ ID NO: 6459982 - DNA, 14 bp, Homo sapiens
tccttcccatggag

SEQ ID NO: 6459983 - DNA, 18 bp, Homo sapiens
tccttcccatttctctac

SEQ ID NO: 6459984 - DNA, 9 bp, Homo sapiens
tccttcccc

SEQ ID NO: 6459985 - DNA, 17 bp, Homo sapiens
tccttccccaacttccc

SEQ ID NO: 6459986 - DNA, 14 bp, Homo sapiens
tccttccccacccc

SEQ ID NO: 6459987 - DNA, 14 bp, Homo sapiens
tccttccccagctc

SEQ ID NO: 6459988 - DNA, 16 bp, Homo sapiens
tccttccccagctccc

SEQ ID NO: 6459989 - DNA, 17 bp, Homo sapiens
tccttccccagctcccc

SEQ ID NO: 6459990 - DNA, 22 bp, Homo sapiens
tccttccccagctcccccaggc

SEQ ID NO: 6459991 - DNA, 24 bp, Homo sapiens
tccttccccagctcccccaggcag

SEQ ID NO: 6459992 - DNA, 13 bp, Homo sapiens
tccttccccagga

SEQ ID NO: 6459993 - DNA, 17 bp, Homo sapiens
tccttccccatttccac

SEQ ID NO: 6459994 - DNA, 18 bp, Homo sapiens
tccttcccccagcacaaa

SEQ ID NO: 6459995 - DNA, 17 bp, Homo sapiens
tccttcccccagcccaa

SEQ ID NO: 6459996 - DNA, 18 bp, Homo sapiens
tccttcccccagcccaat

SEQ ID NO: 6459997 - DNA, 20 bp, Homo sapiens
tccttcccccagcccaataa

SEQ ID NO: 6459998 - DNA, 23 bp, Homo sapiens
tccttcccccatcccctttcctc

SEQ ID NO: 6459999 - DNA, 17 bp, Homo sapiens
tccttccccccatctct

SEQ ID NO: 6460000 - DNA, 10 bp, Homo sapiens
tccttcccct

SEQ ID NO: 6460001 - DNA, 16 bp, Homo sapiens
tccttcccctcttctt

SEQ ID NO: 6460002 - DNA, 16 bp, Homo sapiens
tccttccccttccccg

SEQ ID NO: 6460003 - DNA, 18 bp, Homo sapiens
tccttccccttgtccctg

SEQ ID NO: 6460004 - DNA, 17 bp, Homo sapiens
tccttcccctttcccca

SEQ ID NO: 6460005 - DNA, 23 bp, Homo sapiens
tccttcccgcagcaccagcctga

SEQ ID NO: 6460006 - DNA, 23 bp, Homo sapiens
tccttccctaactcaactgttgc

SEQ ID NO: 6460007 - DNA, 22 bp, Homo sapiens
tccttccctaatagctttttaa

SEQ ID NO: 6460008 - DNA, 13 bp, Homo sapiens
tccttccctaccc

SEQ ID NO: 6460009 - DNA, 13 bp, Homo sapiens
tccttccctaggc

SEQ ID NO: 6460010 - DNA, 22 bp, Homo sapiens
tccttccctaggcacctctgtg

SEQ ID NO: 6460011 - DNA, 17 bp, Homo sapiens
tccttccctcaaagctt

SEQ ID NO: 6460012 - DNA, 14 bp, Homo sapiens
tccttccctcaccc

SEQ ID NO: 6460013 - DNA, 20 bp, Homo sapiens
tccttccctcacccccagca

SEQ ID NO: 6460014 - DNA, 21 bp, Homo sapiens
tccttccctcatgcccgccag

SEQ ID NO: 6460015 - DNA, 12 bp, Homo sapiens
tccttccctctc

SEQ ID NO: 6460016 - DNA, 22 bp, Homo sapiens
tccttccctctttccccacctc

SEQ ID NO: 6460017 - DNA, 14 bp, Homo sapiens
tccttccctgcaga

SEQ ID NO: 6460018 - DNA, 14 bp, Homo sapiens
tccttccctgccac

SEQ ID NO: 6460019 - DNA, 14 bp, Homo sapiens
tccttccctgctgt

SEQ ID NO: 6460020 - DNA, 12 bp, Homo sapiens
tccttccctggc

SEQ ID NO: 6460021 - DNA, 14 bp, Homo sapiens
tccttccctggctt

SEQ ID NO: 6460022 - DNA, 19 bp, Homo sapiens
tccttccctgggctgtgct

SEQ ID NO: 6460023 - DNA, 16 bp, Homo sapiens
tccttccctggtccag

SEQ ID NO: 6460024 - DNA, 12 bp, Homo sapiens
tccttccctgta

SEQ ID NO: 6460025 - DNA, 18 bp, Homo sapiens
tccttccctgtgtctttt

SEQ ID NO: 6460026 - DNA, 21 bp, Homo sapiens
tccttccctgttctccctttc

SEQ ID NO: 6460027 - DNA, 15 bp, Homo sapiens
tccttcccttctcca

SEQ ID NO: 6460028 - DNA, 17 bp, Homo sapiens
tccttcccttctctcct

SEQ ID NO: 6460029 - DNA, 16 bp, Homo sapiens
tccttcccttctcttg

SEQ ID NO: 6460030 - DNA, 21 bp, Homo sapiens
tccttccgccaatctggccct

SEQ ID NO: 6460031 - DNA, 15 bp, Homo sapiens
tccttccgctccttt

SEQ ID NO: 6460032 - DNA, 16 bp, Homo sapiens
tccttccgctctgagg

SEQ ID NO: 6460033 - DNA, 16 bp, Homo sapiens
tccttccgcttggagc

SEQ ID NO: 6460034 - DNA, 23 bp, Homo sapiens
tccttccgcttggagctattttc

SEQ ID NO: 6460035 - DNA, 23 bp, Homo sapiens
tccttcctaaattttcctgtcct

SEQ ID NO: 6460036 - DNA, 23 bp, Homo sapiens
tccttcctacacccttggacttg

SEQ ID NO: 6460037 - DNA, 13 bp, Homo sapiens
tccttcctaccct

SEQ ID NO: 6460038 - DNA, 16 bp, Homo sapiens
tccttcctatgcccag

SEQ ID NO: 6460039 - DNA, 18 bp, Homo sapiens
tccttcctcagatgatgt

SEQ ID NO: 6460040 - DNA, 18 bp, Homo sapiens
tccttcctcagtcctgga

SEQ ID NO: 6460041 - DNA, 16 bp, Homo sapiens
tccttcctctgagcct

SEQ ID NO: 6460042 - DNA, 13 bp, Homo sapiens
tgataatttaaga

SEQ ID NO: 6460043 - DNA, 18 bp, Homo sapiens
tgataatttaagagctaa

SEQ ID NO: 6460044 - DNA, 21 bp, Homo sapiens
tgataatttcagggaaattaa

SEQ ID NO: 6460045 - DNA, 14 bp, Homo sapiens
tgataattttaaat

SEQ ID NO: 6460046 - DNA, 13 bp, Homo sapiens
tgataattttcct

SEQ ID NO: 6460047 - DNA, 19 bp, Homo sapiens
tgataattttcctttaata

SEQ ID NO: 6460048 - DNA, 15 bp, Homo sapiens
tgataattttgaaat

SEQ ID NO: 6460049 - DNA, 11 bp, Homo sapiens
tgatacaaaga

SEQ ID NO: 6460050 - DNA, 20 bp, Homo sapiens
tgatacaaattgcagactgt

SEQ ID NO: 6460051 - DNA, 19 bp, Homo sapiens
tgatacaacaggattttca

SEQ ID NO: 6460052 - DNA, 21 bp, Homo sapiens
tgatacaacaggattttcaag

SEQ ID NO: 6460053 - DNA, 23 bp, Homo sapiens
tgatacaacaggattttcaagtt

SEQ ID NO: 6460054 - DNA, 20 bp, Homo sapiens
tgatacaagagtcagcatca

SEQ ID NO: 6460055 - DNA, 18 bp, Homo sapiens
tgatacaatgctgtgccc

SEQ ID NO: 6460056 - DNA, 12 bp, Homo sapiens
tgatacacagta

SEQ ID NO: 6460057 - DNA, 17 bp, Homo sapiens
tgatacacagtaattgt

SEQ ID NO: 6460058 - DNA, 20 bp, Homo sapiens
tgatacacagtaattgtgac

SEQ ID NO: 6460059 - DNA, 23 bp, Homo sapiens
tgatacactatgaagatgtttca

SEQ ID NO: 6460060 - DNA, 19 bp, Homo sapiens
tgatacagagtatatttcc

SEQ ID NO: 6460061 - DNA, 20 bp, Homo sapiens
tgatacagtcaacaagcctg

SEQ ID NO: 6460062 - DNA, 13 bp, Homo sapiens
tgatacagttttg

SEQ ID NO: 6460063 - DNA, 16 bp, Homo sapiens
tgatacataaaaatta

SEQ ID NO: 6460064 - DNA, 16 bp, Homo sapiens
tgatacataactaaat

SEQ ID NO: 6460065 - DNA, 19 bp, Homo sapiens
tgatacataactaaatttg

SEQ ID NO: 6460066 - DNA, 13 bp, Homo sapiens
tgatacattcaaa

SEQ ID NO: 6460067 - DNA, 15 bp, Homo sapiens
tgatacatttacata

SEQ ID NO: 6460068 - DNA, 20 bp, Homo sapiens
tgatacatttatcttctgtt

SEQ ID NO: 6460069 - DNA, 21 bp, Homo sapiens
tgataccagcagcaactgaaa

SEQ ID NO: 6460070 - DNA, 14 bp, Homo sapiens
tgataccagctgga

SEQ ID NO: 6460071 - DNA, 19 bp, Homo sapiens
tgataccatatgaatgaaa

SEQ ID NO: 6460072 - DNA, 17 bp, Homo sapiens
tgatacccaacagttta

SEQ ID NO: 6460073 - DNA, 20 bp, Homo sapiens
tgatacccaacagtttattt

SEQ ID NO: 6460074 - DNA, 15 bp, Homo sapiens
tgatacccccctctg

SEQ ID NO: 6460075 - DNA, 22 bp, Homo sapiens
tgatacccctggggaacatttc

SEQ ID NO: 6460076 - DNA, 19 bp, Homo sapiens
tgatacctattaaaggaaa

SEQ ID NO: 6460077 - DNA, 21 bp, Homo sapiens
tgatacctattaaaggaaaac

SEQ ID NO: 6460078 - DNA, 17 bp, Homo sapiens
tgatacctgcctgggac

SEQ ID NO: 6460079 - DNA, 12 bp, Homo sapiens
tgataccttcaa

SEQ ID NO: 6460080 - DNA, 13 bp, Homo sapiens
tgataccttcaat

SEQ ID NO: 6460081 - DNA, 18 bp, Homo sapiens
tgataccttcatttaata

SEQ ID NO: 6460082 - DNA, 21 bp, Homo sapiens
tgatacgtccgtgtgtcccag

SEQ ID NO: 6460083 - DNA, 17 bp, Homo sapiens
tgatacgtgtgtgaagt

SEQ ID NO: 6460084 - DNA, 22 bp, Homo sapiens
tgatacgtgtgtgaagtatttt

SEQ ID NO: 6460085 - DNA, 14 bp, Homo sapiens
tgatactaagcatt

SEQ ID NO: 6460086 - DNA, 16 bp, Homo sapiens
tgatactaataaacta

SEQ ID NO: 6460087 - DNA, 15 bp, Homo sapiens
tgatactaccagggt

SEQ ID NO: 6460088 - DNA, 20 bp, Homo sapiens
tgatactactagatcacttg

SEQ ID NO: 6460089 - DNA, 18 bp, Homo sapiens
tgatactatccagttact

SEQ ID NO: 6460090 - DNA, 13 bp, Homo sapiens
tgatactattcag

SEQ ID NO: 6460091 - DNA, 22 bp, Homo sapiens
tgatactccaccagtgaaaatt

SEQ ID NO: 6460092 - DNA, 22 bp, Homo sapiens
tgatactgaattgttatgtaaa

SEQ ID NO: 6460093 - DNA, 13 bp, Homo sapiens
tgatactgatggt

SEQ ID NO: 6460094 - DNA, 17 bp, Homo sapiens
tgatactgattatgaaa

SEQ ID NO: 6460095 - DNA, 17 bp, Homo sapiens
tgatactggctcagaag

SEQ ID NO: 6460096 - DNA, 20 bp, Homo sapiens
tgatactgtctaagaataat

SEQ ID NO: 6460097 - DNA, 21 bp, Homo sapiens
tgatactgtgtgttttcccaa

SEQ ID NO: 6460098 - DNA, 14 bp, Homo sapiens
tgatactgttgcac

SEQ ID NO: 6460099 - DNA, 18 bp, Homo sapiens
tgatactgttgcacgtgt

SEQ ID NO: 6460100 - DNA, 20 bp, Homo sapiens
tgatactgttgcacgtgtgt

SEQ ID NO: 6460101 - DNA, 16 bp, Homo sapiens
tgatactgtttcttgc

SEQ ID NO: 6460102 - DNA, 21 bp, Homo sapiens
tgatactgtttcttgcactga

SEQ ID NO: 6460103 - DNA, 22 bp, Homo sapiens
tgatacttatattttcgtatga

SEQ ID NO: 6460104 - DNA, 18 bp, Homo sapiens
tgatacttcaggtgcttt

SEQ ID NO: 6460105 - DNA, 20 bp, Homo sapiens
tgatacttcaggtgcttttg

SEQ ID NO: 6460106 - DNA, 12 bp, Homo sapiens
tgatacttccaa

SEQ ID NO: 6460107 - DNA, 20 bp, Homo sapiens
tgatacttcgacactgttct

SEQ ID NO: 6460108 - DNA, 21 bp, Homo sapiens
tgatacttcgacactgttctt

SEQ ID NO: 6460109 - DNA, 14 bp, Homo sapiens
tgatacttgaattt

SEQ ID NO: 6460110 - DNA, 13 bp, Homo sapiens
tgatacttgtaac

SEQ ID NO: 6460111 - DNA, 17 bp, Homo sapiens
tgatacttgtaactttt

SEQ ID NO: 6460112 - DNA, 19 bp, Homo sapiens
tgatacttgttccagatgg

SEQ ID NO: 6460113 - DNA, 18 bp, Homo sapiens
tgatactttagccatcat

SEQ ID NO: 6460114 - DNA, 13 bp, Homo sapiens
tgatagaacaaaa

SEQ ID NO: 6460115 - DNA, 16 bp, Homo sapiens
tgatagaacaaaagag

SEQ ID NO: 6460116 - DNA, 14 bp, Homo sapiens
tgatagaactgtac

SEQ ID NO: 6460117 - DNA, 15 bp, Homo sapiens
tgatagaactgtact

SEQ ID NO: 6460118 - DNA, 22 bp, Homo sapiens
tgatagaactgtactgttttct

SEQ ID NO: 6460119 - DNA, 23 bp, Homo sapiens
tgatagaagaaggactgaagaaa

SEQ ID NO: 6460120 - DNA, 16 bp, Homo sapiens
tgatagaatgatgttt

SEQ ID NO: 6460121 - DNA, 21 bp, Homo sapiens
tgatagacacatatgaggggg

SEQ ID NO: 6460122 - DNA, 22 bp, Homo sapiens
tgatagacacatatgaggggga

SEQ ID NO: 6460123 - DNA, 19 bp, Homo sapiens
tgatagacttcgaaaacag

SEQ ID NO: 6460124 - DNA, 21 bp, Homo sapiens
tgatagacttcgaaaacagat

SEQ ID NO: 6460125 - DNA, 19 bp, Homo sapiens
tgatagactttgtgaatct

SEQ ID NO: 6460126 - DNA, 16 bp, Homo sapiens
tgatagagcctttgat

SEQ ID NO: 6460127 - DNA, 15 bp, Homo sapiens
tgatagagtgatttt

SEQ ID NO: 6460128 - DNA, 22 bp, Homo sapiens
tgatagagtttaacagatattt

SEQ ID NO: 6460129 - DNA, 18 bp, Homo sapiens
tgatagatcctttaaaaa

SEQ ID NO: 6460130 - DNA, 12 bp, Homo sapiens
tgatagatttga

SEQ ID NO: 6460131 - DNA, 16 bp, Homo sapiens
tgatagcaaaatcaag

SEQ ID NO: 6460132 - DNA, 20 bp, Homo sapiens
tgatagcaagcgttattttg

SEQ ID NO: 6460133 - DNA, 20 bp, Homo sapiens
tgatagcacagaccctgccc

SEQ ID NO: 6460134 - DNA, 21 bp, Homo sapiens
tgatagcacagaccctgccct

SEQ ID NO: 6460135 - DNA, 23 bp, Homo sapiens
tgatagcacagaccctgccctgt

SEQ ID NO: 6460136 - DNA, 15 bp, Homo sapiens
tgatagcactggttt

SEQ ID NO: 6460137 - DNA, 21 bp, Homo sapiens
tgatagcactggtttgtttct

SEQ ID NO: 6460138 - DNA, 14 bp, Homo sapiens
tgatagcactttct

SEQ ID NO: 6460139 - DNA, 15 bp, Homo sapiens
tgatagcactttcta

SEQ ID NO: 6460140 - DNA, 14 bp, Homo sapiens
tgatagcattgtaa

SEQ ID NO: 6460141 - DNA, 23 bp, Homo sapiens
tgatagcccagaacaaaaagaaa

SEQ ID NO: 6460142 - DNA, 22 bp, Homo sapiens
tgatagctaaataacttgccat

SEQ ID NO: 6460143 - DNA, 16 bp, Homo sapiens
tgatagctaacatttt

SEQ ID NO: 6460144 - DNA, 18 bp, Homo sapiens
tgatagctaacattttaa

SEQ ID NO: 6460145 - DNA, 21 bp, Homo sapiens
tgatagctaacattttaaata

SEQ ID NO: 6460146 - DNA, 19 bp, Homo sapiens
tgatagctactgtagaaag

SEQ ID NO: 6460147 - DNA, 15 bp, Homo sapiens
tgatagctggggctt

SEQ ID NO: 6460148 - DNA, 16 bp, Homo sapiens
tgatagcttacactga

SEQ ID NO: 6460149 - DNA, 16 bp, Homo sapiens
tgataggaaaagaagg

SEQ ID NO: 6460150 - DNA, 18 bp, Homo sapiens
tgataggaactgtctcaa

SEQ ID NO: 6460151 - DNA, 13 bp, Homo sapiens
tgataggaggggg

SEQ ID NO: 6460152 - DNA, 21 bp, Homo sapiens
tgataggccctggatgtgccc

SEQ ID NO: 6460153 - DNA, 15 bp, Homo sapiens
tgatagggaactggg

SEQ ID NO: 6460154 - DNA, 19 bp, Homo sapiens
tgatagggtaaggggaggc

SEQ ID NO: 6460155 - DNA, 22 bp, Homo sapiens
tgataggttattttgatgtaaa

SEQ ID NO: 6460156 - DNA, 15 bp, Homo sapiens
tgatagtatttataa

SEQ ID NO: 6460157 - DNA, 21 bp, Homo sapiens
tgatagtccaatttttactca

SEQ ID NO: 6460158 - DNA, 16 bp, Homo sapiens
tgatagtcctttttcc

SEQ ID NO: 6460159 - DNA, 22 bp, Homo sapiens
tgatagtgactagcactagaca

SEQ ID NO: 6460160 - DNA, 18 bp, Homo sapiens
tgatagtgtaaacaaata

SEQ ID NO: 6460161 - DNA, 14 bp, Homo sapiens
tgatagtgtgattt

SEQ ID NO: 6460162 - DNA, 15 bp, Homo sapiens
tgatagtgtgatttt

SEQ ID NO: 6460163 - DNA, 16 bp, Homo sapiens
tgatagtgtgattttt

SEQ ID NO: 6460164 - DNA, 18 bp, Homo sapiens
tgatagtgttttgtactt

SEQ ID NO: 6460165 - DNA, 13 bp, Homo sapiens
tgatagttactgt

SEQ ID NO: 6460166 - DNA, 16 bp, Homo sapiens
tgatagttactgttgt

SEQ ID NO: 6460167 - DNA, 22 bp, Homo sapiens
tgatagttgaagggaggtgaag

SEQ ID NO: 6460168 - DNA, 14 bp, Homo sapiens
tgatagttgaatgt

SEQ ID NO: 6460169 - DNA, 13 bp, Homo sapiens
tgatagtttacaa

SEQ ID NO: 6460170 - DNA, 14 bp, Homo sapiens
tgatagtttacaaa

SEQ ID NO: 6460171 - DNA, 14 bp, Homo sapiens
tgatagtttcattt

SEQ ID NO: 6460172 - DNA, 22 bp, Homo sapiens
tgatagttttctagatgacata

SEQ ID NO: 6460173 - DNA, 15 bp, Homo sapiens
tgatataaagaatga

SEQ ID NO: 6460174 - DNA, 19 bp, Homo sapiens
tgatataaagaatgaaagt

SEQ ID NO: 6460175 - DNA, 20 bp, Homo sapiens
tgatataaaggaccctgttt

SEQ ID NO: 6460176 - DNA, 22 bp, Homo sapiens
tgatataaaggaccctgtttct

SEQ ID NO: 6460177 - DNA, 13 bp, Homo sapiens
tgatataaatgca

SEQ ID NO: 6460178 - DNA, 16 bp, Homo sapiens
tgatataaatgcaata

SEQ ID NO: 6460179 - DNA, 12 bp, Homo sapiens
tgatataaattc

SEQ ID NO: 6460180 - DNA, 14 bp, Homo sapiens
tgatataatatcat

SEQ ID NO: 6460181 - DNA, 23 bp, Homo sapiens
tgatataatcttggcttcttaaa

SEQ ID NO: 6460182 - DNA, 16 bp, Homo sapiens
tgatataatctttcaa

SEQ ID NO: 6460183 - DNA, 17 bp, Homo sapiens
tgatataattgtactgt

SEQ ID NO: 6460184 - DNA, 18 bp, Homo sapiens
tgatataatttccatagt

SEQ ID NO: 6460185 - DNA, 13 bp, Homo sapiens
tgatatacacagt

SEQ ID NO: 6460186 - DNA, 13 bp, Homo sapiens
tgatatacattgt

SEQ ID NO: 6460187 - DNA, 16 bp, Homo sapiens
tgatatagaaagctgt

SEQ ID NO: 6460188 - DNA, 22 bp, Homo sapiens
tgatatagaacagtgcttgcca

SEQ ID NO: 6460189 - DNA, 18 bp, Homo sapiens
tgatatagaattagcttt

SEQ ID NO: 6460190 - DNA, 22 bp, Homo sapiens
tgatatagaattagctttttca

SEQ ID NO: 6460191 - DNA, 20 bp, Homo sapiens
tgatatagagtgacttggag

SEQ ID NO: 6460192 - DNA, 18 bp, Homo sapiens
tgatataggaaaatacat

SEQ ID NO: 6460193 - DNA, 21 bp, Homo sapiens
tgatatagtcagctgcctttt

SEQ ID NO: 6460194 - DNA, 15 bp, Homo sapiens
tgatatagtgctgtt

SEQ ID NO: 6460195 - DNA, 14 bp, Homo sapiens
tgatatataaacct

SEQ ID NO: 6460196 - DNA, 19 bp, Homo sapiens
tgatatataagtgtacata

SEQ ID NO: 6460197 - DNA, 19 bp, Homo sapiens
tgatatataatttcctcac

SEQ ID NO: 6460198 - DNA, 15 bp, Homo sapiens
tgatatatatgtata

SEQ ID NO: 6460199 - DNA, 20 bp, Homo sapiens
tgatatatgagactttatgt

SEQ ID NO: 6460200 - DNA, 16 bp, Homo sapiens
tgatatatggataatg

SEQ ID NO: 6460201 - DNA, 13 bp, Homo sapiens
tgatatatgtatt

SEQ ID NO: 6460202 - DNA, 14 bp, Homo sapiens
tgatatatgtattt

SEQ ID NO: 6460203 - DNA, 13 bp, Homo sapiens
tgatatatgtgtt

SEQ ID NO: 6460204 - DNA, 22 bp, Homo sapiens
tgatatattctttccatgcagt

SEQ ID NO: 6460205 - DNA, 22 bp, Homo sapiens
tgatatatttataaatatgtga

SEQ ID NO: 6460206 - DNA, 13 bp, Homo sapiens
tgatatattttac

SEQ ID NO: 6460207 - DNA, 14 bp, Homo sapiens
tgatatattttcca

SEQ ID NO: 6460208 - DNA, 20 bp, Homo sapiens
tgatatcaacagcttcccta

SEQ ID NO: 6460209 - DNA, 13 bp, Homo sapiens
tgatatcacctct

SEQ ID NO: 6460210 - DNA, 20 bp, Homo sapiens
tgatatcacctctcttcagc

SEQ ID NO: 6460211 - DNA, 18 bp, Homo sapiens
tgatatcacgggcccgct

SEQ ID NO: 6460212 - DNA, 14 bp, Homo sapiens
tgatatcattgttg

SEQ ID NO: 6460213 - DNA, 21 bp, Homo sapiens
tgatatccacaaatgctattc

SEQ ID NO: 6460214 - DNA, 19 bp, Homo sapiens
tgatatccagtaagcacat

SEQ ID NO: 6460215 - DNA, 21 bp, Homo sapiens
tgatatccattctttctgata

SEQ ID NO: 6460216 - DNA, 12 bp, Homo sapiens
tgatatccctga

SEQ ID NO: 6460217 - DNA, 18 bp, Homo sapiens
tgatatccctgatcctaa

SEQ ID NO: 6460218 - DNA, 19 bp, Homo sapiens
tgatatcgtgaaatcctca

SEQ ID NO: 6460219 - DNA, 15 bp, Homo sapiens
tgatatctataaaat

SEQ ID NO: 6460220 - DNA, 15 bp, Homo sapiens
tccttcctcttggct

SEQ ID NO: 6460221 - DNA, 15 bp, Homo sapiens
tccttcctgattgtt

SEQ ID NO: 6460222 - DNA, 20 bp, Homo sapiens
tccttcctgattgtttacag

SEQ ID NO: 6460223 - DNA, 18 bp, Homo sapiens
tccttcctgcagacctgg

SEQ ID NO: 6460224 - DNA, 13 bp, Homo sapiens
tccttcctgccct

SEQ ID NO: 6460225 - DNA, 19 bp, Homo sapiens
tccttcctgccctgtacct

SEQ ID NO: 6460226 - DNA, 22 bp, Homo sapiens
tccttcctgccctgtacctctc

SEQ ID NO: 6460227 - DNA, 11 bp, Homo sapiens
tccttcctgcg

SEQ ID NO: 6460228 - DNA, 15 bp, Homo sapiens
tccttcctggcctga

SEQ ID NO: 6460229 - DNA, 17 bp, Homo sapiens
tccttcctggcctgaga

SEQ ID NO: 6460230 - DNA, 18 bp, Homo sapiens
tccttcctgggaccccct

SEQ ID NO: 6460231 - DNA, 23 bp, Homo sapiens
tccttcctgggaccccctcgcca

SEQ ID NO: 6460232 - DNA, 19 bp, Homo sapiens
tccttcctgtcttcctgca

SEQ ID NO: 6460233 - DNA, 14 bp, Homo sapiens
tccttcctgtggcc

SEQ ID NO: 6460234 - DNA, 17 bp, Homo sapiens
tccttcctgtgggtggg

SEQ ID NO: 6460235 - DNA, 16 bp, Homo sapiens
tccttcctgttctgaa

SEQ ID NO: 6460236 - DNA, 14 bp, Homo sapiens
tccttccttcagga

SEQ ID NO: 6460237 - DNA, 17 bp, Homo sapiens
tccttccttcaggactc

SEQ ID NO: 6460238 - DNA, 13 bp, Homo sapiens
tccttccttccat

SEQ ID NO: 6460239 - DNA, 16 bp, Homo sapiens
tccttccttccctggc

SEQ ID NO: 6460240 - DNA, 16 bp, Homo sapiens
tccttccttgactgtc

SEQ ID NO: 6460241 - DNA, 15 bp, Homo sapiens
tccttcgaaaggcct

SEQ ID NO: 6460242 - DNA, 19 bp, Homo sapiens
tccttcgagggttccaggc

SEQ ID NO: 6460243 - DNA, 14 bp, Homo sapiens
tccttcgctttcct

SEQ ID NO: 6460244 - DNA, 23 bp, Homo sapiens
tccttcggggcgatgctccctca

SEQ ID NO: 6460245 - DNA, 17 bp, Homo sapiens
tccttcgtatcccgagt

SEQ ID NO: 6460246 - DNA, 21 bp, Homo sapiens
tccttcgtgaacatcccctcc

SEQ ID NO: 6460247 - DNA, 23 bp, Homo sapiens
tccttcgtgaacatcccctccca

SEQ ID NO: 6460248 - DNA, 18 bp, Homo sapiens
tccttcgtgtctctccca

SEQ ID NO: 6460249 - DNA, 19 bp, Homo sapiens
tccttcgtgtctctcccac

SEQ ID NO: 6460250 - DNA, 19 bp, Homo sapiens
tccttctaatgaagacaat

SEQ ID NO: 6460251 - DNA, 21 bp, Homo sapiens
tccttctaccccaaggccagt

SEQ ID NO: 6460252 - DNA, 16 bp, Homo sapiens
tccttctagtttccca

SEQ ID NO: 6460253 - DNA, 14 bp, Homo sapiens
tccttctcactgcc

SEQ ID NO: 6460254 - DNA, 14 bp, Homo sapiens
tccttctcatcttg

SEQ ID NO: 6460255 - DNA, 14 bp, Homo sapiens
tccttctccccaag

SEQ ID NO: 6460256 - DNA, 14 bp, Homo sapiens
tccttctcccctcc

SEQ ID NO: 6460257 - DNA, 21 bp, Homo sapiens
tccttctcccctccagacccc

SEQ ID NO: 6460258 - DNA, 13 bp, Homo sapiens
tccttctcccctg

SEQ ID NO: 6460259 - DNA, 14 bp, Homo sapiens
tccttctcccctgc

SEQ ID NO: 6460260 - DNA, 16 bp, Homo sapiens
tccttctcctcttgta

SEQ ID NO: 6460261 - DNA, 20 bp, Homo sapiens
tccttctcgtcttcctctct

SEQ ID NO: 6460262 - DNA, 18 bp, Homo sapiens
tccttctctagtttcccc

SEQ ID NO: 6460263 - DNA, 18 bp, Homo sapiens
tccttctctgaacacagg

SEQ ID NO: 6460264 - DNA, 21 bp, Homo sapiens
tccttctctgggtctgatttt

SEQ ID NO: 6460265 - DNA, 23 bp, Homo sapiens
tccttctctgggtctgattttct

SEQ ID NO: 6460266 - DNA, 19 bp, Homo sapiens
tccttctctttcaatgtgt

SEQ ID NO: 6460267 - DNA, 14 bp, Homo sapiens
tccttctgaaaata

SEQ ID NO: 6460268 - DNA, 11 bp, Homo sapiens
tccttctgaag

SEQ ID NO: 6460269 - DNA, 12 bp, Homo sapiens
tccttctgaagt

SEQ ID NO: 6460270 - DNA, 19 bp, Homo sapiens
tccttctgaagtctgagcc

SEQ ID NO: 6460271 - DNA, 18 bp, Homo sapiens
tccttctgagctccacct

SEQ ID NO: 6460272 - DNA, 22 bp, Homo sapiens
tccttctgagctccacctctgg

SEQ ID NO: 6460273 - DNA, 16 bp, Homo sapiens
tccttctgatctgaga

SEQ ID NO: 6460274 - DNA, 22 bp, Homo sapiens
tccttctgcaaagtggcaggga

SEQ ID NO: 6460275 - DNA, 19 bp, Homo sapiens
tccttctgcaactgaaatt

SEQ ID NO: 6460276 - DNA, 22 bp, Homo sapiens
tccttctgcaactgaaattaca

SEQ ID NO: 6460277 - DNA, 14 bp, Homo sapiens
tccttctgcaccca

SEQ ID NO: 6460278 - DNA, 21 bp, Homo sapiens
tccttctgccagttccctccc

SEQ ID NO: 6460279 - DNA, 18 bp, Homo sapiens
tccttctgcccttcctcc

SEQ ID NO: 6460280 - DNA, 21 bp, Homo sapiens
tccttctgcccttcctccagg

SEQ ID NO: 6460281 - DNA, 12 bp, Homo sapiens
tccttctgcctt

SEQ ID NO: 6460282 - DNA, 17 bp, Homo sapiens
tccttctgctcccaccc

SEQ ID NO: 6460283 - DNA, 19 bp, Homo sapiens
tccttctgctcccacccca

SEQ ID NO: 6460284 - DNA, 22 bp, Homo sapiens
tccttctgctcccaccccagaa

SEQ ID NO: 6460285 - DNA, 13 bp, Homo sapiens
tccttctggcctt

SEQ ID NO: 6460286 - DNA, 13 bp, Homo sapiens
tccttctggttct

SEQ ID NO: 6460287 - DNA, 16 bp, Homo sapiens
tccttctgtagtgtat

SEQ ID NO: 6460288 - DNA, 20 bp, Homo sapiens
tccttctgtgaaagtacatt

SEQ ID NO: 6460289 - DNA, 23 bp, Homo sapiens
tccttctgtgaagaagccctgtt

SEQ ID NO: 6460290 - DNA, 12 bp, Homo sapiens
tccttctgtgtt

SEQ ID NO: 6460291 - DNA, 16 bp, Homo sapiens
tccttctgttaagaaa

SEQ ID NO: 6460292 - DNA, 14 bp, Homo sapiens
tccttcttccactt

SEQ ID NO: 6460293 - DNA, 18 bp, Homo sapiens
tccttcttcctcaagtct

SEQ ID NO: 6460294 - DNA, 13 bp, Homo sapiens
tccttcttgccct

SEQ ID NO: 6460295 - DNA, 16 bp, Homo sapiens
tccttcttgctcagtc

SEQ ID NO: 6460296 - DNA, 19 bp, Homo sapiens
tccttcttggcttcctggc

SEQ ID NO: 6460297 - DNA, 16 bp, Homo sapiens
tccttcttgtagtagt

SEQ ID NO: 6460298 - DNA, 12 bp, Homo sapiens
tccttctttaaa

SEQ ID NO: 6460299 - DNA, 17 bp, Homo sapiens
tccttctttcacaggca

SEQ ID NO: 6460300 - DNA, 12 bp, Homo sapiens
tccttctttcct

SEQ ID NO: 6460301 - DNA, 13 bp, Homo sapiens
tccttctttcctt

SEQ ID NO: 6460302 - DNA, 17 bp, Homo sapiens
tccttctttccttgttc

SEQ ID NO: 6460303 - DNA, 12 bp, Homo sapiens
tccttctttctc

SEQ ID NO: 6460304 - DNA, 19 bp, Homo sapiens
tccttctttgccctttact

SEQ ID NO: 6460305 - DNA, 15 bp, Homo sapiens
tccttctttgtctta

SEQ ID NO: 6460306 - DNA, 16 bp, Homo sapiens
tccttgaaaataaaaa

SEQ ID NO: 6460307 - DNA, 20 bp, Homo sapiens
tccttgaaatgagtaaaaac

SEQ ID NO: 6460308 - DNA, 22 bp, Homo sapiens
tccttgaacccaacagtccctt

SEQ ID NO: 6460309 - DNA, 16 bp, Homo sapiens
tccttgaaccctaata

SEQ ID NO: 6460310 - DNA, 21 bp, Homo sapiens
tccttgaactgtcagcccaca

SEQ ID NO: 6460311 - DNA, 21 bp, Homo sapiens
tccttgaagaactgcaggccc

SEQ ID NO: 6460312 - DNA, 16 bp, Homo sapiens
tccttgaagcttgtat

SEQ ID NO: 6460313 - DNA, 22 bp, Homo sapiens
tccttgaagcttgtatctgata

SEQ ID NO: 6460314 - DNA, 21 bp, Homo sapiens
tccttgaaggactaatagaaa

SEQ ID NO: 6460315 - DNA, 18 bp, Homo sapiens
tccttgaccactggccct

SEQ ID NO: 6460316 - DNA, 20 bp, Homo sapiens
tccttgaccactggccctgg

SEQ ID NO: 6460317 - DNA, 13 bp, Homo sapiens
tccttgaccagca

SEQ ID NO: 6460318 - DNA, 21 bp, Homo sapiens
tccttgaccagcagatcccag

SEQ ID NO: 6460319 - DNA, 19 bp, Homo sapiens
tccttgacctctataaact

SEQ ID NO: 6460320 - DNA, 22 bp, Homo sapiens
tccttgacctgcattgtaaata

SEQ ID NO: 6460321 - DNA, 21 bp, Homo sapiens
tccttgaccttcctctggggc

SEQ ID NO: 6460322 - DNA, 15 bp, Homo sapiens
tccttgactattaca

SEQ ID NO: 6460323 - DNA, 23 bp, Homo sapiens
tccttgactgaagcgaacatctt

SEQ ID NO: 6460324 - DNA, 16 bp, Homo sapiens
tccttgactgtctagc

SEQ ID NO: 6460325 - DNA, 20 bp, Homo sapiens
tccttgagagaccaggcaaa

SEQ ID NO: 6460326 - DNA, 16 bp, Homo sapiens
tccttgagctaagcag

SEQ ID NO: 6460327 - DNA, 23 bp, Homo sapiens
tccttgataaaaaatttattatg

SEQ ID NO: 6460328 - DNA, 14 bp, Homo sapiens
tccttgataacagc

SEQ ID NO: 6460329 - DNA, 12 bp, Homo sapiens
tccttgataatg

SEQ ID NO: 6460330 - DNA, 13 bp, Homo sapiens
tccttgatatttg

SEQ ID NO: 6460331 - DNA, 22 bp, Homo sapiens
tccttgatctgtatatacaata

SEQ ID NO: 6460332 - DNA, 22 bp, Homo sapiens
tccttgatgccagagggccagc

SEQ ID NO: 6460333 - DNA, 15 bp, Homo sapiens
tccttgcaaccaggc

SEQ ID NO: 6460334 - DNA, 21 bp, Homo sapiens
tccttgcaaggttaagcaagg

SEQ ID NO: 6460335 - DNA, 22 bp, Homo sapiens
tccttgcacactcccctgcact

SEQ ID NO: 6460336 - DNA, 14 bp, Homo sapiens
tccttgcacccctc

SEQ ID NO: 6460337 - DNA, 23 bp, Homo sapiens
tccttgcacctcagcctcccaag

SEQ ID NO: 6460338 - DNA, 14 bp, Homo sapiens
tccttgcacctgag

SEQ ID NO: 6460339 - DNA, 17 bp, Homo sapiens
tccttgcacctgagcct

SEQ ID NO: 6460340 - DNA, 14 bp, Homo sapiens
tccttgcacctgca

SEQ ID NO: 6460341 - DNA, 22 bp, Homo sapiens
tccttgcatcaaggggtcactt

SEQ ID NO: 6460342 - DNA, 16 bp, Homo sapiens
tccttgccacaatcac

SEQ ID NO: 6460343 - DNA, 17 bp, Homo sapiens
tccttgccacaatcact

SEQ ID NO: 6460344 - DNA, 16 bp, Homo sapiens
tccttgccaccccccg

SEQ ID NO: 6460345 - DNA, 12 bp, Homo sapiens
tccttgcccagg

SEQ ID NO: 6460346 - DNA, 20 bp, Homo sapiens
tccttgcccatcgggaccag

SEQ ID NO: 6460347 - DNA, 22 bp, Homo sapiens
tccttgcccatcgggaccagaa

SEQ ID NO: 6460348 - DNA, 19 bp, Homo sapiens
tccttgccccacagttgtg

SEQ ID NO: 6460349 - DNA, 23 bp, Homo sapiens
tccttgccccacagttgtgttca

SEQ ID NO: 6460350 - DNA, 14 bp, Homo sapiens
tccttgccccactc

SEQ ID NO: 6460351 - DNA, 16 bp, Homo sapiens
tccttgcccccagtgc

SEQ ID NO: 6460352 - DNA, 16 bp, Homo sapiens
tccttgccccccgccc

SEQ ID NO: 6460353 - DNA, 20 bp, Homo sapiens
tccttgccccccgccctcat

SEQ ID NO: 6460354 - DNA, 13 bp, Homo sapiens
tccttgcccctgc

SEQ ID NO: 6460355 - DNA, 17 bp, Homo sapiens
tccttgcccctgctctg

SEQ ID NO: 6460356 - DNA, 18 bp, Homo sapiens
tccttgcccctgctctgt

SEQ ID NO: 6460357 - DNA, 12 bp, Homo sapiens
tccttgccctgg

SEQ ID NO: 6460358 - DNA, 14 bp, Homo sapiens
tccttgccctgggc

SEQ ID NO: 6460359 - DNA, 22 bp, Homo sapiens
tccttgccctgggccagcccag

SEQ ID NO: 6460360 - DNA, 17 bp, Homo sapiens
tccttgcctcctgtgta

SEQ ID NO: 6460361 - DNA, 22 bp, Homo sapiens
tccttgcctctgctctgtgcac

SEQ ID NO: 6460362 - DNA, 12 bp, Homo sapiens
tccttgcctgga

SEQ ID NO: 6460363 - DNA, 13 bp, Homo sapiens
tccttgcctgtct

SEQ ID NO: 6460364 - DNA, 22 bp, Homo sapiens
tccttgcctgtgacttggactt

SEQ ID NO: 6460365 - DNA, 13 bp, Homo sapiens
tccttgccttaat

SEQ ID NO: 6460366 - DNA, 13 bp, Homo sapiens
tccttgccttctt

SEQ ID NO: 6460367 - DNA, 18 bp, Homo sapiens
tccttgccttctttactc

SEQ ID NO: 6460368 - DNA, 16 bp, Homo sapiens
tccttgcgcctcagcc

SEQ ID NO: 6460369 - DNA, 18 bp, Homo sapiens
tccttgcgcctcagccct

SEQ ID NO: 6460370 - DNA, 21 bp, Homo sapiens
tccttgctagccctggggtgg

SEQ ID NO: 6460371 - DNA, 15 bp, Homo sapiens
tccttgctatgatga

SEQ ID NO: 6460372 - DNA, 14 bp, Homo sapiens
tccttgctcctgga

SEQ ID NO: 6460373 - DNA, 13 bp, Homo sapiens
tccttgctctccc

SEQ ID NO: 6460374 - DNA, 14 bp, Homo sapiens
tccttgctctccct

SEQ ID NO: 6460375 - DNA, 21 bp, Homo sapiens
tccttgctctccctcttctca

SEQ ID NO: 6460376 - DNA, 14 bp, Homo sapiens
tccttgctctgcac

SEQ ID NO: 6460377 - DNA, 17 bp, Homo sapiens
tccttgcttcctgtctt

SEQ ID NO: 6460378 - DNA, 16 bp, Homo sapiens
tccttgctttgctgtt

SEQ ID NO: 6460379 - DNA, 13 bp, Homo sapiens
tccttgcttttct

SEQ ID NO: 6460380 - DNA, 12 bp, Homo sapiens
tccttggaaacc

SEQ ID NO: 6460381 - DNA, 23 bp, Homo sapiens
tccttggaaatcaaatgtaaagt

SEQ ID NO: 6460382 - DNA, 18 bp, Homo sapiens
tccttggagaaatgaaaa

SEQ ID NO: 6460383 - DNA, 19 bp, Homo sapiens
tccttggagaaatgaaaac

SEQ ID NO: 6460384 - DNA, 14 bp, Homo sapiens
tccttggagagcag

SEQ ID NO: 6460385 - DNA, 18 bp, Homo sapiens
tccttggagagcagctgg

SEQ ID NO: 6460386 - DNA, 19 bp, Homo sapiens
tccttggagagcagctggc

SEQ ID NO: 6460387 - DNA, 16 bp, Homo sapiens
tccttggagtcccagg

SEQ ID NO: 6460388 - DNA, 19 bp, Homo sapiens
tccttggataggcttttta

SEQ ID NO: 6460389 - DNA, 18 bp, Homo sapiens
tccttggcacccccatgc

SEQ ID NO: 6460390 - DNA, 23 bp, Homo sapiens
tccttggcacccccatgctgcct

SEQ ID NO: 6460391 - DNA, 14 bp, Homo sapiens
tccttggcagccgg

SEQ ID NO: 6460392 - DNA, 21 bp, Homo sapiens
tccttggcaggctgatttcta

SEQ ID NO: 6460393 - DNA, 20 bp, Homo sapiens
tccttggcatcacagggcag

SEQ ID NO: 6460394 - DNA, 15 bp, Homo sapiens
tccttggccacagac

SEQ ID NO: 6460395 - DNA, 23 bp, Homo sapiens
tccttggccaccagaccatgggc

SEQ ID NO: 6460396 - DNA, 14 bp, Homo sapiens
tccttggcccagca

SEQ ID NO: 6460397 - DNA, 20 bp, Homo sapiens
tccttggcccagcagcggcc

SEQ ID NO: 6460398 - DNA, 21 bp, Homo sapiens
tccttggccccctttcccggg

SEQ ID NO: 6460399 - DNA, 16 bp, Homo sapiens
tgatatctataaaata

SEQ ID NO: 6460400 - DNA, 15 bp, Homo sapiens
tgatatctgtttgct

SEQ ID NO: 6460401 - DNA, 15 bp, Homo sapiens
tgatatctttctcat

SEQ ID NO: 6460402 - DNA, 12 bp, Homo sapiens
tgatatgaaaaa

SEQ ID NO: 6460403 - DNA, 16 bp, Homo sapiens
tgatatgactaattca

SEQ ID NO: 6460404 - DNA, 18 bp, Homo sapiens
tgatatgactaattcagg

SEQ ID NO: 6460405 - DNA, 14 bp, Homo sapiens
tgatatgatccaga

SEQ ID NO: 6460406 - DNA, 17 bp, Homo sapiens
tgatatgattgtaacat

SEQ ID NO: 6460407 - DNA, 22 bp, Homo sapiens
tgatatgattgtaacatatttc

SEQ ID NO: 6460408 - DNA, 23 bp, Homo sapiens
tgatatgcacaatgtagataagt

SEQ ID NO: 6460409 - DNA, 10 bp, Homo sapiens
tgatatgcat

SEQ ID NO: 6460410 - DNA, 16 bp, Homo sapiens
tgatatgcatttcctg

SEQ ID NO: 6460411 - DNA, 16 bp, Homo sapiens
tgatatgctgagaaat

SEQ ID NO: 6460412 - DNA, 20 bp, Homo sapiens
tgatatggagccctgtaatt

SEQ ID NO: 6460413 - DNA, 16 bp, Homo sapiens
tgatatggcagaagac

SEQ ID NO: 6460414 - DNA, 17 bp, Homo sapiens
tgatatggcagaagaca

SEQ ID NO: 6460415 - DNA, 19 bp, Homo sapiens
tgatatggcagaagacacc

SEQ ID NO: 6460416 - DNA, 16 bp, Homo sapiens
tgatatgggctttctc

SEQ ID NO: 6460417 - DNA, 21 bp, Homo sapiens
tgatatggtactaaggagaat

SEQ ID NO: 6460418 - DNA, 15 bp, Homo sapiens
tgatatgtaaacata

SEQ ID NO: 6460419 - DNA, 15 bp, Homo sapiens
tgatatgtattgttt

SEQ ID NO: 6460420 - DNA, 19 bp, Homo sapiens
tgatatgtgcttgtgtgta

SEQ ID NO: 6460421 - DNA, 20 bp, Homo sapiens
tgatatgtgcttgtgtgtat

SEQ ID NO: 6460422 - DNA, 15 bp, Homo sapiens
tgatatgtgtaatat

SEQ ID NO: 6460423 - DNA, 16 bp, Homo sapiens
tgatatgttttaaagt

SEQ ID NO: 6460424 - DNA, 17 bp, Homo sapiens
tgatatgttttatttca

SEQ ID NO: 6460425 - DNA, 18 bp, Homo sapiens
tgatattaagaactgctg

SEQ ID NO: 6460426 - DNA, 20 bp, Homo sapiens
tgatattatattaaacatac

SEQ ID NO: 6460427 - DNA, 20 bp, Homo sapiens
tgatattatttcttctctta

SEQ ID NO: 6460428 - DNA, 18 bp, Homo sapiens
tgatattcaaacacacag

SEQ ID NO: 6460429 - DNA, 20 bp, Homo sapiens
tgatattcaaatggacaaac

SEQ ID NO: 6460430 - DNA, 16 bp, Homo sapiens
tgatattcaaggcttt

SEQ ID NO: 6460431 - DNA, 15 bp, Homo sapiens
tgatattccatagta

SEQ ID NO: 6460432 - DNA, 18 bp, Homo sapiens
tgatattccatgaatgta

SEQ ID NO: 6460433 - DNA, 22 bp, Homo sapiens
tgatattccatgaatgtatcag

SEQ ID NO: 6460434 - DNA, 12 bp, Homo sapiens
tgatattctaag

SEQ ID NO: 6460435 - DNA, 18 bp, Homo sapiens
tgatattctgttgcttta

SEQ ID NO: 6460436 - DNA, 14 bp, Homo sapiens
tgatattctttaaa

SEQ ID NO: 6460437 - DNA, 15 bp, Homo sapiens
tgatattctttgtta

SEQ ID NO: 6460438 - DNA, 18 bp, Homo sapiens
tgatattctttgttaatt

SEQ ID NO: 6460439 - DNA, 18 bp, Homo sapiens
tgatattgaccatgtgat

SEQ ID NO: 6460440 - DNA, 23 bp, Homo sapiens
tgatattgaggtgtttgaaatat

SEQ ID NO: 6460441 - DNA, 13 bp, Homo sapiens
tgatattgtgaac

SEQ ID NO: 6460442 - DNA, 12 bp, Homo sapiens
tgatattgtgta

SEQ ID NO: 6460443 - DNA, 14 bp, Homo sapiens
tgatattgtttgct

SEQ ID NO: 6460444 - DNA, 15 bp, Homo sapiens
tgatattgtttgctg

SEQ ID NO: 6460445 - DNA, 23 bp, Homo sapiens
tgatattgtttgctgttgggttt

SEQ ID NO: 6460446 - DNA, 22 bp, Homo sapiens
tgatatttaggtttttggctga

SEQ ID NO: 6460447 - DNA, 19 bp, Homo sapiens
tgatatttatttcctgcta

SEQ ID NO: 6460448 - DNA, 21 bp, Homo sapiens
tgatatttatttcctgctact

SEQ ID NO: 6460449 - DNA, 15 bp, Homo sapiens
tgatatttcagaaat

SEQ ID NO: 6460450 - DNA, 15 bp, Homo sapiens
tgatatttccttcac

SEQ ID NO: 6460451 - DNA, 12 bp, Homo sapiens
tgatatttctct

SEQ ID NO: 6460452 - DNA, 15 bp, Homo sapiens
tgatatttcttgctt

SEQ ID NO: 6460453 - DNA, 12 bp, Homo sapiens
tgatatttgcat

SEQ ID NO: 6460454 - DNA, 14 bp, Homo sapiens
tgatatttgcattg

SEQ ID NO: 6460455 - DNA, 16 bp, Homo sapiens
tgatatttgcattgag

SEQ ID NO: 6460456 - DNA, 21 bp, Homo sapiens
tgatatttgtatttattcttt

SEQ ID NO: 6460457 - DNA, 13 bp, Homo sapiens
tgatattttaaaa

SEQ ID NO: 6460458 - DNA, 19 bp, Homo sapiens
tgatattttacctcttatt

SEQ ID NO: 6460459 - DNA, 14 bp, Homo sapiens
tgatattttacttg

SEQ ID NO: 6460460 - DNA, 22 bp, Homo sapiens
tgatattttcaacgcagccctg

SEQ ID NO: 6460461 - DNA, 17 bp, Homo sapiens
tgatattttctgtgcct

SEQ ID NO: 6460462 - DNA, 16 bp, Homo sapiens
tgatattttgtacttt

SEQ ID NO: 6460463 - DNA, 18 bp, Homo sapiens
tgatattttgtttttccc

SEQ ID NO: 6460464 - DNA, 15 bp, Homo sapiens
tgatatttttataca

SEQ ID NO: 6460465 - DNA, 17 bp, Homo sapiens
tgatatttttatacaag

SEQ ID NO: 6460466 - DNA, 21 bp, Homo sapiens
tgatatttttatacaagtaat

SEQ ID NO: 6460467 - DNA, 17 bp, Homo sapiens
tgatatttttatgtgca

SEQ ID NO: 6460468 - DNA, 19 bp, Homo sapiens
tgatatttttatgtgcagc

SEQ ID NO: 6460469 - DNA, 14 bp, Homo sapiens
tgatatttttccat

SEQ ID NO: 6460470 - DNA, 20 bp, Homo sapiens
tgatatttttccatttattt

SEQ ID NO: 6460471 - DNA, 19 bp, Homo sapiens
tgatattttttatcataaa

SEQ ID NO: 6460472 - DNA, 16 bp, Homo sapiens
tgatattttttctctc

SEQ ID NO: 6460473 - DNA, 12 bp, Homo sapiens
tgatcaaaaata

SEQ ID NO: 6460474 - DNA, 16 bp, Homo sapiens
tgatcaaaaataaact

SEQ ID NO: 6460475 - DNA, 14 bp, Homo sapiens
tgatcaaaatcaaa

SEQ ID NO: 6460476 - DNA, 14 bp, Homo sapiens
tgatcaaatgtaca

SEQ ID NO: 6460477 - DNA, 16 bp, Homo sapiens
tgatcaaatgtacatc

SEQ ID NO: 6460478 - DNA, 19 bp, Homo sapiens
tgatcaaatgtttaatcat

SEQ ID NO: 6460479 - DNA, 22 bp, Homo sapiens
tgatcaaatgtttaatcatata

SEQ ID NO: 6460480 - DNA, 16 bp, Homo sapiens
tgatcaaattcatttt

SEQ ID NO: 6460481 - DNA, 23 bp, Homo sapiens
tgatcaaattcatttttttcact

SEQ ID NO: 6460482 - DNA, 19 bp, Homo sapiens
tgatcaacaatttaatgta

SEQ ID NO: 6460483 - DNA, 14 bp, Homo sapiens
tgatcaactgttca

SEQ ID NO: 6460484 - DNA, 15 bp, Homo sapiens
tgatcaagaatgcaa

SEQ ID NO: 6460485 - DNA, 13 bp, Homo sapiens
tgatcaagatata

SEQ ID NO: 6460486 - DNA, 20 bp, Homo sapiens
tgatcaagggaatgtaactg

SEQ ID NO: 6460487 - DNA, 22 bp, Homo sapiens
tgatcaaggtgctcttctcatt

SEQ ID NO: 6460488 - DNA, 18 bp, Homo sapiens
tgatcaagtcctttgtga

SEQ ID NO: 6460489 - DNA, 16 bp, Homo sapiens
tgatcaataaaatgtg

SEQ ID NO: 6460490 - DNA, 21 bp, Homo sapiens
tgatcaataaaatgtgatttt

SEQ ID NO: 6460491 - DNA, 16 bp, Homo sapiens
tgatcaatatttttat

SEQ ID NO: 6460492 - DNA, 19 bp, Homo sapiens
tgatcaatcattttggagg

SEQ ID NO: 6460493 - DNA, 21 bp, Homo sapiens
tgatcaatctgcagtttgtga

SEQ ID NO: 6460494 - DNA, 16 bp, Homo sapiens
tgatcaattaaatgta

SEQ ID NO: 6460495 - DNA, 16 bp, Homo sapiens
tgatcaattttgactt

SEQ ID NO: 6460496 - DNA, 13 bp, Homo sapiens
tgatcacacagcc

SEQ ID NO: 6460497 - DNA, 15 bp, Homo sapiens
tgatcacacagtgtt

SEQ ID NO: 6460498 - DNA, 13 bp, Homo sapiens
tgatcacactctg

SEQ ID NO: 6460499 - DNA, 22 bp, Homo sapiens
tgatcacagtggcgagaggaga

SEQ ID NO: 6460500 - DNA, 17 bp, Homo sapiens
tgatcacatctaaagct

SEQ ID NO: 6460501 - DNA, 17 bp, Homo sapiens
tgatcaccacatctttt

SEQ ID NO: 6460502 - DNA, 16 bp, Homo sapiens
tgatcaccatgaaaga

SEQ ID NO: 6460503 - DNA, 20 bp, Homo sapiens
tgatcaccatgttagcctta

SEQ ID NO: 6460504 - DNA, 13 bp, Homo sapiens
tgatcaccctgaa

SEQ ID NO: 6460505 - DNA, 15 bp, Homo sapiens
tgatcacctcttggg

SEQ ID NO: 6460506 - DNA, 14 bp, Homo sapiens
tgatcacgcctggc

SEQ ID NO: 6460507 - DNA, 15 bp, Homo sapiens
tgatcacggctcact

SEQ ID NO: 6460508 - DNA, 19 bp, Homo sapiens
tgatcacggctcactgcag

SEQ ID NO: 6460509 - DNA, 20 bp, Homo sapiens
tgatcacggctcactgcagc

SEQ ID NO: 6460510 - DNA, 16 bp, Homo sapiens
tgatcacttatcagtt

SEQ ID NO: 6460511 - DNA, 21 bp, Homo sapiens
tgatcagaaggctggggccag

SEQ ID NO: 6460512 - DNA, 16 bp, Homo sapiens
tgatcagaatcccaaa

SEQ ID NO: 6460513 - DNA, 15 bp, Homo sapiens
tgatcagaattttac

SEQ ID NO: 6460514 - DNA, 17 bp, Homo sapiens
tgatcagacatacagct

SEQ ID NO: 6460515 - DNA, 18 bp, Homo sapiens
tgatcagaccataatgtt

SEQ ID NO: 6460516 - DNA, 23 bp, Homo sapiens
tgatcagacttgatttacaagca

SEQ ID NO: 6460517 - DNA, 21 bp, Homo sapiens
tgatcagagccgtggtccttt

SEQ ID NO: 6460518 - DNA, 20 bp, Homo sapiens
tgatcagaggtgtacactaa

SEQ ID NO: 6460519 - DNA, 15 bp, Homo sapiens
tgatcagatctgaca

SEQ ID NO: 6460520 - DNA, 16 bp, Homo sapiens
tgatcagatctgacat

SEQ ID NO: 6460521 - DNA, 23 bp, Homo sapiens
tgatcagatctgacatgattcct

SEQ ID NO: 6460522 - DNA, 15 bp, Homo sapiens
tgatcagatcttaca

SEQ ID NO: 6460523 - DNA, 16 bp, Homo sapiens
tgatcagatgctgaat

SEQ ID NO: 6460524 - DNA, 15 bp, Homo sapiens
tgatcagcaaaaaga

SEQ ID NO: 6460525 - DNA, 17 bp, Homo sapiens
tgatcagcaatgaagaa

SEQ ID NO: 6460526 - DNA, 17 bp, Homo sapiens
tgatcagcattgtgact

SEQ ID NO: 6460527 - DNA, 18 bp, Homo sapiens
tgatcagcattgtgactt

SEQ ID NO: 6460528 - DNA, 16 bp, Homo sapiens
tgatcagccccaccct

SEQ ID NO: 6460529 - DNA, 19 bp, Homo sapiens
tgatcagccttatgtggaa

SEQ ID NO: 6460530 - DNA, 20 bp, Homo sapiens
tgatcagctttcaaagcatt

SEQ ID NO: 6460531 - DNA, 17 bp, Homo sapiens
tgatcaggccccacccc

SEQ ID NO: 6460532 - DNA, 14 bp, Homo sapiens
tgatcaggcttcct

SEQ ID NO: 6460533 - DNA, 18 bp, Homo sapiens
tgatcaggcttcctggtg

SEQ ID NO: 6460534 - DNA, 19 bp, Homo sapiens
tgatcaggcttcctggtga

SEQ ID NO: 6460535 - DNA, 17 bp, Homo sapiens
tgatcagggatccaata

SEQ ID NO: 6460536 - DNA, 16 bp, Homo sapiens
tgatcaggtaactttc

SEQ ID NO: 6460537 - DNA, 21 bp, Homo sapiens
tgatcagtactgactttctga

SEQ ID NO: 6460538 - DNA, 23 bp, Homo sapiens
tgatcagtagtttgcatttcaga

SEQ ID NO: 6460539 - DNA, 19 bp, Homo sapiens
tgatcagtatgctgtttta

SEQ ID NO: 6460540 - DNA, 23 bp, Homo sapiens
tgatcagtatgctgttttaataa

SEQ ID NO: 6460541 - DNA, 15 bp, Homo sapiens
tgatcagtgattttc

SEQ ID NO: 6460542 - DNA, 18 bp, Homo sapiens
tgatcagtgattttcaaa

SEQ ID NO: 6460543 - DNA, 15 bp, Homo sapiens
tgatcagtggacagt

SEQ ID NO: 6460544 - DNA, 19 bp, Homo sapiens
tgatcagtggacagtctgc

SEQ ID NO: 6460545 - DNA, 18 bp, Homo sapiens
tgatcagtgtgataagga

SEQ ID NO: 6460546 - DNA, 14 bp, Homo sapiens
tgatcagtgttaca

SEQ ID NO: 6460547 - DNA, 12 bp, Homo sapiens
tgatcagtgttg

SEQ ID NO: 6460548 - DNA, 18 bp, Homo sapiens
tgatcatagctcactgca

SEQ ID NO: 6460549 - DNA, 22 bp, Homo sapiens
tgatcatagctcactgcagcct

SEQ ID NO: 6460550 - DNA, 20 bp, Homo sapiens
tgatcataggtatttcaaaa

SEQ ID NO: 6460551 - DNA, 13 bp, Homo sapiens
tgatcatatatca

SEQ ID NO: 6460552 - DNA, 19 bp, Homo sapiens
tgatcatatatcataaagg

SEQ ID NO: 6460553 - DNA, 13 bp, Homo sapiens
tgatcatccactg

SEQ ID NO: 6460554 - DNA, 14 bp, Homo sapiens
tgatcatccctttc

SEQ ID NO: 6460555 - DNA, 17 bp, Homo sapiens
tgatcatccctttctcc

SEQ ID NO: 6460556 - DNA, 20 bp, Homo sapiens
tgatcatcgccagaggtgct

SEQ ID NO: 6460557 - DNA, 13 bp, Homo sapiens
tgatcatggtcag

SEQ ID NO: 6460558 - DNA, 15 bp, Homo sapiens
tgatcatgtactttt

SEQ ID NO: 6460559 - DNA, 22 bp, Homo sapiens
tgatcatgtgtggaagttatta

SEQ ID NO: 6460560 - DNA, 16 bp, Homo sapiens
tgatcattagagaaat

SEQ ID NO: 6460561 - DNA, 23 bp, Homo sapiens
tgatcatttattttaagcactct

SEQ ID NO: 6460562 - DNA, 17 bp, Homo sapiens
tgatcatttgcagctgc

SEQ ID NO: 6460563 - DNA, 20 bp, Homo sapiens
tgatcatttgcagctgctgg

SEQ ID NO: 6460564 - DNA, 21 bp, Homo sapiens
tgatcattttccccccactct

SEQ ID NO: 6460565 - DNA, 22 bp, Homo sapiens
tgatcattttccccccactctc

SEQ ID NO: 6460566 - DNA, 14 bp, Homo sapiens
tgatccaagctggt

SEQ ID NO: 6460567 - DNA, 17 bp, Homo sapiens
tgatccaagctggtccc

SEQ ID NO: 6460568 - DNA, 15 bp, Homo sapiens
tgatccacccaaccc

SEQ ID NO: 6460569 - DNA, 22 bp, Homo sapiens
tgatccacccacctcagcctcc

SEQ ID NO: 6460570 - DNA, 15 bp, Homo sapiens
tgatccacccacctg

SEQ ID NO: 6460571 - DNA, 23 bp, Homo sapiens
tgatccacccaccttggcctccc

SEQ ID NO: 6460572 - DNA, 21 bp, Homo sapiens
tgatccacccgccttcagcct

SEQ ID NO: 6460573 - DNA, 20 bp, Homo sapiens
tgatccaccggcctcggcct

SEQ ID NO: 6460574 - DNA, 23 bp, Homo sapiens
tgatccacttcttaatgctttcc

SEQ ID NO: 6460575 - DNA, 23 bp, Homo sapiens
tgatccactttgggggaggagaa

SEQ ID NO: 6460576 - DNA, 19 bp, Homo sapiens
tgatccagcctctcccctg

SEQ ID NO: 6460577 - DNA, 19 bp, Homo sapiens
tgatccagcctttccaagt

SEQ ID NO: 6460578 - DNA, 10 bp, Homo sapiens
tccttggcct

SEQ ID NO: 6460579 - DNA, 13 bp, Homo sapiens
tccttggcctagc

SEQ ID NO: 6460580 - DNA, 22 bp, Homo sapiens
tccttggctcccgggggcccca

SEQ ID NO: 6460581 - DNA, 19 bp, Homo sapiens
tccttggctgaattaaaat

SEQ ID NO: 6460582 - DNA, 15 bp, Homo sapiens
tccttggctggtgca

SEQ ID NO: 6460583 - DNA, 18 bp, Homo sapiens
tccttggctgtatccatg

SEQ ID NO: 6460584 - DNA, 20 bp, Homo sapiens
tccttggcttacctgacctc

SEQ ID NO: 6460585 - DNA, 17 bp, Homo sapiens
tccttggcttgcctggt

SEQ ID NO: 6460586 - DNA, 17 bp, Homo sapiens
tccttggctttatgcaa

SEQ ID NO: 6460587 - DNA, 20 bp, Homo sapiens
tccttggctttatgcaaata

SEQ ID NO: 6460588 - DNA, 20 bp, Homo sapiens
tccttggctttatgcacatt

SEQ ID NO: 6460589 - DNA, 22 bp, Homo sapiens
tccttggctttcagagccagcc

SEQ ID NO: 6460590 - DNA, 15 bp, Homo sapiens
tccttgggaggaagc

SEQ ID NO: 6460591 - DNA, 17 bp, Homo sapiens
tccttgggaggaagcag

SEQ ID NO: 6460592 - DNA, 18 bp, Homo sapiens
tccttgggatgaagaggg

SEQ ID NO: 6460593 - DNA, 17 bp, Homo sapiens
tccttgggcacttttta

SEQ ID NO: 6460594 - DNA, 14 bp, Homo sapiens
tccttgggcagggt

SEQ ID NO: 6460595 - DNA, 20 bp, Homo sapiens
tccttgggcagggtctctgc

SEQ ID NO: 6460596 - DNA, 23 bp, Homo sapiens
tccttgggcgtctcccccagagt

SEQ ID NO: 6460597 - DNA, 12 bp, Homo sapiens
tccttgggctcc

SEQ ID NO: 6460598 - DNA, 19 bp, Homo sapiens
tccttgggctcctggctgc

SEQ ID NO: 6460599 - DNA, 23 bp, Homo sapiens
tccttggggaggggtcagctctg

SEQ ID NO: 6460600 - DNA, 17 bp, Homo sapiens
tccttggggcaggcagt

SEQ ID NO: 6460601 - DNA, 21 bp, Homo sapiens
tccttggggcagggcctgggc

SEQ ID NO: 6460602 - DNA, 20 bp, Homo sapiens
tccttggggccttgtgtgat

SEQ ID NO: 6460603 - DNA, 16 bp, Homo sapiens
tccttggtaaatacaa

SEQ ID NO: 6460604 - DNA, 14 bp, Homo sapiens
tccttggtctgctg

SEQ ID NO: 6460605 - DNA, 17 bp, Homo sapiens
tccttggtctttgtatc

SEQ ID NO: 6460606 - DNA, 14 bp, Homo sapiens
tccttggtgcctgg

SEQ ID NO: 6460607 - DNA, 14 bp, Homo sapiens
tccttggtgctgtg

SEQ ID NO: 6460608 - DNA, 22 bp, Homo sapiens
tccttggtgctgtgtgccccac

SEQ ID NO: 6460609 - DNA, 22 bp, Homo sapiens
tccttggtggccgggggtgggg

SEQ ID NO: 6460610 - DNA, 21 bp, Homo sapiens
tccttggtgtgaccctctgaa

SEQ ID NO: 6460611 - DNA, 16 bp, Homo sapiens
tccttggttatatttt

SEQ ID NO: 6460612 - DNA, 13 bp, Homo sapiens
tccttggttcatg

SEQ ID NO: 6460613 - DNA, 15 bp, Homo sapiens
tccttggttcatgct

SEQ ID NO: 6460614 - DNA, 16 bp, Homo sapiens
tccttggttcatgctt

SEQ ID NO: 6460615 - DNA, 19 bp, Homo sapiens
tccttgtaaaatattttca

SEQ ID NO: 6460616 - DNA, 14 bp, Homo sapiens
tccttgtaatgtag

SEQ ID NO: 6460617 - DNA, 15 bp, Homo sapiens
tccttgtactcttag

SEQ ID NO: 6460618 - DNA, 17 bp, Homo sapiens
tccttgtactcttagga

SEQ ID NO: 6460619 - DNA, 22 bp, Homo sapiens
tccttgtagcatttggaaatga

SEQ ID NO: 6460620 - DNA, 20 bp, Homo sapiens
tccttgtagcgactaaacta

SEQ ID NO: 6460621 - DNA, 19 bp, Homo sapiens
tccttgtcaatactgagcc

SEQ ID NO: 6460622 - DNA, 13 bp, Homo sapiens
tccttgtcacaga

SEQ ID NO: 6460623 - DNA, 22 bp, Homo sapiens
tccttgtcaccagcaacatctc

SEQ ID NO: 6460624 - DNA, 13 bp, Homo sapiens
tccttgtcactgg

SEQ ID NO: 6460625 - DNA, 23 bp, Homo sapiens
tccttgtcagggtctccttcctt

SEQ ID NO: 6460626 - DNA, 15 bp, Homo sapiens
tccttgtccacccac

SEQ ID NO: 6460627 - DNA, 13 bp, Homo sapiens
tccttgtccccac

SEQ ID NO: 6460628 - DNA, 18 bp, Homo sapiens
tccttgtccccacactcc

SEQ ID NO: 6460629 - DNA, 19 bp, Homo sapiens
tccttgtccccacactcct

SEQ ID NO: 6460630 - DNA, 20 bp, Homo sapiens
tccttgtcccgtctggacct

SEQ ID NO: 6460631 - DNA, 16 bp, Homo sapiens
tccttgtctctcattc

SEQ ID NO: 6460632 - DNA, 20 bp, Homo sapiens
tccttgtctgaatgtattta

SEQ ID NO: 6460633 - DNA, 19 bp, Homo sapiens
tccttgtgagagtggcttt

SEQ ID NO: 6460634 - DNA, 13 bp, Homo sapiens
tccttgtgattga

SEQ ID NO: 6460635 - DNA, 12 bp, Homo sapiens
tccttgtgcaaa

SEQ ID NO: 6460636 - DNA, 15 bp, Homo sapiens
tccttgtgctcctgc

SEQ ID NO: 6460637 - DNA, 13 bp, Homo sapiens
tccttgtggactg

SEQ ID NO: 6460638 - DNA, 22 bp, Homo sapiens
tccttgtggactggctgtgccc

SEQ ID NO: 6460639 - DNA, 13 bp, Homo sapiens
tccttgtggcaga

SEQ ID NO: 6460640 - DNA, 14 bp, Homo sapiens
tccttgtggcagag

SEQ ID NO: 6460641 - DNA, 13 bp, Homo sapiens
tccttgtggccta

SEQ ID NO: 6460642 - DNA, 19 bp, Homo sapiens
tccttgtggcctgggcctc

SEQ ID NO: 6460643 - DNA, 21 bp, Homo sapiens
tccttgtggccttttttataa

SEQ ID NO: 6460644 - DNA, 16 bp, Homo sapiens
tccttgtgggcctggg

SEQ ID NO: 6460645 - DNA, 23 bp, Homo sapiens
tccttgtgggcctgggctcctgg

SEQ ID NO: 6460646 - DNA, 21 bp, Homo sapiens
tccttgtggtctttgctgctg

SEQ ID NO: 6460647 - DNA, 23 bp, Homo sapiens
tccttgtggtctttgctgctgct

SEQ ID NO: 6460648 - DNA, 17 bp, Homo sapiens
tccttgtggtttatgtc

SEQ ID NO: 6460649 - DNA, 19 bp, Homo sapiens
tccttgtggtttatgtcat

SEQ ID NO: 6460650 - DNA, 14 bp, Homo sapiens
tccttgtgtgtgtc

SEQ ID NO: 6460651 - DNA, 23 bp, Homo sapiens
tccttgtgttactaagtttttat

SEQ ID NO: 6460652 - DNA, 20 bp, Homo sapiens
tccttgtgttgaaggcagta

SEQ ID NO: 6460653 - DNA, 22 bp, Homo sapiens
tccttgtgttgcactgaacagg

SEQ ID NO: 6460654 - DNA, 16 bp, Homo sapiens
tccttgtgttttgtcc

SEQ ID NO: 6460655 - DNA, 18 bp, Homo sapiens
tccttgttcatggagagc

SEQ ID NO: 6460656 - DNA, 20 bp, Homo sapiens
tccttgttcatggagagctg

SEQ ID NO: 6460657 - DNA, 17 bp, Homo sapiens
tccttgttggtcagagg

SEQ ID NO: 6460658 - DNA, 13 bp, Homo sapiens
tccttgtttatca

SEQ ID NO: 6460659 - DNA, 20 bp, Homo sapiens
tccttgtttatcagatacat

SEQ ID NO: 6460660 - DNA, 14 bp, Homo sapiens
tccttgtttcaaac

SEQ ID NO: 6460661 - DNA, 15 bp, Homo sapiens
tccttgttttaagat

SEQ ID NO: 6460662 - DNA, 19 bp, Homo sapiens
tccttgttttgatttatgg

SEQ ID NO: 6460663 - DNA, 22 bp, Homo sapiens
tcctttaaaaaaatttaagtgc

SEQ ID NO: 6460664 - DNA, 13 bp, Homo sapiens
tcctttaaaacat

SEQ ID NO: 6460665 - DNA, 22 bp, Homo sapiens
tcctttaaagtgagtactgtta

SEQ ID NO: 6460666 - DNA, 20 bp, Homo sapiens
tcctttaaatttcagctttg

SEQ ID NO: 6460667 - DNA, 19 bp, Homo sapiens
tcctttaacctttgctgta

SEQ ID NO: 6460668 - DNA, 20 bp, Homo sapiens
tcctttaactcgttgcagtc

SEQ ID NO: 6460669 - DNA, 20 bp, Homo sapiens
tcctttaatatactccttaa

SEQ ID NO: 6460670 - DNA, 15 bp, Homo sapiens
tcctttaattgtaaa

SEQ ID NO: 6460671 - DNA, 17 bp, Homo sapiens
tcctttacaaccatact

SEQ ID NO: 6460672 - DNA, 12 bp, Homo sapiens
tcctttacacat

SEQ ID NO: 6460673 - DNA, 22 bp, Homo sapiens
tcctttacacattcggctccct

SEQ ID NO: 6460674 - DNA, 15 bp, Homo sapiens
tcctttacagctgtt

SEQ ID NO: 6460675 - DNA, 15 bp, Homo sapiens
tcctttaccctccac

SEQ ID NO: 6460676 - DNA, 22 bp, Homo sapiens
tcctttaccgaggacagcctgc

SEQ ID NO: 6460677 - DNA, 15 bp, Homo sapiens
tcctttacctaccac

SEQ ID NO: 6460678 - DNA, 15 bp, Homo sapiens
tcctttaccttttct

SEQ ID NO: 6460679 - DNA, 13 bp, Homo sapiens
tcctttactttcc

SEQ ID NO: 6460680 - DNA, 15 bp, Homo sapiens
tcctttactttccct

SEQ ID NO: 6460681 - DNA, 20 bp, Homo sapiens
tcctttactttcccttgctt

SEQ ID NO: 6460682 - DNA, 21 bp, Homo sapiens
tcctttactttctctctcctc

SEQ ID NO: 6460683 - DNA, 12 bp, Homo sapiens
tcctttagaaac

SEQ ID NO: 6460684 - DNA, 19 bp, Homo sapiens
tcctttagatagcagcctg

SEQ ID NO: 6460685 - DNA, 20 bp, Homo sapiens
tcctttagatagcagcctgg

SEQ ID NO: 6460686 - DNA, 19 bp, Homo sapiens
tcctttagcgcccagttgg

SEQ ID NO: 6460687 - DNA, 21 bp, Homo sapiens
tcctttataagttgctttcct

SEQ ID NO: 6460688 - DNA, 13 bp, Homo sapiens
tcctttataatga

SEQ ID NO: 6460689 - DNA, 18 bp, Homo sapiens
tcctttataattctttct

SEQ ID NO: 6460690 - DNA, 18 bp, Homo sapiens
tcctttatacagttgtat

SEQ ID NO: 6460691 - DNA, 14 bp, Homo sapiens
tcctttatactgtg

SEQ ID NO: 6460692 - DNA, 15 bp, Homo sapiens
tcctttatactgtga

SEQ ID NO: 6460693 - DNA, 19 bp, Homo sapiens
tcctttatactgtgaagtt

SEQ ID NO: 6460694 - DNA, 22 bp, Homo sapiens
tcctttatactgtgaagttaca

SEQ ID NO: 6460695 - DNA, 15 bp, Homo sapiens
tcctttatccctgag

SEQ ID NO: 6460696 - DNA, 15 bp, Homo sapiens
tcctttatctgtaat

SEQ ID NO: 6460697 - DNA, 15 bp, Homo sapiens
tcctttatgattctt

SEQ ID NO: 6460698 - DNA, 15 bp, Homo sapiens
tcctttatgtattct

SEQ ID NO: 6460699 - DNA, 15 bp, Homo sapiens
tcctttatgtgaatt

SEQ ID NO: 6460700 - DNA, 21 bp, Homo sapiens
tcctttatgtggaaaacagaa

SEQ ID NO: 6460701 - DNA, 15 bp, Homo sapiens
tcctttattgcagtt

SEQ ID NO: 6460702 - DNA, 16 bp, Homo sapiens
tcctttatttctgata

SEQ ID NO: 6460703 - DNA, 15 bp, Homo sapiens
tcctttcaataaagt

SEQ ID NO: 6460704 - DNA, 16 bp, Homo sapiens
tcctttcaataaagtt

SEQ ID NO: 6460705 - DNA, 18 bp, Homo sapiens
tcctttcaataaagttgt

SEQ ID NO: 6460706 - DNA, 22 bp, Homo sapiens
tcctttcaataaagttgttgca

SEQ ID NO: 6460707 - DNA, 16 bp, Homo sapiens
tcctttcacaaccttc

SEQ ID NO: 6460708 - DNA, 18 bp, Homo sapiens
tcctttcacaaccttctg

SEQ ID NO: 6460709 - DNA, 19 bp, Homo sapiens
tcctttcaccccagggcct

SEQ ID NO: 6460710 - DNA, 18 bp, Homo sapiens
tcctttcactcctttcct

SEQ ID NO: 6460711 - DNA, 13 bp, Homo sapiens
tcctttcacttct

SEQ ID NO: 6460712 - DNA, 18 bp, Homo sapiens
tcctttcacttctttccc

SEQ ID NO: 6460713 - DNA, 23 bp, Homo sapiens
tcctttcagccacatgccccagg

SEQ ID NO: 6460714 - DNA, 21 bp, Homo sapiens
tcctttcagggaatttcagga

SEQ ID NO: 6460715 - DNA, 17 bp, Homo sapiens
tcctttcagtttttatt

SEQ ID NO: 6460716 - DNA, 16 bp, Homo sapiens
tcctttcatcctcagc

SEQ ID NO: 6460717 - DNA, 20 bp, Homo sapiens
tcctttcatctctctacctc

SEQ ID NO: 6460718 - DNA, 16 bp, Homo sapiens
tcctttcatttactgt

SEQ ID NO: 6460719 - DNA, 18 bp, Homo sapiens
tcctttcattttctttcc

SEQ ID NO: 6460720 - DNA, 18 bp, Homo sapiens
tcctttccaaggcttctc

SEQ ID NO: 6460721 - DNA, 23 bp, Homo sapiens
tcctttccaagtatttcacagca

SEQ ID NO: 6460722 - DNA, 19 bp, Homo sapiens
tcctttccaatagaaagaa

SEQ ID NO: 6460723 - DNA, 23 bp, Homo sapiens
tcctttccaatagaaagaaacta

SEQ ID NO: 6460724 - DNA, 18 bp, Homo sapiens
tcctttccaggggccaat

SEQ ID NO: 6460725 - DNA, 13 bp, Homo sapiens
tcctttccatctg

SEQ ID NO: 6460726 - DNA, 17 bp, Homo sapiens
tcctttccatctgtcca

SEQ ID NO: 6460727 - DNA, 14 bp, Homo sapiens
tcctttcccacagt

SEQ ID NO: 6460728 - DNA, 17 bp, Homo sapiens
tcctttccccagcccag

SEQ ID NO: 6460729 - DNA, 18 bp, Homo sapiens
tcctttccccagcccagg

SEQ ID NO: 6460730 - DNA, 11 bp, Homo sapiens
tcctttcccct

SEQ ID NO: 6460731 - DNA, 19 bp, Homo sapiens
tcctttcccctctctgccc

SEQ ID NO: 6460732 - DNA, 20 bp, Homo sapiens
tcctttcccctctctgcccc

SEQ ID NO: 6460733 - DNA, 21 bp, Homo sapiens
tcctttcccctctctgcccct

SEQ ID NO: 6460734 - DNA, 16 bp, Homo sapiens
tcctttccccttcctt

SEQ ID NO: 6460735 - DNA, 15 bp, Homo sapiens
tcctttcccctttct

SEQ ID NO: 6460736 - DNA, 16 bp, Homo sapiens
tcctttcccctttctc

SEQ ID NO: 6460737 - DNA, 17 bp, Homo sapiens
tcctttcccctttctct

SEQ ID NO: 6460738 - DNA, 21 bp, Homo sapiens
tcctttcccctttttctttcc

SEQ ID NO: 6460739 - DNA, 14 bp, Homo sapiens
tcctttccctccac

SEQ ID NO: 6460740 - DNA, 13 bp, Homo sapiens
tcctttccctctc

SEQ ID NO: 6460741 - DNA, 14 bp, Homo sapiens
tcctttccctggag

SEQ ID NO: 6460742 - DNA, 18 bp, Homo sapiens
tcctttcccttcctcttc

SEQ ID NO: 6460743 - DNA, 12 bp, Homo sapiens
tcctttcccttt

SEQ ID NO: 6460744 - DNA, 13 bp, Homo sapiens
tcctttcccttta

SEQ ID NO: 6460745 - DNA, 20 bp, Homo sapiens
tcctttcctactgtcctgga

SEQ ID NO: 6460746 - DNA, 21 bp, Homo sapiens
tcctttcctctcctctctgga

SEQ ID NO: 6460747 - DNA, 13 bp, Homo sapiens
tcctttcctctga

SEQ ID NO: 6460748 - DNA, 15 bp, Homo sapiens
tcctttcctctgcag

SEQ ID NO: 6460749 - DNA, 18 bp, Homo sapiens
tcctttccttcagtcact

SEQ ID NO: 6460750 - DNA, 16 bp, Homo sapiens
tcctttccttcccagg

SEQ ID NO: 6460751 - DNA, 13 bp, Homo sapiens
tcctttccttctc

SEQ ID NO: 6460752 - DNA, 22 bp, Homo sapiens
tcctttccttctcgtcttcctc

SEQ ID NO: 6460753 - DNA, 12 bp, Homo sapiens
tcctttcctttc

SEQ ID NO: 6460754 - DNA, 19 bp, Homo sapiens
tcctttctaatcctatctg

SEQ ID NO: 6460755 - DNA, 15 bp, Homo sapiens
tcctttctatatcct

SEQ ID NO: 6460756 - DNA, 21 bp, Homo sapiens
tcctttctatcatttttgtac

SEQ ID NO: 6460757 - DNA, 20 bp, Homo sapiens
tgatccaggaaagatgtccc

SEQ ID NO: 6460758 - DNA, 21 bp, Homo sapiens
tgatccaggcaatcgttctgc

SEQ ID NO: 6460759 - DNA, 14 bp, Homo sapiens
tgatccagggattg

SEQ ID NO: 6460760 - DNA, 23 bp, Homo sapiens
tgatccagtcattttattttgta

SEQ ID NO: 6460761 - DNA, 14 bp, Homo sapiens
tgatccatctcagt

SEQ ID NO: 6460762 - DNA, 16 bp, Homo sapiens
tgatccatctcagtca

SEQ ID NO: 6460763 - DNA, 18 bp, Homo sapiens
tgatccatctcagtcact

SEQ ID NO: 6460764 - DNA, 15 bp, Homo sapiens
tgatccatgtaactg

SEQ ID NO: 6460765 - DNA, 17 bp, Homo sapiens
tgatccatttctaatta

SEQ ID NO: 6460766 - DNA, 21 bp, Homo sapiens
tgatccatttctaattatgta

SEQ ID NO: 6460767 - DNA, 19 bp, Homo sapiens
tgatcccaagtgccagtct

SEQ ID NO: 6460768 - DNA, 14 bp, Homo sapiens
tgatcccaccccct

SEQ ID NO: 6460769 - DNA, 20 bp, Homo sapiens
tgatcccagacccattcctt

SEQ ID NO: 6460770 - DNA, 12 bp, Homo sapiens
tgatcccagcac

SEQ ID NO: 6460771 - DNA, 13 bp, Homo sapiens
tgatcccagcact

SEQ ID NO: 6460772 - DNA, 21 bp, Homo sapiens
tgatcccagctcactgcagcc

SEQ ID NO: 6460773 - DNA, 22 bp, Homo sapiens
tgatcccagctcactgcagcct

SEQ ID NO: 6460774 - DNA, 23 bp, Homo sapiens
tgatcccagctcactgcagcctc

SEQ ID NO: 6460775 - DNA, 17 bp, Homo sapiens
tgatcccagtcactcct

SEQ ID NO: 6460776 - DNA, 19 bp, Homo sapiens
tgatccccacactgcctta

SEQ ID NO: 6460777 - DNA, 13 bp, Homo sapiens
tgatccccacgcc

SEQ ID NO: 6460778 - DNA, 19 bp, Homo sapiens
tgatccccacgccacagcc

SEQ ID NO: 6460779 - DNA, 20 bp, Homo sapiens
tgatcccccaaacagcatgt

SEQ ID NO: 6460780 - DNA, 18 bp, Homo sapiens
tgatccccgtctctgccc

SEQ ID NO: 6460781 - DNA, 19 bp, Homo sapiens
tgatccccgtctctgccct

SEQ ID NO: 6460782 - DNA, 22 bp, Homo sapiens
tgatcccctgcttctggctcct

SEQ ID NO: 6460783 - DNA, 21 bp, Homo sapiens
tgatcccctttggttttacta

SEQ ID NO: 6460784 - DNA, 15 bp, Homo sapiens
tgatccctaatgtgt

SEQ ID NO: 6460785 - DNA, 11 bp, Homo sapiens
tgatccctcca

SEQ ID NO: 6460786 - DNA, 19 bp, Homo sapiens
tgatccctctgggggctct

SEQ ID NO: 6460787 - DNA, 21 bp, Homo sapiens
tgatccctgaacccctggcca

SEQ ID NO: 6460788 - DNA, 18 bp, Homo sapiens
tgatccctgctctctgag

SEQ ID NO: 6460789 - DNA, 19 bp, Homo sapiens
tgatccctgtgttgtctct

SEQ ID NO: 6460790 - DNA, 20 bp, Homo sapiens
tgatccctgtgttgtctcta

SEQ ID NO: 6460791 - DNA, 20 bp, Homo sapiens
tgatcccttccccctgctga

SEQ ID NO: 6460792 - DNA, 23 bp, Homo sapiens
tgatcccttccccctgctgatca

SEQ ID NO: 6460793 - DNA, 19 bp, Homo sapiens
tgatcccttgagatatgga

SEQ ID NO: 6460794 - DNA, 23 bp, Homo sapiens
tgatccctttcccatgatccaga

SEQ ID NO: 6460795 - DNA, 19 bp, Homo sapiens
tgatccgcccacctcagcc

SEQ ID NO: 6460796 - DNA, 19 bp, Homo sapiens
tgatccgcctacctcagcc

SEQ ID NO: 6460797 - DNA, 20 bp, Homo sapiens
tgatccgcctgcctctgcct

SEQ ID NO: 6460798 - DNA, 20 bp, Homo sapiens
tgatccggctgctcctccag

SEQ ID NO: 6460799 - DNA, 15 bp, Homo sapiens
tgatccggtttcttt

SEQ ID NO: 6460800 - DNA, 18 bp, Homo sapiens
tgatcctaaatatgacag

SEQ ID NO: 6460801 - DNA, 14 bp, Homo sapiens
tgatcctcacgcct

SEQ ID NO: 6460802 - DNA, 11 bp, Homo sapiens
tgatcctcagt

SEQ ID NO: 6460803 - DNA, 12 bp, Homo sapiens
tgatcctcagtg

SEQ ID NO: 6460804 - DNA, 13 bp, Homo sapiens
tgatcctcagtgc

SEQ ID NO: 6460805 - DNA, 12 bp, Homo sapiens
tgatcctcccac

SEQ ID NO: 6460806 - DNA, 21 bp, Homo sapiens
tgatcctcccacctcagcctc

SEQ ID NO: 6460807 - DNA, 22 bp, Homo sapiens
tgatcctcccacctcagcctcc

SEQ ID NO: 6460808 - DNA, 18 bp, Homo sapiens
tgatcctcccgccccagc

SEQ ID NO: 6460809 - DNA, 20 bp, Homo sapiens
tgatcctcccgccccagcct

SEQ ID NO: 6460810 - DNA, 21 bp, Homo sapiens
tgatcctcccgccccagcctc

SEQ ID NO: 6460811 - DNA, 20 bp, Homo sapiens
tgatcctcctgtcttggcct

SEQ ID NO: 6460812 - DNA, 21 bp, Homo sapiens
tgatcctcctgtcttggcctc

SEQ ID NO: 6460813 - DNA, 20 bp, Homo sapiens
tgatcctgaacaagaaagag

SEQ ID NO: 6460814 - DNA, 13 bp, Homo sapiens
tgatcctgcggag

SEQ ID NO: 6460815 - DNA, 16 bp, Homo sapiens
tgatcctgctccagca

SEQ ID NO: 6460816 - DNA, 19 bp, Homo sapiens
tgatcctgctccagcagca

SEQ ID NO: 6460817 - DNA, 14 bp, Homo sapiens
tgatcctggaggcc

SEQ ID NO: 6460818 - DNA, 13 bp, Homo sapiens
tgatcctgtcctt

SEQ ID NO: 6460819 - DNA, 13 bp, Homo sapiens
tgatcctgtgaag

SEQ ID NO: 6460820 - DNA, 13 bp, Homo sapiens
tgatcctgttctg

SEQ ID NO: 6460821 - DNA, 23 bp, Homo sapiens
tgatccttagatgtgtctcctgt

SEQ ID NO: 6460822 - DNA, 21 bp, Homo sapiens
tgatccttcctactttgcttc

SEQ ID NO: 6460823 - DNA, 22 bp, Homo sapiens
tgatccttcctattcctattct

SEQ ID NO: 6460824 - DNA, 16 bp, Homo sapiens
tgatccttctgagctc

SEQ ID NO: 6460825 - DNA, 12 bp, Homo sapiens
tgatccttggaa

SEQ ID NO: 6460826 - DNA, 18 bp, Homo sapiens
tgatccttggtgctgtgt

SEQ ID NO: 6460827 - DNA, 21 bp, Homo sapiens
tgatccttgttttaagattgt

SEQ ID NO: 6460828 - DNA, 15 bp, Homo sapiens
tgatcgaaaaaataa

SEQ ID NO: 6460829 - DNA, 15 bp, Homo sapiens
tgatcgacgtggtga

SEQ ID NO: 6460830 - DNA, 15 bp, Homo sapiens
tgatcgacttcttgg

SEQ ID NO: 6460831 - DNA, 18 bp, Homo sapiens
tgatcgagccactgcact

SEQ ID NO: 6460832 - DNA, 18 bp, Homo sapiens
tgatcgatgttaaacgtc

SEQ ID NO: 6460833 - DNA, 20 bp, Homo sapiens
tgatcgatgttaaacgtcac

SEQ ID NO: 6460834 - DNA, 13 bp, Homo sapiens
tgatcgcctgtgg

SEQ ID NO: 6460835 - DNA, 22 bp, Homo sapiens
tgatcgccttatttatattcat

SEQ ID NO: 6460836 - DNA, 20 bp, Homo sapiens
tgatcggccagttttcggaa

SEQ ID NO: 6460837 - DNA, 19 bp, Homo sapiens
tgatcgggataacaaaatc

SEQ ID NO: 6460838 - DNA, 20 bp, Homo sapiens
tgatcgtctcggcccctctg

SEQ ID NO: 6460839 - DNA, 15 bp, Homo sapiens
tgatcgtgacgctga

SEQ ID NO: 6460840 - DNA, 16 bp, Homo sapiens
tgatcgtgacgctgaa

SEQ ID NO: 6460841 - DNA, 21 bp, Homo sapiens
tgatcgtgacgctgaataaat

SEQ ID NO: 6460842 - DNA, 17 bp, Homo sapiens
tgatcgttctttctagc

SEQ ID NO: 6460843 - DNA, 22 bp, Homo sapiens
tgatctaaaatttgtaatattt

SEQ ID NO: 6460844 - DNA, 20 bp, Homo sapiens
tgatctaagaagctacagat

SEQ ID NO: 6460845 - DNA, 17 bp, Homo sapiens
tgatctaataaacttta

SEQ ID NO: 6460846 - DNA, 18 bp, Homo sapiens
tgatctaataaactttat

SEQ ID NO: 6460847 - DNA, 19 bp, Homo sapiens
tgatctaataaactttatt

SEQ ID NO: 6460848 - DNA, 15 bp, Homo sapiens
tgatctacatgagga

SEQ ID NO: 6460849 - DNA, 14 bp, Homo sapiens
tgatctacccgtgc

SEQ ID NO: 6460850 - DNA, 17 bp, Homo sapiens
tgatctacccgtgcctg

SEQ ID NO: 6460851 - DNA, 21 bp, Homo sapiens
tgatctaccttgaattgatat

SEQ ID NO: 6460852 - DNA, 21 bp, Homo sapiens
tgatctactcatttgctgaca

SEQ ID NO: 6460853 - DNA, 14 bp, Homo sapiens
tgatctacttgcct

SEQ ID NO: 6460854 - DNA, 17 bp, Homo sapiens
tgatctagagccagtta

SEQ ID NO: 6460855 - DNA, 14 bp, Homo sapiens
tgatctaggaagac

SEQ ID NO: 6460856 - DNA, 15 bp, Homo sapiens
tgatctaggaagact

SEQ ID NO: 6460857 - DNA, 13 bp, Homo sapiens
tgatctaggttta

SEQ ID NO: 6460858 - DNA, 14 bp, Homo sapiens
tgatctaggtttaa

SEQ ID NO: 6460859 - DNA, 19 bp, Homo sapiens
tgatctatgggaaatctag

SEQ ID NO: 6460860 - DNA, 15 bp, Homo sapiens
tgatctattactctg

SEQ ID NO: 6460861 - DNA, 22 bp, Homo sapiens
tgatctattgcagatatttgat

SEQ ID NO: 6460862 - DNA, 16 bp, Homo sapiens
tgatctatttgtagat

SEQ ID NO: 6460863 - DNA, 22 bp, Homo sapiens
tgatctatttgtagattaggat

SEQ ID NO: 6460864 - DNA, 16 bp, Homo sapiens
tgatctcaaactatga

SEQ ID NO: 6460865 - DNA, 22 bp, Homo sapiens
tgatctcagcatcctggaaatt

SEQ ID NO: 6460866 - DNA, 18 bp, Homo sapiens
tgatctcagctcactgca

SEQ ID NO: 6460867 - DNA, 23 bp, Homo sapiens
tgatctcaggagcttgcaagaag

SEQ ID NO: 6460868 - DNA, 19 bp, Homo sapiens
tgatctcagggaagcccag

SEQ ID NO: 6460869 - DNA, 14 bp, Homo sapiens
tgatctcaggttct

SEQ ID NO: 6460870 - DNA, 20 bp, Homo sapiens
tgatctcatcccaataaaat

SEQ ID NO: 6460871 - DNA, 15 bp, Homo sapiens
tgatctcatttaatc

SEQ ID NO: 6460872 - DNA, 16 bp, Homo sapiens
tgatctccatatgtta

SEQ ID NO: 6460873 - DNA, 19 bp, Homo sapiens
tgatctccatatgttacac

SEQ ID NO: 6460874 - DNA, 21 bp, Homo sapiens
tgatctccatatgttacacta

SEQ ID NO: 6460875 - DNA, 13 bp, Homo sapiens
tgatctccctgcc

SEQ ID NO: 6460876 - DNA, 17 bp, Homo sapiens
tgatctccgcagaggct

SEQ ID NO: 6460877 - DNA, 15 bp, Homo sapiens
tgatctccgtggctt

SEQ ID NO: 6460878 - DNA, 18 bp, Homo sapiens
tgatctccgtggctttgg

SEQ ID NO: 6460879 - DNA, 14 bp, Homo sapiens
tgatctcctgagct

SEQ ID NO: 6460880 - DNA, 15 bp, Homo sapiens
tgatctcctggtagc

SEQ ID NO: 6460881 - DNA, 18 bp, Homo sapiens
tgatctcgaactcctaac

SEQ ID NO: 6460882 - DNA, 18 bp, Homo sapiens
tgatctcgactcccccct

SEQ ID NO: 6460883 - DNA, 14 bp, Homo sapiens
tgatctcgatgcag

SEQ ID NO: 6460884 - DNA, 22 bp, Homo sapiens
tgatctcgctgtaagatttgtc

SEQ ID NO: 6460885 - DNA, 15 bp, Homo sapiens
tgatctcggatgacc

SEQ ID NO: 6460886 - DNA, 17 bp, Homo sapiens
tgatctcggctcactgc

SEQ ID NO: 6460887 - DNA, 21 bp, Homo sapiens
tgatctcgtttactccatgtt

SEQ ID NO: 6460888 - DNA, 18 bp, Homo sapiens
tgatctctactaccacaa

SEQ ID NO: 6460889 - DNA, 21 bp, Homo sapiens
tgatctctactaccacaagga

SEQ ID NO: 6460890 - DNA, 20 bp, Homo sapiens
tgatctctcagccccaaaca

SEQ ID NO: 6460891 - DNA, 14 bp, Homo sapiens
tgatctctccacgg

SEQ ID NO: 6460892 - DNA, 18 bp, Homo sapiens
tgatctctcttgtcctct

SEQ ID NO: 6460893 - DNA, 16 bp, Homo sapiens
tgatctctgacctctg

SEQ ID NO: 6460894 - DNA, 17 bp, Homo sapiens
tgatctctgacctctgc

SEQ ID NO: 6460895 - DNA, 15 bp, Homo sapiens
tgatctctgtagaat

SEQ ID NO: 6460896 - DNA, 23 bp, Homo sapiens
tgatctctgttacaaaagaaaaa

SEQ ID NO: 6460897 - DNA, 13 bp, Homo sapiens
tgatctcttagaa

SEQ ID NO: 6460898 - DNA, 12 bp, Homo sapiens
tgatctcttagg

SEQ ID NO: 6460899 - DNA, 12 bp, Homo sapiens
tgatctcttcct

SEQ ID NO: 6460900 - DNA, 13 bp, Homo sapiens
tgatctcttcctg

SEQ ID NO: 6460901 - DNA, 21 bp, Homo sapiens
tgatctcttctggtgttgact

SEQ ID NO: 6460902 - DNA, 23 bp, Homo sapiens
tgatctcttcttttggcttccat

SEQ ID NO: 6460903 - DNA, 14 bp, Homo sapiens
tgatctgaaaaata

SEQ ID NO: 6460904 - DNA, 15 bp, Homo sapiens
tgatctgaacatctg

SEQ ID NO: 6460905 - DNA, 17 bp, Homo sapiens
tgatctgacatccccac

SEQ ID NO: 6460906 - DNA, 20 bp, Homo sapiens
tgatctgaggctaagacaca

SEQ ID NO: 6460907 - DNA, 17 bp, Homo sapiens
tgatctgagtcccagga

SEQ ID NO: 6460908 - DNA, 23 bp, Homo sapiens
tgatctgcaggggtctgggagtc

SEQ ID NO: 6460909 - DNA, 19 bp, Homo sapiens
tgatctgcatatttctgta

SEQ ID NO: 6460910 - DNA, 15 bp, Homo sapiens
tgatctgcccgcctc

SEQ ID NO: 6460911 - DNA, 23 bp, Homo sapiens
tgatctgcccgcctcggcctccc

SEQ ID NO: 6460912 - DNA, 20 bp, Homo sapiens
tgatctgctagtgctgtaat

SEQ ID NO: 6460913 - DNA, 14 bp, Homo sapiens
tgatctgctcagcc

SEQ ID NO: 6460914 - DNA, 17 bp, Homo sapiens
tgatctgctcagccctg

SEQ ID NO: 6460915 - DNA, 16 bp, Homo sapiens
tgatctgctctgtttt

SEQ ID NO: 6460916 - DNA, 14 bp, Homo sapiens
tgatctgctgctga

SEQ ID NO: 6460917 - DNA, 18 bp, Homo sapiens
tgatctgcttttcagaat

SEQ ID NO: 6460918 - DNA, 13 bp, Homo sapiens
tgatctggaaccc

SEQ ID NO: 6460919 - DNA, 14 bp, Homo sapiens
tgatctggaaccca

SEQ ID NO: 6460920 - DNA, 14 bp, Homo sapiens
tgatctggacagaa

SEQ ID NO: 6460921 - DNA, 16 bp, Homo sapiens
tgatctggcccaagct

SEQ ID NO: 6460922 - DNA, 20 bp, Homo sapiens
tgatctgggcattttcctcc

SEQ ID NO: 6460923 - DNA, 18 bp, Homo sapiens
tgatctggtgcgtgtggc

SEQ ID NO: 6460924 - DNA, 19 bp, Homo sapiens
tgatctggtgcgtgtggcc

SEQ ID NO: 6460925 - DNA, 18 bp, Homo sapiens
tgatctggtggttattta

SEQ ID NO: 6460926 - DNA, 13 bp, Homo sapiens
tgatctgtacttt

SEQ ID NO: 6460927 - DNA, 17 bp, Homo sapiens
tgatctgtactttgtgt

SEQ ID NO: 6460928 - DNA, 18 bp, Homo sapiens
tgatctgtagacttctgg

SEQ ID NO: 6460929 - DNA, 14 bp, Homo sapiens
tgatctgtagtttt

SEQ ID NO: 6460930 - DNA, 14 bp, Homo sapiens
tgatctgtataaaa

SEQ ID NO: 6460931 - DNA, 13 bp, Homo sapiens
tgatctgtatata

SEQ ID NO: 6460932 - DNA, 14 bp, Homo sapiens
tgatctgtattaag

SEQ ID NO: 6460933 - DNA, 22 bp, Homo sapiens
tgatctgtattaagctccagtg

SEQ ID NO: 6460934 - DNA, 14 bp, Homo sapiens
tgatctgtccacct

SEQ ID NO: 6460935 - DNA, 12 bp, Homo sapiens
tcctttctcaga

SEQ ID NO: 6460936 - DNA, 14 bp, Homo sapiens
tcctttctcagccg

SEQ ID NO: 6460937 - DNA, 17 bp, Homo sapiens
tcctttctcatttcttt

SEQ ID NO: 6460938 - DNA, 10 bp, Homo sapiens
tcctttctcc

SEQ ID NO: 6460939 - DNA, 13 bp, Homo sapiens
tcctttctccaat

SEQ ID NO: 6460940 - DNA, 17 bp, Homo sapiens
tcctttctccagccagc

SEQ ID NO: 6460941 - DNA, 18 bp, Homo sapiens
tcctttctccagccagca

SEQ ID NO: 6460942 - DNA, 13 bp, Homo sapiens
tcctttctccagg

SEQ ID NO: 6460943 - DNA, 17 bp, Homo sapiens
tcctttctccaggacca

SEQ ID NO: 6460944 - DNA, 14 bp, Homo sapiens
tcctttctccctgc

SEQ ID NO: 6460945 - DNA, 16 bp, Homo sapiens
tcctttctcctgcccc

SEQ ID NO: 6460946 - DNA, 17 bp, Homo sapiens
tcctttctcctgtgaat

SEQ ID NO: 6460947 - DNA, 14 bp, Homo sapiens
tcctttctctcttt

SEQ ID NO: 6460948 - DNA, 17 bp, Homo sapiens
tcctttctgagggcccg

SEQ ID NO: 6460949 - DNA, 17 bp, Homo sapiens
tcctttctgatcttcac

SEQ ID NO: 6460950 - DNA, 22 bp, Homo sapiens
tcctttctgcagacgtctgcct

SEQ ID NO: 6460951 - DNA, 14 bp, Homo sapiens
tcctttctgccttg

SEQ ID NO: 6460952 - DNA, 20 bp, Homo sapiens
tcctttctgccttggcctcg

SEQ ID NO: 6460953 - DNA, 19 bp, Homo sapiens
tcctttctggccccagcct

SEQ ID NO: 6460954 - DNA, 19 bp, Homo sapiens
tcctttctgtgaagctaat

SEQ ID NO: 6460955 - DNA, 13 bp, Homo sapiens
tcctttctgtgcc

SEQ ID NO: 6460956 - DNA, 18 bp, Homo sapiens
tcctttctgtggtgaggg

SEQ ID NO: 6460957 - DNA, 12 bp, Homo sapiens
tcctttcttccg

SEQ ID NO: 6460958 - DNA, 20 bp, Homo sapiens
tcctttcttccggcccctcc

SEQ ID NO: 6460959 - DNA, 17 bp, Homo sapiens
tcctttcttccttcctt

SEQ ID NO: 6460960 - DNA, 18 bp, Homo sapiens
tcctttcttccttggcca

SEQ ID NO: 6460961 - DNA, 22 bp, Homo sapiens
tcctttcttggttcataaatga

SEQ ID NO: 6460962 - DNA, 17 bp, Homo sapiens
tcctttcttgtctttcc

SEQ ID NO: 6460963 - DNA, 14 bp, Homo sapiens
tcctttctttaaac

SEQ ID NO: 6460964 - DNA, 20 bp, Homo sapiens
tcctttctttttcttcttcc

SEQ ID NO: 6460965 - DNA, 21 bp, Homo sapiens
tcctttcttttttttcttggt

SEQ ID NO: 6460966 - DNA, 15 bp, Homo sapiens
tcctttgaaagactg

SEQ ID NO: 6460967 - DNA, 19 bp, Homo sapiens
tcctttgaacgtgcttctt

SEQ ID NO: 6460968 - DNA, 15 bp, Homo sapiens
tcctttgaagaaggc

SEQ ID NO: 6460969 - DNA, 24 bp, Homo sapiens
tcctttgaagaattgtagttctta

SEQ ID NO: 6460970 - DNA, 19 bp, Homo sapiens
tcctttgacaaaagtaaat

SEQ ID NO: 6460971 - DNA, 22 bp, Homo sapiens
tcctttgacaaaagtaaatggg

SEQ ID NO: 6460972 - DNA, 13 bp, Homo sapiens
tcctttgacattt

SEQ ID NO: 6460973 - DNA, 12 bp, Homo sapiens
tcctttgagaaa

SEQ ID NO: 6460974 - DNA, 16 bp, Homo sapiens
tcctttgagaaagaaa

SEQ ID NO: 6460975 - DNA, 18 bp, Homo sapiens
tcctttgagaatgtgatt

SEQ ID NO: 6460976 - DNA, 19 bp, Homo sapiens
tcctttgagaatgtgattc

SEQ ID NO: 6460977 - DNA, 22 bp, Homo sapiens
tcctttgatattatgtggcttt

SEQ ID NO: 6460978 - DNA, 20 bp, Homo sapiens
tcctttgcaattgctcttct

SEQ ID NO: 6460979 - DNA, 21 bp, Homo sapiens
tcctttgcaattgctcttctc

SEQ ID NO: 6460980 - DNA, 13 bp, Homo sapiens
tcctttgcaccct

SEQ ID NO: 6460981 - DNA, 14 bp, Homo sapiens
tcctttgcactgag

SEQ ID NO: 6460982 - DNA, 22 bp, Homo sapiens
tcctttgcatggcagggcctca

SEQ ID NO: 6460983 - DNA, 16 bp, Homo sapiens
tcctttgcattcatct

SEQ ID NO: 6460984 - DNA, 17 bp, Homo sapiens
tcctttgcattccatga

SEQ ID NO: 6460985 - DNA, 12 bp, Homo sapiens
tcctttgccctt

SEQ ID NO: 6460986 - DNA, 21 bp, Homo sapiens
tcctttgcccttacctgtctc

SEQ ID NO: 6460987 - DNA, 16 bp, Homo sapiens
tcctttgcccttcctc

SEQ ID NO: 6460988 - DNA, 22 bp, Homo sapiens
tcctttgcccttcctcctgcct

SEQ ID NO: 6460989 - DNA, 15 bp, Homo sapiens
tcctttgcctctgct

SEQ ID NO: 6460990 - DNA, 17 bp, Homo sapiens
tcctttgcgcaaacttt

SEQ ID NO: 6460991 - DNA, 17 bp, Homo sapiens
tcctttgcgcctgtgac

SEQ ID NO: 6460992 - DNA, 15 bp, Homo sapiens
tcctttgctctgagg

SEQ ID NO: 6460993 - DNA, 13 bp, Homo sapiens
tcctttgctctgg

SEQ ID NO: 6460994 - DNA, 22 bp, Homo sapiens
tcctttgctcttgccattttaa

SEQ ID NO: 6460995 - DNA, 22 bp, Homo sapiens
tcctttggaacaagacagcctt

SEQ ID NO: 6460996 - DNA, 14 bp, Homo sapiens
tcctttggaacaat

SEQ ID NO: 6460997 - DNA, 22 bp, Homo sapiens
tcctttggagcttttttcttta

SEQ ID NO: 6460998 - DNA, 16 bp, Homo sapiens
tcctttggcaatatca

SEQ ID NO: 6460999 - DNA, 22 bp, Homo sapiens
tcctttggcatgtttaattgtg

SEQ ID NO: 6461000 - DNA, 23 bp, Homo sapiens
tcctttgggagctcattcttttc

SEQ ID NO: 6461001 - DNA, 21 bp, Homo sapiens
tcctttggggaagtttatttg

SEQ ID NO: 6461002 - DNA, 18 bp, Homo sapiens
tcctttggggcttctgtg

SEQ ID NO: 6461003 - DNA, 15 bp, Homo sapiens
tcctttgggtgactc

SEQ ID NO: 6461004 - DNA, 18 bp, Homo sapiens
tcctttggtcctggtgct

SEQ ID NO: 6461005 - DNA, 13 bp, Homo sapiens
tcctttgtacttt

SEQ ID NO: 6461006 - DNA, 11 bp, Homo sapiens
tcctttgtata

SEQ ID NO: 6461007 - DNA, 18 bp, Homo sapiens
tcctttgtattctgtctt

SEQ ID NO: 6461008 - DNA, 15 bp, Homo sapiens
tcctttgtcaaatgg

SEQ ID NO: 6461009 - DNA, 13 bp, Homo sapiens
tcctttgtcattt

SEQ ID NO: 6461010 - DNA, 11 bp, Homo sapiens
tcctttgtctt

SEQ ID NO: 6461011 - DNA, 14 bp, Homo sapiens
tcctttgtcttgga

SEQ ID NO: 6461012 - DNA, 17 bp, Homo sapiens
tcctttgtgaatatttt

SEQ ID NO: 6461013 - DNA, 17 bp, Homo sapiens
tcctttgtgcttagtta

SEQ ID NO: 6461014 - DNA, 17 bp, Homo sapiens
tcctttgtggttttatg

SEQ ID NO: 6461015 - DNA, 15 bp, Homo sapiens
tcctttgtgtttata

SEQ ID NO: 6461016 - DNA, 13 bp, Homo sapiens
tcctttgttactt

SEQ ID NO: 6461017 - DNA, 10 bp, Homo sapiens
tcctttgttc

SEQ ID NO: 6461018 - DNA, 20 bp, Homo sapiens
tcctttgttccctaagtcca

SEQ ID NO: 6461019 - DNA, 16 bp, Homo sapiens
tcctttgttcttacct

SEQ ID NO: 6461020 - DNA, 15 bp, Homo sapiens
tcctttgttgctgtt

SEQ ID NO: 6461021 - DNA, 16 bp, Homo sapiens
tcctttgttgctgttg

SEQ ID NO: 6461022 - DNA, 18 bp, Homo sapiens
tcctttgttgctgttgct

SEQ ID NO: 6461023 - DNA, 19 bp, Homo sapiens
tcctttgttgtctacatta

SEQ ID NO: 6461024 - DNA, 20 bp, Homo sapiens
tcctttgttttctgactaat

SEQ ID NO: 6461025 - DNA, 15 bp, Homo sapiens
tcctttgtttttatg

SEQ ID NO: 6461026 - DNA, 19 bp, Homo sapiens
tcctttgtttttttttcct

SEQ ID NO: 6461027 - DNA, 16 bp, Homo sapiens
tccttttaagaaagct

SEQ ID NO: 6461028 - DNA, 14 bp, Homo sapiens
tccttttaattcta

SEQ ID NO: 6461029 - DNA, 14 bp, Homo sapiens
tccttttagcctag

SEQ ID NO: 6461030 - DNA, 12 bp, Homo sapiens
tccttttatgtg

SEQ ID NO: 6461031 - DNA, 15 bp, Homo sapiens
tccttttatgttatt

SEQ ID NO: 6461032 - DNA, 15 bp, Homo sapiens
tccttttattaaaac

SEQ ID NO: 6461033 - DNA, 21 bp, Homo sapiens
tccttttatttctccatcttt

SEQ ID NO: 6461034 - DNA, 20 bp, Homo sapiens
tccttttcataggtctgaaa

SEQ ID NO: 6461035 - DNA, 13 bp, Homo sapiens
tccttttcatctg

SEQ ID NO: 6461036 - DNA, 15 bp, Homo sapiens
tccttttccagagca

SEQ ID NO: 6461037 - DNA, 23 bp, Homo sapiens
tccttttccagagcattccagtc

SEQ ID NO: 6461038 - DNA, 20 bp, Homo sapiens
tccttttcccctacagaatt

SEQ ID NO: 6461039 - DNA, 23 bp, Homo sapiens
tccttttccgttctgttctgctg

SEQ ID NO: 6461040 - DNA, 11 bp, Homo sapiens
tccttttccta

SEQ ID NO: 6461041 - DNA, 14 bp, Homo sapiens
tccttttccttacc

SEQ ID NO: 6461042 - DNA, 23 bp, Homo sapiens
tccttttccttatttgccttcta

SEQ ID NO: 6461043 - DNA, 14 bp, Homo sapiens
tccttttctccact

SEQ ID NO: 6461044 - DNA, 16 bp, Homo sapiens
tccttttctcctatct

SEQ ID NO: 6461045 - DNA, 16 bp, Homo sapiens
tccttttctctcctgt

SEQ ID NO: 6461046 - DNA, 19 bp, Homo sapiens
tccttttcttcaccctccc

SEQ ID NO: 6461047 - DNA, 13 bp, Homo sapiens
tccttttcttcct

SEQ ID NO: 6461048 - DNA, 21 bp, Homo sapiens
tccttttcttccttctttctc

SEQ ID NO: 6461049 - DNA, 19 bp, Homo sapiens
tccttttcttggcttgttt

SEQ ID NO: 6461050 - DNA, 18 bp, Homo sapiens
tccttttcttgtttatca

SEQ ID NO: 6461051 - DNA, 15 bp, Homo sapiens
tccttttcttttgtt

SEQ ID NO: 6461052 - DNA, 23 bp, Homo sapiens
tccttttcttttgttactgttct

SEQ ID NO: 6461053 - DNA, 14 bp, Homo sapiens
tccttttgacactg

SEQ ID NO: 6461054 - DNA, 18 bp, Homo sapiens
tccttttgacactgctct

SEQ ID NO: 6461055 - DNA, 14 bp, Homo sapiens
tccttttgaccttc

SEQ ID NO: 6461056 - DNA, 23 bp, Homo sapiens
tccttttgaccttcatttcatgt

SEQ ID NO: 6461057 - DNA, 21 bp, Homo sapiens
tccttttgactccttttggaa

SEQ ID NO: 6461058 - DNA, 22 bp, Homo sapiens
tccttttgactccttttggaac

SEQ ID NO: 6461059 - DNA, 22 bp, Homo sapiens
tccttttgaggagctggagggg

SEQ ID NO: 6461060 - DNA, 16 bp, Homo sapiens
tccttttgataaattt

SEQ ID NO: 6461061 - DNA, 19 bp, Homo sapiens
tccttttgcaacaagacaa

SEQ ID NO: 6461062 - DNA, 13 bp, Homo sapiens
tccttttgctgtc

SEQ ID NO: 6461063 - DNA, 16 bp, Homo sapiens
tccttttgctgtcttt

SEQ ID NO: 6461064 - DNA, 17 bp, Homo sapiens
tccttttgcttcatctg

SEQ ID NO: 6461065 - DNA, 14 bp, Homo sapiens
tccttttggagtca

SEQ ID NO: 6461066 - DNA, 13 bp, Homo sapiens
tccttttggcctg

SEQ ID NO: 6461067 - DNA, 14 bp, Homo sapiens
tccttttggcctgg

SEQ ID NO: 6461068 - DNA, 21 bp, Homo sapiens
tccttttggcctgggggaggt

SEQ ID NO: 6461069 - DNA, 17 bp, Homo sapiens
tccttttgtagaatgaa

SEQ ID NO: 6461070 - DNA, 15 bp, Homo sapiens
tccttttgtatcctc

SEQ ID NO: 6461071 - DNA, 16 bp, Homo sapiens
tccttttgtatcctcc

SEQ ID NO: 6461072 - DNA, 18 bp, Homo sapiens
tccttttgtatcttcctt

SEQ ID NO: 6461073 - DNA, 21 bp, Homo sapiens
tccttttgtatcttcctttct

SEQ ID NO: 6461074 - DNA, 18 bp, Homo sapiens
tccttttgtccccagggc

SEQ ID NO: 6461075 - DNA, 19 bp, Homo sapiens
tccttttgtccccagggcc

SEQ ID NO: 6461076 - DNA, 20 bp, Homo sapiens
tccttttgtccccagggccc

SEQ ID NO: 6461077 - DNA, 14 bp, Homo sapiens
tcctttttaaatgt

SEQ ID NO: 6461078 - DNA, 17 bp, Homo sapiens
tcctttttaaatgtgaa

SEQ ID NO: 6461079 - DNA, 21 bp, Homo sapiens
tcctttttaaatgtgaatttt

SEQ ID NO: 6461080 - DNA, 17 bp, Homo sapiens
tcctttttaatatgctt

SEQ ID NO: 6461081 - DNA, 13 bp, Homo sapiens
tcctttttattta

SEQ ID NO: 6461082 - DNA, 14 bp, Homo sapiens
tcctttttatttat

SEQ ID NO: 6461083 - DNA, 15 bp, Homo sapiens
tcctttttatttata

SEQ ID NO: 6461084 - DNA, 17 bp, Homo sapiens
tcctttttcaaatgagt

SEQ ID NO: 6461085 - DNA, 17 bp, Homo sapiens
tcctttttccaatgttt

SEQ ID NO: 6461086 - DNA, 21 bp, Homo sapiens
tcctttttccatcattttaca

SEQ ID NO: 6461087 - DNA, 16 bp, Homo sapiens
tcctttttcctctcca

SEQ ID NO: 6461088 - DNA, 20 bp, Homo sapiens
tcctttttctccctctggat

SEQ ID NO: 6461089 - DNA, 14 bp, Homo sapiens
tcctttttctgatt

SEQ ID NO: 6461090 - DNA, 22 bp, Homo sapiens
tcctttttctgattagctttgt

SEQ ID NO: 6461091 - DNA, 23 bp, Homo sapiens
tcctttttctgattagctttgtg

SEQ ID NO: 6461092 - DNA, 19 bp, Homo sapiens
tcctttttctttataaact

SEQ ID NO: 6461093 - DNA, 18 bp, Homo sapiens
tcctttttctttcctttc

SEQ ID NO: 6461094 - DNA, 18 bp, Homo sapiens
tcctttttctttttttaa

SEQ ID NO: 6461095 - DNA, 14 bp, Homo sapiens
tcctttttgacact

SEQ ID NO: 6461096 - DNA, 17 bp, Homo sapiens
tcctttttgacactgaa

SEQ ID NO: 6461097 - DNA, 23 bp, Homo sapiens
tcctttttggtcgaggagtaaca

SEQ ID NO: 6461098 - DNA, 16 bp, Homo sapiens
tcctttttggttttta

SEQ ID NO: 6461099 - DNA, 20 bp, Homo sapiens
tcctttttgtaaatatgtga

SEQ ID NO: 6461100 - DNA, 17 bp, Homo sapiens
tccttttttaactgtgt

SEQ ID NO: 6461101 - DNA, 22 bp, Homo sapiens
tccttttttcccataagacaat

SEQ ID NO: 6461102 - DNA, 20 bp, Homo sapiens
tccttttttcctttcctgat

SEQ ID NO: 6461103 - DNA, 16 bp, Homo sapiens
tccttttttcttttct

SEQ ID NO: 6461104 - DNA, 12 bp, Homo sapiens
tccttttttgtc

SEQ ID NO: 6461105 - DNA, 16 bp, Homo sapiens
tccttttttgtctatg

SEQ ID NO: 6461106 - DNA, 22 bp, Homo sapiens
tccttttttgttcctttttcct

SEQ ID NO: 6461107 - DNA, 17 bp, Homo sapiens
tcctttttttaaatttt

SEQ ID NO: 6461108 - DNA, 24 bp, Homo sapiens
tcctttttttaaattttctccagt

SEQ ID NO: 6461109 - DNA, 21 bp, Homo sapiens
tcctttttttccatctttaca

SEQ ID NO: 6461110 - DNA, 13 bp, Homo sapiens
tcctttttttccc

SEQ ID NO: 6461111 - DNA, 20 bp, Homo sapiens
tcctttttttcccttttctt

SEQ ID NO: 6461112 - DNA, 13 bp, Homo sapiens
tcgaaaagaaatt

SEQ ID NO: 6461113 - DNA, 21 bp, Homo sapiens
tcgaaaagaaattgtccttga

SEQ ID NO: 6461114 - DNA, 21 bp, Homo sapiens
tcgaaaagagtcttccaatta

SEQ ID NO: 6461115 - DNA, 19 bp, Homo sapiens
tgatctgtcccctctcccc

SEQ ID NO: 6461116 - DNA, 13 bp, Homo sapiens
tgatctgtccttc

SEQ ID NO: 6461117 - DNA, 19 bp, Homo sapiens
tgatctgtcttgtaatatt

SEQ ID NO: 6461118 - DNA, 21 bp, Homo sapiens
tgatctgtgatagttcacccc

SEQ ID NO: 6461119 - DNA, 14 bp, Homo sapiens
tgatctgtgatttc

SEQ ID NO: 6461120 - DNA, 16 bp, Homo sapiens
tgatctgtgatttctt

SEQ ID NO: 6461121 - DNA, 11 bp, Homo sapiens
tgatctgtgct

SEQ ID NO: 6461122 - DNA, 20 bp, Homo sapiens
tgatctgtggagaatgtaca

SEQ ID NO: 6461123 - DNA, 18 bp, Homo sapiens
tgatctgtgtaaaatctg

SEQ ID NO: 6461124 - DNA, 18 bp, Homo sapiens
tgatctgttgtaatatca

SEQ ID NO: 6461125 - DNA, 18 bp, Homo sapiens
tgatctgttttacaggaa

SEQ ID NO: 6461126 - DNA, 20 bp, Homo sapiens
tgatctgttttacaggaaac

SEQ ID NO: 6461127 - DNA, 16 bp, Homo sapiens
tgatctgttttggatg

SEQ ID NO: 6461128 - DNA, 23 bp, Homo sapiens
tgatcttacacgaagaaatagaa

SEQ ID NO: 6461129 - DNA, 16 bp, Homo sapiens
tgatcttacagaaaat

SEQ ID NO: 6461130 - DNA, 15 bp, Homo sapiens
tgatcttaggtttgt

SEQ ID NO: 6461131 - DNA, 15 bp, Homo sapiens
tgatcttatttttct

SEQ ID NO: 6461132 - DNA, 20 bp, Homo sapiens
tgatcttatttttctaaacg

SEQ ID NO: 6461133 - DNA, 12 bp, Homo sapiens
tgatcttcacta

SEQ ID NO: 6461134 - DNA, 19 bp, Homo sapiens
tgatcttctgggagcagga

SEQ ID NO: 6461135 - DNA, 20 bp, Homo sapiens
tgatcttctgggagcaggaa

SEQ ID NO: 6461136 - DNA, 15 bp, Homo sapiens
tgatcttcttcatcc

SEQ ID NO: 6461137 - DNA, 18 bp, Homo sapiens
tgatcttgcctgtctggc

SEQ ID NO: 6461138 - DNA, 20 bp, Homo sapiens
tgatcttgctctatctcaca

SEQ ID NO: 6461139 - DNA, 17 bp, Homo sapiens
tgatcttggaaagaggt

SEQ ID NO: 6461140 - DNA, 15 bp, Homo sapiens
tgatcttgtgacata

SEQ ID NO: 6461141 - DNA, 18 bp, Homo sapiens
tgatcttgtgctcagcat

SEQ ID NO: 6461142 - DNA, 14 bp, Homo sapiens
tgatctttaaaata

SEQ ID NO: 6461143 - DNA, 17 bp, Homo sapiens
tgatctttaaaatacac

SEQ ID NO: 6461144 - DNA, 17 bp, Homo sapiens
tgatctttcaatatcat

SEQ ID NO: 6461145 - DNA, 11 bp, Homo sapiens
tgatctttgag

SEQ ID NO: 6461146 - DNA, 16 bp, Homo sapiens
tgatctttgcagacag

SEQ ID NO: 6461147 - DNA, 19 bp, Homo sapiens
tgatctttgtttaaatgcc

SEQ ID NO: 6461148 - DNA, 15 bp, Homo sapiens
tgatcttttaaagtg

SEQ ID NO: 6461149 - DNA, 12 bp, Homo sapiens
tgatcttttaag

SEQ ID NO: 6461150 - DNA, 22 bp, Homo sapiens
tgatcttttaagtttccttccc

SEQ ID NO: 6461151 - DNA, 15 bp, Homo sapiens
tgatcttttcagtgt

SEQ ID NO: 6461152 - DNA, 18 bp, Homo sapiens
tgatctttttatacacaa

SEQ ID NO: 6461153 - DNA, 15 bp, Homo sapiens
tgatctttttatcat

SEQ ID NO: 6461154 - DNA, 19 bp, Homo sapiens
tgatgaaaaattgctgact

SEQ ID NO: 6461155 - DNA, 21 bp, Homo sapiens
tgatgaaaaattgctgactgt

SEQ ID NO: 6461156 - DNA, 20 bp, Homo sapiens
tgatgaaaacaaaatcacag

SEQ ID NO: 6461157 - DNA, 19 bp, Homo sapiens
tgatgaaaactaaggattt

SEQ ID NO: 6461158 - DNA, 20 bp, Homo sapiens
tgatgaaaactaaggatttt

SEQ ID NO: 6461159 - DNA, 14 bp, Homo sapiens
tgatgaaaagattt

SEQ ID NO: 6461160 - DNA, 22 bp, Homo sapiens
tgatgaaaagctttgtttgttc

SEQ ID NO: 6461161 - DNA, 15 bp, Homo sapiens
tgatgaaaatattta

SEQ ID NO: 6461162 - DNA, 23 bp, Homo sapiens
tgatgaaaatgaatagagagtat

SEQ ID NO: 6461163 - DNA, 14 bp, Homo sapiens
tgatgaaataaaat

SEQ ID NO: 6461164 - DNA, 19 bp, Homo sapiens
tgatgaaataacacagcag

SEQ ID NO: 6461165 - DNA, 16 bp, Homo sapiens
tgatgaaatatgaaac

SEQ ID NO: 6461166 - DNA, 13 bp, Homo sapiens
tgatgaaatcatt

SEQ ID NO: 6461167 - DNA, 13 bp, Homo sapiens
tgatgaaatcttt

SEQ ID NO: 6461168 - DNA, 16 bp, Homo sapiens
tgatgaaatctttctt

SEQ ID NO: 6461169 - DNA, 23 bp, Homo sapiens
tgatgaaatgaggtcagagcctg

SEQ ID NO: 6461170 - DNA, 18 bp, Homo sapiens
tgatgaaatgtaaatact

SEQ ID NO: 6461171 - DNA, 23 bp, Homo sapiens
tgatgaacatattcatgaaatgt

SEQ ID NO: 6461172 - DNA, 11 bp, Homo sapiens
tgatgaagaag

SEQ ID NO: 6461173 - DNA, 14 bp, Homo sapiens
tgatgaagaagggg

SEQ ID NO: 6461174 - DNA, 14 bp, Homo sapiens
tgatgaagaggagt

SEQ ID NO: 6461175 - DNA, 16 bp, Homo sapiens
tgatgaagcaaggaag

SEQ ID NO: 6461176 - DNA, 21 bp, Homo sapiens
tgatgaagccgaccttagatt

SEQ ID NO: 6461177 - DNA, 14 bp, Homo sapiens
tgatgaagcctgtg

SEQ ID NO: 6461178 - DNA, 20 bp, Homo sapiens
tgatgaagcctgtgccacct

SEQ ID NO: 6461179 - DNA, 21 bp, Homo sapiens
tgatgaagcctgtgccacctg

SEQ ID NO: 6461180 - DNA, 23 bp, Homo sapiens
tgatgaagcctgtgccacctgca

SEQ ID NO: 6461181 - DNA, 16 bp, Homo sapiens
tgatgaagctgaggct

SEQ ID NO: 6461182 - DNA, 13 bp, Homo sapiens
tgatgaatcactg

SEQ ID NO: 6461183 - DNA, 14 bp, Homo sapiens
tgatgaatcactgt

SEQ ID NO: 6461184 - DNA, 20 bp, Homo sapiens
tgatgaatcactgttgcttt

SEQ ID NO: 6461185 - DNA, 22 bp, Homo sapiens
tgatgaatcagtcctagaatgt

SEQ ID NO: 6461186 - DNA, 20 bp, Homo sapiens
tgatgaatgaggaacaatca

SEQ ID NO: 6461187 - DNA, 15 bp, Homo sapiens
tgatgaatgtaaagt

SEQ ID NO: 6461188 - DNA, 23 bp, Homo sapiens
tgatgacaaacccaggagtttgt

SEQ ID NO: 6461189 - DNA, 21 bp, Homo sapiens
tgatgacaactggaatagttt

SEQ ID NO: 6461190 - DNA, 20 bp, Homo sapiens
tgatgacacccaccctgtgc

SEQ ID NO: 6461191 - DNA, 17 bp, Homo sapiens
tgatgacagtagtacca

SEQ ID NO: 6461192 - DNA, 18 bp, Homo sapiens
tgatgacatatcacatgt

SEQ ID NO: 6461193 - DNA, 18 bp, Homo sapiens
tgatgacattccctgcta

SEQ ID NO: 6461194 - DNA, 14 bp, Homo sapiens
tgatgaccaagaat

SEQ ID NO: 6461195 - DNA, 17 bp, Homo sapiens
tgatgaccaatctctgt

SEQ ID NO: 6461196 - DNA, 18 bp, Homo sapiens
tgatgaccaatctctgtg

SEQ ID NO: 6461197 - DNA, 14 bp, Homo sapiens
tgatgaccaatggg

SEQ ID NO: 6461198 - DNA, 13 bp, Homo sapiens
tgatgacccacta

SEQ ID NO: 6461199 - DNA, 16 bp, Homo sapiens
tgatgacccactaaag

SEQ ID NO: 6461200 - DNA, 19 bp, Homo sapiens
tgatgacccactaaagagt

SEQ ID NO: 6461201 - DNA, 22 bp, Homo sapiens
tgatgaccttatcagcttcctg

SEQ ID NO: 6461202 - DNA, 15 bp, Homo sapiens
tgatgacgcctgtct

SEQ ID NO: 6461203 - DNA, 19 bp, Homo sapiens
tgatgacgtacaagtagtt

SEQ ID NO: 6461204 - DNA, 21 bp, Homo sapiens
tgatgacgtacaagtagttct

SEQ ID NO: 6461205 - DNA, 21 bp, Homo sapiens
tgatgactacctcagaacata

SEQ ID NO: 6461206 - DNA, 22 bp, Homo sapiens
tgatgactcaagattcccagga

SEQ ID NO: 6461207 - DNA, 23 bp, Homo sapiens
tgatgactcaagattcccaggag

SEQ ID NO: 6461208 - DNA, 20 bp, Homo sapiens
tgatgactcttcttatcaca

SEQ ID NO: 6461209 - DNA, 13 bp, Homo sapiens
tgatgactgctga

SEQ ID NO: 6461210 - DNA, 16 bp, Homo sapiens
tgatgactgctgattt

SEQ ID NO: 6461211 - DNA, 14 bp, Homo sapiens
tgatgactgcttgt

SEQ ID NO: 6461212 - DNA, 17 bp, Homo sapiens
tgatgactggaattttt

SEQ ID NO: 6461213 - DNA, 13 bp, Homo sapiens
tgatgacttgagc

SEQ ID NO: 6461214 - DNA, 14 bp, Homo sapiens
tgatgacttgctgt

SEQ ID NO: 6461215 - DNA, 14 bp, Homo sapiens
tgatgagacaacac

SEQ ID NO: 6461216 - DNA, 19 bp, Homo sapiens
tgatgagacagtgaagtaa

SEQ ID NO: 6461217 - DNA, 13 bp, Homo sapiens
tgatgagacctgg

SEQ ID NO: 6461218 - DNA, 23 bp, Homo sapiens
tgatgagagaatggagacagagt

SEQ ID NO: 6461219 - DNA, 14 bp, Homo sapiens
tgatgagagaatgt

SEQ ID NO: 6461220 - DNA, 16 bp, Homo sapiens
tgatgagagaatgtgg

SEQ ID NO: 6461221 - DNA, 19 bp, Homo sapiens
tgatgagagaatgtggaaa

SEQ ID NO: 6461222 - DNA, 13 bp, Homo sapiens
tgatgagaggaaa

SEQ ID NO: 6461223 - DNA, 20 bp, Homo sapiens
tgatgagatattaaattctc

SEQ ID NO: 6461224 - DNA, 16 bp, Homo sapiens
tgatgagattcactta

SEQ ID NO: 6461225 - DNA, 17 bp, Homo sapiens
tgatgagcactcctgat

SEQ ID NO: 6461226 - DNA, 18 bp, Homo sapiens
tgatgagcactcctgatt

SEQ ID NO: 6461227 - DNA, 14 bp, Homo sapiens
tgatgagcagactt

SEQ ID NO: 6461228 - DNA, 18 bp, Homo sapiens
tgatgagccatattaatt

SEQ ID NO: 6461229 - DNA, 15 bp, Homo sapiens
tgatgagctcctctt

SEQ ID NO: 6461230 - DNA, 15 bp, Homo sapiens
tgatgagctgaaaag

SEQ ID NO: 6461231 - DNA, 17 bp, Homo sapiens
tgatgaggactgtcccc

SEQ ID NO: 6461232 - DNA, 12 bp, Homo sapiens
tgatgaggcatt

SEQ ID NO: 6461233 - DNA, 13 bp, Homo sapiens
tgatgaggcattt

SEQ ID NO: 6461234 - DNA, 16 bp, Homo sapiens
tgatgaggccctccac

SEQ ID NO: 6461235 - DNA, 22 bp, Homo sapiens
tgatgaggccgcggcctccccg

SEQ ID NO: 6461236 - DNA, 17 bp, Homo sapiens
tgatgaggctgatcatt

SEQ ID NO: 6461237 - DNA, 15 bp, Homo sapiens
tgatgaggctggtga

SEQ ID NO: 6461238 - DNA, 13 bp, Homo sapiens
tgatgagggcagc

SEQ ID NO: 6461239 - DNA, 23 bp, Homo sapiens
tgatgagggcagcagccagccct

SEQ ID NO: 6461240 - DNA, 13 bp, Homo sapiens
tgatgaggtattt

SEQ ID NO: 6461241 - DNA, 15 bp, Homo sapiens
tgatgagtaaactga

SEQ ID NO: 6461242 - DNA, 20 bp, Homo sapiens
tgatgagtaaactgaggccc

SEQ ID NO: 6461243 - DNA, 21 bp, Homo sapiens
tgatgagtaaactgaggccca

SEQ ID NO: 6461244 - DNA, 14 bp, Homo sapiens
tgatgagtcttgat

SEQ ID NO: 6461245 - DNA, 17 bp, Homo sapiens
tgatgagtgtaacaaga

SEQ ID NO: 6461246 - DNA, 17 bp, Homo sapiens
tgatgagttaactgtga

SEQ ID NO: 6461247 - DNA, 18 bp, Homo sapiens
tgatgagtttgacagttt

SEQ ID NO: 6461248 - DNA, 18 bp, Homo sapiens
tgatgagtttttatggtt

SEQ ID NO: 6461249 - DNA, 21 bp, Homo sapiens
tgatgataaaaggagaataag

SEQ ID NO: 6461250 - DNA, 19 bp, Homo sapiens
tgatgataacacttaaaat

SEQ ID NO: 6461251 - DNA, 13 bp, Homo sapiens
tgatgataataat

SEQ ID NO: 6461252 - DNA, 15 bp, Homo sapiens
tgatgataataataa

SEQ ID NO: 6461253 - DNA, 17 bp, Homo sapiens
tgatgatacaatgaaca

SEQ ID NO: 6461254 - DNA, 21 bp, Homo sapiens
tgatgatcaaaacctgtgcca

SEQ ID NO: 6461255 - DNA, 14 bp, Homo sapiens
tgatgatcactgtg

SEQ ID NO: 6461256 - DNA, 13 bp, Homo sapiens
tgatgatccagaa

SEQ ID NO: 6461257 - DNA, 17 bp, Homo sapiens
tgatgatccagaacagt

SEQ ID NO: 6461258 - DNA, 18 bp, Homo sapiens
tgatgatccagaacagtg

SEQ ID NO: 6461259 - DNA, 19 bp, Homo sapiens
tgatgatccagaacagtgg

SEQ ID NO: 6461260 - DNA, 14 bp, Homo sapiens
tgatgatctttaaa

SEQ ID NO: 6461261 - DNA, 17 bp, Homo sapiens
tgatgatctttaaaata

SEQ ID NO: 6461262 - DNA, 21 bp, Homo sapiens
tgatgatctttgcagacaggc

SEQ ID NO: 6461263 - DNA, 23 bp, Homo sapiens
tgatgatctttgcagacaggcaa

SEQ ID NO: 6461264 - DNA, 15 bp, Homo sapiens
tgatgatgaaaacta

SEQ ID NO: 6461265 - DNA, 15 bp, Homo sapiens
tgatgatgataatga

SEQ ID NO: 6461266 - DNA, 17 bp, Homo sapiens
tgatgatgatgatgatg

SEQ ID NO: 6461267 - DNA, 13 bp, Homo sapiens
tgatgatgctggc

SEQ ID NO: 6461268 - DNA, 17 bp, Homo sapiens
tgatgatgctgtgacaa

SEQ ID NO: 6461269 - DNA, 18 bp, Homo sapiens
tgatgatgggaattgtgt

SEQ ID NO: 6461270 - DNA, 16 bp, Homo sapiens
tgatgatgtctacaga

SEQ ID NO: 6461271 - DNA, 14 bp, Homo sapiens
tgatgatgtctctt

SEQ ID NO: 6461272 - DNA, 22 bp, Homo sapiens
tgatgatgtgtttaaactgagt

SEQ ID NO: 6461273 - DNA, 22 bp, Homo sapiens
tgatgattaaacacctgacaca

SEQ ID NO: 6461274 - DNA, 15 bp, Homo sapiens
tgatgattattattt

SEQ ID NO: 6461275 - DNA, 16 bp, Homo sapiens
tgatgattcaatcatt

SEQ ID NO: 6461276 - DNA, 18 bp, Homo sapiens
tgatgattgaactggaat

SEQ ID NO: 6461277 - DNA, 16 bp, Homo sapiens
tgatgattgccaacag

SEQ ID NO: 6461278 - DNA, 19 bp, Homo sapiens
tgatgattgccaacagtgg

SEQ ID NO: 6461279 - DNA, 20 bp, Homo sapiens
tgatgatttagagtgctgtc

SEQ ID NO: 6461280 - DNA, 15 bp, Homo sapiens
tgatgattttaacag

SEQ ID NO: 6461281 - DNA, 20 bp, Homo sapiens
tgatgattttgtaattctta

SEQ ID NO: 6461282 - DNA, 20 bp, Homo sapiens
tgatgatttttaacttttta

SEQ ID NO: 6461283 - DNA, 19 bp, Homo sapiens
tgatgcaaaggtggggaga

SEQ ID NO: 6461284 - DNA, 18 bp, Homo sapiens
tgatgcaaccaaaaggga

SEQ ID NO: 6461285 - DNA, 20 bp, Homo sapiens
tgatgcaagccagcttcctg

SEQ ID NO: 6461286 - DNA, 22 bp, Homo sapiens
tgatgcaagccagcttcctgtg

SEQ ID NO: 6461287 - DNA, 18 bp, Homo sapiens
tgatgcaaggattacaga

SEQ ID NO: 6461288 - DNA, 20 bp, Homo sapiens
tgatgcaaggattacagaaa

SEQ ID NO: 6461289 - DNA, 16 bp, Homo sapiens
tgatgcaagtcactaa

SEQ ID NO: 6461290 - DNA, 14 bp, Homo sapiens
tgatgcaatataag

SEQ ID NO: 6461291 - DNA, 18 bp, Homo sapiens
tgatgcaatccttacaaa

SEQ ID NO: 6461292 - DNA, 19 bp, Homo sapiens
tgatgcaatccttacaaat

SEQ ID NO: 6461293 - DNA, 23 bp, Homo sapiens
tgatgcaatccttacaaatgatt

SEQ ID NO: 6461294 - DNA, 15 bp, Homo sapiens
tcgaaaattcatttc

SEQ ID NO: 6461295 - DNA, 24 bp, Homo sapiens
tcgaaaattcatttcacattaatg

SEQ ID NO: 6461296 - DNA, 22 bp, Homo sapiens
tcgaaacctacaagatttcctt

SEQ ID NO: 6461297 - DNA, 12 bp, Homo sapiens
tcgaaactgcca

SEQ ID NO: 6461298 - DNA, 14 bp, Homo sapiens
tcgaaactgccaag

SEQ ID NO: 6461299 - DNA, 16 bp, Homo sapiens
tcgaaagctctagaat

SEQ ID NO: 6461300 - DNA, 19 bp, Homo sapiens
tcgaaagctctagaatctg

SEQ ID NO: 6461301 - DNA, 16 bp, Homo sapiens
tcgaaaggccttcaga

SEQ ID NO: 6461302 - DNA, 14 bp, Homo sapiens
tcgaaagtgtcatc

SEQ ID NO: 6461303 - DNA, 16 bp, Homo sapiens
tcgaaagtgtcatcaa

SEQ ID NO: 6461304 - DNA, 19 bp, Homo sapiens
tcgaaataacaatgttaag

SEQ ID NO: 6461305 - DNA, 21 bp, Homo sapiens
tcgaaatagatatcctctccc

SEQ ID NO: 6461306 - DNA, 22 bp, Homo sapiens
tcgaaatagatatcctctcccc

SEQ ID NO: 6461307 - DNA, 21 bp, Homo sapiens
tcgaaatgaatttatctgaat

SEQ ID NO: 6461308 - DNA, 14 bp, Homo sapiens
tcgaaatgtattca

SEQ ID NO: 6461309 - DNA, 17 bp, Homo sapiens
tcgaaatgtattcacct

SEQ ID NO: 6461310 - DNA, 19 bp, Homo sapiens
tcgaaatttgttgtttgtt

SEQ ID NO: 6461311 - DNA, 16 bp, Homo sapiens
tcgaacaaactgatgc

SEQ ID NO: 6461312 - DNA, 18 bp, Homo sapiens
tcgaacatgtttcactta

SEQ ID NO: 6461313 - DNA, 12 bp, Homo sapiens
tcgaaccaaggc

SEQ ID NO: 6461314 - DNA, 21 bp, Homo sapiens
tcgaaccaaggcagcctccag

SEQ ID NO: 6461315 - DNA, 19 bp, Homo sapiens
tcgaacccacactgcaaca

SEQ ID NO: 6461316 - DNA, 18 bp, Homo sapiens
tcgaaccgttttgaagct

SEQ ID NO: 6461317 - DNA, 12 bp, Homo sapiens
tcgaactcctga

SEQ ID NO: 6461318 - DNA, 13 bp, Homo sapiens
tcgaactcctggc

SEQ ID NO: 6461319 - DNA, 17 bp, Homo sapiens
tcgaactcctggcctcg

SEQ ID NO: 6461320 - DNA, 21 bp, Homo sapiens
tcgaactcgggagggaacatc

SEQ ID NO: 6461321 - DNA, 13 bp, Homo sapiens
tcgaactggctgc

SEQ ID NO: 6461322 - DNA, 14 bp, Homo sapiens
tcgaactggctgca

SEQ ID NO: 6461323 - DNA, 18 bp, Homo sapiens
tcgaacttcacaactagg

SEQ ID NO: 6461324 - DNA, 20 bp, Homo sapiens
tcgaagaaaataattctcta

SEQ ID NO: 6461325 - DNA, 15 bp, Homo sapiens
tcgaagatatacaaa

SEQ ID NO: 6461326 - DNA, 14 bp, Homo sapiens
tcgaagcaaaagta

SEQ ID NO: 6461327 - DNA, 16 bp, Homo sapiens
tcgaagcccttccagt

SEQ ID NO: 6461328 - DNA, 23 bp, Homo sapiens
tcgaagcgcgccactcgcttccc

SEQ ID NO: 6461329 - DNA, 14 bp, Homo sapiens
tcgaagctcagccc

SEQ ID NO: 6461330 - DNA, 15 bp, Homo sapiens
tcgaagctcagccca

SEQ ID NO: 6461331 - DNA, 19 bp, Homo sapiens
tcgaagctgttctctgctt

SEQ ID NO: 6461332 - DNA, 19 bp, Homo sapiens
tcgaaggatgctctttccc

SEQ ID NO: 6461333 - DNA, 20 bp, Homo sapiens
tcgaaggatgctctttccct

SEQ ID NO: 6461334 - DNA, 16 bp, Homo sapiens
tcgaagtcattaaact

SEQ ID NO: 6461335 - DNA, 17 bp, Homo sapiens
tcgaagtcattaaactg

SEQ ID NO: 6461336 - DNA, 20 bp, Homo sapiens
tcgaagtcattaaactggtt

SEQ ID NO: 6461337 - DNA, 14 bp, Homo sapiens
tcgaagtcttccat

SEQ ID NO: 6461338 - DNA, 16 bp, Homo sapiens
tcgaagtcttccatca

SEQ ID NO: 6461339 - DNA, 19 bp, Homo sapiens
tcgaagtcttccccagtta

SEQ ID NO: 6461340 - DNA, 19 bp, Homo sapiens
tcgaagttcatttttatcc

SEQ ID NO: 6461341 - DNA, 14 bp, Homo sapiens
tcgaagtttgcaac

SEQ ID NO: 6461342 - DNA, 18 bp, Homo sapiens
tcgaagtttgcaaccttt

SEQ ID NO: 6461343 - DNA, 17 bp, Homo sapiens
tcgaatagggaagtaaa

SEQ ID NO: 6461344 - DNA, 19 bp, Homo sapiens
tcgaatatatctgtaaaga

SEQ ID NO: 6461345 - DNA, 14 bp, Homo sapiens
tcgaatatcttaat

SEQ ID NO: 6461346 - DNA, 14 bp, Homo sapiens
tcgaatcactcatt

SEQ ID NO: 6461347 - DNA, 23 bp, Homo sapiens
tcgaatcactcatttatttccat

SEQ ID NO: 6461348 - DNA, 14 bp, Homo sapiens
tcgaatctctgtgc

SEQ ID NO: 6461349 - DNA, 16 bp, Homo sapiens
tcgaatctctgtgcct

SEQ ID NO: 6461350 - DNA, 21 bp, Homo sapiens
tcgaatcttaatttattattt

SEQ ID NO: 6461351 - DNA, 14 bp, Homo sapiens
tcgaatgacactgt

SEQ ID NO: 6461352 - DNA, 16 bp, Homo sapiens
tcgaatgtaattggaa

SEQ ID NO: 6461353 - DNA, 22 bp, Homo sapiens
tcgaatgtgtgggcccaaggcc

SEQ ID NO: 6461354 - DNA, 15 bp, Homo sapiens
tcgaattaagaatat

SEQ ID NO: 6461355 - DNA, 17 bp, Homo sapiens
tcgaattagtttgcact

SEQ ID NO: 6461356 - DNA, 19 bp, Homo sapiens
tcgaattttatctgtggag

SEQ ID NO: 6461357 - DNA, 15 bp, Homo sapiens
tcgaatttttattat

SEQ ID NO: 6461358 - DNA, 24 bp, Homo sapiens
tcgacaaaggccacaggcagtcca

SEQ ID NO: 6461359 - DNA, 14 bp, Homo sapiens
tcgacaagaatgtc

SEQ ID NO: 6461360 - DNA, 19 bp, Homo sapiens
tcgacactcaccatgaagc

SEQ ID NO: 6461361 - DNA, 14 bp, Homo sapiens
tcgacagacagcca

SEQ ID NO: 6461362 - DNA, 16 bp, Homo sapiens
tcgacagatgattttc

SEQ ID NO: 6461363 - DNA, 18 bp, Homo sapiens
tcgacagcgcccctgctg

SEQ ID NO: 6461364 - DNA, 16 bp, Homo sapiens
tcgacagctctctggg

SEQ ID NO: 6461365 - DNA, 15 bp, Homo sapiens
tcgacagggcctgga

SEQ ID NO: 6461366 - DNA, 18 bp, Homo sapiens
tcgacagggcctggagcc

SEQ ID NO: 6461367 - DNA, 22 bp, Homo sapiens
tcgacaggtgccctttctctta

SEQ ID NO: 6461368 - DNA, 20 bp, Homo sapiens
tcgacataccccactgggca

SEQ ID NO: 6461369 - DNA, 21 bp, Homo sapiens
tcgacataccccactgggcac

SEQ ID NO: 6461370 - DNA, 22 bp, Homo sapiens
tcgacatagtatggaagtattt

SEQ ID NO: 6461371 - DNA, 18 bp, Homo sapiens
tcgacatcactgttcatg

SEQ ID NO: 6461372 - DNA, 14 bp, Homo sapiens
tcgacatcctagcc

SEQ ID NO: 6461373 - DNA, 17 bp, Homo sapiens
tcgacatcctagcccca

SEQ ID NO: 6461374 - DNA, 20 bp, Homo sapiens
tcgacatcctagccccaccc

SEQ ID NO: 6461375 - DNA, 19 bp, Homo sapiens
tcgaccccaaagccccttg

SEQ ID NO: 6461376 - DNA, 21 bp, Homo sapiens
tcgaccccaaaggaacactga

SEQ ID NO: 6461377 - DNA, 12 bp, Homo sapiens
tcgaccctgggg

SEQ ID NO: 6461378 - DNA, 15 bp, Homo sapiens
tcgaccggccctgca

SEQ ID NO: 6461379 - DNA, 12 bp, Homo sapiens
tcgacctcccca

SEQ ID NO: 6461380 - DNA, 22 bp, Homo sapiens
tcgacgcccgagttagcctcac

SEQ ID NO: 6461381 - DNA, 15 bp, Homo sapiens
tcgactcagcaccac

SEQ ID NO: 6461382 - DNA, 16 bp, Homo sapiens
tcgactcagcctcagg

SEQ ID NO: 6461383 - DNA, 12 bp, Homo sapiens
tcgactctgtgc

SEQ ID NO: 6461384 - DNA, 16 bp, Homo sapiens
tcgactggtccagctc

SEQ ID NO: 6461385 - DNA, 16 bp, Homo sapiens
tcgactggtttttcta

SEQ ID NO: 6461386 - DNA, 15 bp, Homo sapiens
tcgactgttgttatc

SEQ ID NO: 6461387 - DNA, 17 bp, Homo sapiens
tcgactttgtgtctctg

SEQ ID NO: 6461388 - DNA, 18 bp, Homo sapiens
tcgagaaacagcctgtgt

SEQ ID NO: 6461389 - DNA, 14 bp, Homo sapiens
tcgagaactttcat

SEQ ID NO: 6461390 - DNA, 19 bp, Homo sapiens
tcgagaagctgctctggaa

SEQ ID NO: 6461391 - DNA, 21 bp, Homo sapiens
tcgagacaggcagaatcagta

SEQ ID NO: 6461392 - DNA, 15 bp, Homo sapiens
tcgagaccagcccag

SEQ ID NO: 6461393 - DNA, 18 bp, Homo sapiens
tcgagaccatcctggccc

SEQ ID NO: 6461394 - DNA, 18 bp, Homo sapiens
tcgagaccatcctggcta

SEQ ID NO: 6461395 - DNA, 18 bp, Homo sapiens
tcgagacccaaaccccca

SEQ ID NO: 6461396 - DNA, 16 bp, Homo sapiens
tcgagacttctctgtg

SEQ ID NO: 6461397 - DNA, 12 bp, Homo sapiens
tcgagagcctta

SEQ ID NO: 6461398 - DNA, 14 bp, Homo sapiens
tcgagagctggcca

SEQ ID NO: 6461399 - DNA, 11 bp, Homo sapiens
tcgagaggcac

SEQ ID NO: 6461400 - DNA, 14 bp, Homo sapiens
tcgagagggctgag

SEQ ID NO: 6461401 - DNA, 15 bp, Homo sapiens
tcgagagggctgagc

SEQ ID NO: 6461402 - DNA, 19 bp, Homo sapiens
tcgagagggctgagcccct

SEQ ID NO: 6461403 - DNA, 21 bp, Homo sapiens
tcgagagggctgagcccctcc

SEQ ID NO: 6461404 - DNA, 22 bp, Homo sapiens
tcgagagggctgagcccctcct

SEQ ID NO: 6461405 - DNA, 23 bp, Homo sapiens
tcgagaggggccgatgcccagag

SEQ ID NO: 6461406 - DNA, 18 bp, Homo sapiens
tcgagatagttttttctt

SEQ ID NO: 6461407 - DNA, 18 bp, Homo sapiens
tcgagatcccaacactgc

SEQ ID NO: 6461408 - DNA, 22 bp, Homo sapiens
tcgagatcccaacactgccagc

SEQ ID NO: 6461409 - DNA, 23 bp, Homo sapiens
tcgagatcccaacactgccagca

SEQ ID NO: 6461410 - DNA, 13 bp, Homo sapiens
tcgagatggagct

SEQ ID NO: 6461411 - DNA, 20 bp, Homo sapiens
tcgagattatcgttttctta

SEQ ID NO: 6461412 - DNA, 14 bp, Homo sapiens
tcgagcaaaattca

SEQ ID NO: 6461413 - DNA, 21 bp, Homo sapiens
tcgagcaaacaactttctgga

SEQ ID NO: 6461414 - DNA, 14 bp, Homo sapiens
tcgagcagggtgct

SEQ ID NO: 6461415 - DNA, 18 bp, Homo sapiens
tcgagcatgcctggatgg

SEQ ID NO: 6461416 - DNA, 19 bp, Homo sapiens
tcgagcatgttgttttttc

SEQ ID NO: 6461417 - DNA, 14 bp, Homo sapiens
tcgagcatttcttc

SEQ ID NO: 6461418 - DNA, 22 bp, Homo sapiens
tcgagccaactctaacaggcac

SEQ ID NO: 6461419 - DNA, 13 bp, Homo sapiens
tcgagcccagatg

SEQ ID NO: 6461420 - DNA, 15 bp, Homo sapiens
tcgagccccctggat

SEQ ID NO: 6461421 - DNA, 15 bp, Homo sapiens
tcgagccctccccca

SEQ ID NO: 6461422 - DNA, 16 bp, Homo sapiens
tcgagccctcccccaa

SEQ ID NO: 6461423 - DNA, 12 bp, Homo sapiens
tcgagccctgca

SEQ ID NO: 6461424 - DNA, 17 bp, Homo sapiens
tcgagctcggggctggg

SEQ ID NO: 6461425 - DNA, 19 bp, Homo sapiens
tcgagctctgtagcctggt

SEQ ID NO: 6461426 - DNA, 14 bp, Homo sapiens
tcgagctgggaagg

SEQ ID NO: 6461427 - DNA, 14 bp, Homo sapiens
tcgagcttggggca

SEQ ID NO: 6461428 - DNA, 23 bp, Homo sapiens
tcgaggacaagtgagagagcaag

SEQ ID NO: 6461429 - DNA, 15 bp, Homo sapiens
tcgaggacaggaaag

SEQ ID NO: 6461430 - DNA, 19 bp, Homo sapiens
tcgaggactgtatttgtga

SEQ ID NO: 6461431 - DNA, 18 bp, Homo sapiens
tcgaggagataaactgaa

SEQ ID NO: 6461432 - DNA, 18 bp, Homo sapiens
tcgaggagctagaacatt

SEQ ID NO: 6461433 - DNA, 16 bp, Homo sapiens
tcgaggagctcagggt

SEQ ID NO: 6461434 - DNA, 20 bp, Homo sapiens
tcgaggccacattgctggct

SEQ ID NO: 6461435 - DNA, 16 bp, Homo sapiens
tcgaggcctacagagg

SEQ ID NO: 6461436 - DNA, 15 bp, Homo sapiens
tcgaggcctgaagcc

SEQ ID NO: 6461437 - DNA, 23 bp, Homo sapiens
tcgaggcctgcaaaccttcctgg

SEQ ID NO: 6461438 - DNA, 16 bp, Homo sapiens
tcgaggctagaggcat

SEQ ID NO: 6461439 - DNA, 22 bp, Homo sapiens
tcgaggctagaggcatttggaa

SEQ ID NO: 6461440 - DNA, 20 bp, Homo sapiens
tcgaggctgcagtcagtcat

SEQ ID NO: 6461441 - DNA, 13 bp, Homo sapiens
tcgaggctggtgc

SEQ ID NO: 6461442 - DNA, 18 bp, Homo sapiens
tcgaggctgtgtgtccgt

SEQ ID NO: 6461443 - DNA, 14 bp, Homo sapiens
tcgagggccgcctg

SEQ ID NO: 6461444 - DNA, 20 bp, Homo sapiens
tcgaggggtgggctggtatc

SEQ ID NO: 6461445 - DNA, 17 bp, Homo sapiens
tcgagggtttgaggctt

SEQ ID NO: 6461446 - DNA, 22 bp, Homo sapiens
tcgaggtatgtttatatttatt

SEQ ID NO: 6461447 - DNA, 14 bp, Homo sapiens
tcgaggtcctcctg

SEQ ID NO: 6461448 - DNA, 19 bp, Homo sapiens
tcgaggttgccccttcccc

SEQ ID NO: 6461449 - DNA, 22 bp, Homo sapiens
tcgaggttgccccttccccatc

SEQ ID NO: 6461450 - DNA, 13 bp, Homo sapiens
tcgagtccaaaat

SEQ ID NO: 6461451 - DNA, 13 bp, Homo sapiens
tcgagtcccccca

SEQ ID NO: 6461452 - DNA, 17 bp, Homo sapiens
tcgagtccccccacccc

SEQ ID NO: 6461453 - DNA, 18 bp, Homo sapiens
tcgagtccccccacccct

SEQ ID NO: 6461454 - DNA, 23 bp, Homo sapiens
tcgagtccccccacccctcccca

SEQ ID NO: 6461455 - DNA, 16 bp, Homo sapiens
tcgagtctacctcttc

SEQ ID NO: 6461456 - DNA, 14 bp, Homo sapiens
tcgagtctgaggcc

SEQ ID NO: 6461457 - DNA, 23 bp, Homo sapiens
tcgagtgagacagactagaagtt

SEQ ID NO: 6461458 - DNA, 18 bp, Homo sapiens
tcgagtgcccctgcaggg

SEQ ID NO: 6461459 - DNA, 22 bp, Homo sapiens
tcgagtgcccctgcaggggagg

SEQ ID NO: 6461460 - DNA, 22 bp, Homo sapiens
tcgagtgcccctgtcccacctg

SEQ ID NO: 6461461 - DNA, 23 bp, Homo sapiens
tcgagtgcccctgtcccacctgg

SEQ ID NO: 6461462 - DNA, 20 bp, Homo sapiens
tcgagtgccgcatctcacag

SEQ ID NO: 6461463 - DNA, 20 bp, Homo sapiens
tcgagtggcgagtccagaca

SEQ ID NO: 6461464 - DNA, 18 bp, Homo sapiens
tcgagttaaaacaatgaa

SEQ ID NO: 6461465 - DNA, 19 bp, Homo sapiens
tcgagttaaaacaatgaag

SEQ ID NO: 6461466 - DNA, 17 bp, Homo sapiens
tcgagttacagcctggg

SEQ ID NO: 6461467 - DNA, 22 bp, Homo sapiens
tcgagttggcaaaatggggttt

SEQ ID NO: 6461468 - DNA, 13 bp, Homo sapiens
tcgagtttacttc

SEQ ID NO: 6461469 - DNA, 18 bp, Homo sapiens
tcgagtttacttcatgag

SEQ ID NO: 6461470 - DNA, 19 bp, Homo sapiens
tcgatactgcgactttctg

SEQ ID NO: 6461471 - DNA, 21 bp, Homo sapiens
tcgatatgtatatcattctac

SEQ ID NO: 6461472 - DNA, 19 bp, Homo sapiens
tcgatatttccatcattaa

SEQ ID NO: 6461473 - DNA, 22 bp, Homo sapiens
tgatgcaatcttggctcactgc

SEQ ID NO: 6461474 - DNA, 19 bp, Homo sapiens
tgatgcaatgtatggcttt

SEQ ID NO: 6461475 - DNA, 22 bp, Homo sapiens
tgatgcacagtatctgctgttc

SEQ ID NO: 6461476 - DNA, 14 bp, Homo sapiens
tgatgcacatttca

SEQ ID NO: 6461477 - DNA, 22 bp, Homo sapiens
tgatgcacttattttttaatgt

SEQ ID NO: 6461478 - DNA, 23 bp, Homo sapiens
tgatgcacttattttttaatgtg

SEQ ID NO: 6461479 - DNA, 13 bp, Homo sapiens
tgatgcagaaatt

SEQ ID NO: 6461480 - DNA, 19 bp, Homo sapiens
tgatgcagaactttctctt

SEQ ID NO: 6461481 - DNA, 23 bp, Homo sapiens
tgatgcagacaaatgaaataata

SEQ ID NO: 6461482 - DNA, 13 bp, Homo sapiens
tgatgcagacaca

SEQ ID NO: 6461483 - DNA, 15 bp, Homo sapiens
tgatgcagcatttga

SEQ ID NO: 6461484 - DNA, 19 bp, Homo sapiens
tgatgcagcatttgataat

SEQ ID NO: 6461485 - DNA, 16 bp, Homo sapiens
tgatgcagcctgtggc

SEQ ID NO: 6461486 - DNA, 17 bp, Homo sapiens
tgatgcagcctgtggct

SEQ ID NO: 6461487 - DNA, 17 bp, Homo sapiens
tgatgcagctgttgaga

SEQ ID NO: 6461488 - DNA, 20 bp, Homo sapiens
tgatgcagctgttgagaaaa

SEQ ID NO: 6461489 - DNA, 11 bp, Homo sapiens
tgatgcaggaa

SEQ ID NO: 6461490 - DNA, 14 bp, Homo sapiens
tgatgcagtctcct

SEQ ID NO: 6461491 - DNA, 17 bp, Homo sapiens
tgatgcagtgccctaga

SEQ ID NO: 6461492 - DNA, 18 bp, Homo sapiens
tgatgcatgcactgttcc

SEQ ID NO: 6461493 - DNA, 22 bp, Homo sapiens
tgatgcatgctattcacaatta

SEQ ID NO: 6461494 - DNA, 18 bp, Homo sapiens
tgatgcattaaaagaaaa

SEQ ID NO: 6461495 - DNA, 21 bp, Homo sapiens
tgatgcattaaaagaaaataa

SEQ ID NO: 6461496 - DNA, 15 bp, Homo sapiens
tgatgcatttccaca

SEQ ID NO: 6461497 - DNA, 18 bp, Homo sapiens
tgatgcatttccacactg

SEQ ID NO: 6461498 - DNA, 12 bp, Homo sapiens
tgatgcatttta

SEQ ID NO: 6461499 - DNA, 13 bp, Homo sapiens
tgatgccaaagca

SEQ ID NO: 6461500 - DNA, 15 bp, Homo sapiens
tgatgccaaagcaga

SEQ ID NO: 6461501 - DNA, 13 bp, Homo sapiens
tgatgccaaagct

SEQ ID NO: 6461502 - DNA, 20 bp, Homo sapiens
tgatgccaaagctgctttct

SEQ ID NO: 6461503 - DNA, 15 bp, Homo sapiens
tgatgccaacctctg

SEQ ID NO: 6461504 - DNA, 15 bp, Homo sapiens
tgatgccaagttgtt

SEQ ID NO: 6461505 - DNA, 18 bp, Homo sapiens
tgatgccacaccaagctg

SEQ ID NO: 6461506 - DNA, 20 bp, Homo sapiens
tgatgccacttcccagaggc

SEQ ID NO: 6461507 - DNA, 13 bp, Homo sapiens
tgatgccagctgt

SEQ ID NO: 6461508 - DNA, 14 bp, Homo sapiens
tgatgccagctgtc

SEQ ID NO: 6461509 - DNA, 21 bp, Homo sapiens
tgatgccagctgtctcccacg

SEQ ID NO: 6461510 - DNA, 16 bp, Homo sapiens
tgatgccatttgtctt

SEQ ID NO: 6461511 - DNA, 17 bp, Homo sapiens
tgatgccatttgtcttt

SEQ ID NO: 6461512 - DNA, 15 bp, Homo sapiens
tgatgcccaatatat

SEQ ID NO: 6461513 - DNA, 16 bp, Homo sapiens
tgatgcccagataata

SEQ ID NO: 6461514 - DNA, 19 bp, Homo sapiens
tgatgcccagctcagtgcc

SEQ ID NO: 6461515 - DNA, 17 bp, Homo sapiens
tgatgccccttctcccc

SEQ ID NO: 6461516 - DNA, 21 bp, Homo sapiens
tgatgccccttctccccttcc

SEQ ID NO: 6461517 - DNA, 17 bp, Homo sapiens
tgatgccctcccctcag

SEQ ID NO: 6461518 - DNA, 20 bp, Homo sapiens
tgatgccctcccctcagcgc

SEQ ID NO: 6461519 - DNA, 22 bp, Homo sapiens
tgatgccctcccctcagcgcag

SEQ ID NO: 6461520 - DNA, 17 bp, Homo sapiens
tgatgccctcttctcct

SEQ ID NO: 6461521 - DNA, 19 bp, Homo sapiens
tgatgccctcttctccttg

SEQ ID NO: 6461522 - DNA, 14 bp, Homo sapiens
tgatgccctgccct

SEQ ID NO: 6461523 - DNA, 23 bp, Homo sapiens
tgatgccgaacattaggaattgt

SEQ ID NO: 6461524 - DNA, 14 bp, Homo sapiens
tgatgcctccctgt

SEQ ID NO: 6461525 - DNA, 20 bp, Homo sapiens
tgatgcctctccccagagca

SEQ ID NO: 6461526 - DNA, 15 bp, Homo sapiens
tgatgcctgacacag

SEQ ID NO: 6461527 - DNA, 12 bp, Homo sapiens
tgatgcctgccc

SEQ ID NO: 6461528 - DNA, 18 bp, Homo sapiens
tgatgcctggggaaggag

SEQ ID NO: 6461529 - DNA, 21 bp, Homo sapiens
tgatgcctgtgaactgaactc

SEQ ID NO: 6461530 - DNA, 17 bp, Homo sapiens
tgatgcgaaaacttgaa

SEQ ID NO: 6461531 - DNA, 14 bp, Homo sapiens
tgatgcgccttgct

SEQ ID NO: 6461532 - DNA, 15 bp, Homo sapiens
tgatgcgctgggatc

SEQ ID NO: 6461533 - DNA, 11 bp, Homo sapiens
tgatgctaaat

SEQ ID NO: 6461534 - DNA, 19 bp, Homo sapiens
tgatgctatcagttttata

SEQ ID NO: 6461535 - DNA, 16 bp, Homo sapiens
tgatgctccctcccct

SEQ ID NO: 6461536 - DNA, 16 bp, Homo sapiens
tgatgctcccttgatg

SEQ ID NO: 6461537 - DNA, 16 bp, Homo sapiens
tgatgctcctccgggt

SEQ ID NO: 6461538 - DNA, 14 bp, Homo sapiens
tgatgctctggctt

SEQ ID NO: 6461539 - DNA, 15 bp, Homo sapiens
tgatgctctttccca

SEQ ID NO: 6461540 - DNA, 22 bp, Homo sapiens
tgatgctctttcccacccagcc

SEQ ID NO: 6461541 - DNA, 13 bp, Homo sapiens
tgatgctgaaata

SEQ ID NO: 6461542 - DNA, 15 bp, Homo sapiens
tgatgctgaggatga

SEQ ID NO: 6461543 - DNA, 20 bp, Homo sapiens
tgatgctgccggcacagctg

SEQ ID NO: 6461544 - DNA, 23 bp, Homo sapiens
tgatgctgccggcacagctggga

SEQ ID NO: 6461545 - DNA, 22 bp, Homo sapiens
tgatgctggaactcttgacagc

SEQ ID NO: 6461546 - DNA, 20 bp, Homo sapiens
tgatgctggatgctccttcc

SEQ ID NO: 6461547 - DNA, 15 bp, Homo sapiens
tgatgctgggctggg

SEQ ID NO: 6461548 - DNA, 13 bp, Homo sapiens
tgatgctgtattc

SEQ ID NO: 6461549 - DNA, 16 bp, Homo sapiens
tgatgctgtgtgccca

SEQ ID NO: 6461550 - DNA, 16 bp, Homo sapiens
tgatgcttacatctgg

SEQ ID NO: 6461551 - DNA, 20 bp, Homo sapiens
tgatgcttacatctggaatc

SEQ ID NO: 6461552 - DNA, 16 bp, Homo sapiens
tgatgcttcttcagag

SEQ ID NO: 6461553 - DNA, 18 bp, Homo sapiens
tgatgcttgatataataa

SEQ ID NO: 6461554 - DNA, 21 bp, Homo sapiens
tgatgcttgtaacaagaaaac

SEQ ID NO: 6461555 - DNA, 18 bp, Homo sapiens
tgatgctttcagattaaa

SEQ ID NO: 6461556 - DNA, 13 bp, Homo sapiens
tgatgctttggaa

SEQ ID NO: 6461557 - DNA, 14 bp, Homo sapiens
tgatgctttggaag

SEQ ID NO: 6461558 - DNA, 23 bp, Homo sapiens
tgatgctttggaagatgcagaag

SEQ ID NO: 6461559 - DNA, 14 bp, Homo sapiens
tgatgcttttctct

SEQ ID NO: 6461560 - DNA, 20 bp, Homo sapiens
tgatgcttttctctcagcat

SEQ ID NO: 6461561 - DNA, 14 bp, Homo sapiens
tgatgcttttgctg

SEQ ID NO: 6461562 - DNA, 21 bp, Homo sapiens
tgatgcttttgctgctgctta

SEQ ID NO: 6461563 - DNA, 17 bp, Homo sapiens
tgatggaaaaagaatat

SEQ ID NO: 6461564 - DNA, 14 bp, Homo sapiens
tgatggaaaaatca

SEQ ID NO: 6461565 - DNA, 21 bp, Homo sapiens
tgatggaaaataccagtgttg

SEQ ID NO: 6461566 - DNA, 18 bp, Homo sapiens
tgatggaaacgcacttac

SEQ ID NO: 6461567 - DNA, 16 bp, Homo sapiens
tgatggaaactgccaa

SEQ ID NO: 6461568 - DNA, 17 bp, Homo sapiens
tgatggaaactgccaaa

SEQ ID NO: 6461569 - DNA, 18 bp, Homo sapiens
tgatggaaatatttattt

SEQ ID NO: 6461570 - DNA, 15 bp, Homo sapiens
tgatggaacacagaa

SEQ ID NO: 6461571 - DNA, 19 bp, Homo sapiens
tgatggaaggatctctcca

SEQ ID NO: 6461572 - DNA, 14 bp, Homo sapiens
tgatggaagtgggc

SEQ ID NO: 6461573 - DNA, 17 bp, Homo sapiens
tgatggaagtgggccag

SEQ ID NO: 6461574 - DNA, 23 bp, Homo sapiens
tgatggaagtgggccagtcctgg

SEQ ID NO: 6461575 - DNA, 16 bp, Homo sapiens
tgatggaataaggagc

SEQ ID NO: 6461576 - DNA, 15 bp, Homo sapiens
tgatggaatgtgcca

SEQ ID NO: 6461577 - DNA, 16 bp, Homo sapiens
tgatggaatttttctg

SEQ ID NO: 6461578 - DNA, 19 bp, Homo sapiens
tgatggacatgagagtagg

SEQ ID NO: 6461579 - DNA, 23 bp, Homo sapiens
tgatggaccagtggtttccagtc

SEQ ID NO: 6461580 - DNA, 12 bp, Homo sapiens
tgatggaccctc

SEQ ID NO: 6461581 - DNA, 19 bp, Homo sapiens
tgatggaccgggtgggcct

SEQ ID NO: 6461582 - DNA, 15 bp, Homo sapiens
tgatggacctgcccc

SEQ ID NO: 6461583 - DNA, 21 bp, Homo sapiens
tgatggacctgccccggacct

SEQ ID NO: 6461584 - DNA, 13 bp, Homo sapiens
tgatggagaagga

SEQ ID NO: 6461585 - DNA, 17 bp, Homo sapiens
tgatggagaaggaaaag

SEQ ID NO: 6461586 - DNA, 15 bp, Homo sapiens
tgatggagaaggaag

SEQ ID NO: 6461587 - DNA, 17 bp, Homo sapiens
tgatggagcaactgaaa

SEQ ID NO: 6461588 - DNA, 14 bp, Homo sapiens
tgatggagccccac

SEQ ID NO: 6461589 - DNA, 11 bp, Homo sapiens
tgatggaggag

SEQ ID NO: 6461590 - DNA, 17 bp, Homo sapiens
tgatggaggctgcagcg

SEQ ID NO: 6461591 - DNA, 16 bp, Homo sapiens
tgatggaggggagagg

SEQ ID NO: 6461592 - DNA, 16 bp, Homo sapiens
tgatggagtgctgttt

SEQ ID NO: 6461593 - DNA, 20 bp, Homo sapiens
tgatggagtgtgcagacagc

SEQ ID NO: 6461594 - DNA, 23 bp, Homo sapiens
tgatggagtgtgcagacagccat

SEQ ID NO: 6461595 - DNA, 16 bp, Homo sapiens
tgatggatggcacaat

SEQ ID NO: 6461596 - DNA, 18 bp, Homo sapiens
tgatggatggcagactct

SEQ ID NO: 6461597 - DNA, 18 bp, Homo sapiens
tgatggcaacagatctgg

SEQ ID NO: 6461598 - DNA, 23 bp, Homo sapiens
tgatggcaacagatctggaacct

SEQ ID NO: 6461599 - DNA, 18 bp, Homo sapiens
tgatggcacctataaaat

SEQ ID NO: 6461600 - DNA, 16 bp, Homo sapiens
tgatggccaagagcat

SEQ ID NO: 6461601 - DNA, 12 bp, Homo sapiens
tgatggccacaa

SEQ ID NO: 6461602 - DNA, 18 bp, Homo sapiens
tgatggcccattctactt

SEQ ID NO: 6461603 - DNA, 20 bp, Homo sapiens
tgatggcccattctacttgc

SEQ ID NO: 6461604 - DNA, 23 bp, Homo sapiens
tgatggccccatctggatgtaaa

SEQ ID NO: 6461605 - DNA, 16 bp, Homo sapiens
tgatggccttaatttc

SEQ ID NO: 6461606 - DNA, 18 bp, Homo sapiens
tgatggccttaatttcct

SEQ ID NO: 6461607 - DNA, 23 bp, Homo sapiens
tgatggcctttggacccagggcc

SEQ ID NO: 6461608 - DNA, 18 bp, Homo sapiens
tgatggcgcgggaggcac

SEQ ID NO: 6461609 - DNA, 23 bp, Homo sapiens
tgatggcgcgggaggcaccagct

SEQ ID NO: 6461610 - DNA, 23 bp, Homo sapiens
tgatggcggctcacaagtgaaaa

SEQ ID NO: 6461611 - DNA, 21 bp, Homo sapiens
tgatggctcaagacaaggctg

SEQ ID NO: 6461612 - DNA, 14 bp, Homo sapiens
tgatggctgctaga

SEQ ID NO: 6461613 - DNA, 23 bp, Homo sapiens
tgatggctgggtccttgggcctg

SEQ ID NO: 6461614 - DNA, 13 bp, Homo sapiens
tgatggcttctcc

SEQ ID NO: 6461615 - DNA, 15 bp, Homo sapiens
tgatgggaaaatatt

SEQ ID NO: 6461616 - DNA, 16 bp, Homo sapiens
tgatgggaaaatattt

SEQ ID NO: 6461617 - DNA, 18 bp, Homo sapiens
tgatgggaaaatatttcc

SEQ ID NO: 6461618 - DNA, 19 bp, Homo sapiens
tgatgggaaaatatttcct

SEQ ID NO: 6461619 - DNA, 15 bp, Homo sapiens
tgatgggaaggaggg

SEQ ID NO: 6461620 - DNA, 19 bp, Homo sapiens
tgatgggagagtagatggt

SEQ ID NO: 6461621 - DNA, 12 bp, Homo sapiens
tgatgggaggtg

SEQ ID NO: 6461622 - DNA, 13 bp, Homo sapiens
tgatgggaggtgt

SEQ ID NO: 6461623 - DNA, 11 bp, Homo sapiens
tgatgggagta

SEQ ID NO: 6461624 - DNA, 19 bp, Homo sapiens
tgatgggagtaggctccag

SEQ ID NO: 6461625 - DNA, 23 bp, Homo sapiens
tgatgggagtaggctccagacag

SEQ ID NO: 6461626 - DNA, 19 bp, Homo sapiens
tgatgggatgattgaagaa

SEQ ID NO: 6461627 - DNA, 20 bp, Homo sapiens
tgatgggatgattgaagaaa

SEQ ID NO: 6461628 - DNA, 24 bp, Homo sapiens
tgatgggattctggacaggatgtg

SEQ ID NO: 6461629 - DNA, 14 bp, Homo sapiens
tgatgggatttggt

SEQ ID NO: 6461630 - DNA, 22 bp, Homo sapiens
tgatgggcaacccccagcctgc

SEQ ID NO: 6461631 - DNA, 17 bp, Homo sapiens
tgatgggcaaggggcca

SEQ ID NO: 6461632 - DNA, 22 bp, Homo sapiens
tgatgggcaaggggccaggaag

SEQ ID NO: 6461633 - DNA, 16 bp, Homo sapiens
tgatgggcactggaaa

SEQ ID NO: 6461634 - DNA, 13 bp, Homo sapiens
tgatgggccgagc

SEQ ID NO: 6461635 - DNA, 17 bp, Homo sapiens
tgatgggctccccagga

SEQ ID NO: 6461636 - DNA, 14 bp, Homo sapiens
tgatgggcttctgt

SEQ ID NO: 6461637 - DNA, 22 bp, Homo sapiens
tgatgggcttctgttctctgct

SEQ ID NO: 6461638 - DNA, 12 bp, Homo sapiens
tgatgggctttt

SEQ ID NO: 6461639 - DNA, 14 bp, Homo sapiens
tgatggggaaggag

SEQ ID NO: 6461640 - DNA, 15 bp, Homo sapiens
tgatggggaaggagt

SEQ ID NO: 6461641 - DNA, 12 bp, Homo sapiens
tgatggggagaa

SEQ ID NO: 6461642 - DNA, 24 bp, Homo sapiens
tgatggggcaagggcacaagtcct

SEQ ID NO: 6461643 - DNA, 14 bp, Homo sapiens
tgatggggccctgc

SEQ ID NO: 6461644 - DNA, 15 bp, Homo sapiens
tgatggggccctgcc

SEQ ID NO: 6461645 - DNA, 17 bp, Homo sapiens
tgatggggtcagcaggc

SEQ ID NO: 6461646 - DNA, 18 bp, Homo sapiens
tgatggggtcagcaggcc

SEQ ID NO: 6461647 - DNA, 20 bp, Homo sapiens
tgatggggtcagcaggccca

SEQ ID NO: 6461648 - DNA, 22 bp, Homo sapiens
tgatggggtcagcaggcccagg

SEQ ID NO: 6461649 - DNA, 16 bp, Homo sapiens
tgatggggtgggcagg

SEQ ID NO: 6461650 - DNA, 18 bp, Homo sapiens
tgatggggtgggcagggc

SEQ ID NO: 6461651 - DNA, 15 bp, Homo sapiens
tgatgggtcagttgt

SEQ ID NO: 6461652 - DNA, 16 bp, Homo sapiens
tcgatcaaaaccttcc

SEQ ID NO: 6461653 - DNA, 19 bp, Homo sapiens
tcgatcaaaaccttccttc

SEQ ID NO: 6461654 - DNA, 16 bp, Homo sapiens
tcgatcaagagaatca

SEQ ID NO: 6461655 - DNA, 15 bp, Homo sapiens
tcgatccaaattgtg

SEQ ID NO: 6461656 - DNA, 21 bp, Homo sapiens
tcgatccaaattgtgcttctc

SEQ ID NO: 6461657 - DNA, 15 bp, Homo sapiens
tcgatcgtttcacat

SEQ ID NO: 6461658 - DNA, 12 bp, Homo sapiens
tcgatctcctga

SEQ ID NO: 6461659 - DNA, 15 bp, Homo sapiens
tcgatctgtactgta

SEQ ID NO: 6461660 - DNA, 16 bp, Homo sapiens
tcgatctgtactgtaa

SEQ ID NO: 6461661 - DNA, 21 bp, Homo sapiens
tcgatctgtactgtaattttg

SEQ ID NO: 6461662 - DNA, 12 bp, Homo sapiens
tcgatgaatgta

SEQ ID NO: 6461663 - DNA, 13 bp, Homo sapiens
tcgatgaatgtaa

SEQ ID NO: 6461664 - DNA, 20 bp, Homo sapiens
tcgatgaatgtgttgatttg

SEQ ID NO: 6461665 - DNA, 14 bp, Homo sapiens
tcgatgcaagtgtt

SEQ ID NO: 6461666 - DNA, 21 bp, Homo sapiens
tcgatgcaagtgtttctgttc

SEQ ID NO: 6461667 - DNA, 14 bp, Homo sapiens
tcgatgcaatgaac

SEQ ID NO: 6461668 - DNA, 13 bp, Homo sapiens
tcgatgcactgac

SEQ ID NO: 6461669 - DNA, 19 bp, Homo sapiens
tcgatgcgtattctgtggc

SEQ ID NO: 6461670 - DNA, 18 bp, Homo sapiens
tcgatgcgttcactccaa

SEQ ID NO: 6461671 - DNA, 15 bp, Homo sapiens
tcgatgctgctggcc

SEQ ID NO: 6461672 - DNA, 16 bp, Homo sapiens
tcgatgctgctggcct

SEQ ID NO: 6461673 - DNA, 22 bp, Homo sapiens
tcgatgctgctggcctccctcc

SEQ ID NO: 6461674 - DNA, 14 bp, Homo sapiens
tcgatggacctcag

SEQ ID NO: 6461675 - DNA, 17 bp, Homo sapiens
tcgatggacctcagcaa

SEQ ID NO: 6461676 - DNA, 20 bp, Homo sapiens
tcgatggacctcagcaagct

SEQ ID NO: 6461677 - DNA, 23 bp, Homo sapiens
tcgatggacctcagcaagctgcc

SEQ ID NO: 6461678 - DNA, 23 bp, Homo sapiens
tcgatgggggagtctgaagcaga

SEQ ID NO: 6461679 - DNA, 22 bp, Homo sapiens
tcgatgggggatgcttcatgtg

SEQ ID NO: 6461680 - DNA, 20 bp, Homo sapiens
tcgatgtgtactctaactta

SEQ ID NO: 6461681 - DNA, 18 bp, Homo sapiens
tcgattaacctgcatgca

SEQ ID NO: 6461682 - DNA, 12 bp, Homo sapiens
tcgattagactg

SEQ ID NO: 6461683 - DNA, 13 bp, Homo sapiens
tcgattagactgg

SEQ ID NO: 6461684 - DNA, 18 bp, Homo sapiens
tcgattagactggacagc

SEQ ID NO: 6461685 - DNA, 13 bp, Homo sapiens
tcgattctttgaa

SEQ ID NO: 6461686 - DNA, 20 bp, Homo sapiens
tcgattgtgtacttttcctt

SEQ ID NO: 6461687 - DNA, 21 bp, Homo sapiens
tcgattgtgtacttttccttt

SEQ ID NO: 6461688 - DNA, 16 bp, Homo sapiens
tcgatttctacctcag

SEQ ID NO: 6461689 - DNA, 15 bp, Homo sapiens
tcgatttctccagga

SEQ ID NO: 6461690 - DNA, 23 bp, Homo sapiens
tcgcaaagacgtaataaaattaa

SEQ ID NO: 6461691 - DNA, 20 bp, Homo sapiens
tcgcaacccgtgccaagtcc

SEQ ID NO: 6461692 - DNA, 13 bp, Homo sapiens
tcgcaaccctgcc

SEQ ID NO: 6461693 - DNA, 14 bp, Homo sapiens
tcgcaaccctgcct

SEQ ID NO: 6461694 - DNA, 17 bp, Homo sapiens
tcgcaagagggtctctt

SEQ ID NO: 6461695 - DNA, 13 bp, Homo sapiens
tcgcaagctgggt

SEQ ID NO: 6461696 - DNA, 13 bp, Homo sapiens
tcgcaaggcctgt

SEQ ID NO: 6461697 - DNA, 17 bp, Homo sapiens
tcgcaaggcctgtgctg

SEQ ID NO: 6461698 - DNA, 18 bp, Homo sapiens
tcgcaagtcacagaaaat

SEQ ID NO: 6461699 - DNA, 17 bp, Homo sapiens
tcgcaatgtaagactcg

SEQ ID NO: 6461700 - DNA, 20 bp, Homo sapiens
tcgcacaatgcatgtgctgt

SEQ ID NO: 6461701 - DNA, 15 bp, Homo sapiens
tcgcacaatgtttga

SEQ ID NO: 6461702 - DNA, 13 bp, Homo sapiens
tcgcacacacagt

SEQ ID NO: 6461703 - DNA, 21 bp, Homo sapiens
tcgcacacacccatgtaacca

SEQ ID NO: 6461704 - DNA, 23 bp, Homo sapiens
tcgcacacagggctcacagggca

SEQ ID NO: 6461705 - DNA, 12 bp, Homo sapiens
tcgcacactggg

SEQ ID NO: 6461706 - DNA, 13 bp, Homo sapiens
tcgcacaggccct

SEQ ID NO: 6461707 - DNA, 20 bp, Homo sapiens
tcgcacagggcatgcctggc

SEQ ID NO: 6461708 - DNA, 14 bp, Homo sapiens
tcgcacagtctctc

SEQ ID NO: 6461709 - DNA, 16 bp, Homo sapiens
tcgcacagtctctctc

SEQ ID NO: 6461710 - DNA, 13 bp, Homo sapiens
tcgcaccactgca

SEQ ID NO: 6461711 - DNA, 16 bp, Homo sapiens
tcgcaccattctgact

SEQ ID NO: 6461712 - DNA, 17 bp, Homo sapiens
tcgcaccattctgactc

SEQ ID NO: 6461713 - DNA, 19 bp, Homo sapiens
tcgcacccccctgttctaa

SEQ ID NO: 6461714 - DNA, 13 bp, Homo sapiens
tcgcaccggagtg

SEQ ID NO: 6461715 - DNA, 18 bp, Homo sapiens
tcgcacctaccatcaggg

SEQ ID NO: 6461716 - DNA, 12 bp, Homo sapiens
tcgcacctcctt

SEQ ID NO: 6461717 - DNA, 23 bp, Homo sapiens
tcgcacctgcctccggcctgcac

SEQ ID NO: 6461718 - DNA, 16 bp, Homo sapiens
tcgcacctgtgctgga

SEQ ID NO: 6461719 - DNA, 18 bp, Homo sapiens
tcgcacctgtgctggagc

SEQ ID NO: 6461720 - DNA, 16 bp, Homo sapiens
tcgcaccttttatacc

SEQ ID NO: 6461721 - DNA, 22 bp, Homo sapiens
tcgcactacatctgatatcagg

SEQ ID NO: 6461722 - DNA, 21 bp, Homo sapiens
tcgcactctggcagcaccgcc

SEQ ID NO: 6461723 - DNA, 19 bp, Homo sapiens
tcgcactgggggacatggg

SEQ ID NO: 6461724 - DNA, 16 bp, Homo sapiens
tcgcacttgcagagga

SEQ ID NO: 6461725 - DNA, 23 bp, Homo sapiens
tcgcacttgcagaggagcccagt

SEQ ID NO: 6461726 - DNA, 14 bp, Homo sapiens
tcgcagagaggcca

SEQ ID NO: 6461727 - DNA, 15 bp, Homo sapiens
tcgcagatgataaaa

SEQ ID NO: 6461728 - DNA, 22 bp, Homo sapiens
tcgcagcacagagtcgctggca

SEQ ID NO: 6461729 - DNA, 16 bp, Homo sapiens
tcgcagcagctccgcc

SEQ ID NO: 6461730 - DNA, 17 bp, Homo sapiens
tcgcagcaggtgcaaga

SEQ ID NO: 6461731 - DNA, 14 bp, Homo sapiens
tcgcagccaccctg

SEQ ID NO: 6461732 - DNA, 17 bp, Homo sapiens
tcgcagccaccctgagg

SEQ ID NO: 6461733 - DNA, 10 bp, Homo sapiens
tcgcagcccc

SEQ ID NO: 6461734 - DNA, 11 bp, Homo sapiens
tcgcagcctga

SEQ ID NO: 6461735 - DNA, 13 bp, Homo sapiens
tcgcagcctgagt

SEQ ID NO: 6461736 - DNA, 20 bp, Homo sapiens
tcgcagcctggcggggcagg

SEQ ID NO: 6461737 - DNA, 19 bp, Homo sapiens
tcgcagctaccctcagcct

SEQ ID NO: 6461738 - DNA, 14 bp, Homo sapiens
tcgcagctcatctt

SEQ ID NO: 6461739 - DNA, 19 bp, Homo sapiens
tcgcaggagtctctgccac

SEQ ID NO: 6461740 - DNA, 22 bp, Homo sapiens
tcgcaggagtctctgccaccca

SEQ ID NO: 6461741 - DNA, 23 bp, Homo sapiens
tcgcaggagtctctgccacccac

SEQ ID NO: 6461742 - DNA, 22 bp, Homo sapiens
tcgcaggatccgctgccaccac

SEQ ID NO: 6461743 - DNA, 21 bp, Homo sapiens
tcgcaggattcttcctccctc

SEQ ID NO: 6461744 - DNA, 18 bp, Homo sapiens
tcgcagtctcttagaatt

SEQ ID NO: 6461745 - DNA, 17 bp, Homo sapiens
tcgcagtgatagttgac

SEQ ID NO: 6461746 - DNA, 17 bp, Homo sapiens
tcgcatccaccgccacc

SEQ ID NO: 6461747 - DNA, 19 bp, Homo sapiens
tcgcatccaccgccacccc

SEQ ID NO: 6461748 - DNA, 20 bp, Homo sapiens
tcgcatcccggctgaccctg

SEQ ID NO: 6461749 - DNA, 18 bp, Homo sapiens
tcgcatccgcctctgagc

SEQ ID NO: 6461750 - DNA, 18 bp, Homo sapiens
tcgcatccgtcctgggcg

SEQ ID NO: 6461751 - DNA, 20 bp, Homo sapiens
tcgcatccgtcctgggcgtg

SEQ ID NO: 6461752 - DNA, 14 bp, Homo sapiens
tcgcatcttcccaa

SEQ ID NO: 6461753 - DNA, 13 bp, Homo sapiens
tcgcatggcagaa

SEQ ID NO: 6461754 - DNA, 14 bp, Homo sapiens
tcgcatgtttaatg

SEQ ID NO: 6461755 - DNA, 17 bp, Homo sapiens
tcgccaaactgtctctg

SEQ ID NO: 6461756 - DNA, 16 bp, Homo sapiens
tcgccaagccatcaca

SEQ ID NO: 6461757 - DNA, 18 bp, Homo sapiens
tcgccaagccatcacagg

SEQ ID NO: 6461758 - DNA, 19 bp, Homo sapiens
tcgccaaggactgactgag

SEQ ID NO: 6461759 - DNA, 16 bp, Homo sapiens
tcgccaaggcctagga

SEQ ID NO: 6461760 - DNA, 13 bp, Homo sapiens
tcgccacaaactc

SEQ ID NO: 6461761 - DNA, 17 bp, Homo sapiens
tcgccacacgcctctgt

SEQ ID NO: 6461762 - DNA, 18 bp, Homo sapiens
tcgccacccctccttcct

SEQ ID NO: 6461763 - DNA, 19 bp, Homo sapiens
tcgccacctttcaccctca

SEQ ID NO: 6461764 - DNA, 17 bp, Homo sapiens
tcgccagcttctcctgc

SEQ ID NO: 6461765 - DNA, 16 bp, Homo sapiens
tcgccaggctggagtg

SEQ ID NO: 6461766 - DNA, 23 bp, Homo sapiens
tcgccagtcactgctgcaaggtg

SEQ ID NO: 6461767 - DNA, 16 bp, Homo sapiens
tcgccataaaggcccc

SEQ ID NO: 6461768 - DNA, 19 bp, Homo sapiens
tcgccatcaaggtccagtg

SEQ ID NO: 6461769 - DNA, 20 bp, Homo sapiens
tcgccatcaccccctacccc

SEQ ID NO: 6461770 - DNA, 22 bp, Homo sapiens
tcgccatctgatccccatgcct

SEQ ID NO: 6461771 - DNA, 16 bp, Homo sapiens
tcgccatggcttccca

SEQ ID NO: 6461772 - DNA, 16 bp, Homo sapiens
tcgccatgtgctgtgc

SEQ ID NO: 6461773 - DNA, 13 bp, Homo sapiens
tcgccattccagg

SEQ ID NO: 6461774 - DNA, 20 bp, Homo sapiens
tcgcccacaagccttactca

SEQ ID NO: 6461775 - DNA, 21 bp, Homo sapiens
tcgcccacccgagtacctcca

SEQ ID NO: 6461776 - DNA, 16 bp, Homo sapiens
tcgcccaccgcatgcc

SEQ ID NO: 6461777 - DNA, 22 bp, Homo sapiens
tcgcccaccgcatgccccctcg

SEQ ID NO: 6461778 - DNA, 11 bp, Homo sapiens
tcgcccaccta

SEQ ID NO: 6461779 - DNA, 19 bp, Homo sapiens
tcgcccacctgtgggccag

SEQ ID NO: 6461780 - DNA, 13 bp, Homo sapiens
tcgcccagcagga

SEQ ID NO: 6461781 - DNA, 14 bp, Homo sapiens
tcgcccagcaggag

SEQ ID NO: 6461782 - DNA, 15 bp, Homo sapiens
tcgcccagcaggaga

SEQ ID NO: 6461783 - DNA, 20 bp, Homo sapiens
tcgcccaggcctgggatgca

SEQ ID NO: 6461784 - DNA, 19 bp, Homo sapiens
tcgcccaggctggaatgca

SEQ ID NO: 6461785 - DNA, 19 bp, Homo sapiens
tcgcccaggctggactgca

SEQ ID NO: 6461786 - DNA, 21 bp, Homo sapiens
tcgcccagtcccagcagccag

SEQ ID NO: 6461787 - DNA, 14 bp, Homo sapiens
tcgcccagtctgga

SEQ ID NO: 6461788 - DNA, 21 bp, Homo sapiens
tcgccccaaggttccagaggc

SEQ ID NO: 6461789 - DNA, 14 bp, Homo sapiens
tcgccccacccagg

SEQ ID NO: 6461790 - DNA, 18 bp, Homo sapiens
tcgccccacctccacctg

SEQ ID NO: 6461791 - DNA, 23 bp, Homo sapiens
tcgccccacctccacctgtgaga

SEQ ID NO: 6461792 - DNA, 13 bp, Homo sapiens
tcgccccagactc

SEQ ID NO: 6461793 - DNA, 18 bp, Homo sapiens
tcgccccagatcaccagc

SEQ ID NO: 6461794 - DNA, 20 bp, Homo sapiens
tcgccccaggccctccctga

SEQ ID NO: 6461795 - DNA, 20 bp, Homo sapiens
tcgccccagtggcactgaag

SEQ ID NO: 6461796 - DNA, 12 bp, Homo sapiens
tcgccccatccc

SEQ ID NO: 6461797 - DNA, 14 bp, Homo sapiens
tcgcccccaccagt

SEQ ID NO: 6461798 - DNA, 21 bp, Homo sapiens
tcgccccccgcccggcctcct

SEQ ID NO: 6461799 - DNA, 22 bp, Homo sapiens
tcgccccccgcccggcctccta

SEQ ID NO: 6461800 - DNA, 15 bp, Homo sapiens
tcgcccccgggccct

SEQ ID NO: 6461801 - DNA, 21 bp, Homo sapiens
tcgccccgcagggtccaaagg

SEQ ID NO: 6461802 - DNA, 12 bp, Homo sapiens
tcgcccctcaga

SEQ ID NO: 6461803 - DNA, 14 bp, Homo sapiens
tcgcccctcagagc

SEQ ID NO: 6461804 - DNA, 16 bp, Homo sapiens
tcgcccctcagagcat

SEQ ID NO: 6461805 - DNA, 18 bp, Homo sapiens
tcgcccctcagagcatga

SEQ ID NO: 6461806 - DNA, 12 bp, Homo sapiens
tcgcccctccag

SEQ ID NO: 6461807 - DNA, 14 bp, Homo sapiens
tcgcccctcctcgg

SEQ ID NO: 6461808 - DNA, 20 bp, Homo sapiens
tcgcccctccttttggcctg

SEQ ID NO: 6461809 - DNA, 23 bp, Homo sapiens
tcgcccctccttttggcctgggg

SEQ ID NO: 6461810 - DNA, 14 bp, Homo sapiens
tcgcccctggcaga

SEQ ID NO: 6461811 - DNA, 15 bp, Homo sapiens
tcgcccgataaagac

SEQ ID NO: 6461812 - DNA, 11 bp, Homo sapiens
tcgcccgccca

SEQ ID NO: 6461813 - DNA, 18 bp, Homo sapiens
tcgcccgcccactgtcct

SEQ ID NO: 6461814 - DNA, 22 bp, Homo sapiens
tcgcccgcccactgtcctgggc

SEQ ID NO: 6461815 - DNA, 18 bp, Homo sapiens
tcgccctcctttctgtgc

SEQ ID NO: 6461816 - DNA, 15 bp, Homo sapiens
tcgccctctgaaatt

SEQ ID NO: 6461817 - DNA, 13 bp, Homo sapiens
tcgccctctgtgc

SEQ ID NO: 6461818 - DNA, 15 bp, Homo sapiens
tcgccctctgtgcct

SEQ ID NO: 6461819 - DNA, 15 bp, Homo sapiens
tcgccctgagaagat

SEQ ID NO: 6461820 - DNA, 15 bp, Homo sapiens
tcgccctggccaggg

SEQ ID NO: 6461821 - DNA, 17 bp, Homo sapiens
tcgccctggccagggcc

SEQ ID NO: 6461822 - DNA, 16 bp, Homo sapiens
tcgccctgtccctccc

SEQ ID NO: 6461823 - DNA, 17 bp, Homo sapiens
tcgccctgtccctccca

SEQ ID NO: 6461824 - DNA, 20 bp, Homo sapiens
tcgccctgtccctcccactc

SEQ ID NO: 6461825 - DNA, 14 bp, Homo sapiens
tcgccctgtgccct

SEQ ID NO: 6461826 - DNA, 17 bp, Homo sapiens
tcgccctgtgccctctc

SEQ ID NO: 6461827 - DNA, 13 bp, Homo sapiens
tcgccctgttctt

SEQ ID NO: 6461828 - DNA, 22 bp, Homo sapiens
tcgcccttacttcttgccctgg

SEQ ID NO: 6461829 - DNA, 15 bp, Homo sapiens
tcgcccttcagccca

SEQ ID NO: 6461830 - DNA, 22 bp, Homo sapiens
tcgcccttcagcccaccaccct

SEQ ID NO: 6461831 - DNA, 16 bp, Homo sapiens
tcgccctttgctgcat

SEQ ID NO: 6461832 - DNA, 21 bp, Homo sapiens
tgatgggttcatgtctctgat

SEQ ID NO: 6461833 - DNA, 17 bp, Homo sapiens
tgatggtaaagccatgt

SEQ ID NO: 6461834 - DNA, 18 bp, Homo sapiens
tgatggtatagtatgtgc

SEQ ID NO: 6461835 - DNA, 20 bp, Homo sapiens
tgatggtcacttaaaatgtg

SEQ ID NO: 6461836 - DNA, 15 bp, Homo sapiens
tgatggtcagagggc

SEQ ID NO: 6461837 - DNA, 15 bp, Homo sapiens
tgatggtcagctccc

SEQ ID NO: 6461838 - DNA, 19 bp, Homo sapiens
tgatggtgaatattacatt

SEQ ID NO: 6461839 - DNA, 15 bp, Homo sapiens
tgatggtgacttcct

SEQ ID NO: 6461840 - DNA, 23 bp, Homo sapiens
tgatggtgcaatgacctttcaat

SEQ ID NO: 6461841 - DNA, 21 bp, Homo sapiens
tgatggtgtagccctcccact

SEQ ID NO: 6461842 - DNA, 19 bp, Homo sapiens
tgatggtgtcattctgcct

SEQ ID NO: 6461843 - DNA, 18 bp, Homo sapiens
tgatggtgtccttccctg

SEQ ID NO: 6461844 - DNA, 16 bp, Homo sapiens
tgatggtgttaaagct

SEQ ID NO: 6461845 - DNA, 18 bp, Homo sapiens
tgatggtgttaaagctgt

SEQ ID NO: 6461846 - DNA, 22 bp, Homo sapiens
tgatggtgttaaagctgtacac

SEQ ID NO: 6461847 - DNA, 23 bp, Homo sapiens
tgatggtgttggtgaaaataaga

SEQ ID NO: 6461848 - DNA, 14 bp, Homo sapiens
tgatggttgctttg

SEQ ID NO: 6461849 - DNA, 23 bp, Homo sapiens
tgatggttgctttgagcccacag

SEQ ID NO: 6461850 - DNA, 13 bp, Homo sapiens
tgatggttgtaca

SEQ ID NO: 6461851 - DNA, 18 bp, Homo sapiens
tgatggtttatgttgacc

SEQ ID NO: 6461852 - DNA, 14 bp, Homo sapiens
tgatggtttggaaa

SEQ ID NO: 6461853 - DNA, 15 bp, Homo sapiens
tgatggtttggaaaa

SEQ ID NO: 6461854 - DNA, 20 bp, Homo sapiens
tgatggtttggaaaataact

SEQ ID NO: 6461855 - DNA, 17 bp, Homo sapiens
tgatgtaaaaatgcttc

SEQ ID NO: 6461856 - DNA, 22 bp, Homo sapiens
tgatgtaaaacagaatattctg

SEQ ID NO: 6461857 - DNA, 11 bp, Homo sapiens
tgatgtaaaat

SEQ ID NO: 6461858 - DNA, 21 bp, Homo sapiens
tgatgtaaaatcttgtcatgt

SEQ ID NO: 6461859 - DNA, 17 bp, Homo sapiens
tgatgtaaatgaagtaa

SEQ ID NO: 6461860 - DNA, 21 bp, Homo sapiens
tgatgtaaccgattcatctct

SEQ ID NO: 6461861 - DNA, 16 bp, Homo sapiens
tgatgtaattatggtt

SEQ ID NO: 6461862 - DNA, 11 bp, Homo sapiens
tgatgtaattg

SEQ ID NO: 6461863 - DNA, 14 bp, Homo sapiens
tgatgtacacattt

SEQ ID NO: 6461864 - DNA, 11 bp, Homo sapiens
tgatgtacaga

SEQ ID NO: 6461865 - DNA, 15 bp, Homo sapiens
tgatgtacagatttt

SEQ ID NO: 6461866 - DNA, 22 bp, Homo sapiens
tgatgtacataactcctgtccc

SEQ ID NO: 6461867 - DNA, 18 bp, Homo sapiens
tgatgtagaaaagagact

SEQ ID NO: 6461868 - DNA, 15 bp, Homo sapiens
tgatgtataatgtaa

SEQ ID NO: 6461869 - DNA, 19 bp, Homo sapiens
tgatgtatataaaatgtgc

SEQ ID NO: 6461870 - DNA, 13 bp, Homo sapiens
tgatgtatatgtt

SEQ ID NO: 6461871 - DNA, 12 bp, Homo sapiens
tgatgtatattt

SEQ ID NO: 6461872 - DNA, 23 bp, Homo sapiens
tgatgtatatttaattaaagcac

SEQ ID NO: 6461873 - DNA, 18 bp, Homo sapiens
tgatgtatctgagttgcc

SEQ ID NO: 6461874 - DNA, 13 bp, Homo sapiens
tgatgtatgtgtg

SEQ ID NO: 6461875 - DNA, 17 bp, Homo sapiens
tgatgtatgtgtgaaac

SEQ ID NO: 6461876 - DNA, 20 bp, Homo sapiens
tgatgtatgttggtttttta

SEQ ID NO: 6461877 - DNA, 19 bp, Homo sapiens
tgatgtattacatgactgt

SEQ ID NO: 6461878 - DNA, 21 bp, Homo sapiens
tgatgtattagtagagcaacc

SEQ ID NO: 6461879 - DNA, 13 bp, Homo sapiens
tgatgtattctag

SEQ ID NO: 6461880 - DNA, 21 bp, Homo sapiens
tgatgtattctagctaatgta

SEQ ID NO: 6461881 - DNA, 15 bp, Homo sapiens
tgatgtattttcata

SEQ ID NO: 6461882 - DNA, 18 bp, Homo sapiens
tgatgtattttcatagtg

SEQ ID NO: 6461883 - DNA, 14 bp, Homo sapiens
tgatgtcaaagtgt

SEQ ID NO: 6461884 - DNA, 13 bp, Homo sapiens
tgatgtcacagtt

SEQ ID NO: 6461885 - DNA, 14 bp, Homo sapiens
tgatgtcacagttt

SEQ ID NO: 6461886 - DNA, 20 bp, Homo sapiens
tgatgtcacagtttgttcag

SEQ ID NO: 6461887 - DNA, 15 bp, Homo sapiens
tgatgtcactatttg

SEQ ID NO: 6461888 - DNA, 18 bp, Homo sapiens
tgatgtcactatttgttg

SEQ ID NO: 6461889 - DNA, 18 bp, Homo sapiens
tgatgtcactcacctaga

SEQ ID NO: 6461890 - DNA, 18 bp, Homo sapiens
tgatgtcagcagttgctg

SEQ ID NO: 6461891 - DNA, 22 bp, Homo sapiens
tgatgtcagcagttgctggtaa

SEQ ID NO: 6461892 - DNA, 12 bp, Homo sapiens
tgatgtcagcct

SEQ ID NO: 6461893 - DNA, 17 bp, Homo sapiens
tgatgtcagccttgcat

SEQ ID NO: 6461894 - DNA, 23 bp, Homo sapiens
tgatgtcagtatttcaactgctg

SEQ ID NO: 6461895 - DNA, 14 bp, Homo sapiens
tgatgtcatacaga

SEQ ID NO: 6461896 - DNA, 18 bp, Homo sapiens
tgatgtcatacagagaag

SEQ ID NO: 6461897 - DNA, 20 bp, Homo sapiens
tgatgtcatacagagaagtc

SEQ ID NO: 6461898 - DNA, 22 bp, Homo sapiens
tgatgtcatacagagaagtcac

SEQ ID NO: 6461899 - DNA, 14 bp, Homo sapiens
tgatgtcatgtgtt

SEQ ID NO: 6461900 - DNA, 13 bp, Homo sapiens
tgatgtcatttga

SEQ ID NO: 6461901 - DNA, 15 bp, Homo sapiens
tgatgtccaaactta

SEQ ID NO: 6461902 - DNA, 16 bp, Homo sapiens
tgatgtccaaacttaa

SEQ ID NO: 6461903 - DNA, 12 bp, Homo sapiens
tgatgtccagaa

SEQ ID NO: 6461904 - DNA, 15 bp, Homo sapiens
tgatgtccagaagaa

SEQ ID NO: 6461905 - DNA, 18 bp, Homo sapiens
tgatgtccttaaaatgtg

SEQ ID NO: 6461906 - DNA, 16 bp, Homo sapiens
tgatgtcgttcatttt

SEQ ID NO: 6461907 - DNA, 15 bp, Homo sapiens
tgatgtctacagaaa

SEQ ID NO: 6461908 - DNA, 16 bp, Homo sapiens
tgatgtctacagaaaa

SEQ ID NO: 6461909 - DNA, 14 bp, Homo sapiens
tgatgtctccaagt

SEQ ID NO: 6461910 - DNA, 14 bp, Homo sapiens
tgatgtctgaggat

SEQ ID NO: 6461911 - DNA, 15 bp, Homo sapiens
tgatgtctgcaaagg

SEQ ID NO: 6461912 - DNA, 15 bp, Homo sapiens
tgatgtcttcaataa

SEQ ID NO: 6461913 - DNA, 12 bp, Homo sapiens
tgatgtctttgg

SEQ ID NO: 6461914 - DNA, 23 bp, Homo sapiens
tgatgtcttttcttggcaaaagc

SEQ ID NO: 6461915 - DNA, 12 bp, Homo sapiens
tgatgtgaaact

SEQ ID NO: 6461916 - DNA, 15 bp, Homo sapiens
tgatgtgaaagataa

SEQ ID NO: 6461917 - DNA, 19 bp, Homo sapiens
tgatgtgaaagataaatga

SEQ ID NO: 6461918 - DNA, 19 bp, Homo sapiens
tgatgtgaagagtttcaca

SEQ ID NO: 6461919 - DNA, 22 bp, Homo sapiens
tgatgtgaagataatttgcata

SEQ ID NO: 6461920 - DNA, 18 bp, Homo sapiens
tgatgtgacaataatatt

SEQ ID NO: 6461921 - DNA, 12 bp, Homo sapiens
tgatgtgacatt

SEQ ID NO: 6461922 - DNA, 14 bp, Homo sapiens
tgatgtgacatttg

SEQ ID NO: 6461923 - DNA, 16 bp, Homo sapiens
tgatgtgacatttgtc

SEQ ID NO: 6461924 - DNA, 16 bp, Homo sapiens
tgatgtgatattctgt

SEQ ID NO: 6461925 - DNA, 13 bp, Homo sapiens
tgatgtgatggaa

SEQ ID NO: 6461926 - DNA, 21 bp, Homo sapiens
tgatgtgatggaacacacaca

SEQ ID NO: 6461927 - DNA, 19 bp, Homo sapiens
tgatgtgatttatgcattt

SEQ ID NO: 6461928 - DNA, 14 bp, Homo sapiens
tgatgtgcaaaaat

SEQ ID NO: 6461929 - DNA, 16 bp, Homo sapiens
tgatgtgcaaaaattt

SEQ ID NO: 6461930 - DNA, 22 bp, Homo sapiens
tgatgtgcaaaaccttttactg

SEQ ID NO: 6461931 - DNA, 13 bp, Homo sapiens
tgatgtgccacta

SEQ ID NO: 6461932 - DNA, 21 bp, Homo sapiens
tgatgtgccattttaaaaaaa

SEQ ID NO: 6461933 - DNA, 13 bp, Homo sapiens
tgatgtgcctggg

SEQ ID NO: 6461934 - DNA, 17 bp, Homo sapiens
tgatgtgcgtgctgtct

SEQ ID NO: 6461935 - DNA, 20 bp, Homo sapiens
tgatgtgcgtgctgtctgtc

SEQ ID NO: 6461936 - DNA, 19 bp, Homo sapiens
tgatgtgctgctgggaatg

SEQ ID NO: 6461937 - DNA, 15 bp, Homo sapiens
tgatgtgctggagct

SEQ ID NO: 6461938 - DNA, 15 bp, Homo sapiens
tgatgtggacatatg

SEQ ID NO: 6461939 - DNA, 18 bp, Homo sapiens
tgatgtggacatatgtat

SEQ ID NO: 6461940 - DNA, 12 bp, Homo sapiens
tgatgtggactg

SEQ ID NO: 6461941 - DNA, 17 bp, Homo sapiens
tgatgtggagaaaggac

SEQ ID NO: 6461942 - DNA, 23 bp, Homo sapiens
tgatgtggagaaaggactaacat

SEQ ID NO: 6461943 - DNA, 14 bp, Homo sapiens
tgatgtggaggaag

SEQ ID NO: 6461944 - DNA, 15 bp, Homo sapiens
tgatgtggaggaaga

SEQ ID NO: 6461945 - DNA, 18 bp, Homo sapiens
tgatgtggaggaagagcc

SEQ ID NO: 6461946 - DNA, 13 bp, Homo sapiens
tgatgtggatgaa

SEQ ID NO: 6461947 - DNA, 23 bp, Homo sapiens
tgatgtggccctggctgccggca

SEQ ID NO: 6461948 - DNA, 20 bp, Homo sapiens
tgatgtgggaagttaccttt

SEQ ID NO: 6461949 - DNA, 18 bp, Homo sapiens
tgatgtgggtcaaggaat

SEQ ID NO: 6461950 - DNA, 14 bp, Homo sapiens
tgatgtgtatgtgt

SEQ ID NO: 6461951 - DNA, 16 bp, Homo sapiens
tgatgtgtatgtgttt

SEQ ID NO: 6461952 - DNA, 22 bp, Homo sapiens
tgatgtgtcatatgagtcctca

SEQ ID NO: 6461953 - DNA, 22 bp, Homo sapiens
tgatgtgtccgtgaaagttgtg

SEQ ID NO: 6461954 - DNA, 17 bp, Homo sapiens
tgatgtgtgcccagatc

SEQ ID NO: 6461955 - DNA, 22 bp, Homo sapiens
tgatgtgttcggttttgttgtt

SEQ ID NO: 6461956 - DNA, 20 bp, Homo sapiens
tgatgtgttgccactttcca

SEQ ID NO: 6461957 - DNA, 23 bp, Homo sapiens
tgatgtgttgtgatagctaacat

SEQ ID NO: 6461958 - DNA, 19 bp, Homo sapiens
tgatgtgtttaaactgagt

SEQ ID NO: 6461959 - DNA, 15 bp, Homo sapiens
tgatgtgtttacatt

SEQ ID NO: 6461960 - DNA, 12 bp, Homo sapiens
tgatgttaaaaa

SEQ ID NO: 6461961 - DNA, 16 bp, Homo sapiens
tgatgttaaatgtaat

SEQ ID NO: 6461962 - DNA, 12 bp, Homo sapiens
tgatgttaacaa

SEQ ID NO: 6461963 - DNA, 17 bp, Homo sapiens
tgatgttaacacatttt

SEQ ID NO: 6461964 - DNA, 20 bp, Homo sapiens
tgatgttaacacattttgta

SEQ ID NO: 6461965 - DNA, 18 bp, Homo sapiens
tgatgttacattaggaag

SEQ ID NO: 6461966 - DNA, 14 bp, Homo sapiens
tgatgttactgaga

SEQ ID NO: 6461967 - DNA, 10 bp, Homo sapiens
tgatgttata

SEQ ID NO: 6461968 - DNA, 21 bp, Homo sapiens
tgatgttcagacatttatgtg

SEQ ID NO: 6461969 - DNA, 16 bp, Homo sapiens
tgatgttcagagtggc

SEQ ID NO: 6461970 - DNA, 16 bp, Homo sapiens
tgatgttcagatttct

SEQ ID NO: 6461971 - DNA, 14 bp, Homo sapiens
tgatgttcctggga

SEQ ID NO: 6461972 - DNA, 14 bp, Homo sapiens
tgatgttctaaggc

SEQ ID NO: 6461973 - DNA, 13 bp, Homo sapiens
tgatgttctgaaa

SEQ ID NO: 6461974 - DNA, 16 bp, Homo sapiens
tgatgttctttccatg

SEQ ID NO: 6461975 - DNA, 19 bp, Homo sapiens
tgatgttgaaatatgcata

SEQ ID NO: 6461976 - DNA, 22 bp, Homo sapiens
tgatgttgaaatatgcatacta

SEQ ID NO: 6461977 - DNA, 17 bp, Homo sapiens
tgatgttgctgttcaca

SEQ ID NO: 6461978 - DNA, 13 bp, Homo sapiens
tgatgtttacaat

SEQ ID NO: 6461979 - DNA, 13 bp, Homo sapiens
tgatgtttacatg

SEQ ID NO: 6461980 - DNA, 12 bp, Homo sapiens
tgatgtttatgt

SEQ ID NO: 6461981 - DNA, 13 bp, Homo sapiens
tgatgtttcattt

SEQ ID NO: 6461982 - DNA, 14 bp, Homo sapiens
tgatgtttccagaa

SEQ ID NO: 6461983 - DNA, 18 bp, Homo sapiens
tgatgtttccagaaaata

SEQ ID NO: 6461984 - DNA, 14 bp, Homo sapiens
tgatgtttcctgga

SEQ ID NO: 6461985 - DNA, 21 bp, Homo sapiens
tgatgtttctatatgtaactt

SEQ ID NO: 6461986 - DNA, 12 bp, Homo sapiens
tgatgtttctca

SEQ ID NO: 6461987 - DNA, 13 bp, Homo sapiens
tgatgtttctgtg

SEQ ID NO: 6461988 - DNA, 23 bp, Homo sapiens
tgatgtttgaaattcgctgaaat

SEQ ID NO: 6461989 - DNA, 19 bp, Homo sapiens
tgatgtttgccatttgctg

SEQ ID NO: 6461990 - DNA, 16 bp, Homo sapiens
tgatgtttgtggcctc

SEQ ID NO: 6461991 - DNA, 19 bp, Homo sapiens
tgatgtttgtggcctcaga

SEQ ID NO: 6461992 - DNA, 19 bp, Homo sapiens
tgatgttttacgtgcaaac

SEQ ID NO: 6461993 - DNA, 19 bp, Homo sapiens
tgatgttttccatgagtcc

SEQ ID NO: 6461994 - DNA, 23 bp, Homo sapiens
tgatgttttccatgagtcccctg

SEQ ID NO: 6461995 - DNA, 18 bp, Homo sapiens
tgatgttttcctataata

SEQ ID NO: 6461996 - DNA, 16 bp, Homo sapiens
tgatgttttgatattt

SEQ ID NO: 6461997 - DNA, 23 bp, Homo sapiens
tgatgttttgatatttatttcct

SEQ ID NO: 6461998 - DNA, 16 bp, Homo sapiens
tgatgttttgatgcca

SEQ ID NO: 6461999 - DNA, 18 bp, Homo sapiens
tgatgttttgatgccatt

SEQ ID NO: 6462000 - DNA, 15 bp, Homo sapiens
tgatgtttttatgat

SEQ ID NO: 6462001 - DNA, 13 bp, Homo sapiens
tgatgttttttct

SEQ ID NO: 6462002 - DNA, 20 bp, Homo sapiens
tgatgttttttctgtaatgt

SEQ ID NO: 6462003 - DNA, 23 bp, Homo sapiens
tgatgttttttctgtaatgtaaa

SEQ ID NO: 6462004 - DNA, 20 bp, Homo sapiens
tgattaaaaatatcaaatta

SEQ ID NO: 6462005 - DNA, 16 bp, Homo sapiens
tgattaaacacctgac

SEQ ID NO: 6462006 - DNA, 19 bp, Homo sapiens
tgattaaacacctgacaca

SEQ ID NO: 6462007 - DNA, 12 bp, Homo sapiens
tgattaaacagc

SEQ ID NO: 6462008 - DNA, 16 bp, Homo sapiens
tgattaaacagcaaag

SEQ ID NO: 6462009 - DNA, 15 bp, Homo sapiens
tgattaaactgtatg

SEQ ID NO: 6462010 - DNA, 17 bp, Homo sapiens
tgattaaagtgccttca

SEQ ID NO: 6462011 - DNA, 20 bp, Homo sapiens
tgattaaataagattctaac

SEQ ID NO: 6462012 - DNA, 17 bp, Homo sapiens
tgattaaatatttaatg

SEQ ID NO: 6462013 - DNA, 19 bp, Homo sapiens
tcgccggccttgttttatt

SEQ ID NO: 6462014 - DNA, 17 bp, Homo sapiens
tcgccgtccctcccagg

SEQ ID NO: 6462015 - DNA, 17 bp, Homo sapiens
tcgccgtccctctgcct

SEQ ID NO: 6462016 - DNA, 22 bp, Homo sapiens
tcgccgtgttactgttgcactg

SEQ ID NO: 6462017 - DNA, 17 bp, Homo sapiens
tcgccgttgaagaggaa

SEQ ID NO: 6462018 - DNA, 18 bp, Homo sapiens
tcgcctaccaatctctgc

SEQ ID NO: 6462019 - DNA, 14 bp, Homo sapiens
tcgcctaggatttc

SEQ ID NO: 6462020 - DNA, 22 bp, Homo sapiens
tcgcctcactttccaccaagtg

SEQ ID NO: 6462021 - DNA, 20 bp, Homo sapiens
tcgcctcaggctttttccat

SEQ ID NO: 6462022 - DNA, 18 bp, Homo sapiens
tcgcctccccaccctcct

SEQ ID NO: 6462023 - DNA, 12 bp, Homo sapiens
tcgcctcctcca

SEQ ID NO: 6462024 - DNA, 13 bp, Homo sapiens
tcgcctcctccag

SEQ ID NO: 6462025 - DNA, 12 bp, Homo sapiens
tcgcctcctcct

SEQ ID NO: 6462026 - DNA, 13 bp, Homo sapiens
tcgcctcctcctc

SEQ ID NO: 6462027 - DNA, 18 bp, Homo sapiens
tcgcctcctcctcctgcc

SEQ ID NO: 6462028 - DNA, 17 bp, Homo sapiens
tcgcctctcactctggc

SEQ ID NO: 6462029 - DNA, 20 bp, Homo sapiens
tcgcctctcactctggcagc

SEQ ID NO: 6462030 - DNA, 21 bp, Homo sapiens
tcgcctgacaaccactggtct

SEQ ID NO: 6462031 - DNA, 15 bp, Homo sapiens
tcgcctgagcccagg

SEQ ID NO: 6462032 - DNA, 22 bp, Homo sapiens
tcgcctgagggaagagtagctg

SEQ ID NO: 6462033 - DNA, 12 bp, Homo sapiens
tcgcctgccccc

SEQ ID NO: 6462034 - DNA, 12 bp, Homo sapiens
tcgcctgccctc

SEQ ID NO: 6462035 - DNA, 15 bp, Homo sapiens
tcgcctgccctcctc

SEQ ID NO: 6462036 - DNA, 18 bp, Homo sapiens
tcgcctgccctcctctcc

SEQ ID NO: 6462037 - DNA, 13 bp, Homo sapiens
tcgcctgcctgca

SEQ ID NO: 6462038 - DNA, 15 bp, Homo sapiens
tcgcctgcctgcagc

SEQ ID NO: 6462039 - DNA, 19 bp, Homo sapiens
tcgcctgcctgcagcaggc

SEQ ID NO: 6462040 - DNA, 18 bp, Homo sapiens
tcgcctgcgccgctgtgc

SEQ ID NO: 6462041 - DNA, 20 bp, Homo sapiens
tcgcctgcggactccatggc

SEQ ID NO: 6462042 - DNA, 21 bp, Homo sapiens
tcgcctgcggactccatggcc

SEQ ID NO: 6462043 - DNA, 14 bp, Homo sapiens
tcgcctggcctgag

SEQ ID NO: 6462044 - DNA, 20 bp, Homo sapiens
tcgcctgggaaattgctcca

SEQ ID NO: 6462045 - DNA, 18 bp, Homo sapiens
tcgcctgggcccaggctc

SEQ ID NO: 6462046 - DNA, 16 bp, Homo sapiens
tcgcctgtaatctcac

SEQ ID NO: 6462047 - DNA, 14 bp, Homo sapiens
tcgcctgtcacccc

SEQ ID NO: 6462048 - DNA, 16 bp, Homo sapiens
tcgcctgtcaccccca

SEQ ID NO: 6462049 - DNA, 19 bp, Homo sapiens
tcgcctgtcacccccactc

SEQ ID NO: 6462050 - DNA, 22 bp, Homo sapiens
tcgccttagcactaccactcct

SEQ ID NO: 6462051 - DNA, 20 bp, Homo sapiens
tcgccttagcatgtttgctg

SEQ ID NO: 6462052 - DNA, 19 bp, Homo sapiens
tcgccttccacctctggga

SEQ ID NO: 6462053 - DNA, 12 bp, Homo sapiens
tcgccttcccca

SEQ ID NO: 6462054 - DNA, 15 bp, Homo sapiens
tcgccttgaacaaaa

SEQ ID NO: 6462055 - DNA, 14 bp, Homo sapiens
tcgccttgtgttac

SEQ ID NO: 6462056 - DNA, 19 bp, Homo sapiens
tcgcctttcagcaggcagc

SEQ ID NO: 6462057 - DNA, 14 bp, Homo sapiens
tcgcctttcccacc

SEQ ID NO: 6462058 - DNA, 16 bp, Homo sapiens
tcgcctttcccaccct

SEQ ID NO: 6462059 - DNA, 12 bp, Homo sapiens
tcgcctttcctc

SEQ ID NO: 6462060 - DNA, 19 bp, Homo sapiens
tcgcctttgtcttgtactt

SEQ ID NO: 6462061 - DNA, 20 bp, Homo sapiens
tcgcctttgtcttgtacttc

SEQ ID NO: 6462062 - DNA, 17 bp, Homo sapiens
tcgccttttaggctcag

SEQ ID NO: 6462063 - DNA, 14 bp, Homo sapiens
tcgcgatgatgggc

SEQ ID NO: 6462064 - DNA, 20 bp, Homo sapiens
tcgcgatgatgggctggagc

SEQ ID NO: 6462065 - DNA, 21 bp, Homo sapiens
tcgcgatgatgggctggagca

SEQ ID NO: 6462066 - DNA, 20 bp, Homo sapiens
tcgcgccccccgcgcccctc

SEQ ID NO: 6462067 - DNA, 13 bp, Homo sapiens
tcgcgcccctgtc

SEQ ID NO: 6462068 - DNA, 14 bp, Homo sapiens
tcgcgctcagcatg

SEQ ID NO: 6462069 - DNA, 14 bp, Homo sapiens
tcgcgctctgctca

SEQ ID NO: 6462070 - DNA, 12 bp, Homo sapiens
tcgcgctgcctg

SEQ ID NO: 6462071 - DNA, 15 bp, Homo sapiens
tcgcgctgcctgtgt

SEQ ID NO: 6462072 - DNA, 16 bp, Homo sapiens
tcgcgctgcctgtgtg

SEQ ID NO: 6462073 - DNA, 14 bp, Homo sapiens
tcgcgctggacagc

SEQ ID NO: 6462074 - DNA, 19 bp, Homo sapiens
tcgcggcaggttctctttg

SEQ ID NO: 6462075 - DNA, 17 bp, Homo sapiens
tcgcggccctcagtagt

SEQ ID NO: 6462076 - DNA, 21 bp, Homo sapiens
tcgcggcctcttctctcagac

SEQ ID NO: 6462077 - DNA, 20 bp, Homo sapiens
tcgcgggcagcgggccaggc

SEQ ID NO: 6462078 - DNA, 21 bp, Homo sapiens
tcgcgggcagcgggccaggcc

SEQ ID NO: 6462079 - DNA, 23 bp, Homo sapiens
tcgctaaagggaccatctgctgc

SEQ ID NO: 6462080 - DNA, 24 bp, Homo sapiens
tcgctaagggcttgtttttcttca

SEQ ID NO: 6462081 - DNA, 21 bp, Homo sapiens
tcgctagcagtggcaggcaga

SEQ ID NO: 6462082 - DNA, 16 bp, Homo sapiens
tcgctagggccaaggt

SEQ ID NO: 6462083 - DNA, 15 bp, Homo sapiens
tcgctagtgattaaa

SEQ ID NO: 6462084 - DNA, 14 bp, Homo sapiens
tcgctagtgtttaa

SEQ ID NO: 6462085 - DNA, 22 bp, Homo sapiens
tcgctatgggaggcagccgagg

SEQ ID NO: 6462086 - DNA, 20 bp, Homo sapiens
tcgctatgtgacttgcgctt

SEQ ID NO: 6462087 - DNA, 13 bp, Homo sapiens
tcgctattcccag

SEQ ID NO: 6462088 - DNA, 14 bp, Homo sapiens
tcgctattcccagg

SEQ ID NO: 6462089 - DNA, 19 bp, Homo sapiens
tcgctattcccaggcaggg

SEQ ID NO: 6462090 - DNA, 22 bp, Homo sapiens
tcgctattcccaggcagggagg

SEQ ID NO: 6462091 - DNA, 18 bp, Homo sapiens
tcgctcaatcaagaaaat

SEQ ID NO: 6462092 - DNA, 22 bp, Homo sapiens
tcgctcaggtgatcaaaataaa

SEQ ID NO: 6462093 - DNA, 18 bp, Homo sapiens
tcgctcagtcagtgcact

SEQ ID NO: 6462094 - DNA, 17 bp, Homo sapiens
tcgctccatcgcccagg

SEQ ID NO: 6462095 - DNA, 16 bp, Homo sapiens
tcgctcccaaaggaaa

SEQ ID NO: 6462096 - DNA, 15 bp, Homo sapiens
tcgctcccctctgga

SEQ ID NO: 6462097 - DNA, 16 bp, Homo sapiens
tcgctcccctctggaa

SEQ ID NO: 6462098 - DNA, 18 bp, Homo sapiens
tcgctcccctctggaatc

SEQ ID NO: 6462099 - DNA, 17 bp, Homo sapiens
tcgctccctcccaggac

SEQ ID NO: 6462100 - DNA, 19 bp, Homo sapiens
tcgctccctgtagctctgc

SEQ ID NO: 6462101 - DNA, 22 bp, Homo sapiens
tcgctccctgtagctctgcctc

SEQ ID NO: 6462102 - DNA, 11 bp, Homo sapiens
tcgctcctagg

SEQ ID NO: 6462103 - DNA, 15 bp, Homo sapiens
tcgctcctattgaaa

SEQ ID NO: 6462104 - DNA, 19 bp, Homo sapiens
tcgctcctcaacccctccc

SEQ ID NO: 6462105 - DNA, 18 bp, Homo sapiens
tcgctcctcccagatggc

SEQ ID NO: 6462106 - DNA, 14 bp, Homo sapiens
tcgctcctcctctc

SEQ ID NO: 6462107 - DNA, 12 bp, Homo sapiens
tcgctctctctc

SEQ ID NO: 6462108 - DNA, 15 bp, Homo sapiens
tcgctctgctggcct

SEQ ID NO: 6462109 - DNA, 14 bp, Homo sapiens
tcgctctgggatgc

SEQ ID NO: 6462110 - DNA, 21 bp, Homo sapiens
tcgctctgttgcccaggctgg

SEQ ID NO: 6462111 - DNA, 11 bp, Homo sapiens
tcgctgaaagc

SEQ ID NO: 6462112 - DNA, 23 bp, Homo sapiens
tcgctgaacctgtctcctcccag

SEQ ID NO: 6462113 - DNA, 18 bp, Homo sapiens
tcgctgaattgcccgttt

SEQ ID NO: 6462114 - DNA, 22 bp, Homo sapiens
tcgctgagggcagactggggca

SEQ ID NO: 6462115 - DNA, 22 bp, Homo sapiens
tcgctgatatatgtgtttttca

SEQ ID NO: 6462116 - DNA, 15 bp, Homo sapiens
tcgctgatgcagaca

SEQ ID NO: 6462117 - DNA, 17 bp, Homo sapiens
tcgctgatgctgggctg

SEQ ID NO: 6462118 - DNA, 17 bp, Homo sapiens
tcgctgcacatggcctg

SEQ ID NO: 6462119 - DNA, 18 bp, Homo sapiens
tcgctgcacatggcctga

SEQ ID NO: 6462120 - DNA, 15 bp, Homo sapiens
tcgctgccacccacc

SEQ ID NO: 6462121 - DNA, 19 bp, Homo sapiens
tcgctgccagctctgtatc

SEQ ID NO: 6462122 - DNA, 14 bp, Homo sapiens
tcgctgccaggaca

SEQ ID NO: 6462123 - DNA, 18 bp, Homo sapiens
tcgctgccaggacacctg

SEQ ID NO: 6462124 - DNA, 20 bp, Homo sapiens
tcgctgccaggacacctgcc

SEQ ID NO: 6462125 - DNA, 21 bp, Homo sapiens
tcgctgccaggacacctgccc

SEQ ID NO: 6462126 - DNA, 23 bp, Homo sapiens
tcgctgccaggacacctgcccca

SEQ ID NO: 6462127 - DNA, 24 bp, Homo sapiens
tcgctgccaggacacctgccccag

SEQ ID NO: 6462128 - DNA, 16 bp, Homo sapiens
tcgctgcctccatggc

SEQ ID NO: 6462129 - DNA, 16 bp, Homo sapiens
tcgctgccttgccatg

SEQ ID NO: 6462130 - DNA, 17 bp, Homo sapiens
tcgctgcgcagcctcca

SEQ ID NO: 6462131 - DNA, 14 bp, Homo sapiens
tcgctgcgtcctca

SEQ ID NO: 6462132 - DNA, 17 bp, Homo sapiens
tcgctgctctagctggc

SEQ ID NO: 6462133 - DNA, 12 bp, Homo sapiens
tcgctggaaaac

SEQ ID NO: 6462134 - DNA, 14 bp, Homo sapiens
tcgctggacaaccc

SEQ ID NO: 6462135 - DNA, 15 bp, Homo sapiens
tcgctggacaaccca

SEQ ID NO: 6462136 - DNA, 16 bp, Homo sapiens
tcgctggcagagaagg

SEQ ID NO: 6462137 - DNA, 19 bp, Homo sapiens
tcgctggctgatcattgca

SEQ ID NO: 6462138 - DNA, 20 bp, Homo sapiens
tcgctgggtcagtgctggaa

SEQ ID NO: 6462139 - DNA, 16 bp, Homo sapiens
tcgctgggtcctctgc

SEQ ID NO: 6462140 - DNA, 17 bp, Homo sapiens
tcgctgggtcctctgca

SEQ ID NO: 6462141 - DNA, 23 bp, Homo sapiens
tcgctgggtgccgggctgcacag

SEQ ID NO: 6462142 - DNA, 18 bp, Homo sapiens
tcgctgtaccctttaaga

SEQ ID NO: 6462143 - DNA, 15 bp, Homo sapiens
tcgctgtcccctcag

SEQ ID NO: 6462144 - DNA, 16 bp, Homo sapiens
tcgctgtccgtcctgc

SEQ ID NO: 6462145 - DNA, 12 bp, Homo sapiens
tcgctgtcctgc

SEQ ID NO: 6462146 - DNA, 11 bp, Homo sapiens
tcgctgtcctt

SEQ ID NO: 6462147 - DNA, 17 bp, Homo sapiens
tcgctgtcctttctaga

SEQ ID NO: 6462148 - DNA, 22 bp, Homo sapiens
tcgctgtgaaaatgaggaggat

SEQ ID NO: 6462149 - DNA, 17 bp, Homo sapiens
tcgctgtgatgcatgag

SEQ ID NO: 6462150 - DNA, 12 bp, Homo sapiens
tcgctgtgccac

SEQ ID NO: 6462151 - DNA, 16 bp, Homo sapiens
tcgctgtgccacaggc

SEQ ID NO: 6462152 - DNA, 14 bp, Homo sapiens
tcgctgtgccacca

SEQ ID NO: 6462153 - DNA, 16 bp, Homo sapiens
tcgctgtgccaccacc

SEQ ID NO: 6462154 - DNA, 17 bp, Homo sapiens
tcgctgtgccaccaccc

SEQ ID NO: 6462155 - DNA, 13 bp, Homo sapiens
tcgctgtgtgtta

SEQ ID NO: 6462156 - DNA, 21 bp, Homo sapiens
tcgctgttaccgcctgtctct

SEQ ID NO: 6462157 - DNA, 19 bp, Homo sapiens
tcgctgttctgggcatggc

SEQ ID NO: 6462158 - DNA, 12 bp, Homo sapiens
tcgctgttgctg

SEQ ID NO: 6462159 - DNA, 14 bp, Homo sapiens
tcgctgttgctgaa

SEQ ID NO: 6462160 - DNA, 17 bp, Homo sapiens
tcgcttatatgtccttg

SEQ ID NO: 6462161 - DNA, 17 bp, Homo sapiens
tcgcttcataggcagag

SEQ ID NO: 6462162 - DNA, 23 bp, Homo sapiens
tcgcttcataggcagagcccgcc

SEQ ID NO: 6462163 - DNA, 16 bp, Homo sapiens
tcgcttcatgtaacta

SEQ ID NO: 6462164 - DNA, 16 bp, Homo sapiens
tcgcttcccccatagc

SEQ ID NO: 6462165 - DNA, 16 bp, Homo sapiens
tcgcttcttgcctctg

SEQ ID NO: 6462166 - DNA, 17 bp, Homo sapiens
tcgcttcttgcctctgt

SEQ ID NO: 6462167 - DNA, 14 bp, Homo sapiens
tcgcttctttttca

SEQ ID NO: 6462168 - DNA, 17 bp, Homo sapiens
tcgcttgaacctgggaa

SEQ ID NO: 6462169 - DNA, 13 bp, Homo sapiens
tcgcttgccaaag

SEQ ID NO: 6462170 - DNA, 15 bp, Homo sapiens
tcgcttgccaaagca

SEQ ID NO: 6462171 - DNA, 18 bp, Homo sapiens
tcgcttgccaaagcagat

SEQ ID NO: 6462172 - DNA, 22 bp, Homo sapiens
tcgcttgccgggcctgggcctc

SEQ ID NO: 6462173 - DNA, 19 bp, Homo sapiens
tcgcttgctggaacacagg

SEQ ID NO: 6462174 - DNA, 15 bp, Homo sapiens
tcgcttgcttctgca

SEQ ID NO: 6462175 - DNA, 16 bp, Homo sapiens
tcgcttgcttctgcag

SEQ ID NO: 6462176 - DNA, 16 bp, Homo sapiens
tcgcttggctccatgc

SEQ ID NO: 6462177 - DNA, 16 bp, Homo sapiens
tcgcttgtaaatacca

SEQ ID NO: 6462178 - DNA, 21 bp, Homo sapiens
tcgcttgtgcagaaaacattg

SEQ ID NO: 6462179 - DNA, 15 bp, Homo sapiens
tcgctttcctgagcc

SEQ ID NO: 6462180 - DNA, 19 bp, Homo sapiens
tcgcttttaataaactgca

SEQ ID NO: 6462181 - DNA, 22 bp, Homo sapiens
tcgcttttaataaactgcaagt

SEQ ID NO: 6462182 - DNA, 15 bp, Homo sapiens
tcgcttttggtgcct

SEQ ID NO: 6462183 - DNA, 16 bp, Homo sapiens
tcgctttttcatcctt

SEQ ID NO: 6462184 - DNA, 19 bp, Homo sapiens
tcggaaaaaaaaaaagaaa

SEQ ID NO: 6462185 - DNA, 15 bp, Homo sapiens
tcggaaaacatgcta

SEQ ID NO: 6462186 - DNA, 18 bp, Homo sapiens
tcggaaaacatgctacac

SEQ ID NO: 6462187 - DNA, 12 bp, Homo sapiens
tcggaaacactg

SEQ ID NO: 6462188 - DNA, 22 bp, Homo sapiens
tcggaaatacactacaaatgtt

SEQ ID NO: 6462189 - DNA, 12 bp, Homo sapiens
tcggaacagctc

SEQ ID NO: 6462190 - DNA, 22 bp, Homo sapiens
tcggaaccgctcacctagagcc

SEQ ID NO: 6462191 - DNA, 22 bp, Homo sapiens
tcggaactgcatgctgctggac

SEQ ID NO: 6462192 - DNA, 19 bp, Homo sapiens
tcggaactgtcctttcctt

SEQ ID NO: 6462193 - DNA, 19 bp, Homo sapiens
tgattaaatatttgaagag

SEQ ID NO: 6462194 - DNA, 22 bp, Homo sapiens
tgattaaatgtctgacacatta

SEQ ID NO: 6462195 - DNA, 15 bp, Homo sapiens
tgattaaattatgaa

SEQ ID NO: 6462196 - DNA, 19 bp, Homo sapiens
tgattaaattatgaatgag

SEQ ID NO: 6462197 - DNA, 13 bp, Homo sapiens
tgattaaattctt

SEQ ID NO: 6462198 - DNA, 17 bp, Homo sapiens
tgattaaattcttgcaa

SEQ ID NO: 6462199 - DNA, 19 bp, Homo sapiens
tgattaaattcttgcaaag

SEQ ID NO: 6462200 - DNA, 20 bp, Homo sapiens
tgattaaattcttgcaaagt

SEQ ID NO: 6462201 - DNA, 18 bp, Homo sapiens
tgattaaatttaatatac

SEQ ID NO: 6462202 - DNA, 19 bp, Homo sapiens
tgattaaatttaatatact

SEQ ID NO: 6462203 - DNA, 22 bp, Homo sapiens
tgattaacaaataaattggaat

SEQ ID NO: 6462204 - DNA, 14 bp, Homo sapiens
tgattaacaaatat

SEQ ID NO: 6462205 - DNA, 16 bp, Homo sapiens
tgattaacaatgtatt

SEQ ID NO: 6462206 - DNA, 19 bp, Homo sapiens
tgattaaccacttcagctg

SEQ ID NO: 6462207 - DNA, 13 bp, Homo sapiens
tgattaagatttt

SEQ ID NO: 6462208 - DNA, 17 bp, Homo sapiens
tgattaagattttacaa

SEQ ID NO: 6462209 - DNA, 19 bp, Homo sapiens
tgattaaggactacagaat

SEQ ID NO: 6462210 - DNA, 18 bp, Homo sapiens
tgattaaggtctctcttt

SEQ ID NO: 6462211 - DNA, 22 bp, Homo sapiens
tgattaaggtctctctttggac

SEQ ID NO: 6462212 - DNA, 15 bp, Homo sapiens
tgattaagtaatgat

SEQ ID NO: 6462213 - DNA, 16 bp, Homo sapiens
tgattaagtaatgata

SEQ ID NO: 6462214 - DNA, 13 bp, Homo sapiens
tgattaataaaat

SEQ ID NO: 6462215 - DNA, 16 bp, Homo sapiens
tgattaataaaatatc

SEQ ID NO: 6462216 - DNA, 21 bp, Homo sapiens
tgattaatatgcaagtgaaca

SEQ ID NO: 6462217 - DNA, 11 bp, Homo sapiens
tgattaatcaa

SEQ ID NO: 6462218 - DNA, 12 bp, Homo sapiens
tgattaatcaaa

SEQ ID NO: 6462219 - DNA, 16 bp, Homo sapiens
tgattaatccagaata

SEQ ID NO: 6462220 - DNA, 15 bp, Homo sapiens
tgattaatgtacttt

SEQ ID NO: 6462221 - DNA, 17 bp, Homo sapiens
tgattaatgttttcatt

SEQ ID NO: 6462222 - DNA, 21 bp, Homo sapiens
tgattaatgttttcattatgt

SEQ ID NO: 6462223 - DNA, 21 bp, Homo sapiens
tgattaattcaccttccagtg

SEQ ID NO: 6462224 - DNA, 17 bp, Homo sapiens
tgattacaaataaacag

SEQ ID NO: 6462225 - DNA, 21 bp, Homo sapiens
tgattacaaataaacagttgt

SEQ ID NO: 6462226 - DNA, 22 bp, Homo sapiens
tgattacaaataaacagttgtt

SEQ ID NO: 6462227 - DNA, 19 bp, Homo sapiens
tgattacatagatcagcca

SEQ ID NO: 6462228 - DNA, 20 bp, Homo sapiens
tgattacctcctgtgtggaa

SEQ ID NO: 6462229 - DNA, 12 bp, Homo sapiens
tgattacctctc

SEQ ID NO: 6462230 - DNA, 14 bp, Homo sapiens
tgattacctgccaa

SEQ ID NO: 6462231 - DNA, 21 bp, Homo sapiens
tgattacctgctgcatgaaaa

SEQ ID NO: 6462232 - DNA, 22 bp, Homo sapiens
tgattacgtgtatgtttcttct

SEQ ID NO: 6462233 - DNA, 15 bp, Homo sapiens
tgattactctttgct

SEQ ID NO: 6462234 - DNA, 16 bp, Homo sapiens
tgattactctttgctt

SEQ ID NO: 6462235 - DNA, 18 bp, Homo sapiens
tgattactgcaatcactg

SEQ ID NO: 6462236 - DNA, 21 bp, Homo sapiens
tgattactggcctttttcatt

SEQ ID NO: 6462237 - DNA, 18 bp, Homo sapiens
tgattactgtcaataaac

SEQ ID NO: 6462238 - DNA, 19 bp, Homo sapiens
tgattactgtcaataaaca

SEQ ID NO: 6462239 - DNA, 16 bp, Homo sapiens
tgattacttccactga

SEQ ID NO: 6462240 - DNA, 21 bp, Homo sapiens
tgattacttgtaattatgaaa

SEQ ID NO: 6462241 - DNA, 21 bp, Homo sapiens
tgattagaaggcaagtttcta

SEQ ID NO: 6462242 - DNA, 15 bp, Homo sapiens
tgattagacagaaca

SEQ ID NO: 6462243 - DNA, 16 bp, Homo sapiens
tgattagacagaacac

SEQ ID NO: 6462244 - DNA, 17 bp, Homo sapiens
tgattagacagaacacc

SEQ ID NO: 6462245 - DNA, 17 bp, Homo sapiens
tgattagagctgcataa

SEQ ID NO: 6462246 - DNA, 20 bp, Homo sapiens
tgattagagtgcaaaagtga

SEQ ID NO: 6462247 - DNA, 16 bp, Homo sapiens
tgattagataatcttt

SEQ ID NO: 6462248 - DNA, 22 bp, Homo sapiens
tgattagataatcttttacatt

SEQ ID NO: 6462249 - DNA, 15 bp, Homo sapiens
tgattagcagaagaa

SEQ ID NO: 6462250 - DNA, 19 bp, Homo sapiens
tgattagcagttgaggcca

SEQ ID NO: 6462251 - DNA, 13 bp, Homo sapiens
tgattaggtatgt

SEQ ID NO: 6462252 - DNA, 22 bp, Homo sapiens
tgattaggtatgtttgtaactt

SEQ ID NO: 6462253 - DNA, 21 bp, Homo sapiens
tgattaggttatggtttaatg

SEQ ID NO: 6462254 - DNA, 17 bp, Homo sapiens
tgattagtaaagaaatg

SEQ ID NO: 6462255 - DNA, 22 bp, Homo sapiens
tgattagtgaaaggaagataaa

SEQ ID NO: 6462256 - DNA, 15 bp, Homo sapiens
tgattagttaaaaaa

SEQ ID NO: 6462257 - DNA, 13 bp, Homo sapiens
tgattagttatgt

SEQ ID NO: 6462258 - DNA, 17 bp, Homo sapiens
tgattagttgacagtat

SEQ ID NO: 6462259 - DNA, 19 bp, Homo sapiens
tgattagttttcttgttgc

SEQ ID NO: 6462260 - DNA, 14 bp, Homo sapiens
tgattataaatgtt

SEQ ID NO: 6462261 - DNA, 19 bp, Homo sapiens
tgattataccatgtgtgct

SEQ ID NO: 6462262 - DNA, 18 bp, Homo sapiens
tgattatagcaactaatg

SEQ ID NO: 6462263 - DNA, 20 bp, Homo sapiens
tgattatagcaactaatgtt

SEQ ID NO: 6462264 - DNA, 14 bp, Homo sapiens
tgattatatttcac

SEQ ID NO: 6462265 - DNA, 11 bp, Homo sapiens
tgattatcagg

SEQ ID NO: 6462266 - DNA, 18 bp, Homo sapiens
tgattatcttcagcccag

SEQ ID NO: 6462267 - DNA, 19 bp, Homo sapiens
tgattatcttcagcccagg

SEQ ID NO: 6462268 - DNA, 14 bp, Homo sapiens
tgattatcttgaaa

SEQ ID NO: 6462269 - DNA, 14 bp, Homo sapiens
tgattatgaaatgc

SEQ ID NO: 6462270 - DNA, 17 bp, Homo sapiens
tgattatgaattacatt

SEQ ID NO: 6462271 - DNA, 15 bp, Homo sapiens
tgattatgactgttt

SEQ ID NO: 6462272 - DNA, 22 bp, Homo sapiens
tgattatgattagttatgtctt

SEQ ID NO: 6462273 - DNA, 15 bp, Homo sapiens
tgattatgtaccttt

SEQ ID NO: 6462274 - DNA, 20 bp, Homo sapiens
tgattatgtaccttttgata

SEQ ID NO: 6462275 - DNA, 16 bp, Homo sapiens
tgattatgtatggata

SEQ ID NO: 6462276 - DNA, 17 bp, Homo sapiens
tgattatgtatggatat

SEQ ID NO: 6462277 - DNA, 22 bp, Homo sapiens
tgattatgtcttttatatttgt

SEQ ID NO: 6462278 - DNA, 21 bp, Homo sapiens
tgattatgtgtcctttcttga

SEQ ID NO: 6462279 - DNA, 20 bp, Homo sapiens
tgattattaacgatgtccaa

SEQ ID NO: 6462280 - DNA, 15 bp, Homo sapiens
tgattattcaacaca

SEQ ID NO: 6462281 - DNA, 18 bp, Homo sapiens
tgattattctgattccac

SEQ ID NO: 6462282 - DNA, 14 bp, Homo sapiens
tgattattgaatgt

SEQ ID NO: 6462283 - DNA, 14 bp, Homo sapiens
tgattattgcagaa

SEQ ID NO: 6462284 - DNA, 13 bp, Homo sapiens
tgattatttatga

SEQ ID NO: 6462285 - DNA, 16 bp, Homo sapiens
tgattatttattattt

SEQ ID NO: 6462286 - DNA, 15 bp, Homo sapiens
tgattatttcacttt

SEQ ID NO: 6462287 - DNA, 23 bp, Homo sapiens
tgattatttcactttagatgctg

SEQ ID NO: 6462288 - DNA, 14 bp, Homo sapiens
tgattatttgcatg

SEQ ID NO: 6462289 - DNA, 20 bp, Homo sapiens
tgattattttcattacaatg

SEQ ID NO: 6462290 - DNA, 23 bp, Homo sapiens
tgattattttcctggagtgaaga

SEQ ID NO: 6462291 - DNA, 13 bp, Homo sapiens
tgattattttctt

SEQ ID NO: 6462292 - DNA, 19 bp, Homo sapiens
tgattattttcttcatcca

SEQ ID NO: 6462293 - DNA, 18 bp, Homo sapiens
tgattattttgtgcaaca

SEQ ID NO: 6462294 - DNA, 15 bp, Homo sapiens
tgattatttttccag

SEQ ID NO: 6462295 - DNA, 21 bp, Homo sapiens
tgattattttttttttcttct

SEQ ID NO: 6462296 - DNA, 17 bp, Homo sapiens
tgattcaaaatatttaa

SEQ ID NO: 6462297 - DNA, 17 bp, Homo sapiens
tgattcaaaccaaagct

SEQ ID NO: 6462298 - DNA, 21 bp, Homo sapiens
tgattcaaaccaaagctgcct

SEQ ID NO: 6462299 - DNA, 22 bp, Homo sapiens
tgattcaaaccaaagctgcctg

SEQ ID NO: 6462300 - DNA, 13 bp, Homo sapiens
tgattcaaatggg

SEQ ID NO: 6462301 - DNA, 17 bp, Homo sapiens
tgattcaaatgttacaa

SEQ ID NO: 6462302 - DNA, 19 bp, Homo sapiens
tgattcaaatgttacaaaa

SEQ ID NO: 6462303 - DNA, 19 bp, Homo sapiens
tgattcaaattgctgcttg

SEQ ID NO: 6462304 - DNA, 23 bp, Homo sapiens
tgattcaacacttaagtctcaga

SEQ ID NO: 6462305 - DNA, 12 bp, Homo sapiens
tgattcaacagg

SEQ ID NO: 6462306 - DNA, 16 bp, Homo sapiens
tgattcaagaaacaga

SEQ ID NO: 6462307 - DNA, 22 bp, Homo sapiens
tgattcaagaacaagcaatgat

SEQ ID NO: 6462308 - DNA, 21 bp, Homo sapiens
tgattcaagccattccaaagt

SEQ ID NO: 6462309 - DNA, 23 bp, Homo sapiens
tgattcaaggctcagaaggaatg

SEQ ID NO: 6462310 - DNA, 13 bp, Homo sapiens
tgattcaatgtga

SEQ ID NO: 6462311 - DNA, 19 bp, Homo sapiens
tgattcaatgtgaatttta

SEQ ID NO: 6462312 - DNA, 19 bp, Homo sapiens
tgattcaatttgatgtggt

SEQ ID NO: 6462313 - DNA, 22 bp, Homo sapiens
tgattcacaactaggacctcat

SEQ ID NO: 6462314 - DNA, 14 bp, Homo sapiens
tgattcacatgttt

SEQ ID NO: 6462315 - DNA, 17 bp, Homo sapiens
tgattcacatgttttca

SEQ ID NO: 6462316 - DNA, 18 bp, Homo sapiens
tgattcacatgttttcaa

SEQ ID NO: 6462317 - DNA, 22 bp, Homo sapiens
tgattcacccccaaacagtgac

SEQ ID NO: 6462318 - DNA, 16 bp, Homo sapiens
tgattcacctcttctt

SEQ ID NO: 6462319 - DNA, 17 bp, Homo sapiens
tgattcactattagaga

SEQ ID NO: 6462320 - DNA, 17 bp, Homo sapiens
tgattcactggcctggc

SEQ ID NO: 6462321 - DNA, 22 bp, Homo sapiens
tgattcactggcctggcggaga

SEQ ID NO: 6462322 - DNA, 14 bp, Homo sapiens
tgattcactgtgct

SEQ ID NO: 6462323 - DNA, 14 bp, Homo sapiens
tgattcacttttat

SEQ ID NO: 6462324 - DNA, 19 bp, Homo sapiens
tgattcagaaaatgttctg

SEQ ID NO: 6462325 - DNA, 20 bp, Homo sapiens
tgattcagaaaatgttctgt

SEQ ID NO: 6462326 - DNA, 14 bp, Homo sapiens
tgattcagacagct

SEQ ID NO: 6462327 - DNA, 15 bp, Homo sapiens
tgattcagcaaaaat

SEQ ID NO: 6462328 - DNA, 18 bp, Homo sapiens
tgattcaggtgcagagga

SEQ ID NO: 6462329 - DNA, 14 bp, Homo sapiens
tgattcagtcacat

SEQ ID NO: 6462330 - DNA, 17 bp, Homo sapiens
tgattcagtcttctgga

SEQ ID NO: 6462331 - DNA, 21 bp, Homo sapiens
tgattcagtgttaaatgtgat

SEQ ID NO: 6462332 - DNA, 21 bp, Homo sapiens
tgattcataatgacttaagca

SEQ ID NO: 6462333 - DNA, 14 bp, Homo sapiens
tgattcatatttaa

SEQ ID NO: 6462334 - DNA, 16 bp, Homo sapiens
tgattcatatttaatt

SEQ ID NO: 6462335 - DNA, 20 bp, Homo sapiens
tgattcatatttaatttgaa

SEQ ID NO: 6462336 - DNA, 20 bp, Homo sapiens
tgattcatcctgggatgtaa

SEQ ID NO: 6462337 - DNA, 13 bp, Homo sapiens
tgattcatctctg

SEQ ID NO: 6462338 - DNA, 14 bp, Homo sapiens
tgattcatgtgctt

SEQ ID NO: 6462339 - DNA, 19 bp, Homo sapiens
tgattcatgttcatcaata

SEQ ID NO: 6462340 - DNA, 13 bp, Homo sapiens
tgattcattctga

SEQ ID NO: 6462341 - DNA, 14 bp, Homo sapiens
tgattcattttcct

SEQ ID NO: 6462342 - DNA, 15 bp, Homo sapiens
tgattcattttcctg

SEQ ID NO: 6462343 - DNA, 17 bp, Homo sapiens
tgattcattttcctgtt

SEQ ID NO: 6462344 - DNA, 16 bp, Homo sapiens
tgattccaagggccca

SEQ ID NO: 6462345 - DNA, 20 bp, Homo sapiens
tgattccaagggcccagagg

SEQ ID NO: 6462346 - DNA, 19 bp, Homo sapiens
tgattccaatctctgttct

SEQ ID NO: 6462347 - DNA, 19 bp, Homo sapiens
tgattccactacacctggc

SEQ ID NO: 6462348 - DNA, 23 bp, Homo sapiens
tgattccactacacctggctgag

SEQ ID NO: 6462349 - DNA, 23 bp, Homo sapiens
tgattccaggaggagttagccaa

SEQ ID NO: 6462350 - DNA, 16 bp, Homo sapiens
tgattccatccacctt

SEQ ID NO: 6462351 - DNA, 20 bp, Homo sapiens
tgattccattccatggaaat

SEQ ID NO: 6462352 - DNA, 16 bp, Homo sapiens
tgattccattttaagt

SEQ ID NO: 6462353 - DNA, 14 bp, Homo sapiens
tgattcccaactcc

SEQ ID NO: 6462354 - DNA, 19 bp, Homo sapiens
tgattcccaagctctgctc

SEQ ID NO: 6462355 - DNA, 14 bp, Homo sapiens
tgattcccagagca

SEQ ID NO: 6462356 - DNA, 12 bp, Homo sapiens
tgattcccagca

SEQ ID NO: 6462357 - DNA, 21 bp, Homo sapiens
tgattccccactcaatgacat

SEQ ID NO: 6462358 - DNA, 20 bp, Homo sapiens
tgattcccttgttattcaac

SEQ ID NO: 6462359 - DNA, 15 bp, Homo sapiens
tgattccgcaccctg

SEQ ID NO: 6462360 - DNA, 16 bp, Homo sapiens
tgattccgcaccctgc

SEQ ID NO: 6462361 - DNA, 20 bp, Homo sapiens
tgattcctaaaactctgcca

SEQ ID NO: 6462362 - DNA, 22 bp, Homo sapiens
tgattcctaaaactctgccagc

SEQ ID NO: 6462363 - DNA, 18 bp, Homo sapiens
tgattcctacaacgaaat

SEQ ID NO: 6462364 - DNA, 19 bp, Homo sapiens
tgattcctacccctcttcc

SEQ ID NO: 6462365 - DNA, 21 bp, Homo sapiens
tgattcctctcatttccagct

SEQ ID NO: 6462366 - DNA, 14 bp, Homo sapiens
tgattcctgcattt

SEQ ID NO: 6462367 - DNA, 17 bp, Homo sapiens
tgattcctgctgcctgt

SEQ ID NO: 6462368 - DNA, 21 bp, Homo sapiens
tgattcctggctctaccctgt

SEQ ID NO: 6462369 - DNA, 23 bp, Homo sapiens
tgattcctggtggccagtatcct

SEQ ID NO: 6462370 - DNA, 15 bp, Homo sapiens
tgattccttctctgg

SEQ ID NO: 6462371 - DNA, 12 bp, Homo sapiens
tcggaagagagg

SEQ ID NO: 6462372 - DNA, 21 bp, Homo sapiens
tcggaagagagggctgagcca

SEQ ID NO: 6462373 - DNA, 22 bp, Homo sapiens
tcggaagcagtgccttccataa

SEQ ID NO: 6462374 - DNA, 23 bp, Homo sapiens
tcggaagcagtgccttccataat

SEQ ID NO: 6462375 - DNA, 13 bp, Homo sapiens
tcggaagcctgtc

SEQ ID NO: 6462376 - DNA, 17 bp, Homo sapiens
tcggaagcctgtcctca

SEQ ID NO: 6462377 - DNA, 19 bp, Homo sapiens
tcggaagcctgtcctcacc

SEQ ID NO: 6462378 - DNA, 13 bp, Homo sapiens
tcggaatgttaca

SEQ ID NO: 6462379 - DNA, 19 bp, Homo sapiens
tcggacaagacccccagca

SEQ ID NO: 6462380 - DNA, 11 bp, Homo sapiens
tcggacacagt

SEQ ID NO: 6462381 - DNA, 13 bp, Homo sapiens
tcggacagagccc

SEQ ID NO: 6462382 - DNA, 18 bp, Homo sapiens
tcggacagtgcccatgca

SEQ ID NO: 6462383 - DNA, 17 bp, Homo sapiens
tcggaccactaggcctg

SEQ ID NO: 6462384 - DNA, 17 bp, Homo sapiens
tcggacccaccccaact

SEQ ID NO: 6462385 - DNA, 19 bp, Homo sapiens
tcggacccaccccaactct

SEQ ID NO: 6462386 - DNA, 22 bp, Homo sapiens
tcggacccaccccaactctccc

SEQ ID NO: 6462387 - DNA, 22 bp, Homo sapiens
tcggacggccaatggtgcttcc

SEQ ID NO: 6462388 - DNA, 23 bp, Homo sapiens
tcggactaagcctacctgctctc

SEQ ID NO: 6462389 - DNA, 15 bp, Homo sapiens
tcggactccatggct

SEQ ID NO: 6462390 - DNA, 19 bp, Homo sapiens
tcggactgcccccagaaag

SEQ ID NO: 6462391 - DNA, 14 bp, Homo sapiens
tcggactgctgtgc

SEQ ID NO: 6462392 - DNA, 17 bp, Homo sapiens
tcggacttactgcctga

SEQ ID NO: 6462393 - DNA, 17 bp, Homo sapiens
tcggactttgcaggagt

SEQ ID NO: 6462394 - DNA, 22 bp, Homo sapiens
tcggactttgcaggagttcctt

SEQ ID NO: 6462395 - DNA, 16 bp, Homo sapiens
tcggagaagagcgcag

SEQ ID NO: 6462396 - DNA, 16 bp, Homo sapiens
tcggagaagagctgtt

SEQ ID NO: 6462397 - DNA, 21 bp, Homo sapiens
tcggagacagtgatctccata

SEQ ID NO: 6462398 - DNA, 14 bp, Homo sapiens
tcggagagcagcag

SEQ ID NO: 6462399 - DNA, 16 bp, Homo sapiens
tcggagagcagcagca

SEQ ID NO: 6462400 - DNA, 23 bp, Homo sapiens
tcggagagggctgcgagcatttc

SEQ ID NO: 6462401 - DNA, 18 bp, Homo sapiens
tcggagcatggtgttttc

SEQ ID NO: 6462402 - DNA, 13 bp, Homo sapiens
tcggagcctgcct

SEQ ID NO: 6462403 - DNA, 20 bp, Homo sapiens
tcggagcgttctctgtccta

SEQ ID NO: 6462404 - DNA, 16 bp, Homo sapiens
tcggagctgcctgcag

SEQ ID NO: 6462405 - DNA, 15 bp, Homo sapiens
tcggagctggcccag

SEQ ID NO: 6462406 - DNA, 12 bp, Homo sapiens
tcggagctggct

SEQ ID NO: 6462407 - DNA, 16 bp, Homo sapiens
tcggagctggctgtgc

SEQ ID NO: 6462408 - DNA, 17 bp, Homo sapiens
tcggagctggctgtgcc

SEQ ID NO: 6462409 - DNA, 18 bp, Homo sapiens
tcggagctggctgtgcct

SEQ ID NO: 6462410 - DNA, 20 bp, Homo sapiens
tcggagctggctgtgcctgc

SEQ ID NO: 6462411 - DNA, 12 bp, Homo sapiens
tcggaggaagcc

SEQ ID NO: 6462412 - DNA, 17 bp, Homo sapiens
tcggaggccaggccctc

SEQ ID NO: 6462413 - DNA, 19 bp, Homo sapiens
tcggaggccccactgatgc

SEQ ID NO: 6462414 - DNA, 21 bp, Homo sapiens
tcggaggctacccgctgtggc

SEQ ID NO: 6462415 - DNA, 16 bp, Homo sapiens
tcggaggctcctccct

SEQ ID NO: 6462416 - DNA, 13 bp, Homo sapiens
tcggaggctgggc

SEQ ID NO: 6462417 - DNA, 20 bp, Homo sapiens
tcggagggaattgaggtctg

SEQ ID NO: 6462418 - DNA, 15 bp, Homo sapiens
tcggagggccgcagg

SEQ ID NO: 6462419 - DNA, 16 bp, Homo sapiens
tcggaggtccagctgg

SEQ ID NO: 6462420 - DNA, 12 bp, Homo sapiens
tcggaggtggca

SEQ ID NO: 6462421 - DNA, 15 bp, Homo sapiens
tcggaggtggtggag

SEQ ID NO: 6462422 - DNA, 22 bp, Homo sapiens
tcggagtagaaattgttcctga

SEQ ID NO: 6462423 - DNA, 16 bp, Homo sapiens
tcggagtgaatgtggc

SEQ ID NO: 6462424 - DNA, 15 bp, Homo sapiens
tcggagtgtggcctg

SEQ ID NO: 6462425 - DNA, 16 bp, Homo sapiens
tcggagtgtggcctgg

SEQ ID NO: 6462426 - DNA, 18 bp, Homo sapiens
tcggagtgtggcctggat

SEQ ID NO: 6462427 - DNA, 14 bp, Homo sapiens
tcggataattttca

SEQ ID NO: 6462428 - DNA, 19 bp, Homo sapiens
tcggatcagctgagccttc

SEQ ID NO: 6462429 - DNA, 18 bp, Homo sapiens
tcggatccagggaggctg

SEQ ID NO: 6462430 - DNA, 13 bp, Homo sapiens
tcggatcctgtga

SEQ ID NO: 6462431 - DNA, 14 bp, Homo sapiens
tcggatcgctccgc

SEQ ID NO: 6462432 - DNA, 13 bp, Homo sapiens
tcggatctcacag

SEQ ID NO: 6462433 - DNA, 20 bp, Homo sapiens
tcggatctggggctctggga

SEQ ID NO: 6462434 - DNA, 13 bp, Homo sapiens
tcggatgaccaaa

SEQ ID NO: 6462435 - DNA, 22 bp, Homo sapiens
tcggatgaccaaaccagccttc

SEQ ID NO: 6462436 - DNA, 19 bp, Homo sapiens
tcggatgaccatactcaga

SEQ ID NO: 6462437 - DNA, 21 bp, Homo sapiens
tcggatggaccaacctgctct

SEQ ID NO: 6462438 - DNA, 22 bp, Homo sapiens
tcggatggaccaacctgctctg

SEQ ID NO: 6462439 - DNA, 12 bp, Homo sapiens
tcggatggggca

SEQ ID NO: 6462440 - DNA, 10 bp, Homo sapiens
tcggattaga

SEQ ID NO: 6462441 - DNA, 23 bp, Homo sapiens
tcggatttattcccttttaaaga

SEQ ID NO: 6462442 - DNA, 20 bp, Homo sapiens
tcggatttgagtgatcatta

SEQ ID NO: 6462443 - DNA, 15 bp, Homo sapiens
tcggcaaccgtgggg

SEQ ID NO: 6462444 - DNA, 18 bp, Homo sapiens
tcggcacacactgtgccc

SEQ ID NO: 6462445 - DNA, 19 bp, Homo sapiens
tcggcaccagtgcctcagt

SEQ ID NO: 6462446 - DNA, 14 bp, Homo sapiens
tcggcaccttcccc

SEQ ID NO: 6462447 - DNA, 18 bp, Homo sapiens
tcggcagaactctctgtc

SEQ ID NO: 6462448 - DNA, 21 bp, Homo sapiens
tcggcagaggaacccccacca

SEQ ID NO: 6462449 - DNA, 23 bp, Homo sapiens
tcggcagaggaacccccaccaga

SEQ ID NO: 6462450 - DNA, 15 bp, Homo sapiens
tcggcagaggtggtc

SEQ ID NO: 6462451 - DNA, 16 bp, Homo sapiens
tcggcagatactgtct

SEQ ID NO: 6462452 - DNA, 12 bp, Homo sapiens
tcggcaggaagg

SEQ ID NO: 6462453 - DNA, 18 bp, Homo sapiens
tcggcaggaaggagcggc

SEQ ID NO: 6462454 - DNA, 16 bp, Homo sapiens
tcggcagtggctgggg

SEQ ID NO: 6462455 - DNA, 18 bp, Homo sapiens
tcggcatagtccccagag

SEQ ID NO: 6462456 - DNA, 13 bp, Homo sapiens
tcggcatgccagg

SEQ ID NO: 6462457 - DNA, 15 bp, Homo sapiens
tcggccacaccccag

SEQ ID NO: 6462458 - DNA, 15 bp, Homo sapiens
tcggccactgtgtct

SEQ ID NO: 6462459 - DNA, 12 bp, Homo sapiens
tcggccagagct

SEQ ID NO: 6462460 - DNA, 13 bp, Homo sapiens
tcggccagagctc

SEQ ID NO: 6462461 - DNA, 18 bp, Homo sapiens
tcggccagagctcccagg

SEQ ID NO: 6462462 - DNA, 19 bp, Homo sapiens
tcggccagagctcccagga

SEQ ID NO: 6462463 - DNA, 19 bp, Homo sapiens
tcggccaggcattggctca

SEQ ID NO: 6462464 - DNA, 23 bp, Homo sapiens
tcggccagttttcggaaacactg

SEQ ID NO: 6462465 - DNA, 16 bp, Homo sapiens
tcggcccatctgtcca

SEQ ID NO: 6462466 - DNA, 19 bp, Homo sapiens
tcggccccacatgggaacc

SEQ ID NO: 6462467 - DNA, 15 bp, Homo sapiens
tcggccccaccagtg

SEQ ID NO: 6462468 - DNA, 17 bp, Homo sapiens
tcggccccacccaccct

SEQ ID NO: 6462469 - DNA, 18 bp, Homo sapiens
tcggccccatcgccccac

SEQ ID NO: 6462470 - DNA, 21 bp, Homo sapiens
tcggccccatcgccccaccgc

SEQ ID NO: 6462471 - DNA, 14 bp, Homo sapiens
tcggcccctctgat

SEQ ID NO: 6462472 - DNA, 17 bp, Homo sapiens
tcggcccggagcagcag

SEQ ID NO: 6462473 - DNA, 13 bp, Homo sapiens
tcggccctgaacc

SEQ ID NO: 6462474 - DNA, 18 bp, Homo sapiens
tcggccctgaaccacgag

SEQ ID NO: 6462475 - DNA, 13 bp, Homo sapiens
tcggccctgccca

SEQ ID NO: 6462476 - DNA, 18 bp, Homo sapiens
tcggccctgtagccctgg

SEQ ID NO: 6462477 - DNA, 20 bp, Homo sapiens
tcggccctgtagccctggcc

SEQ ID NO: 6462478 - DNA, 14 bp, Homo sapiens
tcggccctgtcccc

SEQ ID NO: 6462479 - DNA, 17 bp, Homo sapiens
tcggccctgtcccctgg

SEQ ID NO: 6462480 - DNA, 15 bp, Homo sapiens
tcggccgcccggcag

SEQ ID NO: 6462481 - DNA, 22 bp, Homo sapiens
tcggcctagggcccccacagtt

SEQ ID NO: 6462482 - DNA, 19 bp, Homo sapiens
tcggcctccagactgcgga

SEQ ID NO: 6462483 - DNA, 18 bp, Homo sapiens
tcggcctccatcctgagg

SEQ ID NO: 6462484 - DNA, 19 bp, Homo sapiens
tcggcctcccaaagtgctg

SEQ ID NO: 6462485 - DNA, 17 bp, Homo sapiens
tcggcctcccaaagtgt

SEQ ID NO: 6462486 - DNA, 18 bp, Homo sapiens
tcggcctcccacagtgct

SEQ ID NO: 6462487 - DNA, 19 bp, Homo sapiens
tcggcctcctaaagtgctg

SEQ ID NO: 6462488 - DNA, 17 bp, Homo sapiens
tcggcctctaaccccag

SEQ ID NO: 6462489 - DNA, 22 bp, Homo sapiens
tcggcctctaaccccaggcccc

SEQ ID NO: 6462490 - DNA, 19 bp, Homo sapiens
tcggcctgcccccacccca

SEQ ID NO: 6462491 - DNA, 18 bp, Homo sapiens
tcggcctggctggccagg

SEQ ID NO: 6462492 - DNA, 13 bp, Homo sapiens
tcggcctggcttc

SEQ ID NO: 6462493 - DNA, 20 bp, Homo sapiens
tcggcgccttctacctgcag

SEQ ID NO: 6462494 - DNA, 17 bp, Homo sapiens
tcggcgtggcccaaggc

SEQ ID NO: 6462495 - DNA, 22 bp, Homo sapiens
tcggctaaaaagaatgcagaga

SEQ ID NO: 6462496 - DNA, 22 bp, Homo sapiens
tcggctacccctcgactcagca

SEQ ID NO: 6462497 - DNA, 20 bp, Homo sapiens
tcggctactggttacctgga

SEQ ID NO: 6462498 - DNA, 21 bp, Homo sapiens
tcggctactggttacctggag

SEQ ID NO: 6462499 - DNA, 17 bp, Homo sapiens
tcggctcccgcttgctc

SEQ ID NO: 6462500 - DNA, 12 bp, Homo sapiens
tcggctccctgg

SEQ ID NO: 6462501 - DNA, 13 bp, Homo sapiens
tcggctcctgatg

SEQ ID NO: 6462502 - DNA, 17 bp, Homo sapiens
tcggctcctgctgcacc

SEQ ID NO: 6462503 - DNA, 21 bp, Homo sapiens
tcggctctgcagtcctactca

SEQ ID NO: 6462504 - DNA, 16 bp, Homo sapiens
tcggctctgcatgttt

SEQ ID NO: 6462505 - DNA, 13 bp, Homo sapiens
tcggctgccaggg

SEQ ID NO: 6462506 - DNA, 23 bp, Homo sapiens
tcggctgccaggggctctgtggc

SEQ ID NO: 6462507 - DNA, 18 bp, Homo sapiens
tcggctggaagaacatca

SEQ ID NO: 6462508 - DNA, 13 bp, Homo sapiens
tcggctggctccc

SEQ ID NO: 6462509 - DNA, 14 bp, Homo sapiens
tcggctgggcaggg

SEQ ID NO: 6462510 - DNA, 15 bp, Homo sapiens
tcggctgggcagggc

SEQ ID NO: 6462511 - DNA, 19 bp, Homo sapiens
tcggctgggcagggccgca

SEQ ID NO: 6462512 - DNA, 21 bp, Homo sapiens
tcggctgggcagggccgcagg

SEQ ID NO: 6462513 - DNA, 20 bp, Homo sapiens
tcggctggggactgctacct

SEQ ID NO: 6462514 - DNA, 19 bp, Homo sapiens
tcggctgtaaacagctctg

SEQ ID NO: 6462515 - DNA, 15 bp, Homo sapiens
tcggctgtctcctgt

SEQ ID NO: 6462516 - DNA, 10 bp, Homo sapiens
tcggctgtga

SEQ ID NO: 6462517 - DNA, 17 bp, Homo sapiens
tcggctgttcctcccct

SEQ ID NO: 6462518 - DNA, 22 bp, Homo sapiens
tcggcttgagttcaccatctct

SEQ ID NO: 6462519 - DNA, 17 bp, Homo sapiens
tcggcttggatcctggg

SEQ ID NO: 6462520 - DNA, 16 bp, Homo sapiens
tcggcttgtgggctgg

SEQ ID NO: 6462521 - DNA, 23 bp, Homo sapiens
tcggcttgtgggctggtgcccca

SEQ ID NO: 6462522 - DNA, 18 bp, Homo sapiens
tcggcttttaatgtactt

SEQ ID NO: 6462523 - DNA, 20 bp, Homo sapiens
tcgggaaattctgctgcttg

SEQ ID NO: 6462524 - DNA, 16 bp, Homo sapiens
tcgggaacctcactct

SEQ ID NO: 6462525 - DNA, 15 bp, Homo sapiens
tcgggaagagaggag

SEQ ID NO: 6462526 - DNA, 21 bp, Homo sapiens
tcgggaagagaggagttcaat

SEQ ID NO: 6462527 - DNA, 21 bp, Homo sapiens
tcgggaagatcctccttccag

SEQ ID NO: 6462528 - DNA, 12 bp, Homo sapiens
tcgggaaggatg

SEQ ID NO: 6462529 - DNA, 14 bp, Homo sapiens
tcgggaaggatggg

SEQ ID NO: 6462530 - DNA, 17 bp, Homo sapiens
tcgggaaggatgggaaa

SEQ ID NO: 6462531 - DNA, 20 bp, Homo sapiens
tcgggaaggatgggaaaaac

SEQ ID NO: 6462532 - DNA, 16 bp, Homo sapiens
tcgggaaggcctgagg

SEQ ID NO: 6462533 - DNA, 21 bp, Homo sapiens
tcgggaaggcctgagggaagc

SEQ ID NO: 6462534 - DNA, 16 bp, Homo sapiens
tcgggacacctgccct

SEQ ID NO: 6462535 - DNA, 14 bp, Homo sapiens
tcgggacagaccag

SEQ ID NO: 6462536 - DNA, 19 bp, Homo sapiens
tcgggacagaccagcagca

SEQ ID NO: 6462537 - DNA, 13 bp, Homo sapiens
tcgggacagagag

SEQ ID NO: 6462538 - DNA, 14 bp, Homo sapiens
tcgggaccacatct

SEQ ID NO: 6462539 - DNA, 21 bp, Homo sapiens
tcgggaccacatctgtcctca

SEQ ID NO: 6462540 - DNA, 13 bp, Homo sapiens
tcgggacttcaaa

SEQ ID NO: 6462541 - DNA, 19 bp, Homo sapiens
tcgggacttgaaaaccact

SEQ ID NO: 6462542 - DNA, 15 bp, Homo sapiens
tcgggagaggggacg

SEQ ID NO: 6462543 - DNA, 23 bp, Homo sapiens
tcgggagaggggacgcaggcccc

SEQ ID NO: 6462544 - DNA, 14 bp, Homo sapiens
tcgggagcacccag

SEQ ID NO: 6462545 - DNA, 16 bp, Homo sapiens
tcgggagcacccagag

SEQ ID NO: 6462546 - DNA, 20 bp, Homo sapiens
tcgggagcacccagagcacc

SEQ ID NO: 6462547 - DNA, 22 bp, Homo sapiens
tcgggagcagtgtcttccataa

SEQ ID NO: 6462548 - DNA, 23 bp, Homo sapiens
tcgggagcagtgtcttccataat

SEQ ID NO: 6462549 - DNA, 12 bp, Homo sapiens
tcgggagctgca

SEQ ID NO: 6462550 - DNA, 14 bp, Homo sapiens
tgattcctttaaaa

SEQ ID NO: 6462551 - DNA, 20 bp, Homo sapiens
tgattcctttaaaatatatg

SEQ ID NO: 6462552 - DNA, 17 bp, Homo sapiens
tgattcctttgaagagg

SEQ ID NO: 6462553 - DNA, 21 bp, Homo sapiens
tgattcctttgaagaggaaaa

SEQ ID NO: 6462554 - DNA, 21 bp, Homo sapiens
tgattccttttgatggggaga

SEQ ID NO: 6462555 - DNA, 22 bp, Homo sapiens
tgattcgaagggtcttaaagaa

SEQ ID NO: 6462556 - DNA, 15 bp, Homo sapiens
tgattcgagctatat

SEQ ID NO: 6462557 - DNA, 16 bp, Homo sapiens
tgattcgagctatatt

SEQ ID NO: 6462558 - DNA, 22 bp, Homo sapiens
tgattcgcccaaagccagacag

SEQ ID NO: 6462559 - DNA, 23 bp, Homo sapiens
tgattcggggctgacctttcaaa

SEQ ID NO: 6462560 - DNA, 15 bp, Homo sapiens
tgattcgggggctga

SEQ ID NO: 6462561 - DNA, 18 bp, Homo sapiens
tgattcgggggctgacct

SEQ ID NO: 6462562 - DNA, 18 bp, Homo sapiens
tgattctaaaatgtctca

SEQ ID NO: 6462563 - DNA, 19 bp, Homo sapiens
tgattctaatcatctgcag

SEQ ID NO: 6462564 - DNA, 15 bp, Homo sapiens
tgattctacagtgat

SEQ ID NO: 6462565 - DNA, 18 bp, Homo sapiens
tgattctagtacataatt

SEQ ID NO: 6462566 - DNA, 16 bp, Homo sapiens
tgattctatgtaactt

SEQ ID NO: 6462567 - DNA, 14 bp, Homo sapiens
tgattctattatat

SEQ ID NO: 6462568 - DNA, 15 bp, Homo sapiens
tgattctcagggtct

SEQ ID NO: 6462569 - DNA, 23 bp, Homo sapiens
tgattctcagggtctctgctgcc

SEQ ID NO: 6462570 - DNA, 13 bp, Homo sapiens
tgattctcctgcc

SEQ ID NO: 6462571 - DNA, 15 bp, Homo sapiens
tgattctcctgcctc

SEQ ID NO: 6462572 - DNA, 19 bp, Homo sapiens
tgattctcctgcctcagcc

SEQ ID NO: 6462573 - DNA, 20 bp, Homo sapiens
tgattctcctgcctcagctt

SEQ ID NO: 6462574 - DNA, 13 bp, Homo sapiens
tgattctccttca

SEQ ID NO: 6462575 - DNA, 21 bp, Homo sapiens
tgattctccttcagccctcac

SEQ ID NO: 6462576 - DNA, 19 bp, Homo sapiens
tgattctccttttatgtgt

SEQ ID NO: 6462577 - DNA, 19 bp, Homo sapiens
tgattctctacatgctctt

SEQ ID NO: 6462578 - DNA, 14 bp, Homo sapiens
tgattctctcttct

SEQ ID NO: 6462579 - DNA, 13 bp, Homo sapiens
tgattctctgagt

SEQ ID NO: 6462580 - DNA, 14 bp, Homo sapiens
tgattctctgagtg

SEQ ID NO: 6462581 - DNA, 15 bp, Homo sapiens
tgattctctgagtgg

SEQ ID NO: 6462582 - DNA, 12 bp, Homo sapiens
tgattctctgtg

SEQ ID NO: 6462583 - DNA, 19 bp, Homo sapiens
tgattctctgtggtttttt

SEQ ID NO: 6462584 - DNA, 22 bp, Homo sapiens
tgattctcttgagataaggttt

SEQ ID NO: 6462585 - DNA, 21 bp, Homo sapiens
tgattctctttaactgtgtga

SEQ ID NO: 6462586 - DNA, 18 bp, Homo sapiens
tgattctgaagcttatgt

SEQ ID NO: 6462587 - DNA, 17 bp, Homo sapiens
tgattctgaatctgaaa

SEQ ID NO: 6462588 - DNA, 16 bp, Homo sapiens
tgattctgattgctat

SEQ ID NO: 6462589 - DNA, 14 bp, Homo sapiens
tgattctgatttca

SEQ ID NO: 6462590 - DNA, 12 bp, Homo sapiens
tgattctgcctt

SEQ ID NO: 6462591 - DNA, 13 bp, Homo sapiens
tgattctgccttt

SEQ ID NO: 6462592 - DNA, 18 bp, Homo sapiens
tgattctggctttaagcc

SEQ ID NO: 6462593 - DNA, 12 bp, Homo sapiens
tgattctgggat

SEQ ID NO: 6462594 - DNA, 19 bp, Homo sapiens
tgattctgtcccccacgtg

SEQ ID NO: 6462595 - DNA, 13 bp, Homo sapiens
tgattctgttcta

SEQ ID NO: 6462596 - DNA, 21 bp, Homo sapiens
tgattcttaacacagccttcc

SEQ ID NO: 6462597 - DNA, 18 bp, Homo sapiens
tgattcttaactaaaatt

SEQ ID NO: 6462598 - DNA, 13 bp, Homo sapiens
tgattcttacata

SEQ ID NO: 6462599 - DNA, 19 bp, Homo sapiens
tgattcttccaaggaaata

SEQ ID NO: 6462600 - DNA, 21 bp, Homo sapiens
tgattcttctcttgtgatttg

SEQ ID NO: 6462601 - DNA, 16 bp, Homo sapiens
tgattcttgattcctg

SEQ ID NO: 6462602 - DNA, 17 bp, Homo sapiens
tgattcttgattcctgg

SEQ ID NO: 6462603 - DNA, 14 bp, Homo sapiens
tgattcttgtaaat

SEQ ID NO: 6462604 - DNA, 17 bp, Homo sapiens
tgattcttgtaaatctt

SEQ ID NO: 6462605 - DNA, 13 bp, Homo sapiens
tgattcttgtgat

SEQ ID NO: 6462606 - DNA, 23 bp, Homo sapiens
tgattcttgtgattgactttttg

SEQ ID NO: 6462607 - DNA, 15 bp, Homo sapiens
tgattcttgtgtcat

SEQ ID NO: 6462608 - DNA, 23 bp, Homo sapiens
tgattctttttaaagtgtttctg

SEQ ID NO: 6462609 - DNA, 22 bp, Homo sapiens
tgattgaaaagaagaaagtcta

SEQ ID NO: 6462610 - DNA, 22 bp, Homo sapiens
tgattgaaaatagtaaatgctt

SEQ ID NO: 6462611 - DNA, 20 bp, Homo sapiens
tgattgaaagaaaaaaaaat

SEQ ID NO: 6462612 - DNA, 17 bp, Homo sapiens
tgattgaaccagctcat

SEQ ID NO: 6462613 - DNA, 12 bp, Homo sapiens
tgattgaagaaa

SEQ ID NO: 6462614 - DNA, 14 bp, Homo sapiens
tgattgaagaaaca

SEQ ID NO: 6462615 - DNA, 20 bp, Homo sapiens
tgattgaagtatctgtacct

SEQ ID NO: 6462616 - DNA, 19 bp, Homo sapiens
tgattgaataatgccacca

SEQ ID NO: 6462617 - DNA, 17 bp, Homo sapiens
tgattgaatttttaagc

SEQ ID NO: 6462618 - DNA, 17 bp, Homo sapiens
tgattgacagctttgct

SEQ ID NO: 6462619 - DNA, 21 bp, Homo sapiens
tgattgaccgtgttggtctgt

SEQ ID NO: 6462620 - DNA, 13 bp, Homo sapiens
tgattgagaagtt

SEQ ID NO: 6462621 - DNA, 21 bp, Homo sapiens
tgattgagagcagcctcttga

SEQ ID NO: 6462622 - DNA, 12 bp, Homo sapiens
tgattgagagtt

SEQ ID NO: 6462623 - DNA, 18 bp, Homo sapiens
tgattgagagttggctgt

SEQ ID NO: 6462624 - DNA, 16 bp, Homo sapiens
tgattgattcagtatc

SEQ ID NO: 6462625 - DNA, 22 bp, Homo sapiens
tgattgattcagtatcttagag

SEQ ID NO: 6462626 - DNA, 14 bp, Homo sapiens
tgattgatttgaag

SEQ ID NO: 6462627 - DNA, 17 bp, Homo sapiens
tgattgcacagaatttg

SEQ ID NO: 6462628 - DNA, 18 bp, Homo sapiens
tgattgcacagaatttgt

SEQ ID NO: 6462629 - DNA, 15 bp, Homo sapiens
tgattgcacattgtt

SEQ ID NO: 6462630 - DNA, 19 bp, Homo sapiens
tgattgcacgtgcctgtgg

SEQ ID NO: 6462631 - DNA, 18 bp, Homo sapiens
tgattgcactaaataaac

SEQ ID NO: 6462632 - DNA, 20 bp, Homo sapiens
tgattgcagaattgtttaga

SEQ ID NO: 6462633 - DNA, 14 bp, Homo sapiens
tgattgcagcttta

SEQ ID NO: 6462634 - DNA, 20 bp, Homo sapiens
tgattgcagcttttggttaa

SEQ ID NO: 6462635 - DNA, 11 bp, Homo sapiens
tgattgcatat

SEQ ID NO: 6462636 - DNA, 21 bp, Homo sapiens
tgattgcatattttgttatag

SEQ ID NO: 6462637 - DNA, 17 bp, Homo sapiens
tgattgccaaattgaca

SEQ ID NO: 6462638 - DNA, 16 bp, Homo sapiens
tgattgccaacagtgg

SEQ ID NO: 6462639 - DNA, 18 bp, Homo sapiens
tgattgccaagctcagga

SEQ ID NO: 6462640 - DNA, 16 bp, Homo sapiens
tgattgcctcaataaa

SEQ ID NO: 6462641 - DNA, 16 bp, Homo sapiens
tgattgcgagaatttt

SEQ ID NO: 6462642 - DNA, 14 bp, Homo sapiens
tgattgctaaatgt

SEQ ID NO: 6462643 - DNA, 11 bp, Homo sapiens
tgattgctatc

SEQ ID NO: 6462644 - DNA, 14 bp, Homo sapiens
tgattgctccagag

SEQ ID NO: 6462645 - DNA, 15 bp, Homo sapiens
tgattgctcccagga

SEQ ID NO: 6462646 - DNA, 19 bp, Homo sapiens
tgattgctcccaggatctc

SEQ ID NO: 6462647 - DNA, 19 bp, Homo sapiens
tgattgctgcattttacct

SEQ ID NO: 6462648 - DNA, 13 bp, Homo sapiens
tgattgctgccat

SEQ ID NO: 6462649 - DNA, 18 bp, Homo sapiens
tgattgcttgagctcagg

SEQ ID NO: 6462650 - DNA, 17 bp, Homo sapiens
tgattgctttgctgcac

SEQ ID NO: 6462651 - DNA, 19 bp, Homo sapiens
tgattgcttttaaaatttt

SEQ ID NO: 6462652 - DNA, 19 bp, Homo sapiens
tgattggaatagcttctgg

SEQ ID NO: 6462653 - DNA, 16 bp, Homo sapiens
tgattggaatttctgg

SEQ ID NO: 6462654 - DNA, 19 bp, Homo sapiens
tgattggaatttctggcct

SEQ ID NO: 6462655 - DNA, 22 bp, Homo sapiens
tgattggacaggcatgggtgca

SEQ ID NO: 6462656 - DNA, 17 bp, Homo sapiens
tgattggaccaggccat

SEQ ID NO: 6462657 - DNA, 21 bp, Homo sapiens
tgattggacctggcccagtgc

SEQ ID NO: 6462658 - DNA, 13 bp, Homo sapiens
tgattggaggggg

SEQ ID NO: 6462659 - DNA, 18 bp, Homo sapiens
tgattggattattcattt

SEQ ID NO: 6462660 - DNA, 19 bp, Homo sapiens
tgattggattattcattta

SEQ ID NO: 6462661 - DNA, 15 bp, Homo sapiens
tgattggcagatgag

SEQ ID NO: 6462662 - DNA, 23 bp, Homo sapiens
tgattggcagcttcaaaacagaa

SEQ ID NO: 6462663 - DNA, 16 bp, Homo sapiens
tgattggcatataatg

SEQ ID NO: 6462664 - DNA, 15 bp, Homo sapiens
tgattggctgcagga

SEQ ID NO: 6462665 - DNA, 15 bp, Homo sapiens
tgattggctgcttaa

SEQ ID NO: 6462666 - DNA, 20 bp, Homo sapiens
tgattgggaaaacatttgct

SEQ ID NO: 6462667 - DNA, 18 bp, Homo sapiens
tgattgggaataaatatg

SEQ ID NO: 6462668 - DNA, 17 bp, Homo sapiens
tgattgggacagaggtt

SEQ ID NO: 6462669 - DNA, 14 bp, Homo sapiens
tgattgggtgccat

SEQ ID NO: 6462670 - DNA, 15 bp, Homo sapiens
tgattggttcagttt

SEQ ID NO: 6462671 - DNA, 17 bp, Homo sapiens
tgattggttcagttttt

SEQ ID NO: 6462672 - DNA, 18 bp, Homo sapiens
tgattggttgtgccttcc

SEQ ID NO: 6462673 - DNA, 20 bp, Homo sapiens
tgattggttgtgccttccct

SEQ ID NO: 6462674 - DNA, 21 bp, Homo sapiens
tgattggttgtgccttccctt

SEQ ID NO: 6462675 - DNA, 12 bp, Homo sapiens
tgattggttttg

SEQ ID NO: 6462676 - DNA, 14 bp, Homo sapiens
tgattgtaaaatag

SEQ ID NO: 6462677 - DNA, 17 bp, Homo sapiens
tgattgtaacgttgctg

SEQ ID NO: 6462678 - DNA, 20 bp, Homo sapiens
tgattgtaacgttgctgtgg

SEQ ID NO: 6462679 - DNA, 22 bp, Homo sapiens
tgattgtaacgttgctgtggga

SEQ ID NO: 6462680 - DNA, 23 bp, Homo sapiens
tgattgtaacgttgctgtgggaa

SEQ ID NO: 6462681 - DNA, 15 bp, Homo sapiens
tgattgtaagtccca

SEQ ID NO: 6462682 - DNA, 19 bp, Homo sapiens
tgattgtacagaatcattg

SEQ ID NO: 6462683 - DNA, 16 bp, Homo sapiens
tgattgtactttgaat

SEQ ID NO: 6462684 - DNA, 15 bp, Homo sapiens
tgattgtataatgtg

SEQ ID NO: 6462685 - DNA, 16 bp, Homo sapiens
tgattgtataatgtga

SEQ ID NO: 6462686 - DNA, 14 bp, Homo sapiens
tgattgtatgttga

SEQ ID NO: 6462687 - DNA, 16 bp, Homo sapiens
tgattgtattgttgaa

SEQ ID NO: 6462688 - DNA, 13 bp, Homo sapiens
tgattgtcagcca

SEQ ID NO: 6462689 - DNA, 17 bp, Homo sapiens
tgattgtcagccacctc

SEQ ID NO: 6462690 - DNA, 21 bp, Homo sapiens
tgattgtctaaccaattgtga

SEQ ID NO: 6462691 - DNA, 13 bp, Homo sapiens
tgattgtcttaat

SEQ ID NO: 6462692 - DNA, 12 bp, Homo sapiens
tgattgtctttt

SEQ ID NO: 6462693 - DNA, 15 bp, Homo sapiens
tgattgtgaggcttc

SEQ ID NO: 6462694 - DNA, 20 bp, Homo sapiens
tgattgtgaggcttctaata

SEQ ID NO: 6462695 - DNA, 14 bp, Homo sapiens
tgattgtggaatgg

SEQ ID NO: 6462696 - DNA, 17 bp, Homo sapiens
tgattgttatgtaaaac

SEQ ID NO: 6462697 - DNA, 15 bp, Homo sapiens
tgattgttcataata

SEQ ID NO: 6462698 - DNA, 20 bp, Homo sapiens
tgattgttcataatacataa

SEQ ID NO: 6462699 - DNA, 20 bp, Homo sapiens
tgattgttcttttgtttcat

SEQ ID NO: 6462700 - DNA, 21 bp, Homo sapiens
tgattgtttaagccagagtgt

SEQ ID NO: 6462701 - DNA, 15 bp, Homo sapiens
tgattgtttaattgt

SEQ ID NO: 6462702 - DNA, 16 bp, Homo sapiens
tgattgtttaattgta

SEQ ID NO: 6462703 - DNA, 22 bp, Homo sapiens
tgattgtttacaggatattcca

SEQ ID NO: 6462704 - DNA, 19 bp, Homo sapiens
tgattgtttctcaaatctt

SEQ ID NO: 6462705 - DNA, 17 bp, Homo sapiens
tgattgtttgcacagag

SEQ ID NO: 6462706 - DNA, 23 bp, Homo sapiens
tgattgttttaacacagtaccta

SEQ ID NO: 6462707 - DNA, 13 bp, Homo sapiens
tgattgttttaga

SEQ ID NO: 6462708 - DNA, 13 bp, Homo sapiens
tgattgttttatt

SEQ ID NO: 6462709 - DNA, 12 bp, Homo sapiens
tgatttaaaaaa

SEQ ID NO: 6462710 - DNA, 23 bp, Homo sapiens
tgatttaaaagtgtattttattc

SEQ ID NO: 6462711 - DNA, 16 bp, Homo sapiens
tgatttaaacacatta

SEQ ID NO: 6462712 - DNA, 21 bp, Homo sapiens
tgatttaaacttcttaactgg

SEQ ID NO: 6462713 - DNA, 13 bp, Homo sapiens
tgatttaacatta

SEQ ID NO: 6462714 - DNA, 18 bp, Homo sapiens
tgatttaagacacttttt

SEQ ID NO: 6462715 - DNA, 13 bp, Homo sapiens
tgatttaataaaa

SEQ ID NO: 6462716 - DNA, 14 bp, Homo sapiens
tgatttaataaaat

SEQ ID NO: 6462717 - DNA, 15 bp, Homo sapiens
tgatttaataaaata

SEQ ID NO: 6462718 - DNA, 23 bp, Homo sapiens
tgatttaataaaataattctaaa

SEQ ID NO: 6462719 - DNA, 14 bp, Homo sapiens
tgatttaataacat

SEQ ID NO: 6462720 - DNA, 20 bp, Homo sapiens
tgatttaataacataacaaa

SEQ ID NO: 6462721 - DNA, 17 bp, Homo sapiens
tgatttaatagtgttaa

SEQ ID NO: 6462722 - DNA, 21 bp, Homo sapiens
tgatttaatagtgttaatcaa

SEQ ID NO: 6462723 - DNA, 15 bp, Homo sapiens
tgatttaatttgaaa

SEQ ID NO: 6462724 - DNA, 20 bp, Homo sapiens
tgatttacaagcatcatgga

SEQ ID NO: 6462725 - DNA, 12 bp, Homo sapiens
tgatttacacag

SEQ ID NO: 6462726 - DNA, 17 bp, Homo sapiens
tgatttacagtgcctgt

SEQ ID NO: 6462727 - DNA, 15 bp, Homo sapiens
tgatttacagtttca

SEQ ID NO: 6462728 - DNA, 17 bp, Homo sapiens
tgatttacagtttcaaa

SEQ ID NO: 6462729 - DNA, 15 bp, Homo sapiens
tgatttacatgctga

SEQ ID NO: 6462730 - DNA, 14 bp, Homo sapiens
tcgggagctgcaca

SEQ ID NO: 6462731 - DNA, 13 bp, Homo sapiens
tcgggagggtgga

SEQ ID NO: 6462732 - DNA, 21 bp, Homo sapiens
tcgggaggtcgaggcaggagg

SEQ ID NO: 6462733 - DNA, 21 bp, Homo sapiens
tcgggagttcaagaccagcct

SEQ ID NO: 6462734 - DNA, 19 bp, Homo sapiens
tcgggataacaaaatcaca

SEQ ID NO: 6462735 - DNA, 16 bp, Homo sapiens
tcgggatgaaaagcca

SEQ ID NO: 6462736 - DNA, 22 bp, Homo sapiens
tcgggatgaaaagccatatcta

SEQ ID NO: 6462737 - DNA, 19 bp, Homo sapiens
tcgggattccctggtgggc

SEQ ID NO: 6462738 - DNA, 14 bp, Homo sapiens
tcgggcaagggccg

SEQ ID NO: 6462739 - DNA, 15 bp, Homo sapiens
tcgggcaccagccag

SEQ ID NO: 6462740 - DNA, 17 bp, Homo sapiens
tcgggcaccagccagcg

SEQ ID NO: 6462741 - DNA, 13 bp, Homo sapiens
tcgggcagccagc

SEQ ID NO: 6462742 - DNA, 15 bp, Homo sapiens
tcgggcagccagcag

SEQ ID NO: 6462743 - DNA, 16 bp, Homo sapiens
tcgggcagccagcaga

SEQ ID NO: 6462744 - DNA, 17 bp, Homo sapiens
tcgggcagccagcagag

SEQ ID NO: 6462745 - DNA, 22 bp, Homo sapiens
tcgggcagtggaggctgctgtg

SEQ ID NO: 6462746 - DNA, 12 bp, Homo sapiens
tcgggcatgaca

SEQ ID NO: 6462747 - DNA, 14 bp, Homo sapiens
tcgggcccacctgg

SEQ ID NO: 6462748 - DNA, 17 bp, Homo sapiens
tcgggcccacctggcca

SEQ ID NO: 6462749 - DNA, 14 bp, Homo sapiens
tcgggcccagggac

SEQ ID NO: 6462750 - DNA, 16 bp, Homo sapiens
tcgggcccctgagcct

SEQ ID NO: 6462751 - DNA, 12 bp, Homo sapiens
tcgggcccctgc

SEQ ID NO: 6462752 - DNA, 18 bp, Homo sapiens
tcgggcccctgcctgcct

SEQ ID NO: 6462753 - DNA, 23 bp, Homo sapiens
tcgggcccctgcctgccttctcc

SEQ ID NO: 6462754 - DNA, 19 bp, Homo sapiens
tcgggccctctctccgccc

SEQ ID NO: 6462755 - DNA, 20 bp, Homo sapiens
tcgggccctctctccgcccc

SEQ ID NO: 6462756 - DNA, 13 bp, Homo sapiens
tcgggcccttccc

SEQ ID NO: 6462757 - DNA, 13 bp, Homo sapiens
tcgggcccttctt

SEQ ID NO: 6462758 - DNA, 18 bp, Homo sapiens
tcgggcccttcttgctgc

SEQ ID NO: 6462759 - DNA, 16 bp, Homo sapiens
tcgggccgaggcccag

SEQ ID NO: 6462760 - DNA, 22 bp, Homo sapiens
tcgggcgcctgcgctcctctgc

SEQ ID NO: 6462761 - DNA, 21 bp, Homo sapiens
tcgggcgtgggtctctgggga

SEQ ID NO: 6462762 - DNA, 12 bp, Homo sapiens
tcgggctcacct

SEQ ID NO: 6462763 - DNA, 14 bp, Homo sapiens
tcgggctccagcca

SEQ ID NO: 6462764 - DNA, 14 bp, Homo sapiens
tcgggctcccgggt

SEQ ID NO: 6462765 - DNA, 17 bp, Homo sapiens
tcgggctcctgtgccct

SEQ ID NO: 6462766 - DNA, 20 bp, Homo sapiens
tcgggctgccagcccagctg

SEQ ID NO: 6462767 - DNA, 12 bp, Homo sapiens
tcgggctgtgcc

SEQ ID NO: 6462768 - DNA, 18 bp, Homo sapiens
tcgggctgttctggtggc

SEQ ID NO: 6462769 - DNA, 19 bp, Homo sapiens
tcgggctgttctggtggcc

SEQ ID NO: 6462770 - DNA, 15 bp, Homo sapiens
tcggggaactcctgg

SEQ ID NO: 6462771 - DNA, 19 bp, Homo sapiens
tcggggagaggctgaggac

SEQ ID NO: 6462772 - DNA, 13 bp, Homo sapiens
tcggggaggcaga

SEQ ID NO: 6462773 - DNA, 15 bp, Homo sapiens
tcggggatggggagg

SEQ ID NO: 6462774 - DNA, 18 bp, Homo sapiens
tcggggcaagagaggctg

SEQ ID NO: 6462775 - DNA, 22 bp, Homo sapiens
tcggggcaggaagtccctgaga

SEQ ID NO: 6462776 - DNA, 16 bp, Homo sapiens
tcggggcaggccaggg

SEQ ID NO: 6462777 - DNA, 12 bp, Homo sapiens
tcggggcagggc

SEQ ID NO: 6462778 - DNA, 15 bp, Homo sapiens
tcggggcagggcagg

SEQ ID NO: 6462779 - DNA, 15 bp, Homo sapiens
tcggggcatctggcc

SEQ ID NO: 6462780 - DNA, 19 bp, Homo sapiens
tcggggccatttggccggc

SEQ ID NO: 6462781 - DNA, 20 bp, Homo sapiens
tcggggccatttggccggct

SEQ ID NO: 6462782 - DNA, 12 bp, Homo sapiens
tcggggccctgt

SEQ ID NO: 6462783 - DNA, 15 bp, Homo sapiens
tcggggccctgtgta

SEQ ID NO: 6462784 - DNA, 23 bp, Homo sapiens
tcggggccggtgaggggaggggc

SEQ ID NO: 6462785 - DNA, 12 bp, Homo sapiens
tcggggcctcct

SEQ ID NO: 6462786 - DNA, 15 bp, Homo sapiens
tcggggcctgtgccg

SEQ ID NO: 6462787 - DNA, 17 bp, Homo sapiens
tcggggcgacccctcag

SEQ ID NO: 6462788 - DNA, 20 bp, Homo sapiens
tcggggcgatgctccctcag

SEQ ID NO: 6462789 - DNA, 13 bp, Homo sapiens
tcggggctccagg

SEQ ID NO: 6462790 - DNA, 14 bp, Homo sapiens
tcggggctccccac

SEQ ID NO: 6462791 - DNA, 20 bp, Homo sapiens
tcggggctgggggctgcagg

SEQ ID NO: 6462792 - DNA, 17 bp, Homo sapiens
tcgggggagcagagaga

SEQ ID NO: 6462793 - DNA, 19 bp, Homo sapiens
tcgggggagcagagagagc

SEQ ID NO: 6462794 - DNA, 14 bp, Homo sapiens
tcgggggaggagca

SEQ ID NO: 6462795 - DNA, 18 bp, Homo sapiens
tcggggggcgagggaggg

SEQ ID NO: 6462796 - DNA, 16 bp, Homo sapiens
tcggggggtcacaggc

SEQ ID NO: 6462797 - DNA, 17 bp, Homo sapiens
tcggggggtcacaggcc

SEQ ID NO: 6462798 - DNA, 19 bp, Homo sapiens
tcggggggtcacaggccca

SEQ ID NO: 6462799 - DNA, 23 bp, Homo sapiens
tcggggggtcacaggcccagaag

SEQ ID NO: 6462800 - DNA, 20 bp, Homo sapiens
tcgggggtgctggggccagg

SEQ ID NO: 6462801 - DNA, 16 bp, Homo sapiens
tcggggtcaagctgga

SEQ ID NO: 6462802 - DNA, 13 bp, Homo sapiens
tcggggtccctgg

SEQ ID NO: 6462803 - DNA, 16 bp, Homo sapiens
tcggggtgcacaggag

SEQ ID NO: 6462804 - DNA, 17 bp, Homo sapiens
tcggggtgcacaggagg

SEQ ID NO: 6462805 - DNA, 19 bp, Homo sapiens
tcggggtgcacaggagggg

SEQ ID NO: 6462806 - DNA, 14 bp, Homo sapiens
tcggggtgtgatga

SEQ ID NO: 6462807 - DNA, 18 bp, Homo sapiens
tcgggtgaatctgtctat

SEQ ID NO: 6462808 - DNA, 13 bp, Homo sapiens
tcgggtgcccagg

SEQ ID NO: 6462809 - DNA, 14 bp, Homo sapiens
tcgggtgcccagga

SEQ ID NO: 6462810 - DNA, 17 bp, Homo sapiens
tcgggtggggctggtgg

SEQ ID NO: 6462811 - DNA, 20 bp, Homo sapiens
tcgggtgggggagggaaagg

SEQ ID NO: 6462812 - DNA, 16 bp, Homo sapiens
tcgggttaagaaatac

SEQ ID NO: 6462813 - DNA, 22 bp, Homo sapiens
tcgggttcagaacactttttat

SEQ ID NO: 6462814 - DNA, 13 bp, Homo sapiens
tcggtactcccat

SEQ ID NO: 6462815 - DNA, 16 bp, Homo sapiens
tcggtagcagaggccc

SEQ ID NO: 6462816 - DNA, 20 bp, Homo sapiens
tcggtatctggcttccctgg

SEQ ID NO: 6462817 - DNA, 16 bp, Homo sapiens
tcggtcacctgtgcta

SEQ ID NO: 6462818 - DNA, 13 bp, Homo sapiens
tcggtcaccttgt

SEQ ID NO: 6462819 - DNA, 14 bp, Homo sapiens
tcggtcactgagtc

SEQ ID NO: 6462820 - DNA, 21 bp, Homo sapiens
tcggtcactgagtctggagtg

SEQ ID NO: 6462821 - DNA, 16 bp, Homo sapiens
tcggtcagcgactgga

SEQ ID NO: 6462822 - DNA, 16 bp, Homo sapiens
tcggtcagcggggcag

SEQ ID NO: 6462823 - DNA, 16 bp, Homo sapiens
tcggtcatgtgtgtat

SEQ ID NO: 6462824 - DNA, 17 bp, Homo sapiens
tcggtcatgtgtgtatt

SEQ ID NO: 6462825 - DNA, 13 bp, Homo sapiens
tcggtcctggtgc

SEQ ID NO: 6462826 - DNA, 14 bp, Homo sapiens
tcggtcctgtctcc

SEQ ID NO: 6462827 - DNA, 18 bp, Homo sapiens
tcggtcctgtctcccctc

SEQ ID NO: 6462828 - DNA, 18 bp, Homo sapiens
tcggtctcccaaagtgct

SEQ ID NO: 6462829 - DNA, 20 bp, Homo sapiens
tcggtctcccaaagtgctgg

SEQ ID NO: 6462830 - DNA, 15 bp, Homo sapiens
tcggtcttttgtatt

SEQ ID NO: 6462831 - DNA, 16 bp, Homo sapiens
tcggtgaccccatcac

SEQ ID NO: 6462832 - DNA, 17 bp, Homo sapiens
tcggtgaccccatcact

SEQ ID NO: 6462833 - DNA, 17 bp, Homo sapiens
tcggtgccatcagtgcc

SEQ ID NO: 6462834 - DNA, 12 bp, Homo sapiens
tcggtggccatg

SEQ ID NO: 6462835 - DNA, 19 bp, Homo sapiens
tcggtggccatgcttcttg

SEQ ID NO: 6462836 - DNA, 19 bp, Homo sapiens
tcggtgggacagccccagg

SEQ ID NO: 6462837 - DNA, 23 bp, Homo sapiens
tcggtgggagccgtcagcctgtg

SEQ ID NO: 6462838 - DNA, 16 bp, Homo sapiens
tcggtgtacacagagg

SEQ ID NO: 6462839 - DNA, 22 bp, Homo sapiens
tcggtgtccatttatagaataa

SEQ ID NO: 6462840 - DNA, 15 bp, Homo sapiens
tcggtgtgctgccaa

SEQ ID NO: 6462841 - DNA, 20 bp, Homo sapiens
tcggtgtggacgctgtgctg

SEQ ID NO: 6462842 - DNA, 17 bp, Homo sapiens
tcggtgttacttccctt

SEQ ID NO: 6462843 - DNA, 20 bp, Homo sapiens
tcggttaacaaataacaact

SEQ ID NO: 6462844 - DNA, 14 bp, Homo sapiens
tcggttcaggagga

SEQ ID NO: 6462845 - DNA, 15 bp, Homo sapiens
tcggttccacgtccc

SEQ ID NO: 6462846 - DNA, 23 bp, Homo sapiens
tcggttccacgtccccctggggc

SEQ ID NO: 6462847 - DNA, 13 bp, Homo sapiens
tcggttccagaca

SEQ ID NO: 6462848 - DNA, 19 bp, Homo sapiens
tcggttcctctgatttcaa

SEQ ID NO: 6462849 - DNA, 21 bp, Homo sapiens
tcggttgaccctactgtggat

SEQ ID NO: 6462850 - DNA, 19 bp, Homo sapiens
tcggttgattgtgcatgga

SEQ ID NO: 6462851 - DNA, 15 bp, Homo sapiens
tcggttgcagggctg

SEQ ID NO: 6462852 - DNA, 19 bp, Homo sapiens
tcggttgtaggactaaata

SEQ ID NO: 6462853 - DNA, 19 bp, Homo sapiens
tcggtttctaacttggagc

SEQ ID NO: 6462854 - DNA, 13 bp, Homo sapiens
tcgtaaaattaag

SEQ ID NO: 6462855 - DNA, 16 bp, Homo sapiens
tcgtaaaattaagaaa

SEQ ID NO: 6462856 - DNA, 16 bp, Homo sapiens
tcgtaaactgacacag

SEQ ID NO: 6462857 - DNA, 15 bp, Homo sapiens
tcgtaaagatttggg

SEQ ID NO: 6462858 - DNA, 16 bp, Homo sapiens
tcgtaacctggtgcct

SEQ ID NO: 6462859 - DNA, 14 bp, Homo sapiens
tcgtaagaacatgt

SEQ ID NO: 6462860 - DNA, 12 bp, Homo sapiens
tcgtaagttctg

SEQ ID NO: 6462861 - DNA, 17 bp, Homo sapiens
tcgtaatagcttctgtg

SEQ ID NO: 6462862 - DNA, 22 bp, Homo sapiens
tcgtaataggtgtcatggatag

SEQ ID NO: 6462863 - DNA, 15 bp, Homo sapiens
tcgtacagttcttcg

SEQ ID NO: 6462864 - DNA, 17 bp, Homo sapiens
tcgtaccgcttccttag

SEQ ID NO: 6462865 - DNA, 16 bp, Homo sapiens
tcgtacgcccaggaca

SEQ ID NO: 6462866 - DNA, 13 bp, Homo sapiens
tcgtactcaggag

SEQ ID NO: 6462867 - DNA, 14 bp, Homo sapiens
tcgtactctctctc

SEQ ID NO: 6462868 - DNA, 13 bp, Homo sapiens
tcgtactttcaca

SEQ ID NO: 6462869 - DNA, 12 bp, Homo sapiens
tcgtagacacag

SEQ ID NO: 6462870 - DNA, 21 bp, Homo sapiens
tcgtagcaaattctgtggcag

SEQ ID NO: 6462871 - DNA, 17 bp, Homo sapiens
tcgtagcccctgctaag

SEQ ID NO: 6462872 - DNA, 22 bp, Homo sapiens
tcgtagctttcccaaataaact

SEQ ID NO: 6462873 - DNA, 15 bp, Homo sapiens
tcgtaggcagccacg

SEQ ID NO: 6462874 - DNA, 19 bp, Homo sapiens
tcgtagtgtgtttaaataa

SEQ ID NO: 6462875 - DNA, 21 bp, Homo sapiens
tcgtataacacaatatgaata

SEQ ID NO: 6462876 - DNA, 16 bp, Homo sapiens
tcgtatagaaaaagca

SEQ ID NO: 6462877 - DNA, 22 bp, Homo sapiens
tcgtatagaaaaagcacagctc

SEQ ID NO: 6462878 - DNA, 23 bp, Homo sapiens
tcgtatagaaaaagcacagctct

SEQ ID NO: 6462879 - DNA, 17 bp, Homo sapiens
tcgtatagctgtattga

SEQ ID NO: 6462880 - DNA, 14 bp, Homo sapiens
tcgtatatttctca

SEQ ID NO: 6462881 - DNA, 12 bp, Homo sapiens
tcgtatgaaaat

SEQ ID NO: 6462882 - DNA, 21 bp, Homo sapiens
tcgtatgatacttcgacactg

SEQ ID NO: 6462883 - DNA, 22 bp, Homo sapiens
tcgtatgatacttcgacactgt

SEQ ID NO: 6462884 - DNA, 15 bp, Homo sapiens
tcgtattcaccttca

SEQ ID NO: 6462885 - DNA, 17 bp, Homo sapiens
tcgtcaactttcctcaa

SEQ ID NO: 6462886 - DNA, 18 bp, Homo sapiens
tcgtcaatccatcagcaa

SEQ ID NO: 6462887 - DNA, 18 bp, Homo sapiens
tcgtcaccccagccctcg

SEQ ID NO: 6462888 - DNA, 19 bp, Homo sapiens
tcgtcacgagcacaatggt

SEQ ID NO: 6462889 - DNA, 24 bp, Homo sapiens
tcgtcactcaaatgaatttgctaa

SEQ ID NO: 6462890 - DNA, 23 bp, Homo sapiens
tcgtcactgcttaacttcacata

SEQ ID NO: 6462891 - DNA, 16 bp, Homo sapiens
tcgtcagcctccctga

SEQ ID NO: 6462892 - DNA, 15 bp, Homo sapiens
tcgtcagtgttcatg

SEQ ID NO: 6462893 - DNA, 23 bp, Homo sapiens
tcgtcatcatttttccttccctt

SEQ ID NO: 6462894 - DNA, 16 bp, Homo sapiens
tcgtcatcttccctgc

SEQ ID NO: 6462895 - DNA, 18 bp, Homo sapiens
tcgtccaagggacagccc

SEQ ID NO: 6462896 - DNA, 20 bp, Homo sapiens
tcgtccaagggacagcccac

SEQ ID NO: 6462897 - DNA, 16 bp, Homo sapiens
tcgtccacagcttcct

SEQ ID NO: 6462898 - DNA, 18 bp, Homo sapiens
tcgtccaccccccacaca

SEQ ID NO: 6462899 - DNA, 20 bp, Homo sapiens
tcgtcccaggctgccggctc

SEQ ID NO: 6462900 - DNA, 12 bp, Homo sapiens
tcgtccccagac

SEQ ID NO: 6462901 - DNA, 15 bp, Homo sapiens
tcgtccccagaccag

SEQ ID NO: 6462902 - DNA, 12 bp, Homo sapiens
tcgtccccctcc

SEQ ID NO: 6462903 - DNA, 13 bp, Homo sapiens
tcgtccccctccc

SEQ ID NO: 6462904 - DNA, 19 bp, Homo sapiens
tcgtccccctccctgccca

SEQ ID NO: 6462905 - DNA, 20 bp, Homo sapiens
tcgtccccctccctgcccaa

SEQ ID NO: 6462906 - DNA, 23 bp, Homo sapiens
tcgtcccgtccctccctttcctc

SEQ ID NO: 6462907 - DNA, 17 bp, Homo sapiens
tcgtccctctgctccgt

SEQ ID NO: 6462908 - DNA, 17 bp, Homo sapiens
tcgtccggcctgcagcc

SEQ ID NO: 6462909 - DNA, 14 bp, Homo sapiens
tcgtccgtctgtct

SEQ ID NO: 6462910 - DNA, 13 bp, Homo sapiens
tcgtcctccccct

SEQ ID NO: 6462911 - DNA, 19 bp, Homo sapiens
tgatttacatgtatggtta

SEQ ID NO: 6462912 - DNA, 17 bp, Homo sapiens
tgatttactaacagtaa

SEQ ID NO: 6462913 - DNA, 18 bp, Homo sapiens
tgatttagaagcaaagat

SEQ ID NO: 6462914 - DNA, 23 bp, Homo sapiens
tgatttagaagcaaagatttcag

SEQ ID NO: 6462915 - DNA, 20 bp, Homo sapiens
tgatttagattgagtaagat

SEQ ID NO: 6462916 - DNA, 15 bp, Homo sapiens
tgatttagcaagcaa

SEQ ID NO: 6462917 - DNA, 22 bp, Homo sapiens
tgatttagcaagcaactaattt

SEQ ID NO: 6462918 - DNA, 20 bp, Homo sapiens
tgatttagcaagttctagaa

SEQ ID NO: 6462919 - DNA, 19 bp, Homo sapiens
tgatttagcattcatattt

SEQ ID NO: 6462920 - DNA, 12 bp, Homo sapiens
tgatttagccat

SEQ ID NO: 6462921 - DNA, 20 bp, Homo sapiens
tgatttaggagaagccagga

SEQ ID NO: 6462922 - DNA, 21 bp, Homo sapiens
tgatttaggagaagccaggaa

SEQ ID NO: 6462923 - DNA, 13 bp, Homo sapiens
tgatttaggcact

SEQ ID NO: 6462924 - DNA, 19 bp, Homo sapiens
tgatttagggaagcaggga

SEQ ID NO: 6462925 - DNA, 19 bp, Homo sapiens
tgatttaggtcagtagact

SEQ ID NO: 6462926 - DNA, 22 bp, Homo sapiens
tgatttagtgtttttacctctg

SEQ ID NO: 6462927 - DNA, 22 bp, Homo sapiens
tgatttataaagatttttgtta

SEQ ID NO: 6462928 - DNA, 15 bp, Homo sapiens
tgatttatactgtga

SEQ ID NO: 6462929 - DNA, 22 bp, Homo sapiens
tgatttatagtttgtacatgca

SEQ ID NO: 6462930 - DNA, 23 bp, Homo sapiens
tgatttatatatggcatatttat

SEQ ID NO: 6462931 - DNA, 17 bp, Homo sapiens
tgatttatatgtgtaat

SEQ ID NO: 6462932 - DNA, 19 bp, Homo sapiens
tgatttatatgtgtaattt

SEQ ID NO: 6462933 - DNA, 15 bp, Homo sapiens
tgatttatatttcat

SEQ ID NO: 6462934 - DNA, 13 bp, Homo sapiens
tgatttatgcatg

SEQ ID NO: 6462935 - DNA, 22 bp, Homo sapiens
tgatttatgcatggaaacctga

SEQ ID NO: 6462936 - DNA, 13 bp, Homo sapiens
tgatttatggttt

SEQ ID NO: 6462937 - DNA, 12 bp, Homo sapiens
tgatttattctg

SEQ ID NO: 6462938 - DNA, 15 bp, Homo sapiens
tgatttattgaaatt

SEQ ID NO: 6462939 - DNA, 13 bp, Homo sapiens
tgatttatttgtc

SEQ ID NO: 6462940 - DNA, 19 bp, Homo sapiens
tgatttatttgtttaaaaa

SEQ ID NO: 6462941 - DNA, 11 bp, Homo sapiens
tgatttcaaat

SEQ ID NO: 6462942 - DNA, 14 bp, Homo sapiens
tgatttcaaatgca

SEQ ID NO: 6462943 - DNA, 15 bp, Homo sapiens
tgatttcaaatgcag

SEQ ID NO: 6462944 - DNA, 23 bp, Homo sapiens
tgatttcaaatgcagtccagtga

SEQ ID NO: 6462945 - DNA, 11 bp, Homo sapiens
tgatttcaagg

SEQ ID NO: 6462946 - DNA, 15 bp, Homo sapiens
tgatttcacaaatat

SEQ ID NO: 6462947 - DNA, 16 bp, Homo sapiens
tgatttcacaacagat

SEQ ID NO: 6462948 - DNA, 14 bp, Homo sapiens
tgatttcacagtgt

SEQ ID NO: 6462949 - DNA, 12 bp, Homo sapiens
tgatttcacata

SEQ ID NO: 6462950 - DNA, 17 bp, Homo sapiens
tgatttcacatttctac

SEQ ID NO: 6462951 - DNA, 18 bp, Homo sapiens
tgatttcaggatactctg

SEQ ID NO: 6462952 - DNA, 19 bp, Homo sapiens
tgatttcaggatactctgt

SEQ ID NO: 6462953 - DNA, 23 bp, Homo sapiens
tgatttcaggatactctgtcaga

SEQ ID NO: 6462954 - DNA, 14 bp, Homo sapiens
tgatttcagggaaa

SEQ ID NO: 6462955 - DNA, 16 bp, Homo sapiens
tgatttcagtaagtct

SEQ ID NO: 6462956 - DNA, 21 bp, Homo sapiens
tgatttcagtcatagcaagct

SEQ ID NO: 6462957 - DNA, 13 bp, Homo sapiens
tgatttcagttca

SEQ ID NO: 6462958 - DNA, 14 bp, Homo sapiens
tgatttcagttcat

SEQ ID NO: 6462959 - DNA, 14 bp, Homo sapiens
tgatttcagttttt

SEQ ID NO: 6462960 - DNA, 19 bp, Homo sapiens
tgatttcagtttttcattt

SEQ ID NO: 6462961 - DNA, 15 bp, Homo sapiens
tgatttcataattca

SEQ ID NO: 6462962 - DNA, 20 bp, Homo sapiens
tgatttcataattcagaact

SEQ ID NO: 6462963 - DNA, 14 bp, Homo sapiens
tgatttcatattga

SEQ ID NO: 6462964 - DNA, 19 bp, Homo sapiens
tgatttcattacatttctg

SEQ ID NO: 6462965 - DNA, 22 bp, Homo sapiens
tgatttcattacatttctgaat

SEQ ID NO: 6462966 - DNA, 14 bp, Homo sapiens
tgatttcattacca

SEQ ID NO: 6462967 - DNA, 13 bp, Homo sapiens
tgatttcatttca

SEQ ID NO: 6462968 - DNA, 17 bp, Homo sapiens
tgatttcatttcaactg

SEQ ID NO: 6462969 - DNA, 18 bp, Homo sapiens
tgatttccaaagagaaaa

SEQ ID NO: 6462970 - DNA, 13 bp, Homo sapiens
tgatttccaggcc

SEQ ID NO: 6462971 - DNA, 14 bp, Homo sapiens
tgatttccaggccc

SEQ ID NO: 6462972 - DNA, 14 bp, Homo sapiens
tgatttccatctct

SEQ ID NO: 6462973 - DNA, 16 bp, Homo sapiens
tgatttccatctctgg

SEQ ID NO: 6462974 - DNA, 17 bp, Homo sapiens
tgatttccatctctggt

SEQ ID NO: 6462975 - DNA, 22 bp, Homo sapiens
tgatttcccaaaaacactaaag

SEQ ID NO: 6462976 - DNA, 16 bp, Homo sapiens
tgatttcccccctccg

SEQ ID NO: 6462977 - DNA, 23 bp, Homo sapiens
tgatttccccttttgcattctcc

SEQ ID NO: 6462978 - DNA, 18 bp, Homo sapiens
tgatttcccgtggcccca

SEQ ID NO: 6462979 - DNA, 21 bp, Homo sapiens
tgatttcccgtggccccagcc

SEQ ID NO: 6462980 - DNA, 21 bp, Homo sapiens
tgatttccctaaggagcctgg

SEQ ID NO: 6462981 - DNA, 19 bp, Homo sapiens
tgatttccctccagagaaa

SEQ ID NO: 6462982 - DNA, 20 bp, Homo sapiens
tgatttccctccagagaaag

SEQ ID NO: 6462983 - DNA, 23 bp, Homo sapiens
tgatttcccttttttcttccccc

SEQ ID NO: 6462984 - DNA, 22 bp, Homo sapiens
tgatttccgtgaactctggtgc

SEQ ID NO: 6462985 - DNA, 18 bp, Homo sapiens
tgatttcctaaacataat

SEQ ID NO: 6462986 - DNA, 20 bp, Homo sapiens
tgatttcctaaacataattg

SEQ ID NO: 6462987 - DNA, 15 bp, Homo sapiens
tgatttcctccctct

SEQ ID NO: 6462988 - DNA, 15 bp, Homo sapiens
tgatttcctctgaat

SEQ ID NO: 6462989 - DNA, 15 bp, Homo sapiens
tgatttcctgtgtca

SEQ ID NO: 6462990 - DNA, 17 bp, Homo sapiens
tgatttccttaatgaaa

SEQ ID NO: 6462991 - DNA, 17 bp, Homo sapiens
tgatttccttgaatgtg

SEQ ID NO: 6462992 - DNA, 19 bp, Homo sapiens
tgatttcgatgtacagtct

SEQ ID NO: 6462993 - DNA, 23 bp, Homo sapiens
tgatttcggaccgaaggtgacag

SEQ ID NO: 6462994 - DNA, 11 bp, Homo sapiens
tgatttctaat

SEQ ID NO: 6462995 - DNA, 16 bp, Homo sapiens
tgatttctaatgatat

SEQ ID NO: 6462996 - DNA, 14 bp, Homo sapiens
tgatttctaattgt

SEQ ID NO: 6462997 - DNA, 16 bp, Homo sapiens
tgatttctacaactga

SEQ ID NO: 6462998 - DNA, 13 bp, Homo sapiens
tgatttctagaat

SEQ ID NO: 6462999 - DNA, 11 bp, Homo sapiens
tgatttctagg

SEQ ID NO: 6463000 - DNA, 15 bp, Homo sapiens
tgatttctatgctga

SEQ ID NO: 6463001 - DNA, 22 bp, Homo sapiens
tgatttctatggctttcaaagc

SEQ ID NO: 6463002 - DNA, 14 bp, Homo sapiens
tgatttctattcaa

SEQ ID NO: 6463003 - DNA, 20 bp, Homo sapiens
tgatttctattcaaggtggc

SEQ ID NO: 6463004 - DNA, 20 bp, Homo sapiens
tgatttctcagtgatttcct

SEQ ID NO: 6463005 - DNA, 18 bp, Homo sapiens
tgatttctccagaaattt

SEQ ID NO: 6463006 - DNA, 15 bp, Homo sapiens
tgatttctctgaaca

SEQ ID NO: 6463007 - DNA, 16 bp, Homo sapiens
tgatttctgaactatc

SEQ ID NO: 6463008 - DNA, 11 bp, Homo sapiens
tgatttctgag

SEQ ID NO: 6463009 - DNA, 17 bp, Homo sapiens
tgatttctgagatttta

SEQ ID NO: 6463010 - DNA, 22 bp, Homo sapiens
tgatttctgcccttgttccagc

SEQ ID NO: 6463011 - DNA, 19 bp, Homo sapiens
tgatttctggctgggtcac

SEQ ID NO: 6463012 - DNA, 15 bp, Homo sapiens
tgatttctgtgccat

SEQ ID NO: 6463013 - DNA, 16 bp, Homo sapiens
tgatttcttcagaatt

SEQ ID NO: 6463014 - DNA, 21 bp, Homo sapiens
tgatttcttcagaattagatg

SEQ ID NO: 6463015 - DNA, 12 bp, Homo sapiens
tgatttcttcta

SEQ ID NO: 6463016 - DNA, 16 bp, Homo sapiens
tgatttcttctcatta

SEQ ID NO: 6463017 - DNA, 17 bp, Homo sapiens
tgatttcttgtaacatc

SEQ ID NO: 6463018 - DNA, 20 bp, Homo sapiens
tgatttctttaaaagaatga

SEQ ID NO: 6463019 - DNA, 12 bp, Homo sapiens
tgatttctttcc

SEQ ID NO: 6463020 - DNA, 16 bp, Homo sapiens
tgatttctttccagag

SEQ ID NO: 6463021 - DNA, 23 bp, Homo sapiens
tgatttcttttcaccattcgtac

SEQ ID NO: 6463022 - DNA, 18 bp, Homo sapiens
tgatttgaaaaaaagcat

SEQ ID NO: 6463023 - DNA, 16 bp, Homo sapiens
tgatttgaaaaatata

SEQ ID NO: 6463024 - DNA, 14 bp, Homo sapiens
tgatttgaagtgga

SEQ ID NO: 6463025 - DNA, 23 bp, Homo sapiens
tgatttgacatagtctggctgta

SEQ ID NO: 6463026 - DNA, 15 bp, Homo sapiens
tgatttgacccactc

SEQ ID NO: 6463027 - DNA, 14 bp, Homo sapiens
tgatttgactgttt

SEQ ID NO: 6463028 - DNA, 18 bp, Homo sapiens
tgatttgactgtttttac

SEQ ID NO: 6463029 - DNA, 22 bp, Homo sapiens
tgatttgagtttcctttaaata

SEQ ID NO: 6463030 - DNA, 14 bp, Homo sapiens
tgatttgatataca

SEQ ID NO: 6463031 - DNA, 15 bp, Homo sapiens
tgatttgcaggattt

SEQ ID NO: 6463032 - DNA, 21 bp, Homo sapiens
tgatttgcatggattttggat

SEQ ID NO: 6463033 - DNA, 13 bp, Homo sapiens
tgatttgcattga

SEQ ID NO: 6463034 - DNA, 15 bp, Homo sapiens
tgatttgcattgaac

SEQ ID NO: 6463035 - DNA, 18 bp, Homo sapiens
tgatttgcattgaacaca

SEQ ID NO: 6463036 - DNA, 12 bp, Homo sapiens
tgatttgcattt

SEQ ID NO: 6463037 - DNA, 13 bp, Homo sapiens
tgatttgcatttt

SEQ ID NO: 6463038 - DNA, 17 bp, Homo sapiens
tgatttgctgctcttca

SEQ ID NO: 6463039 - DNA, 16 bp, Homo sapiens
tgatttgctgttttct

SEQ ID NO: 6463040 - DNA, 13 bp, Homo sapiens
tgatttggccagg

SEQ ID NO: 6463041 - DNA, 22 bp, Homo sapiens
tgatttgggaagttaggcaaat

SEQ ID NO: 6463042 - DNA, 18 bp, Homo sapiens
tgatttgggctctagaat

SEQ ID NO: 6463043 - DNA, 22 bp, Homo sapiens
tgatttgggggaggctttggga

SEQ ID NO: 6463044 - DNA, 18 bp, Homo sapiens
tgatttgggttggggaag

SEQ ID NO: 6463045 - DNA, 17 bp, Homo sapiens
tgatttggtcaccttcc

SEQ ID NO: 6463046 - DNA, 20 bp, Homo sapiens
tgatttggtgaccaactgtc

SEQ ID NO: 6463047 - DNA, 19 bp, Homo sapiens
tgatttgtaaaacagtggt

SEQ ID NO: 6463048 - DNA, 22 bp, Homo sapiens
tgatttgtaaaggactatttat

SEQ ID NO: 6463049 - DNA, 18 bp, Homo sapiens
tgatttgtagtggaaaca

SEQ ID NO: 6463050 - DNA, 15 bp, Homo sapiens
tgatttgtcactgct

SEQ ID NO: 6463051 - DNA, 20 bp, Homo sapiens
tgatttgtcagagaacctgt

SEQ ID NO: 6463052 - DNA, 18 bp, Homo sapiens
tgatttgtcccagaattt

SEQ ID NO: 6463053 - DNA, 13 bp, Homo sapiens
tgatttgtcttcc

SEQ ID NO: 6463054 - DNA, 22 bp, Homo sapiens
tgatttgtcttcccttctttgc

SEQ ID NO: 6463055 - DNA, 23 bp, Homo sapiens
tgatttgtcttcccttctttgca

SEQ ID NO: 6463056 - DNA, 22 bp, Homo sapiens
tgatttgtgaaataaaacagga

SEQ ID NO: 6463057 - DNA, 20 bp, Homo sapiens
tgatttgttgggaccttctg

SEQ ID NO: 6463058 - DNA, 20 bp, Homo sapiens
tgatttgttttgaattttgt

SEQ ID NO: 6463059 - DNA, 19 bp, Homo sapiens
tgattttaaaacttttctg

SEQ ID NO: 6463060 - DNA, 15 bp, Homo sapiens
tgattttaaaatgaa

SEQ ID NO: 6463061 - DNA, 20 bp, Homo sapiens
tgattttaaaatgtacatgt

SEQ ID NO: 6463062 - DNA, 22 bp, Homo sapiens
tgattttaaatgcaaattaaag

SEQ ID NO: 6463063 - DNA, 15 bp, Homo sapiens
tgattttaaatgtgt

SEQ ID NO: 6463064 - DNA, 12 bp, Homo sapiens
tgattttaacaa

SEQ ID NO: 6463065 - DNA, 14 bp, Homo sapiens
tgattttaacaata

SEQ ID NO: 6463066 - DNA, 19 bp, Homo sapiens
tgattttaacaataactac

SEQ ID NO: 6463067 - DNA, 22 bp, Homo sapiens
tgattttaacaataactactgt

SEQ ID NO: 6463068 - DNA, 17 bp, Homo sapiens
tgattttaactctgtct

SEQ ID NO: 6463069 - DNA, 19 bp, Homo sapiens
tgattttaagaatccaaac

SEQ ID NO: 6463070 - DNA, 21 bp, Homo sapiens
tgattttaagatagaacaggc

SEQ ID NO: 6463071 - DNA, 16 bp, Homo sapiens
tgattttaataatata

SEQ ID NO: 6463072 - DNA, 14 bp, Homo sapiens
tgattttaatgaaa

SEQ ID NO: 6463073 - DNA, 13 bp, Homo sapiens
tgattttaattac

SEQ ID NO: 6463074 - DNA, 14 bp, Homo sapiens
tgattttaattcag

SEQ ID NO: 6463075 - DNA, 14 bp, Homo sapiens
tgattttaatttta

SEQ ID NO: 6463076 - DNA, 19 bp, Homo sapiens
tgattttacaattgaaatg

SEQ ID NO: 6463077 - DNA, 20 bp, Homo sapiens
tgattttacagagaatctga

SEQ ID NO: 6463078 - DNA, 22 bp, Homo sapiens
tgattttacagagaatctgaag

SEQ ID NO: 6463079 - DNA, 19 bp, Homo sapiens
tgattttagccttctctgt

SEQ ID NO: 6463080 - DNA, 17 bp, Homo sapiens
tgattttatgtttaaaa

SEQ ID NO: 6463081 - DNA, 16 bp, Homo sapiens
tgattttattacagaa

SEQ ID NO: 6463082 - DNA, 21 bp, Homo sapiens
tgattttattacagaaatgtt

SEQ ID NO: 6463083 - DNA, 22 bp, Homo sapiens
tgattttattacagaaatgttt

SEQ ID NO: 6463084 - DNA, 13 bp, Homo sapiens
tgattttattctt

SEQ ID NO: 6463085 - DNA, 17 bp, Homo sapiens
tgattttatttttgcaa

SEQ ID NO: 6463086 - DNA, 18 bp, Homo sapiens
tgattttatttttgcaaa

SEQ ID NO: 6463087 - DNA, 12 bp, Homo sapiens
tgattttcaaaa

SEQ ID NO: 6463088 - DNA, 17 bp, Homo sapiens
tgattttcaagcagcat

SEQ ID NO: 6463089 - DNA, 23 bp, Homo sapiens
tgattttcacagctttgaggaac

SEQ ID NO: 6463090 - DNA, 23 bp, Homo sapiens
tcgtcctgcccccgacagcccag

SEQ ID NO: 6463091 - DNA, 22 bp, Homo sapiens
tcgtcctgtagcacgctgcctg

SEQ ID NO: 6463092 - DNA, 16 bp, Homo sapiens
tcgtccttactcctgt

SEQ ID NO: 6463093 - DNA, 13 bp, Homo sapiens
tcgtccttttggt

SEQ ID NO: 6463094 - DNA, 18 bp, Homo sapiens
tcgtcgagctccccccag

SEQ ID NO: 6463095 - DNA, 18 bp, Homo sapiens
tcgtctcatcctcctttc

SEQ ID NO: 6463096 - DNA, 19 bp, Homo sapiens
tcgtctccaattcgaaaac

SEQ ID NO: 6463097 - DNA, 14 bp, Homo sapiens
tcgtctgactctgg

SEQ ID NO: 6463098 - DNA, 15 bp, Homo sapiens
tcgtctgactgtgtg

SEQ ID NO: 6463099 - DNA, 16 bp, Homo sapiens
tcgtctgactgtgtgt

SEQ ID NO: 6463100 - DNA, 11 bp, Homo sapiens
tcgtctgatgt

SEQ ID NO: 6463101 - DNA, 15 bp, Homo sapiens
tcgtctgtgaatgct

SEQ ID NO: 6463102 - DNA, 18 bp, Homo sapiens
tcgtctgtttataaacat

SEQ ID NO: 6463103 - DNA, 15 bp, Homo sapiens
tcgtcttcaaattaa

SEQ ID NO: 6463104 - DNA, 14 bp, Homo sapiens
tcgtcttcactctt

SEQ ID NO: 6463105 - DNA, 19 bp, Homo sapiens
tcgtcttccgtctcccccg

SEQ ID NO: 6463106 - DNA, 22 bp, Homo sapiens
tcgtcttccgtctcccccgtgt

SEQ ID NO: 6463107 - DNA, 15 bp, Homo sapiens
tcgtcttcttggcca

SEQ ID NO: 6463108 - DNA, 17 bp, Homo sapiens
tcgtcttgaacgagcag

SEQ ID NO: 6463109 - DNA, 18 bp, Homo sapiens
tcgtcttgaacgagcagc

SEQ ID NO: 6463110 - DNA, 19 bp, Homo sapiens
tcgtcttgtgtttgctgca

SEQ ID NO: 6463111 - DNA, 19 bp, Homo sapiens
tcgtctttgcttgtcctgc

SEQ ID NO: 6463112 - DNA, 15 bp, Homo sapiens
tcgtctttgtgtatg

SEQ ID NO: 6463113 - DNA, 12 bp, Homo sapiens
tcgtgaaatcct

SEQ ID NO: 6463114 - DNA, 16 bp, Homo sapiens
tcgtgaactgcagtga

SEQ ID NO: 6463115 - DNA, 18 bp, Homo sapiens
tcgtgaactgcagtgatg

SEQ ID NO: 6463116 - DNA, 19 bp, Homo sapiens
tcgtgaagagggaagccag

SEQ ID NO: 6463117 - DNA, 16 bp, Homo sapiens
tcgtgacagcctctga

SEQ ID NO: 6463118 - DNA, 18 bp, Homo sapiens
tcgtgacagcctctgact

SEQ ID NO: 6463119 - DNA, 23 bp, Homo sapiens
tcgtgacagcctctgactcacca

SEQ ID NO: 6463120 - DNA, 21 bp, Homo sapiens
tcgtgacctgctaggccagag

SEQ ID NO: 6463121 - DNA, 20 bp, Homo sapiens
tcgtgacgctgaataaatgt

SEQ ID NO: 6463122 - DNA, 21 bp, Homo sapiens
tcgtgacgctgaataaatgtc

SEQ ID NO: 6463123 - DNA, 15 bp, Homo sapiens
tcgtgagctcttgtg

SEQ ID NO: 6463124 - DNA, 15 bp, Homo sapiens
tcgtgagctggggac

SEQ ID NO: 6463125 - DNA, 21 bp, Homo sapiens
tcgtgatagttattattttcc

SEQ ID NO: 6463126 - DNA, 23 bp, Homo sapiens
tcgtgatatgctgcttgtgacct

SEQ ID NO: 6463127 - DNA, 19 bp, Homo sapiens
tcgtgatctgcccacctcg

SEQ ID NO: 6463128 - DNA, 23 bp, Homo sapiens
tcgtgatctgcccgcctcggcct

SEQ ID NO: 6463129 - DNA, 13 bp, Homo sapiens
tcgtgatggggca

SEQ ID NO: 6463130 - DNA, 12 bp, Homo sapiens
tcgtgatgtgga

SEQ ID NO: 6463131 - DNA, 23 bp, Homo sapiens
tcgtgatgtggaggaagagccac

SEQ ID NO: 6463132 - DNA, 15 bp, Homo sapiens
tcgtgcactctgcta

SEQ ID NO: 6463133 - DNA, 20 bp, Homo sapiens
tcgtgcactctgctaatcat

SEQ ID NO: 6463134 - DNA, 13 bp, Homo sapiens
tcgtgcatgtaat

SEQ ID NO: 6463135 - DNA, 22 bp, Homo sapiens
tcgtgcattggaagaccccacc

SEQ ID NO: 6463136 - DNA, 21 bp, Homo sapiens
tcgtgcatttgaggggccagg

SEQ ID NO: 6463137 - DNA, 13 bp, Homo sapiens
tcgtgccagcagc

SEQ ID NO: 6463138 - DNA, 17 bp, Homo sapiens
tcgtgccagcagcctcg

SEQ ID NO: 6463139 - DNA, 20 bp, Homo sapiens
tcgtgccagtcgcgctgcct

SEQ ID NO: 6463140 - DNA, 22 bp, Homo sapiens
tcgtgccagtcgcgctgcctgt

SEQ ID NO: 6463141 - DNA, 20 bp, Homo sapiens
tcgtgccgtggagcttggag

SEQ ID NO: 6463142 - DNA, 21 bp, Homo sapiens
tcgtgccgtggagcttggagc

SEQ ID NO: 6463143 - DNA, 22 bp, Homo sapiens
tcgtgccgtggagcttggagcc

SEQ ID NO: 6463144 - DNA, 23 bp, Homo sapiens
tcgtgcctccttccacctccctc

SEQ ID NO: 6463145 - DNA, 16 bp, Homo sapiens
tcgtgcctgagaccag

SEQ ID NO: 6463146 - DNA, 23 bp, Homo sapiens
tcgtgcctgagaccagggtggcc

SEQ ID NO: 6463147 - DNA, 17 bp, Homo sapiens
tcgtgcgtgggcttctt

SEQ ID NO: 6463148 - DNA, 18 bp, Homo sapiens
tcgtgctaaattttcagt

SEQ ID NO: 6463149 - DNA, 16 bp, Homo sapiens
tcgtgctactgcactc

SEQ ID NO: 6463150 - DNA, 22 bp, Homo sapiens
tcgtgctactgcactccagcct

SEQ ID NO: 6463151 - DNA, 24 bp, Homo sapiens
tcgtggaaagggtgctgcttccct

SEQ ID NO: 6463152 - DNA, 21 bp, Homo sapiens
tcgtggaacagttacctctgc

SEQ ID NO: 6463153 - DNA, 22 bp, Homo sapiens
tcgtggaagaagggccaccctg

SEQ ID NO: 6463154 - DNA, 15 bp, Homo sapiens
tcgtggacacctgcc

SEQ ID NO: 6463155 - DNA, 18 bp, Homo sapiens
tcgtggacacctgccctg

SEQ ID NO: 6463156 - DNA, 20 bp, Homo sapiens
tcgtggacacctgccctgcc

SEQ ID NO: 6463157 - DNA, 22 bp, Homo sapiens
tcgtggactgagtgggaagccc

SEQ ID NO: 6463158 - DNA, 17 bp, Homo sapiens
tcgtggactgtgctggt

SEQ ID NO: 6463159 - DNA, 21 bp, Homo sapiens
tcgtggagacagggcatttga

SEQ ID NO: 6463160 - DNA, 13 bp, Homo sapiens
tcgtggagccatt

SEQ ID NO: 6463161 - DNA, 20 bp, Homo sapiens
tcgtggcagataatcagcct

SEQ ID NO: 6463162 - DNA, 22 bp, Homo sapiens
tcgtggcagataatcagcctct

SEQ ID NO: 6463163 - DNA, 21 bp, Homo sapiens
tcgtggccaacgtggacctgc

SEQ ID NO: 6463164 - DNA, 14 bp, Homo sapiens
tcgtggccagcccg

SEQ ID NO: 6463165 - DNA, 19 bp, Homo sapiens
tcgtgggaaaggggagtag

SEQ ID NO: 6463166 - DNA, 22 bp, Homo sapiens
tcgtgggacagtcacctcatgg

SEQ ID NO: 6463167 - DNA, 13 bp, Homo sapiens
tcgtggtatgtat

SEQ ID NO: 6463168 - DNA, 17 bp, Homo sapiens
tcgtgtaattggcccaa

SEQ ID NO: 6463169 - DNA, 23 bp, Homo sapiens
tcgtgtacagctcccttccctgc

SEQ ID NO: 6463170 - DNA, 20 bp, Homo sapiens
tcgtgtagtggaagagcagc

SEQ ID NO: 6463171 - DNA, 14 bp, Homo sapiens
tcgtgtatcctggg

SEQ ID NO: 6463172 - DNA, 15 bp, Homo sapiens
tcgtgtatcctgggg

SEQ ID NO: 6463173 - DNA, 14 bp, Homo sapiens
tcgtgtattccata

SEQ ID NO: 6463174 - DNA, 14 bp, Homo sapiens
tcgtgtatttatta

SEQ ID NO: 6463175 - DNA, 14 bp, Homo sapiens
tcgtgtcagctcag

SEQ ID NO: 6463176 - DNA, 15 bp, Homo sapiens
tcgtgtctgctgttg

SEQ ID NO: 6463177 - DNA, 21 bp, Homo sapiens
tcgtgtctggcgttgtgggga

SEQ ID NO: 6463178 - DNA, 23 bp, Homo sapiens
tcgtgtgcatgagaatgtcattt

SEQ ID NO: 6463179 - DNA, 14 bp, Homo sapiens
tcgtgtgcccacca

SEQ ID NO: 6463180 - DNA, 16 bp, Homo sapiens
tcgtgtgcttagaaac

SEQ ID NO: 6463181 - DNA, 13 bp, Homo sapiens
tcgtgtggatctt

SEQ ID NO: 6463182 - DNA, 17 bp, Homo sapiens
tcgtgtggatcttgcca

SEQ ID NO: 6463183 - DNA, 14 bp, Homo sapiens
tcgtgtggctcctg

SEQ ID NO: 6463184 - DNA, 15 bp, Homo sapiens
tcgtgtgtagaaaaa

SEQ ID NO: 6463185 - DNA, 21 bp, Homo sapiens
tcgtgtgtgttatttccccag

SEQ ID NO: 6463186 - DNA, 21 bp, Homo sapiens
tcgtgtgtttctattttttga

SEQ ID NO: 6463187 - DNA, 14 bp, Homo sapiens
tcgtgttcgctggc

SEQ ID NO: 6463188 - DNA, 21 bp, Homo sapiens
tcgtgttggaaaatgtgtctc

SEQ ID NO: 6463189 - DNA, 22 bp, Homo sapiens
tcgtgttggtattttcagagaa

SEQ ID NO: 6463190 - DNA, 15 bp, Homo sapiens
tcgtgtttcacagtg

SEQ ID NO: 6463191 - DNA, 17 bp, Homo sapiens
tcgtgtttcacagtggg

SEQ ID NO: 6463192 - DNA, 23 bp, Homo sapiens
tcgtgtttgcttaaaatatgtga

SEQ ID NO: 6463193 - DNA, 22 bp, Homo sapiens
tcgtgttttcaaggaagaaaac

SEQ ID NO: 6463194 - DNA, 23 bp, Homo sapiens
tcgtgttttcaaggaagaaaacg

SEQ ID NO: 6463195 - DNA, 17 bp, Homo sapiens
tcgttaaaaagttgttt

SEQ ID NO: 6463196 - DNA, 17 bp, Homo sapiens
tcgttaacattgaccaa

SEQ ID NO: 6463197 - DNA, 14 bp, Homo sapiens
tcgttaactgtgta

SEQ ID NO: 6463198 - DNA, 21 bp, Homo sapiens
tcgttaatagattatttcata

SEQ ID NO: 6463199 - DNA, 18 bp, Homo sapiens
tcgttacctgccgcccat

SEQ ID NO: 6463200 - DNA, 19 bp, Homo sapiens
tcgttagtatctaacatgt

SEQ ID NO: 6463201 - DNA, 19 bp, Homo sapiens
tcgttatagagagcaattt

SEQ ID NO: 6463202 - DNA, 22 bp, Homo sapiens
tcgttatctactgactatattt

SEQ ID NO: 6463203 - DNA, 13 bp, Homo sapiens
tcgttattataaa

SEQ ID NO: 6463204 - DNA, 18 bp, Homo sapiens
tcgttcaaaacattccaa

SEQ ID NO: 6463205 - DNA, 20 bp, Homo sapiens
tcgttcccatagatttgaag

SEQ ID NO: 6463206 - DNA, 15 bp, Homo sapiens
tcgttccccacccct

SEQ ID NO: 6463207 - DNA, 14 bp, Homo sapiens
tcgttcccccaggg

SEQ ID NO: 6463208 - DNA, 22 bp, Homo sapiens
tcgttcccccaggggtgagccc

SEQ ID NO: 6463209 - DNA, 12 bp, Homo sapiens
tcgttcctttct

SEQ ID NO: 6463210 - DNA, 22 bp, Homo sapiens
tcgttcgcagagcttttcagat

SEQ ID NO: 6463211 - DNA, 15 bp, Homo sapiens
tcgttctaaaatcaa

SEQ ID NO: 6463212 - DNA, 16 bp, Homo sapiens
tcgttctaaaatcaag

SEQ ID NO: 6463213 - DNA, 13 bp, Homo sapiens
tcgttctccctgg

SEQ ID NO: 6463214 - DNA, 23 bp, Homo sapiens
tcgttctgctgaccaaatggcca

SEQ ID NO: 6463215 - DNA, 17 bp, Homo sapiens
tcgttcttgttctgttt

SEQ ID NO: 6463216 - DNA, 15 bp, Homo sapiens
tcgttgacatgcaca

SEQ ID NO: 6463217 - DNA, 19 bp, Homo sapiens
tcgttgactgcttctctgc

SEQ ID NO: 6463218 - DNA, 17 bp, Homo sapiens
tcgttgactttagggac

SEQ ID NO: 6463219 - DNA, 19 bp, Homo sapiens
tcgttgccctaattcatct

SEQ ID NO: 6463220 - DNA, 21 bp, Homo sapiens
tcgttgccctaattcatcttt

SEQ ID NO: 6463221 - DNA, 21 bp, Homo sapiens
tcgttgctccagtataaatta

SEQ ID NO: 6463222 - DNA, 17 bp, Homo sapiens
tcgttggtagagccctc

SEQ ID NO: 6463223 - DNA, 20 bp, Homo sapiens
tcgttggtgaccagtttctt

SEQ ID NO: 6463224 - DNA, 22 bp, Homo sapiens
tcgttggttatacaagttcttg

SEQ ID NO: 6463225 - DNA, 16 bp, Homo sapiens
tcgttggttcatgtgt

SEQ ID NO: 6463226 - DNA, 19 bp, Homo sapiens
tcgttggttgtttctctga

SEQ ID NO: 6463227 - DNA, 17 bp, Homo sapiens
tcgttgtccaatttgta

SEQ ID NO: 6463228 - DNA, 17 bp, Homo sapiens
tcgttgttcccactgaa

SEQ ID NO: 6463229 - DNA, 13 bp, Homo sapiens
tcgtttaatgttt

SEQ ID NO: 6463230 - DNA, 17 bp, Homo sapiens
tcgtttacactgcacat

SEQ ID NO: 6463231 - DNA, 15 bp, Homo sapiens
tcgtttactatgcct

SEQ ID NO: 6463232 - DNA, 17 bp, Homo sapiens
tcgtttagaatcagaat

SEQ ID NO: 6463233 - DNA, 18 bp, Homo sapiens
tcgtttagaatcagaata

SEQ ID NO: 6463234 - DNA, 20 bp, Homo sapiens
tcgtttagtgccaatgttgt

SEQ ID NO: 6463235 - DNA, 23 bp, Homo sapiens
tcgtttatatttttttaactgtg

SEQ ID NO: 6463236 - DNA, 13 bp, Homo sapiens
tcgtttatgtgtg

SEQ ID NO: 6463237 - DNA, 12 bp, Homo sapiens
tcgtttcaaaaa

SEQ ID NO: 6463238 - DNA, 19 bp, Homo sapiens
tcgtttcaaaaacacagtg

SEQ ID NO: 6463239 - DNA, 21 bp, Homo sapiens
tcgtttcaaaaacacagtgtt

SEQ ID NO: 6463240 - DNA, 14 bp, Homo sapiens
tcgtttccatcatg

SEQ ID NO: 6463241 - DNA, 15 bp, Homo sapiens
tcgtttgcctccaga

SEQ ID NO: 6463242 - DNA, 16 bp, Homo sapiens
tcgtttgggctcaagg

SEQ ID NO: 6463243 - DNA, 13 bp, Homo sapiens
tcgtttggtctta

SEQ ID NO: 6463244 - DNA, 23 bp, Homo sapiens
tcgtttgtattctacctttgtaa

SEQ ID NO: 6463245 - DNA, 21 bp, Homo sapiens
tcgtttgtgaacgctgtgatg

SEQ ID NO: 6463246 - DNA, 14 bp, Homo sapiens
tcgtttgtgttctg

SEQ ID NO: 6463247 - DNA, 10 bp, Homo sapiens
tcgtttgttt

SEQ ID NO: 6463248 - DNA, 14 bp, Homo sapiens
tcgtttgtttgttt

SEQ ID NO: 6463249 - DNA, 12 bp, Homo sapiens
tcgttttagtgt

SEQ ID NO: 6463250 - DNA, 22 bp, Homo sapiens
tcgttttcaaaattgttacaaa

SEQ ID NO: 6463251 - DNA, 13 bp, Homo sapiens
tcgttttcaaaga

SEQ ID NO: 6463252 - DNA, 21 bp, Homo sapiens
tcgttttcttaaagtgccagt

SEQ ID NO: 6463253 - DNA, 15 bp, Homo sapiens
tcgttttctttgctg

SEQ ID NO: 6463254 - DNA, 19 bp, Homo sapiens
tcgttttctttgctgtgcc

SEQ ID NO: 6463255 - DNA, 23 bp, Homo sapiens
tcgttttgaagacgtggactcct

SEQ ID NO: 6463256 - DNA, 11 bp, Homo sapiens
tcgtttttgta

SEQ ID NO: 6463257 - DNA, 14 bp, Homo sapiens
tcgttttttacaaa

SEQ ID NO: 6463258 - DNA, 20 bp, Homo sapiens
tcgttttttttttgtttgtt

SEQ ID NO: 6463259 - DNA, 21 bp, Homo sapiens
tctaaaaaaaaaaataaatgt

SEQ ID NO: 6463260 - DNA, 15 bp, Homo sapiens
tctaaaaaaatgttt

SEQ ID NO: 6463261 - DNA, 14 bp, Homo sapiens
tctaaaaaataact

SEQ ID NO: 6463262 - DNA, 16 bp, Homo sapiens
tctaaaaaataactgt

SEQ ID NO: 6463263 - DNA, 15 bp, Homo sapiens
tctaaaaacatttgt

SEQ ID NO: 6463264 - DNA, 18 bp, Homo sapiens
tctaaaaagtcaattcat

SEQ ID NO: 6463265 - DNA, 14 bp, Homo sapiens
tctaaaaagtcaga

SEQ ID NO: 6463266 - DNA, 17 bp, Homo sapiens
tctaaaaataaaatgat

SEQ ID NO: 6463267 - DNA, 15 bp, Homo sapiens
tgattttcataactt

SEQ ID NO: 6463268 - DNA, 19 bp, Homo sapiens
tgattttcatcaatttaaa

SEQ ID NO: 6463269 - DNA, 15 bp, Homo sapiens
tgattttcattgctg

SEQ ID NO: 6463270 - DNA, 17 bp, Homo sapiens
tgattttccatctaaaa

SEQ ID NO: 6463271 - DNA, 13 bp, Homo sapiens
tgattttcctgtg

SEQ ID NO: 6463272 - DNA, 15 bp, Homo sapiens
tgattttcctttttc

SEQ ID NO: 6463273 - DNA, 13 bp, Homo sapiens
tgattttctccac

SEQ ID NO: 6463274 - DNA, 15 bp, Homo sapiens
tgattttctcctaaa

SEQ ID NO: 6463275 - DNA, 15 bp, Homo sapiens
tgattttgaaaccat

SEQ ID NO: 6463276 - DNA, 15 bp, Homo sapiens
tgattttgaaatcat

SEQ ID NO: 6463277 - DNA, 23 bp, Homo sapiens
tgattttgaacctgatgaaaata

SEQ ID NO: 6463278 - DNA, 12 bp, Homo sapiens
tgattttgacac

SEQ ID NO: 6463279 - DNA, 20 bp, Homo sapiens
tgattttgaccttgtattga

SEQ ID NO: 6463280 - DNA, 22 bp, Homo sapiens
tgattttgcaaaatgagttgtg

SEQ ID NO: 6463281 - DNA, 19 bp, Homo sapiens
tgattttgctgtagaagat

SEQ ID NO: 6463282 - DNA, 17 bp, Homo sapiens
tgattttggaactgtgt

SEQ ID NO: 6463283 - DNA, 23 bp, Homo sapiens
tgattttggaactgtgtttcaaa

SEQ ID NO: 6463284 - DNA, 21 bp, Homo sapiens
tgattttggccactttgcaga

SEQ ID NO: 6463285 - DNA, 16 bp, Homo sapiens
tgattttgtaaagttg

SEQ ID NO: 6463286 - DNA, 16 bp, Homo sapiens
tgattttgtaattctt

SEQ ID NO: 6463287 - DNA, 19 bp, Homo sapiens
tgattttgtaattcttatg

SEQ ID NO: 6463288 - DNA, 17 bp, Homo sapiens
tgattttgtacagaatt

SEQ ID NO: 6463289 - DNA, 18 bp, Homo sapiens
tgattttgtacagaattt

SEQ ID NO: 6463290 - DNA, 21 bp, Homo sapiens
tgattttgtacagaattttta

SEQ ID NO: 6463291 - DNA, 15 bp, Homo sapiens
tgattttgtatgtaa

SEQ ID NO: 6463292 - DNA, 17 bp, Homo sapiens
tgattttgtatgtaaat

SEQ ID NO: 6463293 - DNA, 20 bp, Homo sapiens
tgatttttaaagtttaaata

SEQ ID NO: 6463294 - DNA, 15 bp, Homo sapiens
tgatttttaaatcat

SEQ ID NO: 6463295 - DNA, 14 bp, Homo sapiens
tgatttttaaatta

SEQ ID NO: 6463296 - DNA, 17 bp, Homo sapiens
tgatttttaaattaaat

SEQ ID NO: 6463297 - DNA, 22 bp, Homo sapiens
tgatttttaagaaagtaattta

SEQ ID NO: 6463298 - DNA, 23 bp, Homo sapiens
tgatttttaagaaagtaatttaa

SEQ ID NO: 6463299 - DNA, 15 bp, Homo sapiens
tgatttttaagattt

SEQ ID NO: 6463300 - DNA, 16 bp, Homo sapiens
tgatttttaatggaaa

SEQ ID NO: 6463301 - DNA, 23 bp, Homo sapiens
tgatttttataaatactgcaaat

SEQ ID NO: 6463302 - DNA, 14 bp, Homo sapiens
tgatttttatccaa

SEQ ID NO: 6463303 - DNA, 12 bp, Homo sapiens
tgatttttatct

SEQ ID NO: 6463304 - DNA, 20 bp, Homo sapiens
tgatttttcaaagacttcat

SEQ ID NO: 6463305 - DNA, 16 bp, Homo sapiens
tgatttttctcttcat

SEQ ID NO: 6463306 - DNA, 13 bp, Homo sapiens
tgatttttcttct

SEQ ID NO: 6463307 - DNA, 15 bp, Homo sapiens
tgatttttgaagttg

SEQ ID NO: 6463308 - DNA, 14 bp, Homo sapiens
tgatttttgtgtat

SEQ ID NO: 6463309 - DNA, 21 bp, Homo sapiens
tgatttttgtgtatccagtat

SEQ ID NO: 6463310 - DNA, 14 bp, Homo sapiens
tgatttttgttgat

SEQ ID NO: 6463311 - DNA, 23 bp, Homo sapiens
tgatttttgtttttgtaatgcac

SEQ ID NO: 6463312 - DNA, 9 bp, Homo sapiens
tgatttttt

SEQ ID NO: 6463313 - DNA, 16 bp, Homo sapiens
tgattttttaaaagaa

SEQ ID NO: 6463314 - DNA, 19 bp, Homo sapiens
tgattttttacaaattatg

SEQ ID NO: 6463315 - DNA, 14 bp, Homo sapiens
tgattttttattca

SEQ ID NO: 6463316 - DNA, 13 bp, Homo sapiens
tgattttttgcat

SEQ ID NO: 6463317 - DNA, 18 bp, Homo sapiens
tgattttttgttcttgtt

SEQ ID NO: 6463318 - DNA, 20 bp, Homo sapiens
tgattttttgttcttgttgt

SEQ ID NO: 6463319 - DNA, 17 bp, Homo sapiens
tgatttttttaaacata

SEQ ID NO: 6463320 - DNA, 16 bp, Homo sapiens
tgatttttttaaagta

SEQ ID NO: 6463321 - DNA, 19 bp, Homo sapiens
tgatttttttaaagtagtt

SEQ ID NO: 6463322 - DNA, 18 bp, Homo sapiens
tgatttttttattatttt

SEQ ID NO: 6463323 - DNA, 17 bp, Homo sapiens
tgatttttttgttcatt

SEQ ID NO: 6463324 - DNA, 17 bp, Homo sapiens
tgattttttttaattac

SEQ ID NO: 6463325 - DNA, 16 bp, Homo sapiens
tgattttttttccttt

SEQ ID NO: 6463326 - DNA, 22 bp, Homo sapiens
tgatttttttttcatacactta

SEQ ID NO: 6463327 - DNA, 15 bp, Homo sapiens
tgatttttttttcca

SEQ ID NO: 6463328 - DNA, 23 bp, Homo sapiens
tgatttttttttccttcagtgcc

SEQ ID NO: 6463329 - DNA, 19 bp, Homo sapiens
tgattttttttttaacttg

SEQ ID NO: 6463330 - DNA, 20 bp, Homo sapiens
tgatttttttttttaatcta

SEQ ID NO: 6463331 - DNA, 20 bp, Homo sapiens
tgatttttttttttttttcc

SEQ ID NO: 6463332 - DNA, 21 bp, Homo sapiens
tgcaaaaaaaaaaatgtcaag

SEQ ID NO: 6463333 - DNA, 17 bp, Homo sapiens
tgcaaaaaaaaacttaa

SEQ ID NO: 6463334 - DNA, 18 bp, Homo sapiens
tgcaaaaaaaaacttaaa

SEQ ID NO: 6463335 - DNA, 22 bp, Homo sapiens
tgcaaaaaaaaacttaaagcaa

SEQ ID NO: 6463336 - DNA, 16 bp, Homo sapiens
tgcaaaaaaagcctcc

SEQ ID NO: 6463337 - DNA, 17 bp, Homo sapiens
tgcaaaaaaagcctcca

SEQ ID NO: 6463338 - DNA, 18 bp, Homo sapiens
tgcaaaaaaagcctccaa

SEQ ID NO: 6463339 - DNA, 20 bp, Homo sapiens
tgcaaaaaaagcctccaagg

SEQ ID NO: 6463340 - DNA, 14 bp, Homo sapiens
tgcaaaaaatctta

SEQ ID NO: 6463341 - DNA, 19 bp, Homo sapiens
tgcaaaaacatatgtctgt

SEQ ID NO: 6463342 - DNA, 21 bp, Homo sapiens
tgcaaaaacatatgtctgtct

SEQ ID NO: 6463343 - DNA, 22 bp, Homo sapiens
tgcaaaaacatatgtctgtctt

SEQ ID NO: 6463344 - DNA, 19 bp, Homo sapiens
tgcaaaaactgtaaaagtg

SEQ ID NO: 6463345 - DNA, 19 bp, Homo sapiens
tgcaaaaactttcatgcct

SEQ ID NO: 6463346 - DNA, 15 bp, Homo sapiens
tgcaaaaagaaatga

SEQ ID NO: 6463347 - DNA, 12 bp, Homo sapiens
tgcaaaaagata

SEQ ID NO: 6463348 - DNA, 14 bp, Homo sapiens
tgcaaaaagggtca

SEQ ID NO: 6463349 - DNA, 15 bp, Homo sapiens
tgcaaaaagtagact

SEQ ID NO: 6463350 - DNA, 11 bp, Homo sapiens
tgcaaaaataa

SEQ ID NO: 6463351 - DNA, 15 bp, Homo sapiens
tgcaaaaataaccaa

SEQ ID NO: 6463352 - DNA, 21 bp, Homo sapiens
tgcaaaaataaccaagtcctc

SEQ ID NO: 6463353 - DNA, 14 bp, Homo sapiens
tgcaaaaatatata

SEQ ID NO: 6463354 - DNA, 22 bp, Homo sapiens
tgcaaaaatatttataaaactt

SEQ ID NO: 6463355 - DNA, 23 bp, Homo sapiens
tgcaaaaatatttataaaacttc

SEQ ID NO: 6463356 - DNA, 22 bp, Homo sapiens
tgcaaaaatccaaatattgtta

SEQ ID NO: 6463357 - DNA, 17 bp, Homo sapiens
tgcaaaaatccttctcc

SEQ ID NO: 6463358 - DNA, 16 bp, Homo sapiens
tgcaaaaatgaattca

SEQ ID NO: 6463359 - DNA, 20 bp, Homo sapiens
tgcaaaaatgaattcacccc

SEQ ID NO: 6463360 - DNA, 13 bp, Homo sapiens
tgcaaaaatgagt

SEQ ID NO: 6463361 - DNA, 12 bp, Homo sapiens
tgcaaaaatgga

SEQ ID NO: 6463362 - DNA, 13 bp, Homo sapiens
tgcaaaacatttc

SEQ ID NO: 6463363 - DNA, 14 bp, Homo sapiens
tgcaaaactgtgtc

SEQ ID NO: 6463364 - DNA, 17 bp, Homo sapiens
tgcaaaagaagttgatc

SEQ ID NO: 6463365 - DNA, 18 bp, Homo sapiens
tgcaaaagaagttgatct

SEQ ID NO: 6463366 - DNA, 23 bp, Homo sapiens
tgcaaaagactaatttaaaaaat

SEQ ID NO: 6463367 - DNA, 13 bp, Homo sapiens
tgcaaaagcagtg

SEQ ID NO: 6463368 - DNA, 22 bp, Homo sapiens
tgcaaaaggactctcaggacca

SEQ ID NO: 6463369 - DNA, 12 bp, Homo sapiens
tgcaaaaggctg

SEQ ID NO: 6463370 - DNA, 22 bp, Homo sapiens
tgcaaaaggttcactaaagcag

SEQ ID NO: 6463371 - DNA, 22 bp, Homo sapiens
tgcaaaagtggggctaaatgaa

SEQ ID NO: 6463372 - DNA, 15 bp, Homo sapiens
tgcaaaatacatgaa

SEQ ID NO: 6463373 - DNA, 14 bp, Homo sapiens
tgcaaaatagaaga

SEQ ID NO: 6463374 - DNA, 23 bp, Homo sapiens
tgcaaaatagaagaagaggaagt

SEQ ID NO: 6463375 - DNA, 17 bp, Homo sapiens
tgcaaaatagacatctt

SEQ ID NO: 6463376 - DNA, 13 bp, Homo sapiens
tgcaaaatattgg

SEQ ID NO: 6463377 - DNA, 21 bp, Homo sapiens
tgcaaaatattggtattaaag

SEQ ID NO: 6463378 - DNA, 13 bp, Homo sapiens
tgcaaaatcactt

SEQ ID NO: 6463379 - DNA, 23 bp, Homo sapiens
tgcaaaatgcgtatttgcatttg

SEQ ID NO: 6463380 - DNA, 21 bp, Homo sapiens
tgcaaaatggaaatgtaataa

SEQ ID NO: 6463381 - DNA, 12 bp, Homo sapiens
tgcaaaatggag

SEQ ID NO: 6463382 - DNA, 17 bp, Homo sapiens
tgcaaaatggagaccaa

SEQ ID NO: 6463383 - DNA, 15 bp, Homo sapiens
tgcaaaatgtagaaa

SEQ ID NO: 6463384 - DNA, 13 bp, Homo sapiens
tgcaaaatgtctt

SEQ ID NO: 6463385 - DNA, 22 bp, Homo sapiens
tgcaaaattaaatctagacatt

SEQ ID NO: 6463386 - DNA, 13 bp, Homo sapiens
tgcaaaattacct

SEQ ID NO: 6463387 - DNA, 16 bp, Homo sapiens
tgcaaaattacctacc

SEQ ID NO: 6463388 - DNA, 18 bp, Homo sapiens
tgcaaaattgttttcact

SEQ ID NO: 6463389 - DNA, 21 bp, Homo sapiens
tgcaaaatttagaagaaaagt

SEQ ID NO: 6463390 - DNA, 21 bp, Homo sapiens
tgcaaaatttccagtaccttt

SEQ ID NO: 6463391 - DNA, 15 bp, Homo sapiens
tgcaaacaacctgaa

SEQ ID NO: 6463392 - DNA, 18 bp, Homo sapiens
tgcaaacaactgaaatgt

SEQ ID NO: 6463393 - DNA, 23 bp, Homo sapiens
tgcaaacacacaaaggtataatt

SEQ ID NO: 6463394 - DNA, 13 bp, Homo sapiens
tgcaaacacagca

SEQ ID NO: 6463395 - DNA, 18 bp, Homo sapiens
tgcaaacagaacagggtc

SEQ ID NO: 6463396 - DNA, 17 bp, Homo sapiens
tgcaaacagaagtgcat

SEQ ID NO: 6463397 - DNA, 20 bp, Homo sapiens
tgcaaacagaagtgcatcct

SEQ ID NO: 6463398 - DNA, 23 bp, Homo sapiens
tgcaaacaggttgttttctactt

SEQ ID NO: 6463399 - DNA, 13 bp, Homo sapiens
tgcaaacattgga

SEQ ID NO: 6463400 - DNA, 14 bp, Homo sapiens
tgcaaaccacttct

SEQ ID NO: 6463401 - DNA, 12 bp, Homo sapiens
tgcaaaccatca

SEQ ID NO: 6463402 - DNA, 20 bp, Homo sapiens
tgcaaaccatcattgaaatc

SEQ ID NO: 6463403 - DNA, 17 bp, Homo sapiens
tgcaaacccatgaagct

SEQ ID NO: 6463404 - DNA, 20 bp, Homo sapiens
tgcaaacccatgaagctggc

SEQ ID NO: 6463405 - DNA, 15 bp, Homo sapiens
tgcaaaccctttgta

SEQ ID NO: 6463406 - DNA, 22 bp, Homo sapiens
tgcaaacctgcagtttttaatt

SEQ ID NO: 6463407 - DNA, 14 bp, Homo sapiens
tgcaaacctgctgg

SEQ ID NO: 6463408 - DNA, 20 bp, Homo sapiens
tgcaaacctgctggtggggc

SEQ ID NO: 6463409 - DNA, 16 bp, Homo sapiens
tgcaaaccttcctggg

SEQ ID NO: 6463410 - DNA, 16 bp, Homo sapiens
tgcaaacgctgcctgc

SEQ ID NO: 6463411 - DNA, 17 bp, Homo sapiens
tgcaaacgttggagttt

SEQ ID NO: 6463412 - DNA, 20 bp, Homo sapiens
tgcaaactctttggtcgttt

SEQ ID NO: 6463413 - DNA, 15 bp, Homo sapiens
tgcaaactgctttat

SEQ ID NO: 6463414 - DNA, 21 bp, Homo sapiens
tgcaaactgctttattttccc

SEQ ID NO: 6463415 - DNA, 23 bp, Homo sapiens
tgcaaactgggaacccctttccc

SEQ ID NO: 6463416 - DNA, 19 bp, Homo sapiens
tgcaaactgggctggaaga

SEQ ID NO: 6463417 - DNA, 16 bp, Homo sapiens
tgcaaactgtgcttct

SEQ ID NO: 6463418 - DNA, 19 bp, Homo sapiens
tgcaaactgtggcaactga

SEQ ID NO: 6463419 - DNA, 19 bp, Homo sapiens
tgcaaacttgtatctgaag

SEQ ID NO: 6463420 - DNA, 17 bp, Homo sapiens
tgcaaactttattttca

SEQ ID NO: 6463421 - DNA, 13 bp, Homo sapiens
tgcaaagaaaaga

SEQ ID NO: 6463422 - DNA, 13 bp, Homo sapiens
tgcaaagaactca

SEQ ID NO: 6463423 - DNA, 18 bp, Homo sapiens
tgcaaagacagtatttat

SEQ ID NO: 6463424 - DNA, 16 bp, Homo sapiens
tgcaaagaccacctcc

SEQ ID NO: 6463425 - DNA, 15 bp, Homo sapiens
tgcaaagagacattt

SEQ ID NO: 6463426 - DNA, 16 bp, Homo sapiens
tgcaaagagacatttc

SEQ ID NO: 6463427 - DNA, 18 bp, Homo sapiens
tgcaaagagacatttcaa

SEQ ID NO: 6463428 - DNA, 19 bp, Homo sapiens
tgcaaagagacatttcaaa

SEQ ID NO: 6463429 - DNA, 13 bp, Homo sapiens
tgcaaagatctct

SEQ ID NO: 6463430 - DNA, 20 bp, Homo sapiens
tgcaaagatctctagagttt

SEQ ID NO: 6463431 - DNA, 23 bp, Homo sapiens
tgcaaagatctgtcctcagcctt

SEQ ID NO: 6463432 - DNA, 12 bp, Homo sapiens
tgcaaagatgaa

SEQ ID NO: 6463433 - DNA, 18 bp, Homo sapiens
tgcaaagattgcctcttg

SEQ ID NO: 6463434 - DNA, 16 bp, Homo sapiens
tgcaaagcactctctg

SEQ ID NO: 6463435 - DNA, 17 bp, Homo sapiens
tgcaaagcactctctgc

SEQ ID NO: 6463436 - DNA, 15 bp, Homo sapiens
tgcaaagccaaggca

SEQ ID NO: 6463437 - DNA, 15 bp, Homo sapiens
tgcaaagcccagctt

SEQ ID NO: 6463438 - DNA, 17 bp, Homo sapiens
tgcaaagcccagcttga

SEQ ID NO: 6463439 - DNA, 13 bp, Homo sapiens
tgcaaagctgaag

SEQ ID NO: 6463440 - DNA, 11 bp, Homo sapiens
tgcaaagctgc

SEQ ID NO: 6463441 - DNA, 12 bp, Homo sapiens
tgcaaagctttg

SEQ ID NO: 6463442 - DNA, 18 bp, Homo sapiens
tgcaaagctttggctgag

SEQ ID NO: 6463443 - DNA, 18 bp, Homo sapiens
tgcaaaggactgtaagca

SEQ ID NO: 6463444 - DNA, 21 bp, Homo sapiens
tgcaaaggactgtaagcagat

SEQ ID NO: 6463445 - DNA, 23 bp, Homo sapiens
tgcaaaggagggcctcagagaca

SEQ ID NO: 6463446 - DNA, 15 bp, Homo sapiens
tgcaaaggataaatt

SEQ ID NO: 6463447 - DNA, 13 bp, Homo sapiens
tgcaaaggcctgg

SEQ ID NO: 6463448 - DNA, 12 bp, Homo sapiens
tgcaaaggctgg

SEQ ID NO: 6463449 - DNA, 14 bp, Homo sapiens
tgcaaaggctggga

SEQ ID NO: 6463450 - DNA, 22 bp, Homo sapiens
tgcaaaggtctttttaaaccag

SEQ ID NO: 6463451 - DNA, 20 bp, Homo sapiens
tgcaaagtaaaaaaatatga

SEQ ID NO: 6463452 - DNA, 13 bp, Homo sapiens
tgcaaagtactgt

SEQ ID NO: 6463453 - DNA, 21 bp, Homo sapiens
tgcaaagtactgtaagaataa

SEQ ID NO: 6463454 - DNA, 12 bp, Homo sapiens
tgcaaagtattg

SEQ ID NO: 6463455 - DNA, 20 bp, Homo sapiens
tgcaaagtcatgcaaaggct

SEQ ID NO: 6463456 - DNA, 22 bp, Homo sapiens
tgcaaagtcgccagtcactgct

SEQ ID NO: 6463457 - DNA, 21 bp, Homo sapiens
tgcaaagtgattcactgtgct

SEQ ID NO: 6463458 - DNA, 15 bp, Homo sapiens
tgcaaagtgcaaata

SEQ ID NO: 6463459 - DNA, 14 bp, Homo sapiens
tgcaaagtgccctc

SEQ ID NO: 6463460 - DNA, 16 bp, Homo sapiens
tgcaaagtgccctcat

SEQ ID NO: 6463461 - DNA, 19 bp, Homo sapiens
tgcaaagtgccttgctcat

SEQ ID NO: 6463462 - DNA, 16 bp, Homo sapiens
tgcaaagtggcaggga

SEQ ID NO: 6463463 - DNA, 10 bp, Homo sapiens
tgcaaagtgt

SEQ ID NO: 6463464 - DNA, 17 bp, Homo sapiens
tgcaaagtgttgtctta

SEQ ID NO: 6463465 - DNA, 18 bp, Homo sapiens
tgcaaagtgttgtcttat

SEQ ID NO: 6463466 - DNA, 13 bp, Homo sapiens
tgcaaagttctgt

SEQ ID NO: 6463467 - DNA, 21 bp, Homo sapiens
tgcaaataaaacccaatactt

SEQ ID NO: 6463468 - DNA, 21 bp, Homo sapiens
tgcaaataaaacgctttcccc

SEQ ID NO: 6463469 - DNA, 13 bp, Homo sapiens
tgcaaataaagcc

SEQ ID NO: 6463470 - DNA, 15 bp, Homo sapiens
tgcaaataaagcctt

SEQ ID NO: 6463471 - DNA, 22 bp, Homo sapiens
tgcaaataaaggctctggaagc

SEQ ID NO: 6463472 - DNA, 21 bp, Homo sapiens
tgcaaataaggacagcagctg

SEQ ID NO: 6463473 - DNA, 17 bp, Homo sapiens
tgcaaatacaatcagcc

SEQ ID NO: 6463474 - DNA, 17 bp, Homo sapiens
tgcaaatactccaagct

SEQ ID NO: 6463475 - DNA, 22 bp, Homo sapiens
tgcaaatacttccaaagagtca

SEQ ID NO: 6463476 - DNA, 15 bp, Homo sapiens
tgcaaatagaaaaca

SEQ ID NO: 6463477 - DNA, 13 bp, Homo sapiens
tgcaaatagccag

SEQ ID NO: 6463478 - DNA, 18 bp, Homo sapiens
tgcaaatagtttcaaatg

SEQ ID NO: 6463479 - DNA, 13 bp, Homo sapiens
tgcaaatataaac

SEQ ID NO: 6463480 - DNA, 18 bp, Homo sapiens
tgcaaatattagcaaaga

SEQ ID NO: 6463481 - DNA, 19 bp, Homo sapiens
tgcaaatattagcaaagaa

SEQ ID NO: 6463482 - DNA, 18 bp, Homo sapiens
tgcaaatatttttttgta

SEQ ID NO: 6463483 - DNA, 13 bp, Homo sapiens
tgcaaatcaccca

SEQ ID NO: 6463484 - DNA, 12 bp, Homo sapiens
tgcaaatcctat

SEQ ID NO: 6463485 - DNA, 14 bp, Homo sapiens
tgcaaatcctatgt

SEQ ID NO: 6463486 - DNA, 15 bp, Homo sapiens
tgcaaatcctatgtg

SEQ ID NO: 6463487 - DNA, 21 bp, Homo sapiens
tgcaaatctgccaagagagat

SEQ ID NO: 6463488 - DNA, 14 bp, Homo sapiens
tgcaaatgaaggaa

SEQ ID NO: 6463489 - DNA, 17 bp, Homo sapiens
tgcaaatgagatttctt

SEQ ID NO: 6463490 - DNA, 18 bp, Homo sapiens
tgcaaatgagatttcttt

SEQ ID NO: 6463491 - DNA, 20 bp, Homo sapiens
tgcaaatgagctctgaaatc

SEQ ID NO: 6463492 - DNA, 19 bp, Homo sapiens
tgcaaatgcattgtgaatt

SEQ ID NO: 6463493 - DNA, 14 bp, Homo sapiens
tgcaaatgcctcca

SEQ ID NO: 6463494 - DNA, 24 bp, Homo sapiens
tgcaaatggtggttgtttcttcca

SEQ ID NO: 6463495 - DNA, 16 bp, Homo sapiens
tgcaaatgtctaattg

SEQ ID NO: 6463496 - DNA, 15 bp, Homo sapiens
tgcaaatgtcttcca

SEQ ID NO: 6463497 - DNA, 21 bp, Homo sapiens
tgcaaattaaaacatatttca

SEQ ID NO: 6463498 - DNA, 12 bp, Homo sapiens
tgcaaattattc

SEQ ID NO: 6463499 - DNA, 16 bp, Homo sapiens
tgcaaattattctagt

SEQ ID NO: 6463500 - DNA, 18 bp, Homo sapiens
tgcaaattatttattact

SEQ ID NO: 6463501 - DNA, 13 bp, Homo sapiens
tgcaaattccata

SEQ ID NO: 6463502 - DNA, 14 bp, Homo sapiens
tgcaaattgtgaaa

SEQ ID NO: 6463503 - DNA, 15 bp, Homo sapiens
tgcaaattgtgaaat

SEQ ID NO: 6463504 - DNA, 22 bp, Homo sapiens
tgcaaatttctataaatttaag

SEQ ID NO: 6463505 - DNA, 15 bp, Homo sapiens
tgcaaattttgcatt

SEQ ID NO: 6463506 - DNA, 21 bp, Homo sapiens
tgcaaatttttttgtattttt

SEQ ID NO: 6463507 - DNA, 16 bp, Homo sapiens
tgcaacaaaatacatt

SEQ ID NO: 6463508 - DNA, 14 bp, Homo sapiens
tgcaacaaaatgta

SEQ ID NO: 6463509 - DNA, 16 bp, Homo sapiens
tgcaacaaactcaaaa

SEQ ID NO: 6463510 - DNA, 21 bp, Homo sapiens
tgcaacaaagacttgctttaa

SEQ ID NO: 6463511 - DNA, 13 bp, Homo sapiens
tgcaacaaatgaa

SEQ ID NO: 6463512 - DNA, 15 bp, Homo sapiens
tgcaacaacatgtat

SEQ ID NO: 6463513 - DNA, 15 bp, Homo sapiens
tgcaacaagcatgca

SEQ ID NO: 6463514 - DNA, 22 bp, Homo sapiens
tgcaacaagccctgcttttgca

SEQ ID NO: 6463515 - DNA, 15 bp, Homo sapiens
tgcaacaataataaa

SEQ ID NO: 6463516 - DNA, 20 bp, Homo sapiens
tgcaacaataataaatgtta

SEQ ID NO: 6463517 - DNA, 20 bp, Homo sapiens
tgcaacaataattcatcaag

SEQ ID NO: 6463518 - DNA, 11 bp, Homo sapiens
tgcaacaatgc

SEQ ID NO: 6463519 - DNA, 13 bp, Homo sapiens
tgcaacaatgcaa

SEQ ID NO: 6463520 - DNA, 16 bp, Homo sapiens
tgcaacaatgcaaaag

SEQ ID NO: 6463521 - DNA, 20 bp, Homo sapiens
tgcaacaatgcaaaagccaa

SEQ ID NO: 6463522 - DNA, 12 bp, Homo sapiens
tgcaacacacag

SEQ ID NO: 6463523 - DNA, 14 bp, Homo sapiens
tgcaacacacagac

SEQ ID NO: 6463524 - DNA, 11 bp, Homo sapiens
tgcaacactgc

SEQ ID NO: 6463525 - DNA, 16 bp, Homo sapiens
tgcaacactgccaaac

SEQ ID NO: 6463526 - DNA, 16 bp, Homo sapiens
tgcaacagacttgaat

SEQ ID NO: 6463527 - DNA, 18 bp, Homo sapiens
tgcaacagagagaaaaag

SEQ ID NO: 6463528 - DNA, 13 bp, Homo sapiens
tgcaacagcactg

SEQ ID NO: 6463529 - DNA, 24 bp, Homo sapiens
tgcaacagcactggctctctccag

SEQ ID NO: 6463530 - DNA, 14 bp, Homo sapiens
tgcaacagcagtgt

SEQ ID NO: 6463531 - DNA, 16 bp, Homo sapiens
tgcaacaggaggcttt

SEQ ID NO: 6463532 - DNA, 22 bp, Homo sapiens
tgcaacaggaggctttttcagt

SEQ ID NO: 6463533 - DNA, 13 bp, Homo sapiens
tgcaacaggctgg

SEQ ID NO: 6463534 - DNA, 20 bp, Homo sapiens
tgcaacaggttgaggctaaa

SEQ ID NO: 6463535 - DNA, 23 bp, Homo sapiens
tgcaacatggattccaaagcatt

SEQ ID NO: 6463536 - DNA, 14 bp, Homo sapiens
tgcaacatttctgt

SEQ ID NO: 6463537 - DNA, 17 bp, Homo sapiens
tgcaacatttctgtata

SEQ ID NO: 6463538 - DNA, 21 bp, Homo sapiens
tgcaaccaaaagggaaaaaat

SEQ ID NO: 6463539 - DNA, 17 bp, Homo sapiens
tgcaaccaactacaacc

SEQ ID NO: 6463540 - DNA, 19 bp, Homo sapiens
tgcaaccaactatccaagt

SEQ ID NO: 6463541 - DNA, 17 bp, Homo sapiens
tgcaaccaagtcacacg

SEQ ID NO: 6463542 - DNA, 15 bp, Homo sapiens
tgcaaccactctgtg

SEQ ID NO: 6463543 - DNA, 18 bp, Homo sapiens
tgcaaccactctgtggcc

SEQ ID NO: 6463544 - DNA, 21 bp, Homo sapiens
tgcaaccactctgtggccagc

SEQ ID NO: 6463545 - DNA, 23 bp, Homo sapiens
tgcaaccactctgtggccagcct

SEQ ID NO: 6463546 - DNA, 15 bp, Homo sapiens
tgcaaccactgcaac

SEQ ID NO: 6463547 - DNA, 12 bp, Homo sapiens
tgcaaccaggaa

SEQ ID NO: 6463548 - DNA, 15 bp, Homo sapiens
tgcaaccaggcagct

SEQ ID NO: 6463549 - DNA, 16 bp, Homo sapiens
tgcaaccaggcagctg

SEQ ID NO: 6463550 - DNA, 17 bp, Homo sapiens
tgcaaccagggagctgc

SEQ ID NO: 6463551 - DNA, 21 bp, Homo sapiens
tgcaaccagggagctgcaggg

SEQ ID NO: 6463552 - DNA, 18 bp, Homo sapiens
tgcaaccatcagaattca

SEQ ID NO: 6463553 - DNA, 16 bp, Homo sapiens
tgcaaccatttgaaac

SEQ ID NO: 6463554 - DNA, 17 bp, Homo sapiens
tgcaacccaaggtgagg

SEQ ID NO: 6463555 - DNA, 15 bp, Homo sapiens
tgcaacccttacccc

SEQ ID NO: 6463556 - DNA, 21 bp, Homo sapiens
tgcaacctccacctcccaggt

SEQ ID NO: 6463557 - DNA, 13 bp, Homo sapiens
tgcaacctccgcc

SEQ ID NO: 6463558 - DNA, 18 bp, Homo sapiens
tgcaacctccgcctcttg

SEQ ID NO: 6463559 - DNA, 14 bp, Homo sapiens
tgcaacctcgctgg

SEQ ID NO: 6463560 - DNA, 16 bp, Homo sapiens
tgcaacctctgcctcc

SEQ ID NO: 6463561 - DNA, 22 bp, Homo sapiens
tgcaacctctgcctcccgggtt

SEQ ID NO: 6463562 - DNA, 17 bp, Homo sapiens
tgcaacctctgcctcct

SEQ ID NO: 6463563 - DNA, 19 bp, Homo sapiens
tgcaacctctgcctcctgg

SEQ ID NO: 6463564 - DNA, 22 bp, Homo sapiens
tgcaacctctgcctcctgggtt

SEQ ID NO: 6463565 - DNA, 18 bp, Homo sapiens
tgcaacctctgcttccca

SEQ ID NO: 6463566 - DNA, 19 bp, Homo sapiens
tgcaacctctgcttcccag

SEQ ID NO: 6463567 - DNA, 20 bp, Homo sapiens
tgcaacctctgcttcccagg

SEQ ID NO: 6463568 - DNA, 21 bp, Homo sapiens
tgcaacctctgcttcccaggt

SEQ ID NO: 6463569 - DNA, 18 bp, Homo sapiens
tgcaacctcttcctcctg

SEQ ID NO: 6463570 - DNA, 23 bp, Homo sapiens
tgcaacctcttcctcctggttca

SEQ ID NO: 6463571 - DNA, 13 bp, Homo sapiens
tgcaacctgtgca

SEQ ID NO: 6463572 - DNA, 14 bp, Homo sapiens
tgcaacctgtgcaa

SEQ ID NO: 6463573 - DNA, 15 bp, Homo sapiens
tgcaacctgtgcaaa

SEQ ID NO: 6463574 - DNA, 22 bp, Homo sapiens
tgcaacctgtgcaaaataaaat

SEQ ID NO: 6463575 - DNA, 13 bp, Homo sapiens
tgcaacctgtggc

SEQ ID NO: 6463576 - DNA, 14 bp, Homo sapiens
tgcaacctgtggct

SEQ ID NO: 6463577 - DNA, 14 bp, Homo sapiens
tgcaaccttcacct

SEQ ID NO: 6463578 - DNA, 20 bp, Homo sapiens
tgcaacggtctcctgactgg

SEQ ID NO: 6463579 - DNA, 17 bp, Homo sapiens
tgcaactagccaaggct

SEQ ID NO: 6463580 - DNA, 18 bp, Homo sapiens
tgcaactagtaaaatgct

SEQ ID NO: 6463581 - DNA, 22 bp, Homo sapiens
tgcaactcactgattctctaca

SEQ ID NO: 6463582 - DNA, 19 bp, Homo sapiens
tgcaactcatcatcggtga

SEQ ID NO: 6463583 - DNA, 18 bp, Homo sapiens
tgcaactcatgaacaaaa

SEQ ID NO: 6463584 - DNA, 21 bp, Homo sapiens
tgcaactccagcgtcctcagc

SEQ ID NO: 6463585 - DNA, 13 bp, Homo sapiens
tgcaactccatgc

SEQ ID NO: 6463586 - DNA, 14 bp, Homo sapiens
tgcaactccatgcc

SEQ ID NO: 6463587 - DNA, 15 bp, Homo sapiens
tgcaactccatgcct

SEQ ID NO: 6463588 - DNA, 22 bp, Homo sapiens
tgcaactccatgcctatttact

SEQ ID NO: 6463589 - DNA, 21 bp, Homo sapiens
tgcaactcgccctgtttggca

SEQ ID NO: 6463590 - DNA, 14 bp, Homo sapiens
tgcaactcttgtat

SEQ ID NO: 6463591 - DNA, 15 bp, Homo sapiens
tgcaactcttgtatt

SEQ ID NO: 6463592 - DNA, 18 bp, Homo sapiens
tgcaactcttgtattgct

SEQ ID NO: 6463593 - DNA, 21 bp, Homo sapiens
tgcaactgctcagctctggtc

SEQ ID NO: 6463594 - DNA, 14 bp, Homo sapiens
tgcaactggccagc

SEQ ID NO: 6463595 - DNA, 13 bp, Homo sapiens
tgcaacttcagtt

SEQ ID NO: 6463596 - DNA, 15 bp, Homo sapiens
tgcaacttcatgtca

SEQ ID NO: 6463597 - DNA, 21 bp, Homo sapiens
tgcaacttctttttattttct

SEQ ID NO: 6463598 - DNA, 15 bp, Homo sapiens
tgcaacttgagggac

SEQ ID NO: 6463599 - DNA, 17 bp, Homo sapiens
tgcaacttgagggacga

SEQ ID NO: 6463600 - DNA, 14 bp, Homo sapiens
tgcaacttggactt

SEQ ID NO: 6463601 - DNA, 14 bp, Homo sapiens
tgcaacttgtgaac

SEQ ID NO: 6463602 - DNA, 19 bp, Homo sapiens
tgcaactttaagcagctct

SEQ ID NO: 6463603 - DNA, 18 bp, Homo sapiens
tgcaactttagaaagaaa

SEQ ID NO: 6463604 - DNA, 17 bp, Homo sapiens
tgcaactttttaaagta

SEQ ID NO: 6463605 - DNA, 21 bp, Homo sapiens
tgcaagaaccagatcgtactt

SEQ ID NO: 6463606 - DNA, 22 bp, Homo sapiens
tgcaagaactcatcactgtggc

SEQ ID NO: 6463607 - DNA, 20 bp, Homo sapiens
tgcaagaagaaatcatgata

SEQ ID NO: 6463608 - DNA, 17 bp, Homo sapiens
tgcaagaagaatataaa

SEQ ID NO: 6463609 - DNA, 22 bp, Homo sapiens
tgcaagaagccatttagggcag

SEQ ID NO: 6463610 - DNA, 15 bp, Homo sapiens
tgcaagaagtcttga

SEQ ID NO: 6463611 - DNA, 22 bp, Homo sapiens
tgcaagaagtggggcagcagca

SEQ ID NO: 6463612 - DNA, 16 bp, Homo sapiens
tgcaagaatctaaacc

SEQ ID NO: 6463613 - DNA, 20 bp, Homo sapiens
tgcaagaatgaaatgaatga

SEQ ID NO: 6463614 - DNA, 14 bp, Homo sapiens
tgcaagaattaaaa

SEQ ID NO: 6463615 - DNA, 15 bp, Homo sapiens
tgcaagaattaaaac

SEQ ID NO: 6463616 - DNA, 16 bp, Homo sapiens
tgcaagaattaaaact

SEQ ID NO: 6463617 - DNA, 17 bp, Homo sapiens
tgcaagaattaaaactg

SEQ ID NO: 6463618 - DNA, 19 bp, Homo sapiens
tgcaagaattaaaactgag

SEQ ID NO: 6463619 - DNA, 20 bp, Homo sapiens
tgcaagaatttctggaagaa

SEQ ID NO: 6463620 - DNA, 21 bp, Homo sapiens
tgcaagacacaggctcagcat

SEQ ID NO: 6463621 - DNA, 19 bp, Homo sapiens
tgcaagactcgaataaaat

SEQ ID NO: 6463622 - DNA, 20 bp, Homo sapiens
tgcaagacttcactgcagcc

SEQ ID NO: 6463623 - DNA, 21 bp, Homo sapiens
tgcaagagaacattttactgt

SEQ ID NO: 6463624 - DNA, 15 bp, Homo sapiens
tgcaagagaaggaga

SEQ ID NO: 6463625 - DNA, 18 bp, Homo sapiens
tgcaagagaatctgatca

SEQ ID NO: 6463626 - DNA, 19 bp, Homo sapiens
tctaaaaataaaatgatgt

SEQ ID NO: 6463627 - DNA, 23 bp, Homo sapiens
tctaaaaataaaatgcatttaaa

SEQ ID NO: 6463628 - DNA, 21 bp, Homo sapiens
tctaaaaattggtacttgttt

SEQ ID NO: 6463629 - DNA, 16 bp, Homo sapiens
tctaaaacaataaaga

SEQ ID NO: 6463630 - DNA, 14 bp, Homo sapiens
tctaaaacaattcc

SEQ ID NO: 6463631 - DNA, 19 bp, Homo sapiens
tctaaaacactattctcca

SEQ ID NO: 6463632 - DNA, 15 bp, Homo sapiens
tctaaaacagctatt

SEQ ID NO: 6463633 - DNA, 14 bp, Homo sapiens
tctaaaacattccc

SEQ ID NO: 6463634 - DNA, 19 bp, Homo sapiens
tctaaaacattcccctccc

SEQ ID NO: 6463635 - DNA, 17 bp, Homo sapiens
tctaaaaccttagtcat

SEQ ID NO: 6463636 - DNA, 15 bp, Homo sapiens
tctaaaactaaatag

SEQ ID NO: 6463637 - DNA, 17 bp, Homo sapiens
tctaaaactaaatagca

SEQ ID NO: 6463638 - DNA, 13 bp, Homo sapiens
tctaaaactactg

SEQ ID NO: 6463639 - DNA, 19 bp, Homo sapiens
tctaaaactatggttccca

SEQ ID NO: 6463640 - DNA, 21 bp, Homo sapiens
tctaaaactatggttcccaat

SEQ ID NO: 6463641 - DNA, 18 bp, Homo sapiens
tctaaaagaaaaaggcat

SEQ ID NO: 6463642 - DNA, 22 bp, Homo sapiens
tctaaaagaatattcagagaat

SEQ ID NO: 6463643 - DNA, 13 bp, Homo sapiens
tctaaaagacttc

SEQ ID NO: 6463644 - DNA, 18 bp, Homo sapiens
tctaaaagattctttaaa

SEQ ID NO: 6463645 - DNA, 12 bp, Homo sapiens
tctaaaagcacc

SEQ ID NO: 6463646 - DNA, 16 bp, Homo sapiens
tctaaaagcagaaaat

SEQ ID NO: 6463647 - DNA, 12 bp, Homo sapiens
tctaaaagccat

SEQ ID NO: 6463648 - DNA, 16 bp, Homo sapiens
tctaaaaggttcaggg

SEQ ID NO: 6463649 - DNA, 13 bp, Homo sapiens
tctaaaagtaata

SEQ ID NO: 6463650 - DNA, 14 bp, Homo sapiens
tctaaaagtaataa

SEQ ID NO: 6463651 - DNA, 15 bp, Homo sapiens
tctaaaagttttcta

SEQ ID NO: 6463652 - DNA, 17 bp, Homo sapiens
tctaaaagttttctaat

SEQ ID NO: 6463653 - DNA, 15 bp, Homo sapiens
tctaaaataaatgtt

SEQ ID NO: 6463654 - DNA, 22 bp, Homo sapiens
tctaaaatactcaccaaaatat

SEQ ID NO: 6463655 - DNA, 14 bp, Homo sapiens
tctaaaatacttga

SEQ ID NO: 6463656 - DNA, 15 bp, Homo sapiens
tctaaaatagcaata

SEQ ID NO: 6463657 - DNA, 14 bp, Homo sapiens
tctaaaatcatgaa

SEQ ID NO: 6463658 - DNA, 15 bp, Homo sapiens
tctaaaatcctgctt

SEQ ID NO: 6463659 - DNA, 22 bp, Homo sapiens
tctaaaatcttatagttctagg

SEQ ID NO: 6463660 - DNA, 15 bp, Homo sapiens
tctaaaatggacatt

SEQ ID NO: 6463661 - DNA, 18 bp, Homo sapiens
tctaaaatgtgatgttct

SEQ ID NO: 6463662 - DNA, 17 bp, Homo sapiens
tctaaaatgttttatga

SEQ ID NO: 6463663 - DNA, 21 bp, Homo sapiens
tctaaaatgttttatgacatt

SEQ ID NO: 6463664 - DNA, 22 bp, Homo sapiens
tctaaaatgttttatgacattt

SEQ ID NO: 6463665 - DNA, 16 bp, Homo sapiens
tctaaaattattatat

SEQ ID NO: 6463666 - DNA, 14 bp, Homo sapiens
tctaaaattctagt

SEQ ID NO: 6463667 - DNA, 13 bp, Homo sapiens
tctaaaatttaaa

SEQ ID NO: 6463668 - DNA, 13 bp, Homo sapiens
tctaaacaaataa

SEQ ID NO: 6463669 - DNA, 18 bp, Homo sapiens
tctaaacacacttagaat

SEQ ID NO: 6463670 - DNA, 14 bp, Homo sapiens
tctaaacacttcat

SEQ ID NO: 6463671 - DNA, 22 bp, Homo sapiens
tctaaacagacaggaatttaga

SEQ ID NO: 6463672 - DNA, 14 bp, Homo sapiens
tctaaacagttatt

SEQ ID NO: 6463673 - DNA, 14 bp, Homo sapiens
tctaaacattaatc

SEQ ID NO: 6463674 - DNA, 17 bp, Homo sapiens
tctaaacattaatcaat

SEQ ID NO: 6463675 - DNA, 20 bp, Homo sapiens
tctaaacattttttcttcaa

SEQ ID NO: 6463676 - DNA, 17 bp, Homo sapiens
tctaaaccagaaggaag

SEQ ID NO: 6463677 - DNA, 19 bp, Homo sapiens
tctaaaccagaaggaagcc

SEQ ID NO: 6463678 - DNA, 20 bp, Homo sapiens
tctaaaccagaaggaagccc

SEQ ID NO: 6463679 - DNA, 16 bp, Homo sapiens
tctaaaccatgaaaag

SEQ ID NO: 6463680 - DNA, 21 bp, Homo sapiens
tctaaacccagcaaaacagat

SEQ ID NO: 6463681 - DNA, 18 bp, Homo sapiens
tctaaaccccagattctt

SEQ ID NO: 6463682 - DNA, 20 bp, Homo sapiens
tctaaaccccagattcttca

SEQ ID NO: 6463683 - DNA, 20 bp, Homo sapiens
tctaaacctgtgcctccctc

SEQ ID NO: 6463684 - DNA, 16 bp, Homo sapiens
tctaaactaggattga

SEQ ID NO: 6463685 - DNA, 18 bp, Homo sapiens
tctaaactaggctccttc

SEQ ID NO: 6463686 - DNA, 13 bp, Homo sapiens
tctaaactgcccc

SEQ ID NO: 6463687 - DNA, 23 bp, Homo sapiens
tctaaactgccccctctgccctg

SEQ ID NO: 6463688 - DNA, 13 bp, Homo sapiens
tctaaactggaga

SEQ ID NO: 6463689 - DNA, 21 bp, Homo sapiens
tctaaactggattcacagctc

SEQ ID NO: 6463690 - DNA, 13 bp, Homo sapiens
tctaaactgtttt

SEQ ID NO: 6463691 - DNA, 10 bp, Homo sapiens
tctaaactta

SEQ ID NO: 6463692 - DNA, 17 bp, Homo sapiens
tctaaacttagaaatat

SEQ ID NO: 6463693 - DNA, 21 bp, Homo sapiens
tctaaactttattccaagtca

SEQ ID NO: 6463694 - DNA, 12 bp, Homo sapiens
tctaaagaaaca

SEQ ID NO: 6463695 - DNA, 23 bp, Homo sapiens
tctaaagaagttcaaaccctgta

SEQ ID NO: 6463696 - DNA, 13 bp, Homo sapiens
tctaaagaccaaa

SEQ ID NO: 6463697 - DNA, 20 bp, Homo sapiens
tctaaagaccaaacttcact

SEQ ID NO: 6463698 - DNA, 13 bp, Homo sapiens
tctaaagagaaca

SEQ ID NO: 6463699 - DNA, 24 bp, Homo sapiens
tctaaagatagagtcattgctgta

SEQ ID NO: 6463700 - DNA, 21 bp, Homo sapiens
tctaaagatggagtttctaag

SEQ ID NO: 6463701 - DNA, 15 bp, Homo sapiens
tctaaagattctata

SEQ ID NO: 6463702 - DNA, 16 bp, Homo sapiens
tctaaagattctatag

SEQ ID NO: 6463703 - DNA, 22 bp, Homo sapiens
tctaaagattctatagttctag

SEQ ID NO: 6463704 - DNA, 21 bp, Homo sapiens
tctaaagcactggtttcaaga

SEQ ID NO: 6463705 - DNA, 20 bp, Homo sapiens
tctaaagcagagatgtatta

SEQ ID NO: 6463706 - DNA, 15 bp, Homo sapiens
tctaaagccaaaggt

SEQ ID NO: 6463707 - DNA, 16 bp, Homo sapiens
tctaaagccaagcact

SEQ ID NO: 6463708 - DNA, 12 bp, Homo sapiens
tctaaagccagg

SEQ ID NO: 6463709 - DNA, 12 bp, Homo sapiens
tctaaagctctg

SEQ ID NO: 6463710 - DNA, 17 bp, Homo sapiens
tctaaagctgaatgtca

SEQ ID NO: 6463711 - DNA, 13 bp, Homo sapiens
tctaaagctgcca

SEQ ID NO: 6463712 - DNA, 15 bp, Homo sapiens
tctaaagctgccagc

SEQ ID NO: 6463713 - DNA, 17 bp, Homo sapiens
tctaaagctgccagccg

SEQ ID NO: 6463714 - DNA, 18 bp, Homo sapiens
tctaaagcttctataaaa

SEQ ID NO: 6463715 - DNA, 15 bp, Homo sapiens
tctaaagctttatct

SEQ ID NO: 6463716 - DNA, 19 bp, Homo sapiens
tctaaagctttatctttgt

SEQ ID NO: 6463717 - DNA, 14 bp, Homo sapiens
tctaaaggactggt

SEQ ID NO: 6463718 - DNA, 13 bp, Homo sapiens
tctaaaggagttt

SEQ ID NO: 6463719 - DNA, 17 bp, Homo sapiens
tctaaaggagtttatgt

SEQ ID NO: 6463720 - DNA, 18 bp, Homo sapiens
tctaaaggagtttatgtt

SEQ ID NO: 6463721 - DNA, 16 bp, Homo sapiens
tctaaaggatgctgct

SEQ ID NO: 6463722 - DNA, 16 bp, Homo sapiens
tctaaaggatggaaaa

SEQ ID NO: 6463723 - DNA, 17 bp, Homo sapiens
tctaaaggatggaaaaa

SEQ ID NO: 6463724 - DNA, 18 bp, Homo sapiens
tctaaaggctacctttgt

SEQ ID NO: 6463725 - DNA, 16 bp, Homo sapiens
tctaaaggctgttaaa

SEQ ID NO: 6463726 - DNA, 23 bp, Homo sapiens
tctaaagggctatgcctccattt

SEQ ID NO: 6463727 - DNA, 22 bp, Homo sapiens
tctaaaggtaccaaacaaggaa

SEQ ID NO: 6463728 - DNA, 23 bp, Homo sapiens
tctaaaggtaccaaacaaggaag

SEQ ID NO: 6463729 - DNA, 17 bp, Homo sapiens
tctaaaggtccacaggt

SEQ ID NO: 6463730 - DNA, 22 bp, Homo sapiens
tctaaaggtccacaggtctaga

SEQ ID NO: 6463731 - DNA, 17 bp, Homo sapiens
tctaaagtaattggtta

SEQ ID NO: 6463732 - DNA, 19 bp, Homo sapiens
tctaaagtagcaactgctg

SEQ ID NO: 6463733 - DNA, 23 bp, Homo sapiens
tctaaagtagcaactgctggtga

SEQ ID NO: 6463734 - DNA, 21 bp, Homo sapiens
tctaaagtgttggtctttcta

SEQ ID NO: 6463735 - DNA, 12 bp, Homo sapiens
tctaaagtgttt

SEQ ID NO: 6463736 - DNA, 22 bp, Homo sapiens
tctaaagttagggcatttttct

SEQ ID NO: 6463737 - DNA, 17 bp, Homo sapiens
tctaaagttatatttca

SEQ ID NO: 6463738 - DNA, 12 bp, Homo sapiens
tctaaagttcta

SEQ ID NO: 6463739 - DNA, 19 bp, Homo sapiens
tctaaagttctaagattct

SEQ ID NO: 6463740 - DNA, 16 bp, Homo sapiens
tctaaagttgtagtga

SEQ ID NO: 6463741 - DNA, 22 bp, Homo sapiens
tctaaataaaaatatgtaattt

SEQ ID NO: 6463742 - DNA, 17 bp, Homo sapiens
tctaaataaaatataat

SEQ ID NO: 6463743 - DNA, 14 bp, Homo sapiens
tctaaataaagacg

SEQ ID NO: 6463744 - DNA, 17 bp, Homo sapiens
tctaaatacctgccctg

SEQ ID NO: 6463745 - DNA, 17 bp, Homo sapiens
tctaaatagatactttt

SEQ ID NO: 6463746 - DNA, 13 bp, Homo sapiens
tctaaatagccca

SEQ ID NO: 6463747 - DNA, 15 bp, Homo sapiens
tctaaatagcccaga

SEQ ID NO: 6463748 - DNA, 21 bp, Homo sapiens
tctaaataggatcctggaggc

SEQ ID NO: 6463749 - DNA, 16 bp, Homo sapiens
tctaaatatgaatgaa

SEQ ID NO: 6463750 - DNA, 13 bp, Homo sapiens
tctaaatattatg

SEQ ID NO: 6463751 - DNA, 20 bp, Homo sapiens
tctaaatattgcttcaattt

SEQ ID NO: 6463752 - DNA, 20 bp, Homo sapiens
tctaaatcaccagagaccaa

SEQ ID NO: 6463753 - DNA, 13 bp, Homo sapiens
tctaaatcataat

SEQ ID NO: 6463754 - DNA, 17 bp, Homo sapiens
tctaaatctatttatta

SEQ ID NO: 6463755 - DNA, 19 bp, Homo sapiens
tctaaatctatttattaat

SEQ ID NO: 6463756 - DNA, 14 bp, Homo sapiens
tctaaatctgtcca

SEQ ID NO: 6463757 - DNA, 12 bp, Homo sapiens
tctaaatgaaag

SEQ ID NO: 6463758 - DNA, 20 bp, Homo sapiens
tctaaatgattatcttgaaa

SEQ ID NO: 6463759 - DNA, 13 bp, Homo sapiens
tctaaatgcagtt

SEQ ID NO: 6463760 - DNA, 23 bp, Homo sapiens
tctaaatgggaaagtattctgta

SEQ ID NO: 6463761 - DNA, 20 bp, Homo sapiens
tctaaatggtgctgcagatt

SEQ ID NO: 6463762 - DNA, 21 bp, Homo sapiens
tctaaatggtgctgcagattt

SEQ ID NO: 6463763 - DNA, 20 bp, Homo sapiens
tctaaatgttattacttgta

SEQ ID NO: 6463764 - DNA, 14 bp, Homo sapiens
tctaaatgttggaa

SEQ ID NO: 6463765 - DNA, 20 bp, Homo sapiens
tctaaatgtttctttttctt

SEQ ID NO: 6463766 - DNA, 22 bp, Homo sapiens
tctaaatgtttggcatgtaaat

SEQ ID NO: 6463767 - DNA, 11 bp, Homo sapiens
tctaaattaaa

SEQ ID NO: 6463768 - DNA, 15 bp, Homo sapiens
tctaaattaaaaaag

SEQ ID NO: 6463769 - DNA, 20 bp, Homo sapiens
tctaaattaaagcctttagt

SEQ ID NO: 6463770 - DNA, 18 bp, Homo sapiens
tctaaattaagacagcat

SEQ ID NO: 6463771 - DNA, 12 bp, Homo sapiens
tctaaattcact

SEQ ID NO: 6463772 - DNA, 20 bp, Homo sapiens
tctaaattctttatttctgt

SEQ ID NO: 6463773 - DNA, 16 bp, Homo sapiens
tctaaattctttcatg

SEQ ID NO: 6463774 - DNA, 16 bp, Homo sapiens
tctaaattctttcatt

SEQ ID NO: 6463775 - DNA, 17 bp, Homo sapiens
tctaaattgaataatgg

SEQ ID NO: 6463776 - DNA, 15 bp, Homo sapiens
tctaaattgatcatt

SEQ ID NO: 6463777 - DNA, 17 bp, Homo sapiens
tctaaatttcttttgct

SEQ ID NO: 6463778 - DNA, 18 bp, Homo sapiens
tctaaattttatatcttg

SEQ ID NO: 6463779 - DNA, 23 bp, Homo sapiens
tctaaattttatatcttgtagct

SEQ ID NO: 6463780 - DNA, 19 bp, Homo sapiens
tctaaatttttacttaact

SEQ ID NO: 6463781 - DNA, 19 bp, Homo sapiens
tctaacaaaaaaatatatt

SEQ ID NO: 6463782 - DNA, 16 bp, Homo sapiens
tctaacaattttcaga

SEQ ID NO: 6463783 - DNA, 18 bp, Homo sapiens
tctaacacagttgaccct

SEQ ID NO: 6463784 - DNA, 13 bp, Homo sapiens
tctaacacatttc

SEQ ID NO: 6463785 - DNA, 16 bp, Homo sapiens
tctaacacatttcgta

SEQ ID NO: 6463786 - DNA, 19 bp, Homo sapiens
tctaacactggcatgttca

SEQ ID NO: 6463787 - DNA, 13 bp, Homo sapiens
tctaacagccctc

SEQ ID NO: 6463788 - DNA, 23 bp, Homo sapiens
tctaacagccctcctctgcactc

SEQ ID NO: 6463789 - DNA, 19 bp, Homo sapiens
tctaacagctcaggatctc

SEQ ID NO: 6463790 - DNA, 13 bp, Homo sapiens
tctaacagtaaca

SEQ ID NO: 6463791 - DNA, 12 bp, Homo sapiens
tctaacagtcct

SEQ ID NO: 6463792 - DNA, 18 bp, Homo sapiens
tctaacagtccttgcttt

SEQ ID NO: 6463793 - DNA, 22 bp, Homo sapiens
tctaacagtgaagttttactgt

SEQ ID NO: 6463794 - DNA, 18 bp, Homo sapiens
tctaacatatgatactga

SEQ ID NO: 6463795 - DNA, 13 bp, Homo sapiens
tctaacatatgta

SEQ ID NO: 6463796 - DNA, 17 bp, Homo sapiens
tctaacatgaaatatat

SEQ ID NO: 6463797 - DNA, 19 bp, Homo sapiens
tctaacattactgccttca

SEQ ID NO: 6463798 - DNA, 14 bp, Homo sapiens
tctaacattttcta

SEQ ID NO: 6463799 - DNA, 19 bp, Homo sapiens
tctaacatttttgaggaag

SEQ ID NO: 6463800 - DNA, 19 bp, Homo sapiens
tctaaccaaagagtctctg

SEQ ID NO: 6463801 - DNA, 15 bp, Homo sapiens
tctaaccaaatgcat

SEQ ID NO: 6463802 - DNA, 16 bp, Homo sapiens
tctaaccaaatgcatc

SEQ ID NO: 6463803 - DNA, 16 bp, Homo sapiens
tctaaccacacagcct

SEQ ID NO: 6463804 - DNA, 19 bp, Homo sapiens
tctaaccacagctcctttt

SEQ ID NO: 6463805 - DNA, 17 bp, Homo sapiens
tctaaccacatcaatat

SEQ ID NO: 6463806 - DNA, 20 bp, Homo sapiens
tgcaagagaatctgatcaat

SEQ ID NO: 6463807 - DNA, 17 bp, Homo sapiens
tgcaagagacagagccc

SEQ ID NO: 6463808 - DNA, 22 bp, Homo sapiens
tgcaagagacagagcccccaag

SEQ ID NO: 6463809 - DNA, 17 bp, Homo sapiens
tgcaagagactctggcc

SEQ ID NO: 6463810 - DNA, 16 bp, Homo sapiens
tgcaagagactttgtc

SEQ ID NO: 6463811 - DNA, 17 bp, Homo sapiens
tgcaagagactttgtca

SEQ ID NO: 6463812 - DNA, 21 bp, Homo sapiens
tgcaagagactttgtcactta

SEQ ID NO: 6463813 - DNA, 14 bp, Homo sapiens
tgcaagagccaagt

SEQ ID NO: 6463814 - DNA, 14 bp, Homo sapiens
tgcaagagcctgag

SEQ ID NO: 6463815 - DNA, 17 bp, Homo sapiens
tgcaagataattttcag

SEQ ID NO: 6463816 - DNA, 17 bp, Homo sapiens
tgcaagatacaggaaaa

SEQ ID NO: 6463817 - DNA, 17 bp, Homo sapiens
tgcaagatcttatttat

SEQ ID NO: 6463818 - DNA, 13 bp, Homo sapiens
tgcaagatgtgaa

SEQ ID NO: 6463819 - DNA, 14 bp, Homo sapiens
tgcaagatgtgaat

SEQ ID NO: 6463820 - DNA, 15 bp, Homo sapiens
tgcaagatgtgaatt

SEQ ID NO: 6463821 - DNA, 18 bp, Homo sapiens
tgcaagatgtgaattatt

SEQ ID NO: 6463822 - DNA, 22 bp, Homo sapiens
tgcaagattctgtgggcagctg

SEQ ID NO: 6463823 - DNA, 22 bp, Homo sapiens
tgcaagattttttttttaagtg

SEQ ID NO: 6463824 - DNA, 23 bp, Homo sapiens
tgcaagattttttttttaagtga

SEQ ID NO: 6463825 - DNA, 15 bp, Homo sapiens
tgcaagcaaagaacc

SEQ ID NO: 6463826 - DNA, 15 bp, Homo sapiens
tgcaagcacagccct

SEQ ID NO: 6463827 - DNA, 13 bp, Homo sapiens
tgcaagcagagga

SEQ ID NO: 6463828 - DNA, 15 bp, Homo sapiens
tgcaagcagaggacc

SEQ ID NO: 6463829 - DNA, 21 bp, Homo sapiens
tgcaagcagaggaccagggcc

SEQ ID NO: 6463830 - DNA, 18 bp, Homo sapiens
tgcaagcagcctcctggg

SEQ ID NO: 6463831 - DNA, 20 bp, Homo sapiens
tgcaagcagggctctgcccc

SEQ ID NO: 6463832 - DNA, 15 bp, Homo sapiens
tgcaagcagtttcaa

SEQ ID NO: 6463833 - DNA, 21 bp, Homo sapiens
tgcaagcagtttcaataaagt

SEQ ID NO: 6463834 - DNA, 15 bp, Homo sapiens
tgcaagccagatttt

SEQ ID NO: 6463835 - DNA, 21 bp, Homo sapiens
tgcaagccagattttcctgaa

SEQ ID NO: 6463836 - DNA, 18 bp, Homo sapiens
tgcaagccagcttcctgt

SEQ ID NO: 6463837 - DNA, 22 bp, Homo sapiens
tgcaagccagcttcctgtgcag

SEQ ID NO: 6463838 - DNA, 23 bp, Homo sapiens
tgcaagccagcttcctgtgcaga

SEQ ID NO: 6463839 - DNA, 15 bp, Homo sapiens
tgcaagccataacgt

SEQ ID NO: 6463840 - DNA, 22 bp, Homo sapiens
tgcaagccataacgtgccccca

SEQ ID NO: 6463841 - DNA, 23 bp, Homo sapiens
tgcaagccataacgtgcccccag

SEQ ID NO: 6463842 - DNA, 20 bp, Homo sapiens
tgcaagccccaactttctta

SEQ ID NO: 6463843 - DNA, 21 bp, Homo sapiens
tgcaagccccaactttcttat

SEQ ID NO: 6463844 - DNA, 16 bp, Homo sapiens
tgcaagccccagggcc

SEQ ID NO: 6463845 - DNA, 19 bp, Homo sapiens
tgcaagccccagggcctgg

SEQ ID NO: 6463846 - DNA, 20 bp, Homo sapiens
tgcaagccccagggcctggg

SEQ ID NO: 6463847 - DNA, 19 bp, Homo sapiens
tgcaagcccctctttctgt

SEQ ID NO: 6463848 - DNA, 14 bp, Homo sapiens
tgcaagcctgcgtt

SEQ ID NO: 6463849 - DNA, 19 bp, Homo sapiens
tgcaagcctgtctgagact

SEQ ID NO: 6463850 - DNA, 13 bp, Homo sapiens
tgcaagctccagt

SEQ ID NO: 6463851 - DNA, 19 bp, Homo sapiens
tgcaagctccagtagctcc

SEQ ID NO: 6463852 - DNA, 21 bp, Homo sapiens
tgcaagctccagtagctccgc

SEQ ID NO: 6463853 - DNA, 13 bp, Homo sapiens
tgcaagctccgcc

SEQ ID NO: 6463854 - DNA, 14 bp, Homo sapiens
tgcaagctctgcct

SEQ ID NO: 6463855 - DNA, 21 bp, Homo sapiens
tgcaagctctggaattgttga

SEQ ID NO: 6463856 - DNA, 13 bp, Homo sapiens
tgcaagctgcttg

SEQ ID NO: 6463857 - DNA, 20 bp, Homo sapiens
tgcaagctgtccagagaaaa

SEQ ID NO: 6463858 - DNA, 15 bp, Homo sapiens
tgcaagcttcttgct

SEQ ID NO: 6463859 - DNA, 19 bp, Homo sapiens
tgcaaggaagccacagctg

SEQ ID NO: 6463860 - DNA, 19 bp, Homo sapiens
tgcaaggaaggaaagaaag

SEQ ID NO: 6463861 - DNA, 23 bp, Homo sapiens
tgcaaggacaagcaattagaagc

SEQ ID NO: 6463862 - DNA, 21 bp, Homo sapiens
tgcaaggactcccggagcctg

SEQ ID NO: 6463863 - DNA, 19 bp, Homo sapiens
tgcaaggatttttccatgt

SEQ ID NO: 6463864 - DNA, 18 bp, Homo sapiens
tgcaaggattttttaaaa

SEQ ID NO: 6463865 - DNA, 14 bp, Homo sapiens
tgcaaggcaaatgt

SEQ ID NO: 6463866 - DNA, 18 bp, Homo sapiens
tgcaaggcagccgtgggc

SEQ ID NO: 6463867 - DNA, 14 bp, Homo sapiens
tgcaaggcccacag

SEQ ID NO: 6463868 - DNA, 16 bp, Homo sapiens
tgcaaggcccacagga

SEQ ID NO: 6463869 - DNA, 21 bp, Homo sapiens
tgcaaggcctggtgtttcttg

SEQ ID NO: 6463870 - DNA, 18 bp, Homo sapiens
tgcaagggaagagccttt

SEQ ID NO: 6463871 - DNA, 18 bp, Homo sapiens
tgcaaggggaaaatctca

SEQ ID NO: 6463872 - DNA, 17 bp, Homo sapiens
tgcaaggggaaacctgt

SEQ ID NO: 6463873 - DNA, 13 bp, Homo sapiens
tgcaaggggctca

SEQ ID NO: 6463874 - DNA, 16 bp, Homo sapiens
tgcaaggtaaaatttt

SEQ ID NO: 6463875 - DNA, 16 bp, Homo sapiens
tgcaaggtactctggt

SEQ ID NO: 6463876 - DNA, 18 bp, Homo sapiens
tgcaaggtactctggtga

SEQ ID NO: 6463877 - DNA, 15 bp, Homo sapiens
tgcaaggtcattttt

SEQ ID NO: 6463878 - DNA, 16 bp, Homo sapiens
tgcaaggtgcacctgc

SEQ ID NO: 6463879 - DNA, 18 bp, Homo sapiens
tgcaaggtggcctctgcc

SEQ ID NO: 6463880 - DNA, 19 bp, Homo sapiens
tgcaaggtggcctctgcct

SEQ ID NO: 6463881 - DNA, 23 bp, Homo sapiens
tgcaaggtttaggctggtggccc

SEQ ID NO: 6463882 - DNA, 22 bp, Homo sapiens
tgcaagtatgtgagtgtgtcca

SEQ ID NO: 6463883 - DNA, 17 bp, Homo sapiens
tgcaagtcacaaaggaa

SEQ ID NO: 6463884 - DNA, 23 bp, Homo sapiens
tgcaagtcactaaatttctcagt

SEQ ID NO: 6463885 - DNA, 15 bp, Homo sapiens
tgcaagtcagaggat

SEQ ID NO: 6463886 - DNA, 16 bp, Homo sapiens
tgcaagtcagaggatg

SEQ ID NO: 6463887 - DNA, 17 bp, Homo sapiens
tgcaagtcatacttagg

SEQ ID NO: 6463888 - DNA, 17 bp, Homo sapiens
tgcaagtccttttgtaa

SEQ ID NO: 6463889 - DNA, 13 bp, Homo sapiens
tgcaagtctgtgg

SEQ ID NO: 6463890 - DNA, 14 bp, Homo sapiens
tgcaagtgctcagg

SEQ ID NO: 6463891 - DNA, 16 bp, Homo sapiens
tgcaagtgctcaggga

SEQ ID NO: 6463892 - DNA, 17 bp, Homo sapiens
tgcaagtgctcagggaa

SEQ ID NO: 6463893 - DNA, 22 bp, Homo sapiens
tgcaagtggacgtgggctccag

SEQ ID NO: 6463894 - DNA, 23 bp, Homo sapiens
tgcaagtggacgtgggctccagg

SEQ ID NO: 6463895 - DNA, 17 bp, Homo sapiens
tgcaagtggagctgtct

SEQ ID NO: 6463896 - DNA, 18 bp, Homo sapiens
tgcaagtggagctgtctg

SEQ ID NO: 6463897 - DNA, 21 bp, Homo sapiens
tgcaagtggtagcaagaagtg

SEQ ID NO: 6463898 - DNA, 16 bp, Homo sapiens
tgcaagtgtctggagc

SEQ ID NO: 6463899 - DNA, 19 bp, Homo sapiens
tgcaagtgtctggagcggc

SEQ ID NO: 6463900 - DNA, 22 bp, Homo sapiens
tgcaagtgtctggagcggctgc

SEQ ID NO: 6463901 - DNA, 17 bp, Homo sapiens
tgcaagtgtctgtgtgc

SEQ ID NO: 6463902 - DNA, 18 bp, Homo sapiens
tgcaagtgtctgtgtgca

SEQ ID NO: 6463903 - DNA, 14 bp, Homo sapiens
tgcaagtgtgcatg

SEQ ID NO: 6463904 - DNA, 16 bp, Homo sapiens
tgcaagtgtgcatggc

SEQ ID NO: 6463905 - DNA, 19 bp, Homo sapiens
tgcaagtgtgtatgtgcgt

SEQ ID NO: 6463906 - DNA, 18 bp, Homo sapiens
tgcaagtgtgtgcatgtg

SEQ ID NO: 6463907 - DNA, 14 bp, Homo sapiens
tgcaagtgtttctg

SEQ ID NO: 6463908 - DNA, 23 bp, Homo sapiens
tgcaagttatattagtgaagatg

SEQ ID NO: 6463909 - DNA, 17 bp, Homo sapiens
tgcaagttatgaaatat

SEQ ID NO: 6463910 - DNA, 19 bp, Homo sapiens
tgcaagttgaggacttctt

SEQ ID NO: 6463911 - DNA, 16 bp, Homo sapiens
tgcaagttgctctgac

SEQ ID NO: 6463912 - DNA, 16 bp, Homo sapiens
tgcaagtttatcagta

SEQ ID NO: 6463913 - DNA, 19 bp, Homo sapiens
tgcaataaaaaagtgagct

SEQ ID NO: 6463914 - DNA, 16 bp, Homo sapiens
tgcaataaaataacag

SEQ ID NO: 6463915 - DNA, 13 bp, Homo sapiens
tgcaataaaatag

SEQ ID NO: 6463916 - DNA, 15 bp, Homo sapiens
tgcaataaaatagta

SEQ ID NO: 6463917 - DNA, 17 bp, Homo sapiens
tgcaataaaatgggttt

SEQ ID NO: 6463918 - DNA, 21 bp, Homo sapiens
tgcaataaaatgggttttact

SEQ ID NO: 6463919 - DNA, 16 bp, Homo sapiens
tgcaataaactcagtc

SEQ ID NO: 6463920 - DNA, 22 bp, Homo sapiens
tgcaataaactcagtcaaatgt

SEQ ID NO: 6463921 - DNA, 14 bp, Homo sapiens
tgcaataaagagta

SEQ ID NO: 6463922 - DNA, 17 bp, Homo sapiens
tgcaataaagagtaaat

SEQ ID NO: 6463923 - DNA, 22 bp, Homo sapiens
tgcaataaagagtaaatatact

SEQ ID NO: 6463924 - DNA, 23 bp, Homo sapiens
tgcaataaagagtaaatatactt

SEQ ID NO: 6463925 - DNA, 15 bp, Homo sapiens
tgcaataaagtataa

SEQ ID NO: 6463926 - DNA, 12 bp, Homo sapiens
tgcaataaatat

SEQ ID NO: 6463927 - DNA, 17 bp, Homo sapiens
tgcaataacaagcatgc

SEQ ID NO: 6463928 - DNA, 12 bp, Homo sapiens
tgcaataacagc

SEQ ID NO: 6463929 - DNA, 20 bp, Homo sapiens
tgcaataacagttttaagat

SEQ ID NO: 6463930 - DNA, 16 bp, Homo sapiens
tgcaataactctggga

SEQ ID NO: 6463931 - DNA, 18 bp, Homo sapiens
tgcaataacttctgacct

SEQ ID NO: 6463932 - DNA, 19 bp, Homo sapiens
tgcaataacttctgacctt

SEQ ID NO: 6463933 - DNA, 20 bp, Homo sapiens
tgcaataagattggtgttcg

SEQ ID NO: 6463934 - DNA, 21 bp, Homo sapiens
tgcaataaggatttattctca

SEQ ID NO: 6463935 - DNA, 17 bp, Homo sapiens
tgcaataataataaatt

SEQ ID NO: 6463936 - DNA, 20 bp, Homo sapiens
tgcaataatccacccccagg

SEQ ID NO: 6463937 - DNA, 20 bp, Homo sapiens
tgcaataatgatcaaagttt

SEQ ID NO: 6463938 - DNA, 20 bp, Homo sapiens
tgcaataatgcagtatggta

SEQ ID NO: 6463939 - DNA, 15 bp, Homo sapiens
tgcaataatgtgcaa

SEQ ID NO: 6463940 - DNA, 16 bp, Homo sapiens
tgcaataatttgtaca

SEQ ID NO: 6463941 - DNA, 18 bp, Homo sapiens
tgcaataatttgtacaat

SEQ ID NO: 6463942 - DNA, 22 bp, Homo sapiens
tgcaataatttgtacaatggtt

SEQ ID NO: 6463943 - DNA, 12 bp, Homo sapiens
tgcaataatttt

SEQ ID NO: 6463944 - DNA, 16 bp, Homo sapiens
tgcaatacattgttca

SEQ ID NO: 6463945 - DNA, 20 bp, Homo sapiens
tgcaatacatttcttccttc

SEQ ID NO: 6463946 - DNA, 23 bp, Homo sapiens
tgcaatactaacgaccgacgccc

SEQ ID NO: 6463947 - DNA, 13 bp, Homo sapiens
tgcaatagaaata

SEQ ID NO: 6463948 - DNA, 16 bp, Homo sapiens
tgcaatagagactgta

SEQ ID NO: 6463949 - DNA, 19 bp, Homo sapiens
tgcaatagagactgtagat

SEQ ID NO: 6463950 - DNA, 18 bp, Homo sapiens
tgcaatagattactgatg

SEQ ID NO: 6463951 - DNA, 20 bp, Homo sapiens
tgcaatagattactgatgtg

SEQ ID NO: 6463952 - DNA, 19 bp, Homo sapiens
tgcaatagcagttataaca

SEQ ID NO: 6463953 - DNA, 22 bp, Homo sapiens
tgcaatagtcagagtgtccctt

SEQ ID NO: 6463954 - DNA, 19 bp, Homo sapiens
tgcaatataaaaatgtgaa

SEQ ID NO: 6463955 - DNA, 16 bp, Homo sapiens
tgcaatataacattct

SEQ ID NO: 6463956 - DNA, 20 bp, Homo sapiens
tgcaatatactggaaagctt

SEQ ID NO: 6463957 - DNA, 18 bp, Homo sapiens
tgcaatatatctaaattg

SEQ ID NO: 6463958 - DNA, 19 bp, Homo sapiens
tgcaatatatctaaattga

SEQ ID NO: 6463959 - DNA, 21 bp, Homo sapiens
tgcaatatattttgtatgcaa

SEQ ID NO: 6463960 - DNA, 14 bp, Homo sapiens
tgcaatatgagggg

SEQ ID NO: 6463961 - DNA, 21 bp, Homo sapiens
tgcaatatgaggggactgcat

SEQ ID NO: 6463962 - DNA, 15 bp, Homo sapiens
tgcaatatgcctagt

SEQ ID NO: 6463963 - DNA, 19 bp, Homo sapiens
tgcaatatgtaacatgtct

SEQ ID NO: 6463964 - DNA, 14 bp, Homo sapiens
tgcaatattccttt

SEQ ID NO: 6463965 - DNA, 23 bp, Homo sapiens
tgcaatatttattacacaaagaa

SEQ ID NO: 6463966 - DNA, 22 bp, Homo sapiens
tgcaatattttaaatattgtat

SEQ ID NO: 6463967 - DNA, 13 bp, Homo sapiens
tgcaatcactgtg

SEQ ID NO: 6463968 - DNA, 17 bp, Homo sapiens
tgcaatcactgtgctat

SEQ ID NO: 6463969 - DNA, 22 bp, Homo sapiens
tgcaatcatatgtgatctgtct

SEQ ID NO: 6463970 - DNA, 23 bp, Homo sapiens
tgcaatcatatgtgatctgtctt

SEQ ID NO: 6463971 - DNA, 15 bp, Homo sapiens
tgcaatccaggctgt

SEQ ID NO: 6463972 - DNA, 20 bp, Homo sapiens
tgcaatccaggctgttctca

SEQ ID NO: 6463973 - DNA, 16 bp, Homo sapiens
tgcaatccatttattt

SEQ ID NO: 6463974 - DNA, 15 bp, Homo sapiens
tgcaatcccttaata

SEQ ID NO: 6463975 - DNA, 12 bp, Homo sapiens
tgcaatccttac

SEQ ID NO: 6463976 - DNA, 14 bp, Homo sapiens
tgcaatccttacaa

SEQ ID NO: 6463977 - DNA, 19 bp, Homo sapiens
tgcaatctaatctgaactg

SEQ ID NO: 6463978 - DNA, 15 bp, Homo sapiens
tgcaatctactggaa

SEQ ID NO: 6463979 - DNA, 19 bp, Homo sapiens
tgcaatctgtccagacaag

SEQ ID NO: 6463980 - DNA, 16 bp, Homo sapiens
tgcaatcttatgttga

SEQ ID NO: 6463981 - DNA, 21 bp, Homo sapiens
tgcaatgaaaagaaaatgtgc

SEQ ID NO: 6463982 - DNA, 15 bp, Homo sapiens
tgcaatgaaagtcaa

SEQ ID NO: 6463983 - DNA, 19 bp, Homo sapiens
tctaaccagagcaagcttt

SEQ ID NO: 6463984 - DNA, 13 bp, Homo sapiens
tctaaccagtgat

SEQ ID NO: 6463985 - DNA, 13 bp, Homo sapiens
tctaaccattcaa

SEQ ID NO: 6463986 - DNA, 20 bp, Homo sapiens
tctaaccattctgtattgat

SEQ ID NO: 6463987 - DNA, 19 bp, Homo sapiens
tctaaccccaggttttctg

SEQ ID NO: 6463988 - DNA, 22 bp, Homo sapiens
tctaaccccctctgctctgtcc

SEQ ID NO: 6463989 - DNA, 19 bp, Homo sapiens
tctaaccccttacccatct

SEQ ID NO: 6463990 - DNA, 12 bp, Homo sapiens
tctaaccctgtg

SEQ ID NO: 6463991 - DNA, 16 bp, Homo sapiens
tctaaccctgtggaag

SEQ ID NO: 6463992 - DNA, 12 bp, Homo sapiens
tctaacctcagc

SEQ ID NO: 6463993 - DNA, 13 bp, Homo sapiens
tctaacctcatct

SEQ ID NO: 6463994 - DNA, 18 bp, Homo sapiens
tctaacctcatcttcttc

SEQ ID NO: 6463995 - DNA, 14 bp, Homo sapiens
tctaacctgtgacc

SEQ ID NO: 6463996 - DNA, 12 bp, Homo sapiens
tctaaccttgaa

SEQ ID NO: 6463997 - DNA, 18 bp, Homo sapiens
tctaaccttgaatgctgc

SEQ ID NO: 6463998 - DNA, 19 bp, Homo sapiens
tctaaccttgaatgctgcc

SEQ ID NO: 6463999 - DNA, 20 bp, Homo sapiens
tctaaccttgaatgctgcca

SEQ ID NO: 6464000 - DNA, 22 bp, Homo sapiens
tctaaccttgaatgctgccagt

SEQ ID NO: 6464001 - DNA, 14 bp, Homo sapiens
tctaacctttacat

SEQ ID NO: 6464002 - DNA, 16 bp, Homo sapiens
tctaacctttacatga

SEQ ID NO: 6464003 - DNA, 22 bp, Homo sapiens
tctaacctttacatgaggactc

SEQ ID NO: 6464004 - DNA, 14 bp, Homo sapiens
tctaacctttctaa

SEQ ID NO: 6464005 - DNA, 16 bp, Homo sapiens
tctaacgccagcacac

SEQ ID NO: 6464006 - DNA, 14 bp, Homo sapiens
tctaactaaactaa

SEQ ID NO: 6464007 - DNA, 17 bp, Homo sapiens
tctaactacaaaggttt

SEQ ID NO: 6464008 - DNA, 15 bp, Homo sapiens
tctaactacaaggac

SEQ ID NO: 6464009 - DNA, 15 bp, Homo sapiens
tctaactcagaaaca

SEQ ID NO: 6464010 - DNA, 13 bp, Homo sapiens
tctaactcagcaa

SEQ ID NO: 6464011 - DNA, 11 bp, Homo sapiens
tctaactcatt

SEQ ID NO: 6464012 - DNA, 23 bp, Homo sapiens
tctaactcccccattttacagat

SEQ ID NO: 6464013 - DNA, 15 bp, Homo sapiens
tctaactccctcctc

SEQ ID NO: 6464014 - DNA, 15 bp, Homo sapiens
tctaactcctgccat

SEQ ID NO: 6464015 - DNA, 20 bp, Homo sapiens
tctaactctgtccttacata

SEQ ID NO: 6464016 - DNA, 17 bp, Homo sapiens
tctaactcttctggaaa

SEQ ID NO: 6464017 - DNA, 22 bp, Homo sapiens
tctaactgatgagtaaactgag

SEQ ID NO: 6464018 - DNA, 16 bp, Homo sapiens
tctaactgtaaatcac

SEQ ID NO: 6464019 - DNA, 23 bp, Homo sapiens
tctaactgtaaatcacttgtaaa

SEQ ID NO: 6464020 - DNA, 16 bp, Homo sapiens
tctaactgtggaatat

SEQ ID NO: 6464021 - DNA, 20 bp, Homo sapiens
tctaactgtggaatataaat

SEQ ID NO: 6464022 - DNA, 21 bp, Homo sapiens
tctaactgtggaatataaata

SEQ ID NO: 6464023 - DNA, 24 bp, Homo sapiens
tctaactgtggaatataaatagct

SEQ ID NO: 6464024 - DNA, 22 bp, Homo sapiens
tctaactgttgttactggaaga

SEQ ID NO: 6464025 - DNA, 13 bp, Homo sapiens
tctaacttattta

SEQ ID NO: 6464026 - DNA, 15 bp, Homo sapiens
tctaacttcaccata

SEQ ID NO: 6464027 - DNA, 15 bp, Homo sapiens
tctaactttattctt

SEQ ID NO: 6464028 - DNA, 17 bp, Homo sapiens
tctaactttattctttg

SEQ ID NO: 6464029 - DNA, 14 bp, Homo sapiens
tctaagaaaagaga

SEQ ID NO: 6464030 - DNA, 13 bp, Homo sapiens
tctaagaaaagca

SEQ ID NO: 6464031 - DNA, 14 bp, Homo sapiens
tctaagaaaatgta

SEQ ID NO: 6464032 - DNA, 13 bp, Homo sapiens
tctaagaaacatt

SEQ ID NO: 6464033 - DNA, 18 bp, Homo sapiens
tctaagaaacattggaag

SEQ ID NO: 6464034 - DNA, 23 bp, Homo sapiens
tctaagaaacattggaagcaggt

SEQ ID NO: 6464035 - DNA, 17 bp, Homo sapiens
tctaagaaacatttata

SEQ ID NO: 6464036 - DNA, 22 bp, Homo sapiens
tctaagaaacatttatattgat

SEQ ID NO: 6464037 - DNA, 23 bp, Homo sapiens
tctaagaaatatctgtgaaatat

SEQ ID NO: 6464038 - DNA, 21 bp, Homo sapiens
tctaagaaatggctttccaca

SEQ ID NO: 6464039 - DNA, 16 bp, Homo sapiens
tctaagaaattgaata

SEQ ID NO: 6464040 - DNA, 15 bp, Homo sapiens
tctaagaagacattt

SEQ ID NO: 6464041 - DNA, 18 bp, Homo sapiens
tctaagaagacattttgt

SEQ ID NO: 6464042 - DNA, 23 bp, Homo sapiens
tctaagaagttactttttgtaga

SEQ ID NO: 6464043 - DNA, 14 bp, Homo sapiens
tctaagaattcagt

SEQ ID NO: 6464044 - DNA, 14 bp, Homo sapiens
tctaagaatttaga

SEQ ID NO: 6464045 - DNA, 20 bp, Homo sapiens
tctaagaatttctgctaaat

SEQ ID NO: 6464046 - DNA, 21 bp, Homo sapiens
tctaagacaaatgcagtgtat

SEQ ID NO: 6464047 - DNA, 22 bp, Homo sapiens
tctaagacattcaccaacaaca

SEQ ID NO: 6464048 - DNA, 16 bp, Homo sapiens
tctaagactatatata

SEQ ID NO: 6464049 - DNA, 16 bp, Homo sapiens
tctaagactcaaatgt

SEQ ID NO: 6464050 - DNA, 18 bp, Homo sapiens
tctaagactcaaatgttc

SEQ ID NO: 6464051 - DNA, 19 bp, Homo sapiens
tctaagactcaaatgttct

SEQ ID NO: 6464052 - DNA, 22 bp, Homo sapiens
tctaagactcaaatgttctaag

SEQ ID NO: 6464053 - DNA, 18 bp, Homo sapiens
tctaagactctgtgtggc

SEQ ID NO: 6464054 - DNA, 23 bp, Homo sapiens
tctaagagaaggcctttaataaa

SEQ ID NO: 6464055 - DNA, 12 bp, Homo sapiens
tctaagagaagt

SEQ ID NO: 6464056 - DNA, 20 bp, Homo sapiens
tctaagagcgaacttcacat

SEQ ID NO: 6464057 - DNA, 14 bp, Homo sapiens
tctaagatacactg

SEQ ID NO: 6464058 - DNA, 21 bp, Homo sapiens
tctaagatacatatactgatt

SEQ ID NO: 6464059 - DNA, 15 bp, Homo sapiens
tctaagatcttagat

SEQ ID NO: 6464060 - DNA, 21 bp, Homo sapiens
tctaagatcttagattctctg

SEQ ID NO: 6464061 - DNA, 16 bp, Homo sapiens
tctaagatcttgcctc

SEQ ID NO: 6464062 - DNA, 14 bp, Homo sapiens
tctaagatgattca

SEQ ID NO: 6464063 - DNA, 19 bp, Homo sapiens
tctaagatgattcaaagta

SEQ ID NO: 6464064 - DNA, 12 bp, Homo sapiens
tctaagatgtga

SEQ ID NO: 6464065 - DNA, 18 bp, Homo sapiens
tctaagatgtgatattct

SEQ ID NO: 6464066 - DNA, 12 bp, Homo sapiens
tctaagatgtta

SEQ ID NO: 6464067 - DNA, 22 bp, Homo sapiens
tctaagatgttatatttttctt

SEQ ID NO: 6464068 - DNA, 23 bp, Homo sapiens
tctaagatgttatatttttctta

SEQ ID NO: 6464069 - DNA, 19 bp, Homo sapiens
tctaagattctaaaggtcc

SEQ ID NO: 6464070 - DNA, 17 bp, Homo sapiens
tctaagattctaatgat

SEQ ID NO: 6464071 - DNA, 19 bp, Homo sapiens
tctaagattctaatgatga

SEQ ID NO: 6464072 - DNA, 16 bp, Homo sapiens
tctaagattgtacata

SEQ ID NO: 6464073 - DNA, 14 bp, Homo sapiens
tctaagatttggtt

SEQ ID NO: 6464074 - DNA, 24 bp, Homo sapiens
tctaagcaagtgagtctggtggag

SEQ ID NO: 6464075 - DNA, 16 bp, Homo sapiens
tctaagcaatgcaaat

SEQ ID NO: 6464076 - DNA, 13 bp, Homo sapiens
tctaagcagaaga

SEQ ID NO: 6464077 - DNA, 20 bp, Homo sapiens
tctaagcagttttgtaaatg

SEQ ID NO: 6464078 - DNA, 18 bp, Homo sapiens
tctaagcatgtagccagt

SEQ ID NO: 6464079 - DNA, 14 bp, Homo sapiens
tctaagcattccac

SEQ ID NO: 6464080 - DNA, 22 bp, Homo sapiens
tctaagccaactttaattgctt

SEQ ID NO: 6464081 - DNA, 13 bp, Homo sapiens
tctaagcccagga

SEQ ID NO: 6464082 - DNA, 23 bp, Homo sapiens
tctaagcctggcttagaaggcac

SEQ ID NO: 6464083 - DNA, 18 bp, Homo sapiens
tctaagcctttccataag

SEQ ID NO: 6464084 - DNA, 17 bp, Homo sapiens
tctaagcctttgagact

SEQ ID NO: 6464085 - DNA, 17 bp, Homo sapiens
tctaagcgtgctgacat

SEQ ID NO: 6464086 - DNA, 15 bp, Homo sapiens
tctaagctcagtgct

SEQ ID NO: 6464087 - DNA, 14 bp, Homo sapiens
tctaagctgcagct

SEQ ID NO: 6464088 - DNA, 18 bp, Homo sapiens
tctaagctgcagcttcct

SEQ ID NO: 6464089 - DNA, 15 bp, Homo sapiens
tctaagctggagctc

SEQ ID NO: 6464090 - DNA, 17 bp, Homo sapiens
tctaagctggagctctt

SEQ ID NO: 6464091 - DNA, 12 bp, Homo sapiens
tctaagctgtgt

SEQ ID NO: 6464092 - DNA, 15 bp, Homo sapiens
tctaagctgtgtgca

SEQ ID NO: 6464093 - DNA, 12 bp, Homo sapiens
tctaagctgttt

SEQ ID NO: 6464094 - DNA, 15 bp, Homo sapiens
tctaaggaatgatcc

SEQ ID NO: 6464095 - DNA, 19 bp, Homo sapiens
tctaaggaattatttcaca

SEQ ID NO: 6464096 - DNA, 14 bp, Homo sapiens
tctaaggacccaaa

SEQ ID NO: 6464097 - DNA, 15 bp, Homo sapiens
tctaaggagcaaata

SEQ ID NO: 6464098 - DNA, 19 bp, Homo sapiens
tctaaggagcgctagtgcc

SEQ ID NO: 6464099 - DNA, 18 bp, Homo sapiens
tctaaggcatgctcccag

SEQ ID NO: 6464100 - DNA, 21 bp, Homo sapiens
tctaaggccaaggcctcagga

SEQ ID NO: 6464101 - DNA, 21 bp, Homo sapiens
tctaaggcctaggattctaaa

SEQ ID NO: 6464102 - DNA, 22 bp, Homo sapiens
tctaaggcctaggattctaaaa

SEQ ID NO: 6464103 - DNA, 20 bp, Homo sapiens
tctaaggctctgagagtcta

SEQ ID NO: 6464104 - DNA, 16 bp, Homo sapiens
tctaaggtactgtggg

SEQ ID NO: 6464105 - DNA, 20 bp, Homo sapiens
tctaaggtccggtgttctaa

SEQ ID NO: 6464106 - DNA, 22 bp, Homo sapiens
tctaaggtccggtgttctaaga

SEQ ID NO: 6464107 - DNA, 18 bp, Homo sapiens
tctaaggttctcatagga

SEQ ID NO: 6464108 - DNA, 19 bp, Homo sapiens
tctaagtaaaaccacagca

SEQ ID NO: 6464109 - DNA, 20 bp, Homo sapiens
tctaagtaaaaccacagcag

SEQ ID NO: 6464110 - DNA, 14 bp, Homo sapiens
tctaagtaaataca

SEQ ID NO: 6464111 - DNA, 16 bp, Homo sapiens
tctaagtaaatacaat

SEQ ID NO: 6464112 - DNA, 20 bp, Homo sapiens
tctaagtaatggttaagttt

SEQ ID NO: 6464113 - DNA, 23 bp, Homo sapiens
tctaagtacctttcctacatttt

SEQ ID NO: 6464114 - DNA, 23 bp, Homo sapiens
tctaagtagagtatattgaaaag

SEQ ID NO: 6464115 - DNA, 19 bp, Homo sapiens
tctaagtagggccagggca

SEQ ID NO: 6464116 - DNA, 21 bp, Homo sapiens
tctaagtatttaaatgttcta

SEQ ID NO: 6464117 - DNA, 22 bp, Homo sapiens
tctaagtcaaacacttgtgact

SEQ ID NO: 6464118 - DNA, 15 bp, Homo sapiens
tctaagtcatgtatg

SEQ ID NO: 6464119 - DNA, 19 bp, Homo sapiens
tctaagtcgtgcactttct

SEQ ID NO: 6464120 - DNA, 15 bp, Homo sapiens
tctaagtctgttatt

SEQ ID NO: 6464121 - DNA, 19 bp, Homo sapiens
tctaagtctgttattgttt

SEQ ID NO: 6464122 - DNA, 13 bp, Homo sapiens
tctaagtctttcc

SEQ ID NO: 6464123 - DNA, 18 bp, Homo sapiens
tctaagtgcctcacattt

SEQ ID NO: 6464124 - DNA, 16 bp, Homo sapiens
tctaagtgctgctgtg

SEQ ID NO: 6464125 - DNA, 18 bp, Homo sapiens
tctaagtgtaacctcagt

SEQ ID NO: 6464126 - DNA, 14 bp, Homo sapiens
tctaagtgtttcac

SEQ ID NO: 6464127 - DNA, 14 bp, Homo sapiens
tctaagttaattta

SEQ ID NO: 6464128 - DNA, 18 bp, Homo sapiens
tctaagttaatttaaagt

SEQ ID NO: 6464129 - DNA, 16 bp, Homo sapiens
tctaagttataagact

SEQ ID NO: 6464130 - DNA, 22 bp, Homo sapiens
tctaagttataagactctcaca

SEQ ID NO: 6464131 - DNA, 19 bp, Homo sapiens
tctaagttatgactgtgaa

SEQ ID NO: 6464132 - DNA, 15 bp, Homo sapiens
tctaagttatgtacg

SEQ ID NO: 6464133 - DNA, 16 bp, Homo sapiens
tctaagtttctaagat

SEQ ID NO: 6464134 - DNA, 18 bp, Homo sapiens
tctaagtttctaagattc

SEQ ID NO: 6464135 - DNA, 20 bp, Homo sapiens
tctaagtttctaagattcta

SEQ ID NO: 6464136 - DNA, 22 bp, Homo sapiens
tctaagttttagggtacatgtg

SEQ ID NO: 6464137 - DNA, 12 bp, Homo sapiens
tctaagttttgt

SEQ ID NO: 6464138 - DNA, 11 bp, Homo sapiens
tctaataaact

SEQ ID NO: 6464139 - DNA, 12 bp, Homo sapiens
tctaataaactt

SEQ ID NO: 6464140 - DNA, 13 bp, Homo sapiens
tctaataaacttt

SEQ ID NO: 6464141 - DNA, 15 bp, Homo sapiens
tctaataaactttat

SEQ ID NO: 6464142 - DNA, 20 bp, Homo sapiens
tctaataaagccatttctta

SEQ ID NO: 6464143 - DNA, 20 bp, Homo sapiens
tctaataaagctcctctgct

SEQ ID NO: 6464144 - DNA, 21 bp, Homo sapiens
tctaataaatatactatgaaa

SEQ ID NO: 6464145 - DNA, 23 bp, Homo sapiens
tctaataaatattgacttctctt

SEQ ID NO: 6464146 - DNA, 14 bp, Homo sapiens
tctaataaattata

SEQ ID NO: 6464147 - DNA, 15 bp, Homo sapiens
tctaataataaatag

SEQ ID NO: 6464148 - DNA, 17 bp, Homo sapiens
tctaataatttctaatg

SEQ ID NO: 6464149 - DNA, 16 bp, Homo sapiens
tctaatacctctgtgt

SEQ ID NO: 6464150 - DNA, 20 bp, Homo sapiens
tctaatacctctgtgtgctc

SEQ ID NO: 6464151 - DNA, 22 bp, Homo sapiens
tctaatactttgtttattgtaa

SEQ ID NO: 6464152 - DNA, 19 bp, Homo sapiens
tctaatagaactcagtttt

SEQ ID NO: 6464153 - DNA, 22 bp, Homo sapiens
tctaatagaactcagttttaac

SEQ ID NO: 6464154 - DNA, 16 bp, Homo sapiens
tctaatagaggcagtg

SEQ ID NO: 6464155 - DNA, 16 bp, Homo sapiens
tctaatagggcaatta

SEQ ID NO: 6464156 - DNA, 22 bp, Homo sapiens
tctaataggtactgccatattt

SEQ ID NO: 6464157 - DNA, 12 bp, Homo sapiens
tctaatagtctt

SEQ ID NO: 6464158 - DNA, 14 bp, Homo sapiens
tctaatatcagcaa

SEQ ID NO: 6464159 - DNA, 20 bp, Homo sapiens
tctaatatcccagaaaaagt

SEQ ID NO: 6464160 - DNA, 17 bp, Homo sapiens
tctaatattaaaaatat

SEQ ID NO: 6464161 - DNA, 13 bp, Homo sapiens
tctaatattagtt

SEQ ID NO: 6464162 - DNA, 22 bp, Homo sapiens
tgcaatgaagtctctgaagtga

SEQ ID NO: 6464163 - DNA, 21 bp, Homo sapiens
tgcaatgacacagtcttggct

SEQ ID NO: 6464164 - DNA, 16 bp, Homo sapiens
tgcaatgacatcttca

SEQ ID NO: 6464165 - DNA, 13 bp, Homo sapiens
tgcaatgaccttt

SEQ ID NO: 6464166 - DNA, 19 bp, Homo sapiens
tgcaatgacctttcaatag

SEQ ID NO: 6464167 - DNA, 23 bp, Homo sapiens
tgcaatgacctttcaataggaaa

SEQ ID NO: 6464168 - DNA, 16 bp, Homo sapiens
tgcaatgagccaagat

SEQ ID NO: 6464169 - DNA, 15 bp, Homo sapiens
tgcaatgataaataa

SEQ ID NO: 6464170 - DNA, 18 bp, Homo sapiens
tgcaatgcatctgaaagt

SEQ ID NO: 6464171 - DNA, 13 bp, Homo sapiens
tgcaatgccccct

SEQ ID NO: 6464172 - DNA, 17 bp, Homo sapiens
tgcaatgcgtcttgtga

SEQ ID NO: 6464173 - DNA, 22 bp, Homo sapiens
tgcaatgcgtcttgtgaaattg

SEQ ID NO: 6464174 - DNA, 19 bp, Homo sapiens
tgcaatgcttctgtagctt

SEQ ID NO: 6464175 - DNA, 15 bp, Homo sapiens
tgcaatggaatataa

SEQ ID NO: 6464176 - DNA, 16 bp, Homo sapiens
tgcaatggcagccttg

SEQ ID NO: 6464177 - DNA, 17 bp, Homo sapiens
tgcaatgggatgtatga

SEQ ID NO: 6464178 - DNA, 22 bp, Homo sapiens
tgcaatgggatgtatgaataca

SEQ ID NO: 6464179 - DNA, 15 bp, Homo sapiens
tgcaatgggcactgg

SEQ ID NO: 6464180 - DNA, 24 bp, Homo sapiens
tgcaatgtatcccttctcacagca

SEQ ID NO: 6464181 - DNA, 22 bp, Homo sapiens
tgcaatgtatggcttttctctt

SEQ ID NO: 6464182 - DNA, 13 bp, Homo sapiens
tgcaatgtattta

SEQ ID NO: 6464183 - DNA, 21 bp, Homo sapiens
tgcaatgtcacaacctctctg

SEQ ID NO: 6464184 - DNA, 19 bp, Homo sapiens
tgcaatgtctgagtgaacc

SEQ ID NO: 6464185 - DNA, 17 bp, Homo sapiens
tgcaatgtgaaaaatct

SEQ ID NO: 6464186 - DNA, 18 bp, Homo sapiens
tgcaatgtgatctatgtt

SEQ ID NO: 6464187 - DNA, 14 bp, Homo sapiens
tgcaatgtgtataa

SEQ ID NO: 6464188 - DNA, 15 bp, Homo sapiens
tgcaatgttattatt

SEQ ID NO: 6464189 - DNA, 17 bp, Homo sapiens
tgcaatgttcaatgcca

SEQ ID NO: 6464190 - DNA, 20 bp, Homo sapiens
tgcaatgttccgttcatctg

SEQ ID NO: 6464191 - DNA, 21 bp, Homo sapiens
tgcaatgttccgttcatctga

SEQ ID NO: 6464192 - DNA, 16 bp, Homo sapiens
tgcaattaaaaagttg

SEQ ID NO: 6464193 - DNA, 22 bp, Homo sapiens
tgcaattaaaactatgtgctat

SEQ ID NO: 6464194 - DNA, 20 bp, Homo sapiens
tgcaattaaacttccaaaga

SEQ ID NO: 6464195 - DNA, 15 bp, Homo sapiens
tgcaattaaagtgat

SEQ ID NO: 6464196 - DNA, 17 bp, Homo sapiens
tgcaattactgcctgca

SEQ ID NO: 6464197 - DNA, 23 bp, Homo sapiens
tgcaattactgcctgcagagata

SEQ ID NO: 6464198 - DNA, 19 bp, Homo sapiens
tgcaattcaaaagttccaa

SEQ ID NO: 6464199 - DNA, 14 bp, Homo sapiens
tgcaattcaatgca

SEQ ID NO: 6464200 - DNA, 16 bp, Homo sapiens
tgcaattcagtctgct

SEQ ID NO: 6464201 - DNA, 17 bp, Homo sapiens
tgcaattcatgtaacag

SEQ ID NO: 6464202 - DNA, 18 bp, Homo sapiens
tgcaattccaagaaaata

SEQ ID NO: 6464203 - DNA, 21 bp, Homo sapiens
tgcaattctttttggaaaaga

SEQ ID NO: 6464204 - DNA, 16 bp, Homo sapiens
tgcaattgatttcttt

SEQ ID NO: 6464205 - DNA, 18 bp, Homo sapiens
tgcaattgcacaaataca

SEQ ID NO: 6464206 - DNA, 21 bp, Homo sapiens
tgcaattgccttttttctgta

SEQ ID NO: 6464207 - DNA, 23 bp, Homo sapiens
tgcaattggggaagaaaaaatgt

SEQ ID NO: 6464208 - DNA, 22 bp, Homo sapiens
tgcaattgtaggggtgtgtgtg

SEQ ID NO: 6464209 - DNA, 12 bp, Homo sapiens
tgcaattgtctt

SEQ ID NO: 6464210 - DNA, 14 bp, Homo sapiens
tgcaattgttaatc

SEQ ID NO: 6464211 - DNA, 18 bp, Homo sapiens
tgcaattgtttaagaatc

SEQ ID NO: 6464212 - DNA, 22 bp, Homo sapiens
tgcaattgtttaagaatcatgg

SEQ ID NO: 6464213 - DNA, 15 bp, Homo sapiens
tgcaatttaaaatta

SEQ ID NO: 6464214 - DNA, 17 bp, Homo sapiens
tgcaatttacttggaat

SEQ ID NO: 6464215 - DNA, 15 bp, Homo sapiens
tgcaatttattaaaa

SEQ ID NO: 6464216 - DNA, 20 bp, Homo sapiens
tgcaatttcaaggttctaac

SEQ ID NO: 6464217 - DNA, 20 bp, Homo sapiens
tgcaatttcatatgctgtat

SEQ ID NO: 6464218 - DNA, 16 bp, Homo sapiens
tgcaatttccattctt

SEQ ID NO: 6464219 - DNA, 23 bp, Homo sapiens
tgcaatttccattcttttaaatg

SEQ ID NO: 6464220 - DNA, 15 bp, Homo sapiens
tgcaatttctcccga

SEQ ID NO: 6464221 - DNA, 15 bp, Homo sapiens
tgcaatttctgtaca

SEQ ID NO: 6464222 - DNA, 22 bp, Homo sapiens
tgcaatttctgtacatttgcaa

SEQ ID NO: 6464223 - DNA, 20 bp, Homo sapiens
tgcaatttcttctgtagcta

SEQ ID NO: 6464224 - DNA, 13 bp, Homo sapiens
tgcaatttgaagg

SEQ ID NO: 6464225 - DNA, 13 bp, Homo sapiens
tgcaatttgaagt

SEQ ID NO: 6464226 - DNA, 15 bp, Homo sapiens
tgcaatttgagccat

SEQ ID NO: 6464227 - DNA, 13 bp, Homo sapiens
tgcaatttgcaag

SEQ ID NO: 6464228 - DNA, 19 bp, Homo sapiens
tgcaatttgggagatatat

SEQ ID NO: 6464229 - DNA, 18 bp, Homo sapiens
tgcaatttgttattcttt

SEQ ID NO: 6464230 - DNA, 18 bp, Homo sapiens
tgcaatttgtttaaagaa

SEQ ID NO: 6464231 - DNA, 18 bp, Homo sapiens
tgcaattttaacacacat

SEQ ID NO: 6464232 - DNA, 17 bp, Homo sapiens
tgcaattttactgtgaa

SEQ ID NO: 6464233 - DNA, 18 bp, Homo sapiens
tgcaattttactgtgaaa

SEQ ID NO: 6464234 - DNA, 16 bp, Homo sapiens
tgcaattttgcatagc

SEQ ID NO: 6464235 - DNA, 15 bp, Homo sapiens
tgcaatttttaaact

SEQ ID NO: 6464236 - DNA, 22 bp, Homo sapiens
tgcaatttttctttcttttgtt

SEQ ID NO: 6464237 - DNA, 15 bp, Homo sapiens
tgcacaaaagcagat

SEQ ID NO: 6464238 - DNA, 23 bp, Homo sapiens
tgcacaaaatgaatgaggtctgg

SEQ ID NO: 6464239 - DNA, 16 bp, Homo sapiens
tgcacaaacagaggcc

SEQ ID NO: 6464240 - DNA, 21 bp, Homo sapiens
tgcacaaacatagacagatgt

SEQ ID NO: 6464241 - DNA, 13 bp, Homo sapiens
tgcacaaaccttc

SEQ ID NO: 6464242 - DNA, 20 bp, Homo sapiens
tgcacaaagtggcataaaaa

SEQ ID NO: 6464243 - DNA, 17 bp, Homo sapiens
tgcacaaattgaaaaca

SEQ ID NO: 6464244 - DNA, 18 bp, Homo sapiens
tgcacaaattgaaaacac

SEQ ID NO: 6464245 - DNA, 19 bp, Homo sapiens
tgcacaaattgaaaacaca

SEQ ID NO: 6464246 - DNA, 15 bp, Homo sapiens
tgcacaacagagtaa

SEQ ID NO: 6464247 - DNA, 12 bp, Homo sapiens
tgcacaacagcc

SEQ ID NO: 6464248 - DNA, 13 bp, Homo sapiens
tgcacaacagccc

SEQ ID NO: 6464249 - DNA, 16 bp, Homo sapiens
tgcacaactctactgt

SEQ ID NO: 6464250 - DNA, 20 bp, Homo sapiens
tgcacaacttttgagagtat

SEQ ID NO: 6464251 - DNA, 20 bp, Homo sapiens
tgcacaagatgccccaggga

SEQ ID NO: 6464252 - DNA, 21 bp, Homo sapiens
tgcacaagatgccccagggat

SEQ ID NO: 6464253 - DNA, 22 bp, Homo sapiens
tgcacaagatgccccagggatg

SEQ ID NO: 6464254 - DNA, 14 bp, Homo sapiens
tgcacaagccaggg

SEQ ID NO: 6464255 - DNA, 14 bp, Homo sapiens
tgcacaagctcaga

SEQ ID NO: 6464256 - DNA, 16 bp, Homo sapiens
tgcacaagctccaagc

SEQ ID NO: 6464257 - DNA, 18 bp, Homo sapiens
tgcacaagctccaagctc

SEQ ID NO: 6464258 - DNA, 22 bp, Homo sapiens
tgcacaagctccaagctcccag

SEQ ID NO: 6464259 - DNA, 15 bp, Homo sapiens
tgcacaagctgcacc

SEQ ID NO: 6464260 - DNA, 18 bp, Homo sapiens
tgcacaagctgcaccctc

SEQ ID NO: 6464261 - DNA, 16 bp, Homo sapiens
tgcacaagcttgtata

SEQ ID NO: 6464262 - DNA, 22 bp, Homo sapiens
tgcacaagcttgtatatacata

SEQ ID NO: 6464263 - DNA, 15 bp, Homo sapiens
tgcacaagttccctg

SEQ ID NO: 6464264 - DNA, 20 bp, Homo sapiens
tgcacaagttccctggagaa

SEQ ID NO: 6464265 - DNA, 21 bp, Homo sapiens
tgcacaagttccctggagaaa

SEQ ID NO: 6464266 - DNA, 12 bp, Homo sapiens
tgcacaataaaa

SEQ ID NO: 6464267 - DNA, 20 bp, Homo sapiens
tgcacaataaaaccaagcct

SEQ ID NO: 6464268 - DNA, 23 bp, Homo sapiens
tgcacaataaaaccaagcctctg

SEQ ID NO: 6464269 - DNA, 17 bp, Homo sapiens
tgcacaatattgaactt

SEQ ID NO: 6464270 - DNA, 15 bp, Homo sapiens
tgcacaatatttctt

SEQ ID NO: 6464271 - DNA, 16 bp, Homo sapiens
tgcacaatcagtttat

SEQ ID NO: 6464272 - DNA, 16 bp, Homo sapiens
tgcacaatgaccagca

SEQ ID NO: 6464273 - DNA, 13 bp, Homo sapiens
tgcacaatgtctt

SEQ ID NO: 6464274 - DNA, 14 bp, Homo sapiens
tgcacaatttagaa

SEQ ID NO: 6464275 - DNA, 15 bp, Homo sapiens
tgcacaatttagaaa

SEQ ID NO: 6464276 - DNA, 20 bp, Homo sapiens
tgcacaatttagaaaacatt

SEQ ID NO: 6464277 - DNA, 17 bp, Homo sapiens
tgcacacaaaacatctt

SEQ ID NO: 6464278 - DNA, 21 bp, Homo sapiens
tgcacacaaacacctcctagc

SEQ ID NO: 6464279 - DNA, 18 bp, Homo sapiens
tgcacacaaatattattt

SEQ ID NO: 6464280 - DNA, 11 bp, Homo sapiens
tgcacacacac

SEQ ID NO: 6464281 - DNA, 14 bp, Homo sapiens
tgcacacacacaca

SEQ ID NO: 6464282 - DNA, 21 bp, Homo sapiens
tgcacacacacacacatgcac

SEQ ID NO: 6464283 - DNA, 21 bp, Homo sapiens
tgcacacacacgcgtccacat

SEQ ID NO: 6464284 - DNA, 22 bp, Homo sapiens
tgcacacacacgcgtccacata

SEQ ID NO: 6464285 - DNA, 19 bp, Homo sapiens
tgcacacacacggatgcac

SEQ ID NO: 6464286 - DNA, 21 bp, Homo sapiens
tgcacacacacggatgcacac

SEQ ID NO: 6464287 - DNA, 18 bp, Homo sapiens
tgcacacacagatgcaca

SEQ ID NO: 6464288 - DNA, 21 bp, Homo sapiens
tgcacacaccagagcccacct

SEQ ID NO: 6464289 - DNA, 11 bp, Homo sapiens
tgcacacacct

SEQ ID NO: 6464290 - DNA, 17 bp, Homo sapiens
tgcacacacctccgaga

SEQ ID NO: 6464291 - DNA, 15 bp, Homo sapiens
tgcacacacctgcac

SEQ ID NO: 6464292 - DNA, 17 bp, Homo sapiens
tgcacacacctgcacac

SEQ ID NO: 6464293 - DNA, 14 bp, Homo sapiens
tgcacacacctgcc

SEQ ID NO: 6464294 - DNA, 17 bp, Homo sapiens
tgcacacacctgcctgc

SEQ ID NO: 6464295 - DNA, 22 bp, Homo sapiens
tgcacacacggttttggcagct

SEQ ID NO: 6464296 - DNA, 18 bp, Homo sapiens
tgcacacactcacctcta

SEQ ID NO: 6464297 - DNA, 19 bp, Homo sapiens
tgcacacagaaatatatat

SEQ ID NO: 6464298 - DNA, 20 bp, Homo sapiens
tgcacacagaaatatatata

SEQ ID NO: 6464299 - DNA, 15 bp, Homo sapiens
tgcacacagaatgct

SEQ ID NO: 6464300 - DNA, 20 bp, Homo sapiens
tgcacacagaatgctcaggg

SEQ ID NO: 6464301 - DNA, 18 bp, Homo sapiens
tgcacacagacggcctag

SEQ ID NO: 6464302 - DNA, 19 bp, Homo sapiens
tgcacacagacggcctagg

SEQ ID NO: 6464303 - DNA, 13 bp, Homo sapiens
tgcacacagagtg

SEQ ID NO: 6464304 - DNA, 18 bp, Homo sapiens
tgcacacagagtgaggga

SEQ ID NO: 6464305 - DNA, 19 bp, Homo sapiens
tgcacacagcggctgcctc

SEQ ID NO: 6464306 - DNA, 16 bp, Homo sapiens
tgcacacaggatggca

SEQ ID NO: 6464307 - DNA, 13 bp, Homo sapiens
tgcacacagggca

SEQ ID NO: 6464308 - DNA, 14 bp, Homo sapiens
tgcacacatatata

SEQ ID NO: 6464309 - DNA, 16 bp, Homo sapiens
tgcacacatcatctgt

SEQ ID NO: 6464310 - DNA, 21 bp, Homo sapiens
tgcacacatcatctgtaagct

SEQ ID NO: 6464311 - DNA, 10 bp, Homo sapiens
tgcacacatt

SEQ ID NO: 6464312 - DNA, 11 bp, Homo sapiens
tgcacacattt

SEQ ID NO: 6464313 - DNA, 13 bp, Homo sapiens
tgcacacattttt

SEQ ID NO: 6464314 - DNA, 13 bp, Homo sapiens
tgcacaccaaatt

SEQ ID NO: 6464315 - DNA, 17 bp, Homo sapiens
tgcacaccaaattgctg

SEQ ID NO: 6464316 - DNA, 18 bp, Homo sapiens
tgcacaccaaattgctga

SEQ ID NO: 6464317 - DNA, 14 bp, Homo sapiens
tgcacaccaaggcc

SEQ ID NO: 6464318 - DNA, 22 bp, Homo sapiens
tgcacaccaaggccctgcatct

SEQ ID NO: 6464319 - DNA, 17 bp, Homo sapiens
tgcacaccattttgtaa

SEQ ID NO: 6464320 - DNA, 17 bp, Homo sapiens
tgcacacccactcagct

SEQ ID NO: 6464321 - DNA, 19 bp, Homo sapiens
tgcacaccccactcccaca

SEQ ID NO: 6464322 - DNA, 14 bp, Homo sapiens
tgcacacccctgca

SEQ ID NO: 6464323 - DNA, 12 bp, Homo sapiens
tgcacaccctgg

SEQ ID NO: 6464324 - DNA, 17 bp, Homo sapiens
tgcacaccgtccctctc

SEQ ID NO: 6464325 - DNA, 15 bp, Homo sapiens
tgcacacctgtaatc

SEQ ID NO: 6464326 - DNA, 16 bp, Homo sapiens
tgcacacctgtaatcc

SEQ ID NO: 6464327 - DNA, 21 bp, Homo sapiens
tgcacaccttttccccaggag

SEQ ID NO: 6464328 - DNA, 23 bp, Homo sapiens
tgcacaccttttccccaggagca

SEQ ID NO: 6464329 - DNA, 16 bp, Homo sapiens
tgcacacgcacataga

SEQ ID NO: 6464330 - DNA, 17 bp, Homo sapiens
tgcacacggcacagagc

SEQ ID NO: 6464331 - DNA, 16 bp, Homo sapiens
tgcacacggctggtca

SEQ ID NO: 6464332 - DNA, 20 bp, Homo sapiens
tgcacacggctggtcactct

SEQ ID NO: 6464333 - DNA, 22 bp, Homo sapiens
tgcacacggctggtcactctgc

SEQ ID NO: 6464334 - DNA, 17 bp, Homo sapiens
tgcacacgtgtgtatga

SEQ ID NO: 6464335 - DNA, 15 bp, Homo sapiens
tgcacactaagaaat

SEQ ID NO: 6464336 - DNA, 16 bp, Homo sapiens
tgcacactatttccct

SEQ ID NO: 6464337 - DNA, 14 bp, Homo sapiens
tgcacactcagtgg

SEQ ID NO: 6464338 - DNA, 23 bp, Homo sapiens
tgcacactcagtgggctgtttct

SEQ ID NO: 6464339 - DNA, 18 bp, Homo sapiens
tgcacactcagttctgct

SEQ ID NO: 6464340 - DNA, 13 bp, Homo sapiens
tctaatattgctt

SEQ ID NO: 6464341 - DNA, 20 bp, Homo sapiens
tctaatatttattgctttat

SEQ ID NO: 6464342 - DNA, 12 bp, Homo sapiens
tctaatcaaaag

SEQ ID NO: 6464343 - DNA, 17 bp, Homo sapiens
tctaatcagattgctta

SEQ ID NO: 6464344 - DNA, 23 bp, Homo sapiens
tctaatcagattgcttaaaagca

SEQ ID NO: 6464345 - DNA, 13 bp, Homo sapiens
tctaatcagtcct

SEQ ID NO: 6464346 - DNA, 13 bp, Homo sapiens
tctaatcagtgat

SEQ ID NO: 6464347 - DNA, 14 bp, Homo sapiens
tctaatcagtgatt

SEQ ID NO: 6464348 - DNA, 23 bp, Homo sapiens
tctaatcagtgattatttttcca

SEQ ID NO: 6464349 - DNA, 16 bp, Homo sapiens
tctaatcatctgcagt

SEQ ID NO: 6464350 - DNA, 20 bp, Homo sapiens
tctaatcatctgcagttctt

SEQ ID NO: 6464351 - DNA, 22 bp, Homo sapiens
tctaatccttttccttatttgc

SEQ ID NO: 6464352 - DNA, 17 bp, Homo sapiens
tctaatcgaaagaaaat

SEQ ID NO: 6464353 - DNA, 12 bp, Homo sapiens
tctaatctctta

SEQ ID NO: 6464354 - DNA, 15 bp, Homo sapiens
tctaatctgaactga

SEQ ID NO: 6464355 - DNA, 21 bp, Homo sapiens
tctaatctgagctgcagcctg

SEQ ID NO: 6464356 - DNA, 20 bp, Homo sapiens
tctaatctgctatgcttgaa

SEQ ID NO: 6464357 - DNA, 23 bp, Homo sapiens
tctaatcttaaatcagaataaat

SEQ ID NO: 6464358 - DNA, 16 bp, Homo sapiens
tctaatgaagagaaaa

SEQ ID NO: 6464359 - DNA, 17 bp, Homo sapiens
tctaatgaatgttccac

SEQ ID NO: 6464360 - DNA, 17 bp, Homo sapiens
tctaatgacattcaata

SEQ ID NO: 6464361 - DNA, 20 bp, Homo sapiens
tctaatgagttgctggaaaa

SEQ ID NO: 6464362 - DNA, 22 bp, Homo sapiens
tctaatgagttgctggaaaatc

SEQ ID NO: 6464363 - DNA, 20 bp, Homo sapiens
tctaatgattcaaatgtttt

SEQ ID NO: 6464364 - DNA, 19 bp, Homo sapiens
tctaatgcatatttataag

SEQ ID NO: 6464365 - DNA, 21 bp, Homo sapiens
tctaatgccttttgaatacat

SEQ ID NO: 6464366 - DNA, 17 bp, Homo sapiens
tctaatgcttgatttag

SEQ ID NO: 6464367 - DNA, 13 bp, Homo sapiens
tctaatggaatat

SEQ ID NO: 6464368 - DNA, 20 bp, Homo sapiens
tctaatgggggcagtctccc

SEQ ID NO: 6464369 - DNA, 15 bp, Homo sapiens
tctaatggtaacttt

SEQ ID NO: 6464370 - DNA, 14 bp, Homo sapiens
tctaatgtaaattt

SEQ ID NO: 6464371 - DNA, 15 bp, Homo sapiens
tctaatgtaaatttt

SEQ ID NO: 6464372 - DNA, 18 bp, Homo sapiens
tctaatgtaacttcctct

SEQ ID NO: 6464373 - DNA, 17 bp, Homo sapiens
tctaatgtagctatttt

SEQ ID NO: 6464374 - DNA, 17 bp, Homo sapiens
tctaatgtattttattg

SEQ ID NO: 6464375 - DNA, 16 bp, Homo sapiens
tctaatgtctcttcct

SEQ ID NO: 6464376 - DNA, 14 bp, Homo sapiens
tctaatgtgaaaat

SEQ ID NO: 6464377 - DNA, 16 bp, Homo sapiens
tctaatgtgactgttg

SEQ ID NO: 6464378 - DNA, 19 bp, Homo sapiens
tctaatgttccccgtggct

SEQ ID NO: 6464379 - DNA, 20 bp, Homo sapiens
tctaatgttctaaattctat

SEQ ID NO: 6464380 - DNA, 22 bp, Homo sapiens
tctaatgttgtctttttaatgt

SEQ ID NO: 6464381 - DNA, 11 bp, Homo sapiens
tctaatgttta

SEQ ID NO: 6464382 - DNA, 14 bp, Homo sapiens
tctaatgtttgcat

SEQ ID NO: 6464383 - DNA, 16 bp, Homo sapiens
tctaatgtttgcatat

SEQ ID NO: 6464384 - DNA, 12 bp, Homo sapiens
tctaatgtttgt

SEQ ID NO: 6464385 - DNA, 19 bp, Homo sapiens
tctaattaaaatgtgcagt

SEQ ID NO: 6464386 - DNA, 13 bp, Homo sapiens
tctaattaagaaa

SEQ ID NO: 6464387 - DNA, 21 bp, Homo sapiens
tctaattaagaaaactattaa

SEQ ID NO: 6464388 - DNA, 12 bp, Homo sapiens
tctaattaatag

SEQ ID NO: 6464389 - DNA, 21 bp, Homo sapiens
tctaattagtctatcaaatga

SEQ ID NO: 6464390 - DNA, 23 bp, Homo sapiens
tctaattatttaaataaaatcac

SEQ ID NO: 6464391 - DNA, 18 bp, Homo sapiens
tctaattcaagattacaa

SEQ ID NO: 6464392 - DNA, 15 bp, Homo sapiens
tctaattcatttact

SEQ ID NO: 6464393 - DNA, 19 bp, Homo sapiens
tctaattcccattttgcaa

SEQ ID NO: 6464394 - DNA, 21 bp, Homo sapiens
tctaattcccattttgcaaaa

SEQ ID NO: 6464395 - DNA, 11 bp, Homo sapiens
tctaattctaa

SEQ ID NO: 6464396 - DNA, 16 bp, Homo sapiens
tctaattcttttcaaa

SEQ ID NO: 6464397 - DNA, 15 bp, Homo sapiens
tctaattgattcaag

SEQ ID NO: 6464398 - DNA, 15 bp, Homo sapiens
tctaattgccatgta

SEQ ID NO: 6464399 - DNA, 15 bp, Homo sapiens
tctaattgcttattt

SEQ ID NO: 6464400 - DNA, 20 bp, Homo sapiens
tctaattggaagaaattcct

SEQ ID NO: 6464401 - DNA, 22 bp, Homo sapiens
tctaattggaagaaattcctgt

SEQ ID NO: 6464402 - DNA, 21 bp, Homo sapiens
tctaattggctttactatttt

SEQ ID NO: 6464403 - DNA, 14 bp, Homo sapiens
tctaattggtcatt

SEQ ID NO: 6464404 - DNA, 24 bp, Homo sapiens
tctaattggtcattcctaatgcat

SEQ ID NO: 6464405 - DNA, 22 bp, Homo sapiens
tctaattgtaagtgaaattaag

SEQ ID NO: 6464406 - DNA, 14 bp, Homo sapiens
tctaatttaactta

SEQ ID NO: 6464407 - DNA, 19 bp, Homo sapiens
tctaatttaccattatttt

SEQ ID NO: 6464408 - DNA, 13 bp, Homo sapiens
tctaatttataca

SEQ ID NO: 6464409 - DNA, 21 bp, Homo sapiens
tctaatttatacaaaataatt

SEQ ID NO: 6464410 - DNA, 23 bp, Homo sapiens
tctaatttatcttgtctctgggc

SEQ ID NO: 6464411 - DNA, 18 bp, Homo sapiens
tctaatttattttctcaa

SEQ ID NO: 6464412 - DNA, 22 bp, Homo sapiens
tctaatttcaaaaatataactt

SEQ ID NO: 6464413 - DNA, 22 bp, Homo sapiens
tctaatttctttagttttctat

SEQ ID NO: 6464414 - DNA, 14 bp, Homo sapiens
tctaatttgaactg

SEQ ID NO: 6464415 - DNA, 12 bp, Homo sapiens
tctaatttgaat

SEQ ID NO: 6464416 - DNA, 15 bp, Homo sapiens
tctaattttggataa

SEQ ID NO: 6464417 - DNA, 19 bp, Homo sapiens
tctaattttggataatatt

SEQ ID NO: 6464418 - DNA, 21 bp, Homo sapiens
tctaattttgtgctctttcct

SEQ ID NO: 6464419 - DNA, 16 bp, Homo sapiens
tctaatttttaagcaa

SEQ ID NO: 6464420 - DNA, 20 bp, Homo sapiens
tctacaaaaaaaatcaaaaa

SEQ ID NO: 6464421 - DNA, 18 bp, Homo sapiens
tctacaaaaaataaaata

SEQ ID NO: 6464422 - DNA, 20 bp, Homo sapiens
tctacaaaaaggtataaata

SEQ ID NO: 6464423 - DNA, 21 bp, Homo sapiens
tctacaaaaaggtataaataa

SEQ ID NO: 6464424 - DNA, 22 bp, Homo sapiens
tctacaaaataacattctgaat

SEQ ID NO: 6464425 - DNA, 18 bp, Homo sapiens
tctacaaaatcctgatga

SEQ ID NO: 6464426 - DNA, 22 bp, Homo sapiens
tctacaaacttttataaatgtt

SEQ ID NO: 6464427 - DNA, 13 bp, Homo sapiens
tctacaaagcact

SEQ ID NO: 6464428 - DNA, 19 bp, Homo sapiens
tctacaaatataagatttt

SEQ ID NO: 6464429 - DNA, 14 bp, Homo sapiens
tctacaactggagt

SEQ ID NO: 6464430 - DNA, 23 bp, Homo sapiens
tctacaagcatttgccctgtgga

SEQ ID NO: 6464431 - DNA, 22 bp, Homo sapiens
tctacaaggactccattggatc

SEQ ID NO: 6464432 - DNA, 15 bp, Homo sapiens
tctacaagtatatgt

SEQ ID NO: 6464433 - DNA, 21 bp, Homo sapiens
tctacaagtatatgtgaaaaa

SEQ ID NO: 6464434 - DNA, 19 bp, Homo sapiens
tctacaagtattctgcctt

SEQ ID NO: 6464435 - DNA, 16 bp, Homo sapiens
tctacaatgacacaca

SEQ ID NO: 6464436 - DNA, 17 bp, Homo sapiens
tctacaatgtgaacttt

SEQ ID NO: 6464437 - DNA, 20 bp, Homo sapiens
tctacaatgtgaactttatt

SEQ ID NO: 6464438 - DNA, 21 bp, Homo sapiens
tctacaattcctctgataata

SEQ ID NO: 6464439 - DNA, 14 bp, Homo sapiens
tctacacaacatgt

SEQ ID NO: 6464440 - DNA, 21 bp, Homo sapiens
tctacacagcagtatgaatga

SEQ ID NO: 6464441 - DNA, 21 bp, Homo sapiens
tctacacagcctggactttgg

SEQ ID NO: 6464442 - DNA, 16 bp, Homo sapiens
tctacacagtaaaaac

SEQ ID NO: 6464443 - DNA, 21 bp, Homo sapiens
tctacacatatatgtatatgt

SEQ ID NO: 6464444 - DNA, 15 bp, Homo sapiens
tctacaccaatgaaa

SEQ ID NO: 6464445 - DNA, 19 bp, Homo sapiens
tctacaccaatgaaaacat

SEQ ID NO: 6464446 - DNA, 20 bp, Homo sapiens
tctacaccctctgccccaga

SEQ ID NO: 6464447 - DNA, 13 bp, Homo sapiens
tctacacctggac

SEQ ID NO: 6464448 - DNA, 24 bp, Homo sapiens
tctacacggactgaggtgcctgct

SEQ ID NO: 6464449 - DNA, 12 bp, Homo sapiens
tctacactctcc

SEQ ID NO: 6464450 - DNA, 14 bp, Homo sapiens
tctacactctcctg

SEQ ID NO: 6464451 - DNA, 18 bp, Homo sapiens
tctacactctcctgggcc

SEQ ID NO: 6464452 - DNA, 19 bp, Homo sapiens
tctacactcttgtaataaa

SEQ ID NO: 6464453 - DNA, 14 bp, Homo sapiens
tctacactgtgctg

SEQ ID NO: 6464454 - DNA, 20 bp, Homo sapiens
tctacagaaagaaaaatgca

SEQ ID NO: 6464455 - DNA, 14 bp, Homo sapiens
tctacagaacctga

SEQ ID NO: 6464456 - DNA, 17 bp, Homo sapiens
tctacagaacctgaggg

SEQ ID NO: 6464457 - DNA, 19 bp, Homo sapiens
tctacagaactacatattt

SEQ ID NO: 6464458 - DNA, 17 bp, Homo sapiens
tctacagaataatccag

SEQ ID NO: 6464459 - DNA, 18 bp, Homo sapiens
tctacagacttctccaga

SEQ ID NO: 6464460 - DNA, 22 bp, Homo sapiens
tctacagagaaaatgaatttgg

SEQ ID NO: 6464461 - DNA, 15 bp, Homo sapiens
tctacagaggccatg

SEQ ID NO: 6464462 - DNA, 16 bp, Homo sapiens
tctacagataatgtct

SEQ ID NO: 6464463 - DNA, 22 bp, Homo sapiens
tctacagatggcatacctgtgc

SEQ ID NO: 6464464 - DNA, 17 bp, Homo sapiens
tctacagcaaatttata

SEQ ID NO: 6464465 - DNA, 18 bp, Homo sapiens
tctacagcaaatttataa

SEQ ID NO: 6464466 - DNA, 19 bp, Homo sapiens
tctacagcaaatttataat

SEQ ID NO: 6464467 - DNA, 22 bp, Homo sapiens
tctacagcaaatttataatttt

SEQ ID NO: 6464468 - DNA, 16 bp, Homo sapiens
tctacagcatacagag

SEQ ID NO: 6464469 - DNA, 19 bp, Homo sapiens
tctacagccagtaaggcag

SEQ ID NO: 6464470 - DNA, 19 bp, Homo sapiens
tctacagctccagatgttt

SEQ ID NO: 6464471 - DNA, 16 bp, Homo sapiens
tctacagctcccccag

SEQ ID NO: 6464472 - DNA, 21 bp, Homo sapiens
tctacaggatggggacactaa

SEQ ID NO: 6464473 - DNA, 12 bp, Homo sapiens
tctacaggcatt

SEQ ID NO: 6464474 - DNA, 20 bp, Homo sapiens
tctacaggcctcttcctgtt

SEQ ID NO: 6464475 - DNA, 19 bp, Homo sapiens
tctacaggtcaagaaatag

SEQ ID NO: 6464476 - DNA, 16 bp, Homo sapiens
tctacagtaatgaaat

SEQ ID NO: 6464477 - DNA, 20 bp, Homo sapiens
tctacagtactgacagaaag

SEQ ID NO: 6464478 - DNA, 16 bp, Homo sapiens
tctacagtacttccag

SEQ ID NO: 6464479 - DNA, 22 bp, Homo sapiens
tctacagtgatagagcaaagca

SEQ ID NO: 6464480 - DNA, 13 bp, Homo sapiens
tctacagtggttt

SEQ ID NO: 6464481 - DNA, 20 bp, Homo sapiens
tctacataagtaattcaaga

SEQ ID NO: 6464482 - DNA, 23 bp, Homo sapiens
tctacatactttcatcctgactc

SEQ ID NO: 6464483 - DNA, 22 bp, Homo sapiens
tctacataggcaaagttttcca

SEQ ID NO: 6464484 - DNA, 16 bp, Homo sapiens
tctacatattctttaa

SEQ ID NO: 6464485 - DNA, 17 bp, Homo sapiens
tctacatcttctgcctt

SEQ ID NO: 6464486 - DNA, 13 bp, Homo sapiens
tctacatgactgg

SEQ ID NO: 6464487 - DNA, 13 bp, Homo sapiens
tctacatgcaaat

SEQ ID NO: 6464488 - DNA, 15 bp, Homo sapiens
tctacatgccatgcc

SEQ ID NO: 6464489 - DNA, 23 bp, Homo sapiens
tctacatgccatgcctatgggcc

SEQ ID NO: 6464490 - DNA, 16 bp, Homo sapiens
tctacatgtaatgaca

SEQ ID NO: 6464491 - DNA, 18 bp, Homo sapiens
tctacatgtaatgacact

SEQ ID NO: 6464492 - DNA, 20 bp, Homo sapiens
tctacatgtgagatagtttt

SEQ ID NO: 6464493 - DNA, 22 bp, Homo sapiens
tctacatgtgagatagttttca

SEQ ID NO: 6464494 - DNA, 12 bp, Homo sapiens
tctacatgtgtt

SEQ ID NO: 6464495 - DNA, 15 bp, Homo sapiens
tctacattattgctt

SEQ ID NO: 6464496 - DNA, 13 bp, Homo sapiens
tctacattctgct

SEQ ID NO: 6464497 - DNA, 23 bp, Homo sapiens
tctacattctgctctgcccatgc

SEQ ID NO: 6464498 - DNA, 21 bp, Homo sapiens
tctacattcttggttgttaat

SEQ ID NO: 6464499 - DNA, 15 bp, Homo sapiens
tctacatttaaacaa

SEQ ID NO: 6464500 - DNA, 22 bp, Homo sapiens
tctacatttaaacaagtatttt

SEQ ID NO: 6464501 - DNA, 12 bp, Homo sapiens
tctacatttcac

SEQ ID NO: 6464502 - DNA, 13 bp, Homo sapiens
tctacatttcaca

SEQ ID NO: 6464503 - DNA, 16 bp, Homo sapiens
tctacatttcacatta

SEQ ID NO: 6464504 - DNA, 23 bp, Homo sapiens
tctacatttcacctactttgtaa

SEQ ID NO: 6464505 - DNA, 20 bp, Homo sapiens
tctacatttctgcagatctt

SEQ ID NO: 6464506 - DNA, 16 bp, Homo sapiens
tctacatttgagggcc

SEQ ID NO: 6464507 - DNA, 14 bp, Homo sapiens
tctacatttttgtt

SEQ ID NO: 6464508 - DNA, 20 bp, Homo sapiens
tctacattttttaaaactga

SEQ ID NO: 6464509 - DNA, 17 bp, Homo sapiens
tctaccaaaaaaaggaa

SEQ ID NO: 6464510 - DNA, 19 bp, Homo sapiens
tctaccaaaaaaaggaagg

SEQ ID NO: 6464511 - DNA, 17 bp, Homo sapiens
tctaccaaaaatctcaa

SEQ ID NO: 6464512 - DNA, 16 bp, Homo sapiens
tctaccaaatgtgtaa

SEQ ID NO: 6464513 - DNA, 15 bp, Homo sapiens
tctaccaacaataaa

SEQ ID NO: 6464514 - DNA, 15 bp, Homo sapiens
tctaccaactggaag

SEQ ID NO: 6464515 - DNA, 15 bp, Homo sapiens
tctaccaagacataa

SEQ ID NO: 6464516 - DNA, 12 bp, Homo sapiens
tctaccaagctg

SEQ ID NO: 6464517 - DNA, 14 bp, Homo sapiens
tctaccaagctgtc

SEQ ID NO: 6464518 - DNA, 20 bp, Homo sapiens
tgcacactcagttctgctct

SEQ ID NO: 6464519 - DNA, 17 bp, Homo sapiens
tgcacactccaggcctc

SEQ ID NO: 6464520 - DNA, 18 bp, Homo sapiens
tgcacactccatctcctg

SEQ ID NO: 6464521 - DNA, 21 bp, Homo sapiens
tgcacactcccctgcactgga

SEQ ID NO: 6464522 - DNA, 22 bp, Homo sapiens
tgcacactctcccattatattt

SEQ ID NO: 6464523 - DNA, 22 bp, Homo sapiens
tgcacacttatttttttcccaa

SEQ ID NO: 6464524 - DNA, 11 bp, Homo sapiens
tgcacacttca

SEQ ID NO: 6464525 - DNA, 16 bp, Homo sapiens
tgcacacttccccatc

SEQ ID NO: 6464526 - DNA, 16 bp, Homo sapiens
tgcacacttctgacct

SEQ ID NO: 6464527 - DNA, 23 bp, Homo sapiens
tgcacacttctgaccttgctgcc

SEQ ID NO: 6464528 - DNA, 15 bp, Homo sapiens
tgcacacttgtatat

SEQ ID NO: 6464529 - DNA, 21 bp, Homo sapiens
tgcacacttgtgtgtgggctg

SEQ ID NO: 6464530 - DNA, 23 bp, Homo sapiens
tgcacacttgtgtgtgggctgtg

SEQ ID NO: 6464531 - DNA, 19 bp, Homo sapiens
tgcacactttggcccaggg

SEQ ID NO: 6464532 - DNA, 20 bp, Homo sapiens
tgcacactttggcccagggt

SEQ ID NO: 6464533 - DNA, 17 bp, Homo sapiens
tgcacactttggtacca

SEQ ID NO: 6464534 - DNA, 19 bp, Homo sapiens
tgcacagaaaaccgagaat

SEQ ID NO: 6464535 - DNA, 20 bp, Homo sapiens
tgcacagaaacttgaactcc

SEQ ID NO: 6464536 - DNA, 21 bp, Homo sapiens
tgcacagaaacttgaactcca

SEQ ID NO: 6464537 - DNA, 11 bp, Homo sapiens
tgcacagaagg

SEQ ID NO: 6464538 - DNA, 18 bp, Homo sapiens
tgcacagaagggctcttt

SEQ ID NO: 6464539 - DNA, 14 bp, Homo sapiens
tgcacagaagtcct

SEQ ID NO: 6464540 - DNA, 15 bp, Homo sapiens
tgcacagaagtcctg

SEQ ID NO: 6464541 - DNA, 15 bp, Homo sapiens
tgcacagacaagcag

SEQ ID NO: 6464542 - DNA, 16 bp, Homo sapiens
tgcacagactggtcca

SEQ ID NO: 6464543 - DNA, 12 bp, Homo sapiens
tgcacagagaag

SEQ ID NO: 6464544 - DNA, 15 bp, Homo sapiens
tgcacagagaagctg

SEQ ID NO: 6464545 - DNA, 17 bp, Homo sapiens
tgcacagagaagctggg

SEQ ID NO: 6464546 - DNA, 18 bp, Homo sapiens
tgcacagagaagctgggg

SEQ ID NO: 6464547 - DNA, 19 bp, Homo sapiens
tgcacagagaagctgggga

SEQ ID NO: 6464548 - DNA, 19 bp, Homo sapiens
tgcacagagatatgcacac

SEQ ID NO: 6464549 - DNA, 16 bp, Homo sapiens
tgcacagagcacactt

SEQ ID NO: 6464550 - DNA, 14 bp, Homo sapiens
tgcacagagcccaa

SEQ ID NO: 6464551 - DNA, 16 bp, Homo sapiens
tgcacagagcccaatg

SEQ ID NO: 6464552 - DNA, 13 bp, Homo sapiens
tgcacagagctct

SEQ ID NO: 6464553 - DNA, 16 bp, Homo sapiens
tgcacagagctctcca

SEQ ID NO: 6464554 - DNA, 22 bp, Homo sapiens
tgcacagagggtcccattgtgc

SEQ ID NO: 6464555 - DNA, 17 bp, Homo sapiens
tgcacagagttgttaca

SEQ ID NO: 6464556 - DNA, 22 bp, Homo sapiens
tgcacagagttgttacattttt

SEQ ID NO: 6464557 - DNA, 15 bp, Homo sapiens
tgcacagatacacat

SEQ ID NO: 6464558 - DNA, 18 bp, Homo sapiens
tgcacagatatactttgt

SEQ ID NO: 6464559 - DNA, 19 bp, Homo sapiens
tgcacagatatactttgtg

SEQ ID NO: 6464560 - DNA, 20 bp, Homo sapiens
tgcacagatgccatggcctg

SEQ ID NO: 6464561 - DNA, 19 bp, Homo sapiens
tgcacagatggatttgcct

SEQ ID NO: 6464562 - DNA, 17 bp, Homo sapiens
tgcacagattaaacttc

SEQ ID NO: 6464563 - DNA, 18 bp, Homo sapiens
tgcacagattaaacttca

SEQ ID NO: 6464564 - DNA, 17 bp, Homo sapiens
tgcacagattcccaggc

SEQ ID NO: 6464565 - DNA, 18 bp, Homo sapiens
tgcacagattgctgaaac

SEQ ID NO: 6464566 - DNA, 16 bp, Homo sapiens
tgcacagcacaaatta

SEQ ID NO: 6464567 - DNA, 15 bp, Homo sapiens
tgcacagcaggacct

SEQ ID NO: 6464568 - DNA, 18 bp, Homo sapiens
tgcacagcaggctgccag

SEQ ID NO: 6464569 - DNA, 21 bp, Homo sapiens
tgcacagcaggctgccagtgc

SEQ ID NO: 6464570 - DNA, 22 bp, Homo sapiens
tgcacagcaggctgccagtgcc

SEQ ID NO: 6464571 - DNA, 23 bp, Homo sapiens
tgcacagcaggctgccagtgcct

SEQ ID NO: 6464572 - DNA, 15 bp, Homo sapiens
tgcacagcatctcag

SEQ ID NO: 6464573 - DNA, 20 bp, Homo sapiens
tgcacagccaacgagacaca

SEQ ID NO: 6464574 - DNA, 17 bp, Homo sapiens
tgcacagcccaaccagg

SEQ ID NO: 6464575 - DNA, 19 bp, Homo sapiens
tgcacagcccaaccaggag

SEQ ID NO: 6464576 - DNA, 24 bp, Homo sapiens
tgcacagcctagttatcaagggga

SEQ ID NO: 6464577 - DNA, 20 bp, Homo sapiens
tgcacagcgcgggcggaggc

SEQ ID NO: 6464578 - DNA, 12 bp, Homo sapiens
tgcacagcgtgg

SEQ ID NO: 6464579 - DNA, 17 bp, Homo sapiens
tgcacagctaacatgga

SEQ ID NO: 6464580 - DNA, 23 bp, Homo sapiens
tgcacagctaacatggaagtact

SEQ ID NO: 6464581 - DNA, 14 bp, Homo sapiens
tgcacagctgcttg

SEQ ID NO: 6464582 - DNA, 15 bp, Homo sapiens
tgcacagctgcttgt

SEQ ID NO: 6464583 - DNA, 18 bp, Homo sapiens
tgcacagctgcttgtcct

SEQ ID NO: 6464584 - DNA, 12 bp, Homo sapiens
tgcacagctgtc

SEQ ID NO: 6464585 - DNA, 14 bp, Homo sapiens
tgcacagctgtcca

SEQ ID NO: 6464586 - DNA, 17 bp, Homo sapiens
tgcacagctgtttgaaa

SEQ ID NO: 6464587 - DNA, 18 bp, Homo sapiens
tgcacagctgtttgaaat

SEQ ID NO: 6464588 - DNA, 17 bp, Homo sapiens
tgcacagcttttccaaa

SEQ ID NO: 6464589 - DNA, 17 bp, Homo sapiens
tgcacaggaagctgaga

SEQ ID NO: 6464590 - DNA, 18 bp, Homo sapiens
tgcacaggcacacagggc

SEQ ID NO: 6464591 - DNA, 12 bp, Homo sapiens
tgcacaggcaga

SEQ ID NO: 6464592 - DNA, 22 bp, Homo sapiens
tgcacaggcagcaaggtcatgg

SEQ ID NO: 6464593 - DNA, 21 bp, Homo sapiens
tgcacaggccacttgctcaga

SEQ ID NO: 6464594 - DNA, 14 bp, Homo sapiens
tgcacaggcctctg

SEQ ID NO: 6464595 - DNA, 17 bp, Homo sapiens
tgcacaggcctctgcct

SEQ ID NO: 6464596 - DNA, 19 bp, Homo sapiens
tgcacagggattctcacaa

SEQ ID NO: 6464597 - DNA, 12 bp, Homo sapiens
tgcacagggcag

SEQ ID NO: 6464598 - DNA, 16 bp, Homo sapiens
tgcacagggcagctgg

SEQ ID NO: 6464599 - DNA, 17 bp, Homo sapiens
tgcacagggcagctggg

SEQ ID NO: 6464600 - DNA, 19 bp, Homo sapiens
tgcacagggcagctgggcc

SEQ ID NO: 6464601 - DNA, 21 bp, Homo sapiens
tgcacagggccctctgaggct

SEQ ID NO: 6464602 - DNA, 23 bp, Homo sapiens
tgcacaggggaaggaaataacat

SEQ ID NO: 6464603 - DNA, 12 bp, Homo sapiens
tgcacagggtcc

SEQ ID NO: 6464604 - DNA, 22 bp, Homo sapiens
tgcacagggtgtggtatgaggg

SEQ ID NO: 6464605 - DNA, 21 bp, Homo sapiens
tgcacagggtttggcccaagt

SEQ ID NO: 6464606 - DNA, 18 bp, Homo sapiens
tgcacagtaggatgtgga

SEQ ID NO: 6464607 - DNA, 15 bp, Homo sapiens
tgcacagtatctgct

SEQ ID NO: 6464608 - DNA, 23 bp, Homo sapiens
tgcacagtatctgctgttcttca

SEQ ID NO: 6464609 - DNA, 16 bp, Homo sapiens
tgcacagtcaaaacga

SEQ ID NO: 6464610 - DNA, 16 bp, Homo sapiens
tgcacagtcagaagga

SEQ ID NO: 6464611 - DNA, 15 bp, Homo sapiens
tgcacagtcatacaa

SEQ ID NO: 6464612 - DNA, 17 bp, Homo sapiens
tgcacagtgcatctcag

SEQ ID NO: 6464613 - DNA, 19 bp, Homo sapiens
tgcacagtgcatctcagcc

SEQ ID NO: 6464614 - DNA, 12 bp, Homo sapiens
tgcacagtgcct

SEQ ID NO: 6464615 - DNA, 18 bp, Homo sapiens
tgcacagtgctgttggtg

SEQ ID NO: 6464616 - DNA, 13 bp, Homo sapiens
tgcacagtggctt

SEQ ID NO: 6464617 - DNA, 19 bp, Homo sapiens
tgcacagtgttggtttcct

SEQ ID NO: 6464618 - DNA, 16 bp, Homo sapiens
tgcacagttctatttg

SEQ ID NO: 6464619 - DNA, 12 bp, Homo sapiens
tgcacataaact

SEQ ID NO: 6464620 - DNA, 15 bp, Homo sapiens
tgcacatacttgaga

SEQ ID NO: 6464621 - DNA, 14 bp, Homo sapiens
tgcacatagcagac

SEQ ID NO: 6464622 - DNA, 16 bp, Homo sapiens
tgcacatatacacatt

SEQ ID NO: 6464623 - DNA, 19 bp, Homo sapiens
tgcacatatattttttaca

SEQ ID NO: 6464624 - DNA, 20 bp, Homo sapiens
tgcacatatgggtgctggca

SEQ ID NO: 6464625 - DNA, 20 bp, Homo sapiens
tgcacatcatgagccttcag

SEQ ID NO: 6464626 - DNA, 16 bp, Homo sapiens
tgcacatcattcattc

SEQ ID NO: 6464627 - DNA, 18 bp, Homo sapiens
tgcacatcattcattcac

SEQ ID NO: 6464628 - DNA, 19 bp, Homo sapiens
tgcacatcattcattcact

SEQ ID NO: 6464629 - DNA, 20 bp, Homo sapiens
tgcacatccgcgtgtgcctg

SEQ ID NO: 6464630 - DNA, 21 bp, Homo sapiens
tgcacatccgcgtgtgcctgt

SEQ ID NO: 6464631 - DNA, 18 bp, Homo sapiens
tgcacatcctcattcact

SEQ ID NO: 6464632 - DNA, 19 bp, Homo sapiens
tgcacatcctcattcacta

SEQ ID NO: 6464633 - DNA, 22 bp, Homo sapiens
tgcacatccttcttggcttcct

SEQ ID NO: 6464634 - DNA, 15 bp, Homo sapiens
tgcacatctacatgc

SEQ ID NO: 6464635 - DNA, 20 bp, Homo sapiens
tgcacatctacatgccatgc

SEQ ID NO: 6464636 - DNA, 22 bp, Homo sapiens
tgcacatctacatgccatgcct

SEQ ID NO: 6464637 - DNA, 16 bp, Homo sapiens
tgcacatctctgcagt

SEQ ID NO: 6464638 - DNA, 22 bp, Homo sapiens
tgcacatctgtaaatctacaca

SEQ ID NO: 6464639 - DNA, 16 bp, Homo sapiens
tgcacatctgtgtctt

SEQ ID NO: 6464640 - DNA, 13 bp, Homo sapiens
tgcacatgaaagt

SEQ ID NO: 6464641 - DNA, 14 bp, Homo sapiens
tgcacatgaaagtt

SEQ ID NO: 6464642 - DNA, 15 bp, Homo sapiens
tgcacatgagtggaa

SEQ ID NO: 6464643 - DNA, 12 bp, Homo sapiens
tgcacatgattt

SEQ ID NO: 6464644 - DNA, 15 bp, Homo sapiens
tgcacatgatttcac

SEQ ID NO: 6464645 - DNA, 17 bp, Homo sapiens
tgcacatgatttcacaa

SEQ ID NO: 6464646 - DNA, 18 bp, Homo sapiens
tgcacatgatttcacaaa

SEQ ID NO: 6464647 - DNA, 22 bp, Homo sapiens
tgcacatgatttcacaaatatt

SEQ ID NO: 6464648 - DNA, 14 bp, Homo sapiens
tgcacatgcccctt

SEQ ID NO: 6464649 - DNA, 16 bp, Homo sapiens
tgcacatgctgtctgg

SEQ ID NO: 6464650 - DNA, 14 bp, Homo sapiens
tgcacatggcctga

SEQ ID NO: 6464651 - DNA, 21 bp, Homo sapiens
tgcacatgtaacatagattta

SEQ ID NO: 6464652 - DNA, 16 bp, Homo sapiens
tgcacatgtattctgt

SEQ ID NO: 6464653 - DNA, 15 bp, Homo sapiens
tgcacatgtcttaat

SEQ ID NO: 6464654 - DNA, 16 bp, Homo sapiens
tgcacatgtcttaatg

SEQ ID NO: 6464655 - DNA, 12 bp, Homo sapiens
tgcacatgtgtc

SEQ ID NO: 6464656 - DNA, 24 bp, Homo sapiens
tgcacatgttggaggagagagcct

SEQ ID NO: 6464657 - DNA, 13 bp, Homo sapiens
tgcacattaaatg

SEQ ID NO: 6464658 - DNA, 20 bp, Homo sapiens
tgcacattaggaacagagta

SEQ ID NO: 6464659 - DNA, 11 bp, Homo sapiens
tgcacattcct

SEQ ID NO: 6464660 - DNA, 15 bp, Homo sapiens
tgcacattctccctt

SEQ ID NO: 6464661 - DNA, 14 bp, Homo sapiens
tgcacattgcctgt

SEQ ID NO: 6464662 - DNA, 21 bp, Homo sapiens
tgcacattgcctgttctgctt

SEQ ID NO: 6464663 - DNA, 23 bp, Homo sapiens
tgcacattgcctgttctgcttcg

SEQ ID NO: 6464664 - DNA, 18 bp, Homo sapiens
tgcacattggaagctccc

SEQ ID NO: 6464665 - DNA, 19 bp, Homo sapiens
tgcacattggaagctccca

SEQ ID NO: 6464666 - DNA, 22 bp, Homo sapiens
tgcacattgggtggggctcctg

SEQ ID NO: 6464667 - DNA, 17 bp, Homo sapiens
tgcacattgttgttttt

SEQ ID NO: 6464668 - DNA, 13 bp, Homo sapiens
tgcacatttatat

SEQ ID NO: 6464669 - DNA, 16 bp, Homo sapiens
tgcacatttatatata

SEQ ID NO: 6464670 - DNA, 19 bp, Homo sapiens
tgcacatttcaaaacaaga

SEQ ID NO: 6464671 - DNA, 16 bp, Homo sapiens
tgcacatttcagaaat

SEQ ID NO: 6464672 - DNA, 18 bp, Homo sapiens
tgcacatttctttgcatt

SEQ ID NO: 6464673 - DNA, 20 bp, Homo sapiens
tgcacatttgaattcatttg

SEQ ID NO: 6464674 - DNA, 22 bp, Homo sapiens
tgcacatttgaattcatttgct

SEQ ID NO: 6464675 - DNA, 13 bp, Homo sapiens
tgcacatttggaa

SEQ ID NO: 6464676 - DNA, 18 bp, Homo sapiens
tgcacattttccacggaa

SEQ ID NO: 6464677 - DNA, 20 bp, Homo sapiens
tgcacattttccacggaaac

SEQ ID NO: 6464678 - DNA, 23 bp, Homo sapiens
tgcacattttccacggaaacaga

SEQ ID NO: 6464679 - DNA, 15 bp, Homo sapiens
tgcacattttgattt

SEQ ID NO: 6464680 - DNA, 17 bp, Homo sapiens
tgcacattttgtacatt

SEQ ID NO: 6464681 - DNA, 22 bp, Homo sapiens
tgcacatttttttctatgcata

SEQ ID NO: 6464682 - DNA, 16 bp, Homo sapiens
tgcaccaacccagccg

SEQ ID NO: 6464683 - DNA, 22 bp, Homo sapiens
tgcaccaacccagccgctgccc

SEQ ID NO: 6464684 - DNA, 23 bp, Homo sapiens
tgcaccaagaaagcttcttcaga

SEQ ID NO: 6464685 - DNA, 17 bp, Homo sapiens
tgcaccaagtacagcct

SEQ ID NO: 6464686 - DNA, 16 bp, Homo sapiens
tgcaccacacctggca

SEQ ID NO: 6464687 - DNA, 18 bp, Homo sapiens
tgcaccaccaagccaagg

SEQ ID NO: 6464688 - DNA, 21 bp, Homo sapiens
tgcaccaccgaccaactccag

SEQ ID NO: 6464689 - DNA, 16 bp, Homo sapiens
tgcaccacgcccggct

SEQ ID NO: 6464690 - DNA, 22 bp, Homo sapiens
tgcaccacggcgtttttttaca

SEQ ID NO: 6464691 - DNA, 23 bp, Homo sapiens
tgcaccactgcactccagcctgg

SEQ ID NO: 6464692 - DNA, 18 bp, Homo sapiens
tgcaccagaaatgtttat

SEQ ID NO: 6464693 - DNA, 12 bp, Homo sapiens
tgcaccagagca

SEQ ID NO: 6464694 - DNA, 19 bp, Homo sapiens
tgcaccagcccttccctgc

SEQ ID NO: 6464695 - DNA, 10 bp, Homo sapiens
tgcaccagga

SEQ ID NO: 6464696 - DNA, 20 bp, Homo sapiens
tctaccacacacagcctgtc

SEQ ID NO: 6464697 - DNA, 21 bp, Homo sapiens
tctaccagactgtgtattcat

SEQ ID NO: 6464698 - DNA, 23 bp, Homo sapiens
tctaccagattctgcctatgtaa

SEQ ID NO: 6464699 - DNA, 22 bp, Homo sapiens
tctaccagcctccctatttttt

SEQ ID NO: 6464700 - DNA, 16 bp, Homo sapiens
tctaccaggcaaattc

SEQ ID NO: 6464701 - DNA, 22 bp, Homo sapiens
tctaccagtgcaggctggccag

SEQ ID NO: 6464702 - DNA, 17 bp, Homo sapiens
tctaccatcatccggtt

SEQ ID NO: 6464703 - DNA, 15 bp, Homo sapiens
tctaccatctccctc

SEQ ID NO: 6464704 - DNA, 19 bp, Homo sapiens
tctaccatgaacagaaaac

SEQ ID NO: 6464705 - DNA, 14 bp, Homo sapiens
tctaccattaaaat

SEQ ID NO: 6464706 - DNA, 14 bp, Homo sapiens
tctaccatttcaga

SEQ ID NO: 6464707 - DNA, 14 bp, Homo sapiens
tctacccaaaccct

SEQ ID NO: 6464708 - DNA, 17 bp, Homo sapiens
tctacccagactcagag

SEQ ID NO: 6464709 - DNA, 14 bp, Homo sapiens
tctacccagagcct

SEQ ID NO: 6464710 - DNA, 12 bp, Homo sapiens
tctacccagccc

SEQ ID NO: 6464711 - DNA, 14 bp, Homo sapiens
tctacccagcccat

SEQ ID NO: 6464712 - DNA, 21 bp, Homo sapiens
tctacccagcccatcttgcct

SEQ ID NO: 6464713 - DNA, 19 bp, Homo sapiens
tctacccagcgagccctgg

SEQ ID NO: 6464714 - DNA, 21 bp, Homo sapiens
tctacccagtgctccagtttc

SEQ ID NO: 6464715 - DNA, 22 bp, Homo sapiens
tctaccccacctgacctctgca

SEQ ID NO: 6464716 - DNA, 21 bp, Homo sapiens
tctaccccagactagatgtag

SEQ ID NO: 6464717 - DNA, 15 bp, Homo sapiens
tctacccccaacacc

SEQ ID NO: 6464718 - DNA, 14 bp, Homo sapiens
tctaccccccacct

SEQ ID NO: 6464719 - DNA, 15 bp, Homo sapiens
tctaccccttactta

SEQ ID NO: 6464720 - DNA, 14 bp, Homo sapiens
tctacccctttctg

SEQ ID NO: 6464721 - DNA, 17 bp, Homo sapiens
tctacccggcccagaga

SEQ ID NO: 6464722 - DNA, 14 bp, Homo sapiens
tctacccgtgcctg

SEQ ID NO: 6464723 - DNA, 19 bp, Homo sapiens
tctacccgtgcctgggccc

SEQ ID NO: 6464724 - DNA, 21 bp, Homo sapiens
tctacccgtgcctgggcccct

SEQ ID NO: 6464725 - DNA, 16 bp, Homo sapiens
tctacccgttccaaaa

SEQ ID NO: 6464726 - DNA, 16 bp, Homo sapiens
tctaccctcccacccc

SEQ ID NO: 6464727 - DNA, 17 bp, Homo sapiens
tctaccctgatcacctc

SEQ ID NO: 6464728 - DNA, 14 bp, Homo sapiens
tctaccctgcagct

SEQ ID NO: 6464729 - DNA, 21 bp, Homo sapiens
tctaccctgcctgtactactc

SEQ ID NO: 6464730 - DNA, 17 bp, Homo sapiens
tctaccctgctccctgc

SEQ ID NO: 6464731 - DNA, 15 bp, Homo sapiens
tctaccctggaaaag

SEQ ID NO: 6464732 - DNA, 13 bp, Homo sapiens
tctaccctgggat

SEQ ID NO: 6464733 - DNA, 13 bp, Homo sapiens
tctaccctgtcct

SEQ ID NO: 6464734 - DNA, 19 bp, Homo sapiens
tctaccctgtctgtccctt

SEQ ID NO: 6464735 - DNA, 18 bp, Homo sapiens
tctacccttggaaagaaa

SEQ ID NO: 6464736 - DNA, 13 bp, Homo sapiens
tctacccttttcc

SEQ ID NO: 6464737 - DNA, 15 bp, Homo sapiens
tctacccttttcctt

SEQ ID NO: 6464738 - DNA, 18 bp, Homo sapiens
tctaccggagagagaatg

SEQ ID NO: 6464739 - DNA, 23 bp, Homo sapiens
tctacctaatgtctcactgttct

SEQ ID NO: 6464740 - DNA, 22 bp, Homo sapiens
tctacctagatttaatataaag

SEQ ID NO: 6464741 - DNA, 16 bp, Homo sapiens
tctacctcatctctga

SEQ ID NO: 6464742 - DNA, 22 bp, Homo sapiens
tctacctcatctctgaaaattc

SEQ ID NO: 6464743 - DNA, 13 bp, Homo sapiens
tctacctccaccc

SEQ ID NO: 6464744 - DNA, 18 bp, Homo sapiens
tctacctccaccctgcat

SEQ ID NO: 6464745 - DNA, 17 bp, Homo sapiens
tctacctcctcctttgt

SEQ ID NO: 6464746 - DNA, 19 bp, Homo sapiens
tctacctccttagctttcc

SEQ ID NO: 6464747 - DNA, 16 bp, Homo sapiens
tctacctctctttctc

SEQ ID NO: 6464748 - DNA, 22 bp, Homo sapiens
tctacctgagcattcaggcagc

SEQ ID NO: 6464749 - DNA, 19 bp, Homo sapiens
tctacctgaggggcctctt

SEQ ID NO: 6464750 - DNA, 15 bp, Homo sapiens
tctacctgcaggact

SEQ ID NO: 6464751 - DNA, 21 bp, Homo sapiens
tctacctgcaggcggggctcc

SEQ ID NO: 6464752 - DNA, 16 bp, Homo sapiens
tctacctgccactcac

SEQ ID NO: 6464753 - DNA, 13 bp, Homo sapiens
tctacctggcaga

SEQ ID NO: 6464754 - DNA, 15 bp, Homo sapiens
tctacctggtctggt

SEQ ID NO: 6464755 - DNA, 15 bp, Homo sapiens
tctaccttccagtca

SEQ ID NO: 6464756 - DNA, 14 bp, Homo sapiens
tctaccttcctgca

SEQ ID NO: 6464757 - DNA, 15 bp, Homo sapiens
tctaccttctcccca

SEQ ID NO: 6464758 - DNA, 14 bp, Homo sapiens
tctaccttttctct

SEQ ID NO: 6464759 - DNA, 13 bp, Homo sapiens
tctaccttttctg

SEQ ID NO: 6464760 - DNA, 14 bp, Homo sapiens
tctaccttttctgg

SEQ ID NO: 6464761 - DNA, 17 bp, Homo sapiens
tctacgaagccacaggc

SEQ ID NO: 6464762 - DNA, 18 bp, Homo sapiens
tctacgaagccacaggcc

SEQ ID NO: 6464763 - DNA, 20 bp, Homo sapiens
tctacgccaaagtgcagccc

SEQ ID NO: 6464764 - DNA, 14 bp, Homo sapiens
tctacgtcatgtat

SEQ ID NO: 6464765 - DNA, 16 bp, Homo sapiens
tctacgttatgaaaac

SEQ ID NO: 6464766 - DNA, 15 bp, Homo sapiens
tctacgttctccagc

SEQ ID NO: 6464767 - DNA, 22 bp, Homo sapiens
tctacgtttccccaataaagcc

SEQ ID NO: 6464768 - DNA, 22 bp, Homo sapiens
tctactaaaaacacaaaaatta

SEQ ID NO: 6464769 - DNA, 12 bp, Homo sapiens
tctactaaaaat

SEQ ID NO: 6464770 - DNA, 13 bp, Homo sapiens
tctactaaaaata

SEQ ID NO: 6464771 - DNA, 20 bp, Homo sapiens
tctactaaaaatacaaaaat

SEQ ID NO: 6464772 - DNA, 21 bp, Homo sapiens
tctactaaaattcaaaaacaa

SEQ ID NO: 6464773 - DNA, 13 bp, Homo sapiens
tctactaaataat

SEQ ID NO: 6464774 - DNA, 17 bp, Homo sapiens
tctactaaatattttat

SEQ ID NO: 6464775 - DNA, 19 bp, Homo sapiens
tctactaagtgatgctgtg

SEQ ID NO: 6464776 - DNA, 18 bp, Homo sapiens
tctactaattccacacct

SEQ ID NO: 6464777 - DNA, 12 bp, Homo sapiens
tctactacctac

SEQ ID NO: 6464778 - DNA, 18 bp, Homo sapiens
tctactacctacgtttgc

SEQ ID NO: 6464779 - DNA, 21 bp, Homo sapiens
tctactagtaataatgtaata

SEQ ID NO: 6464780 - DNA, 20 bp, Homo sapiens
tctactatgatcagaagaac

SEQ ID NO: 6464781 - DNA, 20 bp, Homo sapiens
tctactattaagtttgaaaa

SEQ ID NO: 6464782 - DNA, 13 bp, Homo sapiens
tctactcaaacac

SEQ ID NO: 6464783 - DNA, 20 bp, Homo sapiens
tctactcaacccattgttgt

SEQ ID NO: 6464784 - DNA, 22 bp, Homo sapiens
tctactcacagctgaagaaaat

SEQ ID NO: 6464785 - DNA, 21 bp, Homo sapiens
tctactcacttttcccactcc

SEQ ID NO: 6464786 - DNA, 21 bp, Homo sapiens
tctactcagaaatttttattt

SEQ ID NO: 6464787 - DNA, 18 bp, Homo sapiens
tctactcagcatttgatt

SEQ ID NO: 6464788 - DNA, 18 bp, Homo sapiens
tctactcatatatatcta

SEQ ID NO: 6464789 - DNA, 14 bp, Homo sapiens
tctactcatttttc

SEQ ID NO: 6464790 - DNA, 20 bp, Homo sapiens
tctactccattaaatataaa

SEQ ID NO: 6464791 - DNA, 21 bp, Homo sapiens
tctactcccaagtatggggtt

SEQ ID NO: 6464792 - DNA, 17 bp, Homo sapiens
tctactcctacctcagc

SEQ ID NO: 6464793 - DNA, 19 bp, Homo sapiens
tctactcctacctcagcct

SEQ ID NO: 6464794 - DNA, 17 bp, Homo sapiens
tctactcctagaagaac

SEQ ID NO: 6464795 - DNA, 16 bp, Homo sapiens
tctactcctcacagca

SEQ ID NO: 6464796 - DNA, 21 bp, Homo sapiens
tctactcgagttacagacaaa

SEQ ID NO: 6464797 - DNA, 16 bp, Homo sapiens
tctactctaggactgg

SEQ ID NO: 6464798 - DNA, 23 bp, Homo sapiens
tctactctggaccaaggagcatc

SEQ ID NO: 6464799 - DNA, 16 bp, Homo sapiens
tctactcttaagccat

SEQ ID NO: 6464800 - DNA, 18 bp, Homo sapiens
tctactcttaagccatct

SEQ ID NO: 6464801 - DNA, 13 bp, Homo sapiens
tctactcttcctg

SEQ ID NO: 6464802 - DNA, 14 bp, Homo sapiens
tctactcttcctgt

SEQ ID NO: 6464803 - DNA, 22 bp, Homo sapiens
tctactcttgagagctcaggca

SEQ ID NO: 6464804 - DNA, 12 bp, Homo sapiens
tctactgagcca

SEQ ID NO: 6464805 - DNA, 13 bp, Homo sapiens
tctactgagccac

SEQ ID NO: 6464806 - DNA, 24 bp, Homo sapiens
tctactgcatttagggagtattct

SEQ ID NO: 6464807 - DNA, 17 bp, Homo sapiens
tctactgccccagctcc

SEQ ID NO: 6464808 - DNA, 15 bp, Homo sapiens
tctactgccctcccc

SEQ ID NO: 6464809 - DNA, 20 bp, Homo sapiens
tctactgccctccccttccc

SEQ ID NO: 6464810 - DNA, 15 bp, Homo sapiens
tctactgccttgaaa

SEQ ID NO: 6464811 - DNA, 21 bp, Homo sapiens
tctactggaaatgtagcactt

SEQ ID NO: 6464812 - DNA, 14 bp, Homo sapiens
tctactggcctgta

SEQ ID NO: 6464813 - DNA, 19 bp, Homo sapiens
tctactgggaaggctactt

SEQ ID NO: 6464814 - DNA, 19 bp, Homo sapiens
tctactgggagcctaccca

SEQ ID NO: 6464815 - DNA, 15 bp, Homo sapiens
tctactgtacttttt

SEQ ID NO: 6464816 - DNA, 14 bp, Homo sapiens
tctactgtatcaat

SEQ ID NO: 6464817 - DNA, 20 bp, Homo sapiens
tctactgtatcaataaaatt

SEQ ID NO: 6464818 - DNA, 23 bp, Homo sapiens
tctactgtcaaatgatgtgcaaa

SEQ ID NO: 6464819 - DNA, 19 bp, Homo sapiens
tctactgttatgtgagaac

SEQ ID NO: 6464820 - DNA, 15 bp, Homo sapiens
tctactgttgcacag

SEQ ID NO: 6464821 - DNA, 21 bp, Homo sapiens
tctacttaatccaatgggttt

SEQ ID NO: 6464822 - DNA, 19 bp, Homo sapiens
tctacttacacatcttcca

SEQ ID NO: 6464823 - DNA, 13 bp, Homo sapiens
tctacttcagctt

SEQ ID NO: 6464824 - DNA, 17 bp, Homo sapiens
tctacttcagctttgga

SEQ ID NO: 6464825 - DNA, 14 bp, Homo sapiens
tctacttcatagct

SEQ ID NO: 6464826 - DNA, 20 bp, Homo sapiens
tctacttcatgtaatccaaa

SEQ ID NO: 6464827 - DNA, 12 bp, Homo sapiens
tctacttcccct

SEQ ID NO: 6464828 - DNA, 18 bp, Homo sapiens
tctacttcccctgggatg

SEQ ID NO: 6464829 - DNA, 12 bp, Homo sapiens
tctacttctgtg

SEQ ID NO: 6464830 - DNA, 15 bp, Homo sapiens
tctacttctgtgtct

SEQ ID NO: 6464831 - DNA, 21 bp, Homo sapiens
tctacttctttttctttgaga

SEQ ID NO: 6464832 - DNA, 18 bp, Homo sapiens
tctacttgatatttcctt

SEQ ID NO: 6464833 - DNA, 16 bp, Homo sapiens
tctacttgctctggac

SEQ ID NO: 6464834 - DNA, 14 bp, Homo sapiens
tctacttggtggtt

SEQ ID NO: 6464835 - DNA, 20 bp, Homo sapiens
tctacttgtccagttcaaat

SEQ ID NO: 6464836 - DNA, 20 bp, Homo sapiens
tctactttaaattgtggatg

SEQ ID NO: 6464837 - DNA, 22 bp, Homo sapiens
tctactttagaatgagagtgtg

SEQ ID NO: 6464838 - DNA, 21 bp, Homo sapiens
tctactttataatcaagacaa

SEQ ID NO: 6464839 - DNA, 12 bp, Homo sapiens
tctactttcctg

SEQ ID NO: 6464840 - DNA, 19 bp, Homo sapiens
tctactttctcttgtttaa

SEQ ID NO: 6464841 - DNA, 14 bp, Homo sapiens
tctactttgaaata

SEQ ID NO: 6464842 - DNA, 17 bp, Homo sapiens
tctactttgaaatattt

SEQ ID NO: 6464843 - DNA, 20 bp, Homo sapiens
tctactttgaagtcatacca

SEQ ID NO: 6464844 - DNA, 14 bp, Homo sapiens
tctactttgattct

SEQ ID NO: 6464845 - DNA, 16 bp, Homo sapiens
tctactttgattctga

SEQ ID NO: 6464846 - DNA, 14 bp, Homo sapiens
tctactttttcctt

SEQ ID NO: 6464847 - DNA, 15 bp, Homo sapiens
tctactttttccttc

SEQ ID NO: 6464848 - DNA, 16 bp, Homo sapiens
tctactttttccttcc

SEQ ID NO: 6464849 - DNA, 18 bp, Homo sapiens
tctactttttccttcctg

SEQ ID NO: 6464850 - DNA, 15 bp, Homo sapiens
tctactttttctgta

SEQ ID NO: 6464851 - DNA, 21 bp, Homo sapiens
tctactttttgaacttttcat

SEQ ID NO: 6464852 - DNA, 23 bp, Homo sapiens
tctactttttgaacttttcattc

SEQ ID NO: 6464853 - DNA, 20 bp, Homo sapiens
tctactttttgtatttagta

SEQ ID NO: 6464854 - DNA, 17 bp, Homo sapiens
tctagaaaaacaggcac

SEQ ID NO: 6464855 - DNA, 21 bp, Homo sapiens
tctagaaaataatgcaaatgt

SEQ ID NO: 6464856 - DNA, 14 bp, Homo sapiens
tctagaaacaaaca

SEQ ID NO: 6464857 - DNA, 21 bp, Homo sapiens
tctagaaaccagtatggaagg

SEQ ID NO: 6464858 - DNA, 22 bp, Homo sapiens
tctagaaacgagttggtgtctt

SEQ ID NO: 6464859 - DNA, 14 bp, Homo sapiens
tctagaaactctgg

SEQ ID NO: 6464860 - DNA, 17 bp, Homo sapiens
tctagaaagagccttaa

SEQ ID NO: 6464861 - DNA, 22 bp, Homo sapiens
tctagaaagagccttaatgtat

SEQ ID NO: 6464862 - DNA, 17 bp, Homo sapiens
tctagaaagtgggttca

SEQ ID NO: 6464863 - DNA, 22 bp, Homo sapiens
tctagaaatacacttttttcca

SEQ ID NO: 6464864 - DNA, 11 bp, Homo sapiens
tctagaaatgc

SEQ ID NO: 6464865 - DNA, 14 bp, Homo sapiens
tctagaaatgttca

SEQ ID NO: 6464866 - DNA, 21 bp, Homo sapiens
tctagaaatgttcacaaggta

SEQ ID NO: 6464867 - DNA, 15 bp, Homo sapiens
tctagaacacaggca

SEQ ID NO: 6464868 - DNA, 18 bp, Homo sapiens
tctagaacacccactggc

SEQ ID NO: 6464869 - DNA, 21 bp, Homo sapiens
tctagaacacccactggccag

SEQ ID NO: 6464870 - DNA, 20 bp, Homo sapiens
tctagaacatccctgccagc

SEQ ID NO: 6464871 - DNA, 19 bp, Homo sapiens
tctagaaccacttcctgct

SEQ ID NO: 6464872 - DNA, 20 bp, Homo sapiens
tctagaaccacttcctgcta

SEQ ID NO: 6464873 - DNA, 21 bp, Homo sapiens
tctagaaccttctagaacctg

SEQ ID NO: 6464874 - DNA, 16 bp, Homo sapiens
tctagaagaaatgaaa

SEQ ID NO: 6464875 - DNA, 18 bp, Homo sapiens
tgcaccaggactggctgt

SEQ ID NO: 6464876 - DNA, 13 bp, Homo sapiens
tgcaccaggagac

SEQ ID NO: 6464877 - DNA, 15 bp, Homo sapiens
tgcaccaggagacag

SEQ ID NO: 6464878 - DNA, 20 bp, Homo sapiens
tgcaccagtgccgcctgtgc

SEQ ID NO: 6464879 - DNA, 22 bp, Homo sapiens
tgcaccagttttatccataatg

SEQ ID NO: 6464880 - DNA, 20 bp, Homo sapiens
tgcaccatagtatgctctga

SEQ ID NO: 6464881 - DNA, 16 bp, Homo sapiens
tgcaccatcccttttt

SEQ ID NO: 6464882 - DNA, 22 bp, Homo sapiens
tgcaccatccctttttgaagtg

SEQ ID NO: 6464883 - DNA, 16 bp, Homo sapiens
tgcaccattctttctt

SEQ ID NO: 6464884 - DNA, 23 bp, Homo sapiens
tgcaccattctttcttggtgcat

SEQ ID NO: 6464885 - DNA, 15 bp, Homo sapiens
tgcacccaactactg

SEQ ID NO: 6464886 - DNA, 21 bp, Homo sapiens
tgcacccaactactgagctga

SEQ ID NO: 6464887 - DNA, 21 bp, Homo sapiens
tgcacccacccctgcccaggc

SEQ ID NO: 6464888 - DNA, 17 bp, Homo sapiens
tgcacccactcaccagg

SEQ ID NO: 6464889 - DNA, 15 bp, Homo sapiens
tgcacccactgaaag

SEQ ID NO: 6464890 - DNA, 21 bp, Homo sapiens
tgcacccagaaattccttccc

SEQ ID NO: 6464891 - DNA, 18 bp, Homo sapiens
tgcacccagccaaacaca

SEQ ID NO: 6464892 - DNA, 14 bp, Homo sapiens
tgcacccagcccag

SEQ ID NO: 6464893 - DNA, 16 bp, Homo sapiens
tgcacccagcccagat

SEQ ID NO: 6464894 - DNA, 23 bp, Homo sapiens
tgcacccagccccaaggggtggc

SEQ ID NO: 6464895 - DNA, 16 bp, Homo sapiens
tgcacccagccctggt

SEQ ID NO: 6464896 - DNA, 21 bp, Homo sapiens
tgcacccagggtcccagcctg

SEQ ID NO: 6464897 - DNA, 18 bp, Homo sapiens
tgcacccatgggctctga

SEQ ID NO: 6464898 - DNA, 20 bp, Homo sapiens
tgcacccatgggctctgaca

SEQ ID NO: 6464899 - DNA, 21 bp, Homo sapiens
tgcaccccaaagctttcctgc

SEQ ID NO: 6464900 - DNA, 14 bp, Homo sapiens
tgcaccccacagga

SEQ ID NO: 6464901 - DNA, 22 bp, Homo sapiens
tgcaccccagcattccagctct

SEQ ID NO: 6464902 - DNA, 17 bp, Homo sapiens
tgcaccccagcgtcagg

SEQ ID NO: 6464903 - DNA, 19 bp, Homo sapiens
tgcaccccagcgtcaggcc

SEQ ID NO: 6464904 - DNA, 14 bp, Homo sapiens
tgcaccccatgctg

SEQ ID NO: 6464905 - DNA, 14 bp, Homo sapiens
tgcacccccctggg

SEQ ID NO: 6464906 - DNA, 17 bp, Homo sapiens
tgcacccccctgtgcct

SEQ ID NO: 6464907 - DNA, 14 bp, Homo sapiens
tgcacccctcccca

SEQ ID NO: 6464908 - DNA, 18 bp, Homo sapiens
tgcacccctccccattca

SEQ ID NO: 6464909 - DNA, 22 bp, Homo sapiens
tgcacccctccccattcacaga

SEQ ID NO: 6464910 - DNA, 21 bp, Homo sapiens
tgcacccctgagccagcaggg

SEQ ID NO: 6464911 - DNA, 20 bp, Homo sapiens
tgcaccccttctctcctccc

SEQ ID NO: 6464912 - DNA, 16 bp, Homo sapiens
tgcacccctttcctcc

SEQ ID NO: 6464913 - DNA, 23 bp, Homo sapiens
tgcacccctttcctccccataca

SEQ ID NO: 6464914 - DNA, 19 bp, Homo sapiens
tgcacccctttttcccgcc

SEQ ID NO: 6464915 - DNA, 17 bp, Homo sapiens
tgcacccgcctcgacct

SEQ ID NO: 6464916 - DNA, 14 bp, Homo sapiens
tgcacccgcctctc

SEQ ID NO: 6464917 - DNA, 21 bp, Homo sapiens
tgcacccggcctggatgccag

SEQ ID NO: 6464918 - DNA, 13 bp, Homo sapiens
tgcacccgtgcca

SEQ ID NO: 6464919 - DNA, 18 bp, Homo sapiens
tgcacccgtgccacgcgc

SEQ ID NO: 6464920 - DNA, 22 bp, Homo sapiens
tgcacccgtgccacgcgctctg

SEQ ID NO: 6464921 - DNA, 23 bp, Homo sapiens
tgcaccctcaacctcctgggttc

SEQ ID NO: 6464922 - DNA, 16 bp, Homo sapiens
tgcaccctcaggcagg

SEQ ID NO: 6464923 - DNA, 19 bp, Homo sapiens
tgcaccctccacaggagcc

SEQ ID NO: 6464924 - DNA, 22 bp, Homo sapiens
tgcaccctccacaggagccgca

SEQ ID NO: 6464925 - DNA, 16 bp, Homo sapiens
tgcaccctccaccctg

SEQ ID NO: 6464926 - DNA, 16 bp, Homo sapiens
tgcaccctccgccttc

SEQ ID NO: 6464927 - DNA, 14 bp, Homo sapiens
tgcaccctctatcc

SEQ ID NO: 6464928 - DNA, 23 bp, Homo sapiens
tgcaccctctgctatgtctgtga

SEQ ID NO: 6464929 - DNA, 20 bp, Homo sapiens
tgcaccctgcgcctccagag

SEQ ID NO: 6464930 - DNA, 21 bp, Homo sapiens
tgcaccctgcgcctccagagg

SEQ ID NO: 6464931 - DNA, 20 bp, Homo sapiens
tgcacccttccacagctggc

SEQ ID NO: 6464932 - DNA, 14 bp, Homo sapiens
tgcacccttccctc

SEQ ID NO: 6464933 - DNA, 18 bp, Homo sapiens
tgcacccttcttttctca

SEQ ID NO: 6464934 - DNA, 18 bp, Homo sapiens
tgcaccgccgcagaagca

SEQ ID NO: 6464935 - DNA, 17 bp, Homo sapiens
tgcaccgcctgccctcc

SEQ ID NO: 6464936 - DNA, 22 bp, Homo sapiens
tgcaccgcctgccctcccgcac

SEQ ID NO: 6464937 - DNA, 16 bp, Homo sapiens
tgcaccggctggcctg

SEQ ID NO: 6464938 - DNA, 19 bp, Homo sapiens
tgcaccggctggcctggcc

SEQ ID NO: 6464939 - DNA, 16 bp, Homo sapiens
tgcaccggggcctggg

SEQ ID NO: 6464940 - DNA, 14 bp, Homo sapiens
tgcaccgtggtcag

SEQ ID NO: 6464941 - DNA, 21 bp, Homo sapiens
tgcacctaatccccataactt

SEQ ID NO: 6464942 - DNA, 23 bp, Homo sapiens
tgcacctacccatacaccccctc

SEQ ID NO: 6464943 - DNA, 14 bp, Homo sapiens
tgcacctataaata

SEQ ID NO: 6464944 - DNA, 14 bp, Homo sapiens
tgcacctatctcag

SEQ ID NO: 6464945 - DNA, 20 bp, Homo sapiens
tgcacctatctcagccatag

SEQ ID NO: 6464946 - DNA, 16 bp, Homo sapiens
tgcacctcaaggtcat

SEQ ID NO: 6464947 - DNA, 16 bp, Homo sapiens
tgcacctcagcctccc

SEQ ID NO: 6464948 - DNA, 15 bp, Homo sapiens
tgcacctcagggcca

SEQ ID NO: 6464949 - DNA, 15 bp, Homo sapiens
tgcacctccccccac

SEQ ID NO: 6464950 - DNA, 16 bp, Homo sapiens
tgcacctcccttccct

SEQ ID NO: 6464951 - DNA, 18 bp, Homo sapiens
tgcacctcctaccctccc

SEQ ID NO: 6464952 - DNA, 20 bp, Homo sapiens
tgcacctcctaccctcccac

SEQ ID NO: 6464953 - DNA, 14 bp, Homo sapiens
tgcacctctggcta

SEQ ID NO: 6464954 - DNA, 17 bp, Homo sapiens
tgcacctctgttcattt

SEQ ID NO: 6464955 - DNA, 20 bp, Homo sapiens
tgcacctctgttcatttcac

SEQ ID NO: 6464956 - DNA, 14 bp, Homo sapiens
tgcacctgagaccc

SEQ ID NO: 6464957 - DNA, 13 bp, Homo sapiens
tgcacctgagcct

SEQ ID NO: 6464958 - DNA, 16 bp, Homo sapiens
tgcacctgagcctgtt

SEQ ID NO: 6464959 - DNA, 22 bp, Homo sapiens
tgcacctgaggcccagcagagc

SEQ ID NO: 6464960 - DNA, 16 bp, Homo sapiens
tgcacctgcagccaag

SEQ ID NO: 6464961 - DNA, 17 bp, Homo sapiens
tgcacctgcagccaagc

SEQ ID NO: 6464962 - DNA, 15 bp, Homo sapiens
tgcacctgcagcgcg

SEQ ID NO: 6464963 - DNA, 16 bp, Homo sapiens
tgcacctgcaggctta

SEQ ID NO: 6464964 - DNA, 11 bp, Homo sapiens
tgcacctgcat

SEQ ID NO: 6464965 - DNA, 12 bp, Homo sapiens
tgcacctgcccc

SEQ ID NO: 6464966 - DNA, 14 bp, Homo sapiens
tgcacctgccccag

SEQ ID NO: 6464967 - DNA, 15 bp, Homo sapiens
tgcacctgccccagg

SEQ ID NO: 6464968 - DNA, 16 bp, Homo sapiens
tgcacctgccccaggc

SEQ ID NO: 6464969 - DNA, 13 bp, Homo sapiens
tgcacctgccccg

SEQ ID NO: 6464970 - DNA, 12 bp, Homo sapiens
tgcacctgcctc

SEQ ID NO: 6464971 - DNA, 22 bp, Homo sapiens
tgcacctgcctccaccagcaag

SEQ ID NO: 6464972 - DNA, 18 bp, Homo sapiens
tgcacctgcctgccgctg

SEQ ID NO: 6464973 - DNA, 19 bp, Homo sapiens
  misc_feature (10)..(10): n is a, c, g or t
tgcacctgcnttgtccctg

SEQ ID NO: 6464974 - DNA, 21 bp, Homo sapiens
tgcacctgctgcgtccccact

SEQ ID NO: 6464975 - DNA, 21 bp, Homo sapiens
tgcacctgggcagctcctccc

SEQ ID NO: 6464976 - DNA, 22 bp, Homo sapiens
tgcacctgggcagctcctccct

SEQ ID NO: 6464977 - DNA, 13 bp, Homo sapiens
tgcacctgtcccc

SEQ ID NO: 6464978 - DNA, 16 bp, Homo sapiens
tgcacctgtccccacc

SEQ ID NO: 6464979 - DNA, 21 bp, Homo sapiens
tgcacctgtccccaccctcca

SEQ ID NO: 6464980 - DNA, 22 bp, Homo sapiens
tgcacctgtggcctctcagtca

SEQ ID NO: 6464981 - DNA, 22 bp, Homo sapiens
tgcaccttcactctccagggta

SEQ ID NO: 6464982 - DNA, 13 bp, Homo sapiens
tgcaccttctgac

SEQ ID NO: 6464983 - DNA, 23 bp, Homo sapiens
tgcaccttctgacgcagcctgag

SEQ ID NO: 6464984 - DNA, 15 bp, Homo sapiens
tgcaccttgccaggg

SEQ ID NO: 6464985 - DNA, 16 bp, Homo sapiens
tgcaccttgccaggga

SEQ ID NO: 6464986 - DNA, 12 bp, Homo sapiens
tgcaccttgctc

SEQ ID NO: 6464987 - DNA, 16 bp, Homo sapiens
tgcaccttgtaaatgc

SEQ ID NO: 6464988 - DNA, 14 bp, Homo sapiens
tgcaccttgtgaag

SEQ ID NO: 6464989 - DNA, 23 bp, Homo sapiens
tgcaccttgtgaaggaaaaacat

SEQ ID NO: 6464990 - DNA, 23 bp, Homo sapiens
tgcacctttgtctggatgcacac

SEQ ID NO: 6464991 - DNA, 12 bp, Homo sapiens
tgcaccttttca

SEQ ID NO: 6464992 - DNA, 15 bp, Homo sapiens
tgcacgaccttggga

SEQ ID NO: 6464993 - DNA, 20 bp, Homo sapiens
tgcacgacgccctctcccca

SEQ ID NO: 6464994 - DNA, 16 bp, Homo sapiens
tgcacgcacacatcag

SEQ ID NO: 6464995 - DNA, 19 bp, Homo sapiens
tgcacgcacactgtctgcc

SEQ ID NO: 6464996 - DNA, 20 bp, Homo sapiens
tgcacgcaccccgcccctgc

SEQ ID NO: 6464997 - DNA, 13 bp, Homo sapiens
tgcacgcagatta

SEQ ID NO: 6464998 - DNA, 21 bp, Homo sapiens
tgcacgcagattagcaggcca

SEQ ID NO: 6464999 - DNA, 18 bp, Homo sapiens
tgcacgcaggcacagcag

SEQ ID NO: 6465000 - DNA, 15 bp, Homo sapiens
tgcacgcccatgtgt

SEQ ID NO: 6465001 - DNA, 19 bp, Homo sapiens
tgcacgcccatgtgtgagt

SEQ ID NO: 6465002 - DNA, 12 bp, Homo sapiens
tgcacgccgtgg

SEQ ID NO: 6465003 - DNA, 15 bp, Homo sapiens
tgcacgcctgagcgt

SEQ ID NO: 6465004 - DNA, 20 bp, Homo sapiens
tgcacgcgccctttctacca

SEQ ID NO: 6465005 - DNA, 20 bp, Homo sapiens
tgcacgcggactccggggtt

SEQ ID NO: 6465006 - DNA, 19 bp, Homo sapiens
tgcacgctcaatgcccagt

SEQ ID NO: 6465007 - DNA, 16 bp, Homo sapiens
tgcacgctcccctcca

SEQ ID NO: 6465008 - DNA, 14 bp, Homo sapiens
tgcacgctgcccag

SEQ ID NO: 6465009 - DNA, 17 bp, Homo sapiens
tgcacgctgcccagggg

SEQ ID NO: 6465010 - DNA, 19 bp, Homo sapiens
tgcacgctgcccaggggct

SEQ ID NO: 6465011 - DNA, 22 bp, Homo sapiens
tgcacgctgggcaatgagaatc

SEQ ID NO: 6465012 - DNA, 15 bp, Homo sapiens
tgcacgctggggaag

SEQ ID NO: 6465013 - DNA, 15 bp, Homo sapiens
tgcacggctgctcgg

SEQ ID NO: 6465014 - DNA, 20 bp, Homo sapiens
tgcacgggatgcgtgggagg

SEQ ID NO: 6465015 - DNA, 21 bp, Homo sapiens
tgcacgggatgcgtgggaggc

SEQ ID NO: 6465016 - DNA, 14 bp, Homo sapiens
tgcacggtgaatgg

SEQ ID NO: 6465017 - DNA, 18 bp, Homo sapiens
tgcacggtgggccttgct

SEQ ID NO: 6465018 - DNA, 15 bp, Homo sapiens
tgcacggttcaatgg

SEQ ID NO: 6465019 - DNA, 20 bp, Homo sapiens
tgcacggttcaatggtagat

SEQ ID NO: 6465020 - DNA, 22 bp, Homo sapiens
tgcacggtttcgaagtcattaa

SEQ ID NO: 6465021 - DNA, 21 bp, Homo sapiens
tgcacggtttctgttctgccc

SEQ ID NO: 6465022 - DNA, 17 bp, Homo sapiens
tgcacggtttgtgagag

SEQ ID NO: 6465023 - DNA, 16 bp, Homo sapiens
tgcacgtaaagtactt

SEQ ID NO: 6465024 - DNA, 18 bp, Homo sapiens
tgcacgtaaagtacttgt

SEQ ID NO: 6465025 - DNA, 19 bp, Homo sapiens
tgcacgtacacacacatac

SEQ ID NO: 6465026 - DNA, 19 bp, Homo sapiens
tgcacgtagtagggtcagg

SEQ ID NO: 6465027 - DNA, 20 bp, Homo sapiens
tgcacgtcaccctcctgagc

SEQ ID NO: 6465028 - DNA, 21 bp, Homo sapiens
tgcacgtcaccctcctgagcc

SEQ ID NO: 6465029 - DNA, 23 bp, Homo sapiens
tgcacgtcaccctcctgagcctc

SEQ ID NO: 6465030 - DNA, 16 bp, Homo sapiens
tgcacgtcttgctatt

SEQ ID NO: 6465031 - DNA, 20 bp, Homo sapiens
tgcacgtgcacacacctgca

SEQ ID NO: 6465032 - DNA, 16 bp, Homo sapiens
tgcacgtggagagctg

SEQ ID NO: 6465033 - DNA, 18 bp, Homo sapiens
tgcacgtggagagctggt

SEQ ID NO: 6465034 - DNA, 23 bp, Homo sapiens
tgcacgtggcatgtggcctgtgg

SEQ ID NO: 6465035 - DNA, 17 bp, Homo sapiens
tgcacgtggcctcttga

SEQ ID NO: 6465036 - DNA, 22 bp, Homo sapiens
tgcacgtggcctcttgagcagt

SEQ ID NO: 6465037 - DNA, 18 bp, Homo sapiens
tgcacgtggcttctgatg

SEQ ID NO: 6465038 - DNA, 12 bp, Homo sapiens
tgcacgtgtgca

SEQ ID NO: 6465039 - DNA, 12 bp, Homo sapiens
tgcacgtgtgtt

SEQ ID NO: 6465040 - DNA, 17 bp, Homo sapiens
tgcacgttatggtgttt

SEQ ID NO: 6465041 - DNA, 19 bp, Homo sapiens
tgcacgttatggtgtttct

SEQ ID NO: 6465042 - DNA, 17 bp, Homo sapiens
tgcacgttcataaccaa

SEQ ID NO: 6465043 - DNA, 18 bp, Homo sapiens
tgcacgttcataaccaac

SEQ ID NO: 6465044 - DNA, 19 bp, Homo sapiens
tgcacgttcataaccaaca

SEQ ID NO: 6465045 - DNA, 22 bp, Homo sapiens
tgcactaaaacccatcttcccc

SEQ ID NO: 6465046 - DNA, 15 bp, Homo sapiens
tgcactaaaagtgat

SEQ ID NO: 6465047 - DNA, 21 bp, Homo sapiens
tgcactaaaagtgatgtgatt

SEQ ID NO: 6465048 - DNA, 20 bp, Homo sapiens
tgcactaaaatgaggatcca

SEQ ID NO: 6465049 - DNA, 17 bp, Homo sapiens
tgcactaaagccagcct

SEQ ID NO: 6465050 - DNA, 18 bp, Homo sapiens
tgcactaaagtatgtaaa

SEQ ID NO: 6465051 - DNA, 22 bp, Homo sapiens
tgcactaacaaagctcaaaaca

SEQ ID NO: 6465052 - DNA, 23 bp, Homo sapiens
tctagaagaaatgaaattttacc

SEQ ID NO: 6465053 - DNA, 18 bp, Homo sapiens
tctagaagagtctattgt

SEQ ID NO: 6465054 - DNA, 19 bp, Homo sapiens
tctagaagagtctattgtc

SEQ ID NO: 6465055 - DNA, 20 bp, Homo sapiens
tctagaagagtctattgtct

SEQ ID NO: 6465056 - DNA, 18 bp, Homo sapiens
tctagaagatgtgtaaac

SEQ ID NO: 6465057 - DNA, 17 bp, Homo sapiens
tctagaagccaagggaa

SEQ ID NO: 6465058 - DNA, 14 bp, Homo sapiens
tctagaagctcagg

SEQ ID NO: 6465059 - DNA, 13 bp, Homo sapiens
tctagaaggccag

SEQ ID NO: 6465060 - DNA, 18 bp, Homo sapiens
tctagaagtttcccttcc

SEQ ID NO: 6465061 - DNA, 21 bp, Homo sapiens
tctagaatattatgttcctca

SEQ ID NO: 6465062 - DNA, 19 bp, Homo sapiens
tctagaatcccagcagcag

SEQ ID NO: 6465063 - DNA, 15 bp, Homo sapiens
tctagaatcctgctt

SEQ ID NO: 6465064 - DNA, 16 bp, Homo sapiens
tctagaatcctgcttt

SEQ ID NO: 6465065 - DNA, 22 bp, Homo sapiens
tctagaatctgcaattcaaaag

SEQ ID NO: 6465066 - DNA, 14 bp, Homo sapiens
tctagaatggattt

SEQ ID NO: 6465067 - DNA, 21 bp, Homo sapiens
tctagaatgtctgaagtacaa

SEQ ID NO: 6465068 - DNA, 18 bp, Homo sapiens
tctagaatgttattgtgt

SEQ ID NO: 6465069 - DNA, 19 bp, Homo sapiens
tctagaattatttttcact

SEQ ID NO: 6465070 - DNA, 17 bp, Homo sapiens
tctagaattttaagcct

SEQ ID NO: 6465071 - DNA, 19 bp, Homo sapiens
tctagaattttaagccttt

SEQ ID NO: 6465072 - DNA, 13 bp, Homo sapiens
tctagacaaccct

SEQ ID NO: 6465073 - DNA, 21 bp, Homo sapiens
tctagacaagatattgtacat

SEQ ID NO: 6465074 - DNA, 20 bp, Homo sapiens
tctagacactgaaggcaaat

SEQ ID NO: 6465075 - DNA, 15 bp, Homo sapiens
tctagacactttttc

SEQ ID NO: 6465076 - DNA, 16 bp, Homo sapiens
tctagacactttttct

SEQ ID NO: 6465077 - DNA, 13 bp, Homo sapiens
tctagacagtatt

SEQ ID NO: 6465078 - DNA, 17 bp, Homo sapiens
tctagacagtattgcca

SEQ ID NO: 6465079 - DNA, 22 bp, Homo sapiens
tctagacatctacctatactta

SEQ ID NO: 6465080 - DNA, 22 bp, Homo sapiens
tctagacatggaggttctaagg

SEQ ID NO: 6465081 - DNA, 17 bp, Homo sapiens
tctagaccctatacatt

SEQ ID NO: 6465082 - DNA, 14 bp, Homo sapiens
tctagacgcccctc

SEQ ID NO: 6465083 - DNA, 16 bp, Homo sapiens
tctagacgcccctccc

SEQ ID NO: 6465084 - DNA, 18 bp, Homo sapiens
tctagactgcaagaactg

SEQ ID NO: 6465085 - DNA, 19 bp, Homo sapiens
tctagacttccccatcccg

SEQ ID NO: 6465086 - DNA, 14 bp, Homo sapiens
tctagactttctca

SEQ ID NO: 6465087 - DNA, 13 bp, Homo sapiens
tctagactttctg

SEQ ID NO: 6465088 - DNA, 14 bp, Homo sapiens
tctagactttctgt

SEQ ID NO: 6465089 - DNA, 12 bp, Homo sapiens
tctagagagagg

SEQ ID NO: 6465090 - DNA, 16 bp, Homo sapiens
tctagagagccttaac

SEQ ID NO: 6465091 - DNA, 20 bp, Homo sapiens
tctagagatagtacataaag

SEQ ID NO: 6465092 - DNA, 18 bp, Homo sapiens
tctagagcagttggccaa

SEQ ID NO: 6465093 - DNA, 20 bp, Homo sapiens
tctagagccgtgatgcctcc

SEQ ID NO: 6465094 - DNA, 14 bp, Homo sapiens
tctagagcctcgac

SEQ ID NO: 6465095 - DNA, 16 bp, Homo sapiens
tctagagctatgcaca

SEQ ID NO: 6465096 - DNA, 19 bp, Homo sapiens
tctagagctatgcacacca

SEQ ID NO: 6465097 - DNA, 21 bp, Homo sapiens
tctagagcttaatgctacatg

SEQ ID NO: 6465098 - DNA, 13 bp, Homo sapiens
tctagagctttta

SEQ ID NO: 6465099 - DNA, 15 bp, Homo sapiens
tctagagcttttatt

SEQ ID NO: 6465100 - DNA, 22 bp, Homo sapiens
tctagaggagggggcaggctga

SEQ ID NO: 6465101 - DNA, 19 bp, Homo sapiens
tctagaggcaagcctggcc

SEQ ID NO: 6465102 - DNA, 19 bp, Homo sapiens
tctagaggcctgaaatcct

SEQ ID NO: 6465103 - DNA, 16 bp, Homo sapiens
tctagaggcttccttc

SEQ ID NO: 6465104 - DNA, 20 bp, Homo sapiens
tctagagggatccaccgcca

SEQ ID NO: 6465105 - DNA, 21 bp, Homo sapiens
tctagagggttgctgcctttc

SEQ ID NO: 6465106 - DNA, 23 bp, Homo sapiens
tctagaggtcaggacggctcctc

SEQ ID NO: 6465107 - DNA, 13 bp, Homo sapiens
tctagagtccaag

SEQ ID NO: 6465108 - DNA, 15 bp, Homo sapiens
tctagagtccaaggt

SEQ ID NO: 6465109 - DNA, 15 bp, Homo sapiens
tctagagtctcagaa

SEQ ID NO: 6465110 - DNA, 19 bp, Homo sapiens
tctagagttatcttcttta

SEQ ID NO: 6465111 - DNA, 22 bp, Homo sapiens
tctagataaaaggagagaaagc

SEQ ID NO: 6465112 - DNA, 14 bp, Homo sapiens
tctagataaccttg

SEQ ID NO: 6465113 - DNA, 15 bp, Homo sapiens
tctagatacaataaa

SEQ ID NO: 6465114 - DNA, 15 bp, Homo sapiens
tctagatacagaagc

SEQ ID NO: 6465115 - DNA, 23 bp, Homo sapiens
tctagatacaggactggttcctt

SEQ ID NO: 6465116 - DNA, 19 bp, Homo sapiens
tctagatacctaaaacata

SEQ ID NO: 6465117 - DNA, 15 bp, Homo sapiens
tctagatatgagaaa

SEQ ID NO: 6465118 - DNA, 14 bp, Homo sapiens
tctagatcactgtg

SEQ ID NO: 6465119 - DNA, 16 bp, Homo sapiens
tctagatcactgtgct

SEQ ID NO: 6465120 - DNA, 15 bp, Homo sapiens
tctagatcagagagc

SEQ ID NO: 6465121 - DNA, 22 bp, Homo sapiens
tctagatcagatgctccaagat

SEQ ID NO: 6465122 - DNA, 15 bp, Homo sapiens
tctagatctcagcca

SEQ ID NO: 6465123 - DNA, 19 bp, Homo sapiens
tctagatctttgtgccaaa

SEQ ID NO: 6465124 - DNA, 14 bp, Homo sapiens
tctagatgacataa

SEQ ID NO: 6465125 - DNA, 22 bp, Homo sapiens
tctagatgattaaataagattc

SEQ ID NO: 6465126 - DNA, 15 bp, Homo sapiens
tctagatggatgaat

SEQ ID NO: 6465127 - DNA, 17 bp, Homo sapiens
tctagatggatgaatta

SEQ ID NO: 6465128 - DNA, 19 bp, Homo sapiens
tctagatggctcctctcag

SEQ ID NO: 6465129 - DNA, 16 bp, Homo sapiens
tctagattaatactct

SEQ ID NO: 6465130 - DNA, 17 bp, Homo sapiens
tctagattaccatgaag

SEQ ID NO: 6465131 - DNA, 17 bp, Homo sapiens
tctagattcaaaggttc

SEQ ID NO: 6465132 - DNA, 20 bp, Homo sapiens
tctagattcaaaggttctag

SEQ ID NO: 6465133 - DNA, 15 bp, Homo sapiens
tctagattgagagaa

SEQ ID NO: 6465134 - DNA, 16 bp, Homo sapiens
tctagattttgaaaaa

SEQ ID NO: 6465135 - DNA, 19 bp, Homo sapiens
tctagattttgttttgctt

SEQ ID NO: 6465136 - DNA, 16 bp, Homo sapiens
tctagcaaatgttatg

SEQ ID NO: 6465137 - DNA, 22 bp, Homo sapiens
tctagcaaccgcctcaaaatgt

SEQ ID NO: 6465138 - DNA, 18 bp, Homo sapiens
tctagcaagaagattcta

SEQ ID NO: 6465139 - DNA, 21 bp, Homo sapiens
tctagcaagaagattctaaaa

SEQ ID NO: 6465140 - DNA, 14 bp, Homo sapiens
tctagcaattttct

SEQ ID NO: 6465141 - DNA, 15 bp, Homo sapiens
tctagcaattttctt

SEQ ID NO: 6465142 - DNA, 21 bp, Homo sapiens
tctagcaattttctttgtttc

SEQ ID NO: 6465143 - DNA, 14 bp, Homo sapiens
tctagcacactctt

SEQ ID NO: 6465144 - DNA, 18 bp, Homo sapiens
tctagcactcattttcta

SEQ ID NO: 6465145 - DNA, 14 bp, Homo sapiens
tctagcaggcagga

SEQ ID NO: 6465146 - DNA, 17 bp, Homo sapiens
tctagcagtaaatactt

SEQ ID NO: 6465147 - DNA, 22 bp, Homo sapiens
tctagcagtaaatacttgcagt

SEQ ID NO: 6465148 - DNA, 17 bp, Homo sapiens
tctagcatagtaaacta

SEQ ID NO: 6465149 - DNA, 12 bp, Homo sapiens
tctagcatgaag

SEQ ID NO: 6465150 - DNA, 18 bp, Homo sapiens
tctagcatggcatatttt

SEQ ID NO: 6465151 - DNA, 21 bp, Homo sapiens
tctagcatggcatatttttca

SEQ ID NO: 6465152 - DNA, 18 bp, Homo sapiens
tctagcatggctgccaat

SEQ ID NO: 6465153 - DNA, 14 bp, Homo sapiens
tctagcattctgca

SEQ ID NO: 6465154 - DNA, 16 bp, Homo sapiens
tctagccaaatggttt

SEQ ID NO: 6465155 - DNA, 14 bp, Homo sapiens
tctagccactccct

SEQ ID NO: 6465156 - DNA, 20 bp, Homo sapiens
tctagccaggagtctgtgct

SEQ ID NO: 6465157 - DNA, 11 bp, Homo sapiens
tctagccaggc

SEQ ID NO: 6465158 - DNA, 21 bp, Homo sapiens
tctagcccaacctacattcca

SEQ ID NO: 6465159 - DNA, 13 bp, Homo sapiens
tctagcccatgga

SEQ ID NO: 6465160 - DNA, 23 bp, Homo sapiens
tctagcccctctggattcccttt

SEQ ID NO: 6465161 - DNA, 15 bp, Homo sapiens
tctagccctccctgg

SEQ ID NO: 6465162 - DNA, 14 bp, Homo sapiens
tctagccctgcccg

SEQ ID NO: 6465163 - DNA, 17 bp, Homo sapiens
tctagccgctgccctgg

SEQ ID NO: 6465164 - DNA, 19 bp, Homo sapiens
tctagcctctgagatgcta

SEQ ID NO: 6465165 - DNA, 17 bp, Homo sapiens
tctagcctctggactgg

SEQ ID NO: 6465166 - DNA, 21 bp, Homo sapiens
tctagcctctggactggaaag

SEQ ID NO: 6465167 - DNA, 14 bp, Homo sapiens
tctagcctgggcca

SEQ ID NO: 6465168 - DNA, 21 bp, Homo sapiens
tctagcgaacgtatttctcca

SEQ ID NO: 6465169 - DNA, 15 bp, Homo sapiens
tctagcgcaaggcac

SEQ ID NO: 6465170 - DNA, 20 bp, Homo sapiens
tctagctaatggaaaatgat

SEQ ID NO: 6465171 - DNA, 12 bp, Homo sapiens
tctagctataac

SEQ ID NO: 6465172 - DNA, 23 bp, Homo sapiens
tctagctataacaactctatttt

SEQ ID NO: 6465173 - DNA, 15 bp, Homo sapiens
tctagctatgctgta

SEQ ID NO: 6465174 - DNA, 19 bp, Homo sapiens
tctagctatgctgtatctg

SEQ ID NO: 6465175 - DNA, 12 bp, Homo sapiens
tctagctcattt

SEQ ID NO: 6465176 - DNA, 13 bp, Homo sapiens
tctagctccccaa

SEQ ID NO: 6465177 - DNA, 23 bp, Homo sapiens
tctagctccgggggtacagccct

SEQ ID NO: 6465178 - DNA, 18 bp, Homo sapiens
tctagctctatttacttc

SEQ ID NO: 6465179 - DNA, 22 bp, Homo sapiens
tctagctgaattgagcctaaaa

SEQ ID NO: 6465180 - DNA, 12 bp, Homo sapiens
tctagctggagc

SEQ ID NO: 6465181 - DNA, 15 bp, Homo sapiens
tctagctggcaggac

SEQ ID NO: 6465182 - DNA, 11 bp, Homo sapiens
tctagctgttg

SEQ ID NO: 6465183 - DNA, 17 bp, Homo sapiens
tctagcttagtttcaga

SEQ ID NO: 6465184 - DNA, 21 bp, Homo sapiens
tctagcttagtttcagagacc

SEQ ID NO: 6465185 - DNA, 17 bp, Homo sapiens
tctagcttcatgcctca

SEQ ID NO: 6465186 - DNA, 19 bp, Homo sapiens
tctagctttgttgtcctcc

SEQ ID NO: 6465187 - DNA, 20 bp, Homo sapiens
tctagctttgttgtcctccc

SEQ ID NO: 6465188 - DNA, 21 bp, Homo sapiens
tctagctttgttgtcctccca

SEQ ID NO: 6465189 - DNA, 23 bp, Homo sapiens
tctagctttgttgtcctcccagg

SEQ ID NO: 6465190 - DNA, 17 bp, Homo sapiens
tctagcttttttcctcc

SEQ ID NO: 6465191 - DNA, 23 bp, Homo sapiens
tctagcttttttcctcctttctc

SEQ ID NO: 6465192 - DNA, 14 bp, Homo sapiens
tctaggaaaattat

SEQ ID NO: 6465193 - DNA, 14 bp, Homo sapiens
tctaggaaagaaat

SEQ ID NO: 6465194 - DNA, 17 bp, Homo sapiens
tctaggaaatatttatt

SEQ ID NO: 6465195 - DNA, 23 bp, Homo sapiens
tctaggaagaagacaaatgacag

SEQ ID NO: 6465196 - DNA, 23 bp, Homo sapiens
tctaggaagaattttaaaaatga

SEQ ID NO: 6465197 - DNA, 16 bp, Homo sapiens
tctaggaagactttgg

SEQ ID NO: 6465198 - DNA, 20 bp, Homo sapiens
tctaggaatggaggagccag

SEQ ID NO: 6465199 - DNA, 23 bp, Homo sapiens
tctaggaatggaggagccaggcc

SEQ ID NO: 6465200 - DNA, 23 bp, Homo sapiens
tctaggacacagttcctgggaac

SEQ ID NO: 6465201 - DNA, 23 bp, Homo sapiens
tctaggaccatggttaagagtcc

SEQ ID NO: 6465202 - DNA, 22 bp, Homo sapiens
tctaggacccccagtgctcaca

SEQ ID NO: 6465203 - DNA, 15 bp, Homo sapiens
tctaggactgggccc

SEQ ID NO: 6465204 - DNA, 14 bp, Homo sapiens
tctaggacttcaaa

SEQ ID NO: 6465205 - DNA, 16 bp, Homo sapiens
tctaggagctgggagg

SEQ ID NO: 6465206 - DNA, 17 bp, Homo sapiens
tctaggagctgggagga

SEQ ID NO: 6465207 - DNA, 18 bp, Homo sapiens
tctaggagtcaactggct

SEQ ID NO: 6465208 - DNA, 20 bp, Homo sapiens
tctaggagtcaactggctgg

SEQ ID NO: 6465209 - DNA, 18 bp, Homo sapiens
tctaggatgggaacaagg

SEQ ID NO: 6465210 - DNA, 16 bp, Homo sapiens
tctaggatgtgatgat

SEQ ID NO: 6465211 - DNA, 16 bp, Homo sapiens
tctaggatgtggagct

SEQ ID NO: 6465212 - DNA, 20 bp, Homo sapiens
tctaggattgggcctcccat

SEQ ID NO: 6465213 - DNA, 20 bp, Homo sapiens
tctaggcaaaattgtgaagc

SEQ ID NO: 6465214 - DNA, 15 bp, Homo sapiens
tctaggcaagcagga

SEQ ID NO: 6465215 - DNA, 18 bp, Homo sapiens
tctaggcactgagcaggg

SEQ ID NO: 6465216 - DNA, 21 bp, Homo sapiens
tctaggcactgtagttctaag

SEQ ID NO: 6465217 - DNA, 24 bp, Homo sapiens
tctaggcactgtagttctaagact

SEQ ID NO: 6465218 - DNA, 18 bp, Homo sapiens
tctaggcatacttttcaa

SEQ ID NO: 6465219 - DNA, 20 bp, Homo sapiens
tctaggcatctcctctcccc

SEQ ID NO: 6465220 - DNA, 18 bp, Homo sapiens
tctaggccaaaaatggtg

SEQ ID NO: 6465221 - DNA, 12 bp, Homo sapiens
tctaggccaccc

SEQ ID NO: 6465222 - DNA, 20 bp, Homo sapiens
tctaggcccattgtcctcct

SEQ ID NO: 6465223 - DNA, 15 bp, Homo sapiens
tctaggccccccaga

SEQ ID NO: 6465224 - DNA, 15 bp, Homo sapiens
tctaggccctgtgag

SEQ ID NO: 6465225 - DNA, 19 bp, Homo sapiens
tctaggccctgtgagcaca

SEQ ID NO: 6465226 - DNA, 11 bp, Homo sapiens
tctaggcctga

SEQ ID NO: 6465227 - DNA, 19 bp, Homo sapiens
tctaggcctttcctctgca

SEQ ID NO: 6465228 - DNA, 21 bp, Homo sapiens
tctaggcctttcctctgcacg

SEQ ID NO: 6465229 - DNA, 22 bp, Homo sapiens
tctaggcctttcctctgcacgc

SEQ ID NO: 6465230 - DNA, 18 bp, Homo sapiens
tgcactaaccccagctgc

SEQ ID NO: 6465231 - DNA, 20 bp, Homo sapiens
tgcactaaccccagctgccg

SEQ ID NO: 6465232 - DNA, 19 bp, Homo sapiens
tgcactaagacaagaacat

SEQ ID NO: 6465233 - DNA, 22 bp, Homo sapiens
tgcactaaggggcccggccagc

SEQ ID NO: 6465234 - DNA, 16 bp, Homo sapiens
tgcactaagtctcttt

SEQ ID NO: 6465235 - DNA, 20 bp, Homo sapiens
tgcactaatgtgttatgaga

SEQ ID NO: 6465236 - DNA, 15 bp, Homo sapiens
tgcactacacttttg

SEQ ID NO: 6465237 - DNA, 16 bp, Homo sapiens
tgcactactcctctgc

SEQ ID NO: 6465238 - DNA, 19 bp, Homo sapiens
tgcactactcctctgcagt

SEQ ID NO: 6465239 - DNA, 13 bp, Homo sapiens
tgcactagcctgt

SEQ ID NO: 6465240 - DNA, 13 bp, Homo sapiens
tgcactaggaatt

SEQ ID NO: 6465241 - DNA, 15 bp, Homo sapiens
tgcactaggacttgg

SEQ ID NO: 6465242 - DNA, 21 bp, Homo sapiens
tgcactagtgcaattccaaga

SEQ ID NO: 6465243 - DNA, 16 bp, Homo sapiens
tgcactatagccattt

SEQ ID NO: 6465244 - DNA, 22 bp, Homo sapiens
tgcactatagcctaggtgacag

SEQ ID NO: 6465245 - DNA, 23 bp, Homo sapiens
tgcactatagcctaggtgacaga

SEQ ID NO: 6465246 - DNA, 17 bp, Homo sapiens
tgcactatatgcaaaca

SEQ ID NO: 6465247 - DNA, 20 bp, Homo sapiens
tgcactatatgcaaacaggg

SEQ ID NO: 6465248 - DNA, 15 bp, Homo sapiens
tgcactatatttgta

SEQ ID NO: 6465249 - DNA, 16 bp, Homo sapiens
tgcactatatttgtat

SEQ ID NO: 6465250 - DNA, 17 bp, Homo sapiens
tgcactatatttgtata

SEQ ID NO: 6465251 - DNA, 18 bp, Homo sapiens
tgcactatatttgtatat

SEQ ID NO: 6465252 - DNA, 15 bp, Homo sapiens
tgcactatgaggaat

SEQ ID NO: 6465253 - DNA, 16 bp, Homo sapiens
tgcactattccacagg

SEQ ID NO: 6465254 - DNA, 13 bp, Homo sapiens
tgcactatttcca

SEQ ID NO: 6465255 - DNA, 16 bp, Homo sapiens
tgcactatttccacat

SEQ ID NO: 6465256 - DNA, 14 bp, Homo sapiens
tgcactcaagttgt

SEQ ID NO: 6465257 - DNA, 15 bp, Homo sapiens
tgcactcaagttgtt

SEQ ID NO: 6465258 - DNA, 21 bp, Homo sapiens
tgcactcacccctagccctgg

SEQ ID NO: 6465259 - DNA, 14 bp, Homo sapiens
tgcactcagaaaat

SEQ ID NO: 6465260 - DNA, 16 bp, Homo sapiens
tgcactcagactgtat

SEQ ID NO: 6465261 - DNA, 15 bp, Homo sapiens
tgcactcatcatatt

SEQ ID NO: 6465262 - DNA, 18 bp, Homo sapiens
tgcactcatgtggactgg

SEQ ID NO: 6465263 - DNA, 14 bp, Homo sapiens
tgcactccaatctg

SEQ ID NO: 6465264 - DNA, 14 bp, Homo sapiens
tgcactccagactc

SEQ ID NO: 6465265 - DNA, 15 bp, Homo sapiens
tgcactccagactct

SEQ ID NO: 6465266 - DNA, 19 bp, Homo sapiens
tgcactccagactctgggg

SEQ ID NO: 6465267 - DNA, 20 bp, Homo sapiens
tgcactccagactctggggg

SEQ ID NO: 6465268 - DNA, 13 bp, Homo sapiens
tgcactccagcct

SEQ ID NO: 6465269 - DNA, 16 bp, Homo sapiens
tgcactccagcctggg

SEQ ID NO: 6465270 - DNA, 17 bp, Homo sapiens
tgcactccagcctgggg

SEQ ID NO: 6465271 - DNA, 18 bp, Homo sapiens
tgcactccagcctggggg

SEQ ID NO: 6465272 - DNA, 16 bp, Homo sapiens
tgcactccatccagct

SEQ ID NO: 6465273 - DNA, 19 bp, Homo sapiens
tgcactccatggccacccc

SEQ ID NO: 6465274 - DNA, 20 bp, Homo sapiens
tgcactccatggccaccccg

SEQ ID NO: 6465275 - DNA, 17 bp, Homo sapiens
tgcactcccacctgaca

SEQ ID NO: 6465276 - DNA, 12 bp, Homo sapiens
tgcactccccca

SEQ ID NO: 6465277 - DNA, 19 bp, Homo sapiens
tgcactcccctgctgggtg

SEQ ID NO: 6465278 - DNA, 19 bp, Homo sapiens
tgcactcccgaccttagct

SEQ ID NO: 6465279 - DNA, 14 bp, Homo sapiens
tgcactccctaaga

SEQ ID NO: 6465280 - DNA, 18 bp, Homo sapiens
tgcactccctggccttgc

SEQ ID NO: 6465281 - DNA, 21 bp, Homo sapiens
tgcactccctggccttgcccg

SEQ ID NO: 6465282 - DNA, 15 bp, Homo sapiens
tgcactccggcctgg

SEQ ID NO: 6465283 - DNA, 19 bp, Homo sapiens
tgcactccggcctgggcga

SEQ ID NO: 6465284 - DNA, 22 bp, Homo sapiens
tgcactccggcctgggtgacag

SEQ ID NO: 6465285 - DNA, 14 bp, Homo sapiens
tgcactcctcacac

SEQ ID NO: 6465286 - DNA, 15 bp, Homo sapiens
tgcactcgcactgca

SEQ ID NO: 6465287 - DNA, 16 bp, Homo sapiens
tgcactcgcactgcaa

SEQ ID NO: 6465288 - DNA, 23 bp, Homo sapiens
tgcactcgccatttcctcacgtg

SEQ ID NO: 6465289 - DNA, 21 bp, Homo sapiens
tgcactctaaaaggttcaggg

SEQ ID NO: 6465290 - DNA, 15 bp, Homo sapiens
tgcactctaaactgc

SEQ ID NO: 6465291 - DNA, 22 bp, Homo sapiens
tgcactctaaccctaggcatca

SEQ ID NO: 6465292 - DNA, 16 bp, Homo sapiens
tgcactctagcctggc

SEQ ID NO: 6465293 - DNA, 20 bp, Homo sapiens
tgcactctgtaattgcactt

SEQ ID NO: 6465294 - DNA, 21 bp, Homo sapiens
tgcactctgtgcccatgggca

SEQ ID NO: 6465295 - DNA, 19 bp, Homo sapiens
tgcactcttgaactgggcg

SEQ ID NO: 6465296 - DNA, 20 bp, Homo sapiens
tgcactcttgaactgggcga

SEQ ID NO: 6465297 - DNA, 13 bp, Homo sapiens
tgcactctttaac

SEQ ID NO: 6465298 - DNA, 22 bp, Homo sapiens
tgcactctttaacacattcttt

SEQ ID NO: 6465299 - DNA, 17 bp, Homo sapiens
tgcactctttaagggag

SEQ ID NO: 6465300 - DNA, 21 bp, Homo sapiens
tgcactgaaaacttagccaga

SEQ ID NO: 6465301 - DNA, 13 bp, Homo sapiens
tgcactgaacagg

SEQ ID NO: 6465302 - DNA, 10 bp, Homo sapiens
tgcactgaag

SEQ ID NO: 6465303 - DNA, 14 bp, Homo sapiens
tgcactgaagagct

SEQ ID NO: 6465304 - DNA, 17 bp, Homo sapiens
tgcactgaagagctctt

SEQ ID NO: 6465305 - DNA, 18 bp, Homo sapiens
tgcactgaagagctcttg

SEQ ID NO: 6465306 - DNA, 21 bp, Homo sapiens
tgcactgaagagctcttggcc

SEQ ID NO: 6465307 - DNA, 22 bp, Homo sapiens
tgcactgaagagctcttggccc

SEQ ID NO: 6465308 - DNA, 21 bp, Homo sapiens
tgcactgaagccggacagctg

SEQ ID NO: 6465309 - DNA, 19 bp, Homo sapiens
tgcactgaagtttgataaa

SEQ ID NO: 6465310 - DNA, 15 bp, Homo sapiens
tgcactgaagttttt

SEQ ID NO: 6465311 - DNA, 15 bp, Homo sapiens
tgcactgaatatata

SEQ ID NO: 6465312 - DNA, 16 bp, Homo sapiens
tgcactgaatatataa

SEQ ID NO: 6465313 - DNA, 18 bp, Homo sapiens
tgcactgacaagatggaa

SEQ ID NO: 6465314 - DNA, 17 bp, Homo sapiens
tgcactgacccttccag

SEQ ID NO: 6465315 - DNA, 20 bp, Homo sapiens
tgcactgacccttccagaca

SEQ ID NO: 6465316 - DNA, 13 bp, Homo sapiens
tgcactgacctgc

SEQ ID NO: 6465317 - DNA, 12 bp, Homo sapiens
tgcactgactct

SEQ ID NO: 6465318 - DNA, 14 bp, Homo sapiens
tgcactgactctgg

SEQ ID NO: 6465319 - DNA, 17 bp, Homo sapiens
tgcactgactctggaaa

SEQ ID NO: 6465320 - DNA, 14 bp, Homo sapiens
tgcactgactgtga

SEQ ID NO: 6465321 - DNA, 22 bp, Homo sapiens
tgcactgaggcagcgacctcaa

SEQ ID NO: 6465322 - DNA, 12 bp, Homo sapiens
tgcactgagggc

SEQ ID NO: 6465323 - DNA, 17 bp, Homo sapiens
tgcactgagggccacac

SEQ ID NO: 6465324 - DNA, 21 bp, Homo sapiens
tgcactgatgttgtgttttta

SEQ ID NO: 6465325 - DNA, 15 bp, Homo sapiens
tgcactgcatgcaaa

SEQ ID NO: 6465326 - DNA, 21 bp, Homo sapiens
tgcactgcccatggacaggct

SEQ ID NO: 6465327 - DNA, 23 bp, Homo sapiens
tgcactgccccctgcttggccag

SEQ ID NO: 6465328 - DNA, 14 bp, Homo sapiens
tgcactgcctgcat

SEQ ID NO: 6465329 - DNA, 18 bp, Homo sapiens
tgcactgcctgcatgagc

SEQ ID NO: 6465330 - DNA, 21 bp, Homo sapiens
tgcactgctcacttttttgaa

SEQ ID NO: 6465331 - DNA, 13 bp, Homo sapiens
tgcactgctgtaa

SEQ ID NO: 6465332 - DNA, 20 bp, Homo sapiens
tgcactggaatatctgagaa

SEQ ID NO: 6465333 - DNA, 20 bp, Homo sapiens
tgcactggaattttgcttta

SEQ ID NO: 6465334 - DNA, 14 bp, Homo sapiens
tgcactggagccac

SEQ ID NO: 6465335 - DNA, 22 bp, Homo sapiens
tgcactggagccacaggcaggg

SEQ ID NO: 6465336 - DNA, 15 bp, Homo sapiens
tgcactggccaccca

SEQ ID NO: 6465337 - DNA, 16 bp, Homo sapiens
tgcactggccccaccc

SEQ ID NO: 6465338 - DNA, 23 bp, Homo sapiens
tgcactggcctgttctgtaggag

SEQ ID NO: 6465339 - DNA, 16 bp, Homo sapiens
tgcactggccttctga

SEQ ID NO: 6465340 - DNA, 21 bp, Homo sapiens
tgcactggccttctgatgaaa

SEQ ID NO: 6465341 - DNA, 16 bp, Homo sapiens
tgcactgggaaggaaa

SEQ ID NO: 6465342 - DNA, 18 bp, Homo sapiens
tgcactgggaatttattt

SEQ ID NO: 6465343 - DNA, 11 bp, Homo sapiens
tgcactgggca

SEQ ID NO: 6465344 - DNA, 21 bp, Homo sapiens
tgcactgggcaggttcctggg

SEQ ID NO: 6465345 - DNA, 17 bp, Homo sapiens
tgcactgggggaacaga

SEQ ID NO: 6465346 - DNA, 15 bp, Homo sapiens
tgcactggggtggga

SEQ ID NO: 6465347 - DNA, 14 bp, Homo sapiens
tgcactgtaaaatg

SEQ ID NO: 6465348 - DNA, 14 bp, Homo sapiens
tgcactgtaaatat

SEQ ID NO: 6465349 - DNA, 16 bp, Homo sapiens
tgcactgtaaatatcc

SEQ ID NO: 6465350 - DNA, 20 bp, Homo sapiens
tgcactgtaaattgctggca

SEQ ID NO: 6465351 - DNA, 16 bp, Homo sapiens
tgcactgtaatatgta

SEQ ID NO: 6465352 - DNA, 21 bp, Homo sapiens
tgcactgtcactttgctctgg

SEQ ID NO: 6465353 - DNA, 23 bp, Homo sapiens
tgcactgtcactttgctctgggt

SEQ ID NO: 6465354 - DNA, 12 bp, Homo sapiens
tgcactgtcctg

SEQ ID NO: 6465355 - DNA, 13 bp, Homo sapiens
tgcactgtcctgc

SEQ ID NO: 6465356 - DNA, 17 bp, Homo sapiens
tgcactgtcctgctcca

SEQ ID NO: 6465357 - DNA, 19 bp, Homo sapiens
tgcactgtcgataatcaga

SEQ ID NO: 6465358 - DNA, 17 bp, Homo sapiens
tgcactgtctcagccaa

SEQ ID NO: 6465359 - DNA, 12 bp, Homo sapiens
tgcactgtctgt

SEQ ID NO: 6465360 - DNA, 15 bp, Homo sapiens
tgcactgtgaaggac

SEQ ID NO: 6465361 - DNA, 21 bp, Homo sapiens
tgcactgtgaatcctggcaag

SEQ ID NO: 6465362 - DNA, 22 bp, Homo sapiens
tgcactgtgccccgcgggcttt

SEQ ID NO: 6465363 - DNA, 12 bp, Homo sapiens
tgcactgtgctt

SEQ ID NO: 6465364 - DNA, 19 bp, Homo sapiens
tgcactgtgcttgctccta

SEQ ID NO: 6465365 - DNA, 12 bp, Homo sapiens
tgcactgtgggg

SEQ ID NO: 6465366 - DNA, 23 bp, Homo sapiens
tgcactgttccccctgtgcagcc

SEQ ID NO: 6465367 - DNA, 14 bp, Homo sapiens
tgcactgttctgat

SEQ ID NO: 6465368 - DNA, 12 bp, Homo sapiens
tgcactgttttt

SEQ ID NO: 6465369 - DNA, 16 bp, Homo sapiens
tgcacttaaaaattag

SEQ ID NO: 6465370 - DNA, 14 bp, Homo sapiens
tgcacttaaagaag

SEQ ID NO: 6465371 - DNA, 22 bp, Homo sapiens
tgcacttacacttataaaataa

SEQ ID NO: 6465372 - DNA, 15 bp, Homo sapiens
tgcacttacttgctt

SEQ ID NO: 6465373 - DNA, 14 bp, Homo sapiens
tgcacttagtagtt

SEQ ID NO: 6465374 - DNA, 21 bp, Homo sapiens
tgcacttataaggtgttttct

SEQ ID NO: 6465375 - DNA, 18 bp, Homo sapiens
tgcacttatgatttcatg

SEQ ID NO: 6465376 - DNA, 21 bp, Homo sapiens
tgcacttatgtacttgatact

SEQ ID NO: 6465377 - DNA, 15 bp, Homo sapiens
tgcacttatttgtca

SEQ ID NO: 6465378 - DNA, 22 bp, Homo sapiens
tgcacttcatatctagatttct

SEQ ID NO: 6465379 - DNA, 14 bp, Homo sapiens
tgcacttcggataa

SEQ ID NO: 6465380 - DNA, 14 bp, Homo sapiens
tgcacttctgtaaa

SEQ ID NO: 6465381 - DNA, 13 bp, Homo sapiens
tgcacttctgtta

SEQ ID NO: 6465382 - DNA, 14 bp, Homo sapiens
tgcacttctgttat

SEQ ID NO: 6465383 - DNA, 23 bp, Homo sapiens
tgcacttgacaccaaccagacag

SEQ ID NO: 6465384 - DNA, 21 bp, Homo sapiens
tgcacttgattaagcttttgt

SEQ ID NO: 6465385 - DNA, 21 bp, Homo sapiens
tgcacttgcagactctacaga

SEQ ID NO: 6465386 - DNA, 13 bp, Homo sapiens
tgcacttggcctc

SEQ ID NO: 6465387 - DNA, 17 bp, Homo sapiens
tgcacttggcctcagct

SEQ ID NO: 6465388 - DNA, 22 bp, Homo sapiens
tgcacttggcctcagctggctg

SEQ ID NO: 6465389 - DNA, 18 bp, Homo sapiens
tgcacttggtgctgcttt

SEQ ID NO: 6465390 - DNA, 21 bp, Homo sapiens
tgcacttgtgattatttatta

SEQ ID NO: 6465391 - DNA, 18 bp, Homo sapiens
tgcacttgttatattata

SEQ ID NO: 6465392 - DNA, 16 bp, Homo sapiens
tgcactttaattgaag

SEQ ID NO: 6465393 - DNA, 18 bp, Homo sapiens
tgcactttaattgaagaa

SEQ ID NO: 6465394 - DNA, 21 bp, Homo sapiens
tgcactttaattgaagaactg

SEQ ID NO: 6465395 - DNA, 21 bp, Homo sapiens
tgcactttagacatttttgtg

SEQ ID NO: 6465396 - DNA, 18 bp, Homo sapiens
tgcactttataaacactg

SEQ ID NO: 6465397 - DNA, 14 bp, Homo sapiens
tgcactttcagact

SEQ ID NO: 6465398 - DNA, 23 bp, Homo sapiens
tgcactttccaatgccacagaca

SEQ ID NO: 6465399 - DNA, 14 bp, Homo sapiens
tgcactttccccct

SEQ ID NO: 6465400 - DNA, 21 bp, Homo sapiens
tgcactttcccccttcccgcc

SEQ ID NO: 6465401 - DNA, 22 bp, Homo sapiens
tgcactttcccccttcccgcct

SEQ ID NO: 6465402 - DNA, 12 bp, Homo sapiens
tgcactttccct

SEQ ID NO: 6465403 - DNA, 15 bp, Homo sapiens
tgcactttccctaga

SEQ ID NO: 6465404 - DNA, 16 bp, Homo sapiens
tgcactttccctagaa

SEQ ID NO: 6465405 - DNA, 19 bp, Homo sapiens
tgcactttccctagaaagc

SEQ ID NO: 6465406 - DNA, 12 bp, Homo sapiens
tgcactttcctt

SEQ ID NO: 6465407 - DNA, 22 bp, Homo sapiens
tgcactttcctttcaataaagt

SEQ ID NO: 6465408 - DNA, 22 bp, Homo sapiens
tgcactttctcatgatttacag

SEQ ID NO: 6465409 - DNA, 14 bp, Homo sapiens
tctaggctctgcct

SEQ ID NO: 6465410 - DNA, 15 bp, Homo sapiens
tctaggctctgcctt

SEQ ID NO: 6465411 - DNA, 16 bp, Homo sapiens
tctagggacccctcct

SEQ ID NO: 6465412 - DNA, 22 bp, Homo sapiens
tctagggacccctcgccccagc

SEQ ID NO: 6465413 - DNA, 16 bp, Homo sapiens
tctagggagtatgctg

SEQ ID NO: 6465414 - DNA, 20 bp, Homo sapiens
tctagggatataaaaacaga

SEQ ID NO: 6465415 - DNA, 16 bp, Homo sapiens
tctagggcagggtggg

SEQ ID NO: 6465416 - DNA, 13 bp, Homo sapiens
tctagggctggga

SEQ ID NO: 6465417 - DNA, 20 bp, Homo sapiens
tctaggggagaagagccctg

SEQ ID NO: 6465418 - DNA, 15 bp, Homo sapiens
tctaggggcagcctc

SEQ ID NO: 6465419 - DNA, 17 bp, Homo sapiens
tctaggggctgtacagt

SEQ ID NO: 6465420 - DNA, 22 bp, Homo sapiens
tctagggtgttctgtacttaga

SEQ ID NO: 6465421 - DNA, 18 bp, Homo sapiens
tctagggttgctggagcc

SEQ ID NO: 6465422 - DNA, 22 bp, Homo sapiens
tctagggttgctggagcctgag

SEQ ID NO: 6465423 - DNA, 20 bp, Homo sapiens
tctaggtcaaggcctgtccc

SEQ ID NO: 6465424 - DNA, 18 bp, Homo sapiens
tctaggtcagtacccacc

SEQ ID NO: 6465425 - DNA, 17 bp, Homo sapiens
tctaggtcagtctaaca

SEQ ID NO: 6465426 - DNA, 22 bp, Homo sapiens
tctaggtcagtctaacagtttg

SEQ ID NO: 6465427 - DNA, 19 bp, Homo sapiens
tctaggtctgtaatttatt

SEQ ID NO: 6465428 - DNA, 18 bp, Homo sapiens
tctaggtggcaaggctgt

SEQ ID NO: 6465429 - DNA, 20 bp, Homo sapiens
tctaggtggcaaggctgtgc

SEQ ID NO: 6465430 - DNA, 16 bp, Homo sapiens
tctaggtggcaggaca

SEQ ID NO: 6465431 - DNA, 15 bp, Homo sapiens
tctaggtgtggctgt

SEQ ID NO: 6465432 - DNA, 15 bp, Homo sapiens
tctaggttaaagcta

SEQ ID NO: 6465433 - DNA, 15 bp, Homo sapiens
tctaggttatacaat

SEQ ID NO: 6465434 - DNA, 19 bp, Homo sapiens
tctaggttatacaataacc

SEQ ID NO: 6465435 - DNA, 23 bp, Homo sapiens
tctaggttatacaataacccagt

SEQ ID NO: 6465436 - DNA, 14 bp, Homo sapiens
tctaggttctaaaa

SEQ ID NO: 6465437 - DNA, 17 bp, Homo sapiens
tctaggtttcaaagatg

SEQ ID NO: 6465438 - DNA, 20 bp, Homo sapiens
tctaggtttcaaagatgctg

SEQ ID NO: 6465439 - DNA, 16 bp, Homo sapiens
tctaggtttcagcaac

SEQ ID NO: 6465440 - DNA, 14 bp, Homo sapiens
tctagtaacagtat

SEQ ID NO: 6465441 - DNA, 19 bp, Homo sapiens
tctagtaagatgcactgaa

SEQ ID NO: 6465442 - DNA, 23 bp, Homo sapiens
tctagtaattgggaaaaaagcaa

SEQ ID NO: 6465443 - DNA, 13 bp, Homo sapiens
tctagtacataat

SEQ ID NO: 6465444 - DNA, 16 bp, Homo sapiens
tctagtacataattga

SEQ ID NO: 6465445 - DNA, 14 bp, Homo sapiens
tctagtactgtgaa

SEQ ID NO: 6465446 - DNA, 17 bp, Homo sapiens
tctagtagaaagaaaat

SEQ ID NO: 6465447 - DNA, 13 bp, Homo sapiens
tctagtagaacaa

SEQ ID NO: 6465448 - DNA, 16 bp, Homo sapiens
tctagtagaacaatgt

SEQ ID NO: 6465449 - DNA, 17 bp, Homo sapiens
tctagtagaacaatgta

SEQ ID NO: 6465450 - DNA, 21 bp, Homo sapiens
tctagtaggtctgcacacata

SEQ ID NO: 6465451 - DNA, 20 bp, Homo sapiens
tctagtagtgtggcctgtgc

SEQ ID NO: 6465452 - DNA, 15 bp, Homo sapiens
tctagtagttaaaaa

SEQ ID NO: 6465453 - DNA, 16 bp, Homo sapiens
tctagtagttaaaaca

SEQ ID NO: 6465454 - DNA, 16 bp, Homo sapiens
tctagtattctttatt

SEQ ID NO: 6465455 - DNA, 19 bp, Homo sapiens
tctagtattctttattatt

SEQ ID NO: 6465456 - DNA, 12 bp, Homo sapiens
tctagtatttgt

SEQ ID NO: 6465457 - DNA, 22 bp, Homo sapiens
tctagtattttatctggaacaa

SEQ ID NO: 6465458 - DNA, 18 bp, Homo sapiens
tctagtccccaaggcctc

SEQ ID NO: 6465459 - DNA, 19 bp, Homo sapiens
tctagtccccaaggcctct

SEQ ID NO: 6465460 - DNA, 15 bp, Homo sapiens
tctagtcccttctct

SEQ ID NO: 6465461 - DNA, 18 bp, Homo sapiens
tctagtcccttctctctt

SEQ ID NO: 6465462 - DNA, 20 bp, Homo sapiens
tctagtccttggtctgctgg

SEQ ID NO: 6465463 - DNA, 12 bp, Homo sapiens
tctagtctctga

SEQ ID NO: 6465464 - DNA, 21 bp, Homo sapiens
tctagtcttgacctctccagc

SEQ ID NO: 6465465 - DNA, 14 bp, Homo sapiens
tctagtcttggcca

SEQ ID NO: 6465466 - DNA, 15 bp, Homo sapiens
tctagtgaagatgtt

SEQ ID NO: 6465467 - DNA, 22 bp, Homo sapiens
tctagtgaattttttaaatgaa

SEQ ID NO: 6465468 - DNA, 19 bp, Homo sapiens
tctagtgagcagtcaggaa

SEQ ID NO: 6465469 - DNA, 15 bp, Homo sapiens
tctagtgagcctggg

SEQ ID NO: 6465470 - DNA, 18 bp, Homo sapiens
tctagtgaggaagacaag

SEQ ID NO: 6465471 - DNA, 19 bp, Homo sapiens
tctagtgcagctgatttta

SEQ ID NO: 6465472 - DNA, 20 bp, Homo sapiens
tctagtgcaggaaaaggctg

SEQ ID NO: 6465473 - DNA, 21 bp, Homo sapiens
tctagtgccgaatgactatgt

SEQ ID NO: 6465474 - DNA, 18 bp, Homo sapiens
tctagtgccttctaaagg

SEQ ID NO: 6465475 - DNA, 20 bp, Homo sapiens
tctagtgctaaacctatctg

SEQ ID NO: 6465476 - DNA, 13 bp, Homo sapiens
tctagtgctgctg

SEQ ID NO: 6465477 - DNA, 18 bp, Homo sapiens
tctagtgcttttcagtga

SEQ ID NO: 6465478 - DNA, 11 bp, Homo sapiens
tctagtggctg

SEQ ID NO: 6465479 - DNA, 12 bp, Homo sapiens
tctagtgggaag

SEQ ID NO: 6465480 - DNA, 13 bp, Homo sapiens
tctagtgggacag

SEQ ID NO: 6465481 - DNA, 21 bp, Homo sapiens
tctagtggtctttgtaagagt

SEQ ID NO: 6465482 - DNA, 22 bp, Homo sapiens
tctagtggtctttgtaagagtg

SEQ ID NO: 6465483 - DNA, 23 bp, Homo sapiens
tctagtggtctttgtaagagtgt

SEQ ID NO: 6465484 - DNA, 12 bp, Homo sapiens
tctagtgtatca

SEQ ID NO: 6465485 - DNA, 14 bp, Homo sapiens
tctagtgtatcaaa

SEQ ID NO: 6465486 - DNA, 19 bp, Homo sapiens
tctagtgtatcaaaatgct

SEQ ID NO: 6465487 - DNA, 18 bp, Homo sapiens
tctagtgtccataaataa

SEQ ID NO: 6465488 - DNA, 23 bp, Homo sapiens
tctagtgtctgggtttggcccaa

SEQ ID NO: 6465489 - DNA, 13 bp, Homo sapiens
tctagtgttcaga

SEQ ID NO: 6465490 - DNA, 17 bp, Homo sapiens
tctagttacctactttt

SEQ ID NO: 6465491 - DNA, 18 bp, Homo sapiens
tctagttagcaggaaata

SEQ ID NO: 6465492 - DNA, 16 bp, Homo sapiens
tctagttatttattct

SEQ ID NO: 6465493 - DNA, 14 bp, Homo sapiens
tctagttcaatgcc

SEQ ID NO: 6465494 - DNA, 16 bp, Homo sapiens
tctagttcactctcca

SEQ ID NO: 6465495 - DNA, 19 bp, Homo sapiens
tctagttcactctccattt

SEQ ID NO: 6465496 - DNA, 17 bp, Homo sapiens
tctagttcccctgttta

SEQ ID NO: 6465497 - DNA, 21 bp, Homo sapiens
tctagttcccctgtttattca

SEQ ID NO: 6465498 - DNA, 21 bp, Homo sapiens
tctagttcctgatgacccagg

SEQ ID NO: 6465499 - DNA, 18 bp, Homo sapiens
tctagttctcttctcctg

SEQ ID NO: 6465500 - DNA, 19 bp, Homo sapiens
tctagttctcttctcctgt

SEQ ID NO: 6465501 - DNA, 17 bp, Homo sapiens
tctagttctgccaggag

SEQ ID NO: 6465502 - DNA, 21 bp, Homo sapiens
tctagttctttcctccccctg

SEQ ID NO: 6465503 - DNA, 19 bp, Homo sapiens
tctagttgacttcaaatgt

SEQ ID NO: 6465504 - DNA, 19 bp, Homo sapiens
tctagttgaggagtttcct

SEQ ID NO: 6465505 - DNA, 20 bp, Homo sapiens
tctagttgaggagtttccta

SEQ ID NO: 6465506 - DNA, 21 bp, Homo sapiens
tctagttgccaaatctggctc

SEQ ID NO: 6465507 - DNA, 20 bp, Homo sapiens
tctagttgcccccattccca

SEQ ID NO: 6465508 - DNA, 22 bp, Homo sapiens
tctagttgcccccattcccagc

SEQ ID NO: 6465509 - DNA, 18 bp, Homo sapiens
tctagttgcttgtaaaat

SEQ ID NO: 6465510 - DNA, 23 bp, Homo sapiens
tctagttgtttgattcagacagc

SEQ ID NO: 6465511 - DNA, 22 bp, Homo sapiens
tctagtttaattaatctgtaat

SEQ ID NO: 6465512 - DNA, 15 bp, Homo sapiens
tctagtttacagaaa

SEQ ID NO: 6465513 - DNA, 21 bp, Homo sapiens
tctagtttacagaaaaatctt

SEQ ID NO: 6465514 - DNA, 12 bp, Homo sapiens
tctagtttactt

SEQ ID NO: 6465515 - DNA, 11 bp, Homo sapiens
tctagtttaga

SEQ ID NO: 6465516 - DNA, 13 bp, Homo sapiens
tctagtttattct

SEQ ID NO: 6465517 - DNA, 14 bp, Homo sapiens
tctagtttattcta

SEQ ID NO: 6465518 - DNA, 23 bp, Homo sapiens
tctagtttcagtaaataatgaaa

SEQ ID NO: 6465519 - DNA, 14 bp, Homo sapiens
tctagtttcccaca

SEQ ID NO: 6465520 - DNA, 16 bp, Homo sapiens
tctagtttccctggtg

SEQ ID NO: 6465521 - DNA, 14 bp, Homo sapiens
tctagtttctcaaa

SEQ ID NO: 6465522 - DNA, 23 bp, Homo sapiens
tctagtttgattaaattcttgca

SEQ ID NO: 6465523 - DNA, 13 bp, Homo sapiens
tctagtttgcata

SEQ ID NO: 6465524 - DNA, 15 bp, Homo sapiens
tctagtttgcatact

SEQ ID NO: 6465525 - DNA, 13 bp, Homo sapiens
tctagtttgcatt

SEQ ID NO: 6465526 - DNA, 15 bp, Homo sapiens
tctagtttgcattcc

SEQ ID NO: 6465527 - DNA, 19 bp, Homo sapiens
tctagtttggcacatgcag

SEQ ID NO: 6465528 - DNA, 12 bp, Homo sapiens
tctagtttgttt

SEQ ID NO: 6465529 - DNA, 15 bp, Homo sapiens
tctagtttgtttagt

SEQ ID NO: 6465530 - DNA, 17 bp, Homo sapiens
tctagttttatacaaag

SEQ ID NO: 6465531 - DNA, 18 bp, Homo sapiens
tctagttttcagtttgta

SEQ ID NO: 6465532 - DNA, 20 bp, Homo sapiens
tctagttttcagtttgtata

SEQ ID NO: 6465533 - DNA, 17 bp, Homo sapiens
tctagttttttttgtaa

SEQ ID NO: 6465534 - DNA, 14 bp, Homo sapiens
tctataaaaaccac

SEQ ID NO: 6465535 - DNA, 12 bp, Homo sapiens
tctataaaactc

SEQ ID NO: 6465536 - DNA, 13 bp, Homo sapiens
tctataaaagaat

SEQ ID NO: 6465537 - DNA, 15 bp, Homo sapiens
tctataaaataaact

SEQ ID NO: 6465538 - DNA, 21 bp, Homo sapiens
tctataaaataaacttcttaa

SEQ ID NO: 6465539 - DNA, 14 bp, Homo sapiens
tctataaaatagat

SEQ ID NO: 6465540 - DNA, 13 bp, Homo sapiens
tctataaacactg

SEQ ID NO: 6465541 - DNA, 14 bp, Homo sapiens
tctataaacactgt

SEQ ID NO: 6465542 - DNA, 17 bp, Homo sapiens
tctataaacactgtttg

SEQ ID NO: 6465543 - DNA, 18 bp, Homo sapiens
tctataaacatatgcaaa

SEQ ID NO: 6465544 - DNA, 17 bp, Homo sapiens
tctataaagaaactttt

SEQ ID NO: 6465545 - DNA, 15 bp, Homo sapiens
tctataaagcattta

SEQ ID NO: 6465546 - DNA, 14 bp, Homo sapiens
tctataaagggtca

SEQ ID NO: 6465547 - DNA, 12 bp, Homo sapiens
tctataaatgac

SEQ ID NO: 6465548 - DNA, 18 bp, Homo sapiens
tctataaatgactattgt

SEQ ID NO: 6465549 - DNA, 19 bp, Homo sapiens
tctataaatgactattgta

SEQ ID NO: 6465550 - DNA, 16 bp, Homo sapiens
tctataaattgtccgt

SEQ ID NO: 6465551 - DNA, 17 bp, Homo sapiens
tctataaatttaagaaa

SEQ ID NO: 6465552 - DNA, 20 bp, Homo sapiens
tctataaatttaagaaaaca

SEQ ID NO: 6465553 - DNA, 21 bp, Homo sapiens
tctataaatttaagaaaacaa

SEQ ID NO: 6465554 - DNA, 23 bp, Homo sapiens
tctataacaaaggatacttattt

SEQ ID NO: 6465555 - DNA, 14 bp, Homo sapiens
tctataacaaatgc

SEQ ID NO: 6465556 - DNA, 15 bp, Homo sapiens
tctataacatgcatt

SEQ ID NO: 6465557 - DNA, 16 bp, Homo sapiens
tctataagagacaaag

SEQ ID NO: 6465558 - DNA, 21 bp, Homo sapiens
tctataagcaaattgcttttt

SEQ ID NO: 6465559 - DNA, 13 bp, Homo sapiens
tctataaggccat

SEQ ID NO: 6465560 - DNA, 22 bp, Homo sapiens
tctataagtgaggaagagttta

SEQ ID NO: 6465561 - DNA, 21 bp, Homo sapiens
tctataagtgttcagtgttga

SEQ ID NO: 6465562 - DNA, 16 bp, Homo sapiens
tctataagttgtacca

SEQ ID NO: 6465563 - DNA, 21 bp, Homo sapiens
tctataagttgtaccaaaaca

SEQ ID NO: 6465564 - DNA, 22 bp, Homo sapiens
tctataagttgtaccaaaacat

SEQ ID NO: 6465565 - DNA, 23 bp, Homo sapiens
tctataagttgtaccaaaacatc

SEQ ID NO: 6465566 - DNA, 14 bp, Homo sapiens
tctataataagttt

SEQ ID NO: 6465567 - DNA, 19 bp, Homo sapiens
tctataataagttttgata

SEQ ID NO: 6465568 - DNA, 20 bp, Homo sapiens
tctataataagttttgatat

SEQ ID NO: 6465569 - DNA, 21 bp, Homo sapiens
tctataatatttgtgtgttca

SEQ ID NO: 6465570 - DNA, 22 bp, Homo sapiens
tctataattccttaaaattttc

SEQ ID NO: 6465571 - DNA, 13 bp, Homo sapiens
tctataattgttt

SEQ ID NO: 6465572 - DNA, 12 bp, Homo sapiens
tctataatttac

SEQ ID NO: 6465573 - DNA, 19 bp, Homo sapiens
tctataatttccatttact

SEQ ID NO: 6465574 - DNA, 15 bp, Homo sapiens
tctataattttgcct

SEQ ID NO: 6465575 - DNA, 15 bp, Homo sapiens
tctatacatctctcc

SEQ ID NO: 6465576 - DNA, 16 bp, Homo sapiens
tctatacatctctccc

SEQ ID NO: 6465577 - DNA, 16 bp, Homo sapiens
tctataccaaccaaac

SEQ ID NO: 6465578 - DNA, 17 bp, Homo sapiens
tctatacccacccagaa

SEQ ID NO: 6465579 - DNA, 15 bp, Homo sapiens
tctatacctgccttt

SEQ ID NO: 6465580 - DNA, 20 bp, Homo sapiens
tctatacctgtctcctttct

SEQ ID NO: 6465581 - DNA, 15 bp, Homo sapiens
tctatactaatgctt

SEQ ID NO: 6465582 - DNA, 18 bp, Homo sapiens
tctatactaatgcttaca

SEQ ID NO: 6465583 - DNA, 14 bp, Homo sapiens
tctatactgtggcc

SEQ ID NO: 6465584 - DNA, 17 bp, Homo sapiens
tctatactgtttgtaat

SEQ ID NO: 6465585 - DNA, 12 bp, Homo sapiens
tctatactttgt

SEQ ID NO: 6465586 - DNA, 18 bp, Homo sapiens
tctatactttgttctgtt

SEQ ID NO: 6465587 - DNA, 12 bp, Homo sapiens
tctatagaaagt

SEQ ID NO: 6465588 - DNA, 19 bp, Homo sapiens
tgcactttgatgtcatgtg

SEQ ID NO: 6465589 - DNA, 20 bp, Homo sapiens
tgcactttgctttaatataa

SEQ ID NO: 6465590 - DNA, 22 bp, Homo sapiens
tgcactttgggtttttaactca

SEQ ID NO: 6465591 - DNA, 18 bp, Homo sapiens
tgcactttgtagtgtttg

SEQ ID NO: 6465592 - DNA, 15 bp, Homo sapiens
tgcactttgttctgg

SEQ ID NO: 6465593 - DNA, 14 bp, Homo sapiens
tgcactttgtttag

SEQ ID NO: 6465594 - DNA, 18 bp, Homo sapiens
tgcactttgtttagaaaa

SEQ ID NO: 6465595 - DNA, 21 bp, Homo sapiens
tgcacttttatgaagttttta

SEQ ID NO: 6465596 - DNA, 21 bp, Homo sapiens
tgcacttttctaaactaggct

SEQ ID NO: 6465597 - DNA, 15 bp, Homo sapiens
tgcacttttgggcct

SEQ ID NO: 6465598 - DNA, 16 bp, Homo sapiens
tgcacttttgggcctt

SEQ ID NO: 6465599 - DNA, 18 bp, Homo sapiens
tgcactttttccttactg

SEQ ID NO: 6465600 - DNA, 14 bp, Homo sapiens
tgcactttttctta

SEQ ID NO: 6465601 - DNA, 20 bp, Homo sapiens
tgcactttttcttaatcatt

SEQ ID NO: 6465602 - DNA, 20 bp, Homo sapiens
tgcacttttttatgaagaaa

SEQ ID NO: 6465603 - DNA, 21 bp, Homo sapiens
tgcacttttttgtttgaatgt

SEQ ID NO: 6465604 - DNA, 17 bp, Homo sapiens
tgcactttttttacttc

SEQ ID NO: 6465605 - DNA, 18 bp, Homo sapiens
tgcactttttttctatat

SEQ ID NO: 6465606 - DNA, 15 bp, Homo sapiens
tgcagaaaaaacaaa

SEQ ID NO: 6465607 - DNA, 16 bp, Homo sapiens
tgcagaaaaagaaaaa

SEQ ID NO: 6465608 - DNA, 16 bp, Homo sapiens
tgcagaaaacagggtc

SEQ ID NO: 6465609 - DNA, 13 bp, Homo sapiens
tgcagaaaacatt

SEQ ID NO: 6465610 - DNA, 16 bp, Homo sapiens
tgcagaaaagcacctg

SEQ ID NO: 6465611 - DNA, 22 bp, Homo sapiens
tgcagaaaagcacctgccgacc

SEQ ID NO: 6465612 - DNA, 17 bp, Homo sapiens
tgcagaaaagctcagag

SEQ ID NO: 6465613 - DNA, 21 bp, Homo sapiens
tgcagaaaagctcagagtagg

SEQ ID NO: 6465614 - DNA, 20 bp, Homo sapiens
tgcagaaaatgaactgcttt

SEQ ID NO: 6465615 - DNA, 17 bp, Homo sapiens
tgcagaaaattctgtgc

SEQ ID NO: 6465616 - DNA, 18 bp, Homo sapiens
tgcagaaaattctgtgcc

SEQ ID NO: 6465617 - DNA, 17 bp, Homo sapiens
tgcagaaacagatttgg

SEQ ID NO: 6465618 - DNA, 20 bp, Homo sapiens
tgcagaaagcatccctcacc

SEQ ID NO: 6465619 - DNA, 14 bp, Homo sapiens
tgcagaaaggagag

SEQ ID NO: 6465620 - DNA, 20 bp, Homo sapiens
tgcagaaatagacaaaaagt

SEQ ID NO: 6465621 - DNA, 18 bp, Homo sapiens
tgcagaaatcacaatttt

SEQ ID NO: 6465622 - DNA, 20 bp, Homo sapiens
tgcagaaatcacgttgctgg

SEQ ID NO: 6465623 - DNA, 15 bp, Homo sapiens
tgcagaaatgaaata

SEQ ID NO: 6465624 - DNA, 21 bp, Homo sapiens
tgcagaacacatttcaaatga

SEQ ID NO: 6465625 - DNA, 20 bp, Homo sapiens
tgcagaacatgagtgctgat

SEQ ID NO: 6465626 - DNA, 13 bp, Homo sapiens
tgcagaaccagtc

SEQ ID NO: 6465627 - DNA, 19 bp, Homo sapiens
tgcagaacccccaggtggc

SEQ ID NO: 6465628 - DNA, 22 bp, Homo sapiens
tgcagaacccccaggtggcctg

SEQ ID NO: 6465629 - DNA, 20 bp, Homo sapiens
tgcagaaccggagagccagc

SEQ ID NO: 6465630 - DNA, 23 bp, Homo sapiens
tgcagaactcatttattcagcaa

SEQ ID NO: 6465631 - DNA, 14 bp, Homo sapiens
tgcagaactcccaa

SEQ ID NO: 6465632 - DNA, 15 bp, Homo sapiens
tgcagaactcccaag

SEQ ID NO: 6465633 - DNA, 20 bp, Homo sapiens
tgcagaactcctccaaagca

SEQ ID NO: 6465634 - DNA, 12 bp, Homo sapiens
tgcagaactgcc

SEQ ID NO: 6465635 - DNA, 14 bp, Homo sapiens
tgcagaactgccat

SEQ ID NO: 6465636 - DNA, 20 bp, Homo sapiens
tgcagaactttctcttttga

SEQ ID NO: 6465637 - DNA, 17 bp, Homo sapiens
tgcagaagaaactcctg

SEQ ID NO: 6465638 - DNA, 18 bp, Homo sapiens
tgcagaagaaactcctgg

SEQ ID NO: 6465639 - DNA, 18 bp, Homo sapiens
tgcagaagcaataataaa

SEQ ID NO: 6465640 - DNA, 18 bp, Homo sapiens
tgcagaagcagtgtttct

SEQ ID NO: 6465641 - DNA, 14 bp, Homo sapiens
tgcagaagccaagg

SEQ ID NO: 6465642 - DNA, 21 bp, Homo sapiens
tgcagaagccaagggaagaca

SEQ ID NO: 6465643 - DNA, 13 bp, Homo sapiens
tgcagaagccaga

SEQ ID NO: 6465644 - DNA, 16 bp, Homo sapiens
tgcagaagccagaagg

SEQ ID NO: 6465645 - DNA, 14 bp, Homo sapiens
tgcagaagctgtgg

SEQ ID NO: 6465646 - DNA, 22 bp, Homo sapiens
tgcagaaggaaaaatgtgtaat

SEQ ID NO: 6465647 - DNA, 14 bp, Homo sapiens
tgcagaaggaaaga

SEQ ID NO: 6465648 - DNA, 17 bp, Homo sapiens
tgcagaaggaaatgatg

SEQ ID NO: 6465649 - DNA, 19 bp, Homo sapiens
tgcagaaggaaatgatgga

SEQ ID NO: 6465650 - DNA, 13 bp, Homo sapiens
tgcagaaggcaag

SEQ ID NO: 6465651 - DNA, 13 bp, Homo sapiens
tgcagaaggccaa

SEQ ID NO: 6465652 - DNA, 14 bp, Homo sapiens
tgcagaagtattct

SEQ ID NO: 6465653 - DNA, 14 bp, Homo sapiens
tgcagaataatgga

SEQ ID NO: 6465654 - DNA, 20 bp, Homo sapiens
tgcagaataatggaaacatt

SEQ ID NO: 6465655 - DNA, 16 bp, Homo sapiens
tgcagaatacttgact

SEQ ID NO: 6465656 - DNA, 16 bp, Homo sapiens
tgcagaatatgacaat

SEQ ID NO: 6465657 - DNA, 19 bp, Homo sapiens
tgcagaatatgacaatcta

SEQ ID NO: 6465658 - DNA, 14 bp, Homo sapiens
tgcagaatcccttt

SEQ ID NO: 6465659 - DNA, 24 bp, Homo sapiens
tgcagaatctctgcctagaatctt

SEQ ID NO: 6465660 - DNA, 16 bp, Homo sapiens
tgcagaatgaagccat

SEQ ID NO: 6465661 - DNA, 17 bp, Homo sapiens
tgcagaatggcatttgc

SEQ ID NO: 6465662 - DNA, 19 bp, Homo sapiens
tgcagaatgtaagtgggcc

SEQ ID NO: 6465663 - DNA, 19 bp, Homo sapiens
tgcagacaaaaagaacaaa

SEQ ID NO: 6465664 - DNA, 21 bp, Homo sapiens
tgcagacaaagccctgtcctt

SEQ ID NO: 6465665 - DNA, 18 bp, Homo sapiens
tgcagacaacaccttcct

SEQ ID NO: 6465666 - DNA, 23 bp, Homo sapiens
tgcagacaagtcttgctgtgctt

SEQ ID NO: 6465667 - DNA, 17 bp, Homo sapiens
tgcagacaatcttctgt

SEQ ID NO: 6465668 - DNA, 12 bp, Homo sapiens
tgcagacacaca

SEQ ID NO: 6465669 - DNA, 17 bp, Homo sapiens
tgcagacacacaacatc

SEQ ID NO: 6465670 - DNA, 23 bp, Homo sapiens
tgcagacacagattatgttcctg

SEQ ID NO: 6465671 - DNA, 17 bp, Homo sapiens
tgcagacacctggactg

SEQ ID NO: 6465672 - DNA, 18 bp, Homo sapiens
tgcagacacctggactga

SEQ ID NO: 6465673 - DNA, 15 bp, Homo sapiens
tgcagacactcaaga

SEQ ID NO: 6465674 - DNA, 17 bp, Homo sapiens
tgcagacactcaagagc

SEQ ID NO: 6465675 - DNA, 17 bp, Homo sapiens
tgcagacagaatataaa

SEQ ID NO: 6465676 - DNA, 15 bp, Homo sapiens
tgcagacagccatgc

SEQ ID NO: 6465677 - DNA, 20 bp, Homo sapiens
tgcagacaggaatcttaagg

SEQ ID NO: 6465678 - DNA, 21 bp, Homo sapiens
tgcagacaggcaagcacctcc

SEQ ID NO: 6465679 - DNA, 22 bp, Homo sapiens
tgcagacaggctctgaggggca

SEQ ID NO: 6465680 - DNA, 21 bp, Homo sapiens
tgcagacaggctggcattcta

SEQ ID NO: 6465681 - DNA, 21 bp, Homo sapiens
tgcagacagtctgttatgcac

SEQ ID NO: 6465682 - DNA, 23 bp, Homo sapiens
tgcagacagtctgttatgcactg

SEQ ID NO: 6465683 - DNA, 12 bp, Homo sapiens
tgcagacagtgt

SEQ ID NO: 6465684 - DNA, 17 bp, Homo sapiens
tgcagacatattttctt

SEQ ID NO: 6465685 - DNA, 20 bp, Homo sapiens
tgcagacatctctggagcca

SEQ ID NO: 6465686 - DNA, 23 bp, Homo sapiens
tgcagacatctctggagccagag

SEQ ID NO: 6465687 - DNA, 15 bp, Homo sapiens
tgcagacatgagtgc

SEQ ID NO: 6465688 - DNA, 16 bp, Homo sapiens
tgcagacattctcaaa

SEQ ID NO: 6465689 - DNA, 20 bp, Homo sapiens
tgcagaccacactctgcctg

SEQ ID NO: 6465690 - DNA, 23 bp, Homo sapiens
tgcagaccacgcccgtcctgcct

SEQ ID NO: 6465691 - DNA, 15 bp, Homo sapiens
tgcagaccaggaagg

SEQ ID NO: 6465692 - DNA, 17 bp, Homo sapiens
tgcagaccatcgcacac

SEQ ID NO: 6465693 - DNA, 14 bp, Homo sapiens
tgcagaccatgcca

SEQ ID NO: 6465694 - DNA, 16 bp, Homo sapiens
tgcagaccatgccaga

SEQ ID NO: 6465695 - DNA, 17 bp, Homo sapiens
tgcagaccctgaaccca

SEQ ID NO: 6465696 - DNA, 14 bp, Homo sapiens
tgcagaccctgcca

SEQ ID NO: 6465697 - DNA, 17 bp, Homo sapiens
tgcagaccctgccaggg

SEQ ID NO: 6465698 - DNA, 22 bp, Homo sapiens
tgcagacctcatgcccagctct

SEQ ID NO: 6465699 - DNA, 14 bp, Homo sapiens
tgcagacctggctg

SEQ ID NO: 6465700 - DNA, 15 bp, Homo sapiens
tgcagacctggctgg

SEQ ID NO: 6465701 - DNA, 20 bp, Homo sapiens
tgcagacctggctgggcctg

SEQ ID NO: 6465702 - DNA, 17 bp, Homo sapiens
tgcagacctgggacttt

SEQ ID NO: 6465703 - DNA, 17 bp, Homo sapiens
tgcagacctgtcaccct

SEQ ID NO: 6465704 - DNA, 19 bp, Homo sapiens
tgcagacctgtcctcctgg

SEQ ID NO: 6465705 - DNA, 20 bp, Homo sapiens
tgcagacctgtcctcctggt

SEQ ID NO: 6465706 - DNA, 22 bp, Homo sapiens
tgcagacggatgcccattcctg

SEQ ID NO: 6465707 - DNA, 18 bp, Homo sapiens
tgcagacgggcaagaagc

SEQ ID NO: 6465708 - DNA, 22 bp, Homo sapiens
tgcagacgggcaagaagctgct

SEQ ID NO: 6465709 - DNA, 14 bp, Homo sapiens
tgcagacgtctggc

SEQ ID NO: 6465710 - DNA, 22 bp, Homo sapiens
tgcagactagaattctagtgct

SEQ ID NO: 6465711 - DNA, 23 bp, Homo sapiens
tgcagactagaattctagtgctg

SEQ ID NO: 6465712 - DNA, 15 bp, Homo sapiens
tgcagactagctaat

SEQ ID NO: 6465713 - DNA, 20 bp, Homo sapiens
tgcagactcagtttgtcaga

SEQ ID NO: 6465714 - DNA, 16 bp, Homo sapiens
tgcagactggagggga

SEQ ID NO: 6465715 - DNA, 22 bp, Homo sapiens
tgcagactggtgttaatgagta

SEQ ID NO: 6465716 - DNA, 14 bp, Homo sapiens
tgcagactgtggct

SEQ ID NO: 6465717 - DNA, 15 bp, Homo sapiens
tgcagactgtggctg

SEQ ID NO: 6465718 - DNA, 18 bp, Homo sapiens
tgcagactgttagctttt

SEQ ID NO: 6465719 - DNA, 16 bp, Homo sapiens
tgcagacttcccagct

SEQ ID NO: 6465720 - DNA, 22 bp, Homo sapiens
tgcagacttcccagctaggaag

SEQ ID NO: 6465721 - DNA, 19 bp, Homo sapiens
tgcagagaaacgtgtaccc

SEQ ID NO: 6465722 - DNA, 20 bp, Homo sapiens
tgcagagaagaataagacat

SEQ ID NO: 6465723 - DNA, 13 bp, Homo sapiens
tgcagagaagctg

SEQ ID NO: 6465724 - DNA, 15 bp, Homo sapiens
tgcagagaagctgga

SEQ ID NO: 6465725 - DNA, 17 bp, Homo sapiens
tgcagagaagctggact

SEQ ID NO: 6465726 - DNA, 19 bp, Homo sapiens
tgcagagacgcaagggaga

SEQ ID NO: 6465727 - DNA, 19 bp, Homo sapiens
tgcagagactcatttcaca

SEQ ID NO: 6465728 - DNA, 15 bp, Homo sapiens
tgcagagagaagcct

SEQ ID NO: 6465729 - DNA, 16 bp, Homo sapiens
tgcagagagccatttt

SEQ ID NO: 6465730 - DNA, 18 bp, Homo sapiens
tgcagagagccattttgt

SEQ ID NO: 6465731 - DNA, 22 bp, Homo sapiens
tgcagagagccattttgtgaat

SEQ ID NO: 6465732 - DNA, 22 bp, Homo sapiens
tgcagagatatttcttcaggag

SEQ ID NO: 6465733 - DNA, 17 bp, Homo sapiens
tgcagagatttcctcca

SEQ ID NO: 6465734 - DNA, 15 bp, Homo sapiens
tgcagagcaataaca

SEQ ID NO: 6465735 - DNA, 14 bp, Homo sapiens
tgcagagcacaaac

SEQ ID NO: 6465736 - DNA, 18 bp, Homo sapiens
tgcagagcacacaggtac

SEQ ID NO: 6465737 - DNA, 17 bp, Homo sapiens
tgcagagcagacaggct

SEQ ID NO: 6465738 - DNA, 13 bp, Homo sapiens
tgcagagcctgca

SEQ ID NO: 6465739 - DNA, 19 bp, Homo sapiens
tgcagagctaggttgtcct

SEQ ID NO: 6465740 - DNA, 15 bp, Homo sapiens
tgcagagctgaagat

SEQ ID NO: 6465741 - DNA, 20 bp, Homo sapiens
tgcagagctgcacttggcct

SEQ ID NO: 6465742 - DNA, 22 bp, Homo sapiens
tgcagagctgcacttggcctca

SEQ ID NO: 6465743 - DNA, 18 bp, Homo sapiens
tgcagaggacagagctgg

SEQ ID NO: 6465744 - DNA, 15 bp, Homo sapiens
tgcagaggaccacag

SEQ ID NO: 6465745 - DNA, 12 bp, Homo sapiens
tgcagaggagcc

SEQ ID NO: 6465746 - DNA, 19 bp, Homo sapiens
tgcagaggagccacctggg

SEQ ID NO: 6465747 - DNA, 22 bp, Homo sapiens
tgcagaggagccacctgggctg

SEQ ID NO: 6465748 - DNA, 15 bp, Homo sapiens
tgcagaggagcccag

SEQ ID NO: 6465749 - DNA, 16 bp, Homo sapiens
tgcagaggaggtgaga

SEQ ID NO: 6465750 - DNA, 21 bp, Homo sapiens
tgcagaggaggtgagagtggg

SEQ ID NO: 6465751 - DNA, 17 bp, Homo sapiens
tgcagaggccagaggcc

SEQ ID NO: 6465752 - DNA, 15 bp, Homo sapiens
tgcagaggcctgcag

SEQ ID NO: 6465753 - DNA, 18 bp, Homo sapiens
tgcagaggcctgcagggc

SEQ ID NO: 6465754 - DNA, 14 bp, Homo sapiens
tgcagaggcctggg

SEQ ID NO: 6465755 - DNA, 17 bp, Homo sapiens
tgcagaggcctggggga

SEQ ID NO: 6465756 - DNA, 23 bp, Homo sapiens
tgcagaggctcttgatggtggac

SEQ ID NO: 6465757 - DNA, 12 bp, Homo sapiens
tgcagaggctgt

SEQ ID NO: 6465758 - DNA, 22 bp, Homo sapiens
tgcagaggctgtggctggtgag

SEQ ID NO: 6465759 - DNA, 21 bp, Homo sapiens
tgcagaggcttattcagttct

SEQ ID NO: 6465760 - DNA, 20 bp, Homo sapiens
tgcagagggagacggccctg

SEQ ID NO: 6465761 - DNA, 13 bp, Homo sapiens
tgcagaggggaaa

SEQ ID NO: 6465762 - DNA, 15 bp, Homo sapiens
tgcagaggggcaggc

SEQ ID NO: 6465763 - DNA, 20 bp, Homo sapiens
tgcagaggggcaggccctgc

SEQ ID NO: 6465764 - DNA, 15 bp, Homo sapiens
tgcagaggtctgtgc

SEQ ID NO: 6465765 - DNA, 13 bp, Homo sapiens
tctatagaaagtg

SEQ ID NO: 6465766 - DNA, 15 bp, Homo sapiens
tctatagaaagtgtt

SEQ ID NO: 6465767 - DNA, 24 bp, Homo sapiens
tctatagaaagtgttctgttacaa

SEQ ID NO: 6465768 - DNA, 17 bp, Homo sapiens
tctatagaactgaatga

SEQ ID NO: 6465769 - DNA, 13 bp, Homo sapiens
tctatagactcta

SEQ ID NO: 6465770 - DNA, 17 bp, Homo sapiens
tctatagactgactttt

SEQ ID NO: 6465771 - DNA, 11 bp, Homo sapiens
tctatagagaa

SEQ ID NO: 6465772 - DNA, 21 bp, Homo sapiens
tctatagataacggctctcca

SEQ ID NO: 6465773 - DNA, 15 bp, Homo sapiens
tctatagatgcctct

SEQ ID NO: 6465774 - DNA, 19 bp, Homo sapiens
tctatagcatcacttaaaa

SEQ ID NO: 6465775 - DNA, 17 bp, Homo sapiens
tctatagcatttaaaga

SEQ ID NO: 6465776 - DNA, 19 bp, Homo sapiens
tctatagcatttaaagata

SEQ ID NO: 6465777 - DNA, 18 bp, Homo sapiens
tctatagctcttctattt

SEQ ID NO: 6465778 - DNA, 20 bp, Homo sapiens
tctatagctcttctatttaa

SEQ ID NO: 6465779 - DNA, 23 bp, Homo sapiens
tctataggacttaatttagcagt

SEQ ID NO: 6465780 - DNA, 22 bp, Homo sapiens
tctataggagatgagcttcatt

SEQ ID NO: 6465781 - DNA, 13 bp, Homo sapiens
tctataggcagct

SEQ ID NO: 6465782 - DNA, 15 bp, Homo sapiens
tctataggcagcttc

SEQ ID NO: 6465783 - DNA, 16 bp, Homo sapiens
tctataggcagcttct

SEQ ID NO: 6465784 - DNA, 20 bp, Homo sapiens
tctataggcagcttctaaga

SEQ ID NO: 6465785 - DNA, 21 bp, Homo sapiens
tctataggtcatgatttctgt

SEQ ID NO: 6465786 - DNA, 15 bp, Homo sapiens
tctatagtgatgatg

SEQ ID NO: 6465787 - DNA, 20 bp, Homo sapiens
tctatagttatacatcttca

SEQ ID NO: 6465788 - DNA, 15 bp, Homo sapiens
tctatataaaataac

SEQ ID NO: 6465789 - DNA, 15 bp, Homo sapiens
tctatataatgtagt

SEQ ID NO: 6465790 - DNA, 20 bp, Homo sapiens
tctatatagacttggagaat

SEQ ID NO: 6465791 - DNA, 21 bp, Homo sapiens
tctatatagttccttgcctta

SEQ ID NO: 6465792 - DNA, 18 bp, Homo sapiens
tctatatatacatgtata

SEQ ID NO: 6465793 - DNA, 14 bp, Homo sapiens
tctatatatgtgta

SEQ ID NO: 6465794 - DNA, 16 bp, Homo sapiens
tctatatcttcttata

SEQ ID NO: 6465795 - DNA, 14 bp, Homo sapiens
tctatatctttaaa

SEQ ID NO: 6465796 - DNA, 20 bp, Homo sapiens
tctatatgtacttgtcaaag

SEQ ID NO: 6465797 - DNA, 23 bp, Homo sapiens
tctatatgtacttgtcaaagaag

SEQ ID NO: 6465798 - DNA, 21 bp, Homo sapiens
tctatatgtagtgcattttta

SEQ ID NO: 6465799 - DNA, 15 bp, Homo sapiens
tctatattatgtctt

SEQ ID NO: 6465800 - DNA, 19 bp, Homo sapiens
tctatattattatatatat

SEQ ID NO: 6465801 - DNA, 22 bp, Homo sapiens
tctatattccgggtgccattcc

SEQ ID NO: 6465802 - DNA, 16 bp, Homo sapiens
tctatattcctccagc

SEQ ID NO: 6465803 - DNA, 18 bp, Homo sapiens
tctatattcctccagctg

SEQ ID NO: 6465804 - DNA, 12 bp, Homo sapiens
tctatattctaa

SEQ ID NO: 6465805 - DNA, 15 bp, Homo sapiens
tctatattgtgccaa

SEQ ID NO: 6465806 - DNA, 17 bp, Homo sapiens
tctatatttaaatcatt

SEQ ID NO: 6465807 - DNA, 18 bp, Homo sapiens
tctatatttactgtttat

SEQ ID NO: 6465808 - DNA, 16 bp, Homo sapiens
tctatatttattttca

SEQ ID NO: 6465809 - DNA, 13 bp, Homo sapiens
tctatatttcata

SEQ ID NO: 6465810 - DNA, 14 bp, Homo sapiens
tctatatttcatat

SEQ ID NO: 6465811 - DNA, 17 bp, Homo sapiens
tctatatttcatattga

SEQ ID NO: 6465812 - DNA, 15 bp, Homo sapiens
tctatatttgtaact

SEQ ID NO: 6465813 - DNA, 17 bp, Homo sapiens
tctatattttaatagaa

SEQ ID NO: 6465814 - DNA, 13 bp, Homo sapiens
tctatattttcat

SEQ ID NO: 6465815 - DNA, 18 bp, Homo sapiens
tctatatttttatttcat

SEQ ID NO: 6465816 - DNA, 19 bp, Homo sapiens
tctatatttttatttctac

SEQ ID NO: 6465817 - DNA, 17 bp, Homo sapiens
tctatcaaatgtgatgg

SEQ ID NO: 6465818 - DNA, 22 bp, Homo sapiens
tctatcaaccccagacactggt

SEQ ID NO: 6465819 - DNA, 23 bp, Homo sapiens
tctatcaactttaatcaagttgt

SEQ ID NO: 6465820 - DNA, 21 bp, Homo sapiens
tctatcaagtattataccttt

SEQ ID NO: 6465821 - DNA, 18 bp, Homo sapiens
tctatcaagtcaatcatt

SEQ ID NO: 6465822 - DNA, 15 bp, Homo sapiens
tctatcaatagtcaa

SEQ ID NO: 6465823 - DNA, 15 bp, Homo sapiens
tctatcacctgtcat

SEQ ID NO: 6465824 - DNA, 14 bp, Homo sapiens
tctatcactgcatt

SEQ ID NO: 6465825 - DNA, 15 bp, Homo sapiens
tctatcactgcatta

SEQ ID NO: 6465826 - DNA, 16 bp, Homo sapiens
tctatcactgcattat

SEQ ID NO: 6465827 - DNA, 20 bp, Homo sapiens
tctatcagacgtgctccctc

SEQ ID NO: 6465828 - DNA, 22 bp, Homo sapiens
tctatcagcatctgacaggtga

SEQ ID NO: 6465829 - DNA, 18 bp, Homo sapiens
tctatcagtacttttatt

SEQ ID NO: 6465830 - DNA, 14 bp, Homo sapiens
tctatcattaaagt

SEQ ID NO: 6465831 - DNA, 15 bp, Homo sapiens
tctatcattaaagtt

SEQ ID NO: 6465832 - DNA, 13 bp, Homo sapiens
tctatcattgttg

SEQ ID NO: 6465833 - DNA, 12 bp, Homo sapiens
tctatcatttaa

SEQ ID NO: 6465834 - DNA, 16 bp, Homo sapiens
tctatcatttaataat

SEQ ID NO: 6465835 - DNA, 17 bp, Homo sapiens
tctatcatttaataata

SEQ ID NO: 6465836 - DNA, 18 bp, Homo sapiens
tctatcatttaataatat

SEQ ID NO: 6465837 - DNA, 17 bp, Homo sapiens
tctatcatttttgtaca

SEQ ID NO: 6465838 - DNA, 15 bp, Homo sapiens
tctatccaaaataaa

SEQ ID NO: 6465839 - DNA, 14 bp, Homo sapiens
tctatccacagaga

SEQ ID NO: 6465840 - DNA, 15 bp, Homo sapiens
tctatccacagagag

SEQ ID NO: 6465841 - DNA, 23 bp, Homo sapiens
tctatcccacccaacagctcaga

SEQ ID NO: 6465842 - DNA, 16 bp, Homo sapiens
tctatccccaagctgg

SEQ ID NO: 6465843 - DNA, 17 bp, Homo sapiens
tctatcccccttaaaga

SEQ ID NO: 6465844 - DNA, 18 bp, Homo sapiens
tctatcccccttaaagaa

SEQ ID NO: 6465845 - DNA, 14 bp, Homo sapiens
tctatccctggcca

SEQ ID NO: 6465846 - DNA, 16 bp, Homo sapiens
tctatcctagtcttca

SEQ ID NO: 6465847 - DNA, 15 bp, Homo sapiens
tctatcctctctctc

SEQ ID NO: 6465848 - DNA, 19 bp, Homo sapiens
tctatcctgttaacactgt

SEQ ID NO: 6465849 - DNA, 23 bp, Homo sapiens
tctatcctgttaacactgtaata

SEQ ID NO: 6465850 - DNA, 19 bp, Homo sapiens
tctatcgagtttgcaatgt

SEQ ID NO: 6465851 - DNA, 15 bp, Homo sapiens
tctatcggaagaaca

SEQ ID NO: 6465852 - DNA, 22 bp, Homo sapiens
tctatcggaagaacatgaatct

SEQ ID NO: 6465853 - DNA, 15 bp, Homo sapiens
tctatcgttattata

SEQ ID NO: 6465854 - DNA, 16 bp, Homo sapiens
tctatcgttattataa

SEQ ID NO: 6465855 - DNA, 18 bp, Homo sapiens
tctatcgttattataaat

SEQ ID NO: 6465856 - DNA, 20 bp, Homo sapiens
tctatcgttattataaatgt

SEQ ID NO: 6465857 - DNA, 14 bp, Homo sapiens
tctatctaaatgat

SEQ ID NO: 6465858 - DNA, 14 bp, Homo sapiens
tctatctaatgaca

SEQ ID NO: 6465859 - DNA, 16 bp, Homo sapiens
tctatctaatgacatg

SEQ ID NO: 6465860 - DNA, 10 bp, Homo sapiens
tctatctact

SEQ ID NO: 6465861 - DNA, 13 bp, Homo sapiens
tctatctctttct

SEQ ID NO: 6465862 - DNA, 20 bp, Homo sapiens
tctatctgcaaatagtttca

SEQ ID NO: 6465863 - DNA, 21 bp, Homo sapiens
tctatctgcaatgtttttgtg

SEQ ID NO: 6465864 - DNA, 23 bp, Homo sapiens
tctatctgcaatgtttttgtgta

SEQ ID NO: 6465865 - DNA, 12 bp, Homo sapiens
tctatctgctgg

SEQ ID NO: 6465866 - DNA, 15 bp, Homo sapiens
tctatctgctgggct

SEQ ID NO: 6465867 - DNA, 18 bp, Homo sapiens
tctatctgtattttcatt

SEQ ID NO: 6465868 - DNA, 17 bp, Homo sapiens
tctatcttgctctgtaa

SEQ ID NO: 6465869 - DNA, 19 bp, Homo sapiens
tctatcttgctctgtaatc

SEQ ID NO: 6465870 - DNA, 17 bp, Homo sapiens
tctatcttgtaaatatt

SEQ ID NO: 6465871 - DNA, 23 bp, Homo sapiens
tctatctttcattaaaaagaata

SEQ ID NO: 6465872 - DNA, 22 bp, Homo sapiens
tctatctttgagcgcccactag

SEQ ID NO: 6465873 - DNA, 18 bp, Homo sapiens
tctatcttttccacaaat

SEQ ID NO: 6465874 - DNA, 18 bp, Homo sapiens
tctatcttttgtttcctt

SEQ ID NO: 6465875 - DNA, 21 bp, Homo sapiens
tctatgaaagctatgaatgtt

SEQ ID NO: 6465876 - DNA, 13 bp, Homo sapiens
tctatgaaatatt

SEQ ID NO: 6465877 - DNA, 13 bp, Homo sapiens
tctatgaacctga

SEQ ID NO: 6465878 - DNA, 18 bp, Homo sapiens
tctatgaagcccacccag

SEQ ID NO: 6465879 - DNA, 21 bp, Homo sapiens
tctatgaagttgctgtttatt

SEQ ID NO: 6465880 - DNA, 23 bp, Homo sapiens
tctatgagaacaagtcacagctg

SEQ ID NO: 6465881 - DNA, 19 bp, Homo sapiens
tctatgataattacaatac

SEQ ID NO: 6465882 - DNA, 22 bp, Homo sapiens
tctatgatcagaactgggaaaa

SEQ ID NO: 6465883 - DNA, 15 bp, Homo sapiens
tctatgatccttttt

SEQ ID NO: 6465884 - DNA, 22 bp, Homo sapiens
tctatgatgaaggtaattaaag

SEQ ID NO: 6465885 - DNA, 23 bp, Homo sapiens
tctatgatgtccaaacttaacag

SEQ ID NO: 6465886 - DNA, 13 bp, Homo sapiens
tctatgatgttgc

SEQ ID NO: 6465887 - DNA, 16 bp, Homo sapiens
tctatgatgttgctgt

SEQ ID NO: 6465888 - DNA, 20 bp, Homo sapiens
tctatgattgtactttgaat

SEQ ID NO: 6465889 - DNA, 22 bp, Homo sapiens
tctatgcaaagcactctctgca

SEQ ID NO: 6465890 - DNA, 16 bp, Homo sapiens
tctatgcaatttttaa

SEQ ID NO: 6465891 - DNA, 14 bp, Homo sapiens
tctatgcagcctgc

SEQ ID NO: 6465892 - DNA, 19 bp, Homo sapiens
tctatgcagtattgccaca

SEQ ID NO: 6465893 - DNA, 20 bp, Homo sapiens
tctatgcataaaaaaatgat

SEQ ID NO: 6465894 - DNA, 17 bp, Homo sapiens
tctatgccaaagatcac

SEQ ID NO: 6465895 - DNA, 14 bp, Homo sapiens
tctatgccagctca

SEQ ID NO: 6465896 - DNA, 12 bp, Homo sapiens
tctatgccaggc

SEQ ID NO: 6465897 - DNA, 19 bp, Homo sapiens
tctatgccaggctgtgcta

SEQ ID NO: 6465898 - DNA, 15 bp, Homo sapiens
tctatgccctgcaga

SEQ ID NO: 6465899 - DNA, 16 bp, Homo sapiens
tctatgccctgcagag

SEQ ID NO: 6465900 - DNA, 18 bp, Homo sapiens
tctatgcctgtatttcca

SEQ ID NO: 6465901 - DNA, 15 bp, Homo sapiens
tctatgctcataact

SEQ ID NO: 6465902 - DNA, 17 bp, Homo sapiens
tctatgctgtgtgcaga

SEQ ID NO: 6465903 - DNA, 23 bp, Homo sapiens
tctatgctgtgtgcagagtatac

SEQ ID NO: 6465904 - DNA, 14 bp, Homo sapiens
tctatgcttcctcg

SEQ ID NO: 6465905 - DNA, 22 bp, Homo sapiens
tctatggaatagttctgtatat

SEQ ID NO: 6465906 - DNA, 21 bp, Homo sapiens
tctatggacagggctgtctct

SEQ ID NO: 6465907 - DNA, 17 bp, Homo sapiens
tctatggaccaaatgta

SEQ ID NO: 6465908 - DNA, 19 bp, Homo sapiens
tctatggagcagccggaag

SEQ ID NO: 6465909 - DNA, 14 bp, Homo sapiens
tctatggagggcag

SEQ ID NO: 6465910 - DNA, 22 bp, Homo sapiens
tctatggcagtccagccagctc

SEQ ID NO: 6465911 - DNA, 23 bp, Homo sapiens
tctatggcagtccagccagctcc

SEQ ID NO: 6465912 - DNA, 11 bp, Homo sapiens
tctatggcttt

SEQ ID NO: 6465913 - DNA, 16 bp, Homo sapiens
tctatggctttcaaag

SEQ ID NO: 6465914 - DNA, 17 bp, Homo sapiens
tctatggctttcaaagc

SEQ ID NO: 6465915 - DNA, 14 bp, Homo sapiens
tctatgggaaaaat

SEQ ID NO: 6465916 - DNA, 12 bp, Homo sapiens
tctatgggactc

SEQ ID NO: 6465917 - DNA, 19 bp, Homo sapiens
tctatgggactcaatgcac

SEQ ID NO: 6465918 - DNA, 23 bp, Homo sapiens
tctatgggactcaatgcactgac

SEQ ID NO: 6465919 - DNA, 19 bp, Homo sapiens
tctatggggagaggaactc

SEQ ID NO: 6465920 - DNA, 22 bp, Homo sapiens
tctatgggtatcaaacagctca

SEQ ID NO: 6465921 - DNA, 15 bp, Homo sapiens
tctatgggtttagtt

SEQ ID NO: 6465922 - DNA, 13 bp, Homo sapiens
tctatggtaaaga

SEQ ID NO: 6465923 - DNA, 16 bp, Homo sapiens
tctatggttatgaaag

SEQ ID NO: 6465924 - DNA, 17 bp, Homo sapiens
tctatgtaaattattgt

SEQ ID NO: 6465925 - DNA, 22 bp, Homo sapiens
tctatgtaaattattgtaaact

SEQ ID NO: 6465926 - DNA, 12 bp, Homo sapiens
tctatgtaactt

SEQ ID NO: 6465927 - DNA, 18 bp, Homo sapiens
tctatgtaacttgttgca

SEQ ID NO: 6465928 - DNA, 19 bp, Homo sapiens
tctatgtaacttgttgcag

SEQ ID NO: 6465929 - DNA, 18 bp, Homo sapiens
tctatgtaatgtaaacca

SEQ ID NO: 6465930 - DNA, 13 bp, Homo sapiens
tctatgtacagat

SEQ ID NO: 6465931 - DNA, 18 bp, Homo sapiens
tctatgtaggaaaaaaat

SEQ ID NO: 6465932 - DNA, 12 bp, Homo sapiens
tctatgtagtgg

SEQ ID NO: 6465933 - DNA, 21 bp, Homo sapiens
tctatgtagtggttttaggat

SEQ ID NO: 6465934 - DNA, 17 bp, Homo sapiens
tctatgtcaattgatat

SEQ ID NO: 6465935 - DNA, 16 bp, Homo sapiens
tctatgtccaacagag

SEQ ID NO: 6465936 - DNA, 20 bp, Homo sapiens
tctatgtcgtgttttcaagg

SEQ ID NO: 6465937 - DNA, 21 bp, Homo sapiens
tctatgtcgtgttttcaagga

SEQ ID NO: 6465938 - DNA, 16 bp, Homo sapiens
tctatgtctgccttcg

SEQ ID NO: 6465939 - DNA, 15 bp, Homo sapiens
tctatgtgtatatat

SEQ ID NO: 6465940 - DNA, 21 bp, Homo sapiens
tctatgtgttgtgtttgtagt

SEQ ID NO: 6465941 - DNA, 16 bp, Homo sapiens
tctatgtgtttctgta

SEQ ID NO: 6465942 - DNA, 14 bp, Homo sapiens
tctatgttaatatt

SEQ ID NO: 6465943 - DNA, 22 bp, Homo sapiens
tctatgttagtataagcttttc

SEQ ID NO: 6465944 - DNA, 17 bp, Homo sapiens
tgcagaggtctgtgctg

SEQ ID NO: 6465945 - DNA, 18 bp, Homo sapiens
tgcagaggtctgtgctga

SEQ ID NO: 6465946 - DNA, 16 bp, Homo sapiens
tgcagaggtgagcaga

SEQ ID NO: 6465947 - DNA, 20 bp, Homo sapiens
tgcagaggtgagcagaggag

SEQ ID NO: 6465948 - DNA, 17 bp, Homo sapiens
tgcagaggttgagagga

SEQ ID NO: 6465949 - DNA, 12 bp, Homo sapiens
tgcagaggtttc

SEQ ID NO: 6465950 - DNA, 18 bp, Homo sapiens
tgcagagtatacaagtgt

SEQ ID NO: 6465951 - DNA, 14 bp, Homo sapiens
tgcagagtatttct

SEQ ID NO: 6465952 - DNA, 14 bp, Homo sapiens
tgcagagtcagcag

SEQ ID NO: 6465953 - DNA, 17 bp, Homo sapiens
tgcagagtcagcagaac

SEQ ID NO: 6465954 - DNA, 17 bp, Homo sapiens
tgcagagtcctgcacag

SEQ ID NO: 6465955 - DNA, 17 bp, Homo sapiens
tgcagagtgcagaggcg

SEQ ID NO: 6465956 - DNA, 14 bp, Homo sapiens
tgcagagtgcccag

SEQ ID NO: 6465957 - DNA, 19 bp, Homo sapiens
tgcagagttcagggaagat

SEQ ID NO: 6465958 - DNA, 24 bp, Homo sapiens
tgcagagttcagggaagataagtt

SEQ ID NO: 6465959 - DNA, 16 bp, Homo sapiens
tgcagagttgaagttt

SEQ ID NO: 6465960 - DNA, 17 bp, Homo sapiens
tgcagagttgtgcatgc

SEQ ID NO: 6465961 - DNA, 15 bp, Homo sapiens
tgcagataaacagaa

SEQ ID NO: 6465962 - DNA, 15 bp, Homo sapiens
tgcagataaatacat

SEQ ID NO: 6465963 - DNA, 23 bp, Homo sapiens
tgcagatagtgcctctgcaaact

SEQ ID NO: 6465964 - DNA, 18 bp, Homo sapiens
tgcagatatccaaacaag

SEQ ID NO: 6465965 - DNA, 19 bp, Homo sapiens
tgcagatatccaaacaaga

SEQ ID NO: 6465966 - DNA, 15 bp, Homo sapiens
tgcagatatgttgag

SEQ ID NO: 6465967 - DNA, 13 bp, Homo sapiens
tgcagatatttga

SEQ ID NO: 6465968 - DNA, 16 bp, Homo sapiens
tgcagatcatctgggg

SEQ ID NO: 6465969 - DNA, 19 bp, Homo sapiens
tgcagatcccagcccaccc

SEQ ID NO: 6465970 - DNA, 21 bp, Homo sapiens
tgcagatcccagcccaccctg

SEQ ID NO: 6465971 - DNA, 16 bp, Homo sapiens
tgcagatctagccagg

SEQ ID NO: 6465972 - DNA, 14 bp, Homo sapiens
tgcagatctgtgct

SEQ ID NO: 6465973 - DNA, 15 bp, Homo sapiens
tgcagatctgtgctc

SEQ ID NO: 6465974 - DNA, 22 bp, Homo sapiens
tgcagatgaagtaactgaggct

SEQ ID NO: 6465975 - DNA, 22 bp, Homo sapiens
tgcagatgagcagtcacactgt

SEQ ID NO: 6465976 - DNA, 14 bp, Homo sapiens
tgcagatgccaaaa

SEQ ID NO: 6465977 - DNA, 22 bp, Homo sapiens
tgcagatggggctcccgcccgt

SEQ ID NO: 6465978 - DNA, 22 bp, Homo sapiens
tgcagatgggtgatatataatg

SEQ ID NO: 6465979 - DNA, 19 bp, Homo sapiens
tgcagatggtactgctgag

SEQ ID NO: 6465980 - DNA, 18 bp, Homo sapiens
tgcagatggtgagagata

SEQ ID NO: 6465981 - DNA, 13 bp, Homo sapiens
tgcagatgtctta

SEQ ID NO: 6465982 - DNA, 16 bp, Homo sapiens
tgcagatgtgagccac

SEQ ID NO: 6465983 - DNA, 15 bp, Homo sapiens
tgcagattacactga

SEQ ID NO: 6465984 - DNA, 22 bp, Homo sapiens
tgcagattcataggcagcatct

SEQ ID NO: 6465985 - DNA, 19 bp, Homo sapiens
tgcagattcctgggcctgt

SEQ ID NO: 6465986 - DNA, 21 bp, Homo sapiens
tgcagattcctgggcctgtcc

SEQ ID NO: 6465987 - DNA, 22 bp, Homo sapiens
tgcagattcctgggcctgtccc

SEQ ID NO: 6465988 - DNA, 23 bp, Homo sapiens
tgcagattctgagcaaaggccct

SEQ ID NO: 6465989 - DNA, 18 bp, Homo sapiens
tgcagcaaacactccacc

SEQ ID NO: 6465990 - DNA, 19 bp, Homo sapiens
tgcagcaaacactccaccc

SEQ ID NO: 6465991 - DNA, 20 bp, Homo sapiens
tgcagcaaatatatgattct

SEQ ID NO: 6465992 - DNA, 17 bp, Homo sapiens
tgcagcaacacccaagt

SEQ ID NO: 6465993 - DNA, 16 bp, Homo sapiens
tgcagcaaccagagca

SEQ ID NO: 6465994 - DNA, 22 bp, Homo sapiens
tgcagcaaccagagcactgtat

SEQ ID NO: 6465995 - DNA, 13 bp, Homo sapiens
tgcagcaactccc

SEQ ID NO: 6465996 - DNA, 16 bp, Homo sapiens
tgcagcaactcccacg

SEQ ID NO: 6465997 - DNA, 19 bp, Homo sapiens
tgcagcaaggccctgctgc

SEQ ID NO: 6465998 - DNA, 14 bp, Homo sapiens
tgcagcaataaagc

SEQ ID NO: 6465999 - DNA, 19 bp, Homo sapiens
tgcagcaatcacaaaggct

SEQ ID NO: 6466000 - DNA, 16 bp, Homo sapiens
tgcagcacaggaggct

SEQ ID NO: 6466001 - DNA, 18 bp, Homo sapiens
tgcagcacaggaggctcc

SEQ ID NO: 6466002 - DNA, 18 bp, Homo sapiens
tgcagcacatgcgggctc

SEQ ID NO: 6466003 - DNA, 13 bp, Homo sapiens
tgcagcacattga

SEQ ID NO: 6466004 - DNA, 21 bp, Homo sapiens
tgcagcacattgccctgaggg

SEQ ID NO: 6466005 - DNA, 15 bp, Homo sapiens
tgcagcacctccagg

SEQ ID NO: 6466006 - DNA, 19 bp, Homo sapiens
tgcagcacctccaggcctg

SEQ ID NO: 6466007 - DNA, 17 bp, Homo sapiens
tgcagcacggacaataa

SEQ ID NO: 6466008 - DNA, 22 bp, Homo sapiens
tgcagcacggacaataaacctc

SEQ ID NO: 6466009 - DNA, 17 bp, Homo sapiens
tgcagcactcacacagg

SEQ ID NO: 6466010 - DNA, 11 bp, Homo sapiens
tgcagcacttt

SEQ ID NO: 6466011 - DNA, 19 bp, Homo sapiens
tgcagcactttaaccctct

SEQ ID NO: 6466012 - DNA, 20 bp, Homo sapiens
tgcagcactttaaccctctc

SEQ ID NO: 6466013 - DNA, 23 bp, Homo sapiens
tgcagcactttaaccctctcttc

SEQ ID NO: 6466014 - DNA, 17 bp, Homo sapiens
tgcagcagaaaacaaac

SEQ ID NO: 6466015 - DNA, 12 bp, Homo sapiens
tgcagcagagga

SEQ ID NO: 6466016 - DNA, 14 bp, Homo sapiens
tgcagcagaggaca

SEQ ID NO: 6466017 - DNA, 15 bp, Homo sapiens
tgcagcagaggagct

SEQ ID NO: 6466018 - DNA, 20 bp, Homo sapiens
tgcagcagaggcctgaggag

SEQ ID NO: 6466019 - DNA, 21 bp, Homo sapiens
tgcagcagaggcctgaggagt

SEQ ID NO: 6466020 - DNA, 19 bp, Homo sapiens
tgcagcagataactttttt

SEQ ID NO: 6466021 - DNA, 13 bp, Homo sapiens
tgcagcagattgg

SEQ ID NO: 6466022 - DNA, 20 bp, Homo sapiens
tgcagcagcaacacaatgtt

SEQ ID NO: 6466023 - DNA, 13 bp, Homo sapiens
tgcagcagcccag

SEQ ID NO: 6466024 - DNA, 20 bp, Homo sapiens
tgcagcagcccagcttcctg

SEQ ID NO: 6466025 - DNA, 18 bp, Homo sapiens
tgcagcagcggtggcctc

SEQ ID NO: 6466026 - DNA, 12 bp, Homo sapiens
tgcagcagcttg

SEQ ID NO: 6466027 - DNA, 19 bp, Homo sapiens
tgcagcagcttgctgcacc

SEQ ID NO: 6466028 - DNA, 20 bp, Homo sapiens
tgcagcagcttgctgcaccc

SEQ ID NO: 6466029 - DNA, 20 bp, Homo sapiens
tgcagcaggaactctggacc

SEQ ID NO: 6466030 - DNA, 13 bp, Homo sapiens
tgcagcaggagtg

SEQ ID NO: 6466031 - DNA, 14 bp, Homo sapiens
tgcagcaggagtgg

SEQ ID NO: 6466032 - DNA, 20 bp, Homo sapiens
tgcagcaggagtggtgcaga

SEQ ID NO: 6466033 - DNA, 22 bp, Homo sapiens
tgcagcaggagtggtgcagaca

SEQ ID NO: 6466034 - DNA, 21 bp, Homo sapiens
tgcagcaggatctagaggggg

SEQ ID NO: 6466035 - DNA, 19 bp, Homo sapiens
tgcagcagggaaggcccaa

SEQ ID NO: 6466036 - DNA, 14 bp, Homo sapiens
tgcagcagggatgc

SEQ ID NO: 6466037 - DNA, 18 bp, Homo sapiens
tgcagcagggatgccctg

SEQ ID NO: 6466038 - DNA, 22 bp, Homo sapiens
tgcagcagggcaggaaggggaa

SEQ ID NO: 6466039 - DNA, 12 bp, Homo sapiens
tgcagcagggct

SEQ ID NO: 6466040 - DNA, 14 bp, Homo sapiens
tgcagcagggctgg

SEQ ID NO: 6466041 - DNA, 16 bp, Homo sapiens
tgcagcagggctgggc

SEQ ID NO: 6466042 - DNA, 18 bp, Homo sapiens
tgcagcagggctgggcct

SEQ ID NO: 6466043 - DNA, 22 bp, Homo sapiens
tgcagcagggctgggcctgcga

SEQ ID NO: 6466044 - DNA, 19 bp, Homo sapiens
tgcagcaggtgctgggctg

SEQ ID NO: 6466045 - DNA, 19 bp, Homo sapiens
tgcagcagtaccatcccac

SEQ ID NO: 6466046 - DNA, 21 bp, Homo sapiens
tgcagcagtaccatcccactg

SEQ ID NO: 6466047 - DNA, 22 bp, Homo sapiens
tgcagcagtaccatcccactga

SEQ ID NO: 6466048 - DNA, 12 bp, Homo sapiens
tgcagcatacca

SEQ ID NO: 6466049 - DNA, 16 bp, Homo sapiens
tgcagcatatacaata

SEQ ID NO: 6466050 - DNA, 17 bp, Homo sapiens
tgcagcatatacaataa

SEQ ID NO: 6466051 - DNA, 14 bp, Homo sapiens
tgcagcatgcccag

SEQ ID NO: 6466052 - DNA, 15 bp, Homo sapiens
tgcagcatggaggaa

SEQ ID NO: 6466053 - DNA, 16 bp, Homo sapiens
tgcagcatggtccctg

SEQ ID NO: 6466054 - DNA, 14 bp, Homo sapiens
tgcagcatttacta

SEQ ID NO: 6466055 - DNA, 16 bp, Homo sapiens
tgcagccaaacagagc

SEQ ID NO: 6466056 - DNA, 20 bp, Homo sapiens
tgcagccaaaggggagccag

SEQ ID NO: 6466057 - DNA, 23 bp, Homo sapiens
tgcagccaaggtgctaaaaggaa

SEQ ID NO: 6466058 - DNA, 14 bp, Homo sapiens
tgcagccagaggca

SEQ ID NO: 6466059 - DNA, 13 bp, Homo sapiens
tgcagccagccca

SEQ ID NO: 6466060 - DNA, 14 bp, Homo sapiens
tgcagccagcccag

SEQ ID NO: 6466061 - DNA, 19 bp, Homo sapiens
tgcagccagcccagcccag

SEQ ID NO: 6466062 - DNA, 21 bp, Homo sapiens
tgcagccagcccagcccagct

SEQ ID NO: 6466063 - DNA, 14 bp, Homo sapiens
tgcagccaggcctc

SEQ ID NO: 6466064 - DNA, 18 bp, Homo sapiens
tgcagccaggcctcgcct

SEQ ID NO: 6466065 - DNA, 22 bp, Homo sapiens
tgcagccaggcctcgcctgccc

SEQ ID NO: 6466066 - DNA, 13 bp, Homo sapiens
tgcagccagggct

SEQ ID NO: 6466067 - DNA, 15 bp, Homo sapiens
tgcagccagggctgg

SEQ ID NO: 6466068 - DNA, 16 bp, Homo sapiens
tgcagccagggctggg

SEQ ID NO: 6466069 - DNA, 15 bp, Homo sapiens
tgcagccagtcaggc

SEQ ID NO: 6466070 - DNA, 23 bp, Homo sapiens
tgcagccatcccgcttagcctgc

SEQ ID NO: 6466071 - DNA, 13 bp, Homo sapiens
tgcagcccaaaac

SEQ ID NO: 6466072 - DNA, 14 bp, Homo sapiens
tgcagcccaaggac

SEQ ID NO: 6466073 - DNA, 16 bp, Homo sapiens
tgcagcccaaggacag

SEQ ID NO: 6466074 - DNA, 12 bp, Homo sapiens
tgcagcccacag

SEQ ID NO: 6466075 - DNA, 17 bp, Homo sapiens
tgcagcccacagaggac

SEQ ID NO: 6466076 - DNA, 18 bp, Homo sapiens
tgcagcccacagaggaca

SEQ ID NO: 6466077 - DNA, 16 bp, Homo sapiens
tgcagcccaccagacg

SEQ ID NO: 6466078 - DNA, 18 bp, Homo sapiens
tgcagcccaccaggagca

SEQ ID NO: 6466079 - DNA, 23 bp, Homo sapiens
tgcagcccagaacgggcctcccc

SEQ ID NO: 6466080 - DNA, 23 bp, Homo sapiens
tgcagcccagagaccttcaaatg

SEQ ID NO: 6466081 - DNA, 13 bp, Homo sapiens
tgcagcccaggcc

SEQ ID NO: 6466082 - DNA, 14 bp, Homo sapiens
tgcagcccatgccc

SEQ ID NO: 6466083 - DNA, 14 bp, Homo sapiens
tgcagcccatttct

SEQ ID NO: 6466084 - DNA, 18 bp, Homo sapiens
tgcagcccatttctccag

SEQ ID NO: 6466085 - DNA, 20 bp, Homo sapiens
tgcagcccatttctccagaa

SEQ ID NO: 6466086 - DNA, 12 bp, Homo sapiens
tgcagccccagg

SEQ ID NO: 6466087 - DNA, 15 bp, Homo sapiens
tgcagccccaggcct

SEQ ID NO: 6466088 - DNA, 17 bp, Homo sapiens
tgcagcccccactgcct

SEQ ID NO: 6466089 - DNA, 23 bp, Homo sapiens
tgcagcccccactgcctttgacc

SEQ ID NO: 6466090 - DNA, 15 bp, Homo sapiens
tgcagccccctgctt

SEQ ID NO: 6466091 - DNA, 21 bp, Homo sapiens
tgcagccccgcctccaggcca

SEQ ID NO: 6466092 - DNA, 18 bp, Homo sapiens
tgcagcccctaagtgcaa

SEQ ID NO: 6466093 - DNA, 12 bp, Homo sapiens
tgcagcccctcc

SEQ ID NO: 6466094 - DNA, 17 bp, Homo sapiens
tgcagcccctgggccct

SEQ ID NO: 6466095 - DNA, 18 bp, Homo sapiens
tgcagcccgatgtccctg

SEQ ID NO: 6466096 - DNA, 14 bp, Homo sapiens
tgcagccctctcca

SEQ ID NO: 6466097 - DNA, 22 bp, Homo sapiens
tgcagccctctccaccctccgg

SEQ ID NO: 6466098 - DNA, 16 bp, Homo sapiens
tgcagccctgagaaag

SEQ ID NO: 6466099 - DNA, 21 bp, Homo sapiens
tgcagccctgagaaagccctg

SEQ ID NO: 6466100 - DNA, 14 bp, Homo sapiens
tgcagccctgctgc

SEQ ID NO: 6466101 - DNA, 13 bp, Homo sapiens
tgcagccctggcc

SEQ ID NO: 6466102 - DNA, 12 bp, Homo sapiens
tgcagcccttcc

SEQ ID NO: 6466103 - DNA, 22 bp, Homo sapiens
tgcagcccttcctcctgaagcc

SEQ ID NO: 6466104 - DNA, 14 bp, Homo sapiens
tgcagcccttgggc

SEQ ID NO: 6466105 - DNA, 15 bp, Homo sapiens
tgcagccgcagagaa

SEQ ID NO: 6466106 - DNA, 17 bp, Homo sapiens
tgcagccgcagagaaat

SEQ ID NO: 6466107 - DNA, 17 bp, Homo sapiens
tgcagccgccttccttg

SEQ ID NO: 6466108 - DNA, 16 bp, Homo sapiens
tgcagccggaggagga

SEQ ID NO: 6466109 - DNA, 19 bp, Homo sapiens
tgcagccggcacagggtct

SEQ ID NO: 6466110 - DNA, 16 bp, Homo sapiens
tgcagccggggagctg

SEQ ID NO: 6466111 - DNA, 18 bp, Homo sapiens
tgcagccgtgcaggactc

SEQ ID NO: 6466112 - DNA, 16 bp, Homo sapiens
tgcagccgtggtccaa

SEQ ID NO: 6466113 - DNA, 23 bp, Homo sapiens
tgcagcctagtaggagctgagct

SEQ ID NO: 6466114 - DNA, 20 bp, Homo sapiens
tgcagcctcagagacatcag

SEQ ID NO: 6466115 - DNA, 13 bp, Homo sapiens
tgcagcctcagga

SEQ ID NO: 6466116 - DNA, 16 bp, Homo sapiens
tgcagcctcaggactg

SEQ ID NO: 6466117 - DNA, 18 bp, Homo sapiens
tgcagcctcaggactggg

SEQ ID NO: 6466118 - DNA, 20 bp, Homo sapiens
tgcagcctcatactcctggg

SEQ ID NO: 6466119 - DNA, 22 bp, Homo sapiens
tgcagcctcatactcctgggct

SEQ ID NO: 6466120 - DNA, 12 bp, Homo sapiens
tgcagcctccac

SEQ ID NO: 6466121 - DNA, 13 bp, Homo sapiens
tgcagcctccccc

SEQ ID NO: 6466122 - DNA, 21 bp, Homo sapiens
tgcagcctccgcctcccgggt

SEQ ID NO: 6466123 - DNA, 15 bp, Homo sapiens
tctatgttcaaagac

SEQ ID NO: 6466124 - DNA, 21 bp, Homo sapiens
tctatgttcaaagactgtgaa

SEQ ID NO: 6466125 - DNA, 12 bp, Homo sapiens
tctatgttcata

SEQ ID NO: 6466126 - DNA, 20 bp, Homo sapiens
tctatgttgcatgataaaca

SEQ ID NO: 6466127 - DNA, 12 bp, Homo sapiens
tctatgttgcta

SEQ ID NO: 6466128 - DNA, 12 bp, Homo sapiens
tctatgttggtt

SEQ ID NO: 6466129 - DNA, 15 bp, Homo sapiens
tctatgttggtttca

SEQ ID NO: 6466130 - DNA, 15 bp, Homo sapiens
tctatgtttgtgtga

SEQ ID NO: 6466131 - DNA, 18 bp, Homo sapiens
tctatgtttgtgtgattt

SEQ ID NO: 6466132 - DNA, 11 bp, Homo sapiens
tctattaaaag

SEQ ID NO: 6466133 - DNA, 16 bp, Homo sapiens
tctattaaaagactca

SEQ ID NO: 6466134 - DNA, 17 bp, Homo sapiens
tctattaaaagactcat

SEQ ID NO: 6466135 - DNA, 19 bp, Homo sapiens
tctattaaaagactcatcc

SEQ ID NO: 6466136 - DNA, 20 bp, Homo sapiens
tctattaaaagactcatccg

SEQ ID NO: 6466137 - DNA, 22 bp, Homo sapiens
tctattaaaagactcatccgtc

SEQ ID NO: 6466138 - DNA, 15 bp, Homo sapiens
tctattaaaattctg

SEQ ID NO: 6466139 - DNA, 21 bp, Homo sapiens
tctattaaaattctgatgttt

SEQ ID NO: 6466140 - DNA, 17 bp, Homo sapiens
tctattaaaattgccat

SEQ ID NO: 6466141 - DNA, 19 bp, Homo sapiens
tctattaaaattgccattt

SEQ ID NO: 6466142 - DNA, 21 bp, Homo sapiens
tctattaaaattgccatttta

SEQ ID NO: 6466143 - DNA, 15 bp, Homo sapiens
tctattaaagtgact

SEQ ID NO: 6466144 - DNA, 20 bp, Homo sapiens
tctattaagccattgaaaga

SEQ ID NO: 6466145 - DNA, 12 bp, Homo sapiens
tctattaatata

SEQ ID NO: 6466146 - DNA, 16 bp, Homo sapiens
tctattaatatatgta

SEQ ID NO: 6466147 - DNA, 21 bp, Homo sapiens
tctattaatatatgtattatt

SEQ ID NO: 6466148 - DNA, 22 bp, Homo sapiens
tctattaatatatgtattattt

SEQ ID NO: 6466149 - DNA, 19 bp, Homo sapiens
tctattaatatttatgtgt

SEQ ID NO: 6466150 - DNA, 14 bp, Homo sapiens
tctattaattactg

SEQ ID NO: 6466151 - DNA, 17 bp, Homo sapiens
tctattaattactgtgt

SEQ ID NO: 6466152 - DNA, 21 bp, Homo sapiens
tctattaccactgaagataga

SEQ ID NO: 6466153 - DNA, 21 bp, Homo sapiens
tctattacttttgcaaactgt

SEQ ID NO: 6466154 - DNA, 14 bp, Homo sapiens
tctattagacttta

SEQ ID NO: 6466155 - DNA, 18 bp, Homo sapiens
tctattagcttactgatt

SEQ ID NO: 6466156 - DNA, 14 bp, Homo sapiens
tctattatactgta

SEQ ID NO: 6466157 - DNA, 19 bp, Homo sapiens
tctattatactgtattaag

SEQ ID NO: 6466158 - DNA, 16 bp, Homo sapiens
tctattatctgggttt

SEQ ID NO: 6466159 - DNA, 20 bp, Homo sapiens
tctattatctgggttttaga

SEQ ID NO: 6466160 - DNA, 23 bp, Homo sapiens
tctattatgaatgtgaagccttc

SEQ ID NO: 6466161 - DNA, 17 bp, Homo sapiens
tctattatggaaaactg

SEQ ID NO: 6466162 - DNA, 20 bp, Homo sapiens
tctattatggaaaactgtgt

SEQ ID NO: 6466163 - DNA, 20 bp, Homo sapiens
tctattatgttatcatcctc

SEQ ID NO: 6466164 - DNA, 12 bp, Homo sapiens
tctattattatg

SEQ ID NO: 6466165 - DNA, 15 bp, Homo sapiens
tctattattgaaata

SEQ ID NO: 6466166 - DNA, 14 bp, Homo sapiens
tctattatttggag

SEQ ID NO: 6466167 - DNA, 23 bp, Homo sapiens
tctattatttggagcctgccaag

SEQ ID NO: 6466168 - DNA, 13 bp, Homo sapiens
tctattcaaaagg

SEQ ID NO: 6466169 - DNA, 16 bp, Homo sapiens
tctattcaaaaggaaa

SEQ ID NO: 6466170 - DNA, 16 bp, Homo sapiens
tctattcagacaagca

SEQ ID NO: 6466171 - DNA, 12 bp, Homo sapiens
tctattcagctt

SEQ ID NO: 6466172 - DNA, 18 bp, Homo sapiens
tctattcataataaacta

SEQ ID NO: 6466173 - DNA, 15 bp, Homo sapiens
tctattcattatgca

SEQ ID NO: 6466174 - DNA, 12 bp, Homo sapiens
tctattccagct

SEQ ID NO: 6466175 - DNA, 13 bp, Homo sapiens
tctattccagctc

SEQ ID NO: 6466176 - DNA, 14 bp, Homo sapiens
tctattccagctca

SEQ ID NO: 6466177 - DNA, 17 bp, Homo sapiens
tctattccctaacttgt

SEQ ID NO: 6466178 - DNA, 18 bp, Homo sapiens
tctattccttctggcctt

SEQ ID NO: 6466179 - DNA, 18 bp, Homo sapiens
tctattcgccacacagta

SEQ ID NO: 6466180 - DNA, 23 bp, Homo sapiens
tctattctcaaagttaaaagtaa

SEQ ID NO: 6466181 - DNA, 19 bp, Homo sapiens
tctattctctaaactggca

SEQ ID NO: 6466182 - DNA, 13 bp, Homo sapiens
tctattctctgcc

SEQ ID NO: 6466183 - DNA, 15 bp, Homo sapiens
tctattctctgcctt

SEQ ID NO: 6466184 - DNA, 16 bp, Homo sapiens
tctattctgagccttg

SEQ ID NO: 6466185 - DNA, 18 bp, Homo sapiens
tctattcttgggaaacac

SEQ ID NO: 6466186 - DNA, 11 bp, Homo sapiens
tctattctttc

SEQ ID NO: 6466187 - DNA, 13 bp, Homo sapiens
tctattgaataat

SEQ ID NO: 6466188 - DNA, 21 bp, Homo sapiens
tctattgataatttagacatt

SEQ ID NO: 6466189 - DNA, 16 bp, Homo sapiens
tctattgatacaatat

SEQ ID NO: 6466190 - DNA, 15 bp, Homo sapiens
tctattgatttgaaa

SEQ ID NO: 6466191 - DNA, 23 bp, Homo sapiens
tctattgcagttatagaaaatct

SEQ ID NO: 6466192 - DNA, 21 bp, Homo sapiens
tctattgcctctgagagcatc

SEQ ID NO: 6466193 - DNA, 13 bp, Homo sapiens
tctattgccttct

SEQ ID NO: 6466194 - DNA, 15 bp, Homo sapiens
tctattgcttggact

SEQ ID NO: 6466195 - DNA, 22 bp, Homo sapiens
tctattgggttcattattggaa

SEQ ID NO: 6466196 - DNA, 12 bp, Homo sapiens
tctattggtctc

SEQ ID NO: 6466197 - DNA, 19 bp, Homo sapiens
tctattgtaagataaaaaa

SEQ ID NO: 6466198 - DNA, 16 bp, Homo sapiens
tctattgtattatttg

SEQ ID NO: 6466199 - DNA, 21 bp, Homo sapiens
tctattgtcgctatgtgactt

SEQ ID NO: 6466200 - DNA, 14 bp, Homo sapiens
tctattgtgcctat

SEQ ID NO: 6466201 - DNA, 21 bp, Homo sapiens
tctattgtgtggatgaccaca

SEQ ID NO: 6466202 - DNA, 12 bp, Homo sapiens
tctattgttact

SEQ ID NO: 6466203 - DNA, 16 bp, Homo sapiens
tctattgttactctgg

SEQ ID NO: 6466204 - DNA, 23 bp, Homo sapiens
tctattgttgtacacagaaatac

SEQ ID NO: 6466205 - DNA, 16 bp, Homo sapiens
tctattgtttctttca

SEQ ID NO: 6466206 - DNA, 20 bp, Homo sapiens
tctatttaaaaaataaaaaa

SEQ ID NO: 6466207 - DNA, 15 bp, Homo sapiens
tctatttaaaaaatg

SEQ ID NO: 6466208 - DNA, 15 bp, Homo sapiens
tctatttaagtaaaa

SEQ ID NO: 6466209 - DNA, 14 bp, Homo sapiens
tctatttaagtgta

SEQ ID NO: 6466210 - DNA, 14 bp, Homo sapiens
tctatttacctcct

SEQ ID NO: 6466211 - DNA, 13 bp, Homo sapiens
tctatttagcatg

SEQ ID NO: 6466212 - DNA, 22 bp, Homo sapiens
tctatttagccagcgtttattg

SEQ ID NO: 6466213 - DNA, 12 bp, Homo sapiens
tctatttagtta

SEQ ID NO: 6466214 - DNA, 21 bp, Homo sapiens
tctatttagttatttaagaag

SEQ ID NO: 6466215 - DNA, 15 bp, Homo sapiens
tctatttatcttcat

SEQ ID NO: 6466216 - DNA, 22 bp, Homo sapiens
tctatttatgagatcactgaac

SEQ ID NO: 6466217 - DNA, 14 bp, Homo sapiens
tctatttatttatt

SEQ ID NO: 6466218 - DNA, 16 bp, Homo sapiens
tctatttcataccatg

SEQ ID NO: 6466219 - DNA, 16 bp, Homo sapiens
tctatttcatgttttt

SEQ ID NO: 6466220 - DNA, 20 bp, Homo sapiens
tctatttccactgaacaaaa

SEQ ID NO: 6466221 - DNA, 18 bp, Homo sapiens
tctatttccccctttctt

SEQ ID NO: 6466222 - DNA, 21 bp, Homo sapiens
tctatttccccctttcttcct

SEQ ID NO: 6466223 - DNA, 17 bp, Homo sapiens
tctatttctatgagaaa

SEQ ID NO: 6466224 - DNA, 13 bp, Homo sapiens
tctatttctctat

SEQ ID NO: 6466225 - DNA, 14 bp, Homo sapiens
tctatttctgaaag

SEQ ID NO: 6466226 - DNA, 20 bp, Homo sapiens
tctatttctgagaaggtcct

SEQ ID NO: 6466227 - DNA, 21 bp, Homo sapiens
tctatttctggatgaatgccc

SEQ ID NO: 6466228 - DNA, 20 bp, Homo sapiens
tctatttcttcttcacatcc

SEQ ID NO: 6466229 - DNA, 20 bp, Homo sapiens
tctatttcttttttaagtca

SEQ ID NO: 6466230 - DNA, 18 bp, Homo sapiens
tctatttgacttgtggtt

SEQ ID NO: 6466231 - DNA, 17 bp, Homo sapiens
tctatttgagaagttct

SEQ ID NO: 6466232 - DNA, 12 bp, Homo sapiens
tctatttgctat

SEQ ID NO: 6466233 - DNA, 12 bp, Homo sapiens
tctatttggaat

SEQ ID NO: 6466234 - DNA, 13 bp, Homo sapiens
tctatttggaatt

SEQ ID NO: 6466235 - DNA, 16 bp, Homo sapiens
tctatttggaatttat

SEQ ID NO: 6466236 - DNA, 13 bp, Homo sapiens
tctatttggggct

SEQ ID NO: 6466237 - DNA, 13 bp, Homo sapiens
tctatttgtacaa

SEQ ID NO: 6466238 - DNA, 18 bp, Homo sapiens
tctatttgtctcttacat

SEQ ID NO: 6466239 - DNA, 20 bp, Homo sapiens
tctattttaataaaaataat

SEQ ID NO: 6466240 - DNA, 15 bp, Homo sapiens
tctattttaattact

SEQ ID NO: 6466241 - DNA, 23 bp, Homo sapiens
tctattttaccactaattttgtt

SEQ ID NO: 6466242 - DNA, 13 bp, Homo sapiens
tctattttacttt

SEQ ID NO: 6466243 - DNA, 20 bp, Homo sapiens
tctattttactttgtacttg

SEQ ID NO: 6466244 - DNA, 23 bp, Homo sapiens
tctattttacttttctgccaaaa

SEQ ID NO: 6466245 - DNA, 13 bp, Homo sapiens
tctattttattat

SEQ ID NO: 6466246 - DNA, 16 bp, Homo sapiens
tctattttcataatca

SEQ ID NO: 6466247 - DNA, 19 bp, Homo sapiens
tctattttctcagaatcta

SEQ ID NO: 6466248 - DNA, 21 bp, Homo sapiens
tctattttgatgcagcatttg

SEQ ID NO: 6466249 - DNA, 14 bp, Homo sapiens
tctattttgatttt

SEQ ID NO: 6466250 - DNA, 15 bp, Homo sapiens
tctattttgcagcag

SEQ ID NO: 6466251 - DNA, 12 bp, Homo sapiens
tctattttgctg

SEQ ID NO: 6466252 - DNA, 17 bp, Homo sapiens
tctattttgtaaactca

SEQ ID NO: 6466253 - DNA, 15 bp, Homo sapiens
tctattttgtaactg

SEQ ID NO: 6466254 - DNA, 19 bp, Homo sapiens
tctattttgtaactgtaaa

SEQ ID NO: 6466255 - DNA, 12 bp, Homo sapiens
tctattttgtga

SEQ ID NO: 6466256 - DNA, 16 bp, Homo sapiens
tctattttgtttttta

SEQ ID NO: 6466257 - DNA, 17 bp, Homo sapiens
tctatttttacatttaa

SEQ ID NO: 6466258 - DNA, 20 bp, Homo sapiens
tctatttttatcatgaattc

SEQ ID NO: 6466259 - DNA, 19 bp, Homo sapiens
tctatttttatgatgacaa

SEQ ID NO: 6466260 - DNA, 17 bp, Homo sapiens
tctatttttcaatcatc

SEQ ID NO: 6466261 - DNA, 16 bp, Homo sapiens
tctatttttcttctaa

SEQ ID NO: 6466262 - DNA, 18 bp, Homo sapiens
tctatttttgtaaaaagg

SEQ ID NO: 6466263 - DNA, 15 bp, Homo sapiens
tctatttttgtcctt

SEQ ID NO: 6466264 - DNA, 13 bp, Homo sapiens
tctatttttgtct

SEQ ID NO: 6466265 - DNA, 17 bp, Homo sapiens
tctattttttaaagact

SEQ ID NO: 6466266 - DNA, 21 bp, Homo sapiens
tctattttttacttgttttcg

SEQ ID NO: 6466267 - DNA, 18 bp, Homo sapiens
tctattttttctctcctt

SEQ ID NO: 6466268 - DNA, 14 bp, Homo sapiens
tctattttttgtat

SEQ ID NO: 6466269 - DNA, 15 bp, Homo sapiens
tctattttttgtata

SEQ ID NO: 6466270 - DNA, 16 bp, Homo sapiens
tctatttttttaactg

SEQ ID NO: 6466271 - DNA, 18 bp, Homo sapiens
tctatttttttaactgaa

SEQ ID NO: 6466272 - DNA, 20 bp, Homo sapiens
tctcaaaaaaaaaaaaaaca

SEQ ID NO: 6466273 - DNA, 21 bp, Homo sapiens
tctcaaaaaaaaaaaaaacaa

SEQ ID NO: 6466274 - DNA, 22 bp, Homo sapiens
tctcaaaaaaaaaaaaatgcac

SEQ ID NO: 6466275 - DNA, 20 bp, Homo sapiens
tctcaaaaaaaagaaaatgt

SEQ ID NO: 6466276 - DNA, 15 bp, Homo sapiens
tctcaaaaatacaaa

SEQ ID NO: 6466277 - DNA, 16 bp, Homo sapiens
tctcaaaaattctcct

SEQ ID NO: 6466278 - DNA, 13 bp, Homo sapiens
tctcaaaacaaaa

SEQ ID NO: 6466279 - DNA, 15 bp, Homo sapiens
tctcaaaacaaaaca

SEQ ID NO: 6466280 - DNA, 23 bp, Homo sapiens
tctcaaaacaatattactttgtc

SEQ ID NO: 6466281 - DNA, 16 bp, Homo sapiens
tctcaaaacagagggc

SEQ ID NO: 6466282 - DNA, 18 bp, Homo sapiens
tctcaaaacagagggctg

SEQ ID NO: 6466283 - DNA, 15 bp, Homo sapiens
tctcaaaactgtact

SEQ ID NO: 6466284 - DNA, 20 bp, Homo sapiens
tctcaaaagaggttacttta

SEQ ID NO: 6466285 - DNA, 18 bp, Homo sapiens
tctcaaaagtctattttt

SEQ ID NO: 6466286 - DNA, 18 bp, Homo sapiens
tctcaaaataaaaccaga

SEQ ID NO: 6466287 - DNA, 17 bp, Homo sapiens
tctcaaaataaagcaat

SEQ ID NO: 6466288 - DNA, 14 bp, Homo sapiens
tctcaaaatgtgcc

SEQ ID NO: 6466289 - DNA, 18 bp, Homo sapiens
tctcaaaatgtgccgtct

SEQ ID NO: 6466290 - DNA, 17 bp, Homo sapiens
tctcaaacactgcttaa

SEQ ID NO: 6466291 - DNA, 20 bp, Homo sapiens
tctcaaacactgcttaagga

SEQ ID NO: 6466292 - DNA, 19 bp, Homo sapiens
tctcaaactaaaagacatt

SEQ ID NO: 6466293 - DNA, 15 bp, Homo sapiens
tctcaaactaacagg

SEQ ID NO: 6466294 - DNA, 23 bp, Homo sapiens
tctcaaactcccgacctcaggtg

SEQ ID NO: 6466295 - DNA, 14 bp, Homo sapiens
tctcaaactcctga

SEQ ID NO: 6466296 - DNA, 15 bp, Homo sapiens
tctcaaactcctgac

SEQ ID NO: 6466297 - DNA, 16 bp, Homo sapiens
tctcaaactcctgacc

SEQ ID NO: 6466298 - DNA, 23 bp, Homo sapiens
tctcaaactcctgacctcaggca

SEQ ID NO: 6466299 - DNA, 12 bp, Homo sapiens
tctcaaactctt

SEQ ID NO: 6466300 - DNA, 13 bp, Homo sapiens
tctcaaactcttg

SEQ ID NO: 6466301 - DNA, 21 bp, Homo sapiens
tctcaaactcttgacctcagg

SEQ ID NO: 6466302 - DNA, 15 bp, Homo sapiens
tctcaaacttgtggc

SEQ ID NO: 6466303 - DNA, 22 bp, Homo sapiens
tctcaaagaaatttccactcag

SEQ ID NO: 6466304 - DNA, 18 bp, Homo sapiens
tgcagcctccgcttccct

SEQ ID NO: 6466305 - DNA, 20 bp, Homo sapiens
tgcagcctccgcttccctgg

SEQ ID NO: 6466306 - DNA, 15 bp, Homo sapiens
tgcagcctccggggt

SEQ ID NO: 6466307 - DNA, 14 bp, Homo sapiens
tgcagcctcctcct

SEQ ID NO: 6466308 - DNA, 15 bp, Homo sapiens
tgcagcctcctcctg

SEQ ID NO: 6466309 - DNA, 19 bp, Homo sapiens
tgcagcctcgaactcctgg

SEQ ID NO: 6466310 - DNA, 20 bp, Homo sapiens
tgcagcctcgaactcctggg

SEQ ID NO: 6466311 - DNA, 23 bp, Homo sapiens
tgcagcctcgacctccctggctt

SEQ ID NO: 6466312 - DNA, 16 bp, Homo sapiens
tgcagcctctctggct

SEQ ID NO: 6466313 - DNA, 17 bp, Homo sapiens
tgcagcctctctggctg

SEQ ID NO: 6466314 - DNA, 22 bp, Homo sapiens
tgcagcctctctggctggtctt

SEQ ID NO: 6466315 - DNA, 16 bp, Homo sapiens
tgcagcctctgcctcc

SEQ ID NO: 6466316 - DNA, 18 bp, Homo sapiens
tgcagcctctgcctccca

SEQ ID NO: 6466317 - DNA, 19 bp, Homo sapiens
tgcagcctctgcctcccag

SEQ ID NO: 6466318 - DNA, 11 bp, Homo sapiens
tgcagcctgct

SEQ ID NO: 6466319 - DNA, 16 bp, Homo sapiens
tgcagcctgctggggc

SEQ ID NO: 6466320 - DNA, 10 bp, Homo sapiens
tgcagcctgg

SEQ ID NO: 6466321 - DNA, 14 bp, Homo sapiens
tgcagcctggaggc

SEQ ID NO: 6466322 - DNA, 15 bp, Homo sapiens
tgcagcctggctggt

SEQ ID NO: 6466323 - DNA, 19 bp, Homo sapiens
tgcagcctggctggtcctc

SEQ ID NO: 6466324 - DNA, 11 bp, Homo sapiens
tgcagcctggg

SEQ ID NO: 6466325 - DNA, 19 bp, Homo sapiens
tgcagcctgggtctggatg

SEQ ID NO: 6466326 - DNA, 21 bp, Homo sapiens
tgcagcctgggtctggatggg

SEQ ID NO: 6466327 - DNA, 14 bp, Homo sapiens
tgcagcctgtggct

SEQ ID NO: 6466328 - DNA, 19 bp, Homo sapiens
tgcagccttcatcagaact

SEQ ID NO: 6466329 - DNA, 12 bp, Homo sapiens
tgcagccttccc

SEQ ID NO: 6466330 - DNA, 16 bp, Homo sapiens
tgcagccttcccctcc

SEQ ID NO: 6466331 - DNA, 15 bp, Homo sapiens
tgcagccttctccat

SEQ ID NO: 6466332 - DNA, 23 bp, Homo sapiens
tgcagccttgaactcctggcctc

SEQ ID NO: 6466333 - DNA, 21 bp, Homo sapiens
tgcagccttgaactctgggct

SEQ ID NO: 6466334 - DNA, 17 bp, Homo sapiens
tgcagcctttcacagga

SEQ ID NO: 6466335 - DNA, 13 bp, Homo sapiens
tgcagccttttct

SEQ ID NO: 6466336 - DNA, 19 bp, Homo sapiens
tgcagcgaaccaatatttg

SEQ ID NO: 6466337 - DNA, 16 bp, Homo sapiens
tgcagcgacccttggt

SEQ ID NO: 6466338 - DNA, 17 bp, Homo sapiens
tgcagcgactggcatac

SEQ ID NO: 6466339 - DNA, 18 bp, Homo sapiens
tgcagcgactgtttcagg

SEQ ID NO: 6466340 - DNA, 14 bp, Homo sapiens
tgcagcgagctgag

SEQ ID NO: 6466341 - DNA, 19 bp, Homo sapiens
tgcagcgagctgagatcac

SEQ ID NO: 6466342 - DNA, 15 bp, Homo sapiens
tgcagcgaggtccac

SEQ ID NO: 6466343 - DNA, 23 bp, Homo sapiens
tgcagcgcccggtgctctgtgtc

SEQ ID NO: 6466344 - DNA, 14 bp, Homo sapiens
tgcagcgcctccct

SEQ ID NO: 6466345 - DNA, 16 bp, Homo sapiens
tgcagcgcctcctgga

SEQ ID NO: 6466346 - DNA, 18 bp, Homo sapiens
tgcagcgcctcctggaca

SEQ ID NO: 6466347 - DNA, 21 bp, Homo sapiens
tgcagcggaagggactctggg

SEQ ID NO: 6466348 - DNA, 15 bp, Homo sapiens
tgcagcggcagagca

SEQ ID NO: 6466349 - DNA, 17 bp, Homo sapiens
tgcagcggcgtgaggcc

SEQ ID NO: 6466350 - DNA, 16 bp, Homo sapiens
tgcagcggctgccctc

SEQ ID NO: 6466351 - DNA, 19 bp, Homo sapiens
tgcagcggtggaaggagcc

SEQ ID NO: 6466352 - DNA, 22 bp, Homo sapiens
tgcagcggtggaaggagcctgc

SEQ ID NO: 6466353 - DNA, 22 bp, Homo sapiens
tgcagcggtgtggaccgaggaa

SEQ ID NO: 6466354 - DNA, 13 bp, Homo sapiens
tgcagcgtctttt

SEQ ID NO: 6466355 - DNA, 16 bp, Homo sapiens
tgcagctaacatgagt

SEQ ID NO: 6466356 - DNA, 21 bp, Homo sapiens
tgcagctaatttgtgaaagtg

SEQ ID NO: 6466357 - DNA, 20 bp, Homo sapiens
tgcagctcaagagatcccaa

SEQ ID NO: 6466358 - DNA, 22 bp, Homo sapiens
tgcagctcaaggaaaggcctga

SEQ ID NO: 6466359 - DNA, 20 bp, Homo sapiens
tgcagctcaagggctggcac

SEQ ID NO: 6466360 - DNA, 16 bp, Homo sapiens
tgcagctcactaccct

SEQ ID NO: 6466361 - DNA, 15 bp, Homo sapiens
tgcagctcagaacca

SEQ ID NO: 6466362 - DNA, 19 bp, Homo sapiens
tgcagctccctggcttctg

SEQ ID NO: 6466363 - DNA, 13 bp, Homo sapiens
tgcagctcctcag

SEQ ID NO: 6466364 - DNA, 14 bp, Homo sapiens
tgcagctcctcagc

SEQ ID NO: 6466365 - DNA, 20 bp, Homo sapiens
tgcagctctccccttctctg

SEQ ID NO: 6466366 - DNA, 22 bp, Homo sapiens
tgcagctctccccttctctgta

SEQ ID NO: 6466367 - DNA, 13 bp, Homo sapiens
tgcagctctcttt

SEQ ID NO: 6466368 - DNA, 15 bp, Homo sapiens
tgcagctcttcctgg

SEQ ID NO: 6466369 - DNA, 20 bp, Homo sapiens
tgcagctctttcttctttga

SEQ ID NO: 6466370 - DNA, 12 bp, Homo sapiens
tgcagctgaccg

SEQ ID NO: 6466371 - DNA, 19 bp, Homo sapiens
tgcagctgcccagcccctc

SEQ ID NO: 6466372 - DNA, 15 bp, Homo sapiens
tgcagctgcctgggg

SEQ ID NO: 6466373 - DNA, 17 bp, Homo sapiens
tgcagctgcctggggcc

SEQ ID NO: 6466374 - DNA, 18 bp, Homo sapiens
tgcagctgcctggggccc

SEQ ID NO: 6466375 - DNA, 21 bp, Homo sapiens
tgcagctgcctggggcccaag

SEQ ID NO: 6466376 - DNA, 15 bp, Homo sapiens
tgcagctgctcccca

SEQ ID NO: 6466377 - DNA, 20 bp, Homo sapiens
tgcagctgctgaagttctga

SEQ ID NO: 6466378 - DNA, 14 bp, Homo sapiens
tgcagctggacaga

SEQ ID NO: 6466379 - DNA, 18 bp, Homo sapiens
tgcagctggacagagggg

SEQ ID NO: 6466380 - DNA, 14 bp, Homo sapiens
tgcagctgggcccc

SEQ ID NO: 6466381 - DNA, 24 bp, Homo sapiens
tgcagctgggccccatgctctgcc

SEQ ID NO: 6466382 - DNA, 13 bp, Homo sapiens
tgcagctgggtgg

SEQ ID NO: 6466383 - DNA, 13 bp, Homo sapiens
tgcagctgtgaga

SEQ ID NO: 6466384 - DNA, 13 bp, Homo sapiens
tgcagctgtgagt

SEQ ID NO: 6466385 - DNA, 17 bp, Homo sapiens
tgcagctgttgagaaaa

SEQ ID NO: 6466386 - DNA, 21 bp, Homo sapiens
tgcagctgtttgttgccccat

SEQ ID NO: 6466387 - DNA, 18 bp, Homo sapiens
tgcagctgttttcaaagc

SEQ ID NO: 6466388 - DNA, 23 bp, Homo sapiens
tgcagctgttttgttgacattct

SEQ ID NO: 6466389 - DNA, 20 bp, Homo sapiens
tgcagcttcaacttttctct

SEQ ID NO: 6466390 - DNA, 20 bp, Homo sapiens
tgcagcttcacccaccaggc

SEQ ID NO: 6466391 - DNA, 21 bp, Homo sapiens
tgcagcttcacccaccaggcc

SEQ ID NO: 6466392 - DNA, 14 bp, Homo sapiens
tgcagcttcaggtg

SEQ ID NO: 6466393 - DNA, 20 bp, Homo sapiens
tgcagcttcatcaattttta

SEQ ID NO: 6466394 - DNA, 21 bp, Homo sapiens
tgcagcttcctcttctaccat

SEQ ID NO: 6466395 - DNA, 17 bp, Homo sapiens
tgcagcttccttccaag

SEQ ID NO: 6466396 - DNA, 18 bp, Homo sapiens
tgcagcttcgaggacagg

SEQ ID NO: 6466397 - DNA, 20 bp, Homo sapiens
tgcagcttcggggcaagtga

SEQ ID NO: 6466398 - DNA, 22 bp, Homo sapiens
tgcagcttcggggcaagtgaga

SEQ ID NO: 6466399 - DNA, 14 bp, Homo sapiens
tgcagcttgagttt

SEQ ID NO: 6466400 - DNA, 13 bp, Homo sapiens
tgcagcttgcagt

SEQ ID NO: 6466401 - DNA, 22 bp, Homo sapiens
tgcagcttgtccttgctcctgg

SEQ ID NO: 6466402 - DNA, 24 bp, Homo sapiens
tgcagcttgtccttgctcctggaa

SEQ ID NO: 6466403 - DNA, 13 bp, Homo sapiens
tgcagcttgtgct

SEQ ID NO: 6466404 - DNA, 22 bp, Homo sapiens
tgcagctttaaaaaattaatct

SEQ ID NO: 6466405 - DNA, 15 bp, Homo sapiens
tgcagctttacatgc

SEQ ID NO: 6466406 - DNA, 15 bp, Homo sapiens
tgcagctttatgttc

SEQ ID NO: 6466407 - DNA, 22 bp, Homo sapiens
tgcagctttatgttcatttgtt

SEQ ID NO: 6466408 - DNA, 14 bp, Homo sapiens
tgcagctttgcaaa

SEQ ID NO: 6466409 - DNA, 19 bp, Homo sapiens
tgcagctttggctgcacgt

SEQ ID NO: 6466410 - DNA, 14 bp, Homo sapiens
tgcagcttttggtc

SEQ ID NO: 6466411 - DNA, 19 bp, Homo sapiens
tgcagcttttggttaatat

SEQ ID NO: 6466412 - DNA, 12 bp, Homo sapiens
tgcaggaaacat

SEQ ID NO: 6466413 - DNA, 20 bp, Homo sapiens
tgcaggaaagaaatcagctt

SEQ ID NO: 6466414 - DNA, 16 bp, Homo sapiens
tgcaggaacgagcact

SEQ ID NO: 6466415 - DNA, 17 bp, Homo sapiens
tgcaggaacgagcactg

SEQ ID NO: 6466416 - DNA, 20 bp, Homo sapiens
tgcaggaacgagcactggcc

SEQ ID NO: 6466417 - DNA, 23 bp, Homo sapiens
tgcaggaacgagcactggccaga

SEQ ID NO: 6466418 - DNA, 18 bp, Homo sapiens
tgcaggaagaccacatgc

SEQ ID NO: 6466419 - DNA, 12 bp, Homo sapiens
tgcaggaagaga

SEQ ID NO: 6466420 - DNA, 15 bp, Homo sapiens
tgcaggaagaggccc

SEQ ID NO: 6466421 - DNA, 17 bp, Homo sapiens
tgcaggaagaggcccac

SEQ ID NO: 6466422 - DNA, 17 bp, Homo sapiens
tgcaggaaggaaaacta

SEQ ID NO: 6466423 - DNA, 14 bp, Homo sapiens
tgcaggaaggagct

SEQ ID NO: 6466424 - DNA, 18 bp, Homo sapiens
tgcaggaaggagctgcct

SEQ ID NO: 6466425 - DNA, 21 bp, Homo sapiens
tgcaggaaggagctgcctgga

SEQ ID NO: 6466426 - DNA, 12 bp, Homo sapiens
tgcaggaatcaa

SEQ ID NO: 6466427 - DNA, 14 bp, Homo sapiens
tgcaggaatcaaaa

SEQ ID NO: 6466428 - DNA, 17 bp, Homo sapiens
tgcaggaatcacccctc

SEQ ID NO: 6466429 - DNA, 18 bp, Homo sapiens
tgcaggaatcccggctcc

SEQ ID NO: 6466430 - DNA, 19 bp, Homo sapiens
tgcaggaatcccggctcca

SEQ ID NO: 6466431 - DNA, 16 bp, Homo sapiens
tgcaggaatgctgaca

SEQ ID NO: 6466432 - DNA, 22 bp, Homo sapiens
tgcaggaatgctgacaatgctg

SEQ ID NO: 6466433 - DNA, 16 bp, Homo sapiens
tgcaggacacagatct

SEQ ID NO: 6466434 - DNA, 14 bp, Homo sapiens
tgcaggacaggagg

SEQ ID NO: 6466435 - DNA, 23 bp, Homo sapiens
tgcaggacaggaggcggcccggc

SEQ ID NO: 6466436 - DNA, 17 bp, Homo sapiens
tgcaggacagtcaaggt

SEQ ID NO: 6466437 - DNA, 14 bp, Homo sapiens
tgcaggacctcagg

SEQ ID NO: 6466438 - DNA, 16 bp, Homo sapiens
tgcaggacctcaggtg

SEQ ID NO: 6466439 - DNA, 18 bp, Homo sapiens
tgcaggacctcaggtgag

SEQ ID NO: 6466440 - DNA, 18 bp, Homo sapiens
tgcaggacctgcctgtag

SEQ ID NO: 6466441 - DNA, 19 bp, Homo sapiens
tgcaggacctgcctgtagc

SEQ ID NO: 6466442 - DNA, 14 bp, Homo sapiens
tgcaggactctagc

SEQ ID NO: 6466443 - DNA, 15 bp, Homo sapiens
tgcaggacttgagaa

SEQ ID NO: 6466444 - DNA, 16 bp, Homo sapiens
tgcaggagacattttc

SEQ ID NO: 6466445 - DNA, 16 bp, Homo sapiens
tgcaggagagagcagc

SEQ ID NO: 6466446 - DNA, 20 bp, Homo sapiens
tgcaggagcaaggctgccct

SEQ ID NO: 6466447 - DNA, 17 bp, Homo sapiens
tgcaggagcagggcggc

SEQ ID NO: 6466448 - DNA, 22 bp, Homo sapiens
tgcaggagcagtatcatgaagc

SEQ ID NO: 6466449 - DNA, 18 bp, Homo sapiens
tgcaggagcctccctgca

SEQ ID NO: 6466450 - DNA, 23 bp, Homo sapiens
tgcaggagcctccctgcacggcc

SEQ ID NO: 6466451 - DNA, 22 bp, Homo sapiens
tgcaggagcgtgaaggacttag

SEQ ID NO: 6466452 - DNA, 13 bp, Homo sapiens
tgcaggagcttct

SEQ ID NO: 6466453 - DNA, 16 bp, Homo sapiens
tgcaggaggcctggga

SEQ ID NO: 6466454 - DNA, 17 bp, Homo sapiens
tgcaggaggcctgggag

SEQ ID NO: 6466455 - DNA, 18 bp, Homo sapiens
tgcaggaggcctgggagg

SEQ ID NO: 6466456 - DNA, 13 bp, Homo sapiens
tgcaggaggctca

SEQ ID NO: 6466457 - DNA, 16 bp, Homo sapiens
tgcaggagggcactgg

SEQ ID NO: 6466458 - DNA, 21 bp, Homo sapiens
tgcaggagggcactggagctg

SEQ ID NO: 6466459 - DNA, 22 bp, Homo sapiens
tgcaggagggttggagtgctct

SEQ ID NO: 6466460 - DNA, 13 bp, Homo sapiens
tgcaggaggtgga

SEQ ID NO: 6466461 - DNA, 15 bp, Homo sapiens
tgcaggaggtggaga

SEQ ID NO: 6466462 - DNA, 16 bp, Homo sapiens
tgcaggaggtggagaa

SEQ ID NO: 6466463 - DNA, 19 bp, Homo sapiens
tgcaggagtgtcctgccca

SEQ ID NO: 6466464 - DNA, 21 bp, Homo sapiens
tgcaggatctcaccaggcagc

SEQ ID NO: 6466465 - DNA, 18 bp, Homo sapiens
tgcaggatctgtctgtgc

SEQ ID NO: 6466466 - DNA, 19 bp, Homo sapiens
tgcaggatctgtctgtgca

SEQ ID NO: 6466467 - DNA, 14 bp, Homo sapiens
tgcaggatggtgtc

SEQ ID NO: 6466468 - DNA, 21 bp, Homo sapiens
tgcaggattctcaccagctgt

SEQ ID NO: 6466469 - DNA, 17 bp, Homo sapiens
tgcaggcacacacgcct

SEQ ID NO: 6466470 - DNA, 22 bp, Homo sapiens
tgcaggcacagaggaggtcagc

SEQ ID NO: 6466471 - DNA, 23 bp, Homo sapiens
tgcaggcactcaatgcagccaga

SEQ ID NO: 6466472 - DNA, 14 bp, Homo sapiens
tgcaggcagagctg

SEQ ID NO: 6466473 - DNA, 23 bp, Homo sapiens
tgcaggcagatttactgtcccag

SEQ ID NO: 6466474 - DNA, 20 bp, Homo sapiens
tgcaggcagcaggatagagt

SEQ ID NO: 6466475 - DNA, 15 bp, Homo sapiens
tgcaggcagccttga

SEQ ID NO: 6466476 - DNA, 14 bp, Homo sapiens
tgcaggcaggaaca

SEQ ID NO: 6466477 - DNA, 19 bp, Homo sapiens
tgcaggcatgctgaacaag

SEQ ID NO: 6466478 - DNA, 11 bp, Homo sapiens
tgcaggccacc

SEQ ID NO: 6466479 - DNA, 21 bp, Homo sapiens
tgcaggccacccccacctccc

SEQ ID NO: 6466480 - DNA, 17 bp, Homo sapiens
tgcaggccactgtgagc

SEQ ID NO: 6466481 - DNA, 17 bp, Homo sapiens
tgcaggccaggccagct

SEQ ID NO: 6466482 - DNA, 23 bp, Homo sapiens
tgcaggccagtcccacggctctg

SEQ ID NO: 6466483 - DNA, 14 bp, Homo sapiens
tctcaaagacccca

SEQ ID NO: 6466484 - DNA, 17 bp, Homo sapiens
tctcaaagacctggggc

SEQ ID NO: 6466485 - DNA, 16 bp, Homo sapiens
tctcaaagagaattgt

SEQ ID NO: 6466486 - DNA, 22 bp, Homo sapiens
tctcaaagcataaaatggaata

SEQ ID NO: 6466487 - DNA, 19 bp, Homo sapiens
tctcaaagcatcaaataat

SEQ ID NO: 6466488 - DNA, 20 bp, Homo sapiens
tctcaaagcatcaaataata

SEQ ID NO: 6466489 - DNA, 11 bp, Homo sapiens
tctcaaaggag

SEQ ID NO: 6466490 - DNA, 18 bp, Homo sapiens
tctcaaaggagaaaaaaa

SEQ ID NO: 6466491 - DNA, 18 bp, Homo sapiens
tctcaaagggtacttcca

SEQ ID NO: 6466492 - DNA, 20 bp, Homo sapiens
tctcaaaggtaattctgaac

SEQ ID NO: 6466493 - DNA, 17 bp, Homo sapiens
tctcaaagtataatctt

SEQ ID NO: 6466494 - DNA, 17 bp, Homo sapiens
tctcaaagtgtggtctc

SEQ ID NO: 6466495 - DNA, 15 bp, Homo sapiens
tctcaaataataata

SEQ ID NO: 6466496 - DNA, 16 bp, Homo sapiens
tctcaaatgctaaatg

SEQ ID NO: 6466497 - DNA, 17 bp, Homo sapiens
tctcaaatgctaaatgc

SEQ ID NO: 6466498 - DNA, 16 bp, Homo sapiens
tctcaaatgctggcaa

SEQ ID NO: 6466499 - DNA, 22 bp, Homo sapiens
tctcaaatggacaataccagaa

SEQ ID NO: 6466500 - DNA, 13 bp, Homo sapiens
tctcaaatgtttt

SEQ ID NO: 6466501 - DNA, 17 bp, Homo sapiens
tctcaaattcagctctg

SEQ ID NO: 6466502 - DNA, 17 bp, Homo sapiens
tctcaaattctcaacct

SEQ ID NO: 6466503 - DNA, 23 bp, Homo sapiens
tctcaaattgtaattaataatag

SEQ ID NO: 6466504 - DNA, 21 bp, Homo sapiens
tctcaaattgtacttgtggga

SEQ ID NO: 6466505 - DNA, 21 bp, Homo sapiens
tctcaaatttttcatctcttc

SEQ ID NO: 6466506 - DNA, 18 bp, Homo sapiens
tctcaacaacatgtcaaa

SEQ ID NO: 6466507 - DNA, 15 bp, Homo sapiens
tctcaacacacagta

SEQ ID NO: 6466508 - DNA, 19 bp, Homo sapiens
tctcaacacccagtttcct

SEQ ID NO: 6466509 - DNA, 16 bp, Homo sapiens
tctcaacaggcctcag

SEQ ID NO: 6466510 - DNA, 19 bp, Homo sapiens
tctcaacaggcctcagggc

SEQ ID NO: 6466511 - DNA, 23 bp, Homo sapiens
tctcaacaggcctcagggctcct

SEQ ID NO: 6466512 - DNA, 17 bp, Homo sapiens
tctcaacagttcattgc

SEQ ID NO: 6466513 - DNA, 14 bp, Homo sapiens
tctcaacatactgt

SEQ ID NO: 6466514 - DNA, 18 bp, Homo sapiens
tctcaacatactgtaatc

SEQ ID NO: 6466515 - DNA, 14 bp, Homo sapiens
tctcaacatgtgtt

SEQ ID NO: 6466516 - DNA, 17 bp, Homo sapiens
tctcaacatgtgtttct

SEQ ID NO: 6466517 - DNA, 19 bp, Homo sapiens
tctcaacatgtgtttctga

SEQ ID NO: 6466518 - DNA, 20 bp, Homo sapiens
tctcaacatgtgtttctgac

SEQ ID NO: 6466519 - DNA, 13 bp, Homo sapiens
tctcaaccatccc

SEQ ID NO: 6466520 - DNA, 17 bp, Homo sapiens
tctcaacccaggagcat

SEQ ID NO: 6466521 - DNA, 14 bp, Homo sapiens
tctcaacctacctc

SEQ ID NO: 6466522 - DNA, 20 bp, Homo sapiens
tctcaaccttggccttctcc

SEQ ID NO: 6466523 - DNA, 18 bp, Homo sapiens
tctcaactctgtttattt

SEQ ID NO: 6466524 - DNA, 23 bp, Homo sapiens
tctcaagaaagccctcattttta

SEQ ID NO: 6466525 - DNA, 17 bp, Homo sapiens
tctcaagaatctagaag

SEQ ID NO: 6466526 - DNA, 17 bp, Homo sapiens
tctcaagagggcactgg

SEQ ID NO: 6466527 - DNA, 21 bp, Homo sapiens
tctcaagatgggggcagggct

SEQ ID NO: 6466528 - DNA, 22 bp, Homo sapiens
tctcaagatgggggcagggctg

SEQ ID NO: 6466529 - DNA, 18 bp, Homo sapiens
tctcaagatgtttatctg

SEQ ID NO: 6466530 - DNA, 15 bp, Homo sapiens
tctcaagcaagttta

SEQ ID NO: 6466531 - DNA, 14 bp, Homo sapiens
tctcaagcactgac

SEQ ID NO: 6466532 - DNA, 13 bp, Homo sapiens
tctcaagccagcc

SEQ ID NO: 6466533 - DNA, 14 bp, Homo sapiens
tctcaagccagccc

SEQ ID NO: 6466534 - DNA, 22 bp, Homo sapiens
tctcaagccgcatcccagactt

SEQ ID NO: 6466535 - DNA, 18 bp, Homo sapiens
tctcaagctagtgtttct

SEQ ID NO: 6466536 - DNA, 19 bp, Homo sapiens
tctcaagctagtgtttcta

SEQ ID NO: 6466537 - DNA, 22 bp, Homo sapiens
tctcaagctatgatcagaagac

SEQ ID NO: 6466538 - DNA, 19 bp, Homo sapiens
tctcaagtaaaacaaatga

SEQ ID NO: 6466539 - DNA, 14 bp, Homo sapiens
tctcaagtatataa

SEQ ID NO: 6466540 - DNA, 21 bp, Homo sapiens
tctcaagtcaaggaagctggg

SEQ ID NO: 6466541 - DNA, 17 bp, Homo sapiens
tctcaagtgaaagactt

SEQ ID NO: 6466542 - DNA, 22 bp, Homo sapiens
tctcaagtgatgagacagtgaa

SEQ ID NO: 6466543 - DNA, 20 bp, Homo sapiens
tctcaagttctaagattcta

SEQ ID NO: 6466544 - DNA, 18 bp, Homo sapiens
tctcaagtttatgtctca

SEQ ID NO: 6466545 - DNA, 21 bp, Homo sapiens
tctcaataaaattatagctct

SEQ ID NO: 6466546 - DNA, 22 bp, Homo sapiens
tctcaataaaattatagctcta

SEQ ID NO: 6466547 - DNA, 23 bp, Homo sapiens
tctcaataaagcacgcagttatg

SEQ ID NO: 6466548 - DNA, 18 bp, Homo sapiens
tctcaataatataataat

SEQ ID NO: 6466549 - DNA, 16 bp, Homo sapiens
tctcaatacagcctga

SEQ ID NO: 6466550 - DNA, 17 bp, Homo sapiens
tctcaatagttcttaaa

SEQ ID NO: 6466551 - DNA, 22 bp, Homo sapiens
tctcaatatataataaatggga

SEQ ID NO: 6466552 - DNA, 21 bp, Homo sapiens
tctcaatcatgggaattttaa

SEQ ID NO: 6466553 - DNA, 24 bp, Homo sapiens
tctcaatcttcggggtgtgatgaa

SEQ ID NO: 6466554 - DNA, 19 bp, Homo sapiens
tctcaatcttggtttgtca

SEQ ID NO: 6466555 - DNA, 19 bp, Homo sapiens
tctcaatgaaccataaatt

SEQ ID NO: 6466556 - DNA, 19 bp, Homo sapiens
tctcaatgtgcaataactt

SEQ ID NO: 6466557 - DNA, 21 bp, Homo sapiens
tctcaatgttccattcagtct

SEQ ID NO: 6466558 - DNA, 19 bp, Homo sapiens
tctcaattccctgaaaaac

SEQ ID NO: 6466559 - DNA, 13 bp, Homo sapiens
tctcaattctgtc

SEQ ID NO: 6466560 - DNA, 21 bp, Homo sapiens
tctcaattgagttaaatcagt

SEQ ID NO: 6466561 - DNA, 19 bp, Homo sapiens
tctcaattgtatagttata

SEQ ID NO: 6466562 - DNA, 12 bp, Homo sapiens
tctcaatttaag

SEQ ID NO: 6466563 - DNA, 12 bp, Homo sapiens
tctcaatttatt

SEQ ID NO: 6466564 - DNA, 15 bp, Homo sapiens
tctcaattttgtatt

SEQ ID NO: 6466565 - DNA, 13 bp, Homo sapiens
tctcaatttttgg

SEQ ID NO: 6466566 - DNA, 22 bp, Homo sapiens
tctcacaaaaaggcaaatattg

SEQ ID NO: 6466567 - DNA, 22 bp, Homo sapiens
tctcacaaaacatattttacat

SEQ ID NO: 6466568 - DNA, 23 bp, Homo sapiens
tctcacaaataagtaatatcttt

SEQ ID NO: 6466569 - DNA, 16 bp, Homo sapiens
tctcacacacacacac

SEQ ID NO: 6466570 - DNA, 23 bp, Homo sapiens
tctcacacatgagcatcaggcca

SEQ ID NO: 6466571 - DNA, 15 bp, Homo sapiens
tctcacacatttctg

SEQ ID NO: 6466572 - DNA, 23 bp, Homo sapiens
tctcacacccaccgtccgccctg

SEQ ID NO: 6466573 - DNA, 13 bp, Homo sapiens
tctcacactcctc

SEQ ID NO: 6466574 - DNA, 14 bp, Homo sapiens
tctcacactcctcc

SEQ ID NO: 6466575 - DNA, 15 bp, Homo sapiens
tctcacactcctcct

SEQ ID NO: 6466576 - DNA, 17 bp, Homo sapiens
tctcacactcctcctgc

SEQ ID NO: 6466577 - DNA, 18 bp, Homo sapiens
tctcacactctaactgta

SEQ ID NO: 6466578 - DNA, 17 bp, Homo sapiens
tctcacactgaatcagc

SEQ ID NO: 6466579 - DNA, 19 bp, Homo sapiens
tctcacactggttctcaat

SEQ ID NO: 6466580 - DNA, 20 bp, Homo sapiens
tctcacagacaggacccctg

SEQ ID NO: 6466581 - DNA, 21 bp, Homo sapiens
tctcacagacaggacccctgc

SEQ ID NO: 6466582 - DNA, 21 bp, Homo sapiens
tctcacagagaagctcctgct

SEQ ID NO: 6466583 - DNA, 13 bp, Homo sapiens
tctcacagaggca

SEQ ID NO: 6466584 - DNA, 11 bp, Homo sapiens
tctcacagcac

SEQ ID NO: 6466585 - DNA, 18 bp, Homo sapiens
tctcacagcacactcagc

SEQ ID NO: 6466586 - DNA, 20 bp, Homo sapiens
tctcacagcacactcagcac

SEQ ID NO: 6466587 - DNA, 17 bp, Homo sapiens
tctcacagctatgcaaa

SEQ ID NO: 6466588 - DNA, 13 bp, Homo sapiens
tctcacaggctga

SEQ ID NO: 6466589 - DNA, 22 bp, Homo sapiens
tctcacagtgggagccagggct

SEQ ID NO: 6466590 - DNA, 20 bp, Homo sapiens
tctcacagtgtggggcagcc

SEQ ID NO: 6466591 - DNA, 15 bp, Homo sapiens
tctcacatccctcta

SEQ ID NO: 6466592 - DNA, 22 bp, Homo sapiens
tctcacatgattccagccatca

SEQ ID NO: 6466593 - DNA, 22 bp, Homo sapiens
tctcacatggtgctacgcctgc

SEQ ID NO: 6466594 - DNA, 15 bp, Homo sapiens
tctcacattgctgta

SEQ ID NO: 6466595 - DNA, 11 bp, Homo sapiens
tctcaccagcc

SEQ ID NO: 6466596 - DNA, 13 bp, Homo sapiens
tctcaccagctca

SEQ ID NO: 6466597 - DNA, 14 bp, Homo sapiens
tctcaccagctcag

SEQ ID NO: 6466598 - DNA, 17 bp, Homo sapiens
tctcaccagctcagccc

SEQ ID NO: 6466599 - DNA, 15 bp, Homo sapiens
tctcaccagctgcaa

SEQ ID NO: 6466600 - DNA, 17 bp, Homo sapiens
tctcaccagctgcaaag

SEQ ID NO: 6466601 - DNA, 18 bp, Homo sapiens
tctcaccatttggatcct

SEQ ID NO: 6466602 - DNA, 14 bp, Homo sapiens
tctcacccaccagc

SEQ ID NO: 6466603 - DNA, 16 bp, Homo sapiens
tctcacccactaggat

SEQ ID NO: 6466604 - DNA, 19 bp, Homo sapiens
tctcacccactaggatagg

SEQ ID NO: 6466605 - DNA, 17 bp, Homo sapiens
tctcacccagaatccct

SEQ ID NO: 6466606 - DNA, 20 bp, Homo sapiens
tctcacccagtccccacccg

SEQ ID NO: 6466607 - DNA, 15 bp, Homo sapiens
tctcacccagttcag

SEQ ID NO: 6466608 - DNA, 16 bp, Homo sapiens
tctcacccataaacag

SEQ ID NO: 6466609 - DNA, 22 bp, Homo sapiens
tctcacccatgcaagcagagga

SEQ ID NO: 6466610 - DNA, 15 bp, Homo sapiens
tctcaccccactcct

SEQ ID NO: 6466611 - DNA, 19 bp, Homo sapiens
tctcacccccatccctggg

SEQ ID NO: 6466612 - DNA, 20 bp, Homo sapiens
tctcaccccccgacctggct

SEQ ID NO: 6466613 - DNA, 12 bp, Homo sapiens
tctcaccctgga

SEQ ID NO: 6466614 - DNA, 16 bp, Homo sapiens
tctcaccctgtgaaac

SEQ ID NO: 6466615 - DNA, 21 bp, Homo sapiens
tctcaccggctctcacctggc

SEQ ID NO: 6466616 - DNA, 19 bp, Homo sapiens
tctcacctaaaaaaagaga

SEQ ID NO: 6466617 - DNA, 20 bp, Homo sapiens
tctcacctaaaccctctgtg

SEQ ID NO: 6466618 - DNA, 18 bp, Homo sapiens
tctcacctacttcctcct

SEQ ID NO: 6466619 - DNA, 12 bp, Homo sapiens
tctcacctcagc

SEQ ID NO: 6466620 - DNA, 14 bp, Homo sapiens
tctcacctctaggt

SEQ ID NO: 6466621 - DNA, 21 bp, Homo sapiens
tctcacctctaggtccccata

SEQ ID NO: 6466622 - DNA, 16 bp, Homo sapiens
tctcacctgaaaatgt

SEQ ID NO: 6466623 - DNA, 18 bp, Homo sapiens
tctcacctgaaaatgtgg

SEQ ID NO: 6466624 - DNA, 13 bp, Homo sapiens
tctcacctggact

SEQ ID NO: 6466625 - DNA, 16 bp, Homo sapiens
tctcacctggccctgc

SEQ ID NO: 6466626 - DNA, 18 bp, Homo sapiens
tctcacctgtgagaccaa

SEQ ID NO: 6466627 - DNA, 15 bp, Homo sapiens
tctcaccttccaaat

SEQ ID NO: 6466628 - DNA, 15 bp, Homo sapiens
tctcaccttcgcctt

SEQ ID NO: 6466629 - DNA, 20 bp, Homo sapiens
tctcacctttcccacctctc

SEQ ID NO: 6466630 - DNA, 17 bp, Homo sapiens
tctcacgattccagtgc

SEQ ID NO: 6466631 - DNA, 16 bp, Homo sapiens
tctcacgccacccccg

SEQ ID NO: 6466632 - DNA, 15 bp, Homo sapiens
tctcacgggctctat

SEQ ID NO: 6466633 - DNA, 20 bp, Homo sapiens
tctcacgggctctatgcctg

SEQ ID NO: 6466634 - DNA, 13 bp, Homo sapiens
tctcactaaactt

SEQ ID NO: 6466635 - DNA, 15 bp, Homo sapiens
tctcactaaacttta

SEQ ID NO: 6466636 - DNA, 14 bp, Homo sapiens
tctcactaaatctt

SEQ ID NO: 6466637 - DNA, 13 bp, Homo sapiens
tctcactacttga

SEQ ID NO: 6466638 - DNA, 22 bp, Homo sapiens
tctcactagtttttcctgtgca

SEQ ID NO: 6466639 - DNA, 17 bp, Homo sapiens
tctcactatgttgccca

SEQ ID NO: 6466640 - DNA, 22 bp, Homo sapiens
tctcactatgttgcccaggcag

SEQ ID NO: 6466641 - DNA, 16 bp, Homo sapiens
tctcactatgtttctc

SEQ ID NO: 6466642 - DNA, 15 bp, Homo sapiens
tctcactcaaagaca

SEQ ID NO: 6466643 - DNA, 13 bp, Homo sapiens
tctcactccacca

SEQ ID NO: 6466644 - DNA, 14 bp, Homo sapiens
tctcactccaccac

SEQ ID NO: 6466645 - DNA, 15 bp, Homo sapiens
tctcactccaccacc

SEQ ID NO: 6466646 - DNA, 13 bp, Homo sapiens
tctcactccagcc

SEQ ID NO: 6466647 - DNA, 15 bp, Homo sapiens
tctcactccagccaa

SEQ ID NO: 6466648 - DNA, 13 bp, Homo sapiens
tctcactccccag

SEQ ID NO: 6466649 - DNA, 23 bp, Homo sapiens
tctcactccccagccccacccct

SEQ ID NO: 6466650 - DNA, 21 bp, Homo sapiens
tctcactccccagcctgggcc

SEQ ID NO: 6466651 - DNA, 15 bp, Homo sapiens
tctcactcccctcct

SEQ ID NO: 6466652 - DNA, 16 bp, Homo sapiens
tctcactcccctctcc

SEQ ID NO: 6466653 - DNA, 18 bp, Homo sapiens
tctcactcccctctcctc

SEQ ID NO: 6466654 - DNA, 19 bp, Homo sapiens
tctcactcccctctcctcc

SEQ ID NO: 6466655 - DNA, 17 bp, Homo sapiens
tctcactcccttctcct

SEQ ID NO: 6466656 - DNA, 23 bp, Homo sapiens
tctcactccctttgtggacttta

SEQ ID NO: 6466657 - DNA, 13 bp, Homo sapiens
tctcactcctacc

SEQ ID NO: 6466658 - DNA, 16 bp, Homo sapiens
tctcactcctacctgg

SEQ ID NO: 6466659 - DNA, 18 bp, Homo sapiens
tctcactcctacctggta

SEQ ID NO: 6466660 - DNA, 13 bp, Homo sapiens
tctcactcctgaa

SEQ ID NO: 6466661 - DNA, 17 bp, Homo sapiens
tgcaggcccagaggagc

SEQ ID NO: 6466662 - DNA, 22 bp, Homo sapiens
tgcaggcccagaggagccaagt

SEQ ID NO: 6466663 - DNA, 17 bp, Homo sapiens
tgcaggcccagcagact

SEQ ID NO: 6466664 - DNA, 15 bp, Homo sapiens
tgcaggcccaggcag

SEQ ID NO: 6466665 - DNA, 23 bp, Homo sapiens
tgcaggcccaggcaggcccagcc

SEQ ID NO: 6466666 - DNA, 15 bp, Homo sapiens
tgcaggccccagcca

SEQ ID NO: 6466667 - DNA, 18 bp, Homo sapiens
tgcaggccccgccccctc

SEQ ID NO: 6466668 - DNA, 17 bp, Homo sapiens
tgcaggccctggcctcc

SEQ ID NO: 6466669 - DNA, 19 bp, Homo sapiens
tgcaggccctggcctcccc

SEQ ID NO: 6466670 - DNA, 21 bp, Homo sapiens
tgcaggcctgctcagggactg

SEQ ID NO: 6466671 - DNA, 16 bp, Homo sapiens
tgcaggcctgtccctg

SEQ ID NO: 6466672 - DNA, 18 bp, Homo sapiens
tgcaggcctgtccctggg

SEQ ID NO: 6466673 - DNA, 19 bp, Homo sapiens
tgcaggcctgtccctggga

SEQ ID NO: 6466674 - DNA, 21 bp, Homo sapiens
tgcaggcctgtccctgggagt

SEQ ID NO: 6466675 - DNA, 21 bp, Homo sapiens
tgcaggcgcgcaccgcccaac

SEQ ID NO: 6466676 - DNA, 17 bp, Homo sapiens
tgcaggcggccctcagt

SEQ ID NO: 6466677 - DNA, 20 bp, Homo sapiens
tgcaggcggggctcctcctg

SEQ ID NO: 6466678 - DNA, 24 bp, Homo sapiens
tgcaggcggtatccagaggtgagg

SEQ ID NO: 6466679 - DNA, 13 bp, Homo sapiens
tgcaggctcccaa

SEQ ID NO: 6466680 - DNA, 18 bp, Homo sapiens
tgcaggctcccaaactca

SEQ ID NO: 6466681 - DNA, 13 bp, Homo sapiens
tgcaggctctggg

SEQ ID NO: 6466682 - DNA, 22 bp, Homo sapiens
tgcaggctctgggctcagggct

SEQ ID NO: 6466683 - DNA, 23 bp, Homo sapiens
tgcaggctctgggctcagggctg

SEQ ID NO: 6466684 - DNA, 19 bp, Homo sapiens
tgcaggctgagccactctc

SEQ ID NO: 6466685 - DNA, 15 bp, Homo sapiens
tgcaggctgcaggag

SEQ ID NO: 6466686 - DNA, 19 bp, Homo sapiens
tgcaggctgcaggagggca

SEQ ID NO: 6466687 - DNA, 19 bp, Homo sapiens
tgcaggctgcagtggctcc

SEQ ID NO: 6466688 - DNA, 18 bp, Homo sapiens
tgcaggctggcaccgcct

SEQ ID NO: 6466689 - DNA, 18 bp, Homo sapiens
tgcaggctggccagccgc

SEQ ID NO: 6466690 - DNA, 19 bp, Homo sapiens
tgcaggctggccagccgct

SEQ ID NO: 6466691 - DNA, 16 bp, Homo sapiens
tgcaggctgtgttttc

SEQ ID NO: 6466692 - DNA, 17 bp, Homo sapiens
tgcaggcttgggaactg

SEQ ID NO: 6466693 - DNA, 19 bp, Homo sapiens
tgcaggctttgccattgtg

SEQ ID NO: 6466694 - DNA, 15 bp, Homo sapiens
tgcagggaaaattat

SEQ ID NO: 6466695 - DNA, 22 bp, Homo sapiens
tgcagggaaaattatttgcata

SEQ ID NO: 6466696 - DNA, 23 bp, Homo sapiens
tgcagggaaagggatggtcaggc

SEQ ID NO: 6466697 - DNA, 16 bp, Homo sapiens
tgcagggaagagggca

SEQ ID NO: 6466698 - DNA, 15 bp, Homo sapiens
tgcagggacagttgg

SEQ ID NO: 6466699 - DNA, 17 bp, Homo sapiens
tgcagggacagttgggt

SEQ ID NO: 6466700 - DNA, 20 bp, Homo sapiens
tgcagggacagttgggtgtg

SEQ ID NO: 6466701 - DNA, 20 bp, Homo sapiens
tgcagggagacatctgcacc

SEQ ID NO: 6466702 - DNA, 22 bp, Homo sapiens
tgcagggagcaccacggccaga

SEQ ID NO: 6466703 - DNA, 13 bp, Homo sapiens
tgcagggagcact

SEQ ID NO: 6466704 - DNA, 15 bp, Homo sapiens
tgcagggagcactgt

SEQ ID NO: 6466705 - DNA, 14 bp, Homo sapiens
tgcagggagcagca

SEQ ID NO: 6466706 - DNA, 20 bp, Homo sapiens
tgcagggagccttctgccac

SEQ ID NO: 6466707 - DNA, 24 bp, Homo sapiens
tgcagggaggaggtggcagccctg

SEQ ID NO: 6466708 - DNA, 13 bp, Homo sapiens
tgcagggaggcca

SEQ ID NO: 6466709 - DNA, 20 bp, Homo sapiens
tgcagggagggcagttttct

SEQ ID NO: 6466710 - DNA, 16 bp, Homo sapiens
tgcagggaggggaggc

SEQ ID NO: 6466711 - DNA, 18 bp, Homo sapiens
tgcagggatattgcctta

SEQ ID NO: 6466712 - DNA, 14 bp, Homo sapiens
tgcagggatgtggg

SEQ ID NO: 6466713 - DNA, 19 bp, Homo sapiens
tgcagggattgctgccact

SEQ ID NO: 6466714 - DNA, 12 bp, Homo sapiens
tgcagggcagcc

SEQ ID NO: 6466715 - DNA, 14 bp, Homo sapiens
tgcagggcagcctg

SEQ ID NO: 6466716 - DNA, 19 bp, Homo sapiens
tgcagggcagcctgtggga

SEQ ID NO: 6466717 - DNA, 10 bp, Homo sapiens
tgcagggcca

SEQ ID NO: 6466718 - DNA, 23 bp, Homo sapiens
tgcagggccactggaaggaacat

SEQ ID NO: 6466719 - DNA, 21 bp, Homo sapiens
tgcagggccagacctgcctgc

SEQ ID NO: 6466720 - DNA, 19 bp, Homo sapiens
tgcagggccatggctcagg

SEQ ID NO: 6466721 - DNA, 18 bp, Homo sapiens
tgcagggcccccacagga

SEQ ID NO: 6466722 - DNA, 16 bp, Homo sapiens
tgcagggccctctggg

SEQ ID NO: 6466723 - DNA, 20 bp, Homo sapiens
tgcagggccgcgagaggccg

SEQ ID NO: 6466724 - DNA, 13 bp, Homo sapiens
tgcagggcctcca

SEQ ID NO: 6466725 - DNA, 16 bp, Homo sapiens
tgcagggcctggcata

SEQ ID NO: 6466726 - DNA, 17 bp, Homo sapiens
tgcagggcctggcatag

SEQ ID NO: 6466727 - DNA, 14 bp, Homo sapiens
tgcagggctcccat

SEQ ID NO: 6466728 - DNA, 17 bp, Homo sapiens
tgcagggctcccatggg

SEQ ID NO: 6466729 - DNA, 19 bp, Homo sapiens
tgcagggctcccatgggct

SEQ ID NO: 6466730 - DNA, 16 bp, Homo sapiens
tgcagggctgctgtgg

SEQ ID NO: 6466731 - DNA, 18 bp, Homo sapiens
tgcagggctgctgtggcc

SEQ ID NO: 6466732 - DNA, 13 bp, Homo sapiens
tgcagggctgggt

SEQ ID NO: 6466733 - DNA, 16 bp, Homo sapiens
tgcagggctgggtcag

SEQ ID NO: 6466734 - DNA, 17 bp, Homo sapiens
tgcagggctgggtcagg

SEQ ID NO: 6466735 - DNA, 12 bp, Homo sapiens
tgcagggctggt

SEQ ID NO: 6466736 - DNA, 14 bp, Homo sapiens
tgcagggctggtct

SEQ ID NO: 6466737 - DNA, 14 bp, Homo sapiens
tgcagggctggttt

SEQ ID NO: 6466738 - DNA, 19 bp, Homo sapiens
tgcagggctggtttgttct

SEQ ID NO: 6466739 - DNA, 19 bp, Homo sapiens
tgcagggctttaaaattct

SEQ ID NO: 6466740 - DNA, 13 bp, Homo sapiens
tgcaggggactgg

SEQ ID NO: 6466741 - DNA, 14 bp, Homo sapiens
tgcaggggactggg

SEQ ID NO: 6466742 - DNA, 16 bp, Homo sapiens
tgcaggggactgggcc

SEQ ID NO: 6466743 - DNA, 21 bp, Homo sapiens
tgcaggggatggggtgggggg

SEQ ID NO: 6466744 - DNA, 20 bp, Homo sapiens
tgcaggggccactccaaact

SEQ ID NO: 6466745 - DNA, 14 bp, Homo sapiens
tgcaggggcctctg

SEQ ID NO: 6466746 - DNA, 15 bp, Homo sapiens
tgcaggggcctctgt

SEQ ID NO: 6466747 - DNA, 14 bp, Homo sapiens
tgcaggggcctgga

SEQ ID NO: 6466748 - DNA, 18 bp, Homo sapiens
tgcaggggctctggagag

SEQ ID NO: 6466749 - DNA, 22 bp, Homo sapiens
tgcagggggtgtgtctgctcag

SEQ ID NO: 6466750 - DNA, 15 bp, Homo sapiens
tgcaggggtccctgc

SEQ ID NO: 6466751 - DNA, 13 bp, Homo sapiens
tgcaggggtctgg

SEQ ID NO: 6466752 - DNA, 13 bp, Homo sapiens
tgcaggggtgacg

SEQ ID NO: 6466753 - DNA, 20 bp, Homo sapiens
tgcagggtcctccggggctc

SEQ ID NO: 6466754 - DNA, 14 bp, Homo sapiens
tgcagggtgacctg

SEQ ID NO: 6466755 - DNA, 19 bp, Homo sapiens
tgcagggtgggtgagctct

SEQ ID NO: 6466756 - DNA, 20 bp, Homo sapiens
tgcagggtggtgctgggact

SEQ ID NO: 6466757 - DNA, 19 bp, Homo sapiens
tgcaggtaagtctggtttt

SEQ ID NO: 6466758 - DNA, 15 bp, Homo sapiens
tgcaggtacttcctc

SEQ ID NO: 6466759 - DNA, 22 bp, Homo sapiens
tgcaggtagacctgtctcctgg

SEQ ID NO: 6466760 - DNA, 17 bp, Homo sapiens
tgcaggtcaaaagtcag

SEQ ID NO: 6466761 - DNA, 18 bp, Homo sapiens
tgcaggtcagcccatgga

SEQ ID NO: 6466762 - DNA, 12 bp, Homo sapiens
tgcaggtcccta

SEQ ID NO: 6466763 - DNA, 15 bp, Homo sapiens
tgcaggtccctaata

SEQ ID NO: 6466764 - DNA, 16 bp, Homo sapiens
tgcaggtccctaataa

SEQ ID NO: 6466765 - DNA, 21 bp, Homo sapiens
tgcaggtccctaataaagctg

SEQ ID NO: 6466766 - DNA, 22 bp, Homo sapiens
tgcaggtccctaataaagctgt

SEQ ID NO: 6466767 - DNA, 13 bp, Homo sapiens
tgcaggtcctggt

SEQ ID NO: 6466768 - DNA, 18 bp, Homo sapiens
tgcaggtgaccagaatga

SEQ ID NO: 6466769 - DNA, 23 bp, Homo sapiens
tgcaggtgagcccatggccctcc

SEQ ID NO: 6466770 - DNA, 19 bp, Homo sapiens
tgcaggtggccaagttcct

SEQ ID NO: 6466771 - DNA, 15 bp, Homo sapiens
tgcaggtggcctccc

SEQ ID NO: 6466772 - DNA, 16 bp, Homo sapiens
tgcaggtggcctccct

SEQ ID NO: 6466773 - DNA, 18 bp, Homo sapiens
tgcaggtggcctccctcc

SEQ ID NO: 6466774 - DNA, 19 bp, Homo sapiens
tgcaggtggcctccctcca

SEQ ID NO: 6466775 - DNA, 20 bp, Homo sapiens
tgcaggtggcctccctccag

SEQ ID NO: 6466776 - DNA, 21 bp, Homo sapiens
tgcaggtggcctccctccaga

SEQ ID NO: 6466777 - DNA, 20 bp, Homo sapiens
tgcaggtgggcactggagca

SEQ ID NO: 6466778 - DNA, 23 bp, Homo sapiens
tgcaggtggggttttcacttcct

SEQ ID NO: 6466779 - DNA, 20 bp, Homo sapiens
tgcaggtggtgtcgggccct

SEQ ID NO: 6466780 - DNA, 16 bp, Homo sapiens
tgcaggtgtcctgagc

SEQ ID NO: 6466781 - DNA, 17 bp, Homo sapiens
tgcaggtgttctgctga

SEQ ID NO: 6466782 - DNA, 15 bp, Homo sapiens
tgcaggttcatggat

SEQ ID NO: 6466783 - DNA, 17 bp, Homo sapiens
tgcaggttgaagccatg

SEQ ID NO: 6466784 - DNA, 20 bp, Homo sapiens
tgcaggttggaccccagaga

SEQ ID NO: 6466785 - DNA, 18 bp, Homo sapiens
tgcaggtttgaccaggaa

SEQ ID NO: 6466786 - DNA, 14 bp, Homo sapiens
tgcagtaaagtctt

SEQ ID NO: 6466787 - DNA, 15 bp, Homo sapiens
tgcagtaaatctttt

SEQ ID NO: 6466788 - DNA, 21 bp, Homo sapiens
tgcagtaaatcttttacaact

SEQ ID NO: 6466789 - DNA, 19 bp, Homo sapiens
tgcagtaattcaactggaa

SEQ ID NO: 6466790 - DNA, 21 bp, Homo sapiens
tgcagtaattcaactggaaat

SEQ ID NO: 6466791 - DNA, 15 bp, Homo sapiens
tgcagtaatttctga

SEQ ID NO: 6466792 - DNA, 11 bp, Homo sapiens
tgcagtacaga

SEQ ID NO: 6466793 - DNA, 14 bp, Homo sapiens
tgcagtacagaatt

SEQ ID NO: 6466794 - DNA, 19 bp, Homo sapiens
tgcagtacagaattggata

SEQ ID NO: 6466795 - DNA, 14 bp, Homo sapiens
tgcagtacaggcaa

SEQ ID NO: 6466796 - DNA, 21 bp, Homo sapiens
tgcagtacattctaaagagag

SEQ ID NO: 6466797 - DNA, 16 bp, Homo sapiens
tgcagtactaaaatta

SEQ ID NO: 6466798 - DNA, 14 bp, Homo sapiens
tgcagtactaacat

SEQ ID NO: 6466799 - DNA, 18 bp, Homo sapiens
tgcagtactttgtgcatt

SEQ ID NO: 6466800 - DNA, 18 bp, Homo sapiens
tgcagtagagagcaaaga

SEQ ID NO: 6466801 - DNA, 14 bp, Homo sapiens
tgcagtagagagcc

SEQ ID NO: 6466802 - DNA, 16 bp, Homo sapiens
tgcagtagagtcatct

SEQ ID NO: 6466803 - DNA, 16 bp, Homo sapiens
tgcagtaggggaggag

SEQ ID NO: 6466804 - DNA, 18 bp, Homo sapiens
tgcagtaggggaggagca

SEQ ID NO: 6466805 - DNA, 16 bp, Homo sapiens
tgcagtataaaatgta

SEQ ID NO: 6466806 - DNA, 18 bp, Homo sapiens
tgcagtataattttctaa

SEQ ID NO: 6466807 - DNA, 21 bp, Homo sapiens
tgcagtatatcacagagccac

SEQ ID NO: 6466808 - DNA, 13 bp, Homo sapiens
tgcagtatatttc

SEQ ID NO: 6466809 - DNA, 16 bp, Homo sapiens
tgcagtatcatgccct

SEQ ID NO: 6466810 - DNA, 21 bp, Homo sapiens
tgcagtatcatgccctgtgca

SEQ ID NO: 6466811 - DNA, 23 bp, Homo sapiens
tgcagtatccgcgagcctgcttg

SEQ ID NO: 6466812 - DNA, 21 bp, Homo sapiens
tgcagtatcggcactgtacaa

SEQ ID NO: 6466813 - DNA, 14 bp, Homo sapiens
tgcagtatctcttg

SEQ ID NO: 6466814 - DNA, 17 bp, Homo sapiens
tgcagtatggccatggg

SEQ ID NO: 6466815 - DNA, 15 bp, Homo sapiens
tgcagtattctgtag

SEQ ID NO: 6466816 - DNA, 21 bp, Homo sapiens
tgcagtattgagtgttctagt

SEQ ID NO: 6466817 - DNA, 22 bp, Homo sapiens
tgcagtattgccacaatgcctc

SEQ ID NO: 6466818 - DNA, 20 bp, Homo sapiens
tgcagtcaacagttcaaaga

SEQ ID NO: 6466819 - DNA, 22 bp, Homo sapiens
tgcagtcaacagttcaaagaag

SEQ ID NO: 6466820 - DNA, 14 bp, Homo sapiens
tgcagtcacctctt

SEQ ID NO: 6466821 - DNA, 17 bp, Homo sapiens
tgcagtcacctcttcta

SEQ ID NO: 6466822 - DNA, 19 bp, Homo sapiens
tgcagtcacgtggaggagc

SEQ ID NO: 6466823 - DNA, 17 bp, Homo sapiens
tgcagtcacgtgtaaac

SEQ ID NO: 6466824 - DNA, 14 bp, Homo sapiens
tgcagtcactgtga

SEQ ID NO: 6466825 - DNA, 19 bp, Homo sapiens
tgcagtcagaagatctttc

SEQ ID NO: 6466826 - DNA, 21 bp, Homo sapiens
tgcagtcagaagatctttctt

SEQ ID NO: 6466827 - DNA, 17 bp, Homo sapiens
tgcagtcagggcccaga

SEQ ID NO: 6466828 - DNA, 13 bp, Homo sapiens
tgcagtcagtcac

SEQ ID NO: 6466829 - DNA, 21 bp, Homo sapiens
tgcagtcagtcatgatggcac

SEQ ID NO: 6466830 - DNA, 21 bp, Homo sapiens
tgcagtcagtgtttcttttaa

SEQ ID NO: 6466831 - DNA, 19 bp, Homo sapiens
tgcagtcatcaacaatgat

SEQ ID NO: 6466832 - DNA, 15 bp, Homo sapiens
tgcagtcatcagaag

SEQ ID NO: 6466833 - DNA, 15 bp, Homo sapiens
tgcagtcatgagaat

SEQ ID NO: 6466834 - DNA, 16 bp, Homo sapiens
tgcagtccagaataag

SEQ ID NO: 6466835 - DNA, 17 bp, Homo sapiens
tgcagtccagaataagt

SEQ ID NO: 6466836 - DNA, 14 bp, Homo sapiens
tgcagtcccaagcg

SEQ ID NO: 6466837 - DNA, 21 bp, Homo sapiens
tgcagtcccacactgtgcaga

SEQ ID NO: 6466838 - DNA, 16 bp, Homo sapiens
tgcagtcccatgcaca

SEQ ID NO: 6466839 - DNA, 12 bp, Homo sapiens
tctcactcctgc

SEQ ID NO: 6466840 - DNA, 15 bp, Homo sapiens
tctcactcctgcctc

SEQ ID NO: 6466841 - DNA, 20 bp, Homo sapiens
tctcactctctggggaagtc

SEQ ID NO: 6466842 - DNA, 17 bp, Homo sapiens
tctcactctcttccttt

SEQ ID NO: 6466843 - DNA, 18 bp, Homo sapiens
tctcactctcttcctttc

SEQ ID NO: 6466844 - DNA, 20 bp, Homo sapiens
tctcactctcttcctttcat

SEQ ID NO: 6466845 - DNA, 14 bp, Homo sapiens
tctcactctgttga

SEQ ID NO: 6466846 - DNA, 21 bp, Homo sapiens
tctcactctgttgaccaggct

SEQ ID NO: 6466847 - DNA, 20 bp, Homo sapiens
tctcactctgttgcccaggc

SEQ ID NO: 6466848 - DNA, 12 bp, Homo sapiens
tctcactcttgt

SEQ ID NO: 6466849 - DNA, 18 bp, Homo sapiens
tctcactgagcactgttt

SEQ ID NO: 6466850 - DNA, 14 bp, Homo sapiens
tctcactgcccagt

SEQ ID NO: 6466851 - DNA, 16 bp, Homo sapiens
tctcactgcccagttt

SEQ ID NO: 6466852 - DNA, 16 bp, Homo sapiens
tctcactgcttgaact

SEQ ID NO: 6466853 - DNA, 23 bp, Homo sapiens
tctcactgctttaggattgaagt

SEQ ID NO: 6466854 - DNA, 15 bp, Homo sapiens
tctcactgctttgca

SEQ ID NO: 6466855 - DNA, 16 bp, Homo sapiens
tctcactggcatcttg

SEQ ID NO: 6466856 - DNA, 23 bp, Homo sapiens
tctcactggccaagaaaattgcc

SEQ ID NO: 6466857 - DNA, 13 bp, Homo sapiens
tctcactgtatta

SEQ ID NO: 6466858 - DNA, 14 bp, Homo sapiens
tctcactgtattaa

SEQ ID NO: 6466859 - DNA, 23 bp, Homo sapiens
tctcactgtgttactgctttgca

SEQ ID NO: 6466860 - DNA, 16 bp, Homo sapiens
tctcactgttctgcaa

SEQ ID NO: 6466861 - DNA, 18 bp, Homo sapiens
tctcactgttgcagtggc

SEQ ID NO: 6466862 - DNA, 20 bp, Homo sapiens
tctcactgttgcccaggctg

SEQ ID NO: 6466863 - DNA, 19 bp, Homo sapiens
tctcactgtttgtttttat

SEQ ID NO: 6466864 - DNA, 14 bp, Homo sapiens
tctcacttatacca

SEQ ID NO: 6466865 - DNA, 18 bp, Homo sapiens
tctcacttataccaaagg

SEQ ID NO: 6466866 - DNA, 21 bp, Homo sapiens
tctcacttcagttgtggcctc

SEQ ID NO: 6466867 - DNA, 13 bp, Homo sapiens
tctcacttcccct

SEQ ID NO: 6466868 - DNA, 13 bp, Homo sapiens
tctcacttctaaa

SEQ ID NO: 6466869 - DNA, 13 bp, Homo sapiens
tctcacttgtgcc

SEQ ID NO: 6466870 - DNA, 18 bp, Homo sapiens
tctcacttttaaaaagaa

SEQ ID NO: 6466871 - DNA, 12 bp, Homo sapiens
tctcacttttca

SEQ ID NO: 6466872 - DNA, 20 bp, Homo sapiens
tctcacttttctccatgagt

SEQ ID NO: 6466873 - DNA, 23 bp, Homo sapiens
tctcagaaagtaaatctgagagg

SEQ ID NO: 6466874 - DNA, 21 bp, Homo sapiens
tctcagaaagtgcctgacaca

SEQ ID NO: 6466875 - DNA, 14 bp, Homo sapiens
tctcagaaatgctg

SEQ ID NO: 6466876 - DNA, 14 bp, Homo sapiens
tctcagaaatgtca

SEQ ID NO: 6466877 - DNA, 23 bp, Homo sapiens
tctcagaacaccaagtaaatcta

SEQ ID NO: 6466878 - DNA, 16 bp, Homo sapiens
tctcagaacagctgaa

SEQ ID NO: 6466879 - DNA, 14 bp, Homo sapiens
tctcagaaccattt

SEQ ID NO: 6466880 - DNA, 18 bp, Homo sapiens
tctcagaaccatttcacc

SEQ ID NO: 6466881 - DNA, 22 bp, Homo sapiens
tctcagaaccttgtcccagcca

SEQ ID NO: 6466882 - DNA, 15 bp, Homo sapiens
tctcagaactcctgt

SEQ ID NO: 6466883 - DNA, 12 bp, Homo sapiens
tctcagaagcac

SEQ ID NO: 6466884 - DNA, 14 bp, Homo sapiens
tctcagaagcacag

SEQ ID NO: 6466885 - DNA, 16 bp, Homo sapiens
tctcagaagcacagaa

SEQ ID NO: 6466886 - DNA, 21 bp, Homo sapiens
tctcagaaggcaaatgacttt

SEQ ID NO: 6466887 - DNA, 18 bp, Homo sapiens
tctcagaagggaggctgg

SEQ ID NO: 6466888 - DNA, 19 bp, Homo sapiens
tctcagaaggtattccttt

SEQ ID NO: 6466889 - DNA, 14 bp, Homo sapiens
tctcagaagtactt

SEQ ID NO: 6466890 - DNA, 19 bp, Homo sapiens
tctcagaagtgaaaaagac

SEQ ID NO: 6466891 - DNA, 12 bp, Homo sapiens
tctcagaatccc

SEQ ID NO: 6466892 - DNA, 21 bp, Homo sapiens
tctcagaatcccttaacagtt

SEQ ID NO: 6466893 - DNA, 15 bp, Homo sapiens
tctcagaatctaaac

SEQ ID NO: 6466894 - DNA, 23 bp, Homo sapiens
tctcagaatctaaacgtggtcac

SEQ ID NO: 6466895 - DNA, 19 bp, Homo sapiens
tctcagaatctacccaaag

SEQ ID NO: 6466896 - DNA, 16 bp, Homo sapiens
tctcagaatctttcct

SEQ ID NO: 6466897 - DNA, 22 bp, Homo sapiens
tctcagaattcggtgtgctgcc

SEQ ID NO: 6466898 - DNA, 13 bp, Homo sapiens
tctcagacccaga

SEQ ID NO: 6466899 - DNA, 17 bp, Homo sapiens
tctcagacccagatgtg

SEQ ID NO: 6466900 - DNA, 21 bp, Homo sapiens
tctcagacccttgaagatgta

SEQ ID NO: 6466901 - DNA, 13 bp, Homo sapiens
tctcagacctcca

SEQ ID NO: 6466902 - DNA, 14 bp, Homo sapiens
tctcagacgacacc

SEQ ID NO: 6466903 - DNA, 19 bp, Homo sapiens
tctcagacgactagcccag

SEQ ID NO: 6466904 - DNA, 15 bp, Homo sapiens
tctcagactctaaac

SEQ ID NO: 6466905 - DNA, 18 bp, Homo sapiens
tctcagactctttcttca

SEQ ID NO: 6466906 - DNA, 16 bp, Homo sapiens
tctcagactgcatgta

SEQ ID NO: 6466907 - DNA, 16 bp, Homo sapiens
tctcagacttctctta

SEQ ID NO: 6466908 - DNA, 15 bp, Homo sapiens
tctcagacttgttgt

SEQ ID NO: 6466909 - DNA, 18 bp, Homo sapiens
tctcagacttttgtacat

SEQ ID NO: 6466910 - DNA, 20 bp, Homo sapiens
tctcagacttttgtacatct

SEQ ID NO: 6466911 - DNA, 19 bp, Homo sapiens
tctcagagcactgtgttca

SEQ ID NO: 6466912 - DNA, 13 bp, Homo sapiens
tctcagagcagca

SEQ ID NO: 6466913 - DNA, 17 bp, Homo sapiens
tctcagagcatctggct

SEQ ID NO: 6466914 - DNA, 19 bp, Homo sapiens
tctcagagcatctggctgt

SEQ ID NO: 6466915 - DNA, 17 bp, Homo sapiens
tctcagagcatgtgtca

SEQ ID NO: 6466916 - DNA, 14 bp, Homo sapiens
tctcagagccaagt

SEQ ID NO: 6466917 - DNA, 15 bp, Homo sapiens
tctcagagccaagtc

SEQ ID NO: 6466918 - DNA, 16 bp, Homo sapiens
tctcagagcctcagct

SEQ ID NO: 6466919 - DNA, 15 bp, Homo sapiens
tctcagagccttcca

SEQ ID NO: 6466920 - DNA, 20 bp, Homo sapiens
tctcagagctacttgggcca

SEQ ID NO: 6466921 - DNA, 21 bp, Homo sapiens
tctcagagctacttgggccat

SEQ ID NO: 6466922 - DNA, 16 bp, Homo sapiens
tctcagagctctcgag

SEQ ID NO: 6466923 - DNA, 23 bp, Homo sapiens
tctcagaggaaaaatgggagcca

SEQ ID NO: 6466924 - DNA, 21 bp, Homo sapiens
tctcagaggcctgctgccagt

SEQ ID NO: 6466925 - DNA, 16 bp, Homo sapiens
tctcagagggttttct

SEQ ID NO: 6466926 - DNA, 19 bp, Homo sapiens
tctcagagtgacagtcata

SEQ ID NO: 6466927 - DNA, 15 bp, Homo sapiens
tctcagataaagtga

SEQ ID NO: 6466928 - DNA, 17 bp, Homo sapiens
tctcagatacttatgaa

SEQ ID NO: 6466929 - DNA, 15 bp, Homo sapiens
tctcagatcacccca

SEQ ID NO: 6466930 - DNA, 16 bp, Homo sapiens
tctcagatccttgttt

SEQ ID NO: 6466931 - DNA, 23 bp, Homo sapiens
tctcagatctggtttctaagagt

SEQ ID NO: 6466932 - DNA, 16 bp, Homo sapiens
tctcagatcttgacag

SEQ ID NO: 6466933 - DNA, 21 bp, Homo sapiens
tctcagatgccccaaagtttc

SEQ ID NO: 6466934 - DNA, 20 bp, Homo sapiens
tctcagatgttaaaataaat

SEQ ID NO: 6466935 - DNA, 21 bp, Homo sapiens
tctcagatgttgaaactttga

SEQ ID NO: 6466936 - DNA, 12 bp, Homo sapiens
tctcagattctg

SEQ ID NO: 6466937 - DNA, 18 bp, Homo sapiens
tctcagatttccacagag

SEQ ID NO: 6466938 - DNA, 18 bp, Homo sapiens
tctcagatttctgaggaa

SEQ ID NO: 6466939 - DNA, 17 bp, Homo sapiens
tctcagattttattatg

SEQ ID NO: 6466940 - DNA, 23 bp, Homo sapiens
tctcagattttattatgtaaatc

SEQ ID NO: 6466941 - DNA, 21 bp, Homo sapiens
tctcagcaaagctacaggact

SEQ ID NO: 6466942 - DNA, 22 bp, Homo sapiens
tctcagcaaattcttgaataaa

SEQ ID NO: 6466943 - DNA, 13 bp, Homo sapiens
tctcagcaagtgc

SEQ ID NO: 6466944 - DNA, 18 bp, Homo sapiens
tctcagcaagtgcccagt

SEQ ID NO: 6466945 - DNA, 15 bp, Homo sapiens
tctcagcacagcctg

SEQ ID NO: 6466946 - DNA, 15 bp, Homo sapiens
tctcagcagaaacac

SEQ ID NO: 6466947 - DNA, 18 bp, Homo sapiens
tctcagcagcgaccaccc

SEQ ID NO: 6466948 - DNA, 15 bp, Homo sapiens
tctcagcatagcctg

SEQ ID NO: 6466949 - DNA, 18 bp, Homo sapiens
tctcagcatagcctgcct

SEQ ID NO: 6466950 - DNA, 16 bp, Homo sapiens
tctcagcatatatata

SEQ ID NO: 6466951 - DNA, 15 bp, Homo sapiens
tctcagccagctgtt

SEQ ID NO: 6466952 - DNA, 13 bp, Homo sapiens
tctcagcccagaa

SEQ ID NO: 6466953 - DNA, 22 bp, Homo sapiens
tctcagccccatcgccccaact

SEQ ID NO: 6466954 - DNA, 21 bp, Homo sapiens
tctcagccccgggcctgcctc

SEQ ID NO: 6466955 - DNA, 22 bp, Homo sapiens
tctcagccccgggcctgcctct

SEQ ID NO: 6466956 - DNA, 17 bp, Homo sapiens
tctcagcccctcagaga

SEQ ID NO: 6466957 - DNA, 18 bp, Homo sapiens
tctcagcccctcagagaa

SEQ ID NO: 6466958 - DNA, 21 bp, Homo sapiens
tctcagccctccatggcctgg

SEQ ID NO: 6466959 - DNA, 16 bp, Homo sapiens
tctcagccgagcccag

SEQ ID NO: 6466960 - DNA, 21 bp, Homo sapiens
tctcagccgagcccaggggag

SEQ ID NO: 6466961 - DNA, 19 bp, Homo sapiens
tctcagcctcccaacccca

SEQ ID NO: 6466962 - DNA, 17 bp, Homo sapiens
tctcagcctcctgagcc

SEQ ID NO: 6466963 - DNA, 18 bp, Homo sapiens
tctcagcctcctgagcct

SEQ ID NO: 6466964 - DNA, 20 bp, Homo sapiens
tctcagccttacatttgtga

SEQ ID NO: 6466965 - DNA, 13 bp, Homo sapiens
tctcagccttccg

SEQ ID NO: 6466966 - DNA, 18 bp, Homo sapiens
tctcagcgggagtctcct

SEQ ID NO: 6466967 - DNA, 19 bp, Homo sapiens
tctcagcgggagtctcctc

SEQ ID NO: 6466968 - DNA, 22 bp, Homo sapiens
tctcagctactcaggaggctga

SEQ ID NO: 6466969 - DNA, 13 bp, Homo sapiens
tctcagctactta

SEQ ID NO: 6466970 - DNA, 16 bp, Homo sapiens
tctcagctcactgcaa

SEQ ID NO: 6466971 - DNA, 17 bp, Homo sapiens
tctcagctcactgcaac

SEQ ID NO: 6466972 - DNA, 18 bp, Homo sapiens
tctcagctcactgcaacc

SEQ ID NO: 6466973 - DNA, 16 bp, Homo sapiens
tctcagctccaggtgg

SEQ ID NO: 6466974 - DNA, 17 bp, Homo sapiens
tctcagctcccaggcca

SEQ ID NO: 6466975 - DNA, 18 bp, Homo sapiens
tctcagctcccatttcta

SEQ ID NO: 6466976 - DNA, 22 bp, Homo sapiens
tctcagctcccatttctactct

SEQ ID NO: 6466977 - DNA, 19 bp, Homo sapiens
tctcagctccccctgtccc

SEQ ID NO: 6466978 - DNA, 13 bp, Homo sapiens
tctcagctccggg

SEQ ID NO: 6466979 - DNA, 14 bp, Homo sapiens
tctcagctgaaatt

SEQ ID NO: 6466980 - DNA, 21 bp, Homo sapiens
tctcagctgccaaccctcccg

SEQ ID NO: 6466981 - DNA, 13 bp, Homo sapiens
tctcagctgctga

SEQ ID NO: 6466982 - DNA, 19 bp, Homo sapiens
tctcagctggcagtgcaat

SEQ ID NO: 6466983 - DNA, 19 bp, Homo sapiens
tctcagctttgagaagcct

SEQ ID NO: 6466984 - DNA, 18 bp, Homo sapiens
tctcaggaaaatctgtga

SEQ ID NO: 6466985 - DNA, 12 bp, Homo sapiens
tctcaggaaatc

SEQ ID NO: 6466986 - DNA, 21 bp, Homo sapiens
tctcaggaaatcaaatatgca

SEQ ID NO: 6466987 - DNA, 18 bp, Homo sapiens
tctcaggacacaggcctg

SEQ ID NO: 6466988 - DNA, 19 bp, Homo sapiens
tctcaggacacaggcctgt

SEQ ID NO: 6466989 - DNA, 21 bp, Homo sapiens
tctcaggacacaggcctgtgt

SEQ ID NO: 6466990 - DNA, 22 bp, Homo sapiens
tctcaggacagcatcccttccc

SEQ ID NO: 6466991 - DNA, 23 bp, Homo sapiens
tctcaggaccaaagctttcatgt

SEQ ID NO: 6466992 - DNA, 21 bp, Homo sapiens
tctcaggaccaccctgccaag

SEQ ID NO: 6466993 - DNA, 22 bp, Homo sapiens
tctcaggaccaccctgccaagg

SEQ ID NO: 6466994 - DNA, 18 bp, Homo sapiens
tctcaggagagtgtgcaa

SEQ ID NO: 6466995 - DNA, 16 bp, Homo sapiens
tctcaggagatggagg

SEQ ID NO: 6466996 - DNA, 14 bp, Homo sapiens
tctcaggagcacag

SEQ ID NO: 6466997 - DNA, 18 bp, Homo sapiens
tctcaggagcacaggcag

SEQ ID NO: 6466998 - DNA, 20 bp, Homo sapiens
tctcaggagcacaggcagct

SEQ ID NO: 6466999 - DNA, 23 bp, Homo sapiens
tctcaggagcacaggcagctgga

SEQ ID NO: 6467000 - DNA, 13 bp, Homo sapiens
tctcaggagccat

SEQ ID NO: 6467001 - DNA, 14 bp, Homo sapiens
tctcaggagcttgc

SEQ ID NO: 6467002 - DNA, 18 bp, Homo sapiens
tctcaggaggggcagcgc

SEQ ID NO: 6467003 - DNA, 17 bp, Homo sapiens
tctcaggaggtgtctcc

SEQ ID NO: 6467004 - DNA, 15 bp, Homo sapiens
tctcaggagtatctt

SEQ ID NO: 6467005 - DNA, 16 bp, Homo sapiens
tctcaggagtctctgg

SEQ ID NO: 6467006 - DNA, 14 bp, Homo sapiens
tctcaggatccaag

SEQ ID NO: 6467007 - DNA, 16 bp, Homo sapiens
tctcaggatccaagct

SEQ ID NO: 6467008 - DNA, 20 bp, Homo sapiens
tctcaggcatgcctgtgtga

SEQ ID NO: 6467009 - DNA, 12 bp, Homo sapiens
tctcaggccagc

SEQ ID NO: 6467010 - DNA, 17 bp, Homo sapiens
tctcaggccagctgctt

SEQ ID NO: 6467011 - DNA, 19 bp, Homo sapiens
tctcaggccccgggcttcc

SEQ ID NO: 6467012 - DNA, 14 bp, Homo sapiens
tctcaggcctccag

SEQ ID NO: 6467013 - DNA, 17 bp, Homo sapiens
tctcaggcgcttctcca

SEQ ID NO: 6467014 - DNA, 16 bp, Homo sapiens
tctcaggctaggccag

SEQ ID NO: 6467015 - DNA, 20 bp, Homo sapiens
tctcaggctaggccagcagg

SEQ ID NO: 6467016 - DNA, 19 bp, Homo sapiens
tctcaggctctgccctgcc

SEQ ID NO: 6467017 - DNA, 19 bp, Homo sapiens
tctcaggctggtgggaggg

SEQ ID NO: 6467018 - DNA, 24 bp, Homo sapiens
tgcagtcccgtggagggtagggga

SEQ ID NO: 6467019 - DNA, 18 bp, Homo sapiens
tgcagtcctcggcagctc

SEQ ID NO: 6467020 - DNA, 19 bp, Homo sapiens
tgcagtcctcggcagctcc

SEQ ID NO: 6467021 - DNA, 15 bp, Homo sapiens
tgcagtcctgaggag

SEQ ID NO: 6467022 - DNA, 13 bp, Homo sapiens
tgcagtcctggga

SEQ ID NO: 6467023 - DNA, 19 bp, Homo sapiens
tgcagtcctggtggggctg

SEQ ID NO: 6467024 - DNA, 15 bp, Homo sapiens
tgcagtcgcttgcca

SEQ ID NO: 6467025 - DNA, 19 bp, Homo sapiens
tgcagtcgcttgccaaagc

SEQ ID NO: 6467026 - DNA, 21 bp, Homo sapiens
tgcagtcgcttgccaaagcag

SEQ ID NO: 6467027 - DNA, 18 bp, Homo sapiens
tgcagtcggcatgccagg

SEQ ID NO: 6467028 - DNA, 18 bp, Homo sapiens
tgcagtctccgcctcctg

SEQ ID NO: 6467029 - DNA, 21 bp, Homo sapiens
tgcagtctctataccaataaa

SEQ ID NO: 6467030 - DNA, 21 bp, Homo sapiens
tgcagtctctttattttacta

SEQ ID NO: 6467031 - DNA, 20 bp, Homo sapiens
tgcagtctgtattttccacc

SEQ ID NO: 6467032 - DNA, 15 bp, Homo sapiens
tgcagtctgtggagc

SEQ ID NO: 6467033 - DNA, 21 bp, Homo sapiens
tgcagtcttctgggctgcggg

SEQ ID NO: 6467034 - DNA, 20 bp, Homo sapiens
tgcagtcttgtactgtgacc

SEQ ID NO: 6467035 - DNA, 16 bp, Homo sapiens
tgcagtcttgtagcta

SEQ ID NO: 6467036 - DNA, 19 bp, Homo sapiens
tgcagtctttcccccagga

SEQ ID NO: 6467037 - DNA, 20 bp, Homo sapiens
tgcagtctttcccccaggaa

SEQ ID NO: 6467038 - DNA, 13 bp, Homo sapiens
tgcagtctttttt

SEQ ID NO: 6467039 - DNA, 14 bp, Homo sapiens
tgcagtgaacttcc

SEQ ID NO: 6467040 - DNA, 23 bp, Homo sapiens
tgcagtgaagatgtgtaaataag

SEQ ID NO: 6467041 - DNA, 16 bp, Homo sapiens
tgcagtgaccgcttcc

SEQ ID NO: 6467042 - DNA, 13 bp, Homo sapiens
tgcagtgagcagg

SEQ ID NO: 6467043 - DNA, 14 bp, Homo sapiens
tgcagtgagcaggg

SEQ ID NO: 6467044 - DNA, 15 bp, Homo sapiens
tgcagtgagcagggt

SEQ ID NO: 6467045 - DNA, 20 bp, Homo sapiens
tgcagtgagcagggtggggt

SEQ ID NO: 6467046 - DNA, 20 bp, Homo sapiens
tgcagtgagccaaaatcatg

SEQ ID NO: 6467047 - DNA, 14 bp, Homo sapiens
tgcagtgagccatg

SEQ ID NO: 6467048 - DNA, 17 bp, Homo sapiens
tgcagtgagctgtgatt

SEQ ID NO: 6467049 - DNA, 23 bp, Homo sapiens
tgcagtgaggggccctccatgcg

SEQ ID NO: 6467050 - DNA, 16 bp, Homo sapiens
tgcagtgatacatgta

SEQ ID NO: 6467051 - DNA, 18 bp, Homo sapiens
tgcagtgatacatgtact

SEQ ID NO: 6467052 - DNA, 23 bp, Homo sapiens
tgcagtgatggcgcgggaggcac

SEQ ID NO: 6467053 - DNA, 14 bp, Homo sapiens
tgcagtgatgtgat

SEQ ID NO: 6467054 - DNA, 23 bp, Homo sapiens
tgcagtgattattttttaaagtc

SEQ ID NO: 6467055 - DNA, 15 bp, Homo sapiens
tgcagtgcagcatgg

SEQ ID NO: 6467056 - DNA, 16 bp, Homo sapiens
tgcagtgcagtataga

SEQ ID NO: 6467057 - DNA, 17 bp, Homo sapiens
tgcagtgccagctccct

SEQ ID NO: 6467058 - DNA, 16 bp, Homo sapiens
tgcagtgccctagaag

SEQ ID NO: 6467059 - DNA, 21 bp, Homo sapiens
tgcagtgccctagaaggggaa

SEQ ID NO: 6467060 - DNA, 16 bp, Homo sapiens
tgcagtgcctttcccc

SEQ ID NO: 6467061 - DNA, 17 bp, Homo sapiens
tgcagtgcctttcccca

SEQ ID NO: 6467062 - DNA, 14 bp, Homo sapiens
tgcagtgcggctca

SEQ ID NO: 6467063 - DNA, 17 bp, Homo sapiens
tgcagtgctcgctgttg

SEQ ID NO: 6467064 - DNA, 23 bp, Homo sapiens
tgcagtgctcgctgttgctgaat

SEQ ID NO: 6467065 - DNA, 17 bp, Homo sapiens
tgcagtggacggagagc

SEQ ID NO: 6467066 - DNA, 15 bp, Homo sapiens
tgcagtggagggggc

SEQ ID NO: 6467067 - DNA, 13 bp, Homo sapiens
tgcagtggcacaa

SEQ ID NO: 6467068 - DNA, 23 bp, Homo sapiens
tgcagtggcacaatcatggctca

SEQ ID NO: 6467069 - DNA, 22 bp, Homo sapiens
tgcagtggcatcatctcagctc

SEQ ID NO: 6467070 - DNA, 22 bp, Homo sapiens
tgcagtggccccttaggccagt

SEQ ID NO: 6467071 - DNA, 17 bp, Homo sapiens
tgcagtggcctggccgt

SEQ ID NO: 6467072 - DNA, 22 bp, Homo sapiens
tgcagtggcgaaatccctgctc

SEQ ID NO: 6467073 - DNA, 16 bp, Homo sapiens
tgcagtggctcatgcc

SEQ ID NO: 6467074 - DNA, 13 bp, Homo sapiens
tgcagtggctccc

SEQ ID NO: 6467075 - DNA, 20 bp, Homo sapiens
tgcagtggctcccctgccca

SEQ ID NO: 6467076 - DNA, 17 bp, Homo sapiens
tgcagtgggtggggctg

SEQ ID NO: 6467077 - DNA, 23 bp, Homo sapiens
tgcagtggtgcgatctcggctca

SEQ ID NO: 6467078 - DNA, 16 bp, Homo sapiens
tgcagtggtgtgaaac

SEQ ID NO: 6467079 - DNA, 18 bp, Homo sapiens
tgcagtgtagttttcctt

SEQ ID NO: 6467080 - DNA, 10 bp, Homo sapiens
tgcagtgtct

SEQ ID NO: 6467081 - DNA, 17 bp, Homo sapiens
tgcagtgtgaatgctgg

SEQ ID NO: 6467082 - DNA, 19 bp, Homo sapiens
tgcagtgtgaatgctgggc

SEQ ID NO: 6467083 - DNA, 13 bp, Homo sapiens
tgcagtgtgcagg

SEQ ID NO: 6467084 - DNA, 12 bp, Homo sapiens
tgcagtgtggag

SEQ ID NO: 6467085 - DNA, 15 bp, Homo sapiens
tgcagtgtggagttc

SEQ ID NO: 6467086 - DNA, 16 bp, Homo sapiens
tgcagtgtgtctttat

SEQ ID NO: 6467087 - DNA, 16 bp, Homo sapiens
tgcagtgttcgcttgg

SEQ ID NO: 6467088 - DNA, 18 bp, Homo sapiens
tgcagtgttcgcttggct

SEQ ID NO: 6467089 - DNA, 18 bp, Homo sapiens
tgcagtgttctgtgaata

SEQ ID NO: 6467090 - DNA, 19 bp, Homo sapiens
tgcagtgttctgtgaatag

SEQ ID NO: 6467091 - DNA, 19 bp, Homo sapiens
tgcagtgtttccctctgtg

SEQ ID NO: 6467092 - DNA, 15 bp, Homo sapiens
tgcagtgttttgcat

SEQ ID NO: 6467093 - DNA, 14 bp, Homo sapiens
tgcagttaacagga

SEQ ID NO: 6467094 - DNA, 23 bp, Homo sapiens
tgcagttaacaggatattagaca

SEQ ID NO: 6467095 - DNA, 19 bp, Homo sapiens
tgcagttaatggggtagag

SEQ ID NO: 6467096 - DNA, 13 bp, Homo sapiens
tgcagttacaaat

SEQ ID NO: 6467097 - DNA, 19 bp, Homo sapiens
tgcagttacaaattataat

SEQ ID NO: 6467098 - DNA, 21 bp, Homo sapiens
tgcagttacactaaaaggtga

SEQ ID NO: 6467099 - DNA, 14 bp, Homo sapiens
tgcagttaccacag

SEQ ID NO: 6467100 - DNA, 22 bp, Homo sapiens
tgcagttaccccgatccgtttg

SEQ ID NO: 6467101 - DNA, 22 bp, Homo sapiens
tgcagttcaaaaacaagacaga

SEQ ID NO: 6467102 - DNA, 20 bp, Homo sapiens
tgcagttcatactgaatgac

SEQ ID NO: 6467103 - DNA, 20 bp, Homo sapiens
tgcagttcatccgcactgta

SEQ ID NO: 6467104 - DNA, 20 bp, Homo sapiens
tgcagttcccccaacctcag

SEQ ID NO: 6467105 - DNA, 22 bp, Homo sapiens
tgcagttcctcttcatctgtgt

SEQ ID NO: 6467106 - DNA, 15 bp, Homo sapiens
tgcagttcctggccc

SEQ ID NO: 6467107 - DNA, 18 bp, Homo sapiens
tgcagttctagtttgcat

SEQ ID NO: 6467108 - DNA, 16 bp, Homo sapiens
tgcagttctgaagaag

SEQ ID NO: 6467109 - DNA, 18 bp, Homo sapiens
tgcagttctgattcattt

SEQ ID NO: 6467110 - DNA, 18 bp, Homo sapiens
tgcagttctttttgtaca

SEQ ID NO: 6467111 - DNA, 17 bp, Homo sapiens
tgcagttgaagagcctg

SEQ ID NO: 6467112 - DNA, 20 bp, Homo sapiens
tgcagttgctcattgtagag

SEQ ID NO: 6467113 - DNA, 12 bp, Homo sapiens
tgcagttgctgt

SEQ ID NO: 6467114 - DNA, 20 bp, Homo sapiens
tgcagttggactctcaggga

SEQ ID NO: 6467115 - DNA, 14 bp, Homo sapiens
tgcagttggcctca

SEQ ID NO: 6467116 - DNA, 13 bp, Homo sapiens
tgcagttgtctct

SEQ ID NO: 6467117 - DNA, 15 bp, Homo sapiens
tgcagttgtctctgt

SEQ ID NO: 6467118 - DNA, 17 bp, Homo sapiens
tgcagttgtctctgttt

SEQ ID NO: 6467119 - DNA, 22 bp, Homo sapiens
tgcagtttacagtatttctaca

SEQ ID NO: 6467120 - DNA, 21 bp, Homo sapiens
tgcagtttatatatatgctac

SEQ ID NO: 6467121 - DNA, 14 bp, Homo sapiens
tgcagtttcatgta

SEQ ID NO: 6467122 - DNA, 18 bp, Homo sapiens
tgcagtttcatgtatgta

SEQ ID NO: 6467123 - DNA, 14 bp, Homo sapiens
tgcagtttcctgga

SEQ ID NO: 6467124 - DNA, 18 bp, Homo sapiens
tgcagtttcttgtgtaga

SEQ ID NO: 6467125 - DNA, 21 bp, Homo sapiens
tgcagtttcttgtgtagattt

SEQ ID NO: 6467126 - DNA, 12 bp, Homo sapiens
tgcagtttcttt

SEQ ID NO: 6467127 - DNA, 17 bp, Homo sapiens
tgcagtttcttttcaca

SEQ ID NO: 6467128 - DNA, 12 bp, Homo sapiens
tgcagtttgaaa

SEQ ID NO: 6467129 - DNA, 13 bp, Homo sapiens
tgcagtttgatca

SEQ ID NO: 6467130 - DNA, 15 bp, Homo sapiens
tgcagtttgatcaaa

SEQ ID NO: 6467131 - DNA, 13 bp, Homo sapiens
tgcagtttggaat

SEQ ID NO: 6467132 - DNA, 14 bp, Homo sapiens
tgcagtttggccct

SEQ ID NO: 6467133 - DNA, 15 bp, Homo sapiens
tgcagtttggccctg

SEQ ID NO: 6467134 - DNA, 20 bp, Homo sapiens
tgcagtttggccctggagcc

SEQ ID NO: 6467135 - DNA, 18 bp, Homo sapiens
tgcagtttggtatgaaac

SEQ ID NO: 6467136 - DNA, 19 bp, Homo sapiens
tgcagtttggtatgaaaca

SEQ ID NO: 6467137 - DNA, 21 bp, Homo sapiens
tgcagtttggtgtgtcctccg

SEQ ID NO: 6467138 - DNA, 16 bp, Homo sapiens
tgcagtttgtgaactt

SEQ ID NO: 6467139 - DNA, 14 bp, Homo sapiens
tgcagttttaactt

SEQ ID NO: 6467140 - DNA, 19 bp, Homo sapiens
tgcagtttttataatagat

SEQ ID NO: 6467141 - DNA, 14 bp, Homo sapiens
tgcagtttttcaga

SEQ ID NO: 6467142 - DNA, 18 bp, Homo sapiens
tgcagtttttcattttaa

SEQ ID NO: 6467143 - DNA, 12 bp, Homo sapiens
tgcataaaaaaa

SEQ ID NO: 6467144 - DNA, 15 bp, Homo sapiens
tgcataaaaaaatga

SEQ ID NO: 6467145 - DNA, 20 bp, Homo sapiens
tgcataaaaattaaatggat

SEQ ID NO: 6467146 - DNA, 17 bp, Homo sapiens
tgcataaaattctagag

SEQ ID NO: 6467147 - DNA, 17 bp, Homo sapiens
tgcataaaattggatta

SEQ ID NO: 6467148 - DNA, 19 bp, Homo sapiens
tgcataaacaatccaaatg

SEQ ID NO: 6467149 - DNA, 18 bp, Homo sapiens
tgcataaacacttttcaa

SEQ ID NO: 6467150 - DNA, 13 bp, Homo sapiens
tgcataaaccaat

SEQ ID NO: 6467151 - DNA, 15 bp, Homo sapiens
tgcataaaccaatga

SEQ ID NO: 6467152 - DNA, 16 bp, Homo sapiens
tgcataaaggttctgg

SEQ ID NO: 6467153 - DNA, 12 bp, Homo sapiens
tgcataaatatg

SEQ ID NO: 6467154 - DNA, 13 bp, Homo sapiens
tgcataaattaat

SEQ ID NO: 6467155 - DNA, 18 bp, Homo sapiens
tgcataaatttgtaatat

SEQ ID NO: 6467156 - DNA, 18 bp, Homo sapiens
tgcataacaaattctgaa

SEQ ID NO: 6467157 - DNA, 18 bp, Homo sapiens
tgcataacaattcctcta

SEQ ID NO: 6467158 - DNA, 22 bp, Homo sapiens
tgcataacgtataaaagcctgt

SEQ ID NO: 6467159 - DNA, 18 bp, Homo sapiens
tgcataagattaaaggaa

SEQ ID NO: 6467160 - DNA, 22 bp, Homo sapiens
tgcataagtgaaaatcttacaa

SEQ ID NO: 6467161 - DNA, 19 bp, Homo sapiens
tgcataataaatgcttcag

SEQ ID NO: 6467162 - DNA, 23 bp, Homo sapiens
tgcataataagctaaagaggctg

SEQ ID NO: 6467163 - DNA, 24 bp, Homo sapiens
tgcataataagctaaagaggctga

SEQ ID NO: 6467164 - DNA, 23 bp, Homo sapiens
tgcataataatcctgcaaagtac

SEQ ID NO: 6467165 - DNA, 17 bp, Homo sapiens
tgcataatatgcatata

SEQ ID NO: 6467166 - DNA, 18 bp, Homo sapiens
tgcataatgcaatcaaaa

SEQ ID NO: 6467167 - DNA, 18 bp, Homo sapiens
tgcataatgctttggaaa

SEQ ID NO: 6467168 - DNA, 21 bp, Homo sapiens
tgcataatgctttggaaaaat

SEQ ID NO: 6467169 - DNA, 15 bp, Homo sapiens
tgcataatggtcaga

SEQ ID NO: 6467170 - DNA, 14 bp, Homo sapiens
tgcataatgtttaa

SEQ ID NO: 6467171 - DNA, 19 bp, Homo sapiens
tgcataattctgaagttat

SEQ ID NO: 6467172 - DNA, 12 bp, Homo sapiens
tgcatacaaaca

SEQ ID NO: 6467173 - DNA, 23 bp, Homo sapiens
tgcatacaaacaagcatataaaa

SEQ ID NO: 6467174 - DNA, 20 bp, Homo sapiens
tgcatacaaatctcactgta

SEQ ID NO: 6467175 - DNA, 10 bp, Homo sapiens
tgcatacaca

SEQ ID NO: 6467176 - DNA, 11 bp, Homo sapiens
tgcatacacac

SEQ ID NO: 6467177 - DNA, 12 bp, Homo sapiens
tgcatacacaca

SEQ ID NO: 6467178 - DNA, 14 bp, Homo sapiens
tgcatacacacaca

SEQ ID NO: 6467179 - DNA, 23 bp, Homo sapiens
tgcatacacacacacacacagcc

SEQ ID NO: 6467180 - DNA, 22 bp, Homo sapiens
tgcatacacatgcactcagtgt

SEQ ID NO: 6467181 - DNA, 22 bp, Homo sapiens
tgcatacactttttctctttcc

SEQ ID NO: 6467182 - DNA, 17 bp, Homo sapiens
tgcatacatgaataaaa

SEQ ID NO: 6467183 - DNA, 20 bp, Homo sapiens
tgcatacatgaataaaaata

SEQ ID NO: 6467184 - DNA, 18 bp, Homo sapiens
tgcataccaacctgggca

SEQ ID NO: 6467185 - DNA, 18 bp, Homo sapiens
tgcataccacttttgttc

SEQ ID NO: 6467186 - DNA, 12 bp, Homo sapiens
tgcataccctca

SEQ ID NO: 6467187 - DNA, 16 bp, Homo sapiens
tgcatacgtaaaaatg

SEQ ID NO: 6467188 - DNA, 20 bp, Homo sapiens
tgcatactcaaggtgagaat

SEQ ID NO: 6467189 - DNA, 19 bp, Homo sapiens
tgcatactcattaggatgg

SEQ ID NO: 6467190 - DNA, 17 bp, Homo sapiens
tgcatactgagccaagt

SEQ ID NO: 6467191 - DNA, 21 bp, Homo sapiens
tgcatactgatccctttccca

SEQ ID NO: 6467192 - DNA, 14 bp, Homo sapiens
tgcatactgttgat

SEQ ID NO: 6467193 - DNA, 21 bp, Homo sapiens
tgcatacttcaaaagtatttt

SEQ ID NO: 6467194 - DNA, 22 bp, Homo sapiens
tgcatacttcctggattttctt

SEQ ID NO: 6467195 - DNA, 18 bp, Homo sapiens
tgcatactttgacaagga

SEQ ID NO: 6467196 - DNA, 13 bp, Homo sapiens
tctcaggctgtcc

SEQ ID NO: 6467197 - DNA, 15 bp, Homo sapiens
tctcagggaaagcct

SEQ ID NO: 6467198 - DNA, 22 bp, Homo sapiens
tctcagggaactgaccctcagg

SEQ ID NO: 6467199 - DNA, 19 bp, Homo sapiens
tctcagggaagcccagctc

SEQ ID NO: 6467200 - DNA, 20 bp, Homo sapiens
tctcagggaagcccagctcc

SEQ ID NO: 6467201 - DNA, 21 bp, Homo sapiens
tctcagggaagcccagctcca

SEQ ID NO: 6467202 - DNA, 20 bp, Homo sapiens
tctcagggagggaaggggat

SEQ ID NO: 6467203 - DNA, 23 bp, Homo sapiens
tctcagggagggaaggggatgga

SEQ ID NO: 6467204 - DNA, 12 bp, Homo sapiens
tctcagggcctg

SEQ ID NO: 6467205 - DNA, 16 bp, Homo sapiens
tctcagggcctggcag

SEQ ID NO: 6467206 - DNA, 19 bp, Homo sapiens
tctcagggcctggcaggcc

SEQ ID NO: 6467207 - DNA, 20 bp, Homo sapiens
tctcagggcctggcaggcca

SEQ ID NO: 6467208 - DNA, 11 bp, Homo sapiens
tctcagggctc

SEQ ID NO: 6467209 - DNA, 13 bp, Homo sapiens
tctcagggctcct

SEQ ID NO: 6467210 - DNA, 17 bp, Homo sapiens
tctcagggctcctgcct

SEQ ID NO: 6467211 - DNA, 23 bp, Homo sapiens
tctcagggctcctgccttctgtc

SEQ ID NO: 6467212 - DNA, 14 bp, Homo sapiens
tctcagggctggag

SEQ ID NO: 6467213 - DNA, 20 bp, Homo sapiens
tctcagggctggagcctggg

SEQ ID NO: 6467214 - DNA, 17 bp, Homo sapiens
tctcaggggccagagga

SEQ ID NO: 6467215 - DNA, 20 bp, Homo sapiens
tctcaggggccagaggaact

SEQ ID NO: 6467216 - DNA, 17 bp, Homo sapiens
tctcaggggctgtttga

SEQ ID NO: 6467217 - DNA, 20 bp, Homo sapiens
tctcagggggtcagcagagt

SEQ ID NO: 6467218 - DNA, 17 bp, Homo sapiens
tctcaggggtgctgggg

SEQ ID NO: 6467219 - DNA, 15 bp, Homo sapiens
tctcagggtcactgt

SEQ ID NO: 6467220 - DNA, 16 bp, Homo sapiens
tctcagggtccagacc

SEQ ID NO: 6467221 - DNA, 15 bp, Homo sapiens
tctcagggtctctgc

SEQ ID NO: 6467222 - DNA, 16 bp, Homo sapiens
tctcagggtgtcccag

SEQ ID NO: 6467223 - DNA, 17 bp, Homo sapiens
tctcagggtgtcccaga

SEQ ID NO: 6467224 - DNA, 17 bp, Homo sapiens
tctcaggtaccttttct

SEQ ID NO: 6467225 - DNA, 22 bp, Homo sapiens
tctcaggtagaaggttgacaca

SEQ ID NO: 6467226 - DNA, 16 bp, Homo sapiens
tctcaggtcactccag

SEQ ID NO: 6467227 - DNA, 18 bp, Homo sapiens
tctcaggtgccactccct

SEQ ID NO: 6467228 - DNA, 23 bp, Homo sapiens
tctcaggtgccactccctgagct

SEQ ID NO: 6467229 - DNA, 18 bp, Homo sapiens
tctcaggtggcatttgca

SEQ ID NO: 6467230 - DNA, 19 bp, Homo sapiens
tctcaggtggcatttgcag

SEQ ID NO: 6467231 - DNA, 16 bp, Homo sapiens
tctcaggttcaagtgg

SEQ ID NO: 6467232 - DNA, 23 bp, Homo sapiens
tctcaggttggcggcagacacat

SEQ ID NO: 6467233 - DNA, 16 bp, Homo sapiens
tctcagtaagaagtct

SEQ ID NO: 6467234 - DNA, 17 bp, Homo sapiens
tctcagtacctcccctc

SEQ ID NO: 6467235 - DNA, 15 bp, Homo sapiens
tctcagtatcttaaa

SEQ ID NO: 6467236 - DNA, 16 bp, Homo sapiens
tctcagtcaaacaagt

SEQ ID NO: 6467237 - DNA, 23 bp, Homo sapiens
tctcagtcactttttcccctgca

SEQ ID NO: 6467238 - DNA, 14 bp, Homo sapiens
tctcagtcagtgtc

SEQ ID NO: 6467239 - DNA, 21 bp, Homo sapiens
tctcagtcatgcataaatatg

SEQ ID NO: 6467240 - DNA, 14 bp, Homo sapiens
tctcagtccccttc

SEQ ID NO: 6467241 - DNA, 18 bp, Homo sapiens
tctcagtcggtgtgtaat

SEQ ID NO: 6467242 - DNA, 13 bp, Homo sapiens
tctcagtctctga

SEQ ID NO: 6467243 - DNA, 17 bp, Homo sapiens
tctcagtctctgagcag

SEQ ID NO: 6467244 - DNA, 15 bp, Homo sapiens
tctcagtctgtcacc

SEQ ID NO: 6467245 - DNA, 14 bp, Homo sapiens
tctcagtgaaggaa

SEQ ID NO: 6467246 - DNA, 23 bp, Homo sapiens
tctcagtgccaactgtggctggt

SEQ ID NO: 6467247 - DNA, 18 bp, Homo sapiens
tctcagtgccttctctca

SEQ ID NO: 6467248 - DNA, 19 bp, Homo sapiens
tctcagtgccttctctcag

SEQ ID NO: 6467249 - DNA, 23 bp, Homo sapiens
tctcagtgccttctctcagctcc

SEQ ID NO: 6467250 - DNA, 14 bp, Homo sapiens
tctcagtgctctcc

SEQ ID NO: 6467251 - DNA, 13 bp, Homo sapiens
tctcagtgctttc

SEQ ID NO: 6467252 - DNA, 13 bp, Homo sapiens
tctcagtggcttc

SEQ ID NO: 6467253 - DNA, 23 bp, Homo sapiens
tctcagtgggacaaaccagagca

SEQ ID NO: 6467254 - DNA, 22 bp, Homo sapiens
tctcagtggttaagattcctaa

SEQ ID NO: 6467255 - DNA, 14 bp, Homo sapiens
tctcagtgtctgaa

SEQ ID NO: 6467256 - DNA, 23 bp, Homo sapiens
tctcagtgttaatactgagaaaa

SEQ ID NO: 6467257 - DNA, 22 bp, Homo sapiens
tctcagtgttgagccttttccc

SEQ ID NO: 6467258 - DNA, 15 bp, Homo sapiens
tctcagtgttttgga

SEQ ID NO: 6467259 - DNA, 21 bp, Homo sapiens
tctcagttaaaatgtgaggaa

SEQ ID NO: 6467260 - DNA, 16 bp, Homo sapiens
tctcagttattcagat

SEQ ID NO: 6467261 - DNA, 18 bp, Homo sapiens
tctcagttcatttcctga

SEQ ID NO: 6467262 - DNA, 21 bp, Homo sapiens
tctcagttccgatttcccagg

SEQ ID NO: 6467263 - DNA, 15 bp, Homo sapiens
tctcagttgcagaaa

SEQ ID NO: 6467264 - DNA, 14 bp, Homo sapiens
tctcagttgcagcc

SEQ ID NO: 6467265 - DNA, 21 bp, Homo sapiens
tctcagttgcagccctgctgc

SEQ ID NO: 6467266 - DNA, 13 bp, Homo sapiens
tctcagtttcact

SEQ ID NO: 6467267 - DNA, 18 bp, Homo sapiens
tctcagtttctgcctggg

SEQ ID NO: 6467268 - DNA, 20 bp, Homo sapiens
tctcagtttctgcctgggca

SEQ ID NO: 6467269 - DNA, 10 bp, Homo sapiens
tctcagtttt

SEQ ID NO: 6467270 - DNA, 12 bp, Homo sapiens
tctcagttttca

SEQ ID NO: 6467271 - DNA, 12 bp, Homo sapiens
tctcagtttttc

SEQ ID NO: 6467272 - DNA, 15 bp, Homo sapiens
tctcagtttttctta

SEQ ID NO: 6467273 - DNA, 21 bp, Homo sapiens
tctcagtttttcttaatatat

SEQ ID NO: 6467274 - DNA, 13 bp, Homo sapiens
tctcataaattta

SEQ ID NO: 6467275 - DNA, 18 bp, Homo sapiens
tctcataatgtgaaatat

SEQ ID NO: 6467276 - DNA, 23 bp, Homo sapiens
tctcataatttatacaggtcata

SEQ ID NO: 6467277 - DNA, 14 bp, Homo sapiens
tctcatacaagcca

SEQ ID NO: 6467278 - DNA, 16 bp, Homo sapiens
tctcataccctccctc

SEQ ID NO: 6467279 - DNA, 19 bp, Homo sapiens
tctcatacctctgaccaac

SEQ ID NO: 6467280 - DNA, 17 bp, Homo sapiens
tctcatacgtccaccat

SEQ ID NO: 6467281 - DNA, 18 bp, Homo sapiens
tctcatactcacctcacc

SEQ ID NO: 6467282 - DNA, 13 bp, Homo sapiens
tctcatactgtct

SEQ ID NO: 6467283 - DNA, 15 bp, Homo sapiens
tctcatagaacattg

SEQ ID NO: 6467284 - DNA, 22 bp, Homo sapiens
tctcatagaggaaattcaaatc

SEQ ID NO: 6467285 - DNA, 14 bp, Homo sapiens
tctcatagatgacc

SEQ ID NO: 6467286 - DNA, 13 bp, Homo sapiens
tctcatagcatta

SEQ ID NO: 6467287 - DNA, 19 bp, Homo sapiens
tctcataggaaaagtacat

SEQ ID NO: 6467288 - DNA, 16 bp, Homo sapiens
tctcataggagactgc

SEQ ID NO: 6467289 - DNA, 17 bp, Homo sapiens
tctcataggttaaaaaa

SEQ ID NO: 6467290 - DNA, 21 bp, Homo sapiens
tctcatatatagacagctttg

SEQ ID NO: 6467291 - DNA, 22 bp, Homo sapiens
tctcatatatagacagctttga

SEQ ID NO: 6467292 - DNA, 22 bp, Homo sapiens
tctcatatatattttaaaaaca

SEQ ID NO: 6467293 - DNA, 11 bp, Homo sapiens
tctcatatatt

SEQ ID NO: 6467294 - DNA, 16 bp, Homo sapiens
tctcatatcactgaag

SEQ ID NO: 6467295 - DNA, 20 bp, Homo sapiens
tctcatatccataaaattgg

SEQ ID NO: 6467296 - DNA, 15 bp, Homo sapiens
tctcatatctaactt

SEQ ID NO: 6467297 - DNA, 20 bp, Homo sapiens
tctcatatgccaccccatgt

SEQ ID NO: 6467298 - DNA, 18 bp, Homo sapiens
tctcatatgtagccctca

SEQ ID NO: 6467299 - DNA, 22 bp, Homo sapiens
tctcatattcgctagtgtttaa

SEQ ID NO: 6467300 - DNA, 19 bp, Homo sapiens
tctcatatttttacaaata

SEQ ID NO: 6467301 - DNA, 14 bp, Homo sapiens
tctcatcacacaca

SEQ ID NO: 6467302 - DNA, 21 bp, Homo sapiens
tctcatcacagtgggaagaat

SEQ ID NO: 6467303 - DNA, 15 bp, Homo sapiens
tctcatcagaaatgt

SEQ ID NO: 6467304 - DNA, 14 bp, Homo sapiens
tctcatcagcccag

SEQ ID NO: 6467305 - DNA, 23 bp, Homo sapiens
tctcatcagcccaggtcccagtg

SEQ ID NO: 6467306 - DNA, 19 bp, Homo sapiens
tctcatcaggcaaattgta

SEQ ID NO: 6467307 - DNA, 16 bp, Homo sapiens
tctcatcatattgtat

SEQ ID NO: 6467308 - DNA, 18 bp, Homo sapiens
tctcatcatgtctattgt

SEQ ID NO: 6467309 - DNA, 13 bp, Homo sapiens
tctcatccatcat

SEQ ID NO: 6467310 - DNA, 13 bp, Homo sapiens
tctcatcccagtc

SEQ ID NO: 6467311 - DNA, 16 bp, Homo sapiens
tctcatcccagtcctg

SEQ ID NO: 6467312 - DNA, 17 bp, Homo sapiens
tctcatccccccacccg

SEQ ID NO: 6467313 - DNA, 21 bp, Homo sapiens
tctcatcctccagtaccttgc

SEQ ID NO: 6467314 - DNA, 14 bp, Homo sapiens
tctcatcctcccat

SEQ ID NO: 6467315 - DNA, 13 bp, Homo sapiens
tctcatcctcctg

SEQ ID NO: 6467316 - DNA, 14 bp, Homo sapiens
tctcatcctcctgg

SEQ ID NO: 6467317 - DNA, 15 bp, Homo sapiens
tctcatcctcctttc

SEQ ID NO: 6467318 - DNA, 20 bp, Homo sapiens
tctcatcggaggcccatgcc

SEQ ID NO: 6467319 - DNA, 18 bp, Homo sapiens
tctcatcgtcttttagtt

SEQ ID NO: 6467320 - DNA, 14 bp, Homo sapiens
tctcatctcccagg

SEQ ID NO: 6467321 - DNA, 15 bp, Homo sapiens
tctcatctcccaggc

SEQ ID NO: 6467322 - DNA, 16 bp, Homo sapiens
tctcatctcccaggcc

SEQ ID NO: 6467323 - DNA, 16 bp, Homo sapiens
tctcatctcctgaccc

SEQ ID NO: 6467324 - DNA, 23 bp, Homo sapiens
tctcatctcctgaccctcccact

SEQ ID NO: 6467325 - DNA, 17 bp, Homo sapiens
tctcatctcctttgcta

SEQ ID NO: 6467326 - DNA, 14 bp, Homo sapiens
tctcatctcttcag

SEQ ID NO: 6467327 - DNA, 13 bp, Homo sapiens
tctcatctgaggc

SEQ ID NO: 6467328 - DNA, 21 bp, Homo sapiens
tctcatctgatcacttcatgt

SEQ ID NO: 6467329 - DNA, 15 bp, Homo sapiens
tctcatctgcaccct

SEQ ID NO: 6467330 - DNA, 22 bp, Homo sapiens
tctcatctgcacccttcttttc

SEQ ID NO: 6467331 - DNA, 15 bp, Homo sapiens
tctcatctgccggcc

SEQ ID NO: 6467332 - DNA, 22 bp, Homo sapiens
tctcatctggggagcaggcagc

SEQ ID NO: 6467333 - DNA, 21 bp, Homo sapiens
tctcatctgtaaaaccaggct

SEQ ID NO: 6467334 - DNA, 14 bp, Homo sapiens
tctcatcttctctc

SEQ ID NO: 6467335 - DNA, 23 bp, Homo sapiens
tctcatcttgtaaataatgctta

SEQ ID NO: 6467336 - DNA, 15 bp, Homo sapiens
tctcatcttgtgaaa

SEQ ID NO: 6467337 - DNA, 16 bp, Homo sapiens
tctcatcttgttcttc

SEQ ID NO: 6467338 - DNA, 12 bp, Homo sapiens
tctcatctttct

SEQ ID NO: 6467339 - DNA, 22 bp, Homo sapiens
tctcatctttcttgatcaacat

SEQ ID NO: 6467340 - DNA, 14 bp, Homo sapiens
tctcatcttttatc

SEQ ID NO: 6467341 - DNA, 16 bp, Homo sapiens
tctcatgaagcaggag

SEQ ID NO: 6467342 - DNA, 14 bp, Homo sapiens
tctcatgaatctgc

SEQ ID NO: 6467343 - DNA, 14 bp, Homo sapiens
tctcatgacattat

SEQ ID NO: 6467344 - DNA, 22 bp, Homo sapiens
tctcatgacggcttttgtcagt

SEQ ID NO: 6467345 - DNA, 16 bp, Homo sapiens
tctcatgaggggagag

SEQ ID NO: 6467346 - DNA, 16 bp, Homo sapiens
tctcatgattccatgc

SEQ ID NO: 6467347 - DNA, 19 bp, Homo sapiens
tctcatgccagcagcacgt

SEQ ID NO: 6467348 - DNA, 20 bp, Homo sapiens
tctcatgccagtaacaggct

SEQ ID NO: 6467349 - DNA, 18 bp, Homo sapiens
tctcatgcccctggctgg

SEQ ID NO: 6467350 - DNA, 16 bp, Homo sapiens
tctcatgcctcagcct

SEQ ID NO: 6467351 - DNA, 12 bp, Homo sapiens
tctcatgcctcc

SEQ ID NO: 6467352 - DNA, 22 bp, Homo sapiens
tctcatgcctcctgaggctgtt

SEQ ID NO: 6467353 - DNA, 16 bp, Homo sapiens
tctcatgctatttcta

SEQ ID NO: 6467354 - DNA, 18 bp, Homo sapiens
tctcatggaaactggcca

SEQ ID NO: 6467355 - DNA, 17 bp, Homo sapiens
tctcatgggaaggggag

SEQ ID NO: 6467356 - DNA, 12 bp, Homo sapiens
tctcatggtatt

SEQ ID NO: 6467357 - DNA, 16 bp, Homo sapiens
tctcatgtaaaataag

SEQ ID NO: 6467358 - DNA, 21 bp, Homo sapiens
tctcatgtaatttgcattact

SEQ ID NO: 6467359 - DNA, 18 bp, Homo sapiens
tctcatgtatcatctgga

SEQ ID NO: 6467360 - DNA, 12 bp, Homo sapiens
tctcatgtatct

SEQ ID NO: 6467361 - DNA, 20 bp, Homo sapiens
tctcatgtctcagcctcctc

SEQ ID NO: 6467362 - DNA, 14 bp, Homo sapiens
tctcatgtgatcct

SEQ ID NO: 6467363 - DNA, 16 bp, Homo sapiens
tctcatgtgatccttt

SEQ ID NO: 6467364 - DNA, 19 bp, Homo sapiens
tctcatgtgatccttttat

SEQ ID NO: 6467365 - DNA, 16 bp, Homo sapiens
tctcatgtgctttgta

SEQ ID NO: 6467366 - DNA, 15 bp, Homo sapiens
tctcatgttaaatat

SEQ ID NO: 6467367 - DNA, 18 bp, Homo sapiens
tctcatgttccttttgaa

SEQ ID NO: 6467368 - DNA, 17 bp, Homo sapiens
tctcatgttttatatga

SEQ ID NO: 6467369 - DNA, 19 bp, Homo sapiens
tctcattaatactctttat

SEQ ID NO: 6467370 - DNA, 23 bp, Homo sapiens
tctcattaatactctttatttat

SEQ ID NO: 6467371 - DNA, 20 bp, Homo sapiens
tctcattaattcaattaaaa

SEQ ID NO: 6467372 - DNA, 16 bp, Homo sapiens
tctcattacccacccg

SEQ ID NO: 6467373 - DNA, 23 bp, Homo sapiens
tctcattactgcttcatttttgt

SEQ ID NO: 6467374 - DNA, 17 bp, Homo sapiens
tctcattccaacagtga

SEQ ID NO: 6467375 - DNA, 19 bp, Homo sapiens
tgcatactttgacaaggaa

SEQ ID NO: 6467376 - DNA, 20 bp, Homo sapiens
tgcatactttgacaaggaaa

SEQ ID NO: 6467377 - DNA, 23 bp, Homo sapiens
tgcatactttttaaatgtaaaga

SEQ ID NO: 6467378 - DNA, 13 bp, Homo sapiens
tgcatagaaggag

SEQ ID NO: 6467379 - DNA, 17 bp, Homo sapiens
tgcatagaaggaggaga

SEQ ID NO: 6467380 - DNA, 16 bp, Homo sapiens
tgcatagaataatgaa

SEQ ID NO: 6467381 - DNA, 22 bp, Homo sapiens
tgcatagaataatgaagatctt

SEQ ID NO: 6467382 - DNA, 12 bp, Homo sapiens
tgcatagagcaa

SEQ ID NO: 6467383 - DNA, 15 bp, Homo sapiens
tgcatagagcaatta

SEQ ID NO: 6467384 - DNA, 16 bp, Homo sapiens
tgcatagagccctggc

SEQ ID NO: 6467385 - DNA, 19 bp, Homo sapiens
tgcatagaggtaccagcaa

SEQ ID NO: 6467386 - DNA, 16 bp, Homo sapiens
tgcatagcagtatatg

SEQ ID NO: 6467387 - DNA, 14 bp, Homo sapiens
tgcatagcgtcctg

SEQ ID NO: 6467388 - DNA, 18 bp, Homo sapiens
tgcatagcgtcctgccct

SEQ ID NO: 6467389 - DNA, 15 bp, Homo sapiens
tgcatagctctattt

SEQ ID NO: 6467390 - DNA, 20 bp, Homo sapiens
tgcatagcttttccctgtcc

SEQ ID NO: 6467391 - DNA, 20 bp, Homo sapiens
tgcataggttagatatagag

SEQ ID NO: 6467392 - DNA, 16 bp, Homo sapiens
tgcataggtttagcag

SEQ ID NO: 6467393 - DNA, 22 bp, Homo sapiens
tgcatagtaaatgtagttcata

SEQ ID NO: 6467394 - DNA, 14 bp, Homo sapiens
tgcatagtattcca

SEQ ID NO: 6467395 - DNA, 16 bp, Homo sapiens
tgcatagtcccagcta

SEQ ID NO: 6467396 - DNA, 16 bp, Homo sapiens
tgcatagtgctaagaa

SEQ ID NO: 6467397 - DNA, 18 bp, Homo sapiens
tgcatagttgtagacaaa

SEQ ID NO: 6467398 - DNA, 14 bp, Homo sapiens
tgcatagtttcttt

SEQ ID NO: 6467399 - DNA, 22 bp, Homo sapiens
tgcatataaaggttatgaaaca

SEQ ID NO: 6467400 - DNA, 21 bp, Homo sapiens
tgcatataacttatattgtaa

SEQ ID NO: 6467401 - DNA, 16 bp, Homo sapiens
tgcatataatgaataa

SEQ ID NO: 6467402 - DNA, 17 bp, Homo sapiens
tgcatataatgaataaa

SEQ ID NO: 6467403 - DNA, 13 bp, Homo sapiens
tgcatatagacac

SEQ ID NO: 6467404 - DNA, 17 bp, Homo sapiens
tgcatatagttaaactg

SEQ ID NO: 6467405 - DNA, 21 bp, Homo sapiens
tgcatatagttaaactgagag

SEQ ID NO: 6467406 - DNA, 17 bp, Homo sapiens
tgcatatatatatgtgt

SEQ ID NO: 6467407 - DNA, 13 bp, Homo sapiens
tgcatatatatgt

SEQ ID NO: 6467408 - DNA, 17 bp, Homo sapiens
tgcatatatatgtatat

SEQ ID NO: 6467409 - DNA, 18 bp, Homo sapiens
tgcatatcacccttccct

SEQ ID NO: 6467410 - DNA, 20 bp, Homo sapiens
tgcatatcacccttccctgc

SEQ ID NO: 6467411 - DNA, 18 bp, Homo sapiens
tgcatatcattaaacaaa

SEQ ID NO: 6467412 - DNA, 21 bp, Homo sapiens
tgcatatcctggtgtctagtt

SEQ ID NO: 6467413 - DNA, 17 bp, Homo sapiens
tgcatatcgctgggctc

SEQ ID NO: 6467414 - DNA, 18 bp, Homo sapiens
tgcatatctctagtccct

SEQ ID NO: 6467415 - DNA, 14 bp, Homo sapiens
tgcatatctgttta

SEQ ID NO: 6467416 - DNA, 14 bp, Homo sapiens
tgcatatgcaatgt

SEQ ID NO: 6467417 - DNA, 18 bp, Homo sapiens
tgcatatgctacacatat

SEQ ID NO: 6467418 - DNA, 16 bp, Homo sapiens
tgcatatggcaacgtt

SEQ ID NO: 6467419 - DNA, 24 bp, Homo sapiens
tgcatatggcaacgttcatgttca

SEQ ID NO: 6467420 - DNA, 12 bp, Homo sapiens
tgcatatgtatg

SEQ ID NO: 6467421 - DNA, 19 bp, Homo sapiens
tgcatatgtcactagaatg

SEQ ID NO: 6467422 - DNA, 20 bp, Homo sapiens
tgcatatgttaaagcttatt

SEQ ID NO: 6467423 - DNA, 19 bp, Homo sapiens
tgcatatgttgaatacttt

SEQ ID NO: 6467424 - DNA, 22 bp, Homo sapiens
tgcatatgttttccacataaat

SEQ ID NO: 6467425 - DNA, 13 bp, Homo sapiens
tgcatattataaa

SEQ ID NO: 6467426 - DNA, 22 bp, Homo sapiens
tgcatattctagtaataaagac

SEQ ID NO: 6467427 - DNA, 15 bp, Homo sapiens
tgcatattctattgt

SEQ ID NO: 6467428 - DNA, 23 bp, Homo sapiens
tgcatattctattgtattatttg

SEQ ID NO: 6467429 - DNA, 22 bp, Homo sapiens
tgcatattctctattttacttt

SEQ ID NO: 6467430 - DNA, 15 bp, Homo sapiens
tgcatattgtacact

SEQ ID NO: 6467431 - DNA, 16 bp, Homo sapiens
tgcatattgtacactt

SEQ ID NO: 6467432 - DNA, 16 bp, Homo sapiens
tgcatattgtattact

SEQ ID NO: 6467433 - DNA, 20 bp, Homo sapiens
tgcatattgtattactagaa

SEQ ID NO: 6467434 - DNA, 15 bp, Homo sapiens
tgcatatttagctgt

SEQ ID NO: 6467435 - DNA, 16 bp, Homo sapiens
tgcatatttagctgtt

SEQ ID NO: 6467436 - DNA, 20 bp, Homo sapiens
tgcatatttataaaaataaa

SEQ ID NO: 6467437 - DNA, 21 bp, Homo sapiens
tgcatatttataaaaataaaa

SEQ ID NO: 6467438 - DNA, 19 bp, Homo sapiens
tgcatatttataagagaag

SEQ ID NO: 6467439 - DNA, 14 bp, Homo sapiens
tgcatatttataga

SEQ ID NO: 6467440 - DNA, 19 bp, Homo sapiens
tgcatatttgcaaagtgta

SEQ ID NO: 6467441 - DNA, 24 bp, Homo sapiens
tgcatattttgtaacttccatgtg

SEQ ID NO: 6467442 - DNA, 14 bp, Homo sapiens
tgcatcaaccagga

SEQ ID NO: 6467443 - DNA, 17 bp, Homo sapiens
tgcatcaaccaggaaga

SEQ ID NO: 6467444 - DNA, 13 bp, Homo sapiens
tgcatcaaggggt

SEQ ID NO: 6467445 - DNA, 17 bp, Homo sapiens
tgcatcacactcaagga

SEQ ID NO: 6467446 - DNA, 20 bp, Homo sapiens
tgcatcacactcaaggacag

SEQ ID NO: 6467447 - DNA, 21 bp, Homo sapiens
tgcatcacactcaaggacagg

SEQ ID NO: 6467448 - DNA, 14 bp, Homo sapiens
tgcatcacatctgc

SEQ ID NO: 6467449 - DNA, 16 bp, Homo sapiens
tgcatcacctctgtaa

SEQ ID NO: 6467450 - DNA, 19 bp, Homo sapiens
tgcatcactgggtgttgat

SEQ ID NO: 6467451 - DNA, 19 bp, Homo sapiens
tgcatcagaaagctttatt

SEQ ID NO: 6467452 - DNA, 23 bp, Homo sapiens
tgcatcagaaagggagggctctg

SEQ ID NO: 6467453 - DNA, 14 bp, Homo sapiens
tgcatcagaaatgt

SEQ ID NO: 6467454 - DNA, 18 bp, Homo sapiens
tgcatcagcctctggcca

SEQ ID NO: 6467455 - DNA, 19 bp, Homo sapiens
tgcatcagcctctggccag

SEQ ID NO: 6467456 - DNA, 22 bp, Homo sapiens
tgcatcagctgctgaaacaaca

SEQ ID NO: 6467457 - DNA, 18 bp, Homo sapiens
tgcatcagctttttgtat

SEQ ID NO: 6467458 - DNA, 23 bp, Homo sapiens
tgcatcagtgactgaattctgcc

SEQ ID NO: 6467459 - DNA, 22 bp, Homo sapiens
tgcatcatagaacagaaatata

SEQ ID NO: 6467460 - DNA, 18 bp, Homo sapiens
tgcatcatagacgagaca

SEQ ID NO: 6467461 - DNA, 13 bp, Homo sapiens
tgcatcatatatt

SEQ ID NO: 6467462 - DNA, 16 bp, Homo sapiens
tgcatcatctgtagat

SEQ ID NO: 6467463 - DNA, 17 bp, Homo sapiens
tgcatcatctgtagata

SEQ ID NO: 6467464 - DNA, 14 bp, Homo sapiens
tgcatcatctgttt

SEQ ID NO: 6467465 - DNA, 18 bp, Homo sapiens
tgcatcatctgtttgtaa

SEQ ID NO: 6467466 - DNA, 16 bp, Homo sapiens
tgcatccaaaggtgct

SEQ ID NO: 6467467 - DNA, 17 bp, Homo sapiens
tgcatccacaggattcc

SEQ ID NO: 6467468 - DNA, 18 bp, Homo sapiens
tgcatccacaggattcca

SEQ ID NO: 6467469 - DNA, 16 bp, Homo sapiens
tgcatccacttcagga

SEQ ID NO: 6467470 - DNA, 19 bp, Homo sapiens
tgcatccacttcaggagcc

SEQ ID NO: 6467471 - DNA, 20 bp, Homo sapiens
tgcatccagcagcagcactt

SEQ ID NO: 6467472 - DNA, 21 bp, Homo sapiens
tgcatccagcctggggctgag

SEQ ID NO: 6467473 - DNA, 13 bp, Homo sapiens
tgcatccaggcct

SEQ ID NO: 6467474 - DNA, 17 bp, Homo sapiens
tgcatccaggcctgagg

SEQ ID NO: 6467475 - DNA, 15 bp, Homo sapiens
tgcatccattgttgt

SEQ ID NO: 6467476 - DNA, 13 bp, Homo sapiens
tgcatcccacagc

SEQ ID NO: 6467477 - DNA, 14 bp, Homo sapiens
tgcatcccacagcc

SEQ ID NO: 6467478 - DNA, 16 bp, Homo sapiens
tgcatcccacagccag

SEQ ID NO: 6467479 - DNA, 19 bp, Homo sapiens
tgcatcccacgttctgtta

SEQ ID NO: 6467480 - DNA, 12 bp, Homo sapiens
tgcatcccagca

SEQ ID NO: 6467481 - DNA, 23 bp, Homo sapiens
tgcatccccacgacccctgcctc

SEQ ID NO: 6467482 - DNA, 23 bp, Homo sapiens
tgcatccccatccccatgccctc

SEQ ID NO: 6467483 - DNA, 21 bp, Homo sapiens
tgcatcccccagcactgatgt

SEQ ID NO: 6467484 - DNA, 17 bp, Homo sapiens
tgcatcccccccacctc

SEQ ID NO: 6467485 - DNA, 17 bp, Homo sapiens
tgcatcccccttagaat

SEQ ID NO: 6467486 - DNA, 16 bp, Homo sapiens
tgcatccccttggctg

SEQ ID NO: 6467487 - DNA, 15 bp, Homo sapiens
tgcatccctccaccc

SEQ ID NO: 6467488 - DNA, 23 bp, Homo sapiens
tgcatccctccaccccagtcccc

SEQ ID NO: 6467489 - DNA, 15 bp, Homo sapiens
tgcatccggagaatt

SEQ ID NO: 6467490 - DNA, 21 bp, Homo sapiens
tgcatccggagaattgcctct

SEQ ID NO: 6467491 - DNA, 19 bp, Homo sapiens
tgcatccgtagttccctga

SEQ ID NO: 6467492 - DNA, 18 bp, Homo sapiens
tgcatcctcagccccagg

SEQ ID NO: 6467493 - DNA, 15 bp, Homo sapiens
tgcatcctccaagaa

SEQ ID NO: 6467494 - DNA, 14 bp, Homo sapiens
tgcatcctccgcct

SEQ ID NO: 6467495 - DNA, 21 bp, Homo sapiens
tgcatcctccgcctcccgggt

SEQ ID NO: 6467496 - DNA, 15 bp, Homo sapiens
tgcatcctcctcagc

SEQ ID NO: 6467497 - DNA, 21 bp, Homo sapiens
tgcatcctcctcagcccccag

SEQ ID NO: 6467498 - DNA, 22 bp, Homo sapiens
tgcatcctctggagccagccga

SEQ ID NO: 6467499 - DNA, 15 bp, Homo sapiens
tgcatccttcatcac

SEQ ID NO: 6467500 - DNA, 13 bp, Homo sapiens
tgcatccttccta

SEQ ID NO: 6467501 - DNA, 14 bp, Homo sapiens
tgcatccttcctat

SEQ ID NO: 6467502 - DNA, 13 bp, Homo sapiens
tgcatccttgtaa

SEQ ID NO: 6467503 - DNA, 14 bp, Homo sapiens
tgcatccttgtaat

SEQ ID NO: 6467504 - DNA, 20 bp, Homo sapiens
tgcatccttgtaatacctga

SEQ ID NO: 6467505 - DNA, 22 bp, Homo sapiens
tgcatcgagtcaaaactcaaat

SEQ ID NO: 6467506 - DNA, 23 bp, Homo sapiens
tgcatcggactaaactatctgta

SEQ ID NO: 6467507 - DNA, 14 bp, Homo sapiens
tgcatcgggaaaga

SEQ ID NO: 6467508 - DNA, 14 bp, Homo sapiens
tgcatcgtcccctc

SEQ ID NO: 6467509 - DNA, 14 bp, Homo sapiens
tgcatcgtggagac

SEQ ID NO: 6467510 - DNA, 17 bp, Homo sapiens
tgcatcgtttcatcttc

SEQ ID NO: 6467511 - DNA, 19 bp, Homo sapiens
tgcatcgttttctttgctg

SEQ ID NO: 6467512 - DNA, 14 bp, Homo sapiens
tgcatctaatgaaa

SEQ ID NO: 6467513 - DNA, 18 bp, Homo sapiens
tgcatctaatgaaaaaca

SEQ ID NO: 6467514 - DNA, 20 bp, Homo sapiens
tgcatctaatgaaaaacaaa

SEQ ID NO: 6467515 - DNA, 16 bp, Homo sapiens
tgcatctactcaggcc

SEQ ID NO: 6467516 - DNA, 19 bp, Homo sapiens
tgcatctactcccaagtat

SEQ ID NO: 6467517 - DNA, 18 bp, Homo sapiens
tgcatctagcctcaagct

SEQ ID NO: 6467518 - DNA, 16 bp, Homo sapiens
tgcatctagctggagc

SEQ ID NO: 6467519 - DNA, 13 bp, Homo sapiens
tgcatctcctccc

SEQ ID NO: 6467520 - DNA, 18 bp, Homo sapiens
tgcatctgaaagttttga

SEQ ID NO: 6467521 - DNA, 19 bp, Homo sapiens
tgcatctgaaagttttgat

SEQ ID NO: 6467522 - DNA, 22 bp, Homo sapiens
tgcatctgaaataggaaacaag

SEQ ID NO: 6467523 - DNA, 15 bp, Homo sapiens
tgcatctgaccccgg

SEQ ID NO: 6467524 - DNA, 14 bp, Homo sapiens
tgcatctgactctc

SEQ ID NO: 6467525 - DNA, 21 bp, Homo sapiens
tgcatctgcaggcaccgggct

SEQ ID NO: 6467526 - DNA, 23 bp, Homo sapiens
tgcatctggcacgtggccaggag

SEQ ID NO: 6467527 - DNA, 13 bp, Homo sapiens
tgcatctggccta

SEQ ID NO: 6467528 - DNA, 23 bp, Homo sapiens
tgcatctggcctatgaccctgtg

SEQ ID NO: 6467529 - DNA, 19 bp, Homo sapiens
tgcatctgggattcccacc

SEQ ID NO: 6467530 - DNA, 18 bp, Homo sapiens
tgcatctgggccagaagt

SEQ ID NO: 6467531 - DNA, 18 bp, Homo sapiens
tgcatctgggtagctgta

SEQ ID NO: 6467532 - DNA, 21 bp, Homo sapiens
tgcatctgggtagctgtaagg

SEQ ID NO: 6467533 - DNA, 21 bp, Homo sapiens
tgcatctgtataagtaagaaa

SEQ ID NO: 6467534 - DNA, 23 bp, Homo sapiens
tgcatctgtataagtaagaaaat

SEQ ID NO: 6467535 - DNA, 19 bp, Homo sapiens
tgcatctgtcctcatgtgt

SEQ ID NO: 6467536 - DNA, 16 bp, Homo sapiens
tgcatctgtctgctct

SEQ ID NO: 6467537 - DNA, 17 bp, Homo sapiens
tgcatctgtctgctctg

SEQ ID NO: 6467538 - DNA, 18 bp, Homo sapiens
tgcatctgtctgctctgc

SEQ ID NO: 6467539 - DNA, 22 bp, Homo sapiens
tgcatcttactgaaggtaaaat

SEQ ID NO: 6467540 - DNA, 13 bp, Homo sapiens
tgcatcttagttt

SEQ ID NO: 6467541 - DNA, 19 bp, Homo sapiens
tgcatcttgctctgtggcc

SEQ ID NO: 6467542 - DNA, 12 bp, Homo sapiens
tgcatctttcat

SEQ ID NO: 6467543 - DNA, 20 bp, Homo sapiens
tgcatctttcatagttctgt

SEQ ID NO: 6467544 - DNA, 15 bp, Homo sapiens
tgcatctttctcttc

SEQ ID NO: 6467545 - DNA, 12 bp, Homo sapiens
tgcatctttgag

SEQ ID NO: 6467546 - DNA, 17 bp, Homo sapiens
tgcatctttgagaatat

SEQ ID NO: 6467547 - DNA, 14 bp, Homo sapiens
tgcatctttgcctc

SEQ ID NO: 6467548 - DNA, 15 bp, Homo sapiens
tgcatgaaagcattc

SEQ ID NO: 6467549 - DNA, 21 bp, Homo sapiens
tgcatgaaattgtatctcagt

SEQ ID NO: 6467550 - DNA, 13 bp, Homo sapiens
tgcatgaacaggg

SEQ ID NO: 6467551 - DNA, 20 bp, Homo sapiens
tgcatgaacagggtccctgg

SEQ ID NO: 6467552 - DNA, 16 bp, Homo sapiens
tgcatgaagagaagca

SEQ ID NO: 6467553 - DNA, 19 bp, Homo sapiens
tctcattccaacagtgagt

SEQ ID NO: 6467554 - DNA, 10 bp, Homo sapiens
tctcattccc

SEQ ID NO: 6467555 - DNA, 18 bp, Homo sapiens
tctcattcccatgtggaa

SEQ ID NO: 6467556 - DNA, 21 bp, Homo sapiens
tctcattcccatgtggaacag

SEQ ID NO: 6467557 - DNA, 14 bp, Homo sapiens
tctcattccccagg

SEQ ID NO: 6467558 - DNA, 22 bp, Homo sapiens
tctcattcgcctttgtcttgta

SEQ ID NO: 6467559 - DNA, 16 bp, Homo sapiens
tctcattctctttctt

SEQ ID NO: 6467560 - DNA, 18 bp, Homo sapiens
tctcattctgttgcccag

SEQ ID NO: 6467561 - DNA, 20 bp, Homo sapiens
tctcattctgttgcccaggc

SEQ ID NO: 6467562 - DNA, 23 bp, Homo sapiens
tctcattctgttgcccaggctgg

SEQ ID NO: 6467563 - DNA, 12 bp, Homo sapiens
tctcattcttgc

SEQ ID NO: 6467564 - DNA, 12 bp, Homo sapiens
tctcattcttgt

SEQ ID NO: 6467565 - DNA, 22 bp, Homo sapiens
tctcattgacttttataaagca

SEQ ID NO: 6467566 - DNA, 15 bp, Homo sapiens
tctcattgatcacag

SEQ ID NO: 6467567 - DNA, 22 bp, Homo sapiens
tctcattgatcacagatgtgcc

SEQ ID NO: 6467568 - DNA, 14 bp, Homo sapiens
tctcattgccaagg

SEQ ID NO: 6467569 - DNA, 17 bp, Homo sapiens
tctcattgccaaggcat

SEQ ID NO: 6467570 - DNA, 21 bp, Homo sapiens
tctcattggaaatttagcatt

SEQ ID NO: 6467571 - DNA, 14 bp, Homo sapiens
tctcattgtcacct

SEQ ID NO: 6467572 - DNA, 19 bp, Homo sapiens
tctcattgttcaattccca

SEQ ID NO: 6467573 - DNA, 16 bp, Homo sapiens
tctcatttaatcctct

SEQ ID NO: 6467574 - DNA, 22 bp, Homo sapiens
tctcatttagcctgtcctgtca

SEQ ID NO: 6467575 - DNA, 15 bp, Homo sapiens
tctcatttatgttat

SEQ ID NO: 6467576 - DNA, 22 bp, Homo sapiens
tctcatttatgttatttatgat

SEQ ID NO: 6467577 - DNA, 16 bp, Homo sapiens
tctcatttcacccctc

SEQ ID NO: 6467578 - DNA, 15 bp, Homo sapiens
tctcatttccaagca

SEQ ID NO: 6467579 - DNA, 17 bp, Homo sapiens
tctcatttccagcttct

SEQ ID NO: 6467580 - DNA, 22 bp, Homo sapiens
tctcatttctcaacagttcatt

SEQ ID NO: 6467581 - DNA, 16 bp, Homo sapiens
tctcatttgggcacct

SEQ ID NO: 6467582 - DNA, 16 bp, Homo sapiens
tctcatttgggctaga

SEQ ID NO: 6467583 - DNA, 17 bp, Homo sapiens
tctcattttaaacaact

SEQ ID NO: 6467584 - DNA, 16 bp, Homo sapiens
tctcattttaatgtaa

SEQ ID NO: 6467585 - DNA, 19 bp, Homo sapiens
tctcattttaatgtaaaga

SEQ ID NO: 6467586 - DNA, 21 bp, Homo sapiens
tctcattttatttacagctgt

SEQ ID NO: 6467587 - DNA, 13 bp, Homo sapiens
tctcattttctca

SEQ ID NO: 6467588 - DNA, 15 bp, Homo sapiens
tctcattttgtatgt

SEQ ID NO: 6467589 - DNA, 22 bp, Homo sapiens
tctcattttgtatgtatgtgta

SEQ ID NO: 6467590 - DNA, 19 bp, Homo sapiens
tctcattttgtccatgtcc

SEQ ID NO: 6467591 - DNA, 20 bp, Homo sapiens
tctcattttgtccatgtccc

SEQ ID NO: 6467592 - DNA, 21 bp, Homo sapiens
tctcatttttccgtaaaaatg

SEQ ID NO: 6467593 - DNA, 16 bp, Homo sapiens
tctcattttttcctga

SEQ ID NO: 6467594 - DNA, 13 bp, Homo sapiens
tctccaaaaacag

SEQ ID NO: 6467595 - DNA, 16 bp, Homo sapiens
tctccaaactgattaa

SEQ ID NO: 6467596 - DNA, 13 bp, Homo sapiens
tctccaaagaaga

SEQ ID NO: 6467597 - DNA, 11 bp, Homo sapiens
tctccaaagct

SEQ ID NO: 6467598 - DNA, 12 bp, Homo sapiens
tctccaaagctt

SEQ ID NO: 6467599 - DNA, 21 bp, Homo sapiens
tctccaaagcttgccactttc

SEQ ID NO: 6467600 - DNA, 21 bp, Homo sapiens
tctccaaagctttcctggaga

SEQ ID NO: 6467601 - DNA, 18 bp, Homo sapiens
tctccaaaggcactgacc

SEQ ID NO: 6467602 - DNA, 22 bp, Homo sapiens
tctccaaatatcagtgggctct

SEQ ID NO: 6467603 - DNA, 24 bp, Homo sapiens
tctccaaatattattcaagtgcct

SEQ ID NO: 6467604 - DNA, 18 bp, Homo sapiens
tctccaaatgattttcat

SEQ ID NO: 6467605 - DNA, 20 bp, Homo sapiens
tctccaacatcacagcccag

SEQ ID NO: 6467606 - DNA, 20 bp, Homo sapiens
tctccaaccactgtgccact

SEQ ID NO: 6467607 - DNA, 23 bp, Homo sapiens
tctccaaccccccagcactgagg

SEQ ID NO: 6467608 - DNA, 23 bp, Homo sapiens
tctccaaccccggaaaacattgc

SEQ ID NO: 6467609 - DNA, 16 bp, Homo sapiens
tctccaactttatttt

SEQ ID NO: 6467610 - DNA, 22 bp, Homo sapiens
tctccaactttattttgaatgt

SEQ ID NO: 6467611 - DNA, 20 bp, Homo sapiens
tctccaagaatggaagcctg

SEQ ID NO: 6467612 - DNA, 15 bp, Homo sapiens
tctccaagacagcag

SEQ ID NO: 6467613 - DNA, 23 bp, Homo sapiens
tctccaagacagcagcagcctgc

SEQ ID NO: 6467614 - DNA, 22 bp, Homo sapiens
tctccaagataagcctgagcct

SEQ ID NO: 6467615 - DNA, 19 bp, Homo sapiens
tctccaagcactagccttc

SEQ ID NO: 6467616 - DNA, 17 bp, Homo sapiens
tctccaagcgcctggct

SEQ ID NO: 6467617 - DNA, 13 bp, Homo sapiens
tctccaaggaaat

SEQ ID NO: 6467618 - DNA, 17 bp, Homo sapiens
tctccaaggatcctctc

SEQ ID NO: 6467619 - DNA, 18 bp, Homo sapiens
tctccaaggatcctctcc

SEQ ID NO: 6467620 - DNA, 20 bp, Homo sapiens
tctccaagggagggtgcagc

SEQ ID NO: 6467621 - DNA, 23 bp, Homo sapiens
tctccaagggcttctgcaccctc

SEQ ID NO: 6467622 - DNA, 18 bp, Homo sapiens
tctccaagtagtccacct

SEQ ID NO: 6467623 - DNA, 17 bp, Homo sapiens
tctccaagtctctctgt

SEQ ID NO: 6467624 - DNA, 18 bp, Homo sapiens
tctccaagtctctctgtg

SEQ ID NO: 6467625 - DNA, 21 bp, Homo sapiens
tctccaagtgccagaggtggg

SEQ ID NO: 6467626 - DNA, 22 bp, Homo sapiens
tctccaagtggaaatcctattt

SEQ ID NO: 6467627 - DNA, 15 bp, Homo sapiens
tctccaatgctctgg

SEQ ID NO: 6467628 - DNA, 17 bp, Homo sapiens
tctccaatgctctggag

SEQ ID NO: 6467629 - DNA, 20 bp, Homo sapiens
tctccaattctgaaatactt

SEQ ID NO: 6467630 - DNA, 14 bp, Homo sapiens
tctccaattgtaaa

SEQ ID NO: 6467631 - DNA, 22 bp, Homo sapiens
tctccacaacactgtgtcacat

SEQ ID NO: 6467632 - DNA, 17 bp, Homo sapiens
tctccacaacagcctgg

SEQ ID NO: 6467633 - DNA, 18 bp, Homo sapiens
tctccacaacagcctggg

SEQ ID NO: 6467634 - DNA, 22 bp, Homo sapiens
tctccacacacagctgggctgt

SEQ ID NO: 6467635 - DNA, 15 bp, Homo sapiens
tctccacacaggtgt

SEQ ID NO: 6467636 - DNA, 15 bp, Homo sapiens
tctccacacccagcc

SEQ ID NO: 6467637 - DNA, 23 bp, Homo sapiens
tctccacacccagcctgtcccac

SEQ ID NO: 6467638 - DNA, 20 bp, Homo sapiens
tctccacacccatgactgcc

SEQ ID NO: 6467639 - DNA, 15 bp, Homo sapiens
tctccacacggagct

SEQ ID NO: 6467640 - DNA, 22 bp, Homo sapiens
tctccacacggagctcctggca

SEQ ID NO: 6467641 - DNA, 19 bp, Homo sapiens
tctccacactgctgctagg

SEQ ID NO: 6467642 - DNA, 14 bp, Homo sapiens
tctccacagcaacc

SEQ ID NO: 6467643 - DNA, 19 bp, Homo sapiens
tctccacagcaaccccagg

SEQ ID NO: 6467644 - DNA, 12 bp, Homo sapiens
tctccacagtgt

SEQ ID NO: 6467645 - DNA, 16 bp, Homo sapiens
tctccaccagacgcct

SEQ ID NO: 6467646 - DNA, 14 bp, Homo sapiens
tctccaccagccct

SEQ ID NO: 6467647 - DNA, 17 bp, Homo sapiens
tctccaccagccctact

SEQ ID NO: 6467648 - DNA, 18 bp, Homo sapiens
tctccaccaggaacctct

SEQ ID NO: 6467649 - DNA, 14 bp, Homo sapiens
tctccacccagagg

SEQ ID NO: 6467650 - DNA, 20 bp, Homo sapiens
tctccacccatgaccttttt

SEQ ID NO: 6467651 - DNA, 15 bp, Homo sapiens
tctccaccccagggt

SEQ ID NO: 6467652 - DNA, 11 bp, Homo sapiens
tctccaccccc

SEQ ID NO: 6467653 - DNA, 13 bp, Homo sapiens
tctccacccgctc

SEQ ID NO: 6467654 - DNA, 14 bp, Homo sapiens
tctccaccctccca

SEQ ID NO: 6467655 - DNA, 23 bp, Homo sapiens
tctccaccctcccagacctgcct

SEQ ID NO: 6467656 - DNA, 17 bp, Homo sapiens
tctccaccctgagcctg

SEQ ID NO: 6467657 - DNA, 14 bp, Homo sapiens
tctccaccctgctc

SEQ ID NO: 6467658 - DNA, 22 bp, Homo sapiens
tctccacctagtggctgtccag

SEQ ID NO: 6467659 - DNA, 14 bp, Homo sapiens
tctccacctcagcc

SEQ ID NO: 6467660 - DNA, 18 bp, Homo sapiens
tctccacctcagccttgg

SEQ ID NO: 6467661 - DNA, 13 bp, Homo sapiens
tctccacctcagg

SEQ ID NO: 6467662 - DNA, 23 bp, Homo sapiens
tctccacctcccccaaaccctgc

SEQ ID NO: 6467663 - DNA, 21 bp, Homo sapiens
tctccacctgagaccctggga

SEQ ID NO: 6467664 - DNA, 13 bp, Homo sapiens
tctccacctgcac

SEQ ID NO: 6467665 - DNA, 14 bp, Homo sapiens
tctccacctgcaca

SEQ ID NO: 6467666 - DNA, 14 bp, Homo sapiens
tctccacctgccag

SEQ ID NO: 6467667 - DNA, 19 bp, Homo sapiens
tctccacctgccagggaca

SEQ ID NO: 6467668 - DNA, 13 bp, Homo sapiens
tctccacctgctc

SEQ ID NO: 6467669 - DNA, 13 bp, Homo sapiens
tctccacctgtgc

SEQ ID NO: 6467670 - DNA, 16 bp, Homo sapiens
tctccacctgtgcttg

SEQ ID NO: 6467671 - DNA, 20 bp, Homo sapiens
tctccacgtctttcctgcta

SEQ ID NO: 6467672 - DNA, 22 bp, Homo sapiens
tctccactgctctcagcctccc

SEQ ID NO: 6467673 - DNA, 14 bp, Homo sapiens
tctccactgctgga

SEQ ID NO: 6467674 - DNA, 10 bp, Homo sapiens
tctccactgt

SEQ ID NO: 6467675 - DNA, 14 bp, Homo sapiens
tctccactgtttca

SEQ ID NO: 6467676 - DNA, 17 bp, Homo sapiens
tctccacttctggtccc

SEQ ID NO: 6467677 - DNA, 21 bp, Homo sapiens
tctccacttctggtcccctgt

SEQ ID NO: 6467678 - DNA, 22 bp, Homo sapiens
tctccacttctggtcccctgtg

SEQ ID NO: 6467679 - DNA, 15 bp, Homo sapiens
tctccactttcagct

SEQ ID NO: 6467680 - DNA, 17 bp, Homo sapiens
tctccactttcagctgt

SEQ ID NO: 6467681 - DNA, 19 bp, Homo sapiens
tctccactttcagctgtct

SEQ ID NO: 6467682 - DNA, 16 bp, Homo sapiens
tctccagaaaaatgaa

SEQ ID NO: 6467683 - DNA, 21 bp, Homo sapiens
tctccagaaaaatgaaaagca

SEQ ID NO: 6467684 - DNA, 18 bp, Homo sapiens
tctccagaaagccccacc

SEQ ID NO: 6467685 - DNA, 21 bp, Homo sapiens
tctccagaaccagtgtctgaa

SEQ ID NO: 6467686 - DNA, 13 bp, Homo sapiens
tctccagaatgta

SEQ ID NO: 6467687 - DNA, 11 bp, Homo sapiens
tctccagaccc

SEQ ID NO: 6467688 - DNA, 13 bp, Homo sapiens
tctccagacccag

SEQ ID NO: 6467689 - DNA, 21 bp, Homo sapiens
tctccagagagaaatcaggcc

SEQ ID NO: 6467690 - DNA, 22 bp, Homo sapiens
tctccagagagaaatcaggcct

SEQ ID NO: 6467691 - DNA, 17 bp, Homo sapiens
tctccagatagctgaat

SEQ ID NO: 6467692 - DNA, 15 bp, Homo sapiens
tctccagatgttaat

SEQ ID NO: 6467693 - DNA, 19 bp, Homo sapiens
tctccagatgtttccagac

SEQ ID NO: 6467694 - DNA, 14 bp, Homo sapiens
tctccagattttta

SEQ ID NO: 6467695 - DNA, 16 bp, Homo sapiens
tctccagatttttaat

SEQ ID NO: 6467696 - DNA, 11 bp, Homo sapiens
tctccagcagg

SEQ ID NO: 6467697 - DNA, 19 bp, Homo sapiens
tctccagcagttaggcacc

SEQ ID NO: 6467698 - DNA, 18 bp, Homo sapiens
tctccagcatcctgcttc

SEQ ID NO: 6467699 - DNA, 12 bp, Homo sapiens
tctccagccagc

SEQ ID NO: 6467700 - DNA, 13 bp, Homo sapiens
tctccagccagca

SEQ ID NO: 6467701 - DNA, 15 bp, Homo sapiens
tctccagcccacacc

SEQ ID NO: 6467702 - DNA, 13 bp, Homo sapiens
tctccagcccacg

SEQ ID NO: 6467703 - DNA, 21 bp, Homo sapiens
tctccagcccatgctggctgg

SEQ ID NO: 6467704 - DNA, 12 bp, Homo sapiens
tctccagcccct

SEQ ID NO: 6467705 - DNA, 13 bp, Homo sapiens
tctccagcccctg

SEQ ID NO: 6467706 - DNA, 18 bp, Homo sapiens
tctccagcccctggatgc

SEQ ID NO: 6467707 - DNA, 22 bp, Homo sapiens
tctccagcccctggatgcagcc

SEQ ID NO: 6467708 - DNA, 11 bp, Homo sapiens
tctccagcctc

SEQ ID NO: 6467709 - DNA, 20 bp, Homo sapiens
tctccagcctcacagatgct

SEQ ID NO: 6467710 - DNA, 18 bp, Homo sapiens
tctccagcctcagctctc

SEQ ID NO: 6467711 - DNA, 23 bp, Homo sapiens
tctccagcctggacccccagctt

SEQ ID NO: 6467712 - DNA, 21 bp, Homo sapiens
tctccagctcagaacccaggg

SEQ ID NO: 6467713 - DNA, 14 bp, Homo sapiens
tctccagctccaag

SEQ ID NO: 6467714 - DNA, 18 bp, Homo sapiens
tctccagctcctctccag

SEQ ID NO: 6467715 - DNA, 15 bp, Homo sapiens
tctccagctgatttt

SEQ ID NO: 6467716 - DNA, 13 bp, Homo sapiens
tctccagctgcct

SEQ ID NO: 6467717 - DNA, 15 bp, Homo sapiens
tctccagctgcctgg

SEQ ID NO: 6467718 - DNA, 16 bp, Homo sapiens
tctccagctgcctggg

SEQ ID NO: 6467719 - DNA, 11 bp, Homo sapiens
tctccagctgg

SEQ ID NO: 6467720 - DNA, 17 bp, Homo sapiens
tctccagctgggctctg

SEQ ID NO: 6467721 - DNA, 17 bp, Homo sapiens
tctccaggaagcccagg

SEQ ID NO: 6467722 - DNA, 20 bp, Homo sapiens
tctccaggaaggtagcccag

SEQ ID NO: 6467723 - DNA, 13 bp, Homo sapiens
tctccaggatcca

SEQ ID NO: 6467724 - DNA, 22 bp, Homo sapiens
tctccaggatggtgcaggatgg

SEQ ID NO: 6467725 - DNA, 16 bp, Homo sapiens
tctccaggcaccgcct

SEQ ID NO: 6467726 - DNA, 11 bp, Homo sapiens
tctccaggcca

SEQ ID NO: 6467727 - DNA, 12 bp, Homo sapiens
tctccaggccag

SEQ ID NO: 6467728 - DNA, 18 bp, Homo sapiens
tctccaggccatgatggc

SEQ ID NO: 6467729 - DNA, 11 bp, Homo sapiens
tctccaggccc

SEQ ID NO: 6467730 - DNA, 19 bp, Homo sapiens
tctccaggcccagcctggc

SEQ ID NO: 6467731 - DNA, 20 bp, Homo sapiens
tctccaggcccagcctggcc

SEQ ID NO: 6467732 - DNA, 18 bp, Homo sapiens
tgcatgaagagaagcaat

SEQ ID NO: 6467733 - DNA, 22 bp, Homo sapiens
tgcatgaagtaatatgcacaca

SEQ ID NO: 6467734 - DNA, 19 bp, Homo sapiens
tgcatgaatatcatacaaa

SEQ ID NO: 6467735 - DNA, 20 bp, Homo sapiens
tgcatgaattactgtatata

SEQ ID NO: 6467736 - DNA, 14 bp, Homo sapiens
tgcatgacaacagt

SEQ ID NO: 6467737 - DNA, 16 bp, Homo sapiens
tgcatgaccaaagtga

SEQ ID NO: 6467738 - DNA, 18 bp, Homo sapiens
tgcatgaccaaagtgata

SEQ ID NO: 6467739 - DNA, 24 bp, Homo sapiens
tgcatgaccacatagaacatgtgt

SEQ ID NO: 6467740 - DNA, 18 bp, Homo sapiens
tgcatgagaatgtcattt

SEQ ID NO: 6467741 - DNA, 23 bp, Homo sapiens
tgcatgagaatgtcatttgctaa

SEQ ID NO: 6467742 - DNA, 12 bp, Homo sapiens
tgcatgagcacc

SEQ ID NO: 6467743 - DNA, 22 bp, Homo sapiens
tgcatgagcacctttctggctt

SEQ ID NO: 6467744 - DNA, 21 bp, Homo sapiens
tgcatgagctacgcctgcctc

SEQ ID NO: 6467745 - DNA, 13 bp, Homo sapiens
tgcatgagctccc

SEQ ID NO: 6467746 - DNA, 21 bp, Homo sapiens
tgcatgaggctagtgtggtgt

SEQ ID NO: 6467747 - DNA, 16 bp, Homo sapiens
tgcatgatattgtatg

SEQ ID NO: 6467748 - DNA, 20 bp, Homo sapiens
tgcatgatctgtcaaagtga

SEQ ID NO: 6467749 - DNA, 16 bp, Homo sapiens
tgcatgatgactcttc

SEQ ID NO: 6467750 - DNA, 13 bp, Homo sapiens
tgcatgatgccct

SEQ ID NO: 6467751 - DNA, 14 bp, Homo sapiens
tgcatgatggtgag

SEQ ID NO: 6467752 - DNA, 14 bp, Homo sapiens
tgcatgatgtattt

SEQ ID NO: 6467753 - DNA, 15 bp, Homo sapiens
tgcatgatgtttgcc

SEQ ID NO: 6467754 - DNA, 17 bp, Homo sapiens
tgcatgattagtgcaat

SEQ ID NO: 6467755 - DNA, 22 bp, Homo sapiens
tgcatgatttcccaaatgaaat

SEQ ID NO: 6467756 - DNA, 23 bp, Homo sapiens
tgcatgatttcccaaatgaaata

SEQ ID NO: 6467757 - DNA, 17 bp, Homo sapiens
tgcatgattttatacat

SEQ ID NO: 6467758 - DNA, 22 bp, Homo sapiens
tgcatgattttatacatagtca

SEQ ID NO: 6467759 - DNA, 20 bp, Homo sapiens
tgcatgatttttgccctgcg

SEQ ID NO: 6467760 - DNA, 15 bp, Homo sapiens
tgcatgcaaaaatga

SEQ ID NO: 6467761 - DNA, 17 bp, Homo sapiens
tgcatgcaaacaagaaa

SEQ ID NO: 6467762 - DNA, 17 bp, Homo sapiens
tgcatgcaaaccaggag

SEQ ID NO: 6467763 - DNA, 16 bp, Homo sapiens
tgcatgcaatttgaag

SEQ ID NO: 6467764 - DNA, 16 bp, Homo sapiens
tgcatgcactgtctca

SEQ ID NO: 6467765 - DNA, 19 bp, Homo sapiens
tgcatgcactgttccccct

SEQ ID NO: 6467766 - DNA, 18 bp, Homo sapiens
tgcatgcagccactgtgc

SEQ ID NO: 6467767 - DNA, 14 bp, Homo sapiens
tgcatgcagttgat

SEQ ID NO: 6467768 - DNA, 14 bp, Homo sapiens
tgcatgcataccac

SEQ ID NO: 6467769 - DNA, 16 bp, Homo sapiens
tgcatgcatgccctct

SEQ ID NO: 6467770 - DNA, 20 bp, Homo sapiens
tgcatgcattgagctgcctc

SEQ ID NO: 6467771 - DNA, 22 bp, Homo sapiens
tgcatgccaaattgtagttctt

SEQ ID NO: 6467772 - DNA, 19 bp, Homo sapiens
tgcatgccaggaagcacgt

SEQ ID NO: 6467773 - DNA, 13 bp, Homo sapiens
tgcatgccaggct

SEQ ID NO: 6467774 - DNA, 16 bp, Homo sapiens
tgcatgccaggctggg

SEQ ID NO: 6467775 - DNA, 20 bp, Homo sapiens
tgcatgcccagagacccagc

SEQ ID NO: 6467776 - DNA, 14 bp, Homo sapiens
tgcatgccgctgca

SEQ ID NO: 6467777 - DNA, 15 bp, Homo sapiens
tgcatgcctggcccc

SEQ ID NO: 6467778 - DNA, 14 bp, Homo sapiens
tgcatgcctggtct

SEQ ID NO: 6467779 - DNA, 15 bp, Homo sapiens
tgcatgcgcaggctc

SEQ ID NO: 6467780 - DNA, 16 bp, Homo sapiens
tgcatgcggcccagcc

SEQ ID NO: 6467781 - DNA, 15 bp, Homo sapiens
tgcatgctaaattat

SEQ ID NO: 6467782 - DNA, 13 bp, Homo sapiens
tgcatgctcctct

SEQ ID NO: 6467783 - DNA, 17 bp, Homo sapiens
tgcatgctcctctgcct

SEQ ID NO: 6467784 - DNA, 18 bp, Homo sapiens
tgcatgctctctgcagcc

SEQ ID NO: 6467785 - DNA, 15 bp, Homo sapiens
tgcatgctctgcagc

SEQ ID NO: 6467786 - DNA, 12 bp, Homo sapiens
tgcatgctctgg

SEQ ID NO: 6467787 - DNA, 16 bp, Homo sapiens
tgcatgctctggaagc

SEQ ID NO: 6467788 - DNA, 22 bp, Homo sapiens
tgcatgctctggaagcctggac

SEQ ID NO: 6467789 - DNA, 14 bp, Homo sapiens
tgcatgctgaaaca

SEQ ID NO: 6467790 - DNA, 13 bp, Homo sapiens
tgcatgctgccca

SEQ ID NO: 6467791 - DNA, 14 bp, Homo sapiens
tgcatgctgcccag

SEQ ID NO: 6467792 - DNA, 20 bp, Homo sapiens
tgcatgctgctttaattgtg

SEQ ID NO: 6467793 - DNA, 14 bp, Homo sapiens
tgcatgctgtccct

SEQ ID NO: 6467794 - DNA, 15 bp, Homo sapiens
tgcatgctgtccctt

SEQ ID NO: 6467795 - DNA, 16 bp, Homo sapiens
tgcatgctgtccctta

SEQ ID NO: 6467796 - DNA, 18 bp, Homo sapiens
tgcatgctgtcccttacg

SEQ ID NO: 6467797 - DNA, 23 bp, Homo sapiens
tgcatgctttgagaccagaagaa

SEQ ID NO: 6467798 - DNA, 11 bp, Homo sapiens
tgcatggaaat

SEQ ID NO: 6467799 - DNA, 17 bp, Homo sapiens
tgcatggaaatcagcca

SEQ ID NO: 6467800 - DNA, 18 bp, Homo sapiens
tgcatggaaatgtcctcc

SEQ ID NO: 6467801 - DNA, 20 bp, Homo sapiens
tgcatggaagtaattaaggt

SEQ ID NO: 6467802 - DNA, 19 bp, Homo sapiens
tgcatggacgcctggctcc

SEQ ID NO: 6467803 - DNA, 13 bp, Homo sapiens
tgcatggactgtg

SEQ ID NO: 6467804 - DNA, 12 bp, Homo sapiens
tgcatggagaag

SEQ ID NO: 6467805 - DNA, 18 bp, Homo sapiens
tgcatggaggccctcctg

SEQ ID NO: 6467806 - DNA, 14 bp, Homo sapiens
tgcatggagtgttt

SEQ ID NO: 6467807 - DNA, 16 bp, Homo sapiens
tgcatggattcagcat

SEQ ID NO: 6467808 - DNA, 16 bp, Homo sapiens
tgcatggatttctttg

SEQ ID NO: 6467809 - DNA, 16 bp, Homo sapiens
tgcatggcacatacca

SEQ ID NO: 6467810 - DNA, 15 bp, Homo sapiens
tgcatggcagcaggc

SEQ ID NO: 6467811 - DNA, 22 bp, Homo sapiens
tgcatggcagcaggcctgttgc

SEQ ID NO: 6467812 - DNA, 19 bp, Homo sapiens
tgcatggcagggcctcatc

SEQ ID NO: 6467813 - DNA, 22 bp, Homo sapiens
tgcatggcagggggctgctgct

SEQ ID NO: 6467814 - DNA, 16 bp, Homo sapiens
tgcatggcatcagact

SEQ ID NO: 6467815 - DNA, 20 bp, Homo sapiens
tgcatggcatcctccagccc

SEQ ID NO: 6467816 - DNA, 21 bp, Homo sapiens
tgcatggcatcctccagcccc

SEQ ID NO: 6467817 - DNA, 13 bp, Homo sapiens
tgcatggccacag

SEQ ID NO: 6467818 - DNA, 17 bp, Homo sapiens
tgcatggccacagccac

SEQ ID NO: 6467819 - DNA, 13 bp, Homo sapiens
tgcatggcctccc

SEQ ID NO: 6467820 - DNA, 16 bp, Homo sapiens
tgcatggcctcccagc

SEQ ID NO: 6467821 - DNA, 14 bp, Homo sapiens
tgcatggctgggga

SEQ ID NO: 6467822 - DNA, 21 bp, Homo sapiens
tgcatggcttctgaaagcagg

SEQ ID NO: 6467823 - DNA, 17 bp, Homo sapiens
tgcatgggaaaaatgtt

SEQ ID NO: 6467824 - DNA, 21 bp, Homo sapiens
tgcatgggaaatagcggccct

SEQ ID NO: 6467825 - DNA, 23 bp, Homo sapiens
tgcatgggaaatagcggccctgg

SEQ ID NO: 6467826 - DNA, 17 bp, Homo sapiens
tgcatgggaggaattca

SEQ ID NO: 6467827 - DNA, 16 bp, Homo sapiens
tgcatgggccagcccc

SEQ ID NO: 6467828 - DNA, 17 bp, Homo sapiens
tgcatgggccagcccct

SEQ ID NO: 6467829 - DNA, 19 bp, Homo sapiens
tgcatgggctaatgaagat

SEQ ID NO: 6467830 - DNA, 18 bp, Homo sapiens
tgcatggggaggcagcag

SEQ ID NO: 6467831 - DNA, 18 bp, Homo sapiens
tgcatggggcgggtccta

SEQ ID NO: 6467832 - DNA, 20 bp, Homo sapiens
tgcatggggctggggtcctc

SEQ ID NO: 6467833 - DNA, 16 bp, Homo sapiens
tgcatgggggcaccgg

SEQ ID NO: 6467834 - DNA, 22 bp, Homo sapiens
tgcatgggggcaccgggctcca

SEQ ID NO: 6467835 - DNA, 23 bp, Homo sapiens
tgcatgggttaattgagaataga

SEQ ID NO: 6467836 - DNA, 15 bp, Homo sapiens
tgcatggtggccaga

SEQ ID NO: 6467837 - DNA, 21 bp, Homo sapiens
tgcatggtgggagctggttga

SEQ ID NO: 6467838 - DNA, 20 bp, Homo sapiens
tgcatggtgtgaactaagtt

SEQ ID NO: 6467839 - DNA, 17 bp, Homo sapiens
tgcatggtttagaaagc

SEQ ID NO: 6467840 - DNA, 15 bp, Homo sapiens
tgcatggtttcagca

SEQ ID NO: 6467841 - DNA, 16 bp, Homo sapiens
tgcatggtttcagcac

SEQ ID NO: 6467842 - DNA, 17 bp, Homo sapiens
tgcatggtttggagctg

SEQ ID NO: 6467843 - DNA, 15 bp, Homo sapiens
tgcatgtaaaatgca

SEQ ID NO: 6467844 - DNA, 16 bp, Homo sapiens
tgcatgtaaaatgcag

SEQ ID NO: 6467845 - DNA, 15 bp, Homo sapiens
tgcatgtactatctt

SEQ ID NO: 6467846 - DNA, 13 bp, Homo sapiens
tgcatgtacttga

SEQ ID NO: 6467847 - DNA, 22 bp, Homo sapiens
tgcatgtacttgaaggatggat

SEQ ID NO: 6467848 - DNA, 12 bp, Homo sapiens
tgcatgtagcat

SEQ ID NO: 6467849 - DNA, 17 bp, Homo sapiens
tgcatgtagcatataaa

SEQ ID NO: 6467850 - DNA, 15 bp, Homo sapiens
tgcatgtataaatga

SEQ ID NO: 6467851 - DNA, 14 bp, Homo sapiens
tgcatgtatgtctt

SEQ ID NO: 6467852 - DNA, 12 bp, Homo sapiens
tgcatgtatgtg

SEQ ID NO: 6467853 - DNA, 12 bp, Homo sapiens
tgcatgtattag

SEQ ID NO: 6467854 - DNA, 15 bp, Homo sapiens
tgcatgtattgtaaa

SEQ ID NO: 6467855 - DNA, 17 bp, Homo sapiens
tgcatgtatttaagaaa

SEQ ID NO: 6467856 - DNA, 17 bp, Homo sapiens
tgcatgtcacatgacat

SEQ ID NO: 6467857 - DNA, 15 bp, Homo sapiens
tgcatgtcacatgcc

SEQ ID NO: 6467858 - DNA, 16 bp, Homo sapiens
tgcatgtcacatgcca

SEQ ID NO: 6467859 - DNA, 17 bp, Homo sapiens
tgcatgtcgcacaatgt

SEQ ID NO: 6467860 - DNA, 18 bp, Homo sapiens
tgcatgtcgcacaatgtt

SEQ ID NO: 6467861 - DNA, 15 bp, Homo sapiens
tgcatgtcggggccc

SEQ ID NO: 6467862 - DNA, 16 bp, Homo sapiens
tgcatgtcggggcccc

SEQ ID NO: 6467863 - DNA, 18 bp, Homo sapiens
tgcatgtcggggcccctg

SEQ ID NO: 6467864 - DNA, 19 bp, Homo sapiens
tgcatgtcggggcccctgc

SEQ ID NO: 6467865 - DNA, 13 bp, Homo sapiens
tgcatgtctaatt

SEQ ID NO: 6467866 - DNA, 17 bp, Homo sapiens
tgcatgtctgcctatgc

SEQ ID NO: 6467867 - DNA, 15 bp, Homo sapiens
tgcatgtctgttctt

SEQ ID NO: 6467868 - DNA, 13 bp, Homo sapiens
tgcatgtctgttt

SEQ ID NO: 6467869 - DNA, 17 bp, Homo sapiens
tgcatgtcttaaatgct

SEQ ID NO: 6467870 - DNA, 23 bp, Homo sapiens
tgcatgtgaagcatgctttgctg

SEQ ID NO: 6467871 - DNA, 13 bp, Homo sapiens
tgcatgtgactct

SEQ ID NO: 6467872 - DNA, 14 bp, Homo sapiens
tgcatgtgactctg

SEQ ID NO: 6467873 - DNA, 17 bp, Homo sapiens
tgcatgtgagcacatgc

SEQ ID NO: 6467874 - DNA, 18 bp, Homo sapiens
tgcatgtgagcacatgcg

SEQ ID NO: 6467875 - DNA, 20 bp, Homo sapiens
tgcatgtgcgtggaagtgtt

SEQ ID NO: 6467876 - DNA, 22 bp, Homo sapiens
tgcatgtgcgtggaagtgttcc

SEQ ID NO: 6467877 - DNA, 17 bp, Homo sapiens
tgcatgtgctgtctcca

SEQ ID NO: 6467878 - DNA, 15 bp, Homo sapiens
tgcatgtggcttctc

SEQ ID NO: 6467879 - DNA, 17 bp, Homo sapiens
tgcatgtggcttctctg

SEQ ID NO: 6467880 - DNA, 16 bp, Homo sapiens
tgcatgtgtctttata

SEQ ID NO: 6467881 - DNA, 12 bp, Homo sapiens
tgcatgtgtgcg

SEQ ID NO: 6467882 - DNA, 16 bp, Homo sapiens
tgcatgtgtgtgtctg

SEQ ID NO: 6467883 - DNA, 22 bp, Homo sapiens
tgcatgtgtgttgtccttcagc

SEQ ID NO: 6467884 - DNA, 14 bp, Homo sapiens
tgcatgttaaaata

SEQ ID NO: 6467885 - DNA, 14 bp, Homo sapiens
tgcatgttaagcgt

SEQ ID NO: 6467886 - DNA, 19 bp, Homo sapiens
tgcatgttacataagataa

SEQ ID NO: 6467887 - DNA, 14 bp, Homo sapiens
tgcatgttaccatc

SEQ ID NO: 6467888 - DNA, 15 bp, Homo sapiens
tgcatgttactaaat

SEQ ID NO: 6467889 - DNA, 13 bp, Homo sapiens
tgcatgttatgtt

SEQ ID NO: 6467890 - DNA, 22 bp, Homo sapiens
tgcatgttatgtttaataagct

SEQ ID NO: 6467891 - DNA, 14 bp, Homo sapiens
tgcatgttccacta

SEQ ID NO: 6467892 - DNA, 16 bp, Homo sapiens
tgcatgttccactaac

SEQ ID NO: 6467893 - DNA, 12 bp, Homo sapiens
tgcatgttcctg

SEQ ID NO: 6467894 - DNA, 20 bp, Homo sapiens
tgcatgttgccatgaggcct

SEQ ID NO: 6467895 - DNA, 15 bp, Homo sapiens
tgcatgttggggttt

SEQ ID NO: 6467896 - DNA, 20 bp, Homo sapiens
tgcatgttgtctaagaaatt

SEQ ID NO: 6467897 - DNA, 21 bp, Homo sapiens
tgcatgttgtctaagaaattg

SEQ ID NO: 6467898 - DNA, 14 bp, Homo sapiens
tgcatgtttaataa

SEQ ID NO: 6467899 - DNA, 15 bp, Homo sapiens
tgcatgtttaataat

SEQ ID NO: 6467900 - DNA, 18 bp, Homo sapiens
tgcatgtttaataatatg

SEQ ID NO: 6467901 - DNA, 19 bp, Homo sapiens
tgcatgtttaataatatgt

SEQ ID NO: 6467902 - DNA, 20 bp, Homo sapiens
tgcatgtttaataatatgta

SEQ ID NO: 6467903 - DNA, 21 bp, Homo sapiens
tgcatgtttaataatatgtac

SEQ ID NO: 6467904 - DNA, 16 bp, Homo sapiens
tgcatgtttgaaatga

SEQ ID NO: 6467905 - DNA, 14 bp, Homo sapiens
tgcatgtttgctgt

SEQ ID NO: 6467906 - DNA, 15 bp, Homo sapiens
tgcatgtttgtgatt

SEQ ID NO: 6467907 - DNA, 23 bp, Homo sapiens
tgcatgtttgttgtatacttcct

SEQ ID NO: 6467908 - DNA, 20 bp, Homo sapiens
tgcatgttttatgtgcactc

SEQ ID NO: 6467909 - DNA, 15 bp, Homo sapiens
tgcatgtttttgaaa

SEQ ID NO: 6467910 - DNA, 23 bp, Homo sapiens
tgcattaaaaaaaaaaaaaaact

SEQ ID NO: 6467911 - DNA, 17 bp, Homo sapiens
tgcattaaaagaaaata

SEQ ID NO: 6467912 - DNA, 16 bp, Homo sapiens
tgcattaaaagactgt

SEQ ID NO: 6467913 - DNA, 13 bp, Homo sapiens
tctccaggcccca

SEQ ID NO: 6467914 - DNA, 16 bp, Homo sapiens
tctccaggctgtttct

SEQ ID NO: 6467915 - DNA, 19 bp, Homo sapiens
tctccagggacagaagcag

SEQ ID NO: 6467916 - DNA, 17 bp, Homo sapiens
tctccagggacccttgc

SEQ ID NO: 6467917 - DNA, 23 bp, Homo sapiens
tctccagggacccttgcctgcct

SEQ ID NO: 6467918 - DNA, 21 bp, Homo sapiens
tctccagggagcaagacagag

SEQ ID NO: 6467919 - DNA, 21 bp, Homo sapiens
tctccagggagggtatttatt

SEQ ID NO: 6467920 - DNA, 18 bp, Homo sapiens
tctccagggcccccaccg

SEQ ID NO: 6467921 - DNA, 17 bp, Homo sapiens
tctccaggggcctgcag

SEQ ID NO: 6467922 - DNA, 20 bp, Homo sapiens
tctccaggggcctgcagaag

SEQ ID NO: 6467923 - DNA, 17 bp, Homo sapiens
tctccaggggctgcttc

SEQ ID NO: 6467924 - DNA, 18 bp, Homo sapiens
tctccaggggctgcttcc

SEQ ID NO: 6467925 - DNA, 16 bp, Homo sapiens
tctccaggggtttaca

SEQ ID NO: 6467926 - DNA, 18 bp, Homo sapiens
tctccaggtcagcctgga

SEQ ID NO: 6467927 - DNA, 19 bp, Homo sapiens
tctccaggtcagcctggaa

SEQ ID NO: 6467928 - DNA, 16 bp, Homo sapiens
tctccaggtgctcatt

SEQ ID NO: 6467929 - DNA, 18 bp, Homo sapiens
tctccaggtttgctgtgt

SEQ ID NO: 6467930 - DNA, 19 bp, Homo sapiens
tctccaggtttgctgtgtc

SEQ ID NO: 6467931 - DNA, 15 bp, Homo sapiens
tctccagtccctggg

SEQ ID NO: 6467932 - DNA, 18 bp, Homo sapiens
tctccagtccctgggagc

SEQ ID NO: 6467933 - DNA, 17 bp, Homo sapiens
tctccagtcttccacct

SEQ ID NO: 6467934 - DNA, 17 bp, Homo sapiens
tctccagtggttgctgt

SEQ ID NO: 6467935 - DNA, 18 bp, Homo sapiens
tctccagtgtgccagaca

SEQ ID NO: 6467936 - DNA, 18 bp, Homo sapiens
tctccagtttttgaggag

SEQ ID NO: 6467937 - DNA, 22 bp, Homo sapiens
tctccataaagcacattttaag

SEQ ID NO: 6467938 - DNA, 22 bp, Homo sapiens
tctccataaccccacccttgcc

SEQ ID NO: 6467939 - DNA, 14 bp, Homo sapiens
tctccatatgttac

SEQ ID NO: 6467940 - DNA, 20 bp, Homo sapiens
tctccatcaccctcttcctg

SEQ ID NO: 6467941 - DNA, 21 bp, Homo sapiens
tctccatcaccctcttcctgt

SEQ ID NO: 6467942 - DNA, 14 bp, Homo sapiens
tctccatcagaagg

SEQ ID NO: 6467943 - DNA, 15 bp, Homo sapiens
tctccatcagatgtg

SEQ ID NO: 6467944 - DNA, 19 bp, Homo sapiens
tctccatcataggctgaca

SEQ ID NO: 6467945 - DNA, 17 bp, Homo sapiens
tctccatccttaactgt

SEQ ID NO: 6467946 - DNA, 17 bp, Homo sapiens
tctccatcctttctgcc

SEQ ID NO: 6467947 - DNA, 22 bp, Homo sapiens
tctccatcctttctgcctctca

SEQ ID NO: 6467948 - DNA, 15 bp, Homo sapiens
tctccatctcccaag

SEQ ID NO: 6467949 - DNA, 11 bp, Homo sapiens
tctccatctct

SEQ ID NO: 6467950 - DNA, 16 bp, Homo sapiens
tctccatctctctggc

SEQ ID NO: 6467951 - DNA, 17 bp, Homo sapiens
tctccatctcttgtacc

SEQ ID NO: 6467952 - DNA, 17 bp, Homo sapiens
tctccatctggcagggt

SEQ ID NO: 6467953 - DNA, 14 bp, Homo sapiens
tctccatctgtttg

SEQ ID NO: 6467954 - DNA, 18 bp, Homo sapiens
tctccatcttcagcttct

SEQ ID NO: 6467955 - DNA, 14 bp, Homo sapiens
tctccatgataact

SEQ ID NO: 6467956 - DNA, 15 bp, Homo sapiens
tctccatgcaagtgc

SEQ ID NO: 6467957 - DNA, 19 bp, Homo sapiens
tctccatgcaagtgctgtt

SEQ ID NO: 6467958 - DNA, 16 bp, Homo sapiens
tctccatggagcctac

SEQ ID NO: 6467959 - DNA, 17 bp, Homo sapiens
tctccatggcatcttcg

SEQ ID NO: 6467960 - DNA, 15 bp, Homo sapiens
tctccatggccacct

SEQ ID NO: 6467961 - DNA, 20 bp, Homo sapiens
tctccatggccctgccatgc

SEQ ID NO: 6467962 - DNA, 19 bp, Homo sapiens
tctccatggcttcctcctc

SEQ ID NO: 6467963 - DNA, 20 bp, Homo sapiens
tctccatggcttcctcctcc

SEQ ID NO: 6467964 - DNA, 14 bp, Homo sapiens
tctccatgggccac

SEQ ID NO: 6467965 - DNA, 23 bp, Homo sapiens
tctccatgggccaccgcccagct

SEQ ID NO: 6467966 - DNA, 16 bp, Homo sapiens
tctccatgtctgtagt

SEQ ID NO: 6467967 - DNA, 11 bp, Homo sapiens
tctccatgtgt

SEQ ID NO: 6467968 - DNA, 14 bp, Homo sapiens
tctccatgtgtact

SEQ ID NO: 6467969 - DNA, 20 bp, Homo sapiens
tctccatgtgtgtgccaagc

SEQ ID NO: 6467970 - DNA, 11 bp, Homo sapiens
tctccattaaa

SEQ ID NO: 6467971 - DNA, 23 bp, Homo sapiens
tctccattaaacttctactgagc

SEQ ID NO: 6467972 - DNA, 16 bp, Homo sapiens
tctccattagaaaatt

SEQ ID NO: 6467973 - DNA, 22 bp, Homo sapiens
tctccattagaaaattttgtaa

SEQ ID NO: 6467974 - DNA, 21 bp, Homo sapiens
tctccattccctccacccact

SEQ ID NO: 6467975 - DNA, 21 bp, Homo sapiens
tctccattctgaaaatagcag

SEQ ID NO: 6467976 - DNA, 15 bp, Homo sapiens
tctccattctgctcc

SEQ ID NO: 6467977 - DNA, 17 bp, Homo sapiens
tctccatttaagacaca

SEQ ID NO: 6467978 - DNA, 12 bp, Homo sapiens
tctccatttcaa

SEQ ID NO: 6467979 - DNA, 22 bp, Homo sapiens
tctccatttcacgggcaacact

SEQ ID NO: 6467980 - DNA, 17 bp, Homo sapiens
tctccatttcactggct

SEQ ID NO: 6467981 - DNA, 16 bp, Homo sapiens
tctccattttcaagct

SEQ ID NO: 6467982 - DNA, 23 bp, Homo sapiens
tctccattttcttctctgtgaag

SEQ ID NO: 6467983 - DNA, 22 bp, Homo sapiens
tctccattttggtgtctttctc

SEQ ID NO: 6467984 - DNA, 17 bp, Homo sapiens
tctccatttttcccagg

SEQ ID NO: 6467985 - DNA, 18 bp, Homo sapiens
tctccatttttcccagga

SEQ ID NO: 6467986 - DNA, 13 bp, Homo sapiens
tctcccaacatgg

SEQ ID NO: 6467987 - DNA, 14 bp, Homo sapiens
tctcccaacatggg

SEQ ID NO: 6467988 - DNA, 18 bp, Homo sapiens
tctcccaacgctgaagcg

SEQ ID NO: 6467989 - DNA, 16 bp, Homo sapiens
tctcccaactgctgct

SEQ ID NO: 6467990 - DNA, 21 bp, Homo sapiens
tctcccaagctgattttattc

SEQ ID NO: 6467991 - DNA, 13 bp, Homo sapiens
tctcccaaggctg

SEQ ID NO: 6467992 - DNA, 15 bp, Homo sapiens
tctcccacacaagca

SEQ ID NO: 6467993 - DNA, 14 bp, Homo sapiens
tctcccacacccac

SEQ ID NO: 6467994 - DNA, 16 bp, Homo sapiens
tctcccacagagtgct

SEQ ID NO: 6467995 - DNA, 21 bp, Homo sapiens
tctcccacagagtgctggact

SEQ ID NO: 6467996 - DNA, 22 bp, Homo sapiens
tctcccacagagtgctggactg

SEQ ID NO: 6467997 - DNA, 16 bp, Homo sapiens
tctcccacatcccact

SEQ ID NO: 6467998 - DNA, 17 bp, Homo sapiens
tctcccacatcccactg

SEQ ID NO: 6467999 - DNA, 17 bp, Homo sapiens
tctcccacatgaggcca

SEQ ID NO: 6468000 - DNA, 21 bp, Homo sapiens
tctcccacatgaggccatctc

SEQ ID NO: 6468001 - DNA, 16 bp, Homo sapiens
tctcccacccaaggag

SEQ ID NO: 6468002 - DNA, 22 bp, Homo sapiens
tctcccaccccagcctcaagta

SEQ ID NO: 6468003 - DNA, 22 bp, Homo sapiens
tctcccaccccctccccaaagc

SEQ ID NO: 6468004 - DNA, 21 bp, Homo sapiens
tctcccaccccggcctccact

SEQ ID NO: 6468005 - DNA, 20 bp, Homo sapiens
tctcccacccggccacagct

SEQ ID NO: 6468006 - DNA, 20 bp, Homo sapiens
tctcccaccctaagggcagc

SEQ ID NO: 6468007 - DNA, 21 bp, Homo sapiens
tctcccaccctttctgccagg

SEQ ID NO: 6468008 - DNA, 14 bp, Homo sapiens
tctcccacctagca

SEQ ID NO: 6468009 - DNA, 19 bp, Homo sapiens
tctcccacgtgcacagctt

SEQ ID NO: 6468010 - DNA, 20 bp, Homo sapiens
tctcccacgtgcacagcttc

SEQ ID NO: 6468011 - DNA, 14 bp, Homo sapiens
tctcccacgtggga

SEQ ID NO: 6468012 - DNA, 15 bp, Homo sapiens
tctcccacgtgggag

SEQ ID NO: 6468013 - DNA, 14 bp, Homo sapiens
tctcccactctcct

SEQ ID NO: 6468014 - DNA, 16 bp, Homo sapiens
tctcccactctcctag

SEQ ID NO: 6468015 - DNA, 12 bp, Homo sapiens
tctcccacttcc

SEQ ID NO: 6468016 - DNA, 20 bp, Homo sapiens
tctcccacttcctcctacct

SEQ ID NO: 6468017 - DNA, 21 bp, Homo sapiens
tctcccacttcctcctacctg

SEQ ID NO: 6468018 - DNA, 19 bp, Homo sapiens
tctcccagaaggctgggtc

SEQ ID NO: 6468019 - DNA, 14 bp, Homo sapiens
tctcccagacctag

SEQ ID NO: 6468020 - DNA, 15 bp, Homo sapiens
tctcccagacttgtt

SEQ ID NO: 6468021 - DNA, 22 bp, Homo sapiens
tctcccagacttgtttcctgtg

SEQ ID NO: 6468022 - DNA, 12 bp, Homo sapiens
tctcccagagca

SEQ ID NO: 6468023 - DNA, 19 bp, Homo sapiens
tctcccagaggctcctgga

SEQ ID NO: 6468024 - DNA, 16 bp, Homo sapiens
tctcccagataatgtg

SEQ ID NO: 6468025 - DNA, 13 bp, Homo sapiens
tctcccagatcct

SEQ ID NO: 6468026 - DNA, 12 bp, Homo sapiens
tctcccagcaca

SEQ ID NO: 6468027 - DNA, 13 bp, Homo sapiens
tctcccagcactg

SEQ ID NO: 6468028 - DNA, 20 bp, Homo sapiens
tctcccagcactgcctcctg

SEQ ID NO: 6468029 - DNA, 21 bp, Homo sapiens
tctcccagcactgcctcctgt

SEQ ID NO: 6468030 - DNA, 22 bp, Homo sapiens
tctcccagcactgcctcctgtt

SEQ ID NO: 6468031 - DNA, 14 bp, Homo sapiens
tctcccagcccacc

SEQ ID NO: 6468032 - DNA, 17 bp, Homo sapiens
tctcccagctctagaca

SEQ ID NO: 6468033 - DNA, 13 bp, Homo sapiens
tctcccagctctg

SEQ ID NO: 6468034 - DNA, 20 bp, Homo sapiens
tctcccaggcaaggctgtgg

SEQ ID NO: 6468035 - DNA, 13 bp, Homo sapiens
tctcccaggcagg

SEQ ID NO: 6468036 - DNA, 13 bp, Homo sapiens
tctcccaggccag

SEQ ID NO: 6468037 - DNA, 23 bp, Homo sapiens
tctcccaggccaggctccttcct

SEQ ID NO: 6468038 - DNA, 14 bp, Homo sapiens
tctcccaggcccca

SEQ ID NO: 6468039 - DNA, 18 bp, Homo sapiens
tctcccaggccccagggg

SEQ ID NO: 6468040 - DNA, 19 bp, Homo sapiens
tctcccaggccccagggga

SEQ ID NO: 6468041 - DNA, 13 bp, Homo sapiens
tctcccaggcccg

SEQ ID NO: 6468042 - DNA, 13 bp, Homo sapiens
tctcccaggcctc

SEQ ID NO: 6468043 - DNA, 16 bp, Homo sapiens
tctcccaggcctctgc

SEQ ID NO: 6468044 - DNA, 20 bp, Homo sapiens
tctcccaggcctctgcccca

SEQ ID NO: 6468045 - DNA, 19 bp, Homo sapiens
tctcccaggctgctggagt

SEQ ID NO: 6468046 - DNA, 22 bp, Homo sapiens
tctcccaggctgctggagtgca

SEQ ID NO: 6468047 - DNA, 13 bp, Homo sapiens
tctcccagggagt

SEQ ID NO: 6468048 - DNA, 17 bp, Homo sapiens
tctcccagggagtgagc

SEQ ID NO: 6468049 - DNA, 18 bp, Homo sapiens
tctcccagggagtgagca

SEQ ID NO: 6468050 - DNA, 21 bp, Homo sapiens
tctcccagggagtgagcagct

SEQ ID NO: 6468051 - DNA, 22 bp, Homo sapiens
tctcccagggagtgagcagcta

SEQ ID NO: 6468052 - DNA, 14 bp, Homo sapiens
tctcccagggctct

SEQ ID NO: 6468053 - DNA, 14 bp, Homo sapiens
tctcccagtatgtt

SEQ ID NO: 6468054 - DNA, 18 bp, Homo sapiens
tctcccagtctacccaga

SEQ ID NO: 6468055 - DNA, 15 bp, Homo sapiens
tctcccagtctctgt

SEQ ID NO: 6468056 - DNA, 21 bp, Homo sapiens
tctcccagtgaactcctgcca

SEQ ID NO: 6468057 - DNA, 13 bp, Homo sapiens
tctcccagttgtc

SEQ ID NO: 6468058 - DNA, 24 bp, Homo sapiens
tctcccatcctggggcagcactcc

SEQ ID NO: 6468059 - DNA, 18 bp, Homo sapiens
tctcccatggagccccag

SEQ ID NO: 6468060 - DNA, 13 bp, Homo sapiens
tctcccatgtgtg

SEQ ID NO: 6468061 - DNA, 18 bp, Homo sapiens
tctcccatgtgtgatgct

SEQ ID NO: 6468062 - DNA, 22 bp, Homo sapiens
tctcccatgtgtgatgctgaca

SEQ ID NO: 6468063 - DNA, 17 bp, Homo sapiens
tctcccattgtccctct

SEQ ID NO: 6468064 - DNA, 18 bp, Homo sapiens
tctcccattgtccctctg

SEQ ID NO: 6468065 - DNA, 16 bp, Homo sapiens
tctcccatttcaggaa

SEQ ID NO: 6468066 - DNA, 20 bp, Homo sapiens
tctcccatttcaggaattta

SEQ ID NO: 6468067 - DNA, 12 bp, Homo sapiens
tctcccatttcc

SEQ ID NO: 6468068 - DNA, 20 bp, Homo sapiens
tctccccaacccccattctc

SEQ ID NO: 6468069 - DNA, 13 bp, Homo sapiens
tctccccaaccct

SEQ ID NO: 6468070 - DNA, 19 bp, Homo sapiens
tctccccaatgagacttgc

SEQ ID NO: 6468071 - DNA, 10 bp, Homo sapiens
tctccccaca

SEQ ID NO: 6468072 - DNA, 23 bp, Homo sapiens
tctccccacagcctctggctcca

SEQ ID NO: 6468073 - DNA, 16 bp, Homo sapiens
tctccccacccacccc

SEQ ID NO: 6468074 - DNA, 23 bp, Homo sapiens
tctccccacgcccgtctctttct

SEQ ID NO: 6468075 - DNA, 14 bp, Homo sapiens
tctccccagagctg

SEQ ID NO: 6468076 - DNA, 18 bp, Homo sapiens
tctccccagagctgcctg

SEQ ID NO: 6468077 - DNA, 12 bp, Homo sapiens
tctccccagcca

SEQ ID NO: 6468078 - DNA, 13 bp, Homo sapiens
tctccccagccag

SEQ ID NO: 6468079 - DNA, 14 bp, Homo sapiens
tctccccagccaga

SEQ ID NO: 6468080 - DNA, 14 bp, Homo sapiens
tctccccagccccc

SEQ ID NO: 6468081 - DNA, 13 bp, Homo sapiens
tctccccagcctg

SEQ ID NO: 6468082 - DNA, 18 bp, Homo sapiens
tctccccaggcatttgcc

SEQ ID NO: 6468083 - DNA, 20 bp, Homo sapiens
tctccccaggcatttgccaa

SEQ ID NO: 6468084 - DNA, 15 bp, Homo sapiens
tctccccaggtccag

SEQ ID NO: 6468085 - DNA, 20 bp, Homo sapiens
tctccccaggtccagctctg

SEQ ID NO: 6468086 - DNA, 11 bp, Homo sapiens
tctccccagtg

SEQ ID NO: 6468087 - DNA, 19 bp, Homo sapiens
tctccccagtgcctgccac

SEQ ID NO: 6468088 - DNA, 22 bp, Homo sapiens
tctccccatccccttcctaaat

SEQ ID NO: 6468089 - DNA, 15 bp, Homo sapiens
tctccccatgctggg

SEQ ID NO: 6468090 - DNA, 18 bp, Homo sapiens
tctccccatgctgggctc

SEQ ID NO: 6468091 - DNA, 22 bp, Homo sapiens
tctccccatgtgcctgcaccag

SEQ ID NO: 6468092 - DNA, 20 bp, Homo sapiens
tgcattaaaattaaatactt

SEQ ID NO: 6468093 - DNA, 18 bp, Homo sapiens
tgcattaaaatttcttat

SEQ ID NO: 6468094 - DNA, 17 bp, Homo sapiens
tgcattaaactgtgaat

SEQ ID NO: 6468095 - DNA, 20 bp, Homo sapiens
tgcattaaattacagaaatt

SEQ ID NO: 6468096 - DNA, 13 bp, Homo sapiens
tgcattaaattca

SEQ ID NO: 6468097 - DNA, 19 bp, Homo sapiens
tgcattaaccactctacag

SEQ ID NO: 6468098 - DNA, 18 bp, Homo sapiens
tgcattaacttaaaagat

SEQ ID NO: 6468099 - DNA, 15 bp, Homo sapiens
tgcattaataatcct

SEQ ID NO: 6468100 - DNA, 12 bp, Homo sapiens
tgcattacagag

SEQ ID NO: 6468101 - DNA, 15 bp, Homo sapiens
tgcattacagagagg

SEQ ID NO: 6468102 - DNA, 16 bp, Homo sapiens
tgcattacagagagga

SEQ ID NO: 6468103 - DNA, 23 bp, Homo sapiens
tgcattaccagcttaaaacactt

SEQ ID NO: 6468104 - DNA, 19 bp, Homo sapiens
tgcattaccttctgttcct

SEQ ID NO: 6468105 - DNA, 17 bp, Homo sapiens
tgcattacttactgtta

SEQ ID NO: 6468106 - DNA, 13 bp, Homo sapiens
tgcattagaaatt

SEQ ID NO: 6468107 - DNA, 23 bp, Homo sapiens
tgcattagaaattagctgtgtga

SEQ ID NO: 6468108 - DNA, 21 bp, Homo sapiens
tgcattagagcccatttcaat

SEQ ID NO: 6468109 - DNA, 14 bp, Homo sapiens
tgcattagcacaga

SEQ ID NO: 6468110 - DNA, 17 bp, Homo sapiens
tgcattagcacagattt

SEQ ID NO: 6468111 - DNA, 19 bp, Homo sapiens
tgcattagcacagatttta

SEQ ID NO: 6468112 - DNA, 22 bp, Homo sapiens
tgcattagggatgcctcctttc

SEQ ID NO: 6468113 - DNA, 20 bp, Homo sapiens
tgcattatatttattactgt

SEQ ID NO: 6468114 - DNA, 21 bp, Homo sapiens
tgcattatatttattactgta

SEQ ID NO: 6468115 - DNA, 21 bp, Homo sapiens
tgcattatatttgtaaattta

SEQ ID NO: 6468116 - DNA, 22 bp, Homo sapiens
tgcattatctagatactgtatc

SEQ ID NO: 6468117 - DNA, 13 bp, Homo sapiens
tgcattatgcaat

SEQ ID NO: 6468118 - DNA, 15 bp, Homo sapiens
tgcattatgtacaca

SEQ ID NO: 6468119 - DNA, 13 bp, Homo sapiens
tgcattatgtatt

SEQ ID NO: 6468120 - DNA, 18 bp, Homo sapiens
tgcattatgtatttataa

SEQ ID NO: 6468121 - DNA, 19 bp, Homo sapiens
tgcattatgtatttataat

SEQ ID NO: 6468122 - DNA, 15 bp, Homo sapiens
tgcattattaaattg

SEQ ID NO: 6468123 - DNA, 21 bp, Homo sapiens
tgcattattcatatgcttccc

SEQ ID NO: 6468124 - DNA, 21 bp, Homo sapiens
tgcattattgacgaactggct

SEQ ID NO: 6468125 - DNA, 23 bp, Homo sapiens
tgcattatttgagaagctgctca

SEQ ID NO: 6468126 - DNA, 14 bp, Homo sapiens
tgcattattttata

SEQ ID NO: 6468127 - DNA, 20 bp, Homo sapiens
tgcattattttatatatttt

SEQ ID NO: 6468128 - DNA, 21 bp, Homo sapiens
tgcattcaaccttaccaaaaa

SEQ ID NO: 6468129 - DNA, 16 bp, Homo sapiens
tgcattcacccagaca

SEQ ID NO: 6468130 - DNA, 20 bp, Homo sapiens
tgcattcatctctcaaactt

SEQ ID NO: 6468131 - DNA, 18 bp, Homo sapiens
tgcattcatgcaagagtt

SEQ ID NO: 6468132 - DNA, 22 bp, Homo sapiens
tgcattcattcatcctcttata

SEQ ID NO: 6468133 - DNA, 19 bp, Homo sapiens
tgcattcattctgagcccc

SEQ ID NO: 6468134 - DNA, 15 bp, Homo sapiens
tgcattcattttctg

SEQ ID NO: 6468135 - DNA, 23 bp, Homo sapiens
tgcattccactttttgttacata

SEQ ID NO: 6468136 - DNA, 21 bp, Homo sapiens
tgcattccagaatcttgactt

SEQ ID NO: 6468137 - DNA, 16 bp, Homo sapiens
tgcattccagagcagg

SEQ ID NO: 6468138 - DNA, 16 bp, Homo sapiens
tgcattccagcgtctg

SEQ ID NO: 6468139 - DNA, 16 bp, Homo sapiens
tgcattccatgatttt

SEQ ID NO: 6468140 - DNA, 21 bp, Homo sapiens
tgcattccatgattttacaga

SEQ ID NO: 6468141 - DNA, 22 bp, Homo sapiens
tgcattccatgattttacagag

SEQ ID NO: 6468142 - DNA, 14 bp, Homo sapiens
tgcattcccagctc

SEQ ID NO: 6468143 - DNA, 16 bp, Homo sapiens
tgcattcccggtgcag

SEQ ID NO: 6468144 - DNA, 22 bp, Homo sapiens
tgcattccctgaatctgtgcct

SEQ ID NO: 6468145 - DNA, 15 bp, Homo sapiens
tgcattcctgtaact

SEQ ID NO: 6468146 - DNA, 18 bp, Homo sapiens
tgcattccttacttgcac

SEQ ID NO: 6468147 - DNA, 20 bp, Homo sapiens
tgcattcctttttcttcact

SEQ ID NO: 6468148 - DNA, 18 bp, Homo sapiens
tgcattcgttgtgttttt

SEQ ID NO: 6468149 - DNA, 23 bp, Homo sapiens
tgcattctatcgttattataaat

SEQ ID NO: 6468150 - DNA, 14 bp, Homo sapiens
tgcattctattgcc

SEQ ID NO: 6468151 - DNA, 18 bp, Homo sapiens
tgcattctattgccttct

SEQ ID NO: 6468152 - DNA, 20 bp, Homo sapiens
tgcattctattgccttcttt

SEQ ID NO: 6468153 - DNA, 15 bp, Homo sapiens
tgcattctctcccat

SEQ ID NO: 6468154 - DNA, 20 bp, Homo sapiens
tgcattctgataggaggggg

SEQ ID NO: 6468155 - DNA, 18 bp, Homo sapiens
tgcattctgtttcctctt

SEQ ID NO: 6468156 - DNA, 19 bp, Homo sapiens
tgcattcttaacaaactct

SEQ ID NO: 6468157 - DNA, 15 bp, Homo sapiens
tgcattcttattcat

SEQ ID NO: 6468158 - DNA, 16 bp, Homo sapiens
tgcattcttctgagca

SEQ ID NO: 6468159 - DNA, 13 bp, Homo sapiens
tgcattctttata

SEQ ID NO: 6468160 - DNA, 17 bp, Homo sapiens
tgcattctttatagtga

SEQ ID NO: 6468161 - DNA, 13 bp, Homo sapiens
tgcattctttttt

SEQ ID NO: 6468162 - DNA, 12 bp, Homo sapiens
tgcattgaaaaa

SEQ ID NO: 6468163 - DNA, 19 bp, Homo sapiens
tgcattgaaaaatttctaa

SEQ ID NO: 6468164 - DNA, 20 bp, Homo sapiens
tgcattgaaaagagctgaag

SEQ ID NO: 6468165 - DNA, 14 bp, Homo sapiens
tgcattgaacacaa

SEQ ID NO: 6468166 - DNA, 15 bp, Homo sapiens
tgcattgaacacaaa

SEQ ID NO: 6468167 - DNA, 21 bp, Homo sapiens
tgcattgaacacaaactgtaa

SEQ ID NO: 6468168 - DNA, 22 bp, Homo sapiens
tgcattgaacacaaactgtaaa

SEQ ID NO: 6468169 - DNA, 20 bp, Homo sapiens
tgcattgaccgcgactaatt

SEQ ID NO: 6468170 - DNA, 14 bp, Homo sapiens
tgcattgacctgga

SEQ ID NO: 6468171 - DNA, 22 bp, Homo sapiens
tgcattgacctggaggggagag

SEQ ID NO: 6468172 - DNA, 23 bp, Homo sapiens
tgcattgacctggaggggagagg

SEQ ID NO: 6468173 - DNA, 21 bp, Homo sapiens
tgcattgactttcagtaaaca

SEQ ID NO: 6468174 - DNA, 22 bp, Homo sapiens
tgcattgactttccccaccaga

SEQ ID NO: 6468175 - DNA, 13 bp, Homo sapiens
tgcattgagctgc

SEQ ID NO: 6468176 - DNA, 14 bp, Homo sapiens
tgcattgagctgcc

SEQ ID NO: 6468177 - DNA, 23 bp, Homo sapiens
tgcattgagctgcctccagcctg

SEQ ID NO: 6468178 - DNA, 16 bp, Homo sapiens
tgcattgaggaaatat

SEQ ID NO: 6468179 - DNA, 20 bp, Homo sapiens
tgcattgaggaaatattaat

SEQ ID NO: 6468180 - DNA, 18 bp, Homo sapiens
tgcattgatattgtgaac

SEQ ID NO: 6468181 - DNA, 22 bp, Homo sapiens
tgcattgccgctgtataaagca

SEQ ID NO: 6468182 - DNA, 22 bp, Homo sapiens
tgcattgctgtgtgaatccagg

SEQ ID NO: 6468183 - DNA, 19 bp, Homo sapiens
tgcattgcttttttttcct

SEQ ID NO: 6468184 - DNA, 22 bp, Homo sapiens
tgcattggataacaccaccatt

SEQ ID NO: 6468185 - DNA, 16 bp, Homo sapiens
tgcattggcctggcct

SEQ ID NO: 6468186 - DNA, 15 bp, Homo sapiens
tgcattgggagcatc

SEQ ID NO: 6468187 - DNA, 14 bp, Homo sapiens
tgcattgggcatta

SEQ ID NO: 6468188 - DNA, 19 bp, Homo sapiens
tgcattggggttcctctgt

SEQ ID NO: 6468189 - DNA, 15 bp, Homo sapiens
tgcattgtccttttc

SEQ ID NO: 6468190 - DNA, 17 bp, Homo sapiens
tgcattgtctgtctgca

SEQ ID NO: 6468191 - DNA, 19 bp, Homo sapiens
tgcattgtgaattgcctgc

SEQ ID NO: 6468192 - DNA, 20 bp, Homo sapiens
tgcattgtgaattgcctgcc

SEQ ID NO: 6468193 - DNA, 17 bp, Homo sapiens
tgcattgtgattggcct

SEQ ID NO: 6468194 - DNA, 19 bp, Homo sapiens
tgcattgtgattggcctgt

SEQ ID NO: 6468195 - DNA, 23 bp, Homo sapiens
tgcattgtgtcagaaacatgaaa

SEQ ID NO: 6468196 - DNA, 16 bp, Homo sapiens
tgcattgtgtgtcaca

SEQ ID NO: 6468197 - DNA, 17 bp, Homo sapiens
tgcattgtgtgtcacaa

SEQ ID NO: 6468198 - DNA, 14 bp, Homo sapiens
tgcattgttataat

SEQ ID NO: 6468199 - DNA, 17 bp, Homo sapiens
tgcattgttggctattt

SEQ ID NO: 6468200 - DNA, 20 bp, Homo sapiens
tgcattgttggctatttgaa

SEQ ID NO: 6468201 - DNA, 14 bp, Homo sapiens
tgcattgttgtaaa

SEQ ID NO: 6468202 - DNA, 18 bp, Homo sapiens
tgcattgtttctgtgggc

SEQ ID NO: 6468203 - DNA, 14 bp, Homo sapiens
tgcatttaaactct

SEQ ID NO: 6468204 - DNA, 14 bp, Homo sapiens
tgcatttaaagtat

SEQ ID NO: 6468205 - DNA, 16 bp, Homo sapiens
tgcatttaaatacagt

SEQ ID NO: 6468206 - DNA, 15 bp, Homo sapiens
tgcatttaagttgta

SEQ ID NO: 6468207 - DNA, 17 bp, Homo sapiens
tgcatttaagttgtaaa

SEQ ID NO: 6468208 - DNA, 19 bp, Homo sapiens
tgcatttaagttgtaaacg

SEQ ID NO: 6468209 - DNA, 18 bp, Homo sapiens
tgcatttaataaagatga

SEQ ID NO: 6468210 - DNA, 22 bp, Homo sapiens
tgcatttaataaagatgagttg

SEQ ID NO: 6468211 - DNA, 12 bp, Homo sapiens
tgcatttaatgt

SEQ ID NO: 6468212 - DNA, 14 bp, Homo sapiens
tgcatttaccaaaa

SEQ ID NO: 6468213 - DNA, 20 bp, Homo sapiens
tgcatttacgcctgtaaatg

SEQ ID NO: 6468214 - DNA, 14 bp, Homo sapiens
tgcatttagaaatc

SEQ ID NO: 6468215 - DNA, 14 bp, Homo sapiens
tgcatttagcacaa

SEQ ID NO: 6468216 - DNA, 14 bp, Homo sapiens
tgcatttagcttct

SEQ ID NO: 6468217 - DNA, 19 bp, Homo sapiens
tgcatttagggagtattct

SEQ ID NO: 6468218 - DNA, 22 bp, Homo sapiens
tgcatttagtggtggtagaaat

SEQ ID NO: 6468219 - DNA, 20 bp, Homo sapiens
tgcatttagttttatggcat

SEQ ID NO: 6468220 - DNA, 18 bp, Homo sapiens
tgcatttatagatcattt

SEQ ID NO: 6468221 - DNA, 19 bp, Homo sapiens
tgcatttatagatcatttc

SEQ ID NO: 6468222 - DNA, 23 bp, Homo sapiens
tgcatttatagatcatttctagg

SEQ ID NO: 6468223 - DNA, 16 bp, Homo sapiens
tgcatttatatgtacc

SEQ ID NO: 6468224 - DNA, 19 bp, Homo sapiens
tgcatttatgagctcttca

SEQ ID NO: 6468225 - DNA, 16 bp, Homo sapiens
tgcatttattgcagtt

SEQ ID NO: 6468226 - DNA, 19 bp, Homo sapiens
tgcatttcaaggaatggaa

SEQ ID NO: 6468227 - DNA, 20 bp, Homo sapiens
tgcatttcacatgccttgca

SEQ ID NO: 6468228 - DNA, 17 bp, Homo sapiens
tgcatttcagaaagcct

SEQ ID NO: 6468229 - DNA, 22 bp, Homo sapiens
tgcatttcatattattttagtg

SEQ ID NO: 6468230 - DNA, 13 bp, Homo sapiens
tgcatttcatgct

SEQ ID NO: 6468231 - DNA, 22 bp, Homo sapiens
tgcatttcatgctatcagaaac

SEQ ID NO: 6468232 - DNA, 15 bp, Homo sapiens
tgcatttccagaaat

SEQ ID NO: 6468233 - DNA, 13 bp, Homo sapiens
tgcatttcctgac

SEQ ID NO: 6468234 - DNA, 14 bp, Homo sapiens
tgcatttctctggg

SEQ ID NO: 6468235 - DNA, 12 bp, Homo sapiens
tgcatttctctt

SEQ ID NO: 6468236 - DNA, 14 bp, Homo sapiens
tgcatttctcttcc

SEQ ID NO: 6468237 - DNA, 19 bp, Homo sapiens
tgcatttctcttcctaaat

SEQ ID NO: 6468238 - DNA, 16 bp, Homo sapiens
tgcatttctcttctca

SEQ ID NO: 6468239 - DNA, 16 bp, Homo sapiens
tgcatttctgggcctt

SEQ ID NO: 6468240 - DNA, 14 bp, Homo sapiens
tgcatttctgtatt

SEQ ID NO: 6468241 - DNA, 22 bp, Homo sapiens
tgcatttcttgacttcacagca

SEQ ID NO: 6468242 - DNA, 19 bp, Homo sapiens
tgcatttctttatttctgt

SEQ ID NO: 6468243 - DNA, 18 bp, Homo sapiens
tgcatttgagagaagcca

SEQ ID NO: 6468244 - DNA, 18 bp, Homo sapiens
tgcatttgaggtctgttc

SEQ ID NO: 6468245 - DNA, 20 bp, Homo sapiens
tgcatttgaggtctgttctt

SEQ ID NO: 6468246 - DNA, 12 bp, Homo sapiens
tgcatttgattt

SEQ ID NO: 6468247 - DNA, 18 bp, Homo sapiens
tgcatttgccccttgagc

SEQ ID NO: 6468248 - DNA, 22 bp, Homo sapiens
tgcatttgcctgcttctttcca

SEQ ID NO: 6468249 - DNA, 13 bp, Homo sapiens
tgcatttgctgtt

SEQ ID NO: 6468250 - DNA, 14 bp, Homo sapiens
tgcatttgctgttg

SEQ ID NO: 6468251 - DNA, 21 bp, Homo sapiens
tgcatttgctgttgtttctat

SEQ ID NO: 6468252 - DNA, 14 bp, Homo sapiens
tgcatttggcactg

SEQ ID NO: 6468253 - DNA, 14 bp, Homo sapiens
tgcatttggctgga

SEQ ID NO: 6468254 - DNA, 14 bp, Homo sapiens
tgcatttgggtcca

SEQ ID NO: 6468255 - DNA, 19 bp, Homo sapiens
tgcatttgggtccaggagg

SEQ ID NO: 6468256 - DNA, 18 bp, Homo sapiens
tgcatttgggtggttttt

SEQ ID NO: 6468257 - DNA, 16 bp, Homo sapiens
tgcatttggtcaagat

SEQ ID NO: 6468258 - DNA, 15 bp, Homo sapiens
tgcatttgtatattt

SEQ ID NO: 6468259 - DNA, 18 bp, Homo sapiens
tgcatttgtgctagaaat

SEQ ID NO: 6468260 - DNA, 15 bp, Homo sapiens
tgcatttgtggtaat

SEQ ID NO: 6468261 - DNA, 15 bp, Homo sapiens
tgcatttgtgtctgc

SEQ ID NO: 6468262 - DNA, 16 bp, Homo sapiens
tgcatttgttcagctc

SEQ ID NO: 6468263 - DNA, 20 bp, Homo sapiens
tgcatttgtttgctgaaatt

SEQ ID NO: 6468264 - DNA, 14 bp, Homo sapiens
tgcattttaaatgt

SEQ ID NO: 6468265 - DNA, 16 bp, Homo sapiens
tgcattttaagcataa

SEQ ID NO: 6468266 - DNA, 17 bp, Homo sapiens
tgcattttaattttaac

SEQ ID NO: 6468267 - DNA, 19 bp, Homo sapiens
tgcattttaattttaacca

SEQ ID NO: 6468268 - DNA, 21 bp, Homo sapiens
tgcattttacagtatcttcaa

SEQ ID NO: 6468269 - DNA, 15 bp, Homo sapiens
tgcattttatagaat

SEQ ID NO: 6468270 - DNA, 17 bp, Homo sapiens
tctcccccaacccacct

SEQ ID NO: 6468271 - DNA, 21 bp, Homo sapiens
tctcccccaacccacctctgg

SEQ ID NO: 6468272 - DNA, 20 bp, Homo sapiens
tctcccccaccccctccccg

SEQ ID NO: 6468273 - DNA, 13 bp, Homo sapiens
tctcccccaccct

SEQ ID NO: 6468274 - DNA, 14 bp, Homo sapiens
tctcccccaccctg

SEQ ID NO: 6468275 - DNA, 19 bp, Homo sapiens
tctcccccaccctgtgccc

SEQ ID NO: 6468276 - DNA, 21 bp, Homo sapiens
tctcccccacccttgttccag

SEQ ID NO: 6468277 - DNA, 12 bp, Homo sapiens
tctcccccagcc

SEQ ID NO: 6468278 - DNA, 15 bp, Homo sapiens
tctcccccagcccca

SEQ ID NO: 6468279 - DNA, 14 bp, Homo sapiens
tctccccccatccc

SEQ ID NO: 6468280 - DNA, 15 bp, Homo sapiens
tctccccccatccca

SEQ ID NO: 6468281 - DNA, 19 bp, Homo sapiens
tctccccccatcccagggt

SEQ ID NO: 6468282 - DNA, 19 bp, Homo sapiens
tctcccccgccctgccccg

SEQ ID NO: 6468283 - DNA, 14 bp, Homo sapiens
tctccccctcagct

SEQ ID NO: 6468284 - DNA, 20 bp, Homo sapiens
tctccccctcctccagggaa

SEQ ID NO: 6468285 - DNA, 23 bp, Homo sapiens
tctccccctcctccagggaaggt

SEQ ID NO: 6468286 - DNA, 12 bp, Homo sapiens
tctccccctggg

SEQ ID NO: 6468287 - DNA, 14 bp, Homo sapiens
tctccccctgggct

SEQ ID NO: 6468288 - DNA, 18 bp, Homo sapiens
tctcccccttgtcttccc

SEQ ID NO: 6468289 - DNA, 16 bp, Homo sapiens
tctccccgcagccctc

SEQ ID NO: 6468290 - DNA, 17 bp, Homo sapiens
tctccccgcagccctct

SEQ ID NO: 6468291 - DNA, 19 bp, Homo sapiens
tctccccgctaaggaagat

SEQ ID NO: 6468292 - DNA, 23 bp, Homo sapiens
tctccccggcaggcctgagaatg

SEQ ID NO: 6468293 - DNA, 20 bp, Homo sapiens
tctcccctcacatcctcctg

SEQ ID NO: 6468294 - DNA, 12 bp, Homo sapiens
tctcccctccag

SEQ ID NO: 6468295 - DNA, 13 bp, Homo sapiens
tctcccctccaga

SEQ ID NO: 6468296 - DNA, 15 bp, Homo sapiens
tctcccctccagcct

SEQ ID NO: 6468297 - DNA, 16 bp, Homo sapiens
tctcccctccccatct

SEQ ID NO: 6468298 - DNA, 17 bp, Homo sapiens
tctcccctccccatctg

SEQ ID NO: 6468299 - DNA, 23 bp, Homo sapiens
tctcccctccccatctgtgttct

SEQ ID NO: 6468300 - DNA, 23 bp, Homo sapiens
tctcccctccccgcctggccagg

SEQ ID NO: 6468301 - DNA, 15 bp, Homo sapiens
tctcccctcccttgt

SEQ ID NO: 6468302 - DNA, 17 bp, Homo sapiens
tctcccctcctctgaat

SEQ ID NO: 6468303 - DNA, 16 bp, Homo sapiens
tctcccctctcccagg

SEQ ID NO: 6468304 - DNA, 20 bp, Homo sapiens
tctcccctctcgccccatcc

SEQ ID NO: 6468305 - DNA, 13 bp, Homo sapiens
tctcccctctctg

SEQ ID NO: 6468306 - DNA, 12 bp, Homo sapiens
tctcccctctta

SEQ ID NO: 6468307 - DNA, 14 bp, Homo sapiens
tctcccctcttctg

SEQ ID NO: 6468308 - DNA, 15 bp, Homo sapiens
tctcccctcttctga

SEQ ID NO: 6468309 - DNA, 16 bp, Homo sapiens
tctcccctgcactgta

SEQ ID NO: 6468310 - DNA, 17 bp, Homo sapiens
tctcccctgcactgtaa

SEQ ID NO: 6468311 - DNA, 21 bp, Homo sapiens
tctcccctgcactgtaaaatg

SEQ ID NO: 6468312 - DNA, 12 bp, Homo sapiens
tctcccctgccc

SEQ ID NO: 6468313 - DNA, 22 bp, Homo sapiens
tctcccctgcccccaggactgg

SEQ ID NO: 6468314 - DNA, 19 bp, Homo sapiens
tctcccctgccccctgcag

SEQ ID NO: 6468315 - DNA, 15 bp, Homo sapiens
tctcccctgccctgc

SEQ ID NO: 6468316 - DNA, 14 bp, Homo sapiens
tctcccctgccctt

SEQ ID NO: 6468317 - DNA, 14 bp, Homo sapiens
tctcccctgccggt

SEQ ID NO: 6468318 - DNA, 17 bp, Homo sapiens
tctcccctgcgcaggcc

SEQ ID NO: 6468319 - DNA, 20 bp, Homo sapiens
tctcccctgttggaggtgag

SEQ ID NO: 6468320 - DNA, 21 bp, Homo sapiens
tctccccttccatttctgcct

SEQ ID NO: 6468321 - DNA, 13 bp, Homo sapiens
tctccccttcctg

SEQ ID NO: 6468322 - DNA, 15 bp, Homo sapiens
tctccccttcctggc

SEQ ID NO: 6468323 - DNA, 18 bp, Homo sapiens
tctccccttctctgcctc

SEQ ID NO: 6468324 - DNA, 18 bp, Homo sapiens
tctccccttggttctgca

SEQ ID NO: 6468325 - DNA, 12 bp, Homo sapiens
tctccccttttc

SEQ ID NO: 6468326 - DNA, 14 bp, Homo sapiens
tctcccgccattgg

SEQ ID NO: 6468327 - DNA, 19 bp, Homo sapiens
tctcccgccattggcctta

SEQ ID NO: 6468328 - DNA, 17 bp, Homo sapiens
tctcccgccccccacac

SEQ ID NO: 6468329 - DNA, 19 bp, Homo sapiens
tctcccgcgggcctggaca

SEQ ID NO: 6468330 - DNA, 14 bp, Homo sapiens
tctcccgctgctgc

SEQ ID NO: 6468331 - DNA, 21 bp, Homo sapiens
tctcccgcttcctggcctccc

SEQ ID NO: 6468332 - DNA, 15 bp, Homo sapiens
tctcccggctgcctg

SEQ ID NO: 6468333 - DNA, 16 bp, Homo sapiens
tctcccggctgcctgc

SEQ ID NO: 6468334 - DNA, 17 bp, Homo sapiens
tctcccggctgcctgcc

SEQ ID NO: 6468335 - DNA, 16 bp, Homo sapiens
tctcccgggactctgc

SEQ ID NO: 6468336 - DNA, 13 bp, Homo sapiens
tctcccgtcaggg

SEQ ID NO: 6468337 - DNA, 15 bp, Homo sapiens
tctcccgtctcgcct

SEQ ID NO: 6468338 - DNA, 16 bp, Homo sapiens
tctcccgtctcgcctg

SEQ ID NO: 6468339 - DNA, 15 bp, Homo sapiens
tctccctaaaataaa

SEQ ID NO: 6468340 - DNA, 14 bp, Homo sapiens
tctccctaaagtgt

SEQ ID NO: 6468341 - DNA, 15 bp, Homo sapiens
tctccctaaccacta

SEQ ID NO: 6468342 - DNA, 19 bp, Homo sapiens
tctccctaccctcttctca

SEQ ID NO: 6468343 - DNA, 20 bp, Homo sapiens
tctccctaccctcttctcag

SEQ ID NO: 6468344 - DNA, 21 bp, Homo sapiens
tctccctaccctcttctcagc

SEQ ID NO: 6468345 - DNA, 18 bp, Homo sapiens
tctccctacctccctcct

SEQ ID NO: 6468346 - DNA, 19 bp, Homo sapiens
tctccctacctccctcctc

SEQ ID NO: 6468347 - DNA, 20 bp, Homo sapiens
tctccctaccttgcctcctt

SEQ ID NO: 6468348 - DNA, 22 bp, Homo sapiens
tctccctagcccttctacccca

SEQ ID NO: 6468349 - DNA, 17 bp, Homo sapiens
tctccctcaactgaagg

SEQ ID NO: 6468350 - DNA, 21 bp, Homo sapiens
tctccctcacacctcccttca

SEQ ID NO: 6468351 - DNA, 12 bp, Homo sapiens
tctccctcaccc

SEQ ID NO: 6468352 - DNA, 23 bp, Homo sapiens
tctccctcagtctggcccttcct

SEQ ID NO: 6468353 - DNA, 12 bp, Homo sapiens
tctccctccact

SEQ ID NO: 6468354 - DNA, 20 bp, Homo sapiens
tctccctccactcctcccaa

SEQ ID NO: 6468355 - DNA, 12 bp, Homo sapiens
tctccctccagc

SEQ ID NO: 6468356 - DNA, 21 bp, Homo sapiens
tctccctccagggaatccgcc

SEQ ID NO: 6468357 - DNA, 12 bp, Homo sapiens
tctccctcccct

SEQ ID NO: 6468358 - DNA, 19 bp, Homo sapiens
tctccctcccctctcagaa

SEQ ID NO: 6468359 - DNA, 20 bp, Homo sapiens
tctccctcccttctttcctt

SEQ ID NO: 6468360 - DNA, 22 bp, Homo sapiens
tctccctcccttctttccttcc

SEQ ID NO: 6468361 - DNA, 17 bp, Homo sapiens
tctccctcctcagctcc

SEQ ID NO: 6468362 - DNA, 12 bp, Homo sapiens
tctccctcctgg

SEQ ID NO: 6468363 - DNA, 15 bp, Homo sapiens
tctccctcctggcca

SEQ ID NO: 6468364 - DNA, 16 bp, Homo sapiens
tctccctcctggccag

SEQ ID NO: 6468365 - DNA, 14 bp, Homo sapiens
tctccctcctggtg

SEQ ID NO: 6468366 - DNA, 22 bp, Homo sapiens
tctccctctaggctctgccttc

SEQ ID NO: 6468367 - DNA, 12 bp, Homo sapiens
tctccctctcac

SEQ ID NO: 6468368 - DNA, 17 bp, Homo sapiens
tctccctctcactgtct

SEQ ID NO: 6468369 - DNA, 19 bp, Homo sapiens
tctccctctcatgtccctc

SEQ ID NO: 6468370 - DNA, 23 bp, Homo sapiens
tctccctctcatgtccctccagg

SEQ ID NO: 6468371 - DNA, 15 bp, Homo sapiens
tctccctctcctgcc

SEQ ID NO: 6468372 - DNA, 16 bp, Homo sapiens
tctccctctcctgcct

SEQ ID NO: 6468373 - DNA, 12 bp, Homo sapiens
tctccctctctc

SEQ ID NO: 6468374 - DNA, 15 bp, Homo sapiens
tctccctctctctgg

SEQ ID NO: 6468375 - DNA, 14 bp, Homo sapiens
tctccctctctgca

SEQ ID NO: 6468376 - DNA, 12 bp, Homo sapiens
tctccctctggc

SEQ ID NO: 6468377 - DNA, 13 bp, Homo sapiens
tctccctctttct

SEQ ID NO: 6468378 - DNA, 16 bp, Homo sapiens
tctccctctttctagc

SEQ ID NO: 6468379 - DNA, 18 bp, Homo sapiens
tctccctctttctagcct

SEQ ID NO: 6468380 - DNA, 16 bp, Homo sapiens
tctccctctttttctc

SEQ ID NO: 6468381 - DNA, 14 bp, Homo sapiens
tctccctgagcctg

SEQ ID NO: 6468382 - DNA, 23 bp, Homo sapiens
tctccctgccaagtctcagaaga

SEQ ID NO: 6468383 - DNA, 16 bp, Homo sapiens
tctccctgccatcccc

SEQ ID NO: 6468384 - DNA, 11 bp, Homo sapiens
tctccctgcct

SEQ ID NO: 6468385 - DNA, 14 bp, Homo sapiens
tctccctgcctcac

SEQ ID NO: 6468386 - DNA, 16 bp, Homo sapiens
tctccctgcctcacat

SEQ ID NO: 6468387 - DNA, 17 bp, Homo sapiens
tctccctgcctcacatc

SEQ ID NO: 6468388 - DNA, 15 bp, Homo sapiens
tctccctgcctcact

SEQ ID NO: 6468389 - DNA, 16 bp, Homo sapiens
tctccctgcctcactc

SEQ ID NO: 6468390 - DNA, 12 bp, Homo sapiens
tctccctgcctg

SEQ ID NO: 6468391 - DNA, 15 bp, Homo sapiens
tctccctgcctggcc

SEQ ID NO: 6468392 - DNA, 13 bp, Homo sapiens
tctccctgcctgt

SEQ ID NO: 6468393 - DNA, 14 bp, Homo sapiens
tctccctgccttta

SEQ ID NO: 6468394 - DNA, 18 bp, Homo sapiens
tctccctgctgctcctag

SEQ ID NO: 6468395 - DNA, 20 bp, Homo sapiens
tctccctgctgctcctagga

SEQ ID NO: 6468396 - DNA, 16 bp, Homo sapiens
tctccctggactctgt

SEQ ID NO: 6468397 - DNA, 17 bp, Homo sapiens
tctccctggagaagcac

SEQ ID NO: 6468398 - DNA, 22 bp, Homo sapiens
tctccctggatctacctggagg

SEQ ID NO: 6468399 - DNA, 14 bp, Homo sapiens
tctccctggccctc

SEQ ID NO: 6468400 - DNA, 13 bp, Homo sapiens
tctccctggctcc

SEQ ID NO: 6468401 - DNA, 14 bp, Homo sapiens
tctccctggctccc

SEQ ID NO: 6468402 - DNA, 20 bp, Homo sapiens
tctccctggctccctcctcc

SEQ ID NO: 6468403 - DNA, 23 bp, Homo sapiens
tctccctggctccctcctccagg

SEQ ID NO: 6468404 - DNA, 22 bp, Homo sapiens
tctccctggctgacccctggcc

SEQ ID NO: 6468405 - DNA, 17 bp, Homo sapiens
tctccctgggcaccctg

SEQ ID NO: 6468406 - DNA, 12 bp, Homo sapiens
tctccctgggga

SEQ ID NO: 6468407 - DNA, 18 bp, Homo sapiens
tctccctggggaggaccc

SEQ ID NO: 6468408 - DNA, 23 bp, Homo sapiens
tctccctggggaggacccctgcc

SEQ ID NO: 6468409 - DNA, 18 bp, Homo sapiens
tctccctggtgcctctgt

SEQ ID NO: 6468410 - DNA, 13 bp, Homo sapiens
tctccctggtgct

SEQ ID NO: 6468411 - DNA, 18 bp, Homo sapiens
tctccctggttgcctctc

SEQ ID NO: 6468412 - DNA, 11 bp, Homo sapiens
tctccctgtca

SEQ ID NO: 6468413 - DNA, 18 bp, Homo sapiens
tctccctgtcacacactg

SEQ ID NO: 6468414 - DNA, 19 bp, Homo sapiens
tctccctgtcacacactgg

SEQ ID NO: 6468415 - DNA, 19 bp, Homo sapiens
tctcccttactattcccac

SEQ ID NO: 6468416 - DNA, 16 bp, Homo sapiens
tctcccttcatccttc

SEQ ID NO: 6468417 - DNA, 15 bp, Homo sapiens
tctcccttccctcct

SEQ ID NO: 6468418 - DNA, 19 bp, Homo sapiens
tctcccttcccttccctca

SEQ ID NO: 6468419 - DNA, 23 bp, Homo sapiens
tctcccttcccttccctcacccc

SEQ ID NO: 6468420 - DNA, 21 bp, Homo sapiens
tctcccttccgtccatccccc

SEQ ID NO: 6468421 - DNA, 23 bp, Homo sapiens
tctcccttccgtccatccccctt

SEQ ID NO: 6468422 - DNA, 19 bp, Homo sapiens
tctcccttcctctctcctt

SEQ ID NO: 6468423 - DNA, 16 bp, Homo sapiens
tctcccttctctctct

SEQ ID NO: 6468424 - DNA, 12 bp, Homo sapiens
tctcccttcttg

SEQ ID NO: 6468425 - DNA, 13 bp, Homo sapiens
tctcccttggcca

SEQ ID NO: 6468426 - DNA, 15 bp, Homo sapiens
tctcccttggccacg

SEQ ID NO: 6468427 - DNA, 13 bp, Homo sapiens
tctcccttggccc

SEQ ID NO: 6468428 - DNA, 17 bp, Homo sapiens
tctcccttgggctctga

SEQ ID NO: 6468429 - DNA, 20 bp, Homo sapiens
tctcccttgggctctgatga

SEQ ID NO: 6468430 - DNA, 19 bp, Homo sapiens
tctcccttgtttactctgt

SEQ ID NO: 6468431 - DNA, 17 bp, Homo sapiens
tctccctttatgtatct

SEQ ID NO: 6468432 - DNA, 13 bp, Homo sapiens
tctccctttctct

SEQ ID NO: 6468433 - DNA, 15 bp, Homo sapiens
tctccctttctctct

SEQ ID NO: 6468434 - DNA, 13 bp, Homo sapiens
tctcccttttcag

SEQ ID NO: 6468435 - DNA, 15 bp, Homo sapiens
tctcccttttcagat

SEQ ID NO: 6468436 - DNA, 20 bp, Homo sapiens
tctccgaaatgctgtctttc

SEQ ID NO: 6468437 - DNA, 23 bp, Homo sapiens
tctccgaccagacaccttgacag

SEQ ID NO: 6468438 - DNA, 13 bp, Homo sapiens
tctccgagctctg

SEQ ID NO: 6468439 - DNA, 15 bp, Homo sapiens
tctccgagctctggt

SEQ ID NO: 6468440 - DNA, 20 bp, Homo sapiens
tctccgattttgctctgtct

SEQ ID NO: 6468441 - DNA, 23 bp, Homo sapiens
tctccgcacacctctggctgtct

SEQ ID NO: 6468442 - DNA, 22 bp, Homo sapiens
tctccgcatcgcatcctcttcc

SEQ ID NO: 6468443 - DNA, 21 bp, Homo sapiens
tctccgcattggaagagcccg

SEQ ID NO: 6468444 - DNA, 18 bp, Homo sapiens
tctccgccagcctcctct

SEQ ID NO: 6468445 - DNA, 21 bp, Homo sapiens
tctccgccagcctcctctgga

SEQ ID NO: 6468446 - DNA, 23 bp, Homo sapiens
tctccgcccacgcggctgctgct

SEQ ID NO: 6468447 - DNA, 17 bp, Homo sapiens
tctccgccccccggcct

SEQ ID NO: 6468448 - DNA, 13 bp, Homo sapiens
tctccgccccgga

SEQ ID NO: 6468449 - DNA, 20 bp, Homo sapiens
tctccgcccctgagcccact

SEQ ID NO: 6468450 - DNA, 14 bp, Homo sapiens
tctccgcctcctga

SEQ ID NO: 6468451 - DNA, 17 bp, Homo sapiens
tgcattttatcagacaa

SEQ ID NO: 6468452 - DNA, 18 bp, Homo sapiens
tgcattttattcttgaag

SEQ ID NO: 6468453 - DNA, 13 bp, Homo sapiens
tgcattttattga

SEQ ID NO: 6468454 - DNA, 21 bp, Homo sapiens
tgcattttattgactgggcaa

SEQ ID NO: 6468455 - DNA, 12 bp, Homo sapiens
tgcattttcaca

SEQ ID NO: 6468456 - DNA, 23 bp, Homo sapiens
tgcattttcctcttgtcctggcc

SEQ ID NO: 6468457 - DNA, 16 bp, Homo sapiens
tgcattttctgaaact

SEQ ID NO: 6468458 - DNA, 22 bp, Homo sapiens
tgcattttctgaaactaatgaa

SEQ ID NO: 6468459 - DNA, 14 bp, Homo sapiens
tgcattttgatatt

SEQ ID NO: 6468460 - DNA, 17 bp, Homo sapiens
tgcattttgatattgct

SEQ ID NO: 6468461 - DNA, 18 bp, Homo sapiens
tgcattttgcagcagtga

SEQ ID NO: 6468462 - DNA, 20 bp, Homo sapiens
tgcattttgctagacagtta

SEQ ID NO: 6468463 - DNA, 21 bp, Homo sapiens
tgcattttgctgcctttatta

SEQ ID NO: 6468464 - DNA, 19 bp, Homo sapiens
tgcattttgtgtacagtaa

SEQ ID NO: 6468465 - DNA, 21 bp, Homo sapiens
tgcattttgtgtgatgcatgt

SEQ ID NO: 6468466 - DNA, 22 bp, Homo sapiens
tgcattttgtgtgatgcatgta

SEQ ID NO: 6468467 - DNA, 13 bp, Homo sapiens
tgcattttgtttg

SEQ ID NO: 6468468 - DNA, 18 bp, Homo sapiens
tgcattttgtttggtatt

SEQ ID NO: 6468469 - DNA, 14 bp, Homo sapiens
tgcatttttaaact

SEQ ID NO: 6468470 - DNA, 15 bp, Homo sapiens
tgcatttttaaactt

SEQ ID NO: 6468471 - DNA, 16 bp, Homo sapiens
tgcatttttaaacttg

SEQ ID NO: 6468472 - DNA, 17 bp, Homo sapiens
tgcatttttaaaggaca

SEQ ID NO: 6468473 - DNA, 22 bp, Homo sapiens
tgcatttttaaaggacaaacag

SEQ ID NO: 6468474 - DNA, 19 bp, Homo sapiens
tgcatttttatctgtgagt

SEQ ID NO: 6468475 - DNA, 15 bp, Homo sapiens
tgcatttttattaaa

SEQ ID NO: 6468476 - DNA, 19 bp, Homo sapiens
tgcatttttattaaagcat

SEQ ID NO: 6468477 - DNA, 17 bp, Homo sapiens
tgcatttttcaagagaa

SEQ ID NO: 6468478 - DNA, 22 bp, Homo sapiens
tgcatttttgatgggaagaaaa

SEQ ID NO: 6468479 - DNA, 14 bp, Homo sapiens
tgcatttttgtaaa

SEQ ID NO: 6468480 - DNA, 14 bp, Homo sapiens
tgcatttttgtgaa

SEQ ID NO: 6468481 - DNA, 19 bp, Homo sapiens
tgcatttttgtgaaatgaa

SEQ ID NO: 6468482 - DNA, 22 bp, Homo sapiens
tgcatttttgttttgaaagttt

SEQ ID NO: 6468483 - DNA, 15 bp, Homo sapiens
tgcattttttaaatt

SEQ ID NO: 6468484 - DNA, 20 bp, Homo sapiens
tgcattttttaaatttgcca

SEQ ID NO: 6468485 - DNA, 21 bp, Homo sapiens
tgcatttttttcattactgtt

SEQ ID NO: 6468486 - DNA, 17 bp, Homo sapiens
tgccaaaaaaaaaagaa

SEQ ID NO: 6468487 - DNA, 19 bp, Homo sapiens
tgccaaaaaggatacataa

SEQ ID NO: 6468488 - DNA, 17 bp, Homo sapiens
tgccaaaaagtgaaata

SEQ ID NO: 6468489 - DNA, 19 bp, Homo sapiens
tgccaaaaatacaacacag

SEQ ID NO: 6468490 - DNA, 13 bp, Homo sapiens
tgccaaaaattca

SEQ ID NO: 6468491 - DNA, 17 bp, Homo sapiens
tgccaaaaccaaattga

SEQ ID NO: 6468492 - DNA, 18 bp, Homo sapiens
tgccaaaaccacatgggc

SEQ ID NO: 6468493 - DNA, 20 bp, Homo sapiens
tgccaaaaccacatgggctg

SEQ ID NO: 6468494 - DNA, 21 bp, Homo sapiens
tgccaaaaccacatgggctgg

SEQ ID NO: 6468495 - DNA, 16 bp, Homo sapiens
tgccaaaaccaggcct

SEQ ID NO: 6468496 - DNA, 23 bp, Homo sapiens
tgccaaaaccaggcctctgctgc

SEQ ID NO: 6468497 - DNA, 16 bp, Homo sapiens
tgccaaaacccagctg

SEQ ID NO: 6468498 - DNA, 20 bp, Homo sapiens
tgccaaaacccagctgcacc

SEQ ID NO: 6468499 - DNA, 18 bp, Homo sapiens
tgccaaaagatctgggga

SEQ ID NO: 6468500 - DNA, 15 bp, Homo sapiens
tgccaaaaggcccct

SEQ ID NO: 6468501 - DNA, 21 bp, Homo sapiens
tgccaaaataaacctgttctt

SEQ ID NO: 6468502 - DNA, 16 bp, Homo sapiens
tgccaaaataaagtct

SEQ ID NO: 6468503 - DNA, 20 bp, Homo sapiens
tgccaaaataaagtctgtca

SEQ ID NO: 6468504 - DNA, 13 bp, Homo sapiens
tgccaaaataatg

SEQ ID NO: 6468505 - DNA, 14 bp, Homo sapiens
tgccaaaataatgt

SEQ ID NO: 6468506 - DNA, 21 bp, Homo sapiens
tgccaaaataatgtcttgtta

SEQ ID NO: 6468507 - DNA, 22 bp, Homo sapiens
tgccaaaataatgtcttgttaa

SEQ ID NO: 6468508 - DNA, 13 bp, Homo sapiens
tgccaaaatatat

SEQ ID NO: 6468509 - DNA, 19 bp, Homo sapiens
tgccaaaatgttggctgcg

SEQ ID NO: 6468510 - DNA, 13 bp, Homo sapiens
tgccaaacagagt

SEQ ID NO: 6468511 - DNA, 15 bp, Homo sapiens
tgccaaacagttgta

SEQ ID NO: 6468512 - DNA, 16 bp, Homo sapiens
tgccaaacatcagtca

SEQ ID NO: 6468513 - DNA, 14 bp, Homo sapiens
tgccaaacccagcc

SEQ ID NO: 6468514 - DNA, 17 bp, Homo sapiens
tgccaaacccagcccct

SEQ ID NO: 6468515 - DNA, 19 bp, Homo sapiens
tgccaaacccagcccctgc

SEQ ID NO: 6468516 - DNA, 15 bp, Homo sapiens
tgccaaagaaagtgg

SEQ ID NO: 6468517 - DNA, 17 bp, Homo sapiens
tgccaaagatagcagaa

SEQ ID NO: 6468518 - DNA, 16 bp, Homo sapiens
tgccaaagcaaaagaa

SEQ ID NO: 6468519 - DNA, 17 bp, Homo sapiens
tgccaaagcaaaagaag

SEQ ID NO: 6468520 - DNA, 13 bp, Homo sapiens
tgccaaagcagac

SEQ ID NO: 6468521 - DNA, 17 bp, Homo sapiens
tgccaaagcagacattt

SEQ ID NO: 6468522 - DNA, 20 bp, Homo sapiens
tgccaaagctagggtggccc

SEQ ID NO: 6468523 - DNA, 11 bp, Homo sapiens
tgccaaagctg

SEQ ID NO: 6468524 - DNA, 13 bp, Homo sapiens
tgccaaagctgct

SEQ ID NO: 6468525 - DNA, 14 bp, Homo sapiens
tgccaaagctgctt

SEQ ID NO: 6468526 - DNA, 14 bp, Homo sapiens
tgccaaagctttac

SEQ ID NO: 6468527 - DNA, 15 bp, Homo sapiens
tgccaaaggatgtga

SEQ ID NO: 6468528 - DNA, 19 bp, Homo sapiens
tgccaaaggatgtgatata

SEQ ID NO: 6468529 - DNA, 18 bp, Homo sapiens
tgccaaagggaaatatca

SEQ ID NO: 6468530 - DNA, 11 bp, Homo sapiens
tgccaaagtac

SEQ ID NO: 6468531 - DNA, 22 bp, Homo sapiens
tgccaaagtacagaatttgaat

SEQ ID NO: 6468532 - DNA, 12 bp, Homo sapiens
tgccaaagtagt

SEQ ID NO: 6468533 - DNA, 20 bp, Homo sapiens
tgccaaagtagtcctggcag

SEQ ID NO: 6468534 - DNA, 17 bp, Homo sapiens
tgccaaagtctcccttc

SEQ ID NO: 6468535 - DNA, 15 bp, Homo sapiens
tgccaaagtgcctgg

SEQ ID NO: 6468536 - DNA, 16 bp, Homo sapiens
tgccaaagtgcctggg

SEQ ID NO: 6468537 - DNA, 21 bp, Homo sapiens
tgccaaagtgtctacatgtgc

SEQ ID NO: 6468538 - DNA, 23 bp, Homo sapiens
tgccaaagtgtctacatgtgcca

SEQ ID NO: 6468539 - DNA, 21 bp, Homo sapiens
tgccaaataaaatgtttacat

SEQ ID NO: 6468540 - DNA, 18 bp, Homo sapiens
tgccaaataaacagctat

SEQ ID NO: 6468541 - DNA, 21 bp, Homo sapiens
tgccaaataaatcatcctcat

SEQ ID NO: 6468542 - DNA, 18 bp, Homo sapiens
tgccaaatataaataaaa

SEQ ID NO: 6468543 - DNA, 16 bp, Homo sapiens
tgccaaatattaagaa

SEQ ID NO: 6468544 - DNA, 22 bp, Homo sapiens
tgccaaatcctgggcatcccca

SEQ ID NO: 6468545 - DNA, 21 bp, Homo sapiens
tgccaaatgactttgcacctg

SEQ ID NO: 6468546 - DNA, 12 bp, Homo sapiens
tgccaaatgctc

SEQ ID NO: 6468547 - DNA, 13 bp, Homo sapiens
tgccaaatgctgg

SEQ ID NO: 6468548 - DNA, 13 bp, Homo sapiens
tgccaaattaaaa

SEQ ID NO: 6468549 - DNA, 17 bp, Homo sapiens
tgccaaattaaaaaaga

SEQ ID NO: 6468550 - DNA, 22 bp, Homo sapiens
tgccaaattattctcctatgtt

SEQ ID NO: 6468551 - DNA, 19 bp, Homo sapiens
tgccaaattctccggtttg

SEQ ID NO: 6468552 - DNA, 18 bp, Homo sapiens
tgccaaattgactgtcac

SEQ ID NO: 6468553 - DNA, 18 bp, Homo sapiens
tgccaaattgattgtcat

SEQ ID NO: 6468554 - DNA, 21 bp, Homo sapiens
tgccaacaatcctagtgcttt

SEQ ID NO: 6468555 - DNA, 16 bp, Homo sapiens
tgccaacaccttcttg

SEQ ID NO: 6468556 - DNA, 23 bp, Homo sapiens
tgccaacactcaagaagcaggct

SEQ ID NO: 6468557 - DNA, 24 bp, Homo sapiens
tgccaacagacactacattaccct

SEQ ID NO: 6468558 - DNA, 14 bp, Homo sapiens
tgccaacagagagg

SEQ ID NO: 6468559 - DNA, 19 bp, Homo sapiens
tgccaacatacccttcttt

SEQ ID NO: 6468560 - DNA, 13 bp, Homo sapiens
tgccaacattgcc

SEQ ID NO: 6468561 - DNA, 17 bp, Homo sapiens
tgccaaccacctctggc

SEQ ID NO: 6468562 - DNA, 19 bp, Homo sapiens
tgccaaccataccttcctt

SEQ ID NO: 6468563 - DNA, 16 bp, Homo sapiens
tgccaaccccacccag

SEQ ID NO: 6468564 - DNA, 20 bp, Homo sapiens
tgccaaccccacccagctcc

SEQ ID NO: 6468565 - DNA, 15 bp, Homo sapiens
tgccaaccctgggct

SEQ ID NO: 6468566 - DNA, 17 bp, Homo sapiens
tgccaacctattttgaa

SEQ ID NO: 6468567 - DNA, 15 bp, Homo sapiens
tgccaacctcgctcc

SEQ ID NO: 6468568 - DNA, 19 bp, Homo sapiens
tgccaacctcgctccaact

SEQ ID NO: 6468569 - DNA, 20 bp, Homo sapiens
tgccaacctgatgccccttc

SEQ ID NO: 6468570 - DNA, 22 bp, Homo sapiens
tgccaacctgatgccccttccc

SEQ ID NO: 6468571 - DNA, 18 bp, Homo sapiens
tgccaacctgtaataaat

SEQ ID NO: 6468572 - DNA, 20 bp, Homo sapiens
tgccaacctgtaataaatat

SEQ ID NO: 6468573 - DNA, 16 bp, Homo sapiens
tgccaactaagccctc

SEQ ID NO: 6468574 - DNA, 18 bp, Homo sapiens
tgccaactaagccctcga

SEQ ID NO: 6468575 - DNA, 21 bp, Homo sapiens
tgccaactattctcaggccaa

SEQ ID NO: 6468576 - DNA, 23 bp, Homo sapiens
tgccaactcaggttcacagcagc

SEQ ID NO: 6468577 - DNA, 14 bp, Homo sapiens
tgccaactgtggct

SEQ ID NO: 6468578 - DNA, 15 bp, Homo sapiens
tgccaactgtggctg

SEQ ID NO: 6468579 - DNA, 23 bp, Homo sapiens
tgccaactgttgtaactaggctc

SEQ ID NO: 6468580 - DNA, 23 bp, Homo sapiens
tgccaacttcccacacggcagcc

SEQ ID NO: 6468581 - DNA, 16 bp, Homo sapiens
tgccaacttgatgttc

SEQ ID NO: 6468582 - DNA, 23 bp, Homo sapiens
tgccaacttgatgttccacctgc

SEQ ID NO: 6468583 - DNA, 13 bp, Homo sapiens
tgccaacttgcca

SEQ ID NO: 6468584 - DNA, 17 bp, Homo sapiens
tgccaactttccagact

SEQ ID NO: 6468585 - DNA, 20 bp, Homo sapiens
tgccaacttttagtgggtga

SEQ ID NO: 6468586 - DNA, 17 bp, Homo sapiens
tgccaagaaaaggcatg

SEQ ID NO: 6468587 - DNA, 14 bp, Homo sapiens
tgccaagaaaatga

SEQ ID NO: 6468588 - DNA, 17 bp, Homo sapiens
tgccaagaactctgggc

SEQ ID NO: 6468589 - DNA, 19 bp, Homo sapiens
tgccaagaactgaaaacat

SEQ ID NO: 6468590 - DNA, 13 bp, Homo sapiens
tgccaagacaaat

SEQ ID NO: 6468591 - DNA, 14 bp, Homo sapiens
tgccaagacaaatc

SEQ ID NO: 6468592 - DNA, 19 bp, Homo sapiens
tgccaagactctatgctct

SEQ ID NO: 6468593 - DNA, 23 bp, Homo sapiens
tgccaagagctactcccacagca

SEQ ID NO: 6468594 - DNA, 15 bp, Homo sapiens
tgccaagcacagtgc

SEQ ID NO: 6468595 - DNA, 17 bp, Homo sapiens
tgccaagcactgtgctc

SEQ ID NO: 6468596 - DNA, 15 bp, Homo sapiens
tgccaagcagtgcac

SEQ ID NO: 6468597 - DNA, 12 bp, Homo sapiens
tgccaagccaga

SEQ ID NO: 6468598 - DNA, 17 bp, Homo sapiens
tgccaagccagattctc

SEQ ID NO: 6468599 - DNA, 23 bp, Homo sapiens
tgccaagccatgggtagcctggg

SEQ ID NO: 6468600 - DNA, 13 bp, Homo sapiens
tgccaagccctgg

SEQ ID NO: 6468601 - DNA, 14 bp, Homo sapiens
tgccaagccctggc

SEQ ID NO: 6468602 - DNA, 12 bp, Homo sapiens
tgccaagccctt

SEQ ID NO: 6468603 - DNA, 15 bp, Homo sapiens
tgccaagccctttgc

SEQ ID NO: 6468604 - DNA, 18 bp, Homo sapiens
tgccaagcctggagcccc

SEQ ID NO: 6468605 - DNA, 22 bp, Homo sapiens
tgccaagcctggagcccctgtg

SEQ ID NO: 6468606 - DNA, 17 bp, Homo sapiens
tgccaagccttctgtga

SEQ ID NO: 6468607 - DNA, 22 bp, Homo sapiens
tgccaagctaatttatagcaag

SEQ ID NO: 6468608 - DNA, 18 bp, Homo sapiens
tgccaagctcaggaccag

SEQ ID NO: 6468609 - DNA, 13 bp, Homo sapiens
tgccaagctccaa

SEQ ID NO: 6468610 - DNA, 17 bp, Homo sapiens
tgccaagcttcctgtgc

SEQ ID NO: 6468611 - DNA, 18 bp, Homo sapiens
tgccaagcttcctgtgcc

SEQ ID NO: 6468612 - DNA, 21 bp, Homo sapiens
tgccaagcttcctgtgccctc

SEQ ID NO: 6468613 - DNA, 19 bp, Homo sapiens
tgccaagcttgtgagagct

SEQ ID NO: 6468614 - DNA, 18 bp, Homo sapiens
tgccaaggaggtcccagg

SEQ ID NO: 6468615 - DNA, 20 bp, Homo sapiens
tgccaaggaggtcccaggaa

SEQ ID NO: 6468616 - DNA, 19 bp, Homo sapiens
tgccaaggcagaggcctgg

SEQ ID NO: 6468617 - DNA, 22 bp, Homo sapiens
tgccaaggccagagtggcctgg

SEQ ID NO: 6468618 - DNA, 17 bp, Homo sapiens
tgccaaggccagcccac

SEQ ID NO: 6468619 - DNA, 20 bp, Homo sapiens
tgccaaggccgcccacctgc

SEQ ID NO: 6468620 - DNA, 12 bp, Homo sapiens
tgccaaggcctc

SEQ ID NO: 6468621 - DNA, 20 bp, Homo sapiens
tgccaaggcctccctcaggc

SEQ ID NO: 6468622 - DNA, 14 bp, Homo sapiens
tgccaaggctctcc

SEQ ID NO: 6468623 - DNA, 16 bp, Homo sapiens
tgccaagggaggcgga

SEQ ID NO: 6468624 - DNA, 13 bp, Homo sapiens
tgccaagggcccc

SEQ ID NO: 6468625 - DNA, 15 bp, Homo sapiens
tgccaagggccccag

SEQ ID NO: 6468626 - DNA, 18 bp, Homo sapiens
tgccaagggccccagggg

SEQ ID NO: 6468627 - DNA, 19 bp, Homo sapiens
tgccaagggccccaggggc

SEQ ID NO: 6468628 - DNA, 21 bp, Homo sapiens
tgccaagggccccaggggcag

SEQ ID NO: 6468629 - DNA, 21 bp, Homo sapiens
tctccggatggaatcacagcc

SEQ ID NO: 6468630 - DNA, 18 bp, Homo sapiens
tctccggcctctccagcc

SEQ ID NO: 6468631 - DNA, 14 bp, Homo sapiens
tctccggcctggcc

SEQ ID NO: 6468632 - DNA, 15 bp, Homo sapiens
tctccggcctggcct

SEQ ID NO: 6468633 - DNA, 21 bp, Homo sapiens
tctccggcctggccttttcca

SEQ ID NO: 6468634 - DNA, 15 bp, Homo sapiens
tctccggcgcagaca

SEQ ID NO: 6468635 - DNA, 14 bp, Homo sapiens
tctccggctcccag

SEQ ID NO: 6468636 - DNA, 21 bp, Homo sapiens
tctccggctcccagcctcagc

SEQ ID NO: 6468637 - DNA, 22 bp, Homo sapiens
tctccggctcccagcctcagcg

SEQ ID NO: 6468638 - DNA, 16 bp, Homo sapiens
tctccgggactgccct

SEQ ID NO: 6468639 - DNA, 19 bp, Homo sapiens
tctccgggactgccctctc

SEQ ID NO: 6468640 - DNA, 16 bp, Homo sapiens
tctccggggccatttg

SEQ ID NO: 6468641 - DNA, 19 bp, Homo sapiens
tctccggggtctgtgctgt

SEQ ID NO: 6468642 - DNA, 20 bp, Homo sapiens
tctccggggtctgtgctgtg

SEQ ID NO: 6468643 - DNA, 22 bp, Homo sapiens
tctccggggtctgtgctgtgcc

SEQ ID NO: 6468644 - DNA, 19 bp, Homo sapiens
tctccggggtggccacagg

SEQ ID NO: 6468645 - DNA, 14 bp, Homo sapiens
tctccgggtcctcc

SEQ ID NO: 6468646 - DNA, 15 bp, Homo sapiens
tctccgggtcctcct

SEQ ID NO: 6468647 - DNA, 17 bp, Homo sapiens
tctccgggtcctcctaa

SEQ ID NO: 6468648 - DNA, 15 bp, Homo sapiens
tctccgggtgtggcc

SEQ ID NO: 6468649 - DNA, 18 bp, Homo sapiens
tctccgggtgtggcctca

SEQ ID NO: 6468650 - DNA, 17 bp, Homo sapiens
tctccgtatgatgtgat

SEQ ID NO: 6468651 - DNA, 17 bp, Homo sapiens
tctccgttagctcctgt

SEQ ID NO: 6468652 - DNA, 19 bp, Homo sapiens
tctccgttagctcctgtgg

SEQ ID NO: 6468653 - DNA, 20 bp, Homo sapiens
tctccgttagctcctgtggc

SEQ ID NO: 6468654 - DNA, 21 bp, Homo sapiens
tctccgttagctcctgtggcc

SEQ ID NO: 6468655 - DNA, 22 bp, Homo sapiens
tctccgttagctcctgtggccc

SEQ ID NO: 6468656 - DNA, 23 bp, Homo sapiens
tctccgttagctcctgtggcccc

SEQ ID NO: 6468657 - DNA, 18 bp, Homo sapiens
tctcctaatgctctgaaa

SEQ ID NO: 6468658 - DNA, 20 bp, Homo sapiens
tctcctacatatcccttcca

SEQ ID NO: 6468659 - DNA, 16 bp, Homo sapiens
tctcctaccccacctc

SEQ ID NO: 6468660 - DNA, 24 bp, Homo sapiens
tctcctaccccacctcatgcctgg

SEQ ID NO: 6468661 - DNA, 20 bp, Homo sapiens
tctcctacctgctgctgcta

SEQ ID NO: 6468662 - DNA, 21 bp, Homo sapiens
tctcctacttagggaagaaaa

SEQ ID NO: 6468663 - DNA, 23 bp, Homo sapiens
tctcctagactgaccctgatcag

SEQ ID NO: 6468664 - DNA, 19 bp, Homo sapiens
tctcctagagacagaagca

SEQ ID NO: 6468665 - DNA, 20 bp, Homo sapiens
tctcctagagacagaagcag

SEQ ID NO: 6468666 - DNA, 13 bp, Homo sapiens
tctcctagcccct

SEQ ID NO: 6468667 - DNA, 15 bp, Homo sapiens
tctcctaggagaagc

SEQ ID NO: 6468668 - DNA, 23 bp, Homo sapiens
tctcctaggagaagcagcctcct

SEQ ID NO: 6468669 - DNA, 17 bp, Homo sapiens
tctcctagtgactgggg

SEQ ID NO: 6468670 - DNA, 15 bp, Homo sapiens
tctcctatacccagc

SEQ ID NO: 6468671 - DNA, 18 bp, Homo sapiens
tctcctatatatttctat

SEQ ID NO: 6468672 - DNA, 23 bp, Homo sapiens
tctcctatatatttctattatta

SEQ ID NO: 6468673 - DNA, 19 bp, Homo sapiens
tctcctatgtggcagctgg

SEQ ID NO: 6468674 - DNA, 20 bp, Homo sapiens
tctcctatgtggcagctggg

SEQ ID NO: 6468675 - DNA, 14 bp, Homo sapiens
tctcctatgtgtaa

SEQ ID NO: 6468676 - DNA, 21 bp, Homo sapiens
tctcctattccttcacacagt

SEQ ID NO: 6468677 - DNA, 18 bp, Homo sapiens
tctcctatttttcagaat

SEQ ID NO: 6468678 - DNA, 16 bp, Homo sapiens
tctcctcaagcctgtg

SEQ ID NO: 6468679 - DNA, 13 bp, Homo sapiens
tctcctcacccca

SEQ ID NO: 6468680 - DNA, 15 bp, Homo sapiens
tctcctcactctgtc

SEQ ID NO: 6468681 - DNA, 16 bp, Homo sapiens
tctcctcactctgtcc

SEQ ID NO: 6468682 - DNA, 13 bp, Homo sapiens
tctcctcactgcc

SEQ ID NO: 6468683 - DNA, 21 bp, Homo sapiens
tctcctcagacagtaaccatg

SEQ ID NO: 6468684 - DNA, 14 bp, Homo sapiens
tctcctcagcctcc

SEQ ID NO: 6468685 - DNA, 15 bp, Homo sapiens
tctcctcagcttggg

SEQ ID NO: 6468686 - DNA, 14 bp, Homo sapiens
tctcctcaggacaa

SEQ ID NO: 6468687 - DNA, 14 bp, Homo sapiens
tctcctcaggacca

SEQ ID NO: 6468688 - DNA, 16 bp, Homo sapiens
tctcctcagggtgggg

SEQ ID NO: 6468689 - DNA, 21 bp, Homo sapiens
tctcctcagtggcttctccag

SEQ ID NO: 6468690 - DNA, 17 bp, Homo sapiens
tctcctcatccatttct

SEQ ID NO: 6468691 - DNA, 14 bp, Homo sapiens
tctcctcatctcca

SEQ ID NO: 6468692 - DNA, 14 bp, Homo sapiens
tctcctcatctcta

SEQ ID NO: 6468693 - DNA, 18 bp, Homo sapiens
tctcctcatctctaacag

SEQ ID NO: 6468694 - DNA, 22 bp, Homo sapiens
tctcctcatttaatatttttca

SEQ ID NO: 6468695 - DNA, 14 bp, Homo sapiens
tctcctccaaatgc

SEQ ID NO: 6468696 - DNA, 23 bp, Homo sapiens
tctcctccaagacactgtggact

SEQ ID NO: 6468697 - DNA, 14 bp, Homo sapiens
tctcctccaccgcc

SEQ ID NO: 6468698 - DNA, 18 bp, Homo sapiens
tctcctccatactcagga

SEQ ID NO: 6468699 - DNA, 20 bp, Homo sapiens
tctcctccatgggagaaaat

SEQ ID NO: 6468700 - DNA, 11 bp, Homo sapiens
tctcctcccac

SEQ ID NO: 6468701 - DNA, 23 bp, Homo sapiens
tctcctcccaccagtggccccca

SEQ ID NO: 6468702 - DNA, 14 bp, Homo sapiens
tctcctcccagcgt

SEQ ID NO: 6468703 - DNA, 19 bp, Homo sapiens
tctcctcccagcgtgtgta

SEQ ID NO: 6468704 - DNA, 20 bp, Homo sapiens
tctcctcccagcgtgtgtat

SEQ ID NO: 6468705 - DNA, 22 bp, Homo sapiens
tctcctcccagctgctttactt

SEQ ID NO: 6468706 - DNA, 18 bp, Homo sapiens
tctcctcccatggccttc

SEQ ID NO: 6468707 - DNA, 14 bp, Homo sapiens
tctcctccccacct

SEQ ID NO: 6468708 - DNA, 17 bp, Homo sapiens
tctcctccccacctgta

SEQ ID NO: 6468709 - DNA, 20 bp, Homo sapiens
tctcctccccacctgtagct

SEQ ID NO: 6468710 - DNA, 17 bp, Homo sapiens
tctcctcccccaccttc

SEQ ID NO: 6468711 - DNA, 16 bp, Homo sapiens
tctcctccccttcctg

SEQ ID NO: 6468712 - DNA, 23 bp, Homo sapiens
tctcctcccgcccttccatgtgc

SEQ ID NO: 6468713 - DNA, 14 bp, Homo sapiens
tctcctccctcagc

SEQ ID NO: 6468714 - DNA, 13 bp, Homo sapiens
tctcctccctgtt

SEQ ID NO: 6468715 - DNA, 13 bp, Homo sapiens
tctcctcccttcc

SEQ ID NO: 6468716 - DNA, 23 bp, Homo sapiens
tctcctcccttccttttccctgc

SEQ ID NO: 6468717 - DNA, 13 bp, Homo sapiens
tctcctccgtggc

SEQ ID NO: 6468718 - DNA, 14 bp, Homo sapiens
tctcctcctcccct

SEQ ID NO: 6468719 - DNA, 18 bp, Homo sapiens
tctcctcctcccctcctc

SEQ ID NO: 6468720 - DNA, 20 bp, Homo sapiens
tctcctcggacacccagggt

SEQ ID NO: 6468721 - DNA, 22 bp, Homo sapiens
tctcctcggacacccagggtct

SEQ ID NO: 6468722 - DNA, 21 bp, Homo sapiens
tctcctcgtccatcagggatc

SEQ ID NO: 6468723 - DNA, 9 bp, Homo sapiens
tctcctctc

SEQ ID NO: 6468724 - DNA, 13 bp, Homo sapiens
tctcctctcagct

SEQ ID NO: 6468725 - DNA, 16 bp, Homo sapiens
tctcctctccagccct

SEQ ID NO: 6468726 - DNA, 17 bp, Homo sapiens
tctcctctccatctcta

SEQ ID NO: 6468727 - DNA, 18 bp, Homo sapiens
tctcctctcccaaataaa

SEQ ID NO: 6468728 - DNA, 13 bp, Homo sapiens
tctcctctcccca

SEQ ID NO: 6468729 - DNA, 16 bp, Homo sapiens
tctcctctcccccagg

SEQ ID NO: 6468730 - DNA, 17 bp, Homo sapiens
tctcctctcccctttgt

SEQ ID NO: 6468731 - DNA, 15 bp, Homo sapiens
tctcctctctctccc

SEQ ID NO: 6468732 - DNA, 22 bp, Homo sapiens
tctcctctctctccctccactc

SEQ ID NO: 6468733 - DNA, 18 bp, Homo sapiens
tctcctctctctctttgt

SEQ ID NO: 6468734 - DNA, 15 bp, Homo sapiens
tctcctctctctgta

SEQ ID NO: 6468735 - DNA, 20 bp, Homo sapiens
tctcctctctctttcctcca

SEQ ID NO: 6468736 - DNA, 12 bp, Homo sapiens
tctcctctctgg

SEQ ID NO: 6468737 - DNA, 13 bp, Homo sapiens
tctcctctctggg

SEQ ID NO: 6468738 - DNA, 22 bp, Homo sapiens
tctcctctgctatgcattttct

SEQ ID NO: 6468739 - DNA, 23 bp, Homo sapiens
tctcctctgctatgcattttctt

SEQ ID NO: 6468740 - DNA, 12 bp, Homo sapiens
tctcctctgctg

SEQ ID NO: 6468741 - DNA, 18 bp, Homo sapiens
tctcctctgctgctggct

SEQ ID NO: 6468742 - DNA, 22 bp, Homo sapiens
tctcctctgcttctttgcctcc

SEQ ID NO: 6468743 - DNA, 12 bp, Homo sapiens
tctcctcttaaa

SEQ ID NO: 6468744 - DNA, 14 bp, Homo sapiens
tctcctcttaaaaa

SEQ ID NO: 6468745 - DNA, 23 bp, Homo sapiens
tctcctcttaaaaaataaaaact

SEQ ID NO: 6468746 - DNA, 22 bp, Homo sapiens
tctcctcttcatggcatcttca

SEQ ID NO: 6468747 - DNA, 15 bp, Homo sapiens
tctcctcttctagca

SEQ ID NO: 6468748 - DNA, 13 bp, Homo sapiens
tctcctcttgtaa

SEQ ID NO: 6468749 - DNA, 13 bp, Homo sapiens
tctcctctttaaa

SEQ ID NO: 6468750 - DNA, 17 bp, Homo sapiens
tctcctctttaaaacaa

SEQ ID NO: 6468751 - DNA, 17 bp, Homo sapiens
tctcctctttgatgtca

SEQ ID NO: 6468752 - DNA, 12 bp, Homo sapiens
tctcctgaaatc

SEQ ID NO: 6468753 - DNA, 18 bp, Homo sapiens
tctcctgaacaatatttt

SEQ ID NO: 6468754 - DNA, 16 bp, Homo sapiens
tctcctgacccagtcc

SEQ ID NO: 6468755 - DNA, 15 bp, Homo sapiens
tctcctgacccctgc

SEQ ID NO: 6468756 - DNA, 21 bp, Homo sapiens
tctcctgaccctcccactccc

SEQ ID NO: 6468757 - DNA, 22 bp, Homo sapiens
tctcctgaccctcccactccca

SEQ ID NO: 6468758 - DNA, 21 bp, Homo sapiens
tctcctgactccagtgagctg

SEQ ID NO: 6468759 - DNA, 15 bp, Homo sapiens
tctcctgactggtgc

SEQ ID NO: 6468760 - DNA, 17 bp, Homo sapiens
tctcctgagaggtgctg

SEQ ID NO: 6468761 - DNA, 21 bp, Homo sapiens
tctcctgagaggtgctgcagg

SEQ ID NO: 6468762 - DNA, 19 bp, Homo sapiens
tctcctgaggagcagccca

SEQ ID NO: 6468763 - DNA, 21 bp, Homo sapiens
tctcctgaggagcagcccacc

SEQ ID NO: 6468764 - DNA, 18 bp, Homo sapiens
tctcctgaggatcagaaa

SEQ ID NO: 6468765 - DNA, 20 bp, Homo sapiens
tctcctgaggatcagaaagt

SEQ ID NO: 6468766 - DNA, 19 bp, Homo sapiens
tctcctgagggtcctgctg

SEQ ID NO: 6468767 - DNA, 18 bp, Homo sapiens
tctcctgagttgtataaa

SEQ ID NO: 6468768 - DNA, 22 bp, Homo sapiens
tctcctgagttgtataaaagtt

SEQ ID NO: 6468769 - DNA, 18 bp, Homo sapiens
tctcctgatagtcacctg

SEQ ID NO: 6468770 - DNA, 16 bp, Homo sapiens
tctcctgatcctgcaa

SEQ ID NO: 6468771 - DNA, 18 bp, Homo sapiens
tctcctgcaaatttagtt

SEQ ID NO: 6468772 - DNA, 12 bp, Homo sapiens
tctcctgccaca

SEQ ID NO: 6468773 - DNA, 19 bp, Homo sapiens
tctcctgccagcccagctg

SEQ ID NO: 6468774 - DNA, 14 bp, Homo sapiens
tctcctgcccagat

SEQ ID NO: 6468775 - DNA, 16 bp, Homo sapiens
tctcctgcccagctct

SEQ ID NO: 6468776 - DNA, 22 bp, Homo sapiens
tctcctgcccagctctgaccct

SEQ ID NO: 6468777 - DNA, 13 bp, Homo sapiens
tctcctgccccaa

SEQ ID NO: 6468778 - DNA, 14 bp, Homo sapiens
tctcctgccctctg

SEQ ID NO: 6468779 - DNA, 13 bp, Homo sapiens
tctcctgcctcag

SEQ ID NO: 6468780 - DNA, 14 bp, Homo sapiens
tctcctgcctcagc

SEQ ID NO: 6468781 - DNA, 22 bp, Homo sapiens
tctcctgcctcagcctcccaaa

SEQ ID NO: 6468782 - DNA, 21 bp, Homo sapiens
tctcctgcctcagcctcccga

SEQ ID NO: 6468783 - DNA, 20 bp, Homo sapiens
tctcctgcctcagcctcctg

SEQ ID NO: 6468784 - DNA, 15 bp, Homo sapiens
tctcctgcctgccct

SEQ ID NO: 6468785 - DNA, 13 bp, Homo sapiens
tctcctgcctgta

SEQ ID NO: 6468786 - DNA, 16 bp, Homo sapiens
tctcctgccttcctcc

SEQ ID NO: 6468787 - DNA, 17 bp, Homo sapiens
tctcctgccttcctcct

SEQ ID NO: 6468788 - DNA, 13 bp, Homo sapiens
tctcctgcgcccc

SEQ ID NO: 6468789 - DNA, 16 bp, Homo sapiens
tctcctgcgccccgcc

SEQ ID NO: 6468790 - DNA, 18 bp, Homo sapiens
tctcctgcgggggcgagg

SEQ ID NO: 6468791 - DNA, 19 bp, Homo sapiens
tctcctgcgtgtgcccact

SEQ ID NO: 6468792 - DNA, 13 bp, Homo sapiens
tctcctgctcacc

SEQ ID NO: 6468793 - DNA, 23 bp, Homo sapiens
tctcctgctcaccacctgcctct

SEQ ID NO: 6468794 - DNA, 17 bp, Homo sapiens
tctcctgctcacccgcc

SEQ ID NO: 6468795 - DNA, 14 bp, Homo sapiens
tctcctgctgctcc

SEQ ID NO: 6468796 - DNA, 20 bp, Homo sapiens
tctcctgctgctccctcaga

SEQ ID NO: 6468797 - DNA, 18 bp, Homo sapiens
tctcctgctgctcctgtt

SEQ ID NO: 6468798 - DNA, 14 bp, Homo sapiens
tctcctgcttcctc

SEQ ID NO: 6468799 - DNA, 16 bp, Homo sapiens
tctcctgcttcctctt

SEQ ID NO: 6468800 - DNA, 21 bp, Homo sapiens
tctcctggaaatattaagaaa

SEQ ID NO: 6468801 - DNA, 23 bp, Homo sapiens
tctcctggaccttgacagagcag

SEQ ID NO: 6468802 - DNA, 20 bp, Homo sapiens
tctcctggacgcccccgccc

SEQ ID NO: 6468803 - DNA, 11 bp, Homo sapiens
tctcctggagc

SEQ ID NO: 6468804 - DNA, 14 bp, Homo sapiens
tctcctggagcaag

SEQ ID NO: 6468805 - DNA, 13 bp, Homo sapiens
tctcctggaggat

SEQ ID NO: 6468806 - DNA, 17 bp, Homo sapiens
tctcctggaggcagggg

SEQ ID NO: 6468807 - DNA, 18 bp, Homo sapiens
tctcctggaggcaggggc

SEQ ID NO: 6468808 - DNA, 19 bp, Homo sapiens
tgccaagggggtgactgga

SEQ ID NO: 6468809 - DNA, 20 bp, Homo sapiens
tgccaagggggtgactggaa

SEQ ID NO: 6468810 - DNA, 17 bp, Homo sapiens
tgccaaggttgtcctgg

SEQ ID NO: 6468811 - DNA, 17 bp, Homo sapiens
tgccaagtcagcatatg

SEQ ID NO: 6468812 - DNA, 23 bp, Homo sapiens
tgccaagtcatagccataaatga

SEQ ID NO: 6468813 - DNA, 13 bp, Homo sapiens
tgccaagtccagg

SEQ ID NO: 6468814 - DNA, 15 bp, Homo sapiens
tgccaagtccaggtc

SEQ ID NO: 6468815 - DNA, 17 bp, Homo sapiens
tgccaagtccaggtcct

SEQ ID NO: 6468816 - DNA, 17 bp, Homo sapiens
tgccaagtcctagctcc

SEQ ID NO: 6468817 - DNA, 18 bp, Homo sapiens
tgccaagtcctgcctttg

SEQ ID NO: 6468818 - DNA, 17 bp, Homo sapiens
tgccaagtctcaggagg

SEQ ID NO: 6468819 - DNA, 18 bp, Homo sapiens
tgccaagtctcaggagga

SEQ ID NO: 6468820 - DNA, 15 bp, Homo sapiens
tgccaagtgcctgct

SEQ ID NO: 6468821 - DNA, 20 bp, Homo sapiens
tgccaagtggacttggagct

SEQ ID NO: 6468822 - DNA, 15 bp, Homo sapiens
tgccaagtggccctc

SEQ ID NO: 6468823 - DNA, 23 bp, Homo sapiens
tgccaagtggggatggggcctcc

SEQ ID NO: 6468824 - DNA, 16 bp, Homo sapiens
tgccaagttgctgtca

SEQ ID NO: 6468825 - DNA, 15 bp, Homo sapiens
tgccaagttgtttga

SEQ ID NO: 6468826 - DNA, 19 bp, Homo sapiens
tgccaagttgtttgagaaa

SEQ ID NO: 6468827 - DNA, 16 bp, Homo sapiens
tgccaagtttttcaga

SEQ ID NO: 6468828 - DNA, 21 bp, Homo sapiens
tgccaataaagtgatctgtgt

SEQ ID NO: 6468829 - DNA, 16 bp, Homo sapiens
tgccaataattacatc

SEQ ID NO: 6468830 - DNA, 19 bp, Homo sapiens
tgccaatagttgctgtccc

SEQ ID NO: 6468831 - DNA, 14 bp, Homo sapiens
tgccaatatcctaa

SEQ ID NO: 6468832 - DNA, 16 bp, Homo sapiens
tgccaatatcctaata

SEQ ID NO: 6468833 - DNA, 21 bp, Homo sapiens
tgccaatatcctaataaaaag

SEQ ID NO: 6468834 - DNA, 19 bp, Homo sapiens
tgccaatatgtattgtaaa

SEQ ID NO: 6468835 - DNA, 23 bp, Homo sapiens
tgccaatccttaaatatgtgaaa

SEQ ID NO: 6468836 - DNA, 23 bp, Homo sapiens
tgccaatcggctacccctcgact

SEQ ID NO: 6468837 - DNA, 18 bp, Homo sapiens
tgccaatctaaaatggca

SEQ ID NO: 6468838 - DNA, 19 bp, Homo sapiens
tgccaatcttaaagacaaa

SEQ ID NO: 6468839 - DNA, 15 bp, Homo sapiens
tgccaatcttgtttt

SEQ ID NO: 6468840 - DNA, 17 bp, Homo sapiens
tgccaatcttgttttaa

SEQ ID NO: 6468841 - DNA, 17 bp, Homo sapiens
tgccaatgagtctgtaa

SEQ ID NO: 6468842 - DNA, 22 bp, Homo sapiens
tgccaatgagtctgtaatttta

SEQ ID NO: 6468843 - DNA, 16 bp, Homo sapiens
tgccaatgatgtgacc

SEQ ID NO: 6468844 - DNA, 18 bp, Homo sapiens
tgccaatgatgtgaccct

SEQ ID NO: 6468845 - DNA, 16 bp, Homo sapiens
tgccaatgccacagcc

SEQ ID NO: 6468846 - DNA, 14 bp, Homo sapiens
tgccaatggaacct

SEQ ID NO: 6468847 - DNA, 18 bp, Homo sapiens
tgccaatgggagctcatg

SEQ ID NO: 6468848 - DNA, 21 bp, Homo sapiens
tgccaatggtgtagctgtcct

SEQ ID NO: 6468849 - DNA, 15 bp, Homo sapiens
tgccaatgtatattg

SEQ ID NO: 6468850 - DNA, 15 bp, Homo sapiens
tgccaatgtgggctg

SEQ ID NO: 6468851 - DNA, 20 bp, Homo sapiens
tgccaatgtgggctgcccct

SEQ ID NO: 6468852 - DNA, 13 bp, Homo sapiens
tgccaatgttgtg

SEQ ID NO: 6468853 - DNA, 15 bp, Homo sapiens
tgccaatgttgtgtg

SEQ ID NO: 6468854 - DNA, 20 bp, Homo sapiens
tgccaattacggtgtacagt

SEQ ID NO: 6468855 - DNA, 15 bp, Homo sapiens
tgccaattagcaatt

SEQ ID NO: 6468856 - DNA, 14 bp, Homo sapiens
tgccaattcatctc

SEQ ID NO: 6468857 - DNA, 15 bp, Homo sapiens
tgccaattgctaccg

SEQ ID NO: 6468858 - DNA, 23 bp, Homo sapiens
tgccaattgctaccgagaaggtt

SEQ ID NO: 6468859 - DNA, 12 bp, Homo sapiens
tgccaatttcct

SEQ ID NO: 6468860 - DNA, 14 bp, Homo sapiens
tgccaatttcctct

SEQ ID NO: 6468861 - DNA, 17 bp, Homo sapiens
tgccaatttttgccttc

SEQ ID NO: 6468862 - DNA, 21 bp, Homo sapiens
tgccaatttttgccttcatta

SEQ ID NO: 6468863 - DNA, 14 bp, Homo sapiens
tgccaatttttgtt

SEQ ID NO: 6468864 - DNA, 16 bp, Homo sapiens
tgccacaaaaatgttc

SEQ ID NO: 6468865 - DNA, 16 bp, Homo sapiens
tgccacaaattgaaag

SEQ ID NO: 6468866 - DNA, 16 bp, Homo sapiens
tgccacaacaccagcc

SEQ ID NO: 6468867 - DNA, 17 bp, Homo sapiens
tgccacaacagaataaa

SEQ ID NO: 6468868 - DNA, 20 bp, Homo sapiens
tgccacaacagaataaagca

SEQ ID NO: 6468869 - DNA, 21 bp, Homo sapiens
tgccacaaccacggtcacacc

SEQ ID NO: 6468870 - DNA, 20 bp, Homo sapiens
tgccacaatcactaaatatc

SEQ ID NO: 6468871 - DNA, 18 bp, Homo sapiens
tgccacaatgcagttctg

SEQ ID NO: 6468872 - DNA, 23 bp, Homo sapiens
tgccacaatgcctctcccacgat

SEQ ID NO: 6468873 - DNA, 13 bp, Homo sapiens
tgccacacagagt

SEQ ID NO: 6468874 - DNA, 15 bp, Homo sapiens
tgccacacagtgggc

SEQ ID NO: 6468875 - DNA, 19 bp, Homo sapiens
tgccacaccaagctgtgcc

SEQ ID NO: 6468876 - DNA, 22 bp, Homo sapiens
tgccacaccaagctgtgccacc

SEQ ID NO: 6468877 - DNA, 13 bp, Homo sapiens
tgccacaccctcc

SEQ ID NO: 6468878 - DNA, 22 bp, Homo sapiens
tgccacacctcgaactggttgt

SEQ ID NO: 6468879 - DNA, 16 bp, Homo sapiens
tgccacacctggcctt

SEQ ID NO: 6468880 - DNA, 15 bp, Homo sapiens
tgccacacgcatggg

SEQ ID NO: 6468881 - DNA, 17 bp, Homo sapiens
tgccacacgcatgggca

SEQ ID NO: 6468882 - DNA, 15 bp, Homo sapiens
tgccacactgatggc

SEQ ID NO: 6468883 - DNA, 12 bp, Homo sapiens
tgccacacttca

SEQ ID NO: 6468884 - DNA, 14 bp, Homo sapiens
tgccacacttcagg

SEQ ID NO: 6468885 - DNA, 15 bp, Homo sapiens
tgccacacttcaggc

SEQ ID NO: 6468886 - DNA, 13 bp, Homo sapiens
tgccacagaggcc

SEQ ID NO: 6468887 - DNA, 14 bp, Homo sapiens
tgccacagaggccc

SEQ ID NO: 6468888 - DNA, 15 bp, Homo sapiens
tgccacagaggcccc

SEQ ID NO: 6468889 - DNA, 18 bp, Homo sapiens
tgccacagaggccccacc

SEQ ID NO: 6468890 - DNA, 23 bp, Homo sapiens
tgccacagaggccccacctgaag

SEQ ID NO: 6468891 - DNA, 17 bp, Homo sapiens
tgccacagagtgtagcc

SEQ ID NO: 6468892 - DNA, 13 bp, Homo sapiens
tgccacagccaag

SEQ ID NO: 6468893 - DNA, 11 bp, Homo sapiens
tgccacagccc

SEQ ID NO: 6468894 - DNA, 13 bp, Homo sapiens
tgccacagcccca

SEQ ID NO: 6468895 - DNA, 17 bp, Homo sapiens
tgccacagccctgtcag

SEQ ID NO: 6468896 - DNA, 22 bp, Homo sapiens
tgccacagccctgtcagcatga

SEQ ID NO: 6468897 - DNA, 19 bp, Homo sapiens
tgccacagcctgctggcag

SEQ ID NO: 6468898 - DNA, 23 bp, Homo sapiens
tgccacagcctgctggcagggcc

SEQ ID NO: 6468899 - DNA, 16 bp, Homo sapiens
tgccacagcttttgca

SEQ ID NO: 6468900 - DNA, 14 bp, Homo sapiens
tgccacaggcctcc

SEQ ID NO: 6468901 - DNA, 15 bp, Homo sapiens
tgccacaggcctccc

SEQ ID NO: 6468902 - DNA, 18 bp, Homo sapiens
tgccacaggcctccctgt

SEQ ID NO: 6468903 - DNA, 23 bp, Homo sapiens
tgccacaggcctccctgtttgaa

SEQ ID NO: 6468904 - DNA, 23 bp, Homo sapiens
tgccacaggctgcaagctgcagg

SEQ ID NO: 6468905 - DNA, 17 bp, Homo sapiens
tgccacagggtactaaa

SEQ ID NO: 6468906 - DNA, 17 bp, Homo sapiens
tgccacaggttttaagg

SEQ ID NO: 6468907 - DNA, 18 bp, Homo sapiens
tgccacaggttttaagga

SEQ ID NO: 6468908 - DNA, 21 bp, Homo sapiens
tgccacagtggtactctgtgt

SEQ ID NO: 6468909 - DNA, 13 bp, Homo sapiens
tgccacatacagg

SEQ ID NO: 6468910 - DNA, 18 bp, Homo sapiens
tgccacatacaggtgctc

SEQ ID NO: 6468911 - DNA, 15 bp, Homo sapiens
tgccacatccagctt

SEQ ID NO: 6468912 - DNA, 16 bp, Homo sapiens
tgccacatccagcttg

SEQ ID NO: 6468913 - DNA, 22 bp, Homo sapiens
tgccacatctgtgtctctggaa

SEQ ID NO: 6468914 - DNA, 14 bp, Homo sapiens
tgccacatcttgaa

SEQ ID NO: 6468915 - DNA, 15 bp, Homo sapiens
tgccacatcttgaaa

SEQ ID NO: 6468916 - DNA, 16 bp, Homo sapiens
tgccacatcttgaaaa

SEQ ID NO: 6468917 - DNA, 22 bp, Homo sapiens
tgccacatcttgaaaatgccac

SEQ ID NO: 6468918 - DNA, 23 bp, Homo sapiens
tgccacatcttgaaaatgccacc

SEQ ID NO: 6468919 - DNA, 21 bp, Homo sapiens
tgccacatcttgatctgctca

SEQ ID NO: 6468920 - DNA, 15 bp, Homo sapiens
tgccacatggccgct

SEQ ID NO: 6468921 - DNA, 17 bp, Homo sapiens
tgccacatggccgctgc

SEQ ID NO: 6468922 - DNA, 18 bp, Homo sapiens
tgccacatggtgtctccc

SEQ ID NO: 6468923 - DNA, 20 bp, Homo sapiens
tgccacatggtgtctcccaa

SEQ ID NO: 6468924 - DNA, 22 bp, Homo sapiens
tgccacatggtgtctcccaaca

SEQ ID NO: 6468925 - DNA, 22 bp, Homo sapiens
tgccacattaaattgataacat

SEQ ID NO: 6468926 - DNA, 18 bp, Homo sapiens
tgccacattgcttcatta

SEQ ID NO: 6468927 - DNA, 11 bp, Homo sapiens
tgccacatttc

SEQ ID NO: 6468928 - DNA, 23 bp, Homo sapiens
tgccacatttctgatcagaggtg

SEQ ID NO: 6468929 - DNA, 21 bp, Homo sapiens
tgccaccaactggccctcttc

SEQ ID NO: 6468930 - DNA, 19 bp, Homo sapiens
tgccaccaagctcacacct

SEQ ID NO: 6468931 - DNA, 12 bp, Homo sapiens
tgccaccaataa

SEQ ID NO: 6468932 - DNA, 16 bp, Homo sapiens
tgccaccacactcagc

SEQ ID NO: 6468933 - DNA, 23 bp, Homo sapiens
tgccaccacagcttatggcatct

SEQ ID NO: 6468934 - DNA, 21 bp, Homo sapiens
tgccaccaccagatgagaagt

SEQ ID NO: 6468935 - DNA, 14 bp, Homo sapiens
tgccaccacccacc

SEQ ID NO: 6468936 - DNA, 15 bp, Homo sapiens
tgccaccaccctgcc

SEQ ID NO: 6468937 - DNA, 17 bp, Homo sapiens
tgccaccaccctgtctt

SEQ ID NO: 6468938 - DNA, 18 bp, Homo sapiens
tgccaccaccctgtcttc

SEQ ID NO: 6468939 - DNA, 19 bp, Homo sapiens
tgccaccaccctgtcttcc

SEQ ID NO: 6468940 - DNA, 20 bp, Homo sapiens
tgccaccaccctgtcttcct

SEQ ID NO: 6468941 - DNA, 22 bp, Homo sapiens
tgccaccacctctgtggcattg

SEQ ID NO: 6468942 - DNA, 22 bp, Homo sapiens
tgccaccacgtctgccaggccc

SEQ ID NO: 6468943 - DNA, 23 bp, Homo sapiens
tgccaccacgtctgccaggccca

SEQ ID NO: 6468944 - DNA, 16 bp, Homo sapiens
tgccaccactagagct

SEQ ID NO: 6468945 - DNA, 17 bp, Homo sapiens
tgccaccactagagctg

SEQ ID NO: 6468946 - DNA, 20 bp, Homo sapiens
tgccaccactagagctgaga

SEQ ID NO: 6468947 - DNA, 18 bp, Homo sapiens
tgccaccactataaaatg

SEQ ID NO: 6468948 - DNA, 22 bp, Homo sapiens
tgccaccagagaccgtcctcac

SEQ ID NO: 6468949 - DNA, 16 bp, Homo sapiens
tgccaccagcaatgcc

SEQ ID NO: 6468950 - DNA, 23 bp, Homo sapiens
tgccaccagcccccgccccagag

SEQ ID NO: 6468951 - DNA, 15 bp, Homo sapiens
tgccaccagcccctc

SEQ ID NO: 6468952 - DNA, 17 bp, Homo sapiens
tgccaccagcgccccca

SEQ ID NO: 6468953 - DNA, 14 bp, Homo sapiens
tgccaccaggccac

SEQ ID NO: 6468954 - DNA, 17 bp, Homo sapiens
tgccaccaggccacctc

SEQ ID NO: 6468955 - DNA, 23 bp, Homo sapiens
tgccaccagggagcttcctggct

SEQ ID NO: 6468956 - DNA, 16 bp, Homo sapiens
tgccaccagtcactgt

SEQ ID NO: 6468957 - DNA, 16 bp, Homo sapiens
tgccaccatacctcct

SEQ ID NO: 6468958 - DNA, 18 bp, Homo sapiens
tgccaccatggccagcca

SEQ ID NO: 6468959 - DNA, 12 bp, Homo sapiens
tgccacccacca

SEQ ID NO: 6468960 - DNA, 13 bp, Homo sapiens
tgccacccacccc

SEQ ID NO: 6468961 - DNA, 14 bp, Homo sapiens
tgccacccacccca

SEQ ID NO: 6468962 - DNA, 23 bp, Homo sapiens
tgccacccaccccaagctgctgc

SEQ ID NO: 6468963 - DNA, 13 bp, Homo sapiens
tgccacccacctc

SEQ ID NO: 6468964 - DNA, 17 bp, Homo sapiens
tgccacccacctccctg

SEQ ID NO: 6468965 - DNA, 20 bp, Homo sapiens
tgccacccactcaggattgg

SEQ ID NO: 6468966 - DNA, 20 bp, Homo sapiens
tgccacccagcaacacagag

SEQ ID NO: 6468967 - DNA, 14 bp, Homo sapiens
tgccaccccaccct

SEQ ID NO: 6468968 - DNA, 15 bp, Homo sapiens
tgccaccccaccctc

SEQ ID NO: 6468969 - DNA, 19 bp, Homo sapiens
tgccaccccaccctccctg

SEQ ID NO: 6468970 - DNA, 20 bp, Homo sapiens
tgccaccccaccctccctgg

SEQ ID NO: 6468971 - DNA, 23 bp, Homo sapiens
tgccaccccaggtttttcatctg

SEQ ID NO: 6468972 - DNA, 14 bp, Homo sapiens
tgccaccccatgtg

SEQ ID NO: 6468973 - DNA, 19 bp, Homo sapiens
tgccaccccatgtgccttt

SEQ ID NO: 6468974 - DNA, 14 bp, Homo sapiens
tgccacccccaggt

SEQ ID NO: 6468975 - DNA, 15 bp, Homo sapiens
tgccacccccaggtc

SEQ ID NO: 6468976 - DNA, 17 bp, Homo sapiens
tgccacccccaggtctt

SEQ ID NO: 6468977 - DNA, 15 bp, Homo sapiens
tgccacccccagttc

SEQ ID NO: 6468978 - DNA, 22 bp, Homo sapiens
tgccacccccagttcctatgac

SEQ ID NO: 6468979 - DNA, 19 bp, Homo sapiens
tgccacccccgctggagga

SEQ ID NO: 6468980 - DNA, 23 bp, Homo sapiens
tgccacccccgctggaggatgtg

SEQ ID NO: 6468981 - DNA, 19 bp, Homo sapiens
tgccacccccttccctggg

SEQ ID NO: 6468982 - DNA, 17 bp, Homo sapiens
tgccaccccgagggctg

SEQ ID NO: 6468983 - DNA, 18 bp, Homo sapiens
tgccaccccgagggctga

SEQ ID NO: 6468984 - DNA, 20 bp, Homo sapiens
tgccacccctaaactccagg

SEQ ID NO: 6468985 - DNA, 15 bp, Homo sapiens
tgccacccctcttct

SEQ ID NO: 6468986 - DNA, 23 bp, Homo sapiens
tctcctggaggctggttctgctg

SEQ ID NO: 6468987 - DNA, 18 bp, Homo sapiens
tctcctggagggcgccca

SEQ ID NO: 6468988 - DNA, 19 bp, Homo sapiens
tctcctggagggcgcccag

SEQ ID NO: 6468989 - DNA, 13 bp, Homo sapiens
tctcctggcccct

SEQ ID NO: 6468990 - DNA, 11 bp, Homo sapiens
tctcctggcct

SEQ ID NO: 6468991 - DNA, 19 bp, Homo sapiens
tctcctggcctatccgctg

SEQ ID NO: 6468992 - DNA, 12 bp, Homo sapiens
tctcctggctgt

SEQ ID NO: 6468993 - DNA, 12 bp, Homo sapiens
tctcctggcttc

SEQ ID NO: 6468994 - DNA, 23 bp, Homo sapiens
tctcctggcttcccatccccagc

SEQ ID NO: 6468995 - DNA, 21 bp, Homo sapiens
tctcctggctttacagacaaa

SEQ ID NO: 6468996 - DNA, 12 bp, Homo sapiens
tctcctgggaaa

SEQ ID NO: 6468997 - DNA, 20 bp, Homo sapiens
tctcctgggcagctgcctcc

SEQ ID NO: 6468998 - DNA, 21 bp, Homo sapiens
tctcctgggcagctgcctccc

SEQ ID NO: 6468999 - DNA, 16 bp, Homo sapiens
tctcctgggcatctgg

SEQ ID NO: 6469000 - DNA, 21 bp, Homo sapiens
tctcctgggcatctggccctg

SEQ ID NO: 6469001 - DNA, 22 bp, Homo sapiens
tctcctgggcatctggccctgc

SEQ ID NO: 6469002 - DNA, 23 bp, Homo sapiens
tctcctgggcatctggccctgct

SEQ ID NO: 6469003 - DNA, 19 bp, Homo sapiens
tctcctgggcccctcccta

SEQ ID NO: 6469004 - DNA, 21 bp, Homo sapiens
tctcctgggcccgctttgcct

SEQ ID NO: 6469005 - DNA, 23 bp, Homo sapiens
tctcctgggcccgctttgcctgc

SEQ ID NO: 6469006 - DNA, 20 bp, Homo sapiens
tctcctgggggtggcaggca

SEQ ID NO: 6469007 - DNA, 21 bp, Homo sapiens
tctcctggtagaggggccggc

SEQ ID NO: 6469008 - DNA, 18 bp, Homo sapiens
tctcctggtagcatgacc

SEQ ID NO: 6469009 - DNA, 23 bp, Homo sapiens
tctcctggtgtttttctctctgg

SEQ ID NO: 6469010 - DNA, 19 bp, Homo sapiens
tctcctgtaagccaaagaa

SEQ ID NO: 6469011 - DNA, 16 bp, Homo sapiens
tctcctgtaattttgt

SEQ ID NO: 6469012 - DNA, 15 bp, Homo sapiens
tctcctgtacctctt

SEQ ID NO: 6469013 - DNA, 19 bp, Homo sapiens
tctcctgtacctcttgagc

SEQ ID NO: 6469014 - DNA, 20 bp, Homo sapiens
tctcctgtataaccccacct

SEQ ID NO: 6469015 - DNA, 22 bp, Homo sapiens
tctcctgtccctccatcccaga

SEQ ID NO: 6469016 - DNA, 23 bp, Homo sapiens
tctcctgtcttatggtccagaaa

SEQ ID NO: 6469017 - DNA, 19 bp, Homo sapiens
tctcctgtgatgtcccagt

SEQ ID NO: 6469018 - DNA, 10 bp, Homo sapiens
tctcctgtgc

SEQ ID NO: 6469019 - DNA, 11 bp, Homo sapiens
tctcctgtgcc

SEQ ID NO: 6469020 - DNA, 17 bp, Homo sapiens
tctcctgtgcccacatc

SEQ ID NO: 6469021 - DNA, 20 bp, Homo sapiens
tctcctgtgtcttaaatact

SEQ ID NO: 6469022 - DNA, 17 bp, Homo sapiens
tctcctgtgtgcttgtc

SEQ ID NO: 6469023 - DNA, 17 bp, Homo sapiens
tctcctgtttcagacca

SEQ ID NO: 6469024 - DNA, 17 bp, Homo sapiens
tctcctgtttcccttcc

SEQ ID NO: 6469025 - DNA, 21 bp, Homo sapiens
tctcctgttttatatattatg

SEQ ID NO: 6469026 - DNA, 17 bp, Homo sapiens
tctccttaaactaccac

SEQ ID NO: 6469027 - DNA, 22 bp, Homo sapiens
tctccttaagctgcagagattt

SEQ ID NO: 6469028 - DNA, 16 bp, Homo sapiens
tctccttacctctgga

SEQ ID NO: 6469029 - DNA, 22 bp, Homo sapiens
tctccttacctgtggagaagcc

SEQ ID NO: 6469030 - DNA, 16 bp, Homo sapiens
tctccttactctgagc

SEQ ID NO: 6469031 - DNA, 17 bp, Homo sapiens
tctccttactctgagcc

SEQ ID NO: 6469032 - DNA, 19 bp, Homo sapiens
tctccttactctgagccca

SEQ ID NO: 6469033 - DNA, 15 bp, Homo sapiens
tctccttagaagtgg

SEQ ID NO: 6469034 - DNA, 17 bp, Homo sapiens
tctccttagacactttg

SEQ ID NO: 6469035 - DNA, 15 bp, Homo sapiens
tctccttagatgtga

SEQ ID NO: 6469036 - DNA, 17 bp, Homo sapiens
tctccttagcttctggc

SEQ ID NO: 6469037 - DNA, 17 bp, Homo sapiens
tctccttagtcttctca

SEQ ID NO: 6469038 - DNA, 16 bp, Homo sapiens
tctccttcacctttgt

SEQ ID NO: 6469039 - DNA, 13 bp, Homo sapiens
tctccttcagcac

SEQ ID NO: 6469040 - DNA, 15 bp, Homo sapiens
tctccttcagccctc

SEQ ID NO: 6469041 - DNA, 11 bp, Homo sapiens
tctccttccaa

SEQ ID NO: 6469042 - DNA, 15 bp, Homo sapiens
tctccttccaactgc

SEQ ID NO: 6469043 - DNA, 21 bp, Homo sapiens
tctccttccaactgctgcccc

SEQ ID NO: 6469044 - DNA, 22 bp, Homo sapiens
tctccttccagtataaccagct

SEQ ID NO: 6469045 - DNA, 13 bp, Homo sapiens
tctccttcccaag

SEQ ID NO: 6469046 - DNA, 19 bp, Homo sapiens
tctccttcccaaggcagct

SEQ ID NO: 6469047 - DNA, 15 bp, Homo sapiens
tctccttcccactgt

SEQ ID NO: 6469048 - DNA, 13 bp, Homo sapiens
tctccttcccaga

SEQ ID NO: 6469049 - DNA, 15 bp, Homo sapiens
tctccttcccagata

SEQ ID NO: 6469050 - DNA, 17 bp, Homo sapiens
tctccttcccagataag

SEQ ID NO: 6469051 - DNA, 11 bp, Homo sapiens
tctccttcccc

SEQ ID NO: 6469052 - DNA, 18 bp, Homo sapiens
tctccttcccccagccca

SEQ ID NO: 6469053 - DNA, 21 bp, Homo sapiens
tctccttcccccagcccaata

SEQ ID NO: 6469054 - DNA, 22 bp, Homo sapiens
tctccttcccccagcccaataa

SEQ ID NO: 6469055 - DNA, 14 bp, Homo sapiens
tctccttcccctac

SEQ ID NO: 6469056 - DNA, 11 bp, Homo sapiens
tctccttccct

SEQ ID NO: 6469057 - DNA, 14 bp, Homo sapiens
tctccttccctctc

SEQ ID NO: 6469058 - DNA, 14 bp, Homo sapiens
tctccttccctctt

SEQ ID NO: 6469059 - DNA, 15 bp, Homo sapiens
tctccttccctcttt

SEQ ID NO: 6469060 - DNA, 17 bp, Homo sapiens
tctccttccctgcagag

SEQ ID NO: 6469061 - DNA, 20 bp, Homo sapiens
tctccttcccttctcttggg

SEQ ID NO: 6469062 - DNA, 13 bp, Homo sapiens
tctccttcctcag

SEQ ID NO: 6469063 - DNA, 14 bp, Homo sapiens
tctccttcctcaga

SEQ ID NO: 6469064 - DNA, 17 bp, Homo sapiens
tctccttcctcagcctc

SEQ ID NO: 6469065 - DNA, 14 bp, Homo sapiens
tctccttcctcttg

SEQ ID NO: 6469066 - DNA, 21 bp, Homo sapiens
tctccttcgctttcctgagcc

SEQ ID NO: 6469067 - DNA, 23 bp, Homo sapiens
tctccttcgtatcccgagtctgg

SEQ ID NO: 6469068 - DNA, 13 bp, Homo sapiens
tctccttcttagc

SEQ ID NO: 6469069 - DNA, 19 bp, Homo sapiens
tctccttgaagcaaatgtg

SEQ ID NO: 6469070 - DNA, 21 bp, Homo sapiens
tctccttgaagcaaatgtgtg

SEQ ID NO: 6469071 - DNA, 16 bp, Homo sapiens
tctccttgagtgtatg

SEQ ID NO: 6469072 - DNA, 16 bp, Homo sapiens
tctccttgataacagc

SEQ ID NO: 6469073 - DNA, 18 bp, Homo sapiens
tctccttgattacataat

SEQ ID NO: 6469074 - DNA, 13 bp, Homo sapiens
tctccttgcagtt

SEQ ID NO: 6469075 - DNA, 17 bp, Homo sapiens
tctccttgcagttcttg

SEQ ID NO: 6469076 - DNA, 19 bp, Homo sapiens
tctccttgccccagtcctg

SEQ ID NO: 6469077 - DNA, 22 bp, Homo sapiens
tctccttgccccccgccctcat

SEQ ID NO: 6469078 - DNA, 14 bp, Homo sapiens
tctccttgccctgg

SEQ ID NO: 6469079 - DNA, 15 bp, Homo sapiens
tctccttgccctggg

SEQ ID NO: 6469080 - DNA, 16 bp, Homo sapiens
tctccttgccttgctt

SEQ ID NO: 6469081 - DNA, 19 bp, Homo sapiens
tctccttgccttgcttctc

SEQ ID NO: 6469082 - DNA, 18 bp, Homo sapiens
tctccttgctacccagaa

SEQ ID NO: 6469083 - DNA, 21 bp, Homo sapiens
tctccttggcctttcctggaa

SEQ ID NO: 6469084 - DNA, 14 bp, Homo sapiens
tctccttgggctcc

SEQ ID NO: 6469085 - DNA, 19 bp, Homo sapiens
tctccttgggctcctggct

SEQ ID NO: 6469086 - DNA, 23 bp, Homo sapiens
tctccttggtgtcgggcatgaca

SEQ ID NO: 6469087 - DNA, 22 bp, Homo sapiens
tctccttgtcacagaatctcca

SEQ ID NO: 6469088 - DNA, 19 bp, Homo sapiens
tctccttgtggcctgggcc

SEQ ID NO: 6469089 - DNA, 17 bp, Homo sapiens
tctcctttaattgtaaa

SEQ ID NO: 6469090 - DNA, 22 bp, Homo sapiens
tctcctttaattgtaaagtaaa

SEQ ID NO: 6469091 - DNA, 20 bp, Homo sapiens
tctcctttagggacagctta

SEQ ID NO: 6469092 - DNA, 23 bp, Homo sapiens
tctcctttcaccccagggcctga

SEQ ID NO: 6469093 - DNA, 21 bp, Homo sapiens
tctcctttccttcccaggccc

SEQ ID NO: 6469094 - DNA, 22 bp, Homo sapiens
tctcctttccttcccaggccct

SEQ ID NO: 6469095 - DNA, 14 bp, Homo sapiens
tctcctttctgact

SEQ ID NO: 6469096 - DNA, 15 bp, Homo sapiens
tctcctttctgactg

SEQ ID NO: 6469097 - DNA, 13 bp, Homo sapiens
tctcctttctgtg

SEQ ID NO: 6469098 - DNA, 15 bp, Homo sapiens
tctcctttctttcta

SEQ ID NO: 6469099 - DNA, 22 bp, Homo sapiens
tctcctttgaagaaggcaaggc

SEQ ID NO: 6469100 - DNA, 13 bp, Homo sapiens
tctcctttgcaat

SEQ ID NO: 6469101 - DNA, 17 bp, Homo sapiens
tctcctttgcaatagca

SEQ ID NO: 6469102 - DNA, 21 bp, Homo sapiens
tctcctttgcaatagcagtta

SEQ ID NO: 6469103 - DNA, 21 bp, Homo sapiens
tctcctttgcactgagggcca

SEQ ID NO: 6469104 - DNA, 23 bp, Homo sapiens
tctcctttgcactgagggccaca

SEQ ID NO: 6469105 - DNA, 19 bp, Homo sapiens
tctcctttgctagtgtctt

SEQ ID NO: 6469106 - DNA, 13 bp, Homo sapiens
tctcctttgctct

SEQ ID NO: 6469107 - DNA, 17 bp, Homo sapiens
tctcctttgctcttgcc

SEQ ID NO: 6469108 - DNA, 22 bp, Homo sapiens
tctcctttgctgaggcctccag

SEQ ID NO: 6469109 - DNA, 20 bp, Homo sapiens
tctcctttggaaggtgacac

SEQ ID NO: 6469110 - DNA, 15 bp, Homo sapiens
tctcctttgtattct

SEQ ID NO: 6469111 - DNA, 17 bp, Homo sapiens
tctcctttgtattctgt

SEQ ID NO: 6469112 - DNA, 23 bp, Homo sapiens
tctcctttgtcaaatggtatttt

SEQ ID NO: 6469113 - DNA, 22 bp, Homo sapiens
tctccttttacttcacttcaaa

SEQ ID NO: 6469114 - DNA, 17 bp, Homo sapiens
tctccttttcctatcct

SEQ ID NO: 6469115 - DNA, 19 bp, Homo sapiens
tctccttttcctctctccc

SEQ ID NO: 6469116 - DNA, 13 bp, Homo sapiens
tctccttttctcc

SEQ ID NO: 6469117 - DNA, 16 bp, Homo sapiens
tctccttttctccact

SEQ ID NO: 6469118 - DNA, 19 bp, Homo sapiens
tctccttttcttttgttac

SEQ ID NO: 6469119 - DNA, 12 bp, Homo sapiens
tctccttttgaa

SEQ ID NO: 6469120 - DNA, 15 bp, Homo sapiens
tctccttttgaactt

SEQ ID NO: 6469121 - DNA, 15 bp, Homo sapiens
tctccttttgactcc

SEQ ID NO: 6469122 - DNA, 20 bp, Homo sapiens
tctcgaactcctaacctcaa

SEQ ID NO: 6469123 - DNA, 19 bp, Homo sapiens
tctcgaactcctgacctca

SEQ ID NO: 6469124 - DNA, 23 bp, Homo sapiens
tctcgaactcctggactcaaagt

SEQ ID NO: 6469125 - DNA, 16 bp, Homo sapiens
tctcgaactgctggat

SEQ ID NO: 6469126 - DNA, 15 bp, Homo sapiens
tctcgaagtcttcca

SEQ ID NO: 6469127 - DNA, 15 bp, Homo sapiens
tctcgaatgtaattg

SEQ ID NO: 6469128 - DNA, 16 bp, Homo sapiens
tctcgactgcttttcg

SEQ ID NO: 6469129 - DNA, 21 bp, Homo sapiens
tctcgagacttctctgtgaac

SEQ ID NO: 6469130 - DNA, 22 bp, Homo sapiens
tctcgagcgccctgcagaccct

SEQ ID NO: 6469131 - DNA, 12 bp, Homo sapiens
tctcgagcttgg

SEQ ID NO: 6469132 - DNA, 12 bp, Homo sapiens
tctcgagtccaa

SEQ ID NO: 6469133 - DNA, 15 bp, Homo sapiens
tctcgatatcctgat

SEQ ID NO: 6469134 - DNA, 13 bp, Homo sapiens
tctcgatctcctg

SEQ ID NO: 6469135 - DNA, 13 bp, Homo sapiens
tctcgatgctgct

SEQ ID NO: 6469136 - DNA, 13 bp, Homo sapiens
tctcgcaactgaa

SEQ ID NO: 6469137 - DNA, 19 bp, Homo sapiens
tctcgcacaatgcatgtgc

SEQ ID NO: 6469138 - DNA, 13 bp, Homo sapiens
tctcgcagcctga

SEQ ID NO: 6469139 - DNA, 21 bp, Homo sapiens
tctcgcagcctgaagcctgga

SEQ ID NO: 6469140 - DNA, 16 bp, Homo sapiens
tctcgcatcttcccaa

SEQ ID NO: 6469141 - DNA, 12 bp, Homo sapiens
tctcgcattttc

SEQ ID NO: 6469142 - DNA, 14 bp, Homo sapiens
tctcgccccatccc

SEQ ID NO: 6469143 - DNA, 13 bp, Homo sapiens
tctcgccccttcc

SEQ ID NO: 6469144 - DNA, 16 bp, Homo sapiens
tctcgccctggccagg

SEQ ID NO: 6469145 - DNA, 16 bp, Homo sapiens
tctcgcctaggatttc

SEQ ID NO: 6469146 - DNA, 20 bp, Homo sapiens
tctcgcctaggatttcagcc

SEQ ID NO: 6469147 - DNA, 17 bp, Homo sapiens
tctcgccttcctgcagt

SEQ ID NO: 6469148 - DNA, 14 bp, Homo sapiens
tctcgcgccctccc

SEQ ID NO: 6469149 - DNA, 21 bp, Homo sapiens
tctcgctaaagttatatttgt

SEQ ID NO: 6469150 - DNA, 17 bp, Homo sapiens
tctcgctcgctcgctct

SEQ ID NO: 6469151 - DNA, 20 bp, Homo sapiens
tctcgctgatgctgggctgg

SEQ ID NO: 6469152 - DNA, 21 bp, Homo sapiens
tctcgctgtcactggctggct

SEQ ID NO: 6469153 - DNA, 22 bp, Homo sapiens
tctcgctgtcactggctggctc

SEQ ID NO: 6469154 - DNA, 17 bp, Homo sapiens
tctcgcttcctcagcct

SEQ ID NO: 6469155 - DNA, 21 bp, Homo sapiens
tctcggaactgcatgctgctg

SEQ ID NO: 6469156 - DNA, 21 bp, Homo sapiens
tctcggacctttcagctgtga

SEQ ID NO: 6469157 - DNA, 17 bp, Homo sapiens
tctcggagctggcccag

SEQ ID NO: 6469158 - DNA, 13 bp, Homo sapiens
tctcggaggccag

SEQ ID NO: 6469159 - DNA, 23 bp, Homo sapiens
tctcggatagttgctatttttgt

SEQ ID NO: 6469160 - DNA, 15 bp, Homo sapiens
tctcggatgaccaaa

SEQ ID NO: 6469161 - DNA, 18 bp, Homo sapiens
tctcggatgaccaaacca

SEQ ID NO: 6469162 - DNA, 21 bp, Homo sapiens
tctcggcatagtccccagagc

SEQ ID NO: 6469163 - DNA, 23 bp, Homo sapiens
tctcggccagcccgtcctcctct

SEQ ID NO: 6469164 - DNA, 18 bp, Homo sapiens
tgccacccctcttctgct

SEQ ID NO: 6469165 - DNA, 17 bp, Homo sapiens
tgccacccctgtccaga

SEQ ID NO: 6469166 - DNA, 23 bp, Homo sapiens
tgccaccccttcctcagcctggg

SEQ ID NO: 6469167 - DNA, 16 bp, Homo sapiens
tgccaccccttcctcc

SEQ ID NO: 6469168 - DNA, 19 bp, Homo sapiens
tgccaccccttcctcccca

SEQ ID NO: 6469169 - DNA, 17 bp, Homo sapiens
tgccacccgtaggcagc

SEQ ID NO: 6469170 - DNA, 14 bp, Homo sapiens
tgccaccctagcca

SEQ ID NO: 6469171 - DNA, 12 bp, Homo sapiens
tgccaccctcac

SEQ ID NO: 6469172 - DNA, 17 bp, Homo sapiens
tgccaccctcacacaca

SEQ ID NO: 6469173 - DNA, 15 bp, Homo sapiens
tgccaccctcctgcg

SEQ ID NO: 6469174 - DNA, 15 bp, Homo sapiens
tgccaccctctccat

SEQ ID NO: 6469175 - DNA, 19 bp, Homo sapiens
tgccaccctctgcagggca

SEQ ID NO: 6469176 - DNA, 15 bp, Homo sapiens
tgccaccctctgctg

SEQ ID NO: 6469177 - DNA, 19 bp, Homo sapiens
tgccaccctctgctgcaca

SEQ ID NO: 6469178 - DNA, 24 bp, Homo sapiens
tgccaccctctgctgcacagtagt

SEQ ID NO: 6469179 - DNA, 14 bp, Homo sapiens
tgccaccctgggct

SEQ ID NO: 6469180 - DNA, 15 bp, Homo sapiens
tgccaccctgggctc

SEQ ID NO: 6469181 - DNA, 20 bp, Homo sapiens
tgccaccctgggctctgtgg

SEQ ID NO: 6469182 - DNA, 20 bp, Homo sapiens
tgccaccgactgcccagcca

SEQ ID NO: 6469183 - DNA, 21 bp, Homo sapiens
tgccaccgactgcccagccac

SEQ ID NO: 6469184 - DNA, 16 bp, Homo sapiens
tgccaccgattgcagg

SEQ ID NO: 6469185 - DNA, 18 bp, Homo sapiens
tgccaccgccagaggaca

SEQ ID NO: 6469186 - DNA, 21 bp, Homo sapiens
tgccaccgccagaggacaagg

SEQ ID NO: 6469187 - DNA, 17 bp, Homo sapiens
tgccaccggggaaccca

SEQ ID NO: 6469188 - DNA, 13 bp, Homo sapiens
tgccacctagact

SEQ ID NO: 6469189 - DNA, 22 bp, Homo sapiens
tgccacctagactctccctgta

SEQ ID NO: 6469190 - DNA, 15 bp, Homo sapiens
tgccacctcccccca

SEQ ID NO: 6469191 - DNA, 22 bp, Homo sapiens
tgccacctcccctatccaccca

SEQ ID NO: 6469192 - DNA, 18 bp, Homo sapiens
tgccacctccccttgcca

SEQ ID NO: 6469193 - DNA, 15 bp, Homo sapiens
tgccacctcctctgt

SEQ ID NO: 6469194 - DNA, 15 bp, Homo sapiens
tgccacctctcccag

SEQ ID NO: 6469195 - DNA, 16 bp, Homo sapiens
tgccacctctcccagc

SEQ ID NO: 6469196 - DNA, 19 bp, Homo sapiens
tgccacctggacccctgca

SEQ ID NO: 6469197 - DNA, 20 bp, Homo sapiens
tgccacctggacccctgcat

SEQ ID NO: 6469198 - DNA, 12 bp, Homo sapiens
tgccacctggca

SEQ ID NO: 6469199 - DNA, 13 bp, Homo sapiens
tgccacctggcaa

SEQ ID NO: 6469200 - DNA, 20 bp, Homo sapiens
tgccacctgtccggcccagt

SEQ ID NO: 6469201 - DNA, 23 bp, Homo sapiens
tgccacgaatttctgtgccctcc

SEQ ID NO: 6469202 - DNA, 20 bp, Homo sapiens
tgccacgcacttcctctctc

SEQ ID NO: 6469203 - DNA, 24 bp, Homo sapiens
tgccacgcacttcctctctcggag

SEQ ID NO: 6469204 - DNA, 14 bp, Homo sapiens
tgccacgcaggcca

SEQ ID NO: 6469205 - DNA, 22 bp, Homo sapiens
tgccacgcaggccacccgggct

SEQ ID NO: 6469206 - DNA, 20 bp, Homo sapiens
tgccacgcgctctgcatgct

SEQ ID NO: 6469207 - DNA, 21 bp, Homo sapiens
tgccacgcgctctgcatgctc

SEQ ID NO: 6469208 - DNA, 23 bp, Homo sapiens
tgccacggcagccaccctgccat

SEQ ID NO: 6469209 - DNA, 17 bp, Homo sapiens
tgccacgtcccgctgcc

SEQ ID NO: 6469210 - DNA, 22 bp, Homo sapiens
tgccacgtcccgctgcctcctg

SEQ ID NO: 6469211 - DNA, 19 bp, Homo sapiens
tgccacgtgccttaggaat

SEQ ID NO: 6469212 - DNA, 15 bp, Homo sapiens
tgccacgtggtcact

SEQ ID NO: 6469213 - DNA, 22 bp, Homo sapiens
tgccacgtggtggcccagctcc

SEQ ID NO: 6469214 - DNA, 14 bp, Homo sapiens
tgccacgttccaca

SEQ ID NO: 6469215 - DNA, 19 bp, Homo sapiens
tgccacgttccacagttgc

SEQ ID NO: 6469216 - DNA, 19 bp, Homo sapiens
tgccactaaaatccaccca

SEQ ID NO: 6469217 - DNA, 20 bp, Homo sapiens
tgccactaaaatccacccag

SEQ ID NO: 6469218 - DNA, 23 bp, Homo sapiens
tgccactaaaatccacccagccc

SEQ ID NO: 6469219 - DNA, 20 bp, Homo sapiens
tgccactaagtacagctgac

SEQ ID NO: 6469220 - DNA, 20 bp, Homo sapiens
tgccactaccccttgatttt

SEQ ID NO: 6469221 - DNA, 19 bp, Homo sapiens
tgccactaggccctggtct

SEQ ID NO: 6469222 - DNA, 19 bp, Homo sapiens
tgccactcacacagccagg

SEQ ID NO: 6469223 - DNA, 13 bp, Homo sapiens
tgccactcaccct

SEQ ID NO: 6469224 - DNA, 22 bp, Homo sapiens
tgccactcacccttcctggccc

SEQ ID NO: 6469225 - DNA, 13 bp, Homo sapiens
tgccactcactag

SEQ ID NO: 6469226 - DNA, 23 bp, Homo sapiens
tgccactcagggtctgggatgaa

SEQ ID NO: 6469227 - DNA, 15 bp, Homo sapiens
tgccactccagtcct

SEQ ID NO: 6469228 - DNA, 19 bp, Homo sapiens
tgccactccagtcctgcca

SEQ ID NO: 6469229 - DNA, 16 bp, Homo sapiens
tgccactccctaccca

SEQ ID NO: 6469230 - DNA, 16 bp, Homo sapiens
tgccactcctgcttct

SEQ ID NO: 6469231 - DNA, 14 bp, Homo sapiens
tgccactctcctcc

SEQ ID NO: 6469232 - DNA, 17 bp, Homo sapiens
tgccactctcctcccct

SEQ ID NO: 6469233 - DNA, 22 bp, Homo sapiens
tgccactctcctgaggagcagc

SEQ ID NO: 6469234 - DNA, 15 bp, Homo sapiens
tgccactctctggga

SEQ ID NO: 6469235 - DNA, 18 bp, Homo sapiens
tgccactctctgggactc

SEQ ID NO: 6469236 - DNA, 20 bp, Homo sapiens
tgccactctctgggactctc

SEQ ID NO: 6469237 - DNA, 13 bp, Homo sapiens
tgccactctgctg

SEQ ID NO: 6469238 - DNA, 19 bp, Homo sapiens
tgccactctgctgcctgta

SEQ ID NO: 6469239 - DNA, 20 bp, Homo sapiens
tgccactctgctgcctgtac

SEQ ID NO: 6469240 - DNA, 16 bp, Homo sapiens
tgccactctgggcagt

SEQ ID NO: 6469241 - DNA, 11 bp, Homo sapiens
tgccactgacc

SEQ ID NO: 6469242 - DNA, 13 bp, Homo sapiens
tgccactgacctc

SEQ ID NO: 6469243 - DNA, 19 bp, Homo sapiens
tgccactgacttgctgtgt

SEQ ID NO: 6469244 - DNA, 20 bp, Homo sapiens
tgccactgagagatctgctg

SEQ ID NO: 6469245 - DNA, 17 bp, Homo sapiens
tgccactgaggagacag

SEQ ID NO: 6469246 - DNA, 18 bp, Homo sapiens
tgccactgaggagacaga

SEQ ID NO: 6469247 - DNA, 19 bp, Homo sapiens
tgccactgaggagacagaa

SEQ ID NO: 6469248 - DNA, 23 bp, Homo sapiens
tgccactgaggagacagaaagcc

SEQ ID NO: 6469249 - DNA, 22 bp, Homo sapiens
tgccactgaggggggatccagt

SEQ ID NO: 6469250 - DNA, 13 bp, Homo sapiens
tgccactgcactc

SEQ ID NO: 6469251 - DNA, 19 bp, Homo sapiens
tgccactgcactccagcct

SEQ ID NO: 6469252 - DNA, 12 bp, Homo sapiens
tgccactgccag

SEQ ID NO: 6469253 - DNA, 13 bp, Homo sapiens
tgccactgccagg

SEQ ID NO: 6469254 - DNA, 16 bp, Homo sapiens
tgccactgccaggcac

SEQ ID NO: 6469255 - DNA, 16 bp, Homo sapiens
tgccactgccataact

SEQ ID NO: 6469256 - DNA, 17 bp, Homo sapiens
tgccactgcccgagctg

SEQ ID NO: 6469257 - DNA, 19 bp, Homo sapiens
tgccactgcccgagctggt

SEQ ID NO: 6469258 - DNA, 20 bp, Homo sapiens
tgccactgcccgagctggtg

SEQ ID NO: 6469259 - DNA, 17 bp, Homo sapiens
tgccactgcctgcacct

SEQ ID NO: 6469260 - DNA, 11 bp, Homo sapiens
tgccactggga

SEQ ID NO: 6469261 - DNA, 11 bp, Homo sapiens
tgccactgggc

SEQ ID NO: 6469262 - DNA, 15 bp, Homo sapiens
tgccactgggcacct

SEQ ID NO: 6469263 - DNA, 17 bp, Homo sapiens
tgccactgggcacctgc

SEQ ID NO: 6469264 - DNA, 18 bp, Homo sapiens
tgccactgggcacctgcg

SEQ ID NO: 6469265 - DNA, 13 bp, Homo sapiens
tgccactgggctc

SEQ ID NO: 6469266 - DNA, 14 bp, Homo sapiens
tgccactgggctct

SEQ ID NO: 6469267 - DNA, 20 bp, Homo sapiens
tgccactgggctctggacct

SEQ ID NO: 6469268 - DNA, 15 bp, Homo sapiens
tgccactgtgtgaat

SEQ ID NO: 6469269 - DNA, 13 bp, Homo sapiens
tgccactgtgtgc

SEQ ID NO: 6469270 - DNA, 22 bp, Homo sapiens
tgccactgttcagcggagctga

SEQ ID NO: 6469271 - DNA, 23 bp, Homo sapiens
tgccactgttcagcggagctgac

SEQ ID NO: 6469272 - DNA, 13 bp, Homo sapiens
tgccacttaaaaa

SEQ ID NO: 6469273 - DNA, 16 bp, Homo sapiens
tgccacttaaaaagac

SEQ ID NO: 6469274 - DNA, 20 bp, Homo sapiens
tgccacttagggagtgtgcc

SEQ ID NO: 6469275 - DNA, 23 bp, Homo sapiens
tgccacttccaggagcccagagg

SEQ ID NO: 6469276 - DNA, 18 bp, Homo sapiens
tgccacttctgcgggctc

SEQ ID NO: 6469277 - DNA, 21 bp, Homo sapiens
tgccacttctgcgggctccct

SEQ ID NO: 6469278 - DNA, 22 bp, Homo sapiens
tgccacttcttaaaggcctgga

SEQ ID NO: 6469279 - DNA, 22 bp, Homo sapiens
tgccacttgaacaaaatctgtt

SEQ ID NO: 6469280 - DNA, 18 bp, Homo sapiens
tgccacttgacattcctt

SEQ ID NO: 6469281 - DNA, 22 bp, Homo sapiens
tgccacttgatggggcctgggt

SEQ ID NO: 6469282 - DNA, 16 bp, Homo sapiens
tgccacttgcactgtg

SEQ ID NO: 6469283 - DNA, 18 bp, Homo sapiens
tgccacttgcactgtgct

SEQ ID NO: 6469284 - DNA, 20 bp, Homo sapiens
tgccactttacccacctaga

SEQ ID NO: 6469285 - DNA, 22 bp, Homo sapiens
tgccactttacccacctagaac

SEQ ID NO: 6469286 - DNA, 20 bp, Homo sapiens
tgccactttcacgtggcctc

SEQ ID NO: 6469287 - DNA, 15 bp, Homo sapiens
tgccactttccacca

SEQ ID NO: 6469288 - DNA, 17 bp, Homo sapiens
tgccactttcgggaggg

SEQ ID NO: 6469289 - DNA, 21 bp, Homo sapiens
tgccactttgactcagaggct

SEQ ID NO: 6469290 - DNA, 13 bp, Homo sapiens
tgccactttgcac

SEQ ID NO: 6469291 - DNA, 15 bp, Homo sapiens
tgccactttgcacat

SEQ ID NO: 6469292 - DNA, 21 bp, Homo sapiens
tgccactttgcacattttgat

SEQ ID NO: 6469293 - DNA, 21 bp, Homo sapiens
tgccactttgcagctaaaata

SEQ ID NO: 6469294 - DNA, 21 bp, Homo sapiens
tgccactttggcttctcctgt

SEQ ID NO: 6469295 - DNA, 23 bp, Homo sapiens
tgccactttggcttctcctgtga

SEQ ID NO: 6469296 - DNA, 12 bp, Homo sapiens
tgccacttttta

SEQ ID NO: 6469297 - DNA, 22 bp, Homo sapiens
tgccagaaacagtgggagccct

SEQ ID NO: 6469298 - DNA, 23 bp, Homo sapiens
tgccagaaacagtgggagccctg

SEQ ID NO: 6469299 - DNA, 20 bp, Homo sapiens
tgccagaaagtcccccctcg

SEQ ID NO: 6469300 - DNA, 18 bp, Homo sapiens
tgccagaacagtttgtac

SEQ ID NO: 6469301 - DNA, 19 bp, Homo sapiens
tgccagaacagtttgtaca

SEQ ID NO: 6469302 - DNA, 17 bp, Homo sapiens
tgccagaagagaattca

SEQ ID NO: 6469303 - DNA, 18 bp, Homo sapiens
tgccagaagatcccctca

SEQ ID NO: 6469304 - DNA, 20 bp, Homo sapiens
tgccagaagatcccctcagg

SEQ ID NO: 6469305 - DNA, 13 bp, Homo sapiens
tgccagaaggaag

SEQ ID NO: 6469306 - DNA, 15 bp, Homo sapiens
tgccagaaggaaggt

SEQ ID NO: 6469307 - DNA, 22 bp, Homo sapiens
tgccagaagttgtggatttcag

SEQ ID NO: 6469308 - DNA, 20 bp, Homo sapiens
tgccagacaaataggagtga

SEQ ID NO: 6469309 - DNA, 16 bp, Homo sapiens
tgccagacactgagct

SEQ ID NO: 6469310 - DNA, 21 bp, Homo sapiens
tgccagacactgagcttctga

SEQ ID NO: 6469311 - DNA, 14 bp, Homo sapiens
tgccagacctgcat

SEQ ID NO: 6469312 - DNA, 19 bp, Homo sapiens
tgccagactctaggttata

SEQ ID NO: 6469313 - DNA, 22 bp, Homo sapiens
tgccagactctaggttatacaa

SEQ ID NO: 6469314 - DNA, 17 bp, Homo sapiens
tgccagactggagtgca

SEQ ID NO: 6469315 - DNA, 13 bp, Homo sapiens
tgccagacttcta

SEQ ID NO: 6469316 - DNA, 21 bp, Homo sapiens
tgccagagaacccagcccacc

SEQ ID NO: 6469317 - DNA, 22 bp, Homo sapiens
tgccagagacggaagccttttt

SEQ ID NO: 6469318 - DNA, 15 bp, Homo sapiens
tgccagagataaact

SEQ ID NO: 6469319 - DNA, 14 bp, Homo sapiens
tgccagagatccaa

SEQ ID NO: 6469320 - DNA, 15 bp, Homo sapiens
tgccagagccaacct

SEQ ID NO: 6469321 - DNA, 19 bp, Homo sapiens
tgccagagccaacctggac

SEQ ID NO: 6469322 - DNA, 23 bp, Homo sapiens
tgccagagccaacctggacttcc

SEQ ID NO: 6469323 - DNA, 14 bp, Homo sapiens
tgccagagcctggg

SEQ ID NO: 6469324 - DNA, 17 bp, Homo sapiens
tgccagagcctggggct

SEQ ID NO: 6469325 - DNA, 17 bp, Homo sapiens
tgccagagccttaataa

SEQ ID NO: 6469326 - DNA, 20 bp, Homo sapiens
tgccagagctacactcgcct

SEQ ID NO: 6469327 - DNA, 23 bp, Homo sapiens
tgccagaggaatcctggcagccc

SEQ ID NO: 6469328 - DNA, 13 bp, Homo sapiens
tgccagaggacca

SEQ ID NO: 6469329 - DNA, 10 bp, Homo sapiens
tgccagaggc

SEQ ID NO: 6469330 - DNA, 12 bp, Homo sapiens
tgccagaggccc

SEQ ID NO: 6469331 - DNA, 13 bp, Homo sapiens
tgccagaggccct

SEQ ID NO: 6469332 - DNA, 15 bp, Homo sapiens
tgccagaggccctgg

SEQ ID NO: 6469333 - DNA, 16 bp, Homo sapiens
tgccagaggccctgga

SEQ ID NO: 6469334 - DNA, 22 bp, Homo sapiens
tgccagaggccctggagggaag

SEQ ID NO: 6469335 - DNA, 14 bp, Homo sapiens
tgccagaggcctgg

SEQ ID NO: 6469336 - DNA, 16 bp, Homo sapiens
tgccagaggcctggtg

SEQ ID NO: 6469337 - DNA, 17 bp, Homo sapiens
tgccagaggcctggtgc

SEQ ID NO: 6469338 - DNA, 22 bp, Homo sapiens
tgccagaggcctggtgccctgg

SEQ ID NO: 6469339 - DNA, 23 bp, Homo sapiens
tgccagagggccagcaggctcct

SEQ ID NO: 6469340 - DNA, 15 bp, Homo sapiens
tgccagaggtgggca

SEQ ID NO: 6469341 - DNA, 21 bp, Homo sapiens
tctcggccccctcaccccagc

SEQ ID NO: 6469342 - DNA, 12 bp, Homo sapiens
tctcggccctga

SEQ ID NO: 6469343 - DNA, 18 bp, Homo sapiens
tctcggccctgaaccacg

SEQ ID NO: 6469344 - DNA, 13 bp, Homo sapiens
tctcggctcactg

SEQ ID NO: 6469345 - DNA, 15 bp, Homo sapiens
tctcggctcagcctc

SEQ ID NO: 6469346 - DNA, 16 bp, Homo sapiens
tctcggctcagcctcc

SEQ ID NO: 6469347 - DNA, 13 bp, Homo sapiens
tctcggctcaggc

SEQ ID NO: 6469348 - DNA, 19 bp, Homo sapiens
tctcggctcaggctctgct

SEQ ID NO: 6469349 - DNA, 21 bp, Homo sapiens
tctcggctcaggctctgctgg

SEQ ID NO: 6469350 - DNA, 16 bp, Homo sapiens
tctcggctcagtgcaa

SEQ ID NO: 6469351 - DNA, 23 bp, Homo sapiens
tctcggctcagtgcaacctctgc

SEQ ID NO: 6469352 - DNA, 21 bp, Homo sapiens
tctcggctccccatgtgtcct

SEQ ID NO: 6469353 - DNA, 15 bp, Homo sapiens
tctcggctctgcatg

SEQ ID NO: 6469354 - DNA, 20 bp, Homo sapiens
tctcggctctgcatgttttc

SEQ ID NO: 6469355 - DNA, 15 bp, Homo sapiens
tctcggcttcaccag

SEQ ID NO: 6469356 - DNA, 15 bp, Homo sapiens
tctcgggactagctg

SEQ ID NO: 6469357 - DNA, 21 bp, Homo sapiens
tctcgggcagccggctctcct

SEQ ID NO: 6469358 - DNA, 14 bp, Homo sapiens
tctcggggcccttg

SEQ ID NO: 6469359 - DNA, 20 bp, Homo sapiens
tctcggggcccttggggcct

SEQ ID NO: 6469360 - DNA, 17 bp, Homo sapiens
tctcggggcgacccctc

SEQ ID NO: 6469361 - DNA, 21 bp, Homo sapiens
tctcggggcgacccctcagtg

SEQ ID NO: 6469362 - DNA, 23 bp, Homo sapiens
tctcgggttctctctctctgtct

SEQ ID NO: 6469363 - DNA, 17 bp, Homo sapiens
tctcggttccacgtccc

SEQ ID NO: 6469364 - DNA, 19 bp, Homo sapiens
tctcggttgaaacctgtat

SEQ ID NO: 6469365 - DNA, 14 bp, Homo sapiens
tctcgtaatagctt

SEQ ID NO: 6469366 - DNA, 19 bp, Homo sapiens
tctcgtaatagcttctgtg

SEQ ID NO: 6469367 - DNA, 20 bp, Homo sapiens
tctcgtaatagcttctgtgt

SEQ ID NO: 6469368 - DNA, 14 bp, Homo sapiens
tctcgtactctctc

SEQ ID NO: 6469369 - DNA, 16 bp, Homo sapiens
tctcgtactctctctc

SEQ ID NO: 6469370 - DNA, 21 bp, Homo sapiens
tctcgtactctctctcttttc

SEQ ID NO: 6469371 - DNA, 22 bp, Homo sapiens
tctcgtactttcacatctctgt

SEQ ID NO: 6469372 - DNA, 23 bp, Homo sapiens
tctcgtagaacctgcgcaccccg

SEQ ID NO: 6469373 - DNA, 17 bp, Homo sapiens
tctcgtagatgctgcct

SEQ ID NO: 6469374 - DNA, 18 bp, Homo sapiens
tctcgtagatgctgccta

SEQ ID NO: 6469375 - DNA, 24 bp, Homo sapiens
tctcgtatagaagtcttcatgaaa

SEQ ID NO: 6469376 - DNA, 22 bp, Homo sapiens
tctcgtccccctccctgcccaa

SEQ ID NO: 6469377 - DNA, 17 bp, Homo sapiens
tctcgtcccgtccctcc

SEQ ID NO: 6469378 - DNA, 15 bp, Homo sapiens
tctcgtgagtcattt

SEQ ID NO: 6469379 - DNA, 20 bp, Homo sapiens
tctcgtgagtcatttaaatg

SEQ ID NO: 6469380 - DNA, 18 bp, Homo sapiens
tctcgtgatccgcctgcc

SEQ ID NO: 6469381 - DNA, 19 bp, Homo sapiens
tctcgtgatccgcctgcct

SEQ ID NO: 6469382 - DNA, 18 bp, Homo sapiens
tctcgtgggagagccatc

SEQ ID NO: 6469383 - DNA, 15 bp, Homo sapiens
tctcgtgggtaaata

SEQ ID NO: 6469384 - DNA, 20 bp, Homo sapiens
tctcgtggtagaagccagta

SEQ ID NO: 6469385 - DNA, 19 bp, Homo sapiens
tctcgtggtaggactgtag

SEQ ID NO: 6469386 - DNA, 20 bp, Homo sapiens
tctcgtgtcagtaatttata

SEQ ID NO: 6469387 - DNA, 23 bp, Homo sapiens
tctcgtgttattttaatctcaga

SEQ ID NO: 6469388 - DNA, 15 bp, Homo sapiens
tctcgttgaggccaa

SEQ ID NO: 6469389 - DNA, 16 bp, Homo sapiens
tctcgttgaggccaag

SEQ ID NO: 6469390 - DNA, 14 bp, Homo sapiens
tctcgttgccctaa

SEQ ID NO: 6469391 - DNA, 16 bp, Homo sapiens
tctcgttgtcacaccc

SEQ ID NO: 6469392 - DNA, 14 bp, Homo sapiens
tctcgtttagtgcc

SEQ ID NO: 6469393 - DNA, 14 bp, Homo sapiens
tctcgtttcaaaaa

SEQ ID NO: 6469394 - DNA, 15 bp, Homo sapiens
tctcgtttctgccca

SEQ ID NO: 6469395 - DNA, 14 bp, Homo sapiens
tctcgtttgtgatt

SEQ ID NO: 6469396 - DNA, 18 bp, Homo sapiens
tctctaaaaataaaatga

SEQ ID NO: 6469397 - DNA, 21 bp, Homo sapiens
tctctaaaatgctgttctcaa

SEQ ID NO: 6469398 - DNA, 14 bp, Homo sapiens
tctctaaaattcta

SEQ ID NO: 6469399 - DNA, 17 bp, Homo sapiens
tctctaaaattctagtc

SEQ ID NO: 6469400 - DNA, 23 bp, Homo sapiens
tctctaaaattctagtctctgat

SEQ ID NO: 6469401 - DNA, 14 bp, Homo sapiens
tctctaaactggca

SEQ ID NO: 6469402 - DNA, 23 bp, Homo sapiens
tctctaaactggcatctgctcta

SEQ ID NO: 6469403 - DNA, 14 bp, Homo sapiens
tctctaaactgttt

SEQ ID NO: 6469404 - DNA, 19 bp, Homo sapiens
tctctaaagagtttatttt

SEQ ID NO: 6469405 - DNA, 21 bp, Homo sapiens
tctctaaagagtttattttaa

SEQ ID NO: 6469406 - DNA, 22 bp, Homo sapiens
tctctaaagagtttattttaag

SEQ ID NO: 6469407 - DNA, 13 bp, Homo sapiens
tctctaaagcact

SEQ ID NO: 6469408 - DNA, 18 bp, Homo sapiens
tctctaacagctcaggat

SEQ ID NO: 6469409 - DNA, 17 bp, Homo sapiens
tctctaaccattcaaat

SEQ ID NO: 6469410 - DNA, 14 bp, Homo sapiens
tctctaacctcctt

SEQ ID NO: 6469411 - DNA, 22 bp, Homo sapiens
tctctaactcagaaacatcagt

SEQ ID NO: 6469412 - DNA, 17 bp, Homo sapiens
tctctaactcctgccat

SEQ ID NO: 6469413 - DNA, 12 bp, Homo sapiens
tctctaagaaaa

SEQ ID NO: 6469414 - DNA, 15 bp, Homo sapiens
tctctaagaaaagag

SEQ ID NO: 6469415 - DNA, 20 bp, Homo sapiens
tctctaagatgaatccaaat

SEQ ID NO: 6469416 - DNA, 21 bp, Homo sapiens
tctctaagatgaatccaaatg

SEQ ID NO: 6469417 - DNA, 24 bp, Homo sapiens
tctctaagatgaatccaaatgtga

SEQ ID NO: 6469418 - DNA, 16 bp, Homo sapiens
tctctaagccacagct

SEQ ID NO: 6469419 - DNA, 23 bp, Homo sapiens
tctctaagtgggcattgccatgt

SEQ ID NO: 6469420 - DNA, 21 bp, Homo sapiens
tctctaagttatgactgtgaa

SEQ ID NO: 6469421 - DNA, 21 bp, Homo sapiens
tctctaagttccactgagctc

SEQ ID NO: 6469422 - DNA, 18 bp, Homo sapiens
tctctaatagaaaagtct

SEQ ID NO: 6469423 - DNA, 22 bp, Homo sapiens
tctctaatagaggcattacttg

SEQ ID NO: 6469424 - DNA, 11 bp, Homo sapiens
tctctaatatg

SEQ ID NO: 6469425 - DNA, 15 bp, Homo sapiens
tctctaatcgaaaga

SEQ ID NO: 6469426 - DNA, 13 bp, Homo sapiens
tctctaatgagct

SEQ ID NO: 6469427 - DNA, 17 bp, Homo sapiens
tctctaatgcttgattt

SEQ ID NO: 6469428 - DNA, 15 bp, Homo sapiens
tctctaattctatta

SEQ ID NO: 6469429 - DNA, 18 bp, Homo sapiens
tctctaattcttcctttg

SEQ ID NO: 6469430 - DNA, 16 bp, Homo sapiens
tctctaattttggata

SEQ ID NO: 6469431 - DNA, 15 bp, Homo sapiens
tctctacaaaaagca

SEQ ID NO: 6469432 - DNA, 14 bp, Homo sapiens
tctctacaaaaata

SEQ ID NO: 6469433 - DNA, 13 bp, Homo sapiens
tctctacaaaccc

SEQ ID NO: 6469434 - DNA, 21 bp, Homo sapiens
tctctacaggcctcttcctgt

SEQ ID NO: 6469435 - DNA, 21 bp, Homo sapiens
tctctacaggtccgtttcctt

SEQ ID NO: 6469436 - DNA, 21 bp, Homo sapiens
tctctacagtctcgtctcttt

SEQ ID NO: 6469437 - DNA, 22 bp, Homo sapiens
tctctacagtctcgtctctttt

SEQ ID NO: 6469438 - DNA, 14 bp, Homo sapiens
tctctacagtgcca

SEQ ID NO: 6469439 - DNA, 13 bp, Homo sapiens
tctctaccagata

SEQ ID NO: 6469440 - DNA, 21 bp, Homo sapiens
tctctacccactatgcacaga

SEQ ID NO: 6469441 - DNA, 16 bp, Homo sapiens
tctctacccatctccc

SEQ ID NO: 6469442 - DNA, 16 bp, Homo sapiens
tctctaccccaaagaa

SEQ ID NO: 6469443 - DNA, 16 bp, Homo sapiens
tctctacccctttctt

SEQ ID NO: 6469444 - DNA, 12 bp, Homo sapiens
tctctacctcca

SEQ ID NO: 6469445 - DNA, 20 bp, Homo sapiens
tctctactaaaaataagaaa

SEQ ID NO: 6469446 - DNA, 17 bp, Homo sapiens
tctctactaccacaagg

SEQ ID NO: 6469447 - DNA, 16 bp, Homo sapiens
tctctactcactggga

SEQ ID NO: 6469448 - DNA, 13 bp, Homo sapiens
tctctactctgct

SEQ ID NO: 6469449 - DNA, 14 bp, Homo sapiens
tctctactctggaa

SEQ ID NO: 6469450 - DNA, 15 bp, Homo sapiens
tctctactggagtgg

SEQ ID NO: 6469451 - DNA, 16 bp, Homo sapiens
tctctactgttattat

SEQ ID NO: 6469452 - DNA, 15 bp, Homo sapiens
tctctacttcccctt

SEQ ID NO: 6469453 - DNA, 13 bp, Homo sapiens
tctctactttcct

SEQ ID NO: 6469454 - DNA, 15 bp, Homo sapiens
tctctagaaccttct

SEQ ID NO: 6469455 - DNA, 18 bp, Homo sapiens
tctctagaagtgccatct

SEQ ID NO: 6469456 - DNA, 13 bp, Homo sapiens
tctctagaatttt

SEQ ID NO: 6469457 - DNA, 14 bp, Homo sapiens
tctctagacaaaat

SEQ ID NO: 6469458 - DNA, 15 bp, Homo sapiens
tctctagcagtgagt

SEQ ID NO: 6469459 - DNA, 12 bp, Homo sapiens
tctctagccact

SEQ ID NO: 6469460 - DNA, 13 bp, Homo sapiens
tctctaggaaagt

SEQ ID NO: 6469461 - DNA, 13 bp, Homo sapiens
tctctaggaaata

SEQ ID NO: 6469462 - DNA, 22 bp, Homo sapiens
tctctaggaccatggttaagag

SEQ ID NO: 6469463 - DNA, 12 bp, Homo sapiens
tctctaggcctg

SEQ ID NO: 6469464 - DNA, 15 bp, Homo sapiens
tctctaggctgggga

SEQ ID NO: 6469465 - DNA, 16 bp, Homo sapiens
tctctagggaaggcca

SEQ ID NO: 6469466 - DNA, 13 bp, Homo sapiens
tctctagggaccc

SEQ ID NO: 6469467 - DNA, 21 bp, Homo sapiens
tctctagggacccctcgcccc

SEQ ID NO: 6469468 - DNA, 22 bp, Homo sapiens
tctctaggtgtcaggagaaagt

SEQ ID NO: 6469469 - DNA, 16 bp, Homo sapiens
tctctagtagttaaaa

SEQ ID NO: 6469470 - DNA, 23 bp, Homo sapiens
tctctagtgcaggaaaaggctgc

SEQ ID NO: 6469471 - DNA, 14 bp, Homo sapiens
tctctagtgctgtg

SEQ ID NO: 6469472 - DNA, 17 bp, Homo sapiens
tctctagtgctgtgaaa

SEQ ID NO: 6469473 - DNA, 17 bp, Homo sapiens
tctctagttccacgcct

SEQ ID NO: 6469474 - DNA, 15 bp, Homo sapiens
tctctagtttgatta

SEQ ID NO: 6469475 - DNA, 18 bp, Homo sapiens
tctctagtttgattaaat

SEQ ID NO: 6469476 - DNA, 16 bp, Homo sapiens
tctctataaaaaatat

SEQ ID NO: 6469477 - DNA, 22 bp, Homo sapiens
tctctataaagggtcaggcccg

SEQ ID NO: 6469478 - DNA, 18 bp, Homo sapiens
tctctataagtgttcagt

SEQ ID NO: 6469479 - DNA, 19 bp, Homo sapiens
tctctataagtgttcagtg

SEQ ID NO: 6469480 - DNA, 21 bp, Homo sapiens
tctctataagtgttcagtgtt

SEQ ID NO: 6469481 - DNA, 22 bp, Homo sapiens
tctctataagtgttcagtgttg

SEQ ID NO: 6469482 - DNA, 16 bp, Homo sapiens
tctctataccaataaa

SEQ ID NO: 6469483 - DNA, 15 bp, Homo sapiens
tctctatatatacat

SEQ ID NO: 6469484 - DNA, 20 bp, Homo sapiens
tctctatcagaaatacaaaa

SEQ ID NO: 6469485 - DNA, 22 bp, Homo sapiens
tctctatcagaaatacaaaaaa

SEQ ID NO: 6469486 - DNA, 13 bp, Homo sapiens
tctctatcattaa

SEQ ID NO: 6469487 - DNA, 14 bp, Homo sapiens
tctctatcattaaa

SEQ ID NO: 6469488 - DNA, 16 bp, Homo sapiens
tctctatcattaaagt

SEQ ID NO: 6469489 - DNA, 18 bp, Homo sapiens
tctctatcattaaagttc

SEQ ID NO: 6469490 - DNA, 13 bp, Homo sapiens
tctctatcattta

SEQ ID NO: 6469491 - DNA, 22 bp, Homo sapiens
tctctatccaaaataaagatca

SEQ ID NO: 6469492 - DNA, 20 bp, Homo sapiens
tctctatgaaaagcacaagg

SEQ ID NO: 6469493 - DNA, 16 bp, Homo sapiens
tctctatgacatgaaa

SEQ ID NO: 6469494 - DNA, 14 bp, Homo sapiens
tctctatgataatt

SEQ ID NO: 6469495 - DNA, 15 bp, Homo sapiens
tctctatgataatta

SEQ ID NO: 6469496 - DNA, 17 bp, Homo sapiens
tctctatgataattaca

SEQ ID NO: 6469497 - DNA, 11 bp, Homo sapiens
tctctatgtac

SEQ ID NO: 6469498 - DNA, 13 bp, Homo sapiens
tctctatgtacag

SEQ ID NO: 6469499 - DNA, 23 bp, Homo sapiens
tctctatgtacgataaagtaaca

SEQ ID NO: 6469500 - DNA, 12 bp, Homo sapiens
tctctatgtact

SEQ ID NO: 6469501 - DNA, 17 bp, Homo sapiens
tctctatgtttattcta

SEQ ID NO: 6469502 - DNA, 14 bp, Homo sapiens
tctctattaaaatg

SEQ ID NO: 6469503 - DNA, 17 bp, Homo sapiens
tctctattccccaccct

SEQ ID NO: 6469504 - DNA, 20 bp, Homo sapiens
tctctattctttccatgaca

SEQ ID NO: 6469505 - DNA, 18 bp, Homo sapiens
tctctattggctcccttt

SEQ ID NO: 6469506 - DNA, 19 bp, Homo sapiens
tctctattgtaattttgtt

SEQ ID NO: 6469507 - DNA, 18 bp, Homo sapiens
tctctatttaaattcttt

SEQ ID NO: 6469508 - DNA, 15 bp, Homo sapiens
tctctatttaatatt

SEQ ID NO: 6469509 - DNA, 22 bp, Homo sapiens
tctctatttatgagatcactga

SEQ ID NO: 6469510 - DNA, 13 bp, Homo sapiens
tctctattttcat

SEQ ID NO: 6469511 - DNA, 23 bp, Homo sapiens
tctctattttcataatcagtaaa

SEQ ID NO: 6469512 - DNA, 20 bp, Homo sapiens
tctctcaaaacaatattact

SEQ ID NO: 6469513 - DNA, 13 bp, Homo sapiens
tctctcaaaatgt

SEQ ID NO: 6469514 - DNA, 14 bp, Homo sapiens
tctctcaaaatgtg

SEQ ID NO: 6469515 - DNA, 13 bp, Homo sapiens
tctctcaaatctg

SEQ ID NO: 6469516 - DNA, 13 bp, Homo sapiens
tctctcaacacca

SEQ ID NO: 6469517 - DNA, 18 bp, Homo sapiens
tctctcaaccttggcctt

SEQ ID NO: 6469518 - DNA, 21 bp, Homo sapiens
tctctcaaccttggccttctc

SEQ ID NO: 6469519 - DNA, 18 bp, Homo sapiens
tctctcaagacttctcca

SEQ ID NO: 6469520 - DNA, 20 bp, Homo sapiens
tgccagaggtgggcaggtgg

SEQ ID NO: 6469521 - DNA, 14 bp, Homo sapiens
tgccagatcctctt

SEQ ID NO: 6469522 - DNA, 16 bp, Homo sapiens
tgccagatcctcttct

SEQ ID NO: 6469523 - DNA, 21 bp, Homo sapiens
tgccagatgcctttatggctg

SEQ ID NO: 6469524 - DNA, 15 bp, Homo sapiens
tgccagatgctgcag

SEQ ID NO: 6469525 - DNA, 14 bp, Homo sapiens
tgccagcaaagccc

SEQ ID NO: 6469526 - DNA, 15 bp, Homo sapiens
tgccagcaaataaat

SEQ ID NO: 6469527 - DNA, 17 bp, Homo sapiens
tgccagcaaataaatac

SEQ ID NO: 6469528 - DNA, 23 bp, Homo sapiens
tgccagcaaataaatacgtgtca

SEQ ID NO: 6469529 - DNA, 16 bp, Homo sapiens
tgccagcaaccttgta

SEQ ID NO: 6469530 - DNA, 13 bp, Homo sapiens
tgccagcaactga

SEQ ID NO: 6469531 - DNA, 17 bp, Homo sapiens
tgccagcaactgaataa

SEQ ID NO: 6469532 - DNA, 13 bp, Homo sapiens
tgccagcacagag

SEQ ID NO: 6469533 - DNA, 22 bp, Homo sapiens
tgccagcacagagcgtccttcc

SEQ ID NO: 6469534 - DNA, 19 bp, Homo sapiens
tgccagcacaggggcccca

SEQ ID NO: 6469535 - DNA, 22 bp, Homo sapiens
tgccagcacctttgagccttgg

SEQ ID NO: 6469536 - DNA, 13 bp, Homo sapiens
tgccagcagagcc

SEQ ID NO: 6469537 - DNA, 18 bp, Homo sapiens
tgccagcagagccagggc

SEQ ID NO: 6469538 - DNA, 19 bp, Homo sapiens
tgccagcagagccagggca

SEQ ID NO: 6469539 - DNA, 17 bp, Homo sapiens
tgccagcagcagcaggt

SEQ ID NO: 6469540 - DNA, 18 bp, Homo sapiens
tgccagcagcagcaggtg

SEQ ID NO: 6469541 - DNA, 12 bp, Homo sapiens
tgccagcagcct

SEQ ID NO: 6469542 - DNA, 14 bp, Homo sapiens
tgccagcagcctcg

SEQ ID NO: 6469543 - DNA, 22 bp, Homo sapiens
tgccagcagcctcgcacaggcc

SEQ ID NO: 6469544 - DNA, 11 bp, Homo sapiens
tgccagcagga

SEQ ID NO: 6469545 - DNA, 12 bp, Homo sapiens
tgccagcaggaa

SEQ ID NO: 6469546 - DNA, 13 bp, Homo sapiens
tgccagcaggaat

SEQ ID NO: 6469547 - DNA, 15 bp, Homo sapiens
tgccagcaggaataa

SEQ ID NO: 6469548 - DNA, 21 bp, Homo sapiens
tgccagcaggggggctgtgcc

SEQ ID NO: 6469549 - DNA, 22 bp, Homo sapiens
tgccagcaggggggctgtgcca

SEQ ID NO: 6469550 - DNA, 20 bp, Homo sapiens
tgccagcagttactgtgaat

SEQ ID NO: 6469551 - DNA, 15 bp, Homo sapiens
tgccagcattccaga

SEQ ID NO: 6469552 - DNA, 21 bp, Homo sapiens
tgccagcattccagacttcaa

SEQ ID NO: 6469553 - DNA, 13 bp, Homo sapiens
tgccagccaagct

SEQ ID NO: 6469554 - DNA, 21 bp, Homo sapiens
tgccagccaatccctggccat

SEQ ID NO: 6469555 - DNA, 20 bp, Homo sapiens
tgccagccagaagcctctgc

SEQ ID NO: 6469556 - DNA, 12 bp, Homo sapiens
tgccagccagca

SEQ ID NO: 6469557 - DNA, 11 bp, Homo sapiens
tgccagccagg

SEQ ID NO: 6469558 - DNA, 18 bp, Homo sapiens
tgccagccatcacaaggg

SEQ ID NO: 6469559 - DNA, 13 bp, Homo sapiens
tgccagcccaaag

SEQ ID NO: 6469560 - DNA, 17 bp, Homo sapiens
tgccagcccagctggcc

SEQ ID NO: 6469561 - DNA, 19 bp, Homo sapiens
tgccagcccagctggccgg

SEQ ID NO: 6469562 - DNA, 22 bp, Homo sapiens
tgccagcccagctggccggaag

SEQ ID NO: 6469563 - DNA, 23 bp, Homo sapiens
tgccagcccagctggccggaagg

SEQ ID NO: 6469564 - DNA, 23 bp, Homo sapiens
tgccagcccattttgaggccaga

SEQ ID NO: 6469565 - DNA, 17 bp, Homo sapiens
tgccagccccacacagc

SEQ ID NO: 6469566 - DNA, 22 bp, Homo sapiens
tgccagccccctaaaagcactc

SEQ ID NO: 6469567 - DNA, 23 bp, Homo sapiens
tgccagccccctaaaagcactcc

SEQ ID NO: 6469568 - DNA, 19 bp, Homo sapiens
tgccagcccctgccattgt

SEQ ID NO: 6469569 - DNA, 15 bp, Homo sapiens
tgccagcccctgcct

SEQ ID NO: 6469570 - DNA, 17 bp, Homo sapiens
tgccagcccctgcctgg

SEQ ID NO: 6469571 - DNA, 19 bp, Homo sapiens
tgccagcccctgcctgggt

SEQ ID NO: 6469572 - DNA, 21 bp, Homo sapiens
tgccagcccggctcggcccag

SEQ ID NO: 6469573 - DNA, 13 bp, Homo sapiens
tgccagcccttca

SEQ ID NO: 6469574 - DNA, 16 bp, Homo sapiens
tgccagccgctggtgc

SEQ ID NO: 6469575 - DNA, 22 bp, Homo sapiens
tgccagccgctggtgcccacca

SEQ ID NO: 6469576 - DNA, 19 bp, Homo sapiens
tgccagccgtgatgctcag

SEQ ID NO: 6469577 - DNA, 17 bp, Homo sapiens
tgccagcctccttgctg

SEQ ID NO: 6469578 - DNA, 21 bp, Homo sapiens
tgccagcctccttgctgaccc

SEQ ID NO: 6469579 - DNA, 12 bp, Homo sapiens
tgccagcctggc

SEQ ID NO: 6469580 - DNA, 21 bp, Homo sapiens
tgccagcctggcttctggagc

SEQ ID NO: 6469581 - DNA, 23 bp, Homo sapiens
tgccagcctggcttctggagccc

SEQ ID NO: 6469582 - DNA, 12 bp, Homo sapiens
tgccagccttcc

SEQ ID NO: 6469583 - DNA, 17 bp, Homo sapiens
tgccagccttcctctgc

SEQ ID NO: 6469584 - DNA, 19 bp, Homo sapiens
tgccagccttgagccctgg

SEQ ID NO: 6469585 - DNA, 21 bp, Homo sapiens
tgccagccttgagccctggct

SEQ ID NO: 6469586 - DNA, 14 bp, Homo sapiens
tgccagccttggag

SEQ ID NO: 6469587 - DNA, 15 bp, Homo sapiens
tgccagccttggggg

SEQ ID NO: 6469588 - DNA, 17 bp, Homo sapiens
tgccagcgcatgtgtcc

SEQ ID NO: 6469589 - DNA, 13 bp, Homo sapiens
tgccagcgctggc

SEQ ID NO: 6469590 - DNA, 18 bp, Homo sapiens
tgccagcggtttcctggt

SEQ ID NO: 6469591 - DNA, 15 bp, Homo sapiens
tgccagctactcagg

SEQ ID NO: 6469592 - DNA, 12 bp, Homo sapiens
tgccagctcagc

SEQ ID NO: 6469593 - DNA, 22 bp, Homo sapiens
tgccagctcaggatattatgtt

SEQ ID NO: 6469594 - DNA, 16 bp, Homo sapiens
tgccagctcaggtgac

SEQ ID NO: 6469595 - DNA, 21 bp, Homo sapiens
tgccagctcaggtgactggag

SEQ ID NO: 6469596 - DNA, 24 bp, Homo sapiens
tgccagctcaggtgactggagccc

SEQ ID NO: 6469597 - DNA, 12 bp, Homo sapiens
tgccagctccac

SEQ ID NO: 6469598 - DNA, 14 bp, Homo sapiens
tgccagctccagtg

SEQ ID NO: 6469599 - DNA, 18 bp, Homo sapiens
tgccagctccatgttctc

SEQ ID NO: 6469600 - DNA, 13 bp, Homo sapiens
tgccagctccctc

SEQ ID NO: 6469601 - DNA, 12 bp, Homo sapiens
tgccagctctgt

SEQ ID NO: 6469602 - DNA, 18 bp, Homo sapiens
tgccagctctgtcaccct

SEQ ID NO: 6469603 - DNA, 20 bp, Homo sapiens
tgccagctctgtcaccctgg

SEQ ID NO: 6469604 - DNA, 22 bp, Homo sapiens
tgccagctcttcctagctggag

SEQ ID NO: 6469605 - DNA, 13 bp, Homo sapiens
tgccagctgccct

SEQ ID NO: 6469606 - DNA, 13 bp, Homo sapiens
tgccagctgcctt

SEQ ID NO: 6469607 - DNA, 21 bp, Homo sapiens
tgccagctgccttcctcatcc

SEQ ID NO: 6469608 - DNA, 17 bp, Homo sapiens
tgccagctgcttctgcc

SEQ ID NO: 6469609 - DNA, 19 bp, Homo sapiens
tgccagctgcttctgccca

SEQ ID NO: 6469610 - DNA, 21 bp, Homo sapiens
tgccagctgcttctgcccacc

SEQ ID NO: 6469611 - DNA, 19 bp, Homo sapiens
tgccagctgggcccagcac

SEQ ID NO: 6469612 - DNA, 13 bp, Homo sapiens
tgccagctggtga

SEQ ID NO: 6469613 - DNA, 18 bp, Homo sapiens
tgccagcttatctcaggg

SEQ ID NO: 6469614 - DNA, 16 bp, Homo sapiens
tgccagcttctctctc

SEQ ID NO: 6469615 - DNA, 19 bp, Homo sapiens
tgccagcttggacatcagt

SEQ ID NO: 6469616 - DNA, 23 bp, Homo sapiens
tgccaggaaaagaaaaatttctg

SEQ ID NO: 6469617 - DNA, 20 bp, Homo sapiens
tgccaggaaacaagggaagg

SEQ ID NO: 6469618 - DNA, 20 bp, Homo sapiens
tgccaggaagccagcaggct

SEQ ID NO: 6469619 - DNA, 15 bp, Homo sapiens
tgccaggaatgtttc

SEQ ID NO: 6469620 - DNA, 16 bp, Homo sapiens
tgccaggacacctgcc

SEQ ID NO: 6469621 - DNA, 16 bp, Homo sapiens
tgccaggacagctgca

SEQ ID NO: 6469622 - DNA, 22 bp, Homo sapiens
tgccaggacagctgcaggtgcc

SEQ ID NO: 6469623 - DNA, 21 bp, Homo sapiens
tgccaggacagctggctgctg

SEQ ID NO: 6469624 - DNA, 20 bp, Homo sapiens
tgccaggacatgcaataaaa

SEQ ID NO: 6469625 - DNA, 23 bp, Homo sapiens
tgccaggacatgcaataaaattt

SEQ ID NO: 6469626 - DNA, 11 bp, Homo sapiens
tgccaggacca

SEQ ID NO: 6469627 - DNA, 14 bp, Homo sapiens
tgccaggaccagcc

SEQ ID NO: 6469628 - DNA, 20 bp, Homo sapiens
tgccaggaccagtcaacctg

SEQ ID NO: 6469629 - DNA, 23 bp, Homo sapiens
tgccaggacccaccactggaagc

SEQ ID NO: 6469630 - DNA, 14 bp, Homo sapiens
tgccaggaccccag

SEQ ID NO: 6469631 - DNA, 17 bp, Homo sapiens
tgccaggaccccaggtc

SEQ ID NO: 6469632 - DNA, 19 bp, Homo sapiens
tgccaggacccgccagccc

SEQ ID NO: 6469633 - DNA, 22 bp, Homo sapiens
tgccaggacccgccagccccgc

SEQ ID NO: 6469634 - DNA, 12 bp, Homo sapiens
tgccaggagatg

SEQ ID NO: 6469635 - DNA, 14 bp, Homo sapiens
tgccaggagatggc

SEQ ID NO: 6469636 - DNA, 16 bp, Homo sapiens
tgccaggagatggccc

SEQ ID NO: 6469637 - DNA, 17 bp, Homo sapiens
tgccaggagatggcccc

SEQ ID NO: 6469638 - DNA, 20 bp, Homo sapiens
tgccaggagcacggctctgt

SEQ ID NO: 6469639 - DNA, 21 bp, Homo sapiens
tgccaggagcagcctccaaga

SEQ ID NO: 6469640 - DNA, 13 bp, Homo sapiens
tgccaggaggacc

SEQ ID NO: 6469641 - DNA, 17 bp, Homo sapiens
tgccaggaggacccagg

SEQ ID NO: 6469642 - DNA, 21 bp, Homo sapiens
tgccaggaggacccagggctc

SEQ ID NO: 6469643 - DNA, 22 bp, Homo sapiens
tgccaggaggcggcagctcttc

SEQ ID NO: 6469644 - DNA, 17 bp, Homo sapiens
tgccaggaggctgcggc

SEQ ID NO: 6469645 - DNA, 17 bp, Homo sapiens
tgccaggaggctggcag

SEQ ID NO: 6469646 - DNA, 23 bp, Homo sapiens
tgccaggagggacaaaggagcct

SEQ ID NO: 6469647 - DNA, 23 bp, Homo sapiens
tgccaggagggcacagcagggga

SEQ ID NO: 6469648 - DNA, 17 bp, Homo sapiens
tgccaggagtgggtggg

SEQ ID NO: 6469649 - DNA, 21 bp, Homo sapiens
tgccaggagtgggtgggacac

SEQ ID NO: 6469650 - DNA, 23 bp, Homo sapiens
tgccaggagtgggtgggacacag

SEQ ID NO: 6469651 - DNA, 20 bp, Homo sapiens
tgccaggatcaagcatgaaa

SEQ ID NO: 6469652 - DNA, 18 bp, Homo sapiens
tgccaggcacaggcaggg

SEQ ID NO: 6469653 - DNA, 22 bp, Homo sapiens
tgccaggcacaggcagggcagg

SEQ ID NO: 6469654 - DNA, 21 bp, Homo sapiens
tgccaggcacctggcctgctg

SEQ ID NO: 6469655 - DNA, 14 bp, Homo sapiens
tgccaggcactctc

SEQ ID NO: 6469656 - DNA, 16 bp, Homo sapiens
tgccaggcaggcacct

SEQ ID NO: 6469657 - DNA, 16 bp, Homo sapiens
tgccaggcaggggtgg

SEQ ID NO: 6469658 - DNA, 21 bp, Homo sapiens
tgccaggcattcaatcctcag

SEQ ID NO: 6469659 - DNA, 19 bp, Homo sapiens
tgccaggccagagggcagt

SEQ ID NO: 6469660 - DNA, 16 bp, Homo sapiens
tgccaggccagcctcc

SEQ ID NO: 6469661 - DNA, 15 bp, Homo sapiens
tgccaggccagtaaa

SEQ ID NO: 6469662 - DNA, 11 bp, Homo sapiens
tgccaggcccg

SEQ ID NO: 6469663 - DNA, 22 bp, Homo sapiens
tgccaggcccggcatgaggccc

SEQ ID NO: 6469664 - DNA, 23 bp, Homo sapiens
tgccaggcccggcatgaggcccc

SEQ ID NO: 6469665 - DNA, 20 bp, Homo sapiens
tgccaggcgaggcccttggc

SEQ ID NO: 6469666 - DNA, 23 bp, Homo sapiens
tgccaggcggacaaagttcagtg

SEQ ID NO: 6469667 - DNA, 16 bp, Homo sapiens
tgccaggcggccctgg

SEQ ID NO: 6469668 - DNA, 20 bp, Homo sapiens
tgccaggcggccctggggag

SEQ ID NO: 6469669 - DNA, 19 bp, Homo sapiens
tgccaggcgttggtgccac

SEQ ID NO: 6469670 - DNA, 20 bp, Homo sapiens
tgccaggctagagtgcagtg

SEQ ID NO: 6469671 - DNA, 23 bp, Homo sapiens
tgccaggctccctttctcttctt

SEQ ID NO: 6469672 - DNA, 19 bp, Homo sapiens
tgccaggctctaaagccaa

SEQ ID NO: 6469673 - DNA, 12 bp, Homo sapiens
tgccaggctctc

SEQ ID NO: 6469674 - DNA, 14 bp, Homo sapiens
tgccaggctctccc

SEQ ID NO: 6469675 - DNA, 15 bp, Homo sapiens
tgccaggctgcggtg

SEQ ID NO: 6469676 - DNA, 23 bp, Homo sapiens
tgccaggctgcggtgggcagcca

SEQ ID NO: 6469677 - DNA, 17 bp, Homo sapiens
tgccaggctggagtgca

SEQ ID NO: 6469678 - DNA, 16 bp, Homo sapiens
tgccaggctgggaggc

SEQ ID NO: 6469679 - DNA, 19 bp, Homo sapiens
tgccaggctgggaggctcg

SEQ ID NO: 6469680 - DNA, 19 bp, Homo sapiens
tgccaggctgggcacggct

SEQ ID NO: 6469681 - DNA, 15 bp, Homo sapiens
tgccaggctgtcagc

SEQ ID NO: 6469682 - DNA, 19 bp, Homo sapiens
tgccaggctgtcagcgcct

SEQ ID NO: 6469683 - DNA, 16 bp, Homo sapiens
tgccaggctgtttcag

SEQ ID NO: 6469684 - DNA, 15 bp, Homo sapiens
tgccaggcttgcctg

SEQ ID NO: 6469685 - DNA, 17 bp, Homo sapiens
tgccaggcttgcctggg

SEQ ID NO: 6469686 - DNA, 19 bp, Homo sapiens
tgccaggcttgcctgggct

SEQ ID NO: 6469687 - DNA, 20 bp, Homo sapiens
tgccaggcttgcctgggctg

SEQ ID NO: 6469688 - DNA, 21 bp, Homo sapiens
tgccagggaactggcctgctg

SEQ ID NO: 6469689 - DNA, 13 bp, Homo sapiens
tgccagggaagac

SEQ ID NO: 6469690 - DNA, 17 bp, Homo sapiens
tgccagggaagacagag

SEQ ID NO: 6469691 - DNA, 16 bp, Homo sapiens
tgccagggaggtggaa

SEQ ID NO: 6469692 - DNA, 24 bp, Homo sapiens
tgccagggaggtggaaggaccctg

SEQ ID NO: 6469693 - DNA, 21 bp, Homo sapiens
tgccagggatggcagtggctg

SEQ ID NO: 6469694 - DNA, 23 bp, Homo sapiens
tgccagggcaggctaccccttca

SEQ ID NO: 6469695 - DNA, 19 bp, Homo sapiens
tgccagggcagggtctggg

SEQ ID NO: 6469696 - DNA, 16 bp, Homo sapiens
tgccagggcccacccc

SEQ ID NO: 6469697 - DNA, 18 bp, Homo sapiens
tctctcaagagtgctgag

SEQ ID NO: 6469698 - DNA, 16 bp, Homo sapiens
tctctcaatttgggtc

SEQ ID NO: 6469699 - DNA, 14 bp, Homo sapiens
tctctcacacacac

SEQ ID NO: 6469700 - DNA, 17 bp, Homo sapiens
tctctcacagacaggac

SEQ ID NO: 6469701 - DNA, 13 bp, Homo sapiens
tctctcaccagcc

SEQ ID NO: 6469702 - DNA, 14 bp, Homo sapiens
tctctcacccacca

SEQ ID NO: 6469703 - DNA, 12 bp, Homo sapiens
tctctcacccag

SEQ ID NO: 6469704 - DNA, 18 bp, Homo sapiens
tctctcacctagaccttg

SEQ ID NO: 6469705 - DNA, 16 bp, Homo sapiens
tctctcacctgctccc

SEQ ID NO: 6469706 - DNA, 13 bp, Homo sapiens
tctctcactcctt

SEQ ID NO: 6469707 - DNA, 21 bp, Homo sapiens
tctctcactctcttcctttca

SEQ ID NO: 6469708 - DNA, 22 bp, Homo sapiens
tctctcactgtgttactgcttt

SEQ ID NO: 6469709 - DNA, 22 bp, Homo sapiens
tctctcactgttgcagtggcct

SEQ ID NO: 6469710 - DNA, 11 bp, Homo sapiens
tctctcagacc

SEQ ID NO: 6469711 - DNA, 11 bp, Homo sapiens
tctctcagcat

SEQ ID NO: 6469712 - DNA, 15 bp, Homo sapiens
tctctcagcctccac

SEQ ID NO: 6469713 - DNA, 19 bp, Homo sapiens
tctctcagcctccactccc

SEQ ID NO: 6469714 - DNA, 12 bp, Homo sapiens
tctctcagctcc

SEQ ID NO: 6469715 - DNA, 12 bp, Homo sapiens
tctctcaggaat

SEQ ID NO: 6469716 - DNA, 22 bp, Homo sapiens
tctctcaggagcacaggcagct

SEQ ID NO: 6469717 - DNA, 16 bp, Homo sapiens
tctctcaggagtatct

SEQ ID NO: 6469718 - DNA, 21 bp, Homo sapiens
tctctcaggccaaactcacct

SEQ ID NO: 6469719 - DNA, 19 bp, Homo sapiens
tctctcaggccaccacaga

SEQ ID NO: 6469720 - DNA, 16 bp, Homo sapiens
tctctcagggccaggc

SEQ ID NO: 6469721 - DNA, 12 bp, Homo sapiens
tctctcagtgaa

SEQ ID NO: 6469722 - DNA, 15 bp, Homo sapiens
tctctcataccctcc

SEQ ID NO: 6469723 - DNA, 16 bp, Homo sapiens
tctctcatagtgtcat

SEQ ID NO: 6469724 - DNA, 15 bp, Homo sapiens
tctctcatctgatca

SEQ ID NO: 6469725 - DNA, 18 bp, Homo sapiens
tctctcatctgttacaca

SEQ ID NO: 6469726 - DNA, 22 bp, Homo sapiens
tctctcatgaacctcaagctgc

SEQ ID NO: 6469727 - DNA, 19 bp, Homo sapiens
tctctcatgagaagccaag

SEQ ID NO: 6469728 - DNA, 14 bp, Homo sapiens
tctctcatgcctcc

SEQ ID NO: 6469729 - DNA, 18 bp, Homo sapiens
tctctcatgcctcctgag

SEQ ID NO: 6469730 - DNA, 11 bp, Homo sapiens
tctctcatgtg

SEQ ID NO: 6469731 - DNA, 12 bp, Homo sapiens
tctctcatgtgg

SEQ ID NO: 6469732 - DNA, 14 bp, Homo sapiens
tctctcattctctt

SEQ ID NO: 6469733 - DNA, 16 bp, Homo sapiens
tctctcattgtctgtg

SEQ ID NO: 6469734 - DNA, 18 bp, Homo sapiens
tctctccaaggtgtgccc

SEQ ID NO: 6469735 - DNA, 17 bp, Homo sapiens
tctctccacacggagct

SEQ ID NO: 6469736 - DNA, 15 bp, Homo sapiens
tctctccacctgcct

SEQ ID NO: 6469737 - DNA, 21 bp, Homo sapiens
tctctccactaccccacacca

SEQ ID NO: 6469738 - DNA, 22 bp, Homo sapiens
tctctccactaccccacaccag

SEQ ID NO: 6469739 - DNA, 21 bp, Homo sapiens
tctctccactgctctcagcct

SEQ ID NO: 6469740 - DNA, 24 bp, Homo sapiens
tctctccactgctctcagcctccc

SEQ ID NO: 6469741 - DNA, 13 bp, Homo sapiens
tctctccactgtg

SEQ ID NO: 6469742 - DNA, 18 bp, Homo sapiens
tctctccactttcagctg

SEQ ID NO: 6469743 - DNA, 19 bp, Homo sapiens
tctctccactttcagctgt

SEQ ID NO: 6469744 - DNA, 20 bp, Homo sapiens
tctctccactttcagctgtc

SEQ ID NO: 6469745 - DNA, 22 bp, Homo sapiens
tctctccagaaacagctgcttc

SEQ ID NO: 6469746 - DNA, 23 bp, Homo sapiens
tctctccagaaacagctgcttct

SEQ ID NO: 6469747 - DNA, 11 bp, Homo sapiens
tctctccagcc

SEQ ID NO: 6469748 - DNA, 16 bp, Homo sapiens
tctctccagcccctgg

SEQ ID NO: 6469749 - DNA, 20 bp, Homo sapiens
tctctccagcctcacagatg

SEQ ID NO: 6469750 - DNA, 14 bp, Homo sapiens
tctctccaggaagt

SEQ ID NO: 6469751 - DNA, 15 bp, Homo sapiens
tctctccaggagggc

SEQ ID NO: 6469752 - DNA, 17 bp, Homo sapiens
tctctccaggtcagcct

SEQ ID NO: 6469753 - DNA, 13 bp, Homo sapiens
tctctccagtgca

SEQ ID NO: 6469754 - DNA, 19 bp, Homo sapiens
tctctccatttcactggct

SEQ ID NO: 6469755 - DNA, 17 bp, Homo sapiens
tctctcccaacgctgaa

SEQ ID NO: 6469756 - DNA, 19 bp, Homo sapiens
tctctcccaccccctcccc

SEQ ID NO: 6469757 - DNA, 14 bp, Homo sapiens
tctctcccaccccg

SEQ ID NO: 6469758 - DNA, 19 bp, Homo sapiens
tctctcccaccccggcctc

SEQ ID NO: 6469759 - DNA, 21 bp, Homo sapiens
tctctcccaccccggcctcca

SEQ ID NO: 6469760 - DNA, 19 bp, Homo sapiens
tctctcccacgtgcacagc

SEQ ID NO: 6469761 - DNA, 21 bp, Homo sapiens
tctctcccacttcctcctacc

SEQ ID NO: 6469762 - DNA, 22 bp, Homo sapiens
tctctcccacttcctcctacct

SEQ ID NO: 6469763 - DNA, 16 bp, Homo sapiens
tctctcccagctctgg

SEQ ID NO: 6469764 - DNA, 20 bp, Homo sapiens
tctctcccaggggctggctt

SEQ ID NO: 6469765 - DNA, 22 bp, Homo sapiens
tctctcccaggggctggcttca

SEQ ID NO: 6469766 - DNA, 20 bp, Homo sapiens
tctctcccataccatcactg

SEQ ID NO: 6469767 - DNA, 23 bp, Homo sapiens
tctctcccatggagccccagccc

SEQ ID NO: 6469768 - DNA, 13 bp, Homo sapiens
tctctccccaatg

SEQ ID NO: 6469769 - DNA, 21 bp, Homo sapiens
tctctccccagccccctccca

SEQ ID NO: 6469770 - DNA, 20 bp, Homo sapiens
tctctccccatatataaatt

SEQ ID NO: 6469771 - DNA, 15 bp, Homo sapiens
tctctccccctctgt

SEQ ID NO: 6469772 - DNA, 22 bp, Homo sapiens
tctctccccggtaatgtcactg

SEQ ID NO: 6469773 - DNA, 22 bp, Homo sapiens
tctctcccctcaaagtctgcaa

SEQ ID NO: 6469774 - DNA, 22 bp, Homo sapiens
tctctcccctcacatcctcctg

SEQ ID NO: 6469775 - DNA, 18 bp, Homo sapiens
tctctccccttgcactgg

SEQ ID NO: 6469776 - DNA, 22 bp, Homo sapiens
tctctccctacctccctcctca

SEQ ID NO: 6469777 - DNA, 20 bp, Homo sapiens
tctctccctccactcctccc

SEQ ID NO: 6469778 - DNA, 19 bp, Homo sapiens
tctctccctcccccagagc

SEQ ID NO: 6469779 - DNA, 21 bp, Homo sapiens
tctctccctcccccagagccc

SEQ ID NO: 6469780 - DNA, 14 bp, Homo sapiens
tctctccctcccct

SEQ ID NO: 6469781 - DNA, 21 bp, Homo sapiens
tctctccctcccctgccattt

SEQ ID NO: 6469782 - DNA, 19 bp, Homo sapiens
tctctccctctttctagcc

SEQ ID NO: 6469783 - DNA, 22 bp, Homo sapiens
tctctccctgccagaggggaag

SEQ ID NO: 6469784 - DNA, 15 bp, Homo sapiens
tctctccctgcctca

SEQ ID NO: 6469785 - DNA, 16 bp, Homo sapiens
tctctccctgcctcac

SEQ ID NO: 6469786 - DNA, 15 bp, Homo sapiens
tctctccctgtcaca

SEQ ID NO: 6469787 - DNA, 16 bp, Homo sapiens
tctctccctgtcacac

SEQ ID NO: 6469788 - DNA, 19 bp, Homo sapiens
tctctccctgtcacacact

SEQ ID NO: 6469789 - DNA, 23 bp, Homo sapiens
tctctcccttacccatcttgctt

SEQ ID NO: 6469790 - DNA, 14 bp, Homo sapiens
tctctcccttcctc

SEQ ID NO: 6469791 - DNA, 20 bp, Homo sapiens
tctctcccttcctctctcct

SEQ ID NO: 6469792 - DNA, 23 bp, Homo sapiens
tctctccgccccggacagggtgg

SEQ ID NO: 6469793 - DNA, 16 bp, Homo sapiens
tctctcctcagactgc

SEQ ID NO: 6469794 - DNA, 14 bp, Homo sapiens
tctctcctcaggac

SEQ ID NO: 6469795 - DNA, 18 bp, Homo sapiens
tctctcctcccctacacc

SEQ ID NO: 6469796 - DNA, 19 bp, Homo sapiens
tctctcctccctcctgggg

SEQ ID NO: 6469797 - DNA, 17 bp, Homo sapiens
tctctcctctctctccc

SEQ ID NO: 6469798 - DNA, 14 bp, Homo sapiens
tctctcctctctgc

SEQ ID NO: 6469799 - DNA, 16 bp, Homo sapiens
tctctcctctctgctt

SEQ ID NO: 6469800 - DNA, 14 bp, Homo sapiens
tctctcctgctcac

SEQ ID NO: 6469801 - DNA, 17 bp, Homo sapiens
tctctcctggactggtt

SEQ ID NO: 6469802 - DNA, 22 bp, Homo sapiens
tctctcctggactggttatctt

SEQ ID NO: 6469803 - DNA, 13 bp, Homo sapiens
tctctcctggcct

SEQ ID NO: 6469804 - DNA, 17 bp, Homo sapiens
tctctcctggctgggcc

SEQ ID NO: 6469805 - DNA, 22 bp, Homo sapiens
tctctcctggctgggccatcct

SEQ ID NO: 6469806 - DNA, 22 bp, Homo sapiens
tctctcctgtataaccccacct

SEQ ID NO: 6469807 - DNA, 13 bp, Homo sapiens
tctctcctgtcct

SEQ ID NO: 6469808 - DNA, 14 bp, Homo sapiens
tctctcctgtcctc

SEQ ID NO: 6469809 - DNA, 18 bp, Homo sapiens
tctctccttcctcttggc

SEQ ID NO: 6469810 - DNA, 14 bp, Homo sapiens
tctctccttctggc

SEQ ID NO: 6469811 - DNA, 19 bp, Homo sapiens
tctctccttcttccctgtt

SEQ ID NO: 6469812 - DNA, 13 bp, Homo sapiens
tctctccttggcc

SEQ ID NO: 6469813 - DNA, 14 bp, Homo sapiens
tctctccttggcca

SEQ ID NO: 6469814 - DNA, 18 bp, Homo sapiens
tctctccttggcctttcc

SEQ ID NO: 6469815 - DNA, 15 bp, Homo sapiens
tctctcctttctccc

SEQ ID NO: 6469816 - DNA, 18 bp, Homo sapiens
tctctcgaatactttgaa

SEQ ID NO: 6469817 - DNA, 20 bp, Homo sapiens
tctctcggaactcccgcacc

SEQ ID NO: 6469818 - DNA, 23 bp, Homo sapiens
tctctcggagtatctgggaactg

SEQ ID NO: 6469819 - DNA, 20 bp, Homo sapiens
tctctcggctccccatgtgt

SEQ ID NO: 6469820 - DNA, 18 bp, Homo sapiens
tctctcggtgtggcgtga

SEQ ID NO: 6469821 - DNA, 23 bp, Homo sapiens
tctctcggttccacgtccccctg

SEQ ID NO: 6469822 - DNA, 20 bp, Homo sapiens
tctctcgtaactggtttcat

SEQ ID NO: 6469823 - DNA, 22 bp, Homo sapiens
tctctcgttttgggtactttct

SEQ ID NO: 6469824 - DNA, 16 bp, Homo sapiens
tctctctaacataaca

SEQ ID NO: 6469825 - DNA, 19 bp, Homo sapiens
tctctctaagacaaatgca

SEQ ID NO: 6469826 - DNA, 20 bp, Homo sapiens
tctctctaagacaaatgcag

SEQ ID NO: 6469827 - DNA, 21 bp, Homo sapiens
tctctctaagacaaatgcagt

SEQ ID NO: 6469828 - DNA, 22 bp, Homo sapiens
tctctctaagacaaatgcagtg

SEQ ID NO: 6469829 - DNA, 21 bp, Homo sapiens
tctctctaagtttagaagcgc

SEQ ID NO: 6469830 - DNA, 21 bp, Homo sapiens
tctctctacaagagcccctgc

SEQ ID NO: 6469831 - DNA, 22 bp, Homo sapiens
tctctctaccagtctatttcca

SEQ ID NO: 6469832 - DNA, 17 bp, Homo sapiens
tctctctatatatacat

SEQ ID NO: 6469833 - DNA, 22 bp, Homo sapiens
tctctctatgcaaaatgtctgt

SEQ ID NO: 6469834 - DNA, 23 bp, Homo sapiens
tctctctcatgcctcctgaggct

SEQ ID NO: 6469835 - DNA, 23 bp, Homo sapiens
tctctctccagaaacagctgctt

SEQ ID NO: 6469836 - DNA, 13 bp, Homo sapiens
tctctctccaggg

SEQ ID NO: 6469837 - DNA, 14 bp, Homo sapiens
tctctctccagtct

SEQ ID NO: 6469838 - DNA, 23 bp, Homo sapiens
tctctctcccatggagccccagc

SEQ ID NO: 6469839 - DNA, 11 bp, Homo sapiens
tctctctccct

SEQ ID NO: 6469840 - DNA, 15 bp, Homo sapiens
tctctctccctccac

SEQ ID NO: 6469841 - DNA, 13 bp, Homo sapiens
tctctctcctcag

SEQ ID NO: 6469842 - DNA, 13 bp, Homo sapiens
tctctctcctctc

SEQ ID NO: 6469843 - DNA, 15 bp, Homo sapiens
tctctctcctggtgt

SEQ ID NO: 6469844 - DNA, 22 bp, Homo sapiens
tctctctcctggtgtgggtaaa

SEQ ID NO: 6469845 - DNA, 12 bp, Homo sapiens
tctctctcctgt

SEQ ID NO: 6469846 - DNA, 16 bp, Homo sapiens
tctctctcggcccctg

SEQ ID NO: 6469847 - DNA, 14 bp, Homo sapiens
tctctctctacaaa

SEQ ID NO: 6469848 - DNA, 14 bp, Homo sapiens
tctctctctctccc

SEQ ID NO: 6469849 - DNA, 14 bp, Homo sapiens
tctctctctctcct

SEQ ID NO: 6469850 - DNA, 16 bp, Homo sapiens
tctctctctctcctca

SEQ ID NO: 6469851 - DNA, 13 bp, Homo sapiens
tctctctctctcg

SEQ ID NO: 6469852 - DNA, 13 bp, Homo sapiens
tctctctctctct

SEQ ID NO: 6469853 - DNA, 14 bp, Homo sapiens
tctctctctctctc

SEQ ID NO: 6469854 - DNA, 13 bp, Homo sapiens
tctctctctctgg

SEQ ID NO: 6469855 - DNA, 14 bp, Homo sapiens
tctctctctcttcc

SEQ ID NO: 6469856 - DNA, 14 bp, Homo sapiens
tctctctctctttg

SEQ ID NO: 6469857 - DNA, 10 bp, Homo sapiens
tctctctctg

SEQ ID NO: 6469858 - DNA, 14 bp, Homo sapiens
tctctctctttctc

SEQ ID NO: 6469859 - DNA, 13 bp, Homo sapiens
tctctctctttgt

SEQ ID NO: 6469860 - DNA, 14 bp, Homo sapiens
tctctctctttgtt

SEQ ID NO: 6469861 - DNA, 15 bp, Homo sapiens
tctctctctttttct

SEQ ID NO: 6469862 - DNA, 14 bp, Homo sapiens
tctctctgactctc

SEQ ID NO: 6469863 - DNA, 15 bp, Homo sapiens
tctctctgagggggt

SEQ ID NO: 6469864 - DNA, 13 bp, Homo sapiens
tctctctgcccaa

SEQ ID NO: 6469865 - DNA, 16 bp, Homo sapiens
tctctctgcccaaccc

SEQ ID NO: 6469866 - DNA, 12 bp, Homo sapiens
tctctctgcccc

SEQ ID NO: 6469867 - DNA, 20 bp, Homo sapiens
tctctctgccctctccctgt

SEQ ID NO: 6469868 - DNA, 19 bp, Homo sapiens
tctctctgcctatttattg

SEQ ID NO: 6469869 - DNA, 13 bp, Homo sapiens
tctctctgcctga

SEQ ID NO: 6469870 - DNA, 13 bp, Homo sapiens
tctctctgcctgc

SEQ ID NO: 6469871 - DNA, 15 bp, Homo sapiens
tctctctgcctgctg

SEQ ID NO: 6469872 - DNA, 13 bp, Homo sapiens
tctctctgctcca

SEQ ID NO: 6469873 - DNA, 11 bp, Homo sapiens
tctctctggag

SEQ ID NO: 6469874 - DNA, 13 bp, Homo sapiens
tctctctggagcc

SEQ ID NO: 6469875 - DNA, 14 bp, Homo sapiens
tctctctggagccc

SEQ ID NO: 6469876 - DNA, 19 bp, Homo sapiens
tctctctggccctctaccc

SEQ ID NO: 6469877 - DNA, 18 bp, Homo sapiens
tgccagggcccctctccc

SEQ ID NO: 6469878 - DNA, 18 bp, Homo sapiens
tgccagggcccctgttcc

SEQ ID NO: 6469879 - DNA, 12 bp, Homo sapiens
tgccagggcccg

SEQ ID NO: 6469880 - DNA, 20 bp, Homo sapiens
tgccagggcgcactttccac

SEQ ID NO: 6469881 - DNA, 13 bp, Homo sapiens
tgccagggctctg

SEQ ID NO: 6469882 - DNA, 16 bp, Homo sapiens
tgccagggctctgggg

SEQ ID NO: 6469883 - DNA, 12 bp, Homo sapiens
tgccagggctgc

SEQ ID NO: 6469884 - DNA, 18 bp, Homo sapiens
tgccagggcttcctcttc

SEQ ID NO: 6469885 - DNA, 23 bp, Homo sapiens
tgccagggggtttgaggaccctc

SEQ ID NO: 6469886 - DNA, 17 bp, Homo sapiens
tgccaggggtaacctgg

SEQ ID NO: 6469887 - DNA, 20 bp, Homo sapiens
tgccaggggtaacctggcca

SEQ ID NO: 6469888 - DNA, 17 bp, Homo sapiens
tgccagggtgagcaggg

SEQ ID NO: 6469889 - DNA, 15 bp, Homo sapiens
tgccagggtgggctg

SEQ ID NO: 6469890 - DNA, 17 bp, Homo sapiens
tgccagggtgggctggg

SEQ ID NO: 6469891 - DNA, 18 bp, Homo sapiens
tgccagggtgggctgggg

SEQ ID NO: 6469892 - DNA, 16 bp, Homo sapiens
tgccagggtgggtgtc

SEQ ID NO: 6469893 - DNA, 23 bp, Homo sapiens
tgccagggtgggtgtccatgtgc

SEQ ID NO: 6469894 - DNA, 20 bp, Homo sapiens
tgccagggtttcgagaagct

SEQ ID NO: 6469895 - DNA, 22 bp, Homo sapiens
tgccaggtccctttcatttgct

SEQ ID NO: 6469896 - DNA, 22 bp, Homo sapiens
tgccaggtgaaggaggctccag

SEQ ID NO: 6469897 - DNA, 13 bp, Homo sapiens
tgccaggtgctgg

SEQ ID NO: 6469898 - DNA, 20 bp, Homo sapiens
tgccaggtggttgggttctg

SEQ ID NO: 6469899 - DNA, 14 bp, Homo sapiens
tgccaggttgcagc

SEQ ID NO: 6469900 - DNA, 18 bp, Homo sapiens
tgccaggttttctgggtg

SEQ ID NO: 6469901 - DNA, 17 bp, Homo sapiens
tgccaggtttttggtct

SEQ ID NO: 6469902 - DNA, 22 bp, Homo sapiens
tgccagtaaaaaaaaaaaatgg

SEQ ID NO: 6469903 - DNA, 23 bp, Homo sapiens
tgccagtaacgcgtcttcctgag

SEQ ID NO: 6469904 - DNA, 22 bp, Homo sapiens
tgccagtaggctcaactaggga

SEQ ID NO: 6469905 - DNA, 17 bp, Homo sapiens
tgccagtagtaccttgt

SEQ ID NO: 6469906 - DNA, 16 bp, Homo sapiens
tgccagtatataagct

SEQ ID NO: 6469907 - DNA, 18 bp, Homo sapiens
tgccagtatgttccaaac

SEQ ID NO: 6469908 - DNA, 17 bp, Homo sapiens
tgccagtattttaaaat

SEQ ID NO: 6469909 - DNA, 16 bp, Homo sapiens
tgccagtcctagctgc

SEQ ID NO: 6469910 - DNA, 17 bp, Homo sapiens
tgccagtcctcctcagg

SEQ ID NO: 6469911 - DNA, 21 bp, Homo sapiens
tgccagtcctcctcaggagaa

SEQ ID NO: 6469912 - DNA, 12 bp, Homo sapiens
tgccagtcgcgc

SEQ ID NO: 6469913 - DNA, 19 bp, Homo sapiens
tgccagtcgcgctgcctgt

SEQ ID NO: 6469914 - DNA, 20 bp, Homo sapiens
tgccagtcgggagagccagg

SEQ ID NO: 6469915 - DNA, 23 bp, Homo sapiens
tgccagtctcactgtgggaaggc

SEQ ID NO: 6469916 - DNA, 22 bp, Homo sapiens
tgccagtctgttaagtaaaatg

SEQ ID NO: 6469917 - DNA, 19 bp, Homo sapiens
tgccagtcttccagaaagc

SEQ ID NO: 6469918 - DNA, 17 bp, Homo sapiens
tgccagtctttaagatc

SEQ ID NO: 6469919 - DNA, 14 bp, Homo sapiens
tgccagtgaagact

SEQ ID NO: 6469920 - DNA, 21 bp, Homo sapiens
tgccagtgaagggttttgtgt

SEQ ID NO: 6469921 - DNA, 19 bp, Homo sapiens
tgccagtgacagacaggct

SEQ ID NO: 6469922 - DNA, 20 bp, Homo sapiens
tgccagtgacagacaggctc

SEQ ID NO: 6469923 - DNA, 17 bp, Homo sapiens
tgccagtgactgctgcg

SEQ ID NO: 6469924 - DNA, 20 bp, Homo sapiens
tgccagtgactgctgcgctg

SEQ ID NO: 6469925 - DNA, 15 bp, Homo sapiens
tgccagtgcactccg

SEQ ID NO: 6469926 - DNA, 17 bp, Homo sapiens
tgccagtgcactccggc

SEQ ID NO: 6469927 - DNA, 21 bp, Homo sapiens
tgccagtgcatgccaggaagc

SEQ ID NO: 6469928 - DNA, 17 bp, Homo sapiens
tgccagtgccagggtgg

SEQ ID NO: 6469929 - DNA, 13 bp, Homo sapiens
tgccagtgcctta

SEQ ID NO: 6469930 - DNA, 21 bp, Homo sapiens
tgccagtgccttacctcctgc

SEQ ID NO: 6469931 - DNA, 14 bp, Homo sapiens
tgccagtgccttat

SEQ ID NO: 6469932 - DNA, 21 bp, Homo sapiens
tgccagtgctaagctgccctg

SEQ ID NO: 6469933 - DNA, 15 bp, Homo sapiens
tgccagtgctcaagg

SEQ ID NO: 6469934 - DNA, 14 bp, Homo sapiens
tgccagtgctggtc

SEQ ID NO: 6469935 - DNA, 23 bp, Homo sapiens
tgccagtggagacggaatctgcc

SEQ ID NO: 6469936 - DNA, 14 bp, Homo sapiens
tgccagtggatccc

SEQ ID NO: 6469937 - DNA, 14 bp, Homo sapiens
tgccagtggtgtcc

SEQ ID NO: 6469938 - DNA, 23 bp, Homo sapiens
tgccagtgtcctgagccccaggg

SEQ ID NO: 6469939 - DNA, 21 bp, Homo sapiens
tgccagtgtgttactcatctt

SEQ ID NO: 6469940 - DNA, 20 bp, Homo sapiens
tgccagtgtttagaagagcc

SEQ ID NO: 6469941 - DNA, 13 bp, Homo sapiens
tgccagttcctgt

SEQ ID NO: 6469942 - DNA, 15 bp, Homo sapiens
tgccagttctctgtg

SEQ ID NO: 6469943 - DNA, 21 bp, Homo sapiens
tgccagttgggctcgcactgc

SEQ ID NO: 6469944 - DNA, 18 bp, Homo sapiens
tgccagttttccctggaa

SEQ ID NO: 6469945 - DNA, 16 bp, Homo sapiens
tgccagttttccgaag

SEQ ID NO: 6469946 - DNA, 20 bp, Homo sapiens
tgccagtttttaaaatgctg

SEQ ID NO: 6469947 - DNA, 12 bp, Homo sapiens
tgccataaaaca

SEQ ID NO: 6469948 - DNA, 22 bp, Homo sapiens
tgccataaaacattaagaaaat

SEQ ID NO: 6469949 - DNA, 22 bp, Homo sapiens
tgccataaaagccgcccagtgg

SEQ ID NO: 6469950 - DNA, 18 bp, Homo sapiens
tgccataaaatctcacgc

SEQ ID NO: 6469951 - DNA, 21 bp, Homo sapiens
tgccataaaattgcagtttca

SEQ ID NO: 6469952 - DNA, 19 bp, Homo sapiens
tgccataaccatgagcact

SEQ ID NO: 6469953 - DNA, 20 bp, Homo sapiens
tgccataaccatgagcacta

SEQ ID NO: 6469954 - DNA, 14 bp, Homo sapiens
tgccataacttgtt

SEQ ID NO: 6469955 - DNA, 19 bp, Homo sapiens
tgccataacttgtttgtaa

SEQ ID NO: 6469956 - DNA, 21 bp, Homo sapiens
tgccataacttgtttgtaaaa

SEQ ID NO: 6469957 - DNA, 17 bp, Homo sapiens
tgccataactttatgaa

SEQ ID NO: 6469958 - DNA, 14 bp, Homo sapiens
tgccataatcagaa

SEQ ID NO: 6469959 - DNA, 16 bp, Homo sapiens
tgccataatcagaaca

SEQ ID NO: 6469960 - DNA, 13 bp, Homo sapiens
tgccataattcta

SEQ ID NO: 6469961 - DNA, 12 bp, Homo sapiens
tgccataccgct

SEQ ID NO: 6469962 - DNA, 23 bp, Homo sapiens
tgccataccgctggggaacagag

SEQ ID NO: 6469963 - DNA, 15 bp, Homo sapiens
tgccataccttctcc

SEQ ID NO: 6469964 - DNA, 22 bp, Homo sapiens
tgccataccttctcccaggcct

SEQ ID NO: 6469965 - DNA, 15 bp, Homo sapiens
tgccatagagtacac

SEQ ID NO: 6469966 - DNA, 21 bp, Homo sapiens
tgccatagagtttaacacaag

SEQ ID NO: 6469967 - DNA, 13 bp, Homo sapiens
tgccatagcataa

SEQ ID NO: 6469968 - DNA, 23 bp, Homo sapiens
tgccatagcataatatgaagcct

SEQ ID NO: 6469969 - DNA, 15 bp, Homo sapiens
tgccatagccaggag

SEQ ID NO: 6469970 - DNA, 19 bp, Homo sapiens
tgccatagggtctgcagcc

SEQ ID NO: 6469971 - DNA, 17 bp, Homo sapiens
tgccatagtcacatggc

SEQ ID NO: 6469972 - DNA, 17 bp, Homo sapiens
tgccatagtcttaactg

SEQ ID NO: 6469973 - DNA, 18 bp, Homo sapiens
tgccatatggaggactgt

SEQ ID NO: 6469974 - DNA, 22 bp, Homo sapiens
tgccatatggaggactgtgaca

SEQ ID NO: 6469975 - DNA, 16 bp, Homo sapiens
tgccatattaaatttt

SEQ ID NO: 6469976 - DNA, 23 bp, Homo sapiens
tgccatattctggttcttgaaaa

SEQ ID NO: 6469977 - DNA, 20 bp, Homo sapiens
tgccatattgcacatgtctt

SEQ ID NO: 6469978 - DNA, 21 bp, Homo sapiens
tgccatattgcacatgtctta

SEQ ID NO: 6469979 - DNA, 15 bp, Homo sapiens
tgccatattgtgtaa

SEQ ID NO: 6469980 - DNA, 19 bp, Homo sapiens
tgccatattgtgtaattta

SEQ ID NO: 6469981 - DNA, 13 bp, Homo sapiens
tgccatattttca

SEQ ID NO: 6469982 - DNA, 14 bp, Homo sapiens
tgccatattttcac

SEQ ID NO: 6469983 - DNA, 17 bp, Homo sapiens
tgccatcaccgctgggt

SEQ ID NO: 6469984 - DNA, 13 bp, Homo sapiens
tgccatcagaaat

SEQ ID NO: 6469985 - DNA, 16 bp, Homo sapiens
tgccatcagaaatttt

SEQ ID NO: 6469986 - DNA, 19 bp, Homo sapiens
tgccatcagaaattttcta

SEQ ID NO: 6469987 - DNA, 22 bp, Homo sapiens
tgccatcagaaattttctacag

SEQ ID NO: 6469988 - DNA, 13 bp, Homo sapiens
tgccatcagcccc

SEQ ID NO: 6469989 - DNA, 20 bp, Homo sapiens
tgccatcagcccctgctgct

SEQ ID NO: 6469990 - DNA, 23 bp, Homo sapiens
tgccatcatctcctgccttcctc

SEQ ID NO: 6469991 - DNA, 16 bp, Homo sapiens
tgccatcatgtttaca

SEQ ID NO: 6469992 - DNA, 23 bp, Homo sapiens
tgccatcattgatgatcactgtg

SEQ ID NO: 6469993 - DNA, 14 bp, Homo sapiens
tgccatcattgctg

SEQ ID NO: 6469994 - DNA, 15 bp, Homo sapiens
tgccatcattgctgt

SEQ ID NO: 6469995 - DNA, 16 bp, Homo sapiens
tgccatcattgctgtc

SEQ ID NO: 6469996 - DNA, 18 bp, Homo sapiens
tgccatcattgctgtctg

SEQ ID NO: 6469997 - DNA, 16 bp, Homo sapiens
tgccatccattctgcc

SEQ ID NO: 6469998 - DNA, 14 bp, Homo sapiens
tgccatcccctccc

SEQ ID NO: 6469999 - DNA, 16 bp, Homo sapiens
tgccatcccggcagcg

SEQ ID NO: 6470000 - DNA, 14 bp, Homo sapiens
tgccatccctccct

SEQ ID NO: 6470001 - DNA, 19 bp, Homo sapiens
tgccatccctccctccacc

SEQ ID NO: 6470002 - DNA, 20 bp, Homo sapiens
tgccatccctccctccacct

SEQ ID NO: 6470003 - DNA, 21 bp, Homo sapiens
tgccatccctccctccacctc

SEQ ID NO: 6470004 - DNA, 22 bp, Homo sapiens
tgccatccctccctccacctcc

SEQ ID NO: 6470005 - DNA, 15 bp, Homo sapiens
tgccatccctgagag

SEQ ID NO: 6470006 - DNA, 11 bp, Homo sapiens
tgccatcctcc

SEQ ID NO: 6470007 - DNA, 15 bp, Homo sapiens
tgccatcctctttct

SEQ ID NO: 6470008 - DNA, 14 bp, Homo sapiens
tgccatcctgatgg

SEQ ID NO: 6470009 - DNA, 14 bp, Homo sapiens
tgccatcgctgtga

SEQ ID NO: 6470010 - DNA, 16 bp, Homo sapiens
tgccatcggtctagaa

SEQ ID NO: 6470011 - DNA, 16 bp, Homo sapiens
tgccatctatctagtt

SEQ ID NO: 6470012 - DNA, 22 bp, Homo sapiens
tgccatctcacctcctgctggg

SEQ ID NO: 6470013 - DNA, 23 bp, Homo sapiens
tgccatctcacctcctgctgggc

SEQ ID NO: 6470014 - DNA, 14 bp, Homo sapiens
tgccatctccaccc

SEQ ID NO: 6470015 - DNA, 14 bp, Homo sapiens
tgccatctgtacat

SEQ ID NO: 6470016 - DNA, 16 bp, Homo sapiens
tgccatctgtgggcac

SEQ ID NO: 6470017 - DNA, 12 bp, Homo sapiens
tgccatctgttt

SEQ ID NO: 6470018 - DNA, 12 bp, Homo sapiens
tgccatcttcag

SEQ ID NO: 6470019 - DNA, 12 bp, Homo sapiens
tgccatcttctc

SEQ ID NO: 6470020 - DNA, 18 bp, Homo sapiens
tgccatcttctccccgag

SEQ ID NO: 6470021 - DNA, 21 bp, Homo sapiens
tgccatcttctccccgaggct

SEQ ID NO: 6470022 - DNA, 22 bp, Homo sapiens
tgccatcttgcttttctttgga

SEQ ID NO: 6470023 - DNA, 19 bp, Homo sapiens
tgccatgaacaaattcttt

SEQ ID NO: 6470024 - DNA, 16 bp, Homo sapiens
tgccatgaactggagg

SEQ ID NO: 6470025 - DNA, 22 bp, Homo sapiens
tgccatgaactggaggccagga

SEQ ID NO: 6470026 - DNA, 14 bp, Homo sapiens
tgccatgaaggcac

SEQ ID NO: 6470027 - DNA, 16 bp, Homo sapiens
tgccatgaaggcacct

SEQ ID NO: 6470028 - DNA, 19 bp, Homo sapiens
tgccatgaaggcacctgcc

SEQ ID NO: 6470029 - DNA, 21 bp, Homo sapiens
tgccatgaaggcacctgcccc

SEQ ID NO: 6470030 - DNA, 20 bp, Homo sapiens
tgccatgaagggaccctttg

SEQ ID NO: 6470031 - DNA, 20 bp, Homo sapiens
tgccatgacaacttctaatt

SEQ ID NO: 6470032 - DNA, 20 bp, Homo sapiens
tgccatgacatttcatctgg

SEQ ID NO: 6470033 - DNA, 16 bp, Homo sapiens
tgccatgactgctcag

SEQ ID NO: 6470034 - DNA, 19 bp, Homo sapiens
tgccatgagccgcccaagg

SEQ ID NO: 6470035 - DNA, 21 bp, Homo sapiens
tgccatgagccgcccaaggcc

SEQ ID NO: 6470036 - DNA, 20 bp, Homo sapiens
tgccatgaggaacaaggcaa

SEQ ID NO: 6470037 - DNA, 23 bp, Homo sapiens
tgccatgaggaacaaggcaaggc

SEQ ID NO: 6470038 - DNA, 18 bp, Homo sapiens
tgccatgaggcctttccc

SEQ ID NO: 6470039 - DNA, 13 bp, Homo sapiens
tgccatgagtcca

SEQ ID NO: 6470040 - DNA, 14 bp, Homo sapiens
tgccatgatctgta

SEQ ID NO: 6470041 - DNA, 16 bp, Homo sapiens
tgccatgatgtttaca

SEQ ID NO: 6470042 - DNA, 23 bp, Homo sapiens
tgccatgatttttggtatttatg

SEQ ID NO: 6470043 - DNA, 20 bp, Homo sapiens
tgccatgcaggaagaggccc

SEQ ID NO: 6470044 - DNA, 22 bp, Homo sapiens
tgccatgcaggaagaggcccac

SEQ ID NO: 6470045 - DNA, 16 bp, Homo sapiens
tgccatgcagggcctc

SEQ ID NO: 6470046 - DNA, 15 bp, Homo sapiens
tgccatgcatacatg

SEQ ID NO: 6470047 - DNA, 18 bp, Homo sapiens
tgccatgccactgccagg

SEQ ID NO: 6470048 - DNA, 16 bp, Homo sapiens
tgccatgcccaccatc

SEQ ID NO: 6470049 - DNA, 18 bp, Homo sapiens
tgccatgcctgctccctg

SEQ ID NO: 6470050 - DNA, 19 bp, Homo sapiens
tgccatgcctgctccctgt

SEQ ID NO: 6470051 - DNA, 19 bp, Homo sapiens
tgccatgcgtggctaacat

SEQ ID NO: 6470052 - DNA, 21 bp, Homo sapiens
tgccatgctatgtgcacagcc

SEQ ID NO: 6470053 - DNA, 14 bp, Homo sapiens
tgccatgctgggcc

SEQ ID NO: 6470054 - DNA, 21 bp, Homo sapiens
tctctctggccctctacccct

SEQ ID NO: 6470055 - DNA, 18 bp, Homo sapiens
tctctctggctctaggac

SEQ ID NO: 6470056 - DNA, 19 bp, Homo sapiens
tctctctggggccctgggc

SEQ ID NO: 6470057 - DNA, 21 bp, Homo sapiens
tctctctggggccctgggcct

SEQ ID NO: 6470058 - DNA, 13 bp, Homo sapiens
tctctctgtgaat

SEQ ID NO: 6470059 - DNA, 13 bp, Homo sapiens
tctctctgtgctg

SEQ ID NO: 6470060 - DNA, 17 bp, Homo sapiens
tctctctgtgtctttct

SEQ ID NO: 6470061 - DNA, 16 bp, Homo sapiens
tctctctgtgtggcaa

SEQ ID NO: 6470062 - DNA, 20 bp, Homo sapiens
tctctctgtgtggcaaacat

SEQ ID NO: 6470063 - DNA, 10 bp, Homo sapiens
tctctctgtt

SEQ ID NO: 6470064 - DNA, 15 bp, Homo sapiens
tctctctgttaaaga

SEQ ID NO: 6470065 - DNA, 16 bp, Homo sapiens
tctctctgttaaagat

SEQ ID NO: 6470066 - DNA, 17 bp, Homo sapiens
tctctctgttcccttcc

SEQ ID NO: 6470067 - DNA, 13 bp, Homo sapiens
tctctctgttgtg

SEQ ID NO: 6470068 - DNA, 11 bp, Homo sapiens
tctctcttcca

SEQ ID NO: 6470069 - DNA, 13 bp, Homo sapiens
tctctcttctagg

SEQ ID NO: 6470070 - DNA, 14 bp, Homo sapiens
tctctcttctctct

SEQ ID NO: 6470071 - DNA, 18 bp, Homo sapiens
tctctcttgctttgttct

SEQ ID NO: 6470072 - DNA, 17 bp, Homo sapiens
tctctcttggacccacc

SEQ ID NO: 6470073 - DNA, 13 bp, Homo sapiens
tctctcttgtcct

SEQ ID NO: 6470074 - DNA, 22 bp, Homo sapiens
tctctcttgttcttactttcct

SEQ ID NO: 6470075 - DNA, 17 bp, Homo sapiens
tctctctttatacagct

SEQ ID NO: 6470076 - DNA, 21 bp, Homo sapiens
tctctctttccatctcccttg

SEQ ID NO: 6470077 - DNA, 12 bp, Homo sapiens
tctctctttctc

SEQ ID NO: 6470078 - DNA, 15 bp, Homo sapiens
tctctcttttcattg

SEQ ID NO: 6470079 - DNA, 22 bp, Homo sapiens
tctctcttttcctcctccaccc

SEQ ID NO: 6470080 - DNA, 20 bp, Homo sapiens
tctctcttttcctctctctc

SEQ ID NO: 6470081 - DNA, 23 bp, Homo sapiens
tctctctttttcttttctatgga

SEQ ID NO: 6470082 - DNA, 16 bp, Homo sapiens
tctctgaaacatattt

SEQ ID NO: 6470083 - DNA, 14 bp, Homo sapiens
tctctgaaagtgtg

SEQ ID NO: 6470084 - DNA, 19 bp, Homo sapiens
tctctgaactgcaacactg

SEQ ID NO: 6470085 - DNA, 16 bp, Homo sapiens
tctctgaactggtaga

SEQ ID NO: 6470086 - DNA, 23 bp, Homo sapiens
tctctgaagagtgggtttcacaa

SEQ ID NO: 6470087 - DNA, 13 bp, Homo sapiens
tctctgaagcatg

SEQ ID NO: 6470088 - DNA, 16 bp, Homo sapiens
tctctgaagcatgttt

SEQ ID NO: 6470089 - DNA, 21 bp, Homo sapiens
tctctgaagcatgtttcatgt

SEQ ID NO: 6470090 - DNA, 22 bp, Homo sapiens
tctctgaagcatgtttcatgtt

SEQ ID NO: 6470091 - DNA, 21 bp, Homo sapiens
tctctgaagcgactctcctgt

SEQ ID NO: 6470092 - DNA, 15 bp, Homo sapiens
tctctgaaggaggcc

SEQ ID NO: 6470093 - DNA, 18 bp, Homo sapiens
tctctgaaggaggccacc

SEQ ID NO: 6470094 - DNA, 14 bp, Homo sapiens
tctctgaagggagg

SEQ ID NO: 6470095 - DNA, 14 bp, Homo sapiens
tctctgaatcctaa

SEQ ID NO: 6470096 - DNA, 16 bp, Homo sapiens
tctctgaatgagcctt

SEQ ID NO: 6470097 - DNA, 22 bp, Homo sapiens
tctctgaatgagcctttgtgct

SEQ ID NO: 6470098 - DNA, 13 bp, Homo sapiens
tctctgaatttgt

SEQ ID NO: 6470099 - DNA, 14 bp, Homo sapiens
tctctgacaaagtg

SEQ ID NO: 6470100 - DNA, 23 bp, Homo sapiens
tctctgacccggttgcagtcact

SEQ ID NO: 6470101 - DNA, 24 bp, Homo sapiens
tctctgacccggttgcagtcactg

SEQ ID NO: 6470102 - DNA, 23 bp, Homo sapiens
tctctgaccctctggaaatatgt

SEQ ID NO: 6470103 - DNA, 15 bp, Homo sapiens
tctctgacctctgct

SEQ ID NO: 6470104 - DNA, 18 bp, Homo sapiens
tctctgacgcttgtgaca

SEQ ID NO: 6470105 - DNA, 19 bp, Homo sapiens
tctctgacgcttgtgacag

SEQ ID NO: 6470106 - DNA, 20 bp, Homo sapiens
tctctgactcttgcctttcc

SEQ ID NO: 6470107 - DNA, 21 bp, Homo sapiens
tctctgactcttgcctttcca

SEQ ID NO: 6470108 - DNA, 15 bp, Homo sapiens
tctctgactgctttg

SEQ ID NO: 6470109 - DNA, 16 bp, Homo sapiens
tctctgagaaccaaaa

SEQ ID NO: 6470110 - DNA, 13 bp, Homo sapiens
tctctgagaagca

SEQ ID NO: 6470111 - DNA, 17 bp, Homo sapiens
tctctgagaagcatcct

SEQ ID NO: 6470112 - DNA, 13 bp, Homo sapiens
tctctgagactct

SEQ ID NO: 6470113 - DNA, 22 bp, Homo sapiens
tctctgagatgcccctctgcct

SEQ ID NO: 6470114 - DNA, 14 bp, Homo sapiens
tctctgagcagtga

SEQ ID NO: 6470115 - DNA, 17 bp, Homo sapiens
tctctgagccccctgtg

SEQ ID NO: 6470116 - DNA, 20 bp, Homo sapiens
tctctgagccccctgtgccc

SEQ ID NO: 6470117 - DNA, 15 bp, Homo sapiens
tctctgagctgtgca

SEQ ID NO: 6470118 - DNA, 14 bp, Homo sapiens
tctctgagctttgt

SEQ ID NO: 6470119 - DNA, 16 bp, Homo sapiens
tctctgagctttgtta

SEQ ID NO: 6470120 - DNA, 17 bp, Homo sapiens
tctctgaggacactaac

SEQ ID NO: 6470121 - DNA, 14 bp, Homo sapiens
tctctgaggcaagg

SEQ ID NO: 6470122 - DNA, 17 bp, Homo sapiens
tctctgagggagaggct

SEQ ID NO: 6470123 - DNA, 15 bp, Homo sapiens
tctctgagtcaaatc

SEQ ID NO: 6470124 - DNA, 19 bp, Homo sapiens
tctctgagtcaaatccagt

SEQ ID NO: 6470125 - DNA, 24 bp, Homo sapiens
tctctgagtcaaatccagtggtgg

SEQ ID NO: 6470126 - DNA, 18 bp, Homo sapiens
tctctgagtggtggttcc

SEQ ID NO: 6470127 - DNA, 19 bp, Homo sapiens
tctctgagtggtggttcct

SEQ ID NO: 6470128 - DNA, 22 bp, Homo sapiens
tctctgagttctgtgtattttc

SEQ ID NO: 6470129 - DNA, 16 bp, Homo sapiens
tctctgagttttagtt

SEQ ID NO: 6470130 - DNA, 14 bp, Homo sapiens
tctctgatacacag

SEQ ID NO: 6470131 - DNA, 23 bp, Homo sapiens
tctctgatacttttttgaaatca

SEQ ID NO: 6470132 - DNA, 23 bp, Homo sapiens
tctctgatcaaaattacttttct

SEQ ID NO: 6470133 - DNA, 16 bp, Homo sapiens
tctctgatgcagctta

SEQ ID NO: 6470134 - DNA, 15 bp, Homo sapiens
tctctgatggcactt

SEQ ID NO: 6470135 - DNA, 15 bp, Homo sapiens
tctctgatgtcccag

SEQ ID NO: 6470136 - DNA, 16 bp, Homo sapiens
tctctgatgtcccagt

SEQ ID NO: 6470137 - DNA, 19 bp, Homo sapiens
tctctgattagttgacagt

SEQ ID NO: 6470138 - DNA, 16 bp, Homo sapiens
tctctgatttgcaaat

SEQ ID NO: 6470139 - DNA, 19 bp, Homo sapiens
tctctgattttcaaagctt

SEQ ID NO: 6470140 - DNA, 20 bp, Homo sapiens
tctctgattttcaaagcttt

SEQ ID NO: 6470141 - DNA, 19 bp, Homo sapiens
tctctgcaaactgccttct

SEQ ID NO: 6470142 - DNA, 19 bp, Homo sapiens
tctctgcaatcttctcaga

SEQ ID NO: 6470143 - DNA, 21 bp, Homo sapiens
tctctgcaatttgtttaaaga

SEQ ID NO: 6470144 - DNA, 23 bp, Homo sapiens
tctctgcaatttgtttaaagaat

SEQ ID NO: 6470145 - DNA, 14 bp, Homo sapiens
tctctgcaatttta

SEQ ID NO: 6470146 - DNA, 20 bp, Homo sapiens
tctctgcaattttactgtga

SEQ ID NO: 6470147 - DNA, 23 bp, Homo sapiens
tctctgcaattttactgtgaaaa

SEQ ID NO: 6470148 - DNA, 19 bp, Homo sapiens
tctctgcacacaagaggct

SEQ ID NO: 6470149 - DNA, 22 bp, Homo sapiens
tctctgcacccagtgaacacat

SEQ ID NO: 6470150 - DNA, 14 bp, Homo sapiens
tctctgcagcccag

SEQ ID NO: 6470151 - DNA, 16 bp, Homo sapiens
tctctgcagcccagcc

SEQ ID NO: 6470152 - DNA, 14 bp, Homo sapiens
tctctgcagctgcc

SEQ ID NO: 6470153 - DNA, 20 bp, Homo sapiens
tctctgcaggcagcctgcct

SEQ ID NO: 6470154 - DNA, 16 bp, Homo sapiens
tctctgcaggtcccta

SEQ ID NO: 6470155 - DNA, 14 bp, Homo sapiens
tctctgcagtaaaa

SEQ ID NO: 6470156 - DNA, 20 bp, Homo sapiens
tctctgcagtaaaacacatt

SEQ ID NO: 6470157 - DNA, 18 bp, Homo sapiens
tctctgcagtatttataa

SEQ ID NO: 6470158 - DNA, 19 bp, Homo sapiens
tctctgcatctactcccaa

SEQ ID NO: 6470159 - DNA, 21 bp, Homo sapiens
tctctgcatctactcccaagt

SEQ ID NO: 6470160 - DNA, 13 bp, Homo sapiens
tctctgcatctga

SEQ ID NO: 6470161 - DNA, 15 bp, Homo sapiens
tctctgcatctgacc

SEQ ID NO: 6470162 - DNA, 16 bp, Homo sapiens
tctctgcatctgacca

SEQ ID NO: 6470163 - DNA, 15 bp, Homo sapiens
tctctgcatcttcag

SEQ ID NO: 6470164 - DNA, 20 bp, Homo sapiens
tctctgcatttaaaaaaatc

SEQ ID NO: 6470165 - DNA, 13 bp, Homo sapiens
tctctgccaccca

SEQ ID NO: 6470166 - DNA, 14 bp, Homo sapiens
tctctgccacccac

SEQ ID NO: 6470167 - DNA, 11 bp, Homo sapiens
tctctgccagc

SEQ ID NO: 6470168 - DNA, 16 bp, Homo sapiens
tctctgccatgtggca

SEQ ID NO: 6470169 - DNA, 21 bp, Homo sapiens
tctctgcccaagttgctctgt

SEQ ID NO: 6470170 - DNA, 14 bp, Homo sapiens
tctctgcccagccg

SEQ ID NO: 6470171 - DNA, 19 bp, Homo sapiens
tctctgcccagcttttcat

SEQ ID NO: 6470172 - DNA, 14 bp, Homo sapiens
tctctgccccaccc

SEQ ID NO: 6470173 - DNA, 23 bp, Homo sapiens
tctctgccccacccaagcccaaa

SEQ ID NO: 6470174 - DNA, 13 bp, Homo sapiens
tctctgccccagc

SEQ ID NO: 6470175 - DNA, 15 bp, Homo sapiens
tctctgccccagcct

SEQ ID NO: 6470176 - DNA, 16 bp, Homo sapiens
tctctgccccagcctg

SEQ ID NO: 6470177 - DNA, 17 bp, Homo sapiens
tctctgccccagcctgt

SEQ ID NO: 6470178 - DNA, 18 bp, Homo sapiens
tctctgccccagcctgtc

SEQ ID NO: 6470179 - DNA, 22 bp, Homo sapiens
tctctgccccttaaatcacaca

SEQ ID NO: 6470180 - DNA, 11 bp, Homo sapiens
tctctgcccta

SEQ ID NO: 6470181 - DNA, 11 bp, Homo sapiens
tctctgccctc

SEQ ID NO: 6470182 - DNA, 17 bp, Homo sapiens
tctctgccctccaagac

SEQ ID NO: 6470183 - DNA, 16 bp, Homo sapiens
tctctgccctcgggtg

SEQ ID NO: 6470184 - DNA, 16 bp, Homo sapiens
tctctgccctgccctg

SEQ ID NO: 6470185 - DNA, 19 bp, Homo sapiens
tctctgccctgccctggcc

SEQ ID NO: 6470186 - DNA, 12 bp, Homo sapiens
tctctgccctgt

SEQ ID NO: 6470187 - DNA, 14 bp, Homo sapiens
tctctgcctcacct

SEQ ID NO: 6470188 - DNA, 14 bp, Homo sapiens
tctctgcctccagg

SEQ ID NO: 6470189 - DNA, 21 bp, Homo sapiens
tctctgcctccctcaccctga

SEQ ID NO: 6470190 - DNA, 14 bp, Homo sapiens
tctctgcctcctcc

SEQ ID NO: 6470191 - DNA, 21 bp, Homo sapiens
tctctgcctctcccaggctgt

SEQ ID NO: 6470192 - DNA, 14 bp, Homo sapiens
tctctgcctctctt

SEQ ID NO: 6470193 - DNA, 11 bp, Homo sapiens
tctctgcctga

SEQ ID NO: 6470194 - DNA, 18 bp, Homo sapiens
tctctgcctgacaaggcc

SEQ ID NO: 6470195 - DNA, 20 bp, Homo sapiens
tctctgcctgacaaggccag

SEQ ID NO: 6470196 - DNA, 13 bp, Homo sapiens
tctctgcctgctg

SEQ ID NO: 6470197 - DNA, 14 bp, Homo sapiens
tctctgcctgctgg

SEQ ID NO: 6470198 - DNA, 13 bp, Homo sapiens
tctctgcctgctt

SEQ ID NO: 6470199 - DNA, 16 bp, Homo sapiens
tctctgcctgcttcct

SEQ ID NO: 6470200 - DNA, 18 bp, Homo sapiens
tctctgcctgcttcctgg

SEQ ID NO: 6470201 - DNA, 19 bp, Homo sapiens
tctctgcctggagcagggg

SEQ ID NO: 6470202 - DNA, 19 bp, Homo sapiens
tctctgcctgtgagccagt

SEQ ID NO: 6470203 - DNA, 12 bp, Homo sapiens
tctctgccttgc

SEQ ID NO: 6470204 - DNA, 16 bp, Homo sapiens
tctctgccttgccttt

SEQ ID NO: 6470205 - DNA, 17 bp, Homo sapiens
tctctgccttgccttta

SEQ ID NO: 6470206 - DNA, 16 bp, Homo sapiens
tctctgcctttactat

SEQ ID NO: 6470207 - DNA, 19 bp, Homo sapiens
tctctgcctttgacattta

SEQ ID NO: 6470208 - DNA, 21 bp, Homo sapiens
tctctgcctttgacatttaat

SEQ ID NO: 6470209 - DNA, 16 bp, Homo sapiens
tctctgctagatttct

SEQ ID NO: 6470210 - DNA, 11 bp, Homo sapiens
tctctgctcca

SEQ ID NO: 6470211 - DNA, 14 bp, Homo sapiens
tctctgctccacca

SEQ ID NO: 6470212 - DNA, 17 bp, Homo sapiens
tctctgctccaccacat

SEQ ID NO: 6470213 - DNA, 18 bp, Homo sapiens
tctctgctccagagagag

SEQ ID NO: 6470214 - DNA, 14 bp, Homo sapiens
tctctgctccttca

SEQ ID NO: 6470215 - DNA, 16 bp, Homo sapiens
tctctgctctagccag

SEQ ID NO: 6470216 - DNA, 22 bp, Homo sapiens
tctctgctctgcgtgtcacctg

SEQ ID NO: 6470217 - DNA, 17 bp, Homo sapiens
tctctgctcttgcctgc

SEQ ID NO: 6470218 - DNA, 21 bp, Homo sapiens
tctctgctcttgtttcactcc

SEQ ID NO: 6470219 - DNA, 14 bp, Homo sapiens
tctctgctgaacat

SEQ ID NO: 6470220 - DNA, 16 bp, Homo sapiens
tctctgctgagcagcc

SEQ ID NO: 6470221 - DNA, 16 bp, Homo sapiens
tctctgctgagctggg

SEQ ID NO: 6470222 - DNA, 13 bp, Homo sapiens
tctctgctgcctc

SEQ ID NO: 6470223 - DNA, 14 bp, Homo sapiens
tctctgctgcctct

SEQ ID NO: 6470224 - DNA, 19 bp, Homo sapiens
tctctgctgcctctgtgga

SEQ ID NO: 6470225 - DNA, 14 bp, Homo sapiens
tctctgctgcttct

SEQ ID NO: 6470226 - DNA, 23 bp, Homo sapiens
tctctgctggcaggattcttccc

SEQ ID NO: 6470227 - DNA, 17 bp, Homo sapiens
tctctgctggggaaggg

SEQ ID NO: 6470228 - DNA, 23 bp, Homo sapiens
tctctgctgggtttccacacagc

SEQ ID NO: 6470229 - DNA, 18 bp, Homo sapiens
tctctgcttacccttcac

SEQ ID NO: 6470230 - DNA, 13 bp, Homo sapiens
tctctgcttaccg

SEQ ID NO: 6470231 - DNA, 22 bp, Homo sapiens
tctctgcttactaatgtgcccc

SEQ ID NO: 6470232 - DNA, 13 bp, Homo sapiens
tctctgcttccag

SEQ ID NO: 6470233 - DNA, 18 bp, Homo sapiens
tctctgcttgagtcaggt

SEQ ID NO: 6470234 - DNA, 22 bp, Homo sapiens
tgccatgctgggccactgggga

SEQ ID NO: 6470235 - DNA, 23 bp, Homo sapiens
tgccatgctgggccactggggac

SEQ ID NO: 6470236 - DNA, 18 bp, Homo sapiens
tgccatggaactgtttcc

SEQ ID NO: 6470237 - DNA, 21 bp, Homo sapiens
tgccatggaattccctcctga

SEQ ID NO: 6470238 - DNA, 14 bp, Homo sapiens
tgccatggatctga

SEQ ID NO: 6470239 - DNA, 24 bp, Homo sapiens
tgccatggatctgatctgtaccat

SEQ ID NO: 6470240 - DNA, 13 bp, Homo sapiens
tgccatggatgat

SEQ ID NO: 6470241 - DNA, 21 bp, Homo sapiens
tgccatggatgattcttttcc

SEQ ID NO: 6470242 - DNA, 14 bp, Homo sapiens
tgccatggcaatgg

SEQ ID NO: 6470243 - DNA, 19 bp, Homo sapiens
tgccatggcaatggcatgc

SEQ ID NO: 6470244 - DNA, 18 bp, Homo sapiens
tgccatggccccccactc

SEQ ID NO: 6470245 - DNA, 13 bp, Homo sapiens
tgccatggcctgt

SEQ ID NO: 6470246 - DNA, 16 bp, Homo sapiens
tgccatggcctgtgct

SEQ ID NO: 6470247 - DNA, 17 bp, Homo sapiens
tgccatggcctgtgctg

SEQ ID NO: 6470248 - DNA, 20 bp, Homo sapiens
tgccatggctggggggtctc

SEQ ID NO: 6470249 - DNA, 22 bp, Homo sapiens
tgccatggctggggggtctcag

SEQ ID NO: 6470250 - DNA, 13 bp, Homo sapiens
tgccatgggccag

SEQ ID NO: 6470251 - DNA, 16 bp, Homo sapiens
tgccatgggccagcct

SEQ ID NO: 6470252 - DNA, 23 bp, Homo sapiens
tgccatgggcttcactgtataaa

SEQ ID NO: 6470253 - DNA, 20 bp, Homo sapiens
tgccatggtgttggaggggc

SEQ ID NO: 6470254 - DNA, 22 bp, Homo sapiens
tgccatggtgttggaggggcag

SEQ ID NO: 6470255 - DNA, 20 bp, Homo sapiens
tgccatgtaaatccccactg

SEQ ID NO: 6470256 - DNA, 20 bp, Homo sapiens
tgccatgtaaggttgtgcag

SEQ ID NO: 6470257 - DNA, 18 bp, Homo sapiens
tgccatgtacagtatgtt

SEQ ID NO: 6470258 - DNA, 12 bp, Homo sapiens
tgccatgtacct

SEQ ID NO: 6470259 - DNA, 19 bp, Homo sapiens
tgccatgtacctcccctgc

SEQ ID NO: 6470260 - DNA, 21 bp, Homo sapiens
tgccatgtacctcccctgcct

SEQ ID NO: 6470261 - DNA, 16 bp, Homo sapiens
tgccatgtagacccct

SEQ ID NO: 6470262 - DNA, 18 bp, Homo sapiens
tgccatgtaggctaagaa

SEQ ID NO: 6470263 - DNA, 17 bp, Homo sapiens
tgccatgtcaaacaaat

SEQ ID NO: 6470264 - DNA, 18 bp, Homo sapiens
tgccatgtcagcgctctg

SEQ ID NO: 6470265 - DNA, 20 bp, Homo sapiens
tgccatgtcagcgctctggt

SEQ ID NO: 6470266 - DNA, 13 bp, Homo sapiens
tgccatgtctgag

SEQ ID NO: 6470267 - DNA, 17 bp, Homo sapiens
tgccatgtctttactag

SEQ ID NO: 6470268 - DNA, 16 bp, Homo sapiens
tgccatgtgaagaggg

SEQ ID NO: 6470269 - DNA, 16 bp, Homo sapiens
tgccatgtgactctgg

SEQ ID NO: 6470270 - DNA, 19 bp, Homo sapiens
tgccatgtgactctggctt

SEQ ID NO: 6470271 - DNA, 21 bp, Homo sapiens
tgccatgtgactctggcttgg

SEQ ID NO: 6470272 - DNA, 14 bp, Homo sapiens
tgccatgtgccagg

SEQ ID NO: 6470273 - DNA, 14 bp, Homo sapiens
tgccatgtgctggg

SEQ ID NO: 6470274 - DNA, 17 bp, Homo sapiens
tgccatgtggagtggac

SEQ ID NO: 6470275 - DNA, 18 bp, Homo sapiens
tgccatgtggagtggaca

SEQ ID NO: 6470276 - DNA, 19 bp, Homo sapiens
tgccatgtgtgagtcactt

SEQ ID NO: 6470277 - DNA, 17 bp, Homo sapiens
tgccatgtgtgctgaac

SEQ ID NO: 6470278 - DNA, 15 bp, Homo sapiens
tgccatgttggccag

SEQ ID NO: 6470279 - DNA, 18 bp, Homo sapiens
tgccatgttggccaggct

SEQ ID NO: 6470280 - DNA, 23 bp, Homo sapiens
tgccatgtttagattccaggatc

SEQ ID NO: 6470281 - DNA, 19 bp, Homo sapiens
tgccatgtttttgccaaaa

SEQ ID NO: 6470282 - DNA, 14 bp, Homo sapiens
tgccattaaagaat

SEQ ID NO: 6470283 - DNA, 14 bp, Homo sapiens
tgccattaacaaat

SEQ ID NO: 6470284 - DNA, 21 bp, Homo sapiens
tgccattacactccagcctgg

SEQ ID NO: 6470285 - DNA, 22 bp, Homo sapiens
tgccattacagaggtattaaaa

SEQ ID NO: 6470286 - DNA, 15 bp, Homo sapiens
tgccattactactgt

SEQ ID NO: 6470287 - DNA, 18 bp, Homo sapiens
tgccattagactgaattt

SEQ ID NO: 6470288 - DNA, 18 bp, Homo sapiens
tgccattatagcgcctgt

SEQ ID NO: 6470289 - DNA, 22 bp, Homo sapiens
tgccattatagcgcctgtataa

SEQ ID NO: 6470290 - DNA, 17 bp, Homo sapiens
tgccattatatttgcat

SEQ ID NO: 6470291 - DNA, 22 bp, Homo sapiens
tgccattatatttgcattatgt

SEQ ID NO: 6470292 - DNA, 18 bp, Homo sapiens
tgccattattctatgtag

SEQ ID NO: 6470293 - DNA, 21 bp, Homo sapiens
tgccattattctatgtagtgg

SEQ ID NO: 6470294 - DNA, 14 bp, Homo sapiens
tgccattatttcta

SEQ ID NO: 6470295 - DNA, 15 bp, Homo sapiens
tgccattatttctac

SEQ ID NO: 6470296 - DNA, 13 bp, Homo sapiens
tgccattcatcct

SEQ ID NO: 6470297 - DNA, 14 bp, Homo sapiens
tgccattcatcctt

SEQ ID NO: 6470298 - DNA, 20 bp, Homo sapiens
tgccattccaaaatattatg

SEQ ID NO: 6470299 - DNA, 17 bp, Homo sapiens
tgccattccactccact

SEQ ID NO: 6470300 - DNA, 21 bp, Homo sapiens
tgccattccactccactcagg

SEQ ID NO: 6470301 - DNA, 18 bp, Homo sapiens
tgccattccctgcctggg

SEQ ID NO: 6470302 - DNA, 21 bp, Homo sapiens
tgccattctcttgcattgtga

SEQ ID NO: 6470303 - DNA, 22 bp, Homo sapiens
tgccattctcttgcattgtgac

SEQ ID NO: 6470304 - DNA, 13 bp, Homo sapiens
tgccattgcactc

SEQ ID NO: 6470305 - DNA, 18 bp, Homo sapiens
tgccattgcactccagcc

SEQ ID NO: 6470306 - DNA, 15 bp, Homo sapiens
tgccattgccaggag

SEQ ID NO: 6470307 - DNA, 18 bp, Homo sapiens
tgccattggaacctgtta

SEQ ID NO: 6470308 - DNA, 17 bp, Homo sapiens
tgccattgtactccagc

SEQ ID NO: 6470309 - DNA, 18 bp, Homo sapiens
tgccattgtatttcttca

SEQ ID NO: 6470310 - DNA, 21 bp, Homo sapiens
tgccattgtctttcctccctt

SEQ ID NO: 6470311 - DNA, 12 bp, Homo sapiens
tgccatttattt

SEQ ID NO: 6470312 - DNA, 16 bp, Homo sapiens
tgccatttctcacgcc

SEQ ID NO: 6470313 - DNA, 16 bp, Homo sapiens
tgccatttctcaggga

SEQ ID NO: 6470314 - DNA, 22 bp, Homo sapiens
tgccatttctgaactgttacaa

SEQ ID NO: 6470315 - DNA, 13 bp, Homo sapiens
tgccatttcttcc

SEQ ID NO: 6470316 - DNA, 16 bp, Homo sapiens
tgccatttcttcccaa

SEQ ID NO: 6470317 - DNA, 18 bp, Homo sapiens
tgccatttcttctctctg

SEQ ID NO: 6470318 - DNA, 20 bp, Homo sapiens
tgccatttcttctctctgtt

SEQ ID NO: 6470319 - DNA, 23 bp, Homo sapiens
tgccatttcttctctctgttccc

SEQ ID NO: 6470320 - DNA, 20 bp, Homo sapiens
tgccatttgatacccctggg

SEQ ID NO: 6470321 - DNA, 21 bp, Homo sapiens
tgccatttgcaccctccgcct

SEQ ID NO: 6470322 - DNA, 12 bp, Homo sapiens
tgccatttgctg

SEQ ID NO: 6470323 - DNA, 18 bp, Homo sapiens
tgccattttctgtaaaga

SEQ ID NO: 6470324 - DNA, 21 bp, Homo sapiens
tgccattttgggttaggagaa

SEQ ID NO: 6470325 - DNA, 16 bp, Homo sapiens
tgccattttgtctggc

SEQ ID NO: 6470326 - DNA, 18 bp, Homo sapiens
tgccattttgtctggctg

SEQ ID NO: 6470327 - DNA, 20 bp, Homo sapiens
tgccattttgtctggctgtg

SEQ ID NO: 6470328 - DNA, 22 bp, Homo sapiens
tgccattttgtctggctgtggc

SEQ ID NO: 6470329 - DNA, 17 bp, Homo sapiens
tgccattttttgtctgt

SEQ ID NO: 6470330 - DNA, 19 bp, Homo sapiens
tgcccaaaaatatggttga

SEQ ID NO: 6470331 - DNA, 21 bp, Homo sapiens
tgcccaaaagaggtgtcatgc

SEQ ID NO: 6470332 - DNA, 13 bp, Homo sapiens
tgcccaaaatgtg

SEQ ID NO: 6470333 - DNA, 16 bp, Homo sapiens
tgcccaaaatgtgaag

SEQ ID NO: 6470334 - DNA, 20 bp, Homo sapiens
tgcccaaacagctgtattta

SEQ ID NO: 6470335 - DNA, 13 bp, Homo sapiens
tgcccaaaccctt

SEQ ID NO: 6470336 - DNA, 18 bp, Homo sapiens
tgcccaaacccttaactg

SEQ ID NO: 6470337 - DNA, 22 bp, Homo sapiens
tgcccaaacccttaactgacat

SEQ ID NO: 6470338 - DNA, 14 bp, Homo sapiens
tgcccaaactcccc

SEQ ID NO: 6470339 - DNA, 16 bp, Homo sapiens
tgcccaaactcccctt

SEQ ID NO: 6470340 - DNA, 22 bp, Homo sapiens
tgcccaaagtggggagggacaa

SEQ ID NO: 6470341 - DNA, 15 bp, Homo sapiens
tgcccaaatcccctc

SEQ ID NO: 6470342 - DNA, 15 bp, Homo sapiens
tgcccaacaccagcc

SEQ ID NO: 6470343 - DNA, 17 bp, Homo sapiens
tgcccaacaccagcccc

SEQ ID NO: 6470344 - DNA, 19 bp, Homo sapiens
tgcccaacaccagcccctg

SEQ ID NO: 6470345 - DNA, 21 bp, Homo sapiens
tgcccaacaccagcccctgcc

SEQ ID NO: 6470346 - DNA, 21 bp, Homo sapiens
tgcccaacagggcaaccaata

SEQ ID NO: 6470347 - DNA, 19 bp, Homo sapiens
tgcccaacccttccctcac

SEQ ID NO: 6470348 - DNA, 23 bp, Homo sapiens
tgcccaacctctgtggtcaccca

SEQ ID NO: 6470349 - DNA, 18 bp, Homo sapiens
tgcccaacctgctctcct

SEQ ID NO: 6470350 - DNA, 23 bp, Homo sapiens
tgcccaacctgctctcctcttgc

SEQ ID NO: 6470351 - DNA, 20 bp, Homo sapiens
tgcccaactcccagccacca

SEQ ID NO: 6470352 - DNA, 22 bp, Homo sapiens
tgcccaagaatagatgctgact

SEQ ID NO: 6470353 - DNA, 14 bp, Homo sapiens
tgcccaagccagag

SEQ ID NO: 6470354 - DNA, 18 bp, Homo sapiens
tgcccaagccagaggctg

SEQ ID NO: 6470355 - DNA, 23 bp, Homo sapiens
tgcccaagccagaggctgggttc

SEQ ID NO: 6470356 - DNA, 21 bp, Homo sapiens
tgcccaagcccaggccaccct

SEQ ID NO: 6470357 - DNA, 16 bp, Homo sapiens
tgcccaagccctgaga

SEQ ID NO: 6470358 - DNA, 17 bp, Homo sapiens
tgcccaagctggtctta

SEQ ID NO: 6470359 - DNA, 11 bp, Homo sapiens
tgcccaaggat

SEQ ID NO: 6470360 - DNA, 19 bp, Homo sapiens
tgcccaaggcctaccccag

SEQ ID NO: 6470361 - DNA, 22 bp, Homo sapiens
tgcccaaggcctaccccagttc

SEQ ID NO: 6470362 - DNA, 20 bp, Homo sapiens
tgcccaaggttgcacagcaa

SEQ ID NO: 6470363 - DNA, 9 bp, Homo sapiens
tgcccaagt

SEQ ID NO: 6470364 - DNA, 16 bp, Homo sapiens
tgcccaagtgaccagg

SEQ ID NO: 6470365 - DNA, 17 bp, Homo sapiens
tgcccaagtgaccaggg

SEQ ID NO: 6470366 - DNA, 18 bp, Homo sapiens
tgcccaagtgaccaggga

SEQ ID NO: 6470367 - DNA, 17 bp, Homo sapiens
tgcccaagtggctcttg

SEQ ID NO: 6470368 - DNA, 17 bp, Homo sapiens
tgcccaagtgggcagtc

SEQ ID NO: 6470369 - DNA, 17 bp, Homo sapiens
tgcccaagttgctctgt

SEQ ID NO: 6470370 - DNA, 22 bp, Homo sapiens
tgcccaatatgcagttctgcag

SEQ ID NO: 6470371 - DNA, 14 bp, Homo sapiens
tgcccaatccatta

SEQ ID NO: 6470372 - DNA, 14 bp, Homo sapiens
tgcccaatcctccc

SEQ ID NO: 6470373 - DNA, 16 bp, Homo sapiens
tgcccaattggaggaa

SEQ ID NO: 6470374 - DNA, 18 bp, Homo sapiens
tgcccacacacactcctt

SEQ ID NO: 6470375 - DNA, 20 bp, Homo sapiens
tgcccacacacactccttcc

SEQ ID NO: 6470376 - DNA, 21 bp, Homo sapiens
tgcccacacacactccttccc

SEQ ID NO: 6470377 - DNA, 23 bp, Homo sapiens
tgcccacacacactccttcccct

SEQ ID NO: 6470378 - DNA, 12 bp, Homo sapiens
tgcccacacact

SEQ ID NO: 6470379 - DNA, 22 bp, Homo sapiens
tgcccacacactttccatctct

SEQ ID NO: 6470380 - DNA, 22 bp, Homo sapiens
tgcccacagaaagccaggagca

SEQ ID NO: 6470381 - DNA, 11 bp, Homo sapiens
tgcccacagcc

SEQ ID NO: 6470382 - DNA, 12 bp, Homo sapiens
tgcccacaggcc

SEQ ID NO: 6470383 - DNA, 14 bp, Homo sapiens
tgcccacaggtgcg

SEQ ID NO: 6470384 - DNA, 20 bp, Homo sapiens
tgcccacagtgtcaggcact

SEQ ID NO: 6470385 - DNA, 21 bp, Homo sapiens
tgcccacagtgtcaggcactg

SEQ ID NO: 6470386 - DNA, 19 bp, Homo sapiens
tgcccacatgtgtccatcc

SEQ ID NO: 6470387 - DNA, 16 bp, Homo sapiens
tgcccacatttagtct

SEQ ID NO: 6470388 - DNA, 23 bp, Homo sapiens
tgcccaccaacatcccattgccc

SEQ ID NO: 6470389 - DNA, 18 bp, Homo sapiens
tgcccaccagctggctct

SEQ ID NO: 6470390 - DNA, 20 bp, Homo sapiens
tgcccaccagctggctctgc

SEQ ID NO: 6470391 - DNA, 22 bp, Homo sapiens
tgcccaccagctggctctgcag

SEQ ID NO: 6470392 - DNA, 14 bp, Homo sapiens
tgcccaccatcggg

SEQ ID NO: 6470393 - DNA, 12 bp, Homo sapiens
tgcccaccccac

SEQ ID NO: 6470394 - DNA, 16 bp, Homo sapiens
tgcccaccccatccct

SEQ ID NO: 6470395 - DNA, 23 bp, Homo sapiens
tgcccacccccaccatgcagccc

SEQ ID NO: 6470396 - DNA, 23 bp, Homo sapiens
tgcccacccccgggatcctgccc

SEQ ID NO: 6470397 - DNA, 13 bp, Homo sapiens
tgcccaccccctg

SEQ ID NO: 6470398 - DNA, 14 bp, Homo sapiens
tgcccaccccctgc

SEQ ID NO: 6470399 - DNA, 19 bp, Homo sapiens
tgcccaccccctgccctgc

SEQ ID NO: 6470400 - DNA, 20 bp, Homo sapiens
tgcccaccccctgccctgca

SEQ ID NO: 6470401 - DNA, 15 bp, Homo sapiens
tgcccaccccctgct

SEQ ID NO: 6470402 - DNA, 23 bp, Homo sapiens
tgcccaccccgcctctgggctca

SEQ ID NO: 6470403 - DNA, 12 bp, Homo sapiens
tgcccacccctc

SEQ ID NO: 6470404 - DNA, 18 bp, Homo sapiens
tgcccacccctcactccc

SEQ ID NO: 6470405 - DNA, 21 bp, Homo sapiens
tgcccacccctcactccccag

SEQ ID NO: 6470406 - DNA, 16 bp, Homo sapiens
tgcccacccctgctgc

SEQ ID NO: 6470407 - DNA, 21 bp, Homo sapiens
tgcccacccgtggagatggga

SEQ ID NO: 6470408 - DNA, 21 bp, Homo sapiens
tgcccacccgtgttctcctcc

SEQ ID NO: 6470409 - DNA, 18 bp, Homo sapiens
tgcccaccctaccagctc

SEQ ID NO: 6470410 - DNA, 13 bp, Homo sapiens
tctctgcttgcct

SEQ ID NO: 6470411 - DNA, 15 bp, Homo sapiens
tctctgcttgcctag

SEQ ID NO: 6470412 - DNA, 14 bp, Homo sapiens
tctctgcttggctt

SEQ ID NO: 6470413 - DNA, 14 bp, Homo sapiens
tctctgctttaaag

SEQ ID NO: 6470414 - DNA, 14 bp, Homo sapiens
tctctggaaagagg

SEQ ID NO: 6470415 - DNA, 23 bp, Homo sapiens
tctctggaaatttagagttctag

SEQ ID NO: 6470416 - DNA, 13 bp, Homo sapiens
tctctggaacctg

SEQ ID NO: 6470417 - DNA, 23 bp, Homo sapiens
tctctggaagaggaaccaggaga

SEQ ID NO: 6470418 - DNA, 16 bp, Homo sapiens
tctctggaaggcccct

SEQ ID NO: 6470419 - DNA, 11 bp, Homo sapiens
tctctggagcc

SEQ ID NO: 6470420 - DNA, 20 bp, Homo sapiens
tctctggagccaagtccaga

SEQ ID NO: 6470421 - DNA, 18 bp, Homo sapiens
tctctggagccagagaga

SEQ ID NO: 6470422 - DNA, 12 bp, Homo sapiens
tctctggagccc

SEQ ID NO: 6470423 - DNA, 21 bp, Homo sapiens
tctctggaggtactgagacag

SEQ ID NO: 6470424 - DNA, 22 bp, Homo sapiens
tctctggaggtactgagacagg

SEQ ID NO: 6470425 - DNA, 22 bp, Homo sapiens
tctctggagtgagctctgtttc

SEQ ID NO: 6470426 - DNA, 18 bp, Homo sapiens
tctctggcaaacttttct

SEQ ID NO: 6470427 - DNA, 15 bp, Homo sapiens
tctctggcaccacac

SEQ ID NO: 6470428 - DNA, 17 bp, Homo sapiens
tctctggcaccacacta

SEQ ID NO: 6470429 - DNA, 17 bp, Homo sapiens
tctctggcagagaagga

SEQ ID NO: 6470430 - DNA, 16 bp, Homo sapiens
tctctggccactctgc

SEQ ID NO: 6470431 - DNA, 23 bp, Homo sapiens
tctctggccactctgctctgcac

SEQ ID NO: 6470432 - DNA, 17 bp, Homo sapiens
tctctggcccagaaagc

SEQ ID NO: 6470433 - DNA, 18 bp, Homo sapiens
tctctggcctcccacccg

SEQ ID NO: 6470434 - DNA, 22 bp, Homo sapiens
tctctggccttcggcctccatc

SEQ ID NO: 6470435 - DNA, 23 bp, Homo sapiens
tctctggccttcggcctccatcc

SEQ ID NO: 6470436 - DNA, 17 bp, Homo sapiens
tctctggcgacagtttt

SEQ ID NO: 6470437 - DNA, 22 bp, Homo sapiens
tctctggcgacagttttccttc

SEQ ID NO: 6470438 - DNA, 22 bp, Homo sapiens
tctctggctctaggacccccag

SEQ ID NO: 6470439 - DNA, 12 bp, Homo sapiens
tctctggctggg

SEQ ID NO: 6470440 - DNA, 13 bp, Homo sapiens
tctctggctgggg

SEQ ID NO: 6470441 - DNA, 19 bp, Homo sapiens
tctctggctgtaaggctct

SEQ ID NO: 6470442 - DNA, 15 bp, Homo sapiens
tctctggcttccatg

SEQ ID NO: 6470443 - DNA, 13 bp, Homo sapiens
tctctggcttctg

SEQ ID NO: 6470444 - DNA, 21 bp, Homo sapiens
tctctggcttctgaagagcct

SEQ ID NO: 6470445 - DNA, 23 bp, Homo sapiens
tctctgggactctcctcctcccc

SEQ ID NO: 6470446 - DNA, 17 bp, Homo sapiens
tctctgggagaaaatca

SEQ ID NO: 6470447 - DNA, 19 bp, Homo sapiens
tctctgggagaaaatcatc

SEQ ID NO: 6470448 - DNA, 16 bp, Homo sapiens
tctctgggagcccaga

SEQ ID NO: 6470449 - DNA, 15 bp, Homo sapiens
tctctgggcctcaga

SEQ ID NO: 6470450 - DNA, 12 bp, Homo sapiens
tctctgggcctg

SEQ ID NO: 6470451 - DNA, 15 bp, Homo sapiens
tctctgggcctgtgt

SEQ ID NO: 6470452 - DNA, 21 bp, Homo sapiens
tctctgggctgagcctactgt

SEQ ID NO: 6470453 - DNA, 15 bp, Homo sapiens
tctctgggctgagga

SEQ ID NO: 6470454 - DNA, 13 bp, Homo sapiens
tctctgggctgga

SEQ ID NO: 6470455 - DNA, 20 bp, Homo sapiens
tctctgggctggatgagctc

SEQ ID NO: 6470456 - DNA, 10 bp, Homo sapiens
tctctgggga

SEQ ID NO: 6470457 - DNA, 16 bp, Homo sapiens
tctctggggcagatcc

SEQ ID NO: 6470458 - DNA, 17 bp, Homo sapiens
tctctggggcagatccc

SEQ ID NO: 6470459 - DNA, 20 bp, Homo sapiens
tctctggggcaggctgcttc

SEQ ID NO: 6470460 - DNA, 14 bp, Homo sapiens
tctctggggccctg

SEQ ID NO: 6470461 - DNA, 13 bp, Homo sapiens
tctctgggggagg

SEQ ID NO: 6470462 - DNA, 16 bp, Homo sapiens
tctctgggggctgagg

SEQ ID NO: 6470463 - DNA, 17 bp, Homo sapiens
tctctggggtctgtgat

SEQ ID NO: 6470464 - DNA, 18 bp, Homo sapiens
tctctgggtcagaaccag

SEQ ID NO: 6470465 - DNA, 22 bp, Homo sapiens
tctctggtggctgggctgctcc

SEQ ID NO: 6470466 - DNA, 15 bp, Homo sapiens
tctctggttcttgaa

SEQ ID NO: 6470467 - DNA, 22 bp, Homo sapiens
tctctggtttcaccagcgttgg

SEQ ID NO: 6470468 - DNA, 19 bp, Homo sapiens
tctctgtaaaatttataca

SEQ ID NO: 6470469 - DNA, 22 bp, Homo sapiens
tctctgtaaccgcttctggggc

SEQ ID NO: 6470470 - DNA, 14 bp, Homo sapiens
tctctgtacatatt

SEQ ID NO: 6470471 - DNA, 21 bp, Homo sapiens
tctctgtacgggccagtttct

SEQ ID NO: 6470472 - DNA, 16 bp, Homo sapiens
tctctgtacttttcat

SEQ ID NO: 6470473 - DNA, 19 bp, Homo sapiens
tctctgtagtggccccctc

SEQ ID NO: 6470474 - DNA, 22 bp, Homo sapiens
tctctgtcagtgtgaaaattca

SEQ ID NO: 6470475 - DNA, 16 bp, Homo sapiens
tctctgtccagggctt

SEQ ID NO: 6470476 - DNA, 15 bp, Homo sapiens
tctctgtcccattcc

SEQ ID NO: 6470477 - DNA, 14 bp, Homo sapiens
tctctgtcccttgc

SEQ ID NO: 6470478 - DNA, 15 bp, Homo sapiens
tctctgtcccttgct

SEQ ID NO: 6470479 - DNA, 17 bp, Homo sapiens
tctctgtcccttgctgt

SEQ ID NO: 6470480 - DNA, 18 bp, Homo sapiens
tctctgtcccttgctgta

SEQ ID NO: 6470481 - DNA, 16 bp, Homo sapiens
tctctgtcctacttct

SEQ ID NO: 6470482 - DNA, 15 bp, Homo sapiens
tctctgtctaccatc

SEQ ID NO: 6470483 - DNA, 21 bp, Homo sapiens
tctctgtctcatccatcatca

SEQ ID NO: 6470484 - DNA, 15 bp, Homo sapiens
tctctgtctctgtgg

SEQ ID NO: 6470485 - DNA, 19 bp, Homo sapiens
tctctgtctttttccttcc

SEQ ID NO: 6470486 - DNA, 22 bp, Homo sapiens
tctctgtgaacgatttagaaag

SEQ ID NO: 6470487 - DNA, 21 bp, Homo sapiens
tctctgtgaagcctctctcct

SEQ ID NO: 6470488 - DNA, 14 bp, Homo sapiens
tctctgtgaataca

SEQ ID NO: 6470489 - DNA, 19 bp, Homo sapiens
tctctgtgaatccatgggt

SEQ ID NO: 6470490 - DNA, 20 bp, Homo sapiens
tctctgtgactcgcttagct

SEQ ID NO: 6470491 - DNA, 15 bp, Homo sapiens
tctctgtgagaaggt

SEQ ID NO: 6470492 - DNA, 19 bp, Homo sapiens
tctctgtgagaaggtttat

SEQ ID NO: 6470493 - DNA, 14 bp, Homo sapiens
tctctgtgagactc

SEQ ID NO: 6470494 - DNA, 13 bp, Homo sapiens
tctctgtgctctg

SEQ ID NO: 6470495 - DNA, 15 bp, Homo sapiens
tctctgtgctgtgga

SEQ ID NO: 6470496 - DNA, 20 bp, Homo sapiens
tctctgtggaagcaaggctg

SEQ ID NO: 6470497 - DNA, 14 bp, Homo sapiens
tctctgtggcctcc

SEQ ID NO: 6470498 - DNA, 19 bp, Homo sapiens
tctctgtggcctccatgcc

SEQ ID NO: 6470499 - DNA, 23 bp, Homo sapiens
tctctgtggtggttcattccaca

SEQ ID NO: 6470500 - DNA, 20 bp, Homo sapiens
tctctgtggttttttttgaa

SEQ ID NO: 6470501 - DNA, 19 bp, Homo sapiens
tctctgtgtatttatataa

SEQ ID NO: 6470502 - DNA, 22 bp, Homo sapiens
tctctgtgtctaagattctaga

SEQ ID NO: 6470503 - DNA, 17 bp, Homo sapiens
tctctgtgtctttctct

SEQ ID NO: 6470504 - DNA, 15 bp, Homo sapiens
tctctgtgtggcaaa

SEQ ID NO: 6470505 - DNA, 18 bp, Homo sapiens
tctctgtgtggcaaacat

SEQ ID NO: 6470506 - DNA, 15 bp, Homo sapiens
tctctgttaaagatc

SEQ ID NO: 6470507 - DNA, 12 bp, Homo sapiens
tctctgttaaca

SEQ ID NO: 6470508 - DNA, 18 bp, Homo sapiens
tctctgttaacatctagc

SEQ ID NO: 6470509 - DNA, 20 bp, Homo sapiens
tctctgttacacactaacat

SEQ ID NO: 6470510 - DNA, 16 bp, Homo sapiens
tctctgttccaagtgt

SEQ ID NO: 6470511 - DNA, 23 bp, Homo sapiens
tctctgttccaagtgtgtgtgca

SEQ ID NO: 6470512 - DNA, 14 bp, Homo sapiens
tctctgttcccttc

SEQ ID NO: 6470513 - DNA, 19 bp, Homo sapiens
tctctgttcccttcctcac

SEQ ID NO: 6470514 - DNA, 16 bp, Homo sapiens
tctctgttctcttgct

SEQ ID NO: 6470515 - DNA, 18 bp, Homo sapiens
tctctgttctcttgcttt

SEQ ID NO: 6470516 - DNA, 20 bp, Homo sapiens
tctctgttctgtttggcact

SEQ ID NO: 6470517 - DNA, 13 bp, Homo sapiens
tctctgttcttca

SEQ ID NO: 6470518 - DNA, 20 bp, Homo sapiens
tctctgttggtccactgtgt

SEQ ID NO: 6470519 - DNA, 23 bp, Homo sapiens
tctctgttggtctgccttctgct

SEQ ID NO: 6470520 - DNA, 14 bp, Homo sapiens
tctctgttgtaaat

SEQ ID NO: 6470521 - DNA, 17 bp, Homo sapiens
tctctgttgtaaataac

SEQ ID NO: 6470522 - DNA, 13 bp, Homo sapiens
tctctgttgtcgt

SEQ ID NO: 6470523 - DNA, 14 bp, Homo sapiens
tctctgtttcctga

SEQ ID NO: 6470524 - DNA, 14 bp, Homo sapiens
tctcttaaactctc

SEQ ID NO: 6470525 - DNA, 22 bp, Homo sapiens
tctcttaaatctcttaaactct

SEQ ID NO: 6470526 - DNA, 22 bp, Homo sapiens
tctcttaaatgcaagtgcctag

SEQ ID NO: 6470527 - DNA, 13 bp, Homo sapiens
tctcttaaatttt

SEQ ID NO: 6470528 - DNA, 22 bp, Homo sapiens
tctcttaagacagcatgtgtta

SEQ ID NO: 6470529 - DNA, 15 bp, Homo sapiens
tctcttaagtggtct

SEQ ID NO: 6470530 - DNA, 17 bp, Homo sapiens
tctcttaatattgagaa

SEQ ID NO: 6470531 - DNA, 17 bp, Homo sapiens
tctcttaatcactactg

SEQ ID NO: 6470532 - DNA, 19 bp, Homo sapiens
tctcttaatcactactgta

SEQ ID NO: 6470533 - DNA, 14 bp, Homo sapiens
tctcttacatctcc

SEQ ID NO: 6470534 - DNA, 19 bp, Homo sapiens
tctcttacgctctctgtct

SEQ ID NO: 6470535 - DNA, 15 bp, Homo sapiens
tctcttactgcaaat

SEQ ID NO: 6470536 - DNA, 16 bp, Homo sapiens
tctcttagaaaaggtg

SEQ ID NO: 6470537 - DNA, 13 bp, Homo sapiens
tctcttagaagcc

SEQ ID NO: 6470538 - DNA, 15 bp, Homo sapiens
tctcttagaagccat

SEQ ID NO: 6470539 - DNA, 19 bp, Homo sapiens
tctcttagagattttcatt

SEQ ID NO: 6470540 - DNA, 20 bp, Homo sapiens
tctcttagagattttcattt

SEQ ID NO: 6470541 - DNA, 18 bp, Homo sapiens
tctcttatcctctctctc

SEQ ID NO: 6470542 - DNA, 12 bp, Homo sapiens
tctcttatcttt

SEQ ID NO: 6470543 - DNA, 14 bp, Homo sapiens
tctcttatgcatta

SEQ ID NO: 6470544 - DNA, 20 bp, Homo sapiens
tctcttatggatgtccccag

SEQ ID NO: 6470545 - DNA, 16 bp, Homo sapiens
tctcttattgcctcac

SEQ ID NO: 6470546 - DNA, 14 bp, Homo sapiens
tctcttcaataaac

SEQ ID NO: 6470547 - DNA, 14 bp, Homo sapiens
tctcttcaatctct

SEQ ID NO: 6470548 - DNA, 17 bp, Homo sapiens
tctcttcaatgaaaaaa

SEQ ID NO: 6470549 - DNA, 17 bp, Homo sapiens
tctcttcactaccctga

SEQ ID NO: 6470550 - DNA, 21 bp, Homo sapiens
tctcttcactaccctgattct

SEQ ID NO: 6470551 - DNA, 22 bp, Homo sapiens
tctcttcagactctcagcccag

SEQ ID NO: 6470552 - DNA, 14 bp, Homo sapiens
tctcttcaggttct

SEQ ID NO: 6470553 - DNA, 13 bp, Homo sapiens
tctcttcagtgtg

SEQ ID NO: 6470554 - DNA, 15 bp, Homo sapiens
tctcttcagtgtgtt

SEQ ID NO: 6470555 - DNA, 19 bp, Homo sapiens
tctcttcatgcgcagtccc

SEQ ID NO: 6470556 - DNA, 19 bp, Homo sapiens
tctcttcatgcttgacata

SEQ ID NO: 6470557 - DNA, 18 bp, Homo sapiens
tctcttcatgtctattcc

SEQ ID NO: 6470558 - DNA, 19 bp, Homo sapiens
tctcttcattattctctgc

SEQ ID NO: 6470559 - DNA, 15 bp, Homo sapiens
tctcttcattcccac

SEQ ID NO: 6470560 - DNA, 9 bp, Homo sapiens
tctcttcca

SEQ ID NO: 6470561 - DNA, 23 bp, Homo sapiens
tctcttccaaccatttatcttga

SEQ ID NO: 6470562 - DNA, 14 bp, Homo sapiens
tctcttccacagtg

SEQ ID NO: 6470563 - DNA, 17 bp, Homo sapiens
tctcttccacttggtct

SEQ ID NO: 6470564 - DNA, 22 bp, Homo sapiens
tctcttccagaagatgccctcc

SEQ ID NO: 6470565 - DNA, 14 bp, Homo sapiens
tctcttccagccca

SEQ ID NO: 6470566 - DNA, 16 bp, Homo sapiens
tctcttccagcccaga

SEQ ID NO: 6470567 - DNA, 22 bp, Homo sapiens
tctcttccagctgcttcaggga

SEQ ID NO: 6470568 - DNA, 20 bp, Homo sapiens
tctcttccataattcagatt

SEQ ID NO: 6470569 - DNA, 21 bp, Homo sapiens
tctcttccatatgacctcatg

SEQ ID NO: 6470570 - DNA, 20 bp, Homo sapiens
tctcttcccacctgtcaacc

SEQ ID NO: 6470571 - DNA, 15 bp, Homo sapiens
tctcttcccaggcct

SEQ ID NO: 6470572 - DNA, 13 bp, Homo sapiens
tctcttccccaga

SEQ ID NO: 6470573 - DNA, 17 bp, Homo sapiens
tctcttcccctctcaga

SEQ ID NO: 6470574 - DNA, 18 bp, Homo sapiens
tctcttccccttccctta

SEQ ID NO: 6470575 - DNA, 12 bp, Homo sapiens
tctcttccctat

SEQ ID NO: 6470576 - DNA, 18 bp, Homo sapiens
tctcttccctccttccct

SEQ ID NO: 6470577 - DNA, 17 bp, Homo sapiens
tctcttccctgcgcctg

SEQ ID NO: 6470578 - DNA, 13 bp, Homo sapiens
tctcttcccttcc

SEQ ID NO: 6470579 - DNA, 20 bp, Homo sapiens
tctcttcccttcccagacca

SEQ ID NO: 6470580 - DNA, 16 bp, Homo sapiens
tctcttcctatcccat

SEQ ID NO: 6470581 - DNA, 20 bp, Homo sapiens
tctcttcctatcccatccca

SEQ ID NO: 6470582 - DNA, 21 bp, Homo sapiens
tctcttcctgcagtgttttgc

SEQ ID NO: 6470583 - DNA, 18 bp, Homo sapiens
tctcttcctgcccctctt

SEQ ID NO: 6470584 - DNA, 16 bp, Homo sapiens
tctcttcctgcctccc

SEQ ID NO: 6470585 - DNA, 12 bp, Homo sapiens
tctcttcctgta

SEQ ID NO: 6470586 - DNA, 14 bp, Homo sapiens
tctcttccttacag

SEQ ID NO: 6470587 - DNA, 18 bp, Homo sapiens
tctcttccttacaggtgt

SEQ ID NO: 6470588 - DNA, 13 bp, Homo sapiens
tctcttcctttcc

SEQ ID NO: 6470589 - DNA, 17 bp, Homo sapiens
tctcttcggcagggagg

SEQ ID NO: 6470590 - DNA, 16 bp, Homo sapiens
tgcccaccctgggcct

SEQ ID NO: 6470591 - DNA, 19 bp, Homo sapiens
tgcccaccctgggcctccc

SEQ ID NO: 6470592 - DNA, 20 bp, Homo sapiens
tgcccaccctgggcctcccg

SEQ ID NO: 6470593 - DNA, 15 bp, Homo sapiens
tgcccacccttcgca

SEQ ID NO: 6470594 - DNA, 22 bp, Homo sapiens
tgcccaccgaccccctttctaa

SEQ ID NO: 6470595 - DNA, 17 bp, Homo sapiens
tgcccaccgcccctgga

SEQ ID NO: 6470596 - DNA, 14 bp, Homo sapiens
tgcccaccgccctc

SEQ ID NO: 6470597 - DNA, 15 bp, Homo sapiens
tgcccaccgccctcc

SEQ ID NO: 6470598 - DNA, 17 bp, Homo sapiens
tgcccaccgccctcctc

SEQ ID NO: 6470599 - DNA, 20 bp, Homo sapiens
tgcccaccgccctcctccac

SEQ ID NO: 6470600 - DNA, 11 bp, Homo sapiens
tgcccacctct

SEQ ID NO: 6470601 - DNA, 17 bp, Homo sapiens
tgcccacctctccctgc

SEQ ID NO: 6470602 - DNA, 14 bp, Homo sapiens
tgcccacctctctt

SEQ ID NO: 6470603 - DNA, 15 bp, Homo sapiens
tgcccacctcttctg

SEQ ID NO: 6470604 - DNA, 11 bp, Homo sapiens
tgcccacctgc

SEQ ID NO: 6470605 - DNA, 17 bp, Homo sapiens
tgcccacctgccaggct

SEQ ID NO: 6470606 - DNA, 19 bp, Homo sapiens
tgcccacctgccaggctgc

SEQ ID NO: 6470607 - DNA, 14 bp, Homo sapiens
tgcccacctgccca

SEQ ID NO: 6470608 - DNA, 17 bp, Homo sapiens
tgcccacctgcccatca

SEQ ID NO: 6470609 - DNA, 19 bp, Homo sapiens
tgcccacctgcccatcaca

SEQ ID NO: 6470610 - DNA, 13 bp, Homo sapiens
tgcccacctgcct

SEQ ID NO: 6470611 - DNA, 15 bp, Homo sapiens
tgcccacctgcctgg

SEQ ID NO: 6470612 - DNA, 16 bp, Homo sapiens
tgcccacctgcctggc

SEQ ID NO: 6470613 - DNA, 17 bp, Homo sapiens
tgcccacctgcctggcc

SEQ ID NO: 6470614 - DNA, 20 bp, Homo sapiens
tgcccacctgcctggccggc

SEQ ID NO: 6470615 - DNA, 13 bp, Homo sapiens
tgcccacctggcc

SEQ ID NO: 6470616 - DNA, 17 bp, Homo sapiens
tgcccacctggcctctg

SEQ ID NO: 6470617 - DNA, 20 bp, Homo sapiens
tgcccacctggcctctgcac

SEQ ID NO: 6470618 - DNA, 14 bp, Homo sapiens
tgcccacctggctg

SEQ ID NO: 6470619 - DNA, 13 bp, Homo sapiens
tgcccacctgggg

SEQ ID NO: 6470620 - DNA, 15 bp, Homo sapiens
tgcccacctggggtc

SEQ ID NO: 6470621 - DNA, 22 bp, Homo sapiens
tgcccacctggggtctctctcc

SEQ ID NO: 6470622 - DNA, 23 bp, Homo sapiens
tgcccacctggggtctctctccc

SEQ ID NO: 6470623 - DNA, 15 bp, Homo sapiens
tgcccacgcagagga

SEQ ID NO: 6470624 - DNA, 19 bp, Homo sapiens
tgcccacgcagaggacgca

SEQ ID NO: 6470625 - DNA, 20 bp, Homo sapiens
tgcccacgcagaggacgcac

SEQ ID NO: 6470626 - DNA, 16 bp, Homo sapiens
tgcccacgcccttgga

SEQ ID NO: 6470627 - DNA, 20 bp, Homo sapiens
tgcccacgcccttggagcct

SEQ ID NO: 6470628 - DNA, 24 bp, Homo sapiens
tgcccacgcccttggagccttcca

SEQ ID NO: 6470629 - DNA, 19 bp, Homo sapiens
tgcccacgctcctgccctc

SEQ ID NO: 6470630 - DNA, 15 bp, Homo sapiens
tgcccacggccaccc

SEQ ID NO: 6470631 - DNA, 16 bp, Homo sapiens
tgcccacggccaccca

SEQ ID NO: 6470632 - DNA, 17 bp, Homo sapiens
tgcccacggccacccac

SEQ ID NO: 6470633 - DNA, 15 bp, Homo sapiens
tgcccacgtacccag

SEQ ID NO: 6470634 - DNA, 23 bp, Homo sapiens
tgcccacgtacccaggtctgggt

SEQ ID NO: 6470635 - DNA, 21 bp, Homo sapiens
tgcccactaagaagttccact

SEQ ID NO: 6470636 - DNA, 22 bp, Homo sapiens
tgcccactaggatcccactggc

SEQ ID NO: 6470637 - DNA, 16 bp, Homo sapiens
tgcccactcccccagg

SEQ ID NO: 6470638 - DNA, 17 bp, Homo sapiens
tgcccactcccccagga

SEQ ID NO: 6470639 - DNA, 17 bp, Homo sapiens
tgcccactccctatctc

SEQ ID NO: 6470640 - DNA, 13 bp, Homo sapiens
tgcccactccctg

SEQ ID NO: 6470641 - DNA, 16 bp, Homo sapiens
tgcccactccctgcaa

SEQ ID NO: 6470642 - DNA, 21 bp, Homo sapiens
tgcccactccgccagccacag

SEQ ID NO: 6470643 - DNA, 14 bp, Homo sapiens
tgcccactcctgct

SEQ ID NO: 6470644 - DNA, 19 bp, Homo sapiens
tgcccactcctgctctgct

SEQ ID NO: 6470645 - DNA, 18 bp, Homo sapiens
tgcccactctgaccgggc

SEQ ID NO: 6470646 - DNA, 11 bp, Homo sapiens
tgcccactgcc

SEQ ID NO: 6470647 - DNA, 19 bp, Homo sapiens
tgcccactgcctgcctccc

SEQ ID NO: 6470648 - DNA, 18 bp, Homo sapiens
tgcccactgctggtgcca

SEQ ID NO: 6470649 - DNA, 20 bp, Homo sapiens
tgcccactgctggtgccagg

SEQ ID NO: 6470650 - DNA, 22 bp, Homo sapiens
tgcccactgctggtgccagggt

SEQ ID NO: 6470651 - DNA, 17 bp, Homo sapiens
tgcccactggccgctga

SEQ ID NO: 6470652 - DNA, 18 bp, Homo sapiens
tgcccacttcagcccagc

SEQ ID NO: 6470653 - DNA, 16 bp, Homo sapiens
tgcccacttctgtgta

SEQ ID NO: 6470654 - DNA, 20 bp, Homo sapiens
tgcccacttctgtgtagaca

SEQ ID NO: 6470655 - DNA, 11 bp, Homo sapiens
tgcccagaact

SEQ ID NO: 6470656 - DNA, 21 bp, Homo sapiens
tgcccagaactggactcagga

SEQ ID NO: 6470657 - DNA, 18 bp, Homo sapiens
tgcccagaacttccctga

SEQ ID NO: 6470658 - DNA, 19 bp, Homo sapiens
tgcccagaataagttattg

SEQ ID NO: 6470659 - DNA, 18 bp, Homo sapiens
tgcccagaatactgatgg

SEQ ID NO: 6470660 - DNA, 12 bp, Homo sapiens
tgcccagacaca

SEQ ID NO: 6470661 - DNA, 21 bp, Homo sapiens
tgcccagacacagactggcaa

SEQ ID NO: 6470662 - DNA, 23 bp, Homo sapiens
tgcccagacacagactggcaata

SEQ ID NO: 6470663 - DNA, 19 bp, Homo sapiens
tgcccagacccctctggcc

SEQ ID NO: 6470664 - DNA, 17 bp, Homo sapiens
tgcccagagacccagcg

SEQ ID NO: 6470665 - DNA, 20 bp, Homo sapiens
tgcccagagacccagcggac

SEQ ID NO: 6470666 - DNA, 18 bp, Homo sapiens
tgcccagagatgcctcca

SEQ ID NO: 6470667 - DNA, 19 bp, Homo sapiens
tgcccagagatgcctccac

SEQ ID NO: 6470668 - DNA, 20 bp, Homo sapiens
tgcccagagatgcctccacc

SEQ ID NO: 6470669 - DNA, 22 bp, Homo sapiens
tgcccagagatgcctccaccgc

SEQ ID NO: 6470670 - DNA, 16 bp, Homo sapiens
tgcccagagcacttta

SEQ ID NO: 6470671 - DNA, 18 bp, Homo sapiens
tgcccagagcactttagc

SEQ ID NO: 6470672 - DNA, 11 bp, Homo sapiens
tgcccagagct

SEQ ID NO: 6470673 - DNA, 12 bp, Homo sapiens
tgcccagagctg

SEQ ID NO: 6470674 - DNA, 13 bp, Homo sapiens
tgcccagagctga

SEQ ID NO: 6470675 - DNA, 15 bp, Homo sapiens
tgcccagagctgggt

SEQ ID NO: 6470676 - DNA, 20 bp, Homo sapiens
tgcccagagggcccaggcag

SEQ ID NO: 6470677 - DNA, 21 bp, Homo sapiens
tgcccagagggcccaggcagg

SEQ ID NO: 6470678 - DNA, 15 bp, Homo sapiens
tgcccagagttgctg

SEQ ID NO: 6470679 - DNA, 16 bp, Homo sapiens
tgcccagatcagccag

SEQ ID NO: 6470680 - DNA, 17 bp, Homo sapiens
tgcccagatcccagaag

SEQ ID NO: 6470681 - DNA, 22 bp, Homo sapiens
tgcccagatcccagaaggacct

SEQ ID NO: 6470682 - DNA, 15 bp, Homo sapiens
tgcccagatgtttta

SEQ ID NO: 6470683 - DNA, 20 bp, Homo sapiens
tgcccagattcccagacctt

SEQ ID NO: 6470684 - DNA, 21 bp, Homo sapiens
tgcccagcacacacctatggc

SEQ ID NO: 6470685 - DNA, 16 bp, Homo sapiens
tgcccagcacctcctc

SEQ ID NO: 6470686 - DNA, 14 bp, Homo sapiens
tgcccagcagaggt

SEQ ID NO: 6470687 - DNA, 19 bp, Homo sapiens
tgcccagcagcccctgaga

SEQ ID NO: 6470688 - DNA, 20 bp, Homo sapiens
tgcccagcagcccctgagag

SEQ ID NO: 6470689 - DNA, 16 bp, Homo sapiens
tgcccagcagctcaag

SEQ ID NO: 6470690 - DNA, 20 bp, Homo sapiens
tgcccagcaggcccagcatg

SEQ ID NO: 6470691 - DNA, 13 bp, Homo sapiens
tgcccagccactc

SEQ ID NO: 6470692 - DNA, 19 bp, Homo sapiens
tgcccagccagccacccct

SEQ ID NO: 6470693 - DNA, 10 bp, Homo sapiens
tgcccagccc

SEQ ID NO: 6470694 - DNA, 23 bp, Homo sapiens
tgcccagcccatttgggctctgg

SEQ ID NO: 6470695 - DNA, 11 bp, Homo sapiens
tgcccagcccc

SEQ ID NO: 6470696 - DNA, 22 bp, Homo sapiens
tgcccagccccctggtctttga

SEQ ID NO: 6470697 - DNA, 20 bp, Homo sapiens
tgcccagccccgctcaggcc

SEQ ID NO: 6470698 - DNA, 12 bp, Homo sapiens
tgcccagcccct

SEQ ID NO: 6470699 - DNA, 21 bp, Homo sapiens
tgcccagcccctcctccctgc

SEQ ID NO: 6470700 - DNA, 14 bp, Homo sapiens
tgcccagcccctgc

SEQ ID NO: 6470701 - DNA, 16 bp, Homo sapiens
tgcccagcccctgccc

SEQ ID NO: 6470702 - DNA, 16 bp, Homo sapiens
tgcccagccccttctg

SEQ ID NO: 6470703 - DNA, 21 bp, Homo sapiens
tgcccagccccttctgaccca

SEQ ID NO: 6470704 - DNA, 12 bp, Homo sapiens
tgcccagccctg

SEQ ID NO: 6470705 - DNA, 14 bp, Homo sapiens
tgcccagccctggc

SEQ ID NO: 6470706 - DNA, 17 bp, Homo sapiens
tgcccagcctgctctcc

SEQ ID NO: 6470707 - DNA, 18 bp, Homo sapiens
tgcccagcctgctctccc

SEQ ID NO: 6470708 - DNA, 18 bp, Homo sapiens
tgcccagcctggaaacct

SEQ ID NO: 6470709 - DNA, 20 bp, Homo sapiens
tgcccagcctggagcggagc

SEQ ID NO: 6470710 - DNA, 14 bp, Homo sapiens
tgcccagcctggat

SEQ ID NO: 6470711 - DNA, 16 bp, Homo sapiens
tgcccagcctggatgc

SEQ ID NO: 6470712 - DNA, 18 bp, Homo sapiens
tgcccagcctggatgcca

SEQ ID NO: 6470713 - DNA, 18 bp, Homo sapiens
tgcccagcggacagtggc

SEQ ID NO: 6470714 - DNA, 21 bp, Homo sapiens
tgcccagcggacagtggcagg

SEQ ID NO: 6470715 - DNA, 22 bp, Homo sapiens
tgcccagcggacagtggcagga

SEQ ID NO: 6470716 - DNA, 15 bp, Homo sapiens
tgcccagctaatttt

SEQ ID NO: 6470717 - DNA, 21 bp, Homo sapiens
tgcccagctagctgcagagcc

SEQ ID NO: 6470718 - DNA, 18 bp, Homo sapiens
tgcccagctatacctgtg

SEQ ID NO: 6470719 - DNA, 13 bp, Homo sapiens
tgcccagctcagt

SEQ ID NO: 6470720 - DNA, 15 bp, Homo sapiens
tgcccagctcctcac

SEQ ID NO: 6470721 - DNA, 13 bp, Homo sapiens
tgcccagctctcg

SEQ ID NO: 6470722 - DNA, 18 bp, Homo sapiens
tgcccagctctctgacgc

SEQ ID NO: 6470723 - DNA, 21 bp, Homo sapiens
tgcccagctctctgacgcttg

SEQ ID NO: 6470724 - DNA, 19 bp, Homo sapiens
tgcccagcttggagtgcca

SEQ ID NO: 6470725 - DNA, 14 bp, Homo sapiens
tgcccagcttgggc

SEQ ID NO: 6470726 - DNA, 21 bp, Homo sapiens
tgcccagcttgggcccagctg

SEQ ID NO: 6470727 - DNA, 20 bp, Homo sapiens
tgcccagcttttcattgctg

SEQ ID NO: 6470728 - DNA, 21 bp, Homo sapiens
tgcccaggaagtaattttctt

SEQ ID NO: 6470729 - DNA, 22 bp, Homo sapiens
tgcccaggacggggccggccag

SEQ ID NO: 6470730 - DNA, 21 bp, Homo sapiens
tgcccaggacggtctgtgccc

SEQ ID NO: 6470731 - DNA, 22 bp, Homo sapiens
tgcccaggacggtctgtgcccg

SEQ ID NO: 6470732 - DNA, 23 bp, Homo sapiens
tgcccaggagagccagccctccc

SEQ ID NO: 6470733 - DNA, 20 bp, Homo sapiens
tgcccaggatgacatagcca

SEQ ID NO: 6470734 - DNA, 14 bp, Homo sapiens
tgcccaggcaagga

SEQ ID NO: 6470735 - DNA, 20 bp, Homo sapiens
tgcccaggcaggtcttgaac

SEQ ID NO: 6470736 - DNA, 19 bp, Homo sapiens
tgcccaggcagtctttgct

SEQ ID NO: 6470737 - DNA, 11 bp, Homo sapiens
tgcccaggcca

SEQ ID NO: 6470738 - DNA, 12 bp, Homo sapiens
tgcccaggccac

SEQ ID NO: 6470739 - DNA, 13 bp, Homo sapiens
tgcccaggccaca

SEQ ID NO: 6470740 - DNA, 14 bp, Homo sapiens
tgcccaggccacag

SEQ ID NO: 6470741 - DNA, 15 bp, Homo sapiens
tgcccaggccacaga

SEQ ID NO: 6470742 - DNA, 17 bp, Homo sapiens
tgcccaggccacagaga

SEQ ID NO: 6470743 - DNA, 22 bp, Homo sapiens
tgcccaggccacagagaacctg

SEQ ID NO: 6470744 - DNA, 13 bp, Homo sapiens
tgcccaggccctt

SEQ ID NO: 6470745 - DNA, 15 bp, Homo sapiens
tgcccaggcctgcct

SEQ ID NO: 6470746 - DNA, 17 bp, Homo sapiens
tgcccaggcctgcctgt

SEQ ID NO: 6470747 - DNA, 19 bp, Homo sapiens
tgcccaggctagagtgcag

SEQ ID NO: 6470748 - DNA, 12 bp, Homo sapiens
tgcccaggctct

SEQ ID NO: 6470749 - DNA, 19 bp, Homo sapiens
tgcccaggctctgctgact

SEQ ID NO: 6470750 - DNA, 13 bp, Homo sapiens
tgcccaggctgga

SEQ ID NO: 6470751 - DNA, 18 bp, Homo sapiens
tgcccaggctggaatgca

SEQ ID NO: 6470752 - DNA, 16 bp, Homo sapiens
tgcccaggctggagtg

SEQ ID NO: 6470753 - DNA, 20 bp, Homo sapiens
tgcccaggctggagtgtagt

SEQ ID NO: 6470754 - DNA, 21 bp, Homo sapiens
tgcccaggctggagtgtagtg

SEQ ID NO: 6470755 - DNA, 15 bp, Homo sapiens
tgcccaggctggtct

SEQ ID NO: 6470756 - DNA, 17 bp, Homo sapiens
tgcccagggatttgtcc

SEQ ID NO: 6470757 - DNA, 15 bp, Homo sapiens
tgcccagggctcagc

SEQ ID NO: 6470758 - DNA, 20 bp, Homo sapiens
tgcccagggctcagcctggt

SEQ ID NO: 6470759 - DNA, 11 bp, Homo sapiens
tgcccaggggt

SEQ ID NO: 6470760 - DNA, 15 bp, Homo sapiens
tgcccaggggtgccc

SEQ ID NO: 6470761 - DNA, 19 bp, Homo sapiens
tgcccaggggtgccccctc

SEQ ID NO: 6470762 - DNA, 21 bp, Homo sapiens
tgcccaggggtgccccctcct

SEQ ID NO: 6470763 - DNA, 23 bp, Homo sapiens
tgcccaggggtgccccctcctct

SEQ ID NO: 6470764 - DNA, 18 bp, Homo sapiens
tgcccagggtcctgtgcc

SEQ ID NO: 6470765 - DNA, 19 bp, Homo sapiens
tgcccagggtcctgtgcct

SEQ ID NO: 6470766 - DNA, 19 bp, Homo sapiens
tgcccaggtaccacccttc

SEQ ID NO: 6470767 - DNA, 22 bp, Homo sapiens
tgcccaggtaccacccttcaga

SEQ ID NO: 6470768 - DNA, 20 bp, Homo sapiens
tgcccaggtatcctggggga

SEQ ID NO: 6470769 - DNA, 21 bp, Homo sapiens
tctcttcggtcgtatccacct

SEQ ID NO: 6470770 - DNA, 16 bp, Homo sapiens
tctcttcggtggcctt

SEQ ID NO: 6470771 - DNA, 15 bp, Homo sapiens
tctcttcgtcctgat

SEQ ID NO: 6470772 - DNA, 18 bp, Homo sapiens
tctcttctcagctcttcc

SEQ ID NO: 6470773 - DNA, 16 bp, Homo sapiens
tctcttctccactgga

SEQ ID NO: 6470774 - DNA, 21 bp, Homo sapiens
tctcttctccccttccatttc

SEQ ID NO: 6470775 - DNA, 12 bp, Homo sapiens
tctcttctcctt

SEQ ID NO: 6470776 - DNA, 16 bp, Homo sapiens
tctcttctctccagct

SEQ ID NO: 6470777 - DNA, 23 bp, Homo sapiens
tctcttctctccagctgactaaa

SEQ ID NO: 6470778 - DNA, 15 bp, Homo sapiens
tctcttctctgcaat

SEQ ID NO: 6470779 - DNA, 18 bp, Homo sapiens
tctcttctctgcaatgct

SEQ ID NO: 6470780 - DNA, 15 bp, Homo sapiens
tctcttctcttcttt

SEQ ID NO: 6470781 - DNA, 19 bp, Homo sapiens
tctcttctgctccaccctt

SEQ ID NO: 6470782 - DNA, 21 bp, Homo sapiens
tctcttctgggttccttcctc

SEQ ID NO: 6470783 - DNA, 14 bp, Homo sapiens
tctcttctgtccat

SEQ ID NO: 6470784 - DNA, 12 bp, Homo sapiens
tctcttctgttc

SEQ ID NO: 6470785 - DNA, 18 bp, Homo sapiens
tctcttcttaatgtacat

SEQ ID NO: 6470786 - DNA, 16 bp, Homo sapiens
tctcttcttactcatt

SEQ ID NO: 6470787 - DNA, 12 bp, Homo sapiens
tctcttcttcat

SEQ ID NO: 6470788 - DNA, 13 bp, Homo sapiens
tctcttcttccat

SEQ ID NO: 6470789 - DNA, 14 bp, Homo sapiens
tctcttcttcccct

SEQ ID NO: 6470790 - DNA, 14 bp, Homo sapiens
tctcttcttgctat

SEQ ID NO: 6470791 - DNA, 17 bp, Homo sapiens
tctcttcttgctatatg

SEQ ID NO: 6470792 - DNA, 12 bp, Homo sapiens
tctcttcttgtt

SEQ ID NO: 6470793 - DNA, 12 bp, Homo sapiens
tctcttctttaa

SEQ ID NO: 6470794 - DNA, 15 bp, Homo sapiens
tctcttctttccatt

SEQ ID NO: 6470795 - DNA, 15 bp, Homo sapiens
tctcttctttctgaa

SEQ ID NO: 6470796 - DNA, 20 bp, Homo sapiens
tctcttgaaaagttcaggga

SEQ ID NO: 6470797 - DNA, 19 bp, Homo sapiens
tctcttgaaacctgttaaa

SEQ ID NO: 6470798 - DNA, 14 bp, Homo sapiens
tctcttgaccctgt

SEQ ID NO: 6470799 - DNA, 18 bp, Homo sapiens
tctcttgagcatcaatct

SEQ ID NO: 6470800 - DNA, 23 bp, Homo sapiens
tctcttgagcatcaatcttgtta

SEQ ID NO: 6470801 - DNA, 16 bp, Homo sapiens
tctcttgagctggcct

SEQ ID NO: 6470802 - DNA, 13 bp, Homo sapiens
tctcttgagggag

SEQ ID NO: 6470803 - DNA, 14 bp, Homo sapiens
tctcttgagtttgt

SEQ ID NO: 6470804 - DNA, 15 bp, Homo sapiens
tctcttgagtttgtc

SEQ ID NO: 6470805 - DNA, 20 bp, Homo sapiens
tctcttgattgatttttaaa

SEQ ID NO: 6470806 - DNA, 15 bp, Homo sapiens
tctcttgcacccgcc

SEQ ID NO: 6470807 - DNA, 20 bp, Homo sapiens
tctcttgcataagcctcagg

SEQ ID NO: 6470808 - DNA, 23 bp, Homo sapiens
tctcttgccccaaatcacaaaca

SEQ ID NO: 6470809 - DNA, 18 bp, Homo sapiens
tctcttgccccttgtcct

SEQ ID NO: 6470810 - DNA, 12 bp, Homo sapiens
tctcttgccctt

SEQ ID NO: 6470811 - DNA, 21 bp, Homo sapiens
tctcttgcctcaacctcccaa

SEQ ID NO: 6470812 - DNA, 13 bp, Homo sapiens
tctcttgcctcag

SEQ ID NO: 6470813 - DNA, 16 bp, Homo sapiens
tctcttgcctcagcct

SEQ ID NO: 6470814 - DNA, 13 bp, Homo sapiens
tctcttgcctgcc

SEQ ID NO: 6470815 - DNA, 14 bp, Homo sapiens
tctcttgcctgcca

SEQ ID NO: 6470816 - DNA, 16 bp, Homo sapiens
tctcttgcctgccact

SEQ ID NO: 6470817 - DNA, 20 bp, Homo sapiens
tctcttgcctgccactgtgt

SEQ ID NO: 6470818 - DNA, 18 bp, Homo sapiens
tctcttgccttaaatata

SEQ ID NO: 6470819 - DNA, 14 bp, Homo sapiens
tctcttgcttgtca

SEQ ID NO: 6470820 - DNA, 15 bp, Homo sapiens
tctcttgcttgtcat

SEQ ID NO: 6470821 - DNA, 14 bp, Homo sapiens
tctcttgctttata

SEQ ID NO: 6470822 - DNA, 13 bp, Homo sapiens
tctcttgctttgt

SEQ ID NO: 6470823 - DNA, 14 bp, Homo sapiens
tctcttgctttgtt

SEQ ID NO: 6470824 - DNA, 22 bp, Homo sapiens
tctcttggaaatgttaagaaag

SEQ ID NO: 6470825 - DNA, 20 bp, Homo sapiens
tctcttggaattagatgttt

SEQ ID NO: 6470826 - DNA, 16 bp, Homo sapiens
tctcttggaccctggg

SEQ ID NO: 6470827 - DNA, 21 bp, Homo sapiens
tctcttggactccctccccac

SEQ ID NO: 6470828 - DNA, 14 bp, Homo sapiens
tctcttggctattg

SEQ ID NO: 6470829 - DNA, 16 bp, Homo sapiens
tctcttggctttgtca

SEQ ID NO: 6470830 - DNA, 23 bp, Homo sapiens
tctcttgggaactgaactcactt

SEQ ID NO: 6470831 - DNA, 13 bp, Homo sapiens
tctcttgggaagc

SEQ ID NO: 6470832 - DNA, 16 bp, Homo sapiens
tctcttgggaagcagt

SEQ ID NO: 6470833 - DNA, 15 bp, Homo sapiens
tctcttgggcaggca

SEQ ID NO: 6470834 - DNA, 17 bp, Homo sapiens
tctcttgggcaggcaga

SEQ ID NO: 6470835 - DNA, 21 bp, Homo sapiens
tctcttgggccaagccagctg

SEQ ID NO: 6470836 - DNA, 23 bp, Homo sapiens
tctcttgggccaagccagctgcc

SEQ ID NO: 6470837 - DNA, 22 bp, Homo sapiens
tctcttgggggccggggggaaa

SEQ ID NO: 6470838 - DNA, 13 bp, Homo sapiens
tctcttgggtggg

SEQ ID NO: 6470839 - DNA, 16 bp, Homo sapiens
tctcttggtcctgctg

SEQ ID NO: 6470840 - DNA, 17 bp, Homo sapiens
tctcttggtcctgctgc

SEQ ID NO: 6470841 - DNA, 16 bp, Homo sapiens
tctcttggtctctttc

SEQ ID NO: 6470842 - DNA, 16 bp, Homo sapiens
tctcttggtggggagg

SEQ ID NO: 6470843 - DNA, 22 bp, Homo sapiens
tctcttggtgttaaaacacttc

SEQ ID NO: 6470844 - DNA, 16 bp, Homo sapiens
tctcttggtttccttc

SEQ ID NO: 6470845 - DNA, 21 bp, Homo sapiens
tctcttgtaaatacatgtccc

SEQ ID NO: 6470846 - DNA, 17 bp, Homo sapiens
tctcttgtaccatagaa

SEQ ID NO: 6470847 - DNA, 13 bp, Homo sapiens
tctcttgtatagc

SEQ ID NO: 6470848 - DNA, 14 bp, Homo sapiens
tctcttgtcacatg

SEQ ID NO: 6470849 - DNA, 17 bp, Homo sapiens
tctcttgtcatataaac

SEQ ID NO: 6470850 - DNA, 19 bp, Homo sapiens
tctcttgtcatataaacct

SEQ ID NO: 6470851 - DNA, 16 bp, Homo sapiens
tctcttgtcattctca

SEQ ID NO: 6470852 - DNA, 13 bp, Homo sapiens
tctcttgtcctct

SEQ ID NO: 6470853 - DNA, 14 bp, Homo sapiens
tctcttgtctggct

SEQ ID NO: 6470854 - DNA, 16 bp, Homo sapiens
tctcttgtgcatttgg

SEQ ID NO: 6470855 - DNA, 19 bp, Homo sapiens
tctcttgtttaaaaaaaga

SEQ ID NO: 6470856 - DNA, 18 bp, Homo sapiens
tctctttaaaaggaaaga

SEQ ID NO: 6470857 - DNA, 14 bp, Homo sapiens
tctctttaaactat

SEQ ID NO: 6470858 - DNA, 16 bp, Homo sapiens
tctctttaatcttcag

SEQ ID NO: 6470859 - DNA, 17 bp, Homo sapiens
tctctttaatcttcagt

SEQ ID NO: 6470860 - DNA, 21 bp, Homo sapiens
tctctttaatgtcacaggcag

SEQ ID NO: 6470861 - DNA, 18 bp, Homo sapiens
tctctttacttcccagta

SEQ ID NO: 6470862 - DNA, 12 bp, Homo sapiens
tctctttaggag

SEQ ID NO: 6470863 - DNA, 17 bp, Homo sapiens
tctctttatacagctgt

SEQ ID NO: 6470864 - DNA, 13 bp, Homo sapiens
tctctttattata

SEQ ID NO: 6470865 - DNA, 17 bp, Homo sapiens
tctctttattataagtg

SEQ ID NO: 6470866 - DNA, 14 bp, Homo sapiens
tctctttattccta

SEQ ID NO: 6470867 - DNA, 15 bp, Homo sapiens
tctctttattttact

SEQ ID NO: 6470868 - DNA, 22 bp, Homo sapiens
tctctttcaattgcagatgcca

SEQ ID NO: 6470869 - DNA, 22 bp, Homo sapiens
tctctttcacattgtttgctgc

SEQ ID NO: 6470870 - DNA, 13 bp, Homo sapiens
tctctttcagtat

SEQ ID NO: 6470871 - DNA, 22 bp, Homo sapiens
tctctttccccaaggacccagc

SEQ ID NO: 6470872 - DNA, 13 bp, Homo sapiens
tctctttccccca

SEQ ID NO: 6470873 - DNA, 19 bp, Homo sapiens
tctctttccctggtccctt

SEQ ID NO: 6470874 - DNA, 12 bp, Homo sapiens
tctctttccctt

SEQ ID NO: 6470875 - DNA, 16 bp, Homo sapiens
tctctttccttcttgc

SEQ ID NO: 6470876 - DNA, 20 bp, Homo sapiens
tctctttctaagagacctga

SEQ ID NO: 6470877 - DNA, 23 bp, Homo sapiens
tctctttctaagagacctgaact

SEQ ID NO: 6470878 - DNA, 17 bp, Homo sapiens
tctctttctactctcct

SEQ ID NO: 6470879 - DNA, 21 bp, Homo sapiens
tctctttctcattagagatct

SEQ ID NO: 6470880 - DNA, 23 bp, Homo sapiens
tctctttctccttagtcttctca

SEQ ID NO: 6470881 - DNA, 12 bp, Homo sapiens
tctctttctctc

SEQ ID NO: 6470882 - DNA, 14 bp, Homo sapiens
tctctttctctcct

SEQ ID NO: 6470883 - DNA, 13 bp, Homo sapiens
tctctttctctct

SEQ ID NO: 6470884 - DNA, 14 bp, Homo sapiens
tctctttctctctc

SEQ ID NO: 6470885 - DNA, 14 bp, Homo sapiens
tctctttctctctt

SEQ ID NO: 6470886 - DNA, 13 bp, Homo sapiens
tctctttctctgg

SEQ ID NO: 6470887 - DNA, 14 bp, Homo sapiens
tctctttctctggt

SEQ ID NO: 6470888 - DNA, 13 bp, Homo sapiens
tctctttctgtac

SEQ ID NO: 6470889 - DNA, 13 bp, Homo sapiens
tctctttcttagt

SEQ ID NO: 6470890 - DNA, 14 bp, Homo sapiens
tctctttcttattt

SEQ ID NO: 6470891 - DNA, 12 bp, Homo sapiens
tctctttcttta

SEQ ID NO: 6470892 - DNA, 13 bp, Homo sapiens
tctctttctttac

SEQ ID NO: 6470893 - DNA, 18 bp, Homo sapiens
tctctttctttacaagat

SEQ ID NO: 6470894 - DNA, 13 bp, Homo sapiens
tctctttctttcc

SEQ ID NO: 6470895 - DNA, 20 bp, Homo sapiens
tctctttcttttctctgtct

SEQ ID NO: 6470896 - DNA, 19 bp, Homo sapiens
tctctttcttttgtgcata

SEQ ID NO: 6470897 - DNA, 20 bp, Homo sapiens
tctctttgaattttctgtgt

SEQ ID NO: 6470898 - DNA, 13 bp, Homo sapiens
tctctttgactta

SEQ ID NO: 6470899 - DNA, 13 bp, Homo sapiens
tctctttgcctca

SEQ ID NO: 6470900 - DNA, 14 bp, Homo sapiens
tctctttgcctcaa

SEQ ID NO: 6470901 - DNA, 16 bp, Homo sapiens
tctctttggaatgaac

SEQ ID NO: 6470902 - DNA, 22 bp, Homo sapiens
tctctttgtaccacagtttctt

SEQ ID NO: 6470903 - DNA, 15 bp, Homo sapiens
tctctttgtctgcct

SEQ ID NO: 6470904 - DNA, 21 bp, Homo sapiens
tctctttgtctgccttcccaa

SEQ ID NO: 6470905 - DNA, 17 bp, Homo sapiens
tctctttgttctaaaga

SEQ ID NO: 6470906 - DNA, 14 bp, Homo sapiens
tctctttgttctca

SEQ ID NO: 6470907 - DNA, 17 bp, Homo sapiens
tctctttgttctcagct

SEQ ID NO: 6470908 - DNA, 21 bp, Homo sapiens
tctctttgtttcaactggatt

SEQ ID NO: 6470909 - DNA, 21 bp, Homo sapiens
tctctttgtttctgtttcttg

SEQ ID NO: 6470910 - DNA, 20 bp, Homo sapiens
tctcttttatatttgtagga

SEQ ID NO: 6470911 - DNA, 14 bp, Homo sapiens
tctcttttcaagaa

SEQ ID NO: 6470912 - DNA, 22 bp, Homo sapiens
tctcttttcacagcaacatttt

SEQ ID NO: 6470913 - DNA, 24 bp, Homo sapiens
tctcttttcattgtgtatcagttt

SEQ ID NO: 6470914 - DNA, 19 bp, Homo sapiens
tctcttttccccgcctgca

SEQ ID NO: 6470915 - DNA, 22 bp, Homo sapiens
tctcttttcccctttcctgtcc

SEQ ID NO: 6470916 - DNA, 17 bp, Homo sapiens
tctcttttcctctctct

SEQ ID NO: 6470917 - DNA, 21 bp, Homo sapiens
tctcttttcctctctgtctgt

SEQ ID NO: 6470918 - DNA, 14 bp, Homo sapiens
tctcttttctagtt

SEQ ID NO: 6470919 - DNA, 12 bp, Homo sapiens
tctcttttctct

SEQ ID NO: 6470920 - DNA, 15 bp, Homo sapiens
tctcttttctctact

SEQ ID NO: 6470921 - DNA, 16 bp, Homo sapiens
tctcttttctctttct

SEQ ID NO: 6470922 - DNA, 18 bp, Homo sapiens
tctcttttctttagagca

SEQ ID NO: 6470923 - DNA, 19 bp, Homo sapiens
tctcttttctttagagcat

SEQ ID NO: 6470924 - DNA, 17 bp, Homo sapiens
tctcttttgaaacaata

SEQ ID NO: 6470925 - DNA, 23 bp, Homo sapiens
tctcttttgaatccatgcttggg

SEQ ID NO: 6470926 - DNA, 15 bp, Homo sapiens
tctcttttgctttct

SEQ ID NO: 6470927 - DNA, 22 bp, Homo sapiens
tctcttttggtttctgcttctc

SEQ ID NO: 6470928 - DNA, 13 bp, Homo sapiens
tctctttttgaaa

SEQ ID NO: 6470929 - DNA, 17 bp, Homo sapiens
tctctttttggaggtgc

SEQ ID NO: 6470930 - DNA, 12 bp, Homo sapiens
tctctttttgtt

SEQ ID NO: 6470931 - DNA, 14 bp, Homo sapiens
tctctttttgtttg

SEQ ID NO: 6470932 - DNA, 15 bp, Homo sapiens
tctcttttttacaaa

SEQ ID NO: 6470933 - DNA, 17 bp, Homo sapiens
tctcttttttattctgt

SEQ ID NO: 6470934 - DNA, 16 bp, Homo sapiens
tctcttttttgggggg

SEQ ID NO: 6470935 - DNA, 22 bp, Homo sapiens
tctctttttttaaaaagttgat

SEQ ID NO: 6470936 - DNA, 18 bp, Homo sapiens
tctctttttttctggagg

SEQ ID NO: 6470937 - DNA, 21 bp, Homo sapiens
tctgaaaaatgcctgctgctg

SEQ ID NO: 6470938 - DNA, 14 bp, Homo sapiens
tctgaaaacaaggt

SEQ ID NO: 6470939 - DNA, 21 bp, Homo sapiens
tctgaaaactgaatgtcaaga

SEQ ID NO: 6470940 - DNA, 11 bp, Homo sapiens
tctgaaaagaa

SEQ ID NO: 6470941 - DNA, 20 bp, Homo sapiens
tctgaaaagaacaaccctga

SEQ ID NO: 6470942 - DNA, 19 bp, Homo sapiens
tctgaaaagctgtgtactt

SEQ ID NO: 6470943 - DNA, 14 bp, Homo sapiens
tctgaaaaggaacg

SEQ ID NO: 6470944 - DNA, 19 bp, Homo sapiens
tctgaaaagtgaagacaga

SEQ ID NO: 6470945 - DNA, 18 bp, Homo sapiens
tctgaaaatagcaaccca

SEQ ID NO: 6470946 - DNA, 11 bp, Homo sapiens
tctgaaaatat

SEQ ID NO: 6470947 - DNA, 17 bp, Homo sapiens
tctgaaaatatttacat

SEQ ID NO: 6470948 - DNA, 14 bp, Homo sapiens
tctgaaaatatttt

SEQ ID NO: 6470949 - DNA, 22 bp, Homo sapiens
tctgaaaattccagaaaggata

SEQ ID NO: 6470950 - DNA, 22 bp, Homo sapiens
tctgaaaattgatgggatttgg

SEQ ID NO: 6470951 - DNA, 23 bp, Homo sapiens
tgcccaggtatcctgggggaaga

SEQ ID NO: 6470952 - DNA, 18 bp, Homo sapiens
tgcccaggtcaccaagca

SEQ ID NO: 6470953 - DNA, 15 bp, Homo sapiens
tgcccaggtcaccgg

SEQ ID NO: 6470954 - DNA, 20 bp, Homo sapiens
tgcccaggttggagtgcagt

SEQ ID NO: 6470955 - DNA, 19 bp, Homo sapiens
tgcccagtaaaatttcagg

SEQ ID NO: 6470956 - DNA, 23 bp, Homo sapiens
tgcccagtaaaatttcaggatta

SEQ ID NO: 6470957 - DNA, 15 bp, Homo sapiens
tgcccagtacattta

SEQ ID NO: 6470958 - DNA, 16 bp, Homo sapiens
tgcccagtcccccaac

SEQ ID NO: 6470959 - DNA, 20 bp, Homo sapiens
tgcccagtcccccaacccca

SEQ ID NO: 6470960 - DNA, 15 bp, Homo sapiens
tgcccagtcctgggt

SEQ ID NO: 6470961 - DNA, 17 bp, Homo sapiens
tgcccagtcctgggttg

SEQ ID NO: 6470962 - DNA, 16 bp, Homo sapiens
tgcccagtcgacccca

SEQ ID NO: 6470963 - DNA, 12 bp, Homo sapiens
tgcccagtctgg

SEQ ID NO: 6470964 - DNA, 19 bp, Homo sapiens
tgcccagtcttgagtgggc

SEQ ID NO: 6470965 - DNA, 15 bp, Homo sapiens
tgcccagtctttgga

SEQ ID NO: 6470966 - DNA, 16 bp, Homo sapiens
tgcccagtgagccctg

SEQ ID NO: 6470967 - DNA, 17 bp, Homo sapiens
tgcccagtgagccctgc

SEQ ID NO: 6470968 - DNA, 18 bp, Homo sapiens
tgcccagtgagccctgct

SEQ ID NO: 6470969 - DNA, 20 bp, Homo sapiens
tgcccagtgagccctgctct

SEQ ID NO: 6470970 - DNA, 16 bp, Homo sapiens
tgcccagtgatggcat

SEQ ID NO: 6470971 - DNA, 15 bp, Homo sapiens
tgcccagtggagcct

SEQ ID NO: 6470972 - DNA, 19 bp, Homo sapiens
tgcccagtggagcctgccg

SEQ ID NO: 6470973 - DNA, 20 bp, Homo sapiens
tgcccagtggagcctgccgc

SEQ ID NO: 6470974 - DNA, 18 bp, Homo sapiens
tgcccagtggtttccctt

SEQ ID NO: 6470975 - DNA, 18 bp, Homo sapiens
tgcccagtgttgtttgta

SEQ ID NO: 6470976 - DNA, 21 bp, Homo sapiens
tgcccagtgttgtttgtaaat

SEQ ID NO: 6470977 - DNA, 23 bp, Homo sapiens
tgcccagttaatcttgctttctt

SEQ ID NO: 6470978 - DNA, 17 bp, Homo sapiens
tgcccagttcatcccaa

SEQ ID NO: 6470979 - DNA, 22 bp, Homo sapiens
tgcccagttggaggagactggg

SEQ ID NO: 6470980 - DNA, 15 bp, Homo sapiens
tgcccatacccctgc

SEQ ID NO: 6470981 - DNA, 18 bp, Homo sapiens
tgcccatacccctgcctg

SEQ ID NO: 6470982 - DNA, 22 bp, Homo sapiens
tgcccatacccctgcctgggtt

SEQ ID NO: 6470983 - DNA, 12 bp, Homo sapiens
tgcccatataaa

SEQ ID NO: 6470984 - DNA, 16 bp, Homo sapiens
tgcccatatggtcatc

SEQ ID NO: 6470985 - DNA, 20 bp, Homo sapiens
tgcccatcacagggttgggc

SEQ ID NO: 6470986 - DNA, 23 bp, Homo sapiens
tgcccatcacagggttgggccca

SEQ ID NO: 6470987 - DNA, 22 bp, Homo sapiens
tgcccatcagtgacagactgga

SEQ ID NO: 6470988 - DNA, 18 bp, Homo sapiens
tgcccatcatgtggcccc

SEQ ID NO: 6470989 - DNA, 15 bp, Homo sapiens
tgcccatcccacccc

SEQ ID NO: 6470990 - DNA, 13 bp, Homo sapiens
tgcccatcccagt

SEQ ID NO: 6470991 - DNA, 14 bp, Homo sapiens
tgcccatcccagtc

SEQ ID NO: 6470992 - DNA, 17 bp, Homo sapiens
tgcccatcccagtccct

SEQ ID NO: 6470993 - DNA, 18 bp, Homo sapiens
tgcccatcccagtgtcct

SEQ ID NO: 6470994 - DNA, 21 bp, Homo sapiens
tgcccatcgtgaagaagcctg

SEQ ID NO: 6470995 - DNA, 22 bp, Homo sapiens
tgcccatcgtgaagaagcctgt

SEQ ID NO: 6470996 - DNA, 17 bp, Homo sapiens
tgcccatgcaccttcca

SEQ ID NO: 6470997 - DNA, 14 bp, Homo sapiens
tgcccatgcctaaa

SEQ ID NO: 6470998 - DNA, 14 bp, Homo sapiens
tgcccatggctggg

SEQ ID NO: 6470999 - DNA, 16 bp, Homo sapiens
tgcccatggctgggaa

SEQ ID NO: 6471000 - DNA, 16 bp, Homo sapiens
tgcccatggcttctgg

SEQ ID NO: 6471001 - DNA, 16 bp, Homo sapiens
tgcccatgggcactgc

SEQ ID NO: 6471002 - DNA, 18 bp, Homo sapiens
tgcccatgggcactgctg

SEQ ID NO: 6471003 - DNA, 20 bp, Homo sapiens
tgcccatgggcactgctggg

SEQ ID NO: 6471004 - DNA, 21 bp, Homo sapiens
tgcccatgtcgcgctcagcat

SEQ ID NO: 6471005 - DNA, 21 bp, Homo sapiens
tgcccatgtgtacattctgcc

SEQ ID NO: 6471006 - DNA, 14 bp, Homo sapiens
tgcccatgtgtccc

SEQ ID NO: 6471007 - DNA, 15 bp, Homo sapiens
tgcccatgtttcaaa

SEQ ID NO: 6471008 - DNA, 17 bp, Homo sapiens
tgcccattagagaagta

SEQ ID NO: 6471009 - DNA, 12 bp, Homo sapiens
tgcccattccta

SEQ ID NO: 6471010 - DNA, 17 bp, Homo sapiens
tgcccattcctgcctgg

SEQ ID NO: 6471011 - DNA, 20 bp, Homo sapiens
tgcccattcctgcctggtcc

SEQ ID NO: 6471012 - DNA, 21 bp, Homo sapiens
tgcccattctgccctgtggga

SEQ ID NO: 6471013 - DNA, 19 bp, Homo sapiens
tgcccattcttttcacttc

SEQ ID NO: 6471014 - DNA, 19 bp, Homo sapiens
tgcccattgtttttctgat

SEQ ID NO: 6471015 - DNA, 15 bp, Homo sapiens
tgcccatttcacaca

SEQ ID NO: 6471016 - DNA, 17 bp, Homo sapiens
tgcccatttcacacaac

SEQ ID NO: 6471017 - DNA, 18 bp, Homo sapiens
tgcccatttcacacaact

SEQ ID NO: 6471018 - DNA, 12 bp, Homo sapiens
tgcccatttcat

SEQ ID NO: 6471019 - DNA, 21 bp, Homo sapiens
tgcccatttcatattctttca

SEQ ID NO: 6471020 - DNA, 14 bp, Homo sapiens
tgccccaaacaaat

SEQ ID NO: 6471021 - DNA, 21 bp, Homo sapiens
tgccccaaaggaagctttctc

SEQ ID NO: 6471022 - DNA, 23 bp, Homo sapiens
tgccccaaataacttcagtcctg

SEQ ID NO: 6471023 - DNA, 15 bp, Homo sapiens
tgccccaacccccag

SEQ ID NO: 6471024 - DNA, 20 bp, Homo sapiens
tgccccaacccccagcaccc

SEQ ID NO: 6471025 - DNA, 16 bp, Homo sapiens
tgccccaacccttctt

SEQ ID NO: 6471026 - DNA, 16 bp, Homo sapiens
tgccccaacctgctga

SEQ ID NO: 6471027 - DNA, 15 bp, Homo sapiens
tgccccaactcctgg

SEQ ID NO: 6471028 - DNA, 16 bp, Homo sapiens
tgccccaactcctgga

SEQ ID NO: 6471029 - DNA, 16 bp, Homo sapiens
tgccccaactccttcc

SEQ ID NO: 6471030 - DNA, 19 bp, Homo sapiens
tgccccaacttaagtttag

SEQ ID NO: 6471031 - DNA, 22 bp, Homo sapiens
tgccccaacttaagtttagaaa

SEQ ID NO: 6471032 - DNA, 21 bp, Homo sapiens
tgccccaagaggctagcccca

SEQ ID NO: 6471033 - DNA, 16 bp, Homo sapiens
tgccccaagcagccag

SEQ ID NO: 6471034 - DNA, 21 bp, Homo sapiens
tgccccaagcagccagccagt

SEQ ID NO: 6471035 - DNA, 16 bp, Homo sapiens
tgccccaaggaggtgg

SEQ ID NO: 6471036 - DNA, 21 bp, Homo sapiens
tgccccaaggccccagggaca

SEQ ID NO: 6471037 - DNA, 15 bp, Homo sapiens
tgccccaaggctgct

SEQ ID NO: 6471038 - DNA, 17 bp, Homo sapiens
tgccccaaggctgctca

SEQ ID NO: 6471039 - DNA, 21 bp, Homo sapiens
tgccccaaggctgctcagagg

SEQ ID NO: 6471040 - DNA, 20 bp, Homo sapiens
tgccccaagggcccagaccc

SEQ ID NO: 6471041 - DNA, 22 bp, Homo sapiens
tgccccaagggcccagaccctg

SEQ ID NO: 6471042 - DNA, 19 bp, Homo sapiens
tgccccaaggggcccacaa

SEQ ID NO: 6471043 - DNA, 20 bp, Homo sapiens
tgccccaatcgggtccagag

SEQ ID NO: 6471044 - DNA, 18 bp, Homo sapiens
tgccccacaaggcccagc

SEQ ID NO: 6471045 - DNA, 17 bp, Homo sapiens
tgccccacacaggcctg

SEQ ID NO: 6471046 - DNA, 23 bp, Homo sapiens
tgccccacacaggcctggcccag

SEQ ID NO: 6471047 - DNA, 21 bp, Homo sapiens
tgccccacacggactcccggg

SEQ ID NO: 6471048 - DNA, 15 bp, Homo sapiens
tgccccacaggccac

SEQ ID NO: 6471049 - DNA, 19 bp, Homo sapiens
tgccccacaggccacacgc

SEQ ID NO: 6471050 - DNA, 11 bp, Homo sapiens
tgccccacagt

SEQ ID NO: 6471051 - DNA, 17 bp, Homo sapiens
tgccccacagttgtgtt

SEQ ID NO: 6471052 - DNA, 20 bp, Homo sapiens
tgccccacagttgtgttcat

SEQ ID NO: 6471053 - DNA, 22 bp, Homo sapiens
tgccccacatgtggccatggcc

SEQ ID NO: 6471054 - DNA, 15 bp, Homo sapiens
tgccccaccacgtct

SEQ ID NO: 6471055 - DNA, 13 bp, Homo sapiens
tgccccacccaag

SEQ ID NO: 6471056 - DNA, 13 bp, Homo sapiens
tgccccacccacc

SEQ ID NO: 6471057 - DNA, 14 bp, Homo sapiens
tgccccacccaccc

SEQ ID NO: 6471058 - DNA, 20 bp, Homo sapiens
tgccccacccaccccacaga

SEQ ID NO: 6471059 - DNA, 16 bp, Homo sapiens
tgccccacccacccct

SEQ ID NO: 6471060 - DNA, 15 bp, Homo sapiens
tgccccaccccacct

SEQ ID NO: 6471061 - DNA, 16 bp, Homo sapiens
tgccccaccccacctc

SEQ ID NO: 6471062 - DNA, 23 bp, Homo sapiens
tgccccaccccacctcacagcta

SEQ ID NO: 6471063 - DNA, 14 bp, Homo sapiens
tgccccacccccct

SEQ ID NO: 6471064 - DNA, 21 bp, Homo sapiens
tgccccacccccctcctcccc

SEQ ID NO: 6471065 - DNA, 23 bp, Homo sapiens
tgccccacccccctcctccccct

SEQ ID NO: 6471066 - DNA, 13 bp, Homo sapiens
tgccccaccctaa

SEQ ID NO: 6471067 - DNA, 13 bp, Homo sapiens
tgccccaccctca

SEQ ID NO: 6471068 - DNA, 14 bp, Homo sapiens
tgccccacctcccc

SEQ ID NO: 6471069 - DNA, 17 bp, Homo sapiens
tgccccacctccccaca

SEQ ID NO: 6471070 - DNA, 18 bp, Homo sapiens
tgccccacctccccacac

SEQ ID NO: 6471071 - DNA, 21 bp, Homo sapiens
tgccccacctcccccttcccc

SEQ ID NO: 6471072 - DNA, 18 bp, Homo sapiens
tgccccacctcccgccct

SEQ ID NO: 6471073 - DNA, 21 bp, Homo sapiens
tgccccacctcccgccctcac

SEQ ID NO: 6471074 - DNA, 16 bp, Homo sapiens
tgccccacctgccact

SEQ ID NO: 6471075 - DNA, 12 bp, Homo sapiens
tgccccaccttg

SEQ ID NO: 6471076 - DNA, 19 bp, Homo sapiens
tgccccacctttattaaaa

SEQ ID NO: 6471077 - DNA, 19 bp, Homo sapiens
tgccccacggagacagagg

SEQ ID NO: 6471078 - DNA, 17 bp, Homo sapiens
tgccccactccagcctg

SEQ ID NO: 6471079 - DNA, 18 bp, Homo sapiens
tgccccactccagcctgg

SEQ ID NO: 6471080 - DNA, 12 bp, Homo sapiens
tgccccactcct

SEQ ID NO: 6471081 - DNA, 15 bp, Homo sapiens
tgccccactctgcct

SEQ ID NO: 6471082 - DNA, 16 bp, Homo sapiens
tgccccactctgcctg

SEQ ID NO: 6471083 - DNA, 19 bp, Homo sapiens
tgccccactctgctgaggc

SEQ ID NO: 6471084 - DNA, 16 bp, Homo sapiens
tgccccacttctggcc

SEQ ID NO: 6471085 - DNA, 12 bp, Homo sapiens
tgccccagaaca

SEQ ID NO: 6471086 - DNA, 21 bp, Homo sapiens
tgccccagactgagctctcca

SEQ ID NO: 6471087 - DNA, 22 bp, Homo sapiens
tgccccagactgagctctccag

SEQ ID NO: 6471088 - DNA, 13 bp, Homo sapiens
tgccccagagccc

SEQ ID NO: 6471089 - DNA, 23 bp, Homo sapiens
tgccccagagctgtttatggcct

SEQ ID NO: 6471090 - DNA, 16 bp, Homo sapiens
tgccccagaggcctct

SEQ ID NO: 6471091 - DNA, 12 bp, Homo sapiens
tgccccagccaa

SEQ ID NO: 6471092 - DNA, 13 bp, Homo sapiens
tgccccagcccag

SEQ ID NO: 6471093 - DNA, 14 bp, Homo sapiens
tgccccagcccaga

SEQ ID NO: 6471094 - DNA, 14 bp, Homo sapiens
tgccccagcctccc

SEQ ID NO: 6471095 - DNA, 17 bp, Homo sapiens
tgccccagcctcccagc

SEQ ID NO: 6471096 - DNA, 12 bp, Homo sapiens
tgccccagctcc

SEQ ID NO: 6471097 - DNA, 14 bp, Homo sapiens
tgccccagctctgg

SEQ ID NO: 6471098 - DNA, 19 bp, Homo sapiens
tgccccagctctggcttcc

SEQ ID NO: 6471099 - DNA, 18 bp, Homo sapiens
tgccccagctgactgtgg

SEQ ID NO: 6471100 - DNA, 19 bp, Homo sapiens
tgccccagctgactgtggc

SEQ ID NO: 6471101 - DNA, 18 bp, Homo sapiens
tgccccagctgccaggcg

SEQ ID NO: 6471102 - DNA, 12 bp, Homo sapiens
tgccccagctgg

SEQ ID NO: 6471103 - DNA, 16 bp, Homo sapiens
tgccccagctgggctg

SEQ ID NO: 6471104 - DNA, 17 bp, Homo sapiens
tgccccaggactctggc

SEQ ID NO: 6471105 - DNA, 21 bp, Homo sapiens
tgccccaggatcactctctgc

SEQ ID NO: 6471106 - DNA, 14 bp, Homo sapiens
tgccccaggccagg

SEQ ID NO: 6471107 - DNA, 19 bp, Homo sapiens
tgccccaggccaggtagca

SEQ ID NO: 6471108 - DNA, 12 bp, Homo sapiens
tgccccaggccc

SEQ ID NO: 6471109 - DNA, 13 bp, Homo sapiens
tgccccaggccct

SEQ ID NO: 6471110 - DNA, 15 bp, Homo sapiens
tgccccaggccctac

SEQ ID NO: 6471111 - DNA, 12 bp, Homo sapiens
tgccccaggccg

SEQ ID NO: 6471112 - DNA, 14 bp, Homo sapiens
tgccccaggcctgg

SEQ ID NO: 6471113 - DNA, 15 bp, Homo sapiens
tgccccaggcctgga

SEQ ID NO: 6471114 - DNA, 18 bp, Homo sapiens
tgccccaggctcaggctg

SEQ ID NO: 6471115 - DNA, 23 bp, Homo sapiens
tgccccaggctcaggctgcccag

SEQ ID NO: 6471116 - DNA, 20 bp, Homo sapiens
tgccccagggagtccagggt

SEQ ID NO: 6471117 - DNA, 19 bp, Homo sapiens
tgccccagggcctgcttcc

SEQ ID NO: 6471118 - DNA, 15 bp, Homo sapiens
tgccccagggctccc

SEQ ID NO: 6471119 - DNA, 21 bp, Homo sapiens
tgccccagtcggccccatctc

SEQ ID NO: 6471120 - DNA, 16 bp, Homo sapiens
tgccccagtttggggt

SEQ ID NO: 6471121 - DNA, 23 bp, Homo sapiens
tgccccagtttggggtgccaaga

SEQ ID NO: 6471122 - DNA, 15 bp, Homo sapiens
tgccccatcagcagc

SEQ ID NO: 6471123 - DNA, 20 bp, Homo sapiens
tgccccatcagcagcttgac

SEQ ID NO: 6471124 - DNA, 21 bp, Homo sapiens
tgccccatcagtgctccctca

SEQ ID NO: 6471125 - DNA, 18 bp, Homo sapiens
tgccccatcctccagcag

SEQ ID NO: 6471126 - DNA, 19 bp, Homo sapiens
tgccccatcctccagcagg

SEQ ID NO: 6471127 - DNA, 16 bp, Homo sapiens
tgccccatcctgggcc

SEQ ID NO: 6471128 - DNA, 17 bp, Homo sapiens
tgccccatcctgggcct

SEQ ID NO: 6471129 - DNA, 18 bp, Homo sapiens
tgccccatcctgggcctt

SEQ ID NO: 6471130 - DNA, 18 bp, Homo sapiens
tctgaaaatttatataac

SEQ ID NO: 6471131 - DNA, 18 bp, Homo sapiens
tctgaaacacactgaaag

SEQ ID NO: 6471132 - DNA, 16 bp, Homo sapiens
tctgaaacagaaagtt

SEQ ID NO: 6471133 - DNA, 17 bp, Homo sapiens
tctgaaacagctgcctt

SEQ ID NO: 6471134 - DNA, 18 bp, Homo sapiens
tctgaaacatatttatag

SEQ ID NO: 6471135 - DNA, 15 bp, Homo sapiens
tctgaaaccttagtt

SEQ ID NO: 6471136 - DNA, 17 bp, Homo sapiens
tctgaaactaatgaaag

SEQ ID NO: 6471137 - DNA, 19 bp, Homo sapiens
tctgaaactcccttgtgtt

SEQ ID NO: 6471138 - DNA, 22 bp, Homo sapiens
tctgaaactcccttgtgttcct

SEQ ID NO: 6471139 - DNA, 23 bp, Homo sapiens
tctgaaactcccttgtgttcctt

SEQ ID NO: 6471140 - DNA, 14 bp, Homo sapiens
tctgaaacttaatt

SEQ ID NO: 6471141 - DNA, 20 bp, Homo sapiens
tctgaaacttcccaacttcc

SEQ ID NO: 6471142 - DNA, 15 bp, Homo sapiens
tctgaaagaatcatt

SEQ ID NO: 6471143 - DNA, 21 bp, Homo sapiens
tctgaaagacagaatgtcacc

SEQ ID NO: 6471144 - DNA, 18 bp, Homo sapiens
tctgaaagagctgtgggt

SEQ ID NO: 6471145 - DNA, 18 bp, Homo sapiens
tctgaaagagtctttctt

SEQ ID NO: 6471146 - DNA, 15 bp, Homo sapiens
tctgaaagctgcttc

SEQ ID NO: 6471147 - DNA, 13 bp, Homo sapiens
tctgaaaggaaaa

SEQ ID NO: 6471148 - DNA, 13 bp, Homo sapiens
tctgaaaggaaat

SEQ ID NO: 6471149 - DNA, 17 bp, Homo sapiens
tctgaaaggaaatacac

SEQ ID NO: 6471150 - DNA, 14 bp, Homo sapiens
tctgaaaggccagc

SEQ ID NO: 6471151 - DNA, 15 bp, Homo sapiens
tctgaaaggccagca

SEQ ID NO: 6471152 - DNA, 18 bp, Homo sapiens
tctgaaaggccagcagct

SEQ ID NO: 6471153 - DNA, 21 bp, Homo sapiens
tctgaaagtattcacatcatt

SEQ ID NO: 6471154 - DNA, 21 bp, Homo sapiens
tctgaaagttgtacatgaaat

SEQ ID NO: 6471155 - DNA, 23 bp, Homo sapiens
tctgaaataaaatgccatagttt

SEQ ID NO: 6471156 - DNA, 21 bp, Homo sapiens
tctgaaatacaaccagaaaca

SEQ ID NO: 6471157 - DNA, 18 bp, Homo sapiens
tctgaaatacctttgcct

SEQ ID NO: 6471158 - DNA, 17 bp, Homo sapiens
tctgaaataggaaacaa

SEQ ID NO: 6471159 - DNA, 20 bp, Homo sapiens
tctgaaataggaaacaagtg

SEQ ID NO: 6471160 - DNA, 23 bp, Homo sapiens
tctgaaatccataaactaagaga

SEQ ID NO: 6471161 - DNA, 16 bp, Homo sapiens
tctgaaatctgaagac

SEQ ID NO: 6471162 - DNA, 22 bp, Homo sapiens
tctgaaatcttcccatgcattc

SEQ ID NO: 6471163 - DNA, 15 bp, Homo sapiens
tctgaaatgttacaa

SEQ ID NO: 6471164 - DNA, 12 bp, Homo sapiens
tctgaaattaaa

SEQ ID NO: 6471165 - DNA, 19 bp, Homo sapiens
tctgaaattaaagaaatga

SEQ ID NO: 6471166 - DNA, 19 bp, Homo sapiens
tctgaaattaggaaagtac

SEQ ID NO: 6471167 - DNA, 16 bp, Homo sapiens
tctgaaatttcccaca

SEQ ID NO: 6471168 - DNA, 18 bp, Homo sapiens
tctgaaatttcctgggag

SEQ ID NO: 6471169 - DNA, 20 bp, Homo sapiens
tctgaaatttcctgggagct

SEQ ID NO: 6471170 - DNA, 18 bp, Homo sapiens
tctgaaattttctagaat

SEQ ID NO: 6471171 - DNA, 15 bp, Homo sapiens
tctgaaatttttctt

SEQ ID NO: 6471172 - DNA, 20 bp, Homo sapiens
tctgaaatttttcttcttga

SEQ ID NO: 6471173 - DNA, 17 bp, Homo sapiens
tctgaacaaaaactgta

SEQ ID NO: 6471174 - DNA, 16 bp, Homo sapiens
tctgaacaaaagcagg

SEQ ID NO: 6471175 - DNA, 22 bp, Homo sapiens
tctgaacaattgtggtctctct

SEQ ID NO: 6471176 - DNA, 20 bp, Homo sapiens
tctgaacaatttagggactc

SEQ ID NO: 6471177 - DNA, 13 bp, Homo sapiens
tctgaacacacac

SEQ ID NO: 6471178 - DNA, 20 bp, Homo sapiens
tctgaacacacacgccagct

SEQ ID NO: 6471179 - DNA, 16 bp, Homo sapiens
tctgaacacaggcagc

SEQ ID NO: 6471180 - DNA, 13 bp, Homo sapiens
tctgaacacattg

SEQ ID NO: 6471181 - DNA, 12 bp, Homo sapiens
tctgaacagctg

SEQ ID NO: 6471182 - DNA, 17 bp, Homo sapiens
tctgaacagctggtgta

SEQ ID NO: 6471183 - DNA, 12 bp, Homo sapiens
tctgaacatctg

SEQ ID NO: 6471184 - DNA, 17 bp, Homo sapiens
tctgaaccacctttgtc

SEQ ID NO: 6471185 - DNA, 14 bp, Homo sapiens
tctgaacccaggca

SEQ ID NO: 6471186 - DNA, 19 bp, Homo sapiens
tctgaacccaggcagctgg

SEQ ID NO: 6471187 - DNA, 22 bp, Homo sapiens
tctgaacccttgtgcttggtgg

SEQ ID NO: 6471188 - DNA, 15 bp, Homo sapiens
tctgaactagttgag

SEQ ID NO: 6471189 - DNA, 22 bp, Homo sapiens
tctgaactcacagactgctgtc

SEQ ID NO: 6471190 - DNA, 17 bp, Homo sapiens
tctgaactcgcttctct

SEQ ID NO: 6471191 - DNA, 13 bp, Homo sapiens
tctgaactctaag

SEQ ID NO: 6471192 - DNA, 17 bp, Homo sapiens
tctgaactctaagcaga

SEQ ID NO: 6471193 - DNA, 13 bp, Homo sapiens
tctgaactctcaa

SEQ ID NO: 6471194 - DNA, 19 bp, Homo sapiens
tctgaactgcaacactgga

SEQ ID NO: 6471195 - DNA, 14 bp, Homo sapiens
tctgaactggagcc

SEQ ID NO: 6471196 - DNA, 15 bp, Homo sapiens
tctgaactggagctg

SEQ ID NO: 6471197 - DNA, 18 bp, Homo sapiens
tctgaactggagctgcta

SEQ ID NO: 6471198 - DNA, 12 bp, Homo sapiens
tctgaactttgg

SEQ ID NO: 6471199 - DNA, 15 bp, Homo sapiens
tctgaactttggaga

SEQ ID NO: 6471200 - DNA, 23 bp, Homo sapiens
tctgaacttttaatgaactttga

SEQ ID NO: 6471201 - DNA, 20 bp, Homo sapiens
tctgaagaaggaaggcctga

SEQ ID NO: 6471202 - DNA, 15 bp, Homo sapiens
tctgaagaagttaat

SEQ ID NO: 6471203 - DNA, 22 bp, Homo sapiens
tctgaagacctcgagcagatga

SEQ ID NO: 6471204 - DNA, 22 bp, Homo sapiens
tctgaagacctttaatggcttc

SEQ ID NO: 6471205 - DNA, 17 bp, Homo sapiens
tctgaagagtatccttc

SEQ ID NO: 6471206 - DNA, 19 bp, Homo sapiens
tctgaagagtatccttcct

SEQ ID NO: 6471207 - DNA, 22 bp, Homo sapiens
tctgaagagtatccttccttca

SEQ ID NO: 6471208 - DNA, 15 bp, Homo sapiens
tctgaagagtatttg

SEQ ID NO: 6471209 - DNA, 15 bp, Homo sapiens
tctgaagatatattt

SEQ ID NO: 6471210 - DNA, 19 bp, Homo sapiens
tctgaagatcaatttctcc

SEQ ID NO: 6471211 - DNA, 23 bp, Homo sapiens
tctgaagatcccaacatggtcct

SEQ ID NO: 6471212 - DNA, 17 bp, Homo sapiens
tctgaagattgaaaaaa

SEQ ID NO: 6471213 - DNA, 22 bp, Homo sapiens
tctgaagattgaaaaaaataaa

SEQ ID NO: 6471214 - DNA, 19 bp, Homo sapiens
tctgaagattgtttatcta

SEQ ID NO: 6471215 - DNA, 16 bp, Homo sapiens
tctgaagcaagagtga

SEQ ID NO: 6471216 - DNA, 12 bp, Homo sapiens
tctgaagcagat

SEQ ID NO: 6471217 - DNA, 20 bp, Homo sapiens
tctgaagcatgtttcatgtt

SEQ ID NO: 6471218 - DNA, 15 bp, Homo sapiens
tctgaagccacctct

SEQ ID NO: 6471219 - DNA, 23 bp, Homo sapiens
tctgaagcccaaagcctgaggac

SEQ ID NO: 6471220 - DNA, 16 bp, Homo sapiens
tctgaagccctcccag

SEQ ID NO: 6471221 - DNA, 21 bp, Homo sapiens
tctgaagcctctaacaaatga

SEQ ID NO: 6471222 - DNA, 16 bp, Homo sapiens
tctgaagcctctggga

SEQ ID NO: 6471223 - DNA, 15 bp, Homo sapiens
tctgaagcctgcagg

SEQ ID NO: 6471224 - DNA, 13 bp, Homo sapiens
tctgaagcctttt

SEQ ID NO: 6471225 - DNA, 21 bp, Homo sapiens
tctgaagcgtgattttaaaat

SEQ ID NO: 6471226 - DNA, 13 bp, Homo sapiens
tctgaagctagag

SEQ ID NO: 6471227 - DNA, 15 bp, Homo sapiens
tctgaagctagagga

SEQ ID NO: 6471228 - DNA, 16 bp, Homo sapiens
tctgaagctattgatg

SEQ ID NO: 6471229 - DNA, 20 bp, Homo sapiens
tctgaagctgacgaacttcc

SEQ ID NO: 6471230 - DNA, 13 bp, Homo sapiens
tctgaaggaagag

SEQ ID NO: 6471231 - DNA, 19 bp, Homo sapiens
tctgaaggaagagaagaca

SEQ ID NO: 6471232 - DNA, 20 bp, Homo sapiens
tctgaaggaatagccagaga

SEQ ID NO: 6471233 - DNA, 21 bp, Homo sapiens
tctgaaggaatagccagagag

SEQ ID NO: 6471234 - DNA, 19 bp, Homo sapiens
tctgaaggacacttcctgc

SEQ ID NO: 6471235 - DNA, 21 bp, Homo sapiens
tctgaaggacacttcctgcct

SEQ ID NO: 6471236 - DNA, 17 bp, Homo sapiens
tctgaaggaggccacct

SEQ ID NO: 6471237 - DNA, 18 bp, Homo sapiens
tctgaaggaggccacctc

SEQ ID NO: 6471238 - DNA, 20 bp, Homo sapiens
tctgaaggaggccacctcct

SEQ ID NO: 6471239 - DNA, 23 bp, Homo sapiens
tctgaaggatcctggaaccactg

SEQ ID NO: 6471240 - DNA, 17 bp, Homo sapiens
tctgaaggcaaatataa

SEQ ID NO: 6471241 - DNA, 13 bp, Homo sapiens
tctgaagggaggg

SEQ ID NO: 6471242 - DNA, 20 bp, Homo sapiens
tctgaagggcatacaatgaa

SEQ ID NO: 6471243 - DNA, 22 bp, Homo sapiens
tctgaaggggaaaacctcagtt

SEQ ID NO: 6471244 - DNA, 20 bp, Homo sapiens
tctgaagggtaattatatag

SEQ ID NO: 6471245 - DNA, 13 bp, Homo sapiens
tctgaagtaattt

SEQ ID NO: 6471246 - DNA, 16 bp, Homo sapiens
tctgaagtacaaacat

SEQ ID NO: 6471247 - DNA, 19 bp, Homo sapiens
tctgaagtacaaacatgaa

SEQ ID NO: 6471248 - DNA, 21 bp, Homo sapiens
tctgaagtacaaacatgaaaa

SEQ ID NO: 6471249 - DNA, 19 bp, Homo sapiens
tctgaagtatgaagtctga

SEQ ID NO: 6471250 - DNA, 22 bp, Homo sapiens
tctgaagtcacatcacaggaca

SEQ ID NO: 6471251 - DNA, 19 bp, Homo sapiens
tctgaagtcagatctgcct

SEQ ID NO: 6471252 - DNA, 22 bp, Homo sapiens
tctgaagtcccttcctgtcctg

SEQ ID NO: 6471253 - DNA, 23 bp, Homo sapiens
tctgaagtctcaagaactgccat

SEQ ID NO: 6471254 - DNA, 18 bp, Homo sapiens
tctgaagtctggaacact

SEQ ID NO: 6471255 - DNA, 20 bp, Homo sapiens
tctgaagtctggaacacttt

SEQ ID NO: 6471256 - DNA, 16 bp, Homo sapiens
tctgaagtgaaactgc

SEQ ID NO: 6471257 - DNA, 18 bp, Homo sapiens
tctgaagtgaaactgctt

SEQ ID NO: 6471258 - DNA, 22 bp, Homo sapiens
tctgaagtgcctactggggggc

SEQ ID NO: 6471259 - DNA, 13 bp, Homo sapiens
tctgaagtgcttg

SEQ ID NO: 6471260 - DNA, 18 bp, Homo sapiens
tctgaagtgggaaaaaat

SEQ ID NO: 6471261 - DNA, 20 bp, Homo sapiens
tctgaagtgtcctaaatatt

SEQ ID NO: 6471262 - DNA, 20 bp, Homo sapiens
tctgaagtgtgtccatcctg

SEQ ID NO: 6471263 - DNA, 14 bp, Homo sapiens
tctgaagttggaca

SEQ ID NO: 6471264 - DNA, 17 bp, Homo sapiens
tctgaagtttcatttat

SEQ ID NO: 6471265 - DNA, 18 bp, Homo sapiens
tctgaagtttcatttatg

SEQ ID NO: 6471266 - DNA, 17 bp, Homo sapiens
tctgaataaagcaatta

SEQ ID NO: 6471267 - DNA, 18 bp, Homo sapiens
tctgaataaagtgtaaca

SEQ ID NO: 6471268 - DNA, 16 bp, Homo sapiens
tctgaataacactgga

SEQ ID NO: 6471269 - DNA, 16 bp, Homo sapiens
tctgaataatttctta

SEQ ID NO: 6471270 - DNA, 23 bp, Homo sapiens
tctgaatagttaaaaattaaata

SEQ ID NO: 6471271 - DNA, 16 bp, Homo sapiens
tctgaatattaaagct

SEQ ID NO: 6471272 - DNA, 19 bp, Homo sapiens
tctgaatattaagaaacaa

SEQ ID NO: 6471273 - DNA, 21 bp, Homo sapiens
tctgaatattaagaaacaatt

SEQ ID NO: 6471274 - DNA, 15 bp, Homo sapiens
tctgaatattctaga

SEQ ID NO: 6471275 - DNA, 12 bp, Homo sapiens
tctgaatatttt

SEQ ID NO: 6471276 - DNA, 15 bp, Homo sapiens
tctgaatcaccaatt

SEQ ID NO: 6471277 - DNA, 18 bp, Homo sapiens
tctgaatcaccaattaaa

SEQ ID NO: 6471278 - DNA, 13 bp, Homo sapiens
tctgaatcactgt

SEQ ID NO: 6471279 - DNA, 15 bp, Homo sapiens
tctgaatcagaaaag

SEQ ID NO: 6471280 - DNA, 17 bp, Homo sapiens
tctgaatcagaaaagct

SEQ ID NO: 6471281 - DNA, 22 bp, Homo sapiens
tctgaatcctgttaaattttct

SEQ ID NO: 6471282 - DNA, 23 bp, Homo sapiens
tctgaatcctgttaaattttctc

SEQ ID NO: 6471283 - DNA, 15 bp, Homo sapiens
tctgaatccttagaa

SEQ ID NO: 6471284 - DNA, 18 bp, Homo sapiens
tctgaatctagagaacag

SEQ ID NO: 6471285 - DNA, 19 bp, Homo sapiens
tctgaatctcaagatgggg

SEQ ID NO: 6471286 - DNA, 20 bp, Homo sapiens
tctgaatctctcaaaatgtg

SEQ ID NO: 6471287 - DNA, 22 bp, Homo sapiens
tctgaatctgataggaaaagaa

SEQ ID NO: 6471288 - DNA, 15 bp, Homo sapiens
tctgaatctgtacat

SEQ ID NO: 6471289 - DNA, 15 bp, Homo sapiens
tctgaatcttctgaa

SEQ ID NO: 6471290 - DNA, 17 bp, Homo sapiens
tctgaatgaaaataact

SEQ ID NO: 6471291 - DNA, 18 bp, Homo sapiens
tctgaatgaaaataactg

SEQ ID NO: 6471292 - DNA, 20 bp, Homo sapiens
tctgaatgaaaataactgaa

SEQ ID NO: 6471293 - DNA, 16 bp, Homo sapiens
tctgaatgaagccttc

SEQ ID NO: 6471294 - DNA, 17 bp, Homo sapiens
tctgaatgaagccttct

SEQ ID NO: 6471295 - DNA, 15 bp, Homo sapiens
tctgaatgaataaag

SEQ ID NO: 6471296 - DNA, 17 bp, Homo sapiens
tctgaatgatcttgtgt

SEQ ID NO: 6471297 - DNA, 21 bp, Homo sapiens
tctgaatgctgagctgaagaa

SEQ ID NO: 6471298 - DNA, 16 bp, Homo sapiens
tctgaatgggagccag

SEQ ID NO: 6471299 - DNA, 23 bp, Homo sapiens
tctgaatgggagccagaattcac

SEQ ID NO: 6471300 - DNA, 12 bp, Homo sapiens
tctgaatgtaat

SEQ ID NO: 6471301 - DNA, 16 bp, Homo sapiens
tctgaatgtaatttgt

SEQ ID NO: 6471302 - DNA, 16 bp, Homo sapiens
tctgaatgtacacttt

SEQ ID NO: 6471303 - DNA, 23 bp, Homo sapiens
tctgaatgtagacggaacagtgt

SEQ ID NO: 6471304 - DNA, 19 bp, Homo sapiens
tctgaatgtattatcctgt

SEQ ID NO: 6471305 - DNA, 19 bp, Homo sapiens
tctgaatgtatttatgtgt

SEQ ID NO: 6471306 - DNA, 17 bp, Homo sapiens
tctgaatgtcccagagg

SEQ ID NO: 6471307 - DNA, 19 bp, Homo sapiens
tgccccatctcccctcagc

SEQ ID NO: 6471308 - DNA, 21 bp, Homo sapiens
tgccccatctcccctcagctc

SEQ ID NO: 6471309 - DNA, 22 bp, Homo sapiens
tgccccatctcctcccatggcc

SEQ ID NO: 6471310 - DNA, 20 bp, Homo sapiens
tgccccatgataaaataagt

SEQ ID NO: 6471311 - DNA, 12 bp, Homo sapiens
tgccccatgtgt

SEQ ID NO: 6471312 - DNA, 15 bp, Homo sapiens
tgccccattccttgc

SEQ ID NO: 6471313 - DNA, 22 bp, Homo sapiens
tgccccattccttgcgcctcag

SEQ ID NO: 6471314 - DNA, 12 bp, Homo sapiens
tgccccattctt

SEQ ID NO: 6471315 - DNA, 16 bp, Homo sapiens
tgcccccaaaagtgtc

SEQ ID NO: 6471316 - DNA, 20 bp, Homo sapiens
tgcccccaaagcccatgccc

SEQ ID NO: 6471317 - DNA, 14 bp, Homo sapiens
tgcccccaacactc

SEQ ID NO: 6471318 - DNA, 18 bp, Homo sapiens
tgcccccaacactccagg

SEQ ID NO: 6471319 - DNA, 20 bp, Homo sapiens
tgcccccaacactccaggcc

SEQ ID NO: 6471320 - DNA, 21 bp, Homo sapiens
tgcccccaaccatttcctcag

SEQ ID NO: 6471321 - DNA, 16 bp, Homo sapiens
tgcccccaatttccca

SEQ ID NO: 6471322 - DNA, 12 bp, Homo sapiens
tgcccccacacc

SEQ ID NO: 6471323 - DNA, 19 bp, Homo sapiens
tgcccccacacccactcca

SEQ ID NO: 6471324 - DNA, 22 bp, Homo sapiens
tgcccccacacctggccctggg

SEQ ID NO: 6471325 - DNA, 11 bp, Homo sapiens
tgcccccacag

SEQ ID NO: 6471326 - DNA, 18 bp, Homo sapiens
tgcccccacagatccatc

SEQ ID NO: 6471327 - DNA, 12 bp, Homo sapiens
tgcccccacagc

SEQ ID NO: 6471328 - DNA, 21 bp, Homo sapiens
tgcccccaccacggccactgg

SEQ ID NO: 6471329 - DNA, 13 bp, Homo sapiens
tgcccccacccca

SEQ ID NO: 6471330 - DNA, 19 bp, Homo sapiens
tgcccccacccccaccctc

SEQ ID NO: 6471331 - DNA, 24 bp, Homo sapiens
tgcccccaccccttcctgtctcac

SEQ ID NO: 6471332 - DNA, 20 bp, Homo sapiens
tgcccccaccctgcttctgc

SEQ ID NO: 6471333 - DNA, 13 bp, Homo sapiens
tgcccccacctct

SEQ ID NO: 6471334 - DNA, 15 bp, Homo sapiens
tgcccccacctctgg

SEQ ID NO: 6471335 - DNA, 18 bp, Homo sapiens
tgcccccacctctggtcc

SEQ ID NO: 6471336 - DNA, 17 bp, Homo sapiens
tgcccccactgaccaga

SEQ ID NO: 6471337 - DNA, 18 bp, Homo sapiens
tgcccccagaaagcctcc

SEQ ID NO: 6471338 - DNA, 20 bp, Homo sapiens
tgcccccagaaagcctcctg

SEQ ID NO: 6471339 - DNA, 19 bp, Homo sapiens
tgcccccagaccccatcca

SEQ ID NO: 6471340 - DNA, 21 bp, Homo sapiens
tgcccccagagtgtagggggc

SEQ ID NO: 6471341 - DNA, 15 bp, Homo sapiens
tgcccccagcactcc

SEQ ID NO: 6471342 - DNA, 17 bp, Homo sapiens
tgcccccagcactcctc

SEQ ID NO: 6471343 - DNA, 14 bp, Homo sapiens
tgcccccagcccaa

SEQ ID NO: 6471344 - DNA, 20 bp, Homo sapiens
tgcccccagccccggggtga

SEQ ID NO: 6471345 - DNA, 17 bp, Homo sapiens
tgcccccagcctcagcc

SEQ ID NO: 6471346 - DNA, 16 bp, Homo sapiens
tgcccccagcctctgt

SEQ ID NO: 6471347 - DNA, 11 bp, Homo sapiens
tgcccccagcg

SEQ ID NO: 6471348 - DNA, 15 bp, Homo sapiens
tgcccccagcgtggg

SEQ ID NO: 6471349 - DNA, 12 bp, Homo sapiens
tgcccccaggac

SEQ ID NO: 6471350 - DNA, 13 bp, Homo sapiens
tgcccccaggact

SEQ ID NO: 6471351 - DNA, 15 bp, Homo sapiens
tgcccccaggcagcc

SEQ ID NO: 6471352 - DNA, 17 bp, Homo sapiens
tgcccccaggcagccac

SEQ ID NO: 6471353 - DNA, 18 bp, Homo sapiens
tgcccccaggcagccacc

SEQ ID NO: 6471354 - DNA, 22 bp, Homo sapiens
tgcccccaggcagccaccagtg

SEQ ID NO: 6471355 - DNA, 14 bp, Homo sapiens
tgcccccagggcac

SEQ ID NO: 6471356 - DNA, 21 bp, Homo sapiens
tgcccccagggtcctgggagg

SEQ ID NO: 6471357 - DNA, 15 bp, Homo sapiens
tgcccccatccagcc

SEQ ID NO: 6471358 - DNA, 16 bp, Homo sapiens
tgcccccatccagcca

SEQ ID NO: 6471359 - DNA, 14 bp, Homo sapiens
tgcccccatccctc

SEQ ID NO: 6471360 - DNA, 15 bp, Homo sapiens
tgcccccatccctcg

SEQ ID NO: 6471361 - DNA, 19 bp, Homo sapiens
tgcccccatctccccaggc

SEQ ID NO: 6471362 - DNA, 21 bp, Homo sapiens
tgcccccatggggtccttgga

SEQ ID NO: 6471363 - DNA, 13 bp, Homo sapiens
tgcccccattccc

SEQ ID NO: 6471364 - DNA, 18 bp, Homo sapiens
tgcccccattctcccagt

SEQ ID NO: 6471365 - DNA, 15 bp, Homo sapiens
tgcccccatttctga

SEQ ID NO: 6471366 - DNA, 15 bp, Homo sapiens
tgccccccagcctct

SEQ ID NO: 6471367 - DNA, 13 bp, Homo sapiens
tgccccccagggc

SEQ ID NO: 6471368 - DNA, 16 bp, Homo sapiens
tgccccccagggctag

SEQ ID NO: 6471369 - DNA, 14 bp, Homo sapiens
tgccccccagtctc

SEQ ID NO: 6471370 - DNA, 18 bp, Homo sapiens
tgccccccatcctggccc

SEQ ID NO: 6471371 - DNA, 17 bp, Homo sapiens
tgccccccatgccctcc

SEQ ID NO: 6471372 - DNA, 20 bp, Homo sapiens
tgccccccatgccctccctg

SEQ ID NO: 6471373 - DNA, 18 bp, Homo sapiens
tgccccccctaagagaca

SEQ ID NO: 6471374 - DNA, 18 bp, Homo sapiens
tgccccccgaggctgcta

SEQ ID NO: 6471375 - DNA, 19 bp, Homo sapiens
tgccccccgaggctgctag

SEQ ID NO: 6471376 - DNA, 13 bp, Homo sapiens
tgcccccctccca

SEQ ID NO: 6471377 - DNA, 13 bp, Homo sapiens
tgcccccctcctc

SEQ ID NO: 6471378 - DNA, 16 bp, Homo sapiens
tgcccccctcctcccc

SEQ ID NO: 6471379 - DNA, 17 bp, Homo sapiens
tgcccccctcctccccg

SEQ ID NO: 6471380 - DNA, 19 bp, Homo sapiens
tgccccccttcccacccct

SEQ ID NO: 6471381 - DNA, 18 bp, Homo sapiens
tgccccccttgccagaca

SEQ ID NO: 6471382 - DNA, 17 bp, Homo sapiens
tgcccccgacagcccag

SEQ ID NO: 6471383 - DNA, 19 bp, Homo sapiens
tgcccccgacggctgtgac

SEQ ID NO: 6471384 - DNA, 21 bp, Homo sapiens
tgcccccgcatcccctgcctc

SEQ ID NO: 6471385 - DNA, 19 bp, Homo sapiens
tgcccccgccacctcccca

SEQ ID NO: 6471386 - DNA, 13 bp, Homo sapiens
tgcccccgcctgc

SEQ ID NO: 6471387 - DNA, 16 bp, Homo sapiens
tgcccccgcctgccac

SEQ ID NO: 6471388 - DNA, 22 bp, Homo sapiens
tgcccccgctcatgggcccctc

SEQ ID NO: 6471389 - DNA, 23 bp, Homo sapiens
tgcccccgctctgccatcagccc

SEQ ID NO: 6471390 - DNA, 16 bp, Homo sapiens
tgcccccgcttagccc

SEQ ID NO: 6471391 - DNA, 15 bp, Homo sapiens
tgcccccggccccct

SEQ ID NO: 6471392 - DNA, 21 bp, Homo sapiens
tgcccccggccccctggtctc

SEQ ID NO: 6471393 - DNA, 20 bp, Homo sapiens
tgcccccgtcttctctccat

SEQ ID NO: 6471394 - DNA, 17 bp, Homo sapiens
tgcccccgttccagctg

SEQ ID NO: 6471395 - DNA, 21 bp, Homo sapiens
tgccccctaatccccttctcc

SEQ ID NO: 6471396 - DNA, 16 bp, Homo sapiens
tgccccctcacctctc

SEQ ID NO: 6471397 - DNA, 18 bp, Homo sapiens
tgccccctccaggagaga

SEQ ID NO: 6471398 - DNA, 23 bp, Homo sapiens
tgccccctcccactcttgaagag

SEQ ID NO: 6471399 - DNA, 14 bp, Homo sapiens
tgccccctccccca

SEQ ID NO: 6471400 - DNA, 21 bp, Homo sapiens
tgccccctcccccatgggctg

SEQ ID NO: 6471401 - DNA, 21 bp, Homo sapiens
tgccccctcccccgcagacag

SEQ ID NO: 6471402 - DNA, 22 bp, Homo sapiens
tgccccctcccccgcagacaga

SEQ ID NO: 6471403 - DNA, 14 bp, Homo sapiens
tgccccctcccctc

SEQ ID NO: 6471404 - DNA, 16 bp, Homo sapiens
tgccccctcccttcac

SEQ ID NO: 6471405 - DNA, 21 bp, Homo sapiens
tgccccctcctctcccatccc

SEQ ID NO: 6471406 - DNA, 22 bp, Homo sapiens
tgccccctccttttcccactgg

SEQ ID NO: 6471407 - DNA, 14 bp, Homo sapiens
tgccccctctgccc

SEQ ID NO: 6471408 - DNA, 22 bp, Homo sapiens
tgccccctgcagaaccggagag

SEQ ID NO: 6471409 - DNA, 16 bp, Homo sapiens
tgccccctgcaggaag

SEQ ID NO: 6471410 - DNA, 17 bp, Homo sapiens
tgccccctgcaggaagg

SEQ ID NO: 6471411 - DNA, 21 bp, Homo sapiens
tgccccctgcaggaaggagct

SEQ ID NO: 6471412 - DNA, 22 bp, Homo sapiens
tgccccctgcaggaaggagctg

SEQ ID NO: 6471413 - DNA, 15 bp, Homo sapiens
tgccccctgccagcc

SEQ ID NO: 6471414 - DNA, 18 bp, Homo sapiens
tgccccctgccagtgaag

SEQ ID NO: 6471415 - DNA, 14 bp, Homo sapiens
tgccccctgctggc

SEQ ID NO: 6471416 - DNA, 16 bp, Homo sapiens
tgccccctgctggctc

SEQ ID NO: 6471417 - DNA, 18 bp, Homo sapiens
tgccccctgcttggccag

SEQ ID NO: 6471418 - DNA, 16 bp, Homo sapiens
tgccccctgggctggg

SEQ ID NO: 6471419 - DNA, 13 bp, Homo sapiens
tgccccctggtgg

SEQ ID NO: 6471420 - DNA, 22 bp, Homo sapiens
tgccccctggtggacagtcctg

SEQ ID NO: 6471421 - DNA, 13 bp, Homo sapiens
tgccccctgtgga

SEQ ID NO: 6471422 - DNA, 21 bp, Homo sapiens
tgccccctgtggatgctgctg

SEQ ID NO: 6471423 - DNA, 12 bp, Homo sapiens
tgcccccttccc

SEQ ID NO: 6471424 - DNA, 20 bp, Homo sapiens
tgcccccttctcccacactg

SEQ ID NO: 6471425 - DNA, 19 bp, Homo sapiens
tgccccctttgaccttccc

SEQ ID NO: 6471426 - DNA, 23 bp, Homo sapiens
tgccccgaccccacctgaggcag

SEQ ID NO: 6471427 - DNA, 16 bp, Homo sapiens
tgccccgacccgggtc

SEQ ID NO: 6471428 - DNA, 15 bp, Homo sapiens
tgccccgactgtggg

SEQ ID NO: 6471429 - DNA, 20 bp, Homo sapiens
tgccccgagcccaggcagct

SEQ ID NO: 6471430 - DNA, 22 bp, Homo sapiens
tgccccgccatggtcaccctca

SEQ ID NO: 6471431 - DNA, 23 bp, Homo sapiens
tgccccgccatggtcaccctcag

SEQ ID NO: 6471432 - DNA, 15 bp, Homo sapiens
tgccccgccccccag

SEQ ID NO: 6471433 - DNA, 18 bp, Homo sapiens
tgccccgcctgagtcagt

SEQ ID NO: 6471434 - DNA, 23 bp, Homo sapiens
tgccccgccttcgtgtgctgctg

SEQ ID NO: 6471435 - DNA, 17 bp, Homo sapiens
tgccccgcttccccaca

SEQ ID NO: 6471436 - DNA, 18 bp, Homo sapiens
tgccccgcttccccacag

SEQ ID NO: 6471437 - DNA, 14 bp, Homo sapiens
tgccccggaggaag

SEQ ID NO: 6471438 - DNA, 14 bp, Homo sapiens
tgccccggccacct

SEQ ID NO: 6471439 - DNA, 15 bp, Homo sapiens
tgccccggccacctc

SEQ ID NO: 6471440 - DNA, 15 bp, Homo sapiens
tgccccggccactct

SEQ ID NO: 6471441 - DNA, 21 bp, Homo sapiens
tgccccggccactctgtttgc

SEQ ID NO: 6471442 - DNA, 21 bp, Homo sapiens
tgccccggcccaacctcgccc

SEQ ID NO: 6471443 - DNA, 17 bp, Homo sapiens
tgccccggcccctcccc

SEQ ID NO: 6471444 - DNA, 19 bp, Homo sapiens
tgccccgggatattataga

SEQ ID NO: 6471445 - DNA, 17 bp, Homo sapiens
tgccccgggtccccagc

SEQ ID NO: 6471446 - DNA, 18 bp, Homo sapiens
tgccccgggtccccagct

SEQ ID NO: 6471447 - DNA, 19 bp, Homo sapiens
tgccccgggtccccagctc

SEQ ID NO: 6471448 - DNA, 17 bp, Homo sapiens
tgccccgtcaccatctc

SEQ ID NO: 6471449 - DNA, 20 bp, Homo sapiens
tgccccgtcaccatctcagg

SEQ ID NO: 6471450 - DNA, 16 bp, Homo sapiens
tgccccgtccccctct

SEQ ID NO: 6471451 - DNA, 20 bp, Homo sapiens
tgccccgtcccctgggccac

SEQ ID NO: 6471452 - DNA, 20 bp, Homo sapiens
tgccccgtctacagctcccc

SEQ ID NO: 6471453 - DNA, 21 bp, Homo sapiens
tgccccgtgcagactggaggg

SEQ ID NO: 6471454 - DNA, 22 bp, Homo sapiens
tgcccctaaagagcatcctgat

SEQ ID NO: 6471455 - DNA, 22 bp, Homo sapiens
tgcccctaagttattacctctc

SEQ ID NO: 6471456 - DNA, 18 bp, Homo sapiens
tgcccctaatctctgtag

SEQ ID NO: 6471457 - DNA, 20 bp, Homo sapiens
tgcccctaatctctgtagga

SEQ ID NO: 6471458 - DNA, 21 bp, Homo sapiens
tgcccctaatctctgtaggaa

SEQ ID NO: 6471459 - DNA, 21 bp, Homo sapiens
tgcccctacgggcgctgcagc

SEQ ID NO: 6471460 - DNA, 23 bp, Homo sapiens
tgcccctacgggcgctgcagcct

SEQ ID NO: 6471461 - DNA, 23 bp, Homo sapiens
tgcccctagcttagagcctccct

SEQ ID NO: 6471462 - DNA, 18 bp, Homo sapiens
tgcccctaggatgctgca

SEQ ID NO: 6471463 - DNA, 21 bp, Homo sapiens
tgcccctaggatgctgcagca

SEQ ID NO: 6471464 - DNA, 17 bp, Homo sapiens
tgcccctagggtccctc

SEQ ID NO: 6471465 - DNA, 20 bp, Homo sapiens
tgcccctagtaactgctgtc

SEQ ID NO: 6471466 - DNA, 22 bp, Homo sapiens
tgcccctattagctcttttctt

SEQ ID NO: 6471467 - DNA, 12 bp, Homo sapiens
tgcccctcacct

SEQ ID NO: 6471468 - DNA, 21 bp, Homo sapiens
tgcccctcatttatcactctg

SEQ ID NO: 6471469 - DNA, 19 bp, Homo sapiens
tgcccctcccatggcccag

SEQ ID NO: 6471470 - DNA, 20 bp, Homo sapiens
tgcccctcccatggcccagc

SEQ ID NO: 6471471 - DNA, 21 bp, Homo sapiens
tgcccctcccatggcccagca

SEQ ID NO: 6471472 - DNA, 17 bp, Homo sapiens
tgcccctccccagccct

SEQ ID NO: 6471473 - DNA, 23 bp, Homo sapiens
tgcccctcccccaacccccaccc

SEQ ID NO: 6471474 - DNA, 19 bp, Homo sapiens
tgcccctcccccagctgcg

SEQ ID NO: 6471475 - DNA, 22 bp, Homo sapiens
tgcccctccccgtccctgtccc

SEQ ID NO: 6471476 - DNA, 12 bp, Homo sapiens
tgcccctcccct

SEQ ID NO: 6471477 - DNA, 22 bp, Homo sapiens
tgcccctccctagatccaggct

SEQ ID NO: 6471478 - DNA, 14 bp, Homo sapiens
tgcccctccctgcc

SEQ ID NO: 6471479 - DNA, 23 bp, Homo sapiens
tgcccctccctgcctccacccac

SEQ ID NO: 6471480 - DNA, 20 bp, Homo sapiens
tgcccctcctctctgcccta

SEQ ID NO: 6471481 - DNA, 18 bp, Homo sapiens
tgcccctcctggagcaga

SEQ ID NO: 6471482 - DNA, 16 bp, Homo sapiens
tgcccctcgcacacag

SEQ ID NO: 6471483 - DNA, 22 bp, Homo sapiens
tgcccctcgcacacagggctca

SEQ ID NO: 6471484 - DNA, 18 bp, Homo sapiens
tctgaatgtcccagaggc

SEQ ID NO: 6471485 - DNA, 17 bp, Homo sapiens
tctgaatgttctgacat

SEQ ID NO: 6471486 - DNA, 15 bp, Homo sapiens
tctgaatgtttgtgt

SEQ ID NO: 6471487 - DNA, 17 bp, Homo sapiens
tctgaatgtttgtgtct

SEQ ID NO: 6471488 - DNA, 23 bp, Homo sapiens
tctgaatgtttgtgtctgtggtt

SEQ ID NO: 6471489 - DNA, 18 bp, Homo sapiens
tctgaattagtccttgct

SEQ ID NO: 6471490 - DNA, 13 bp, Homo sapiens
tctgaattattct

SEQ ID NO: 6471491 - DNA, 15 bp, Homo sapiens
tctgaattattttta

SEQ ID NO: 6471492 - DNA, 14 bp, Homo sapiens
tctgaattccaagt

SEQ ID NO: 6471493 - DNA, 16 bp, Homo sapiens
tctgaattgagaaaag

SEQ ID NO: 6471494 - DNA, 17 bp, Homo sapiens
tctgaattgagaaaaga

SEQ ID NO: 6471495 - DNA, 18 bp, Homo sapiens
tctgaattgagaaaagag

SEQ ID NO: 6471496 - DNA, 20 bp, Homo sapiens
tctgaatttacttccttgca

SEQ ID NO: 6471497 - DNA, 21 bp, Homo sapiens
tctgaatttatctttgataac

SEQ ID NO: 6471498 - DNA, 15 bp, Homo sapiens
tctgaatttatttaa

SEQ ID NO: 6471499 - DNA, 20 bp, Homo sapiens
tctgaatttgcaaagtactg

SEQ ID NO: 6471500 - DNA, 17 bp, Homo sapiens
tctgaatttgccctggg

SEQ ID NO: 6471501 - DNA, 18 bp, Homo sapiens
tctgaatttgccctggga

SEQ ID NO: 6471502 - DNA, 14 bp, Homo sapiens
tctgaattttcaga

SEQ ID NO: 6471503 - DNA, 15 bp, Homo sapiens
tctgaattttgcaat

SEQ ID NO: 6471504 - DNA, 19 bp, Homo sapiens
tctgaattttgcaatgtat

SEQ ID NO: 6471505 - DNA, 19 bp, Homo sapiens
tctgaatttttaaacaagt

SEQ ID NO: 6471506 - DNA, 22 bp, Homo sapiens
tctgacaaaatggggcagaaga

SEQ ID NO: 6471507 - DNA, 19 bp, Homo sapiens
tctgacaaaggtggtaaat

SEQ ID NO: 6471508 - DNA, 14 bp, Homo sapiens
tctgacaaagtgtg

SEQ ID NO: 6471509 - DNA, 13 bp, Homo sapiens
tctgacaaattca

SEQ ID NO: 6471510 - DNA, 15 bp, Homo sapiens
tctgacaaattcaaa

SEQ ID NO: 6471511 - DNA, 16 bp, Homo sapiens
tctgacaacagacttc

SEQ ID NO: 6471512 - DNA, 21 bp, Homo sapiens
tctgacaactgtgaagccacc

SEQ ID NO: 6471513 - DNA, 12 bp, Homo sapiens
tctgacaagggc

SEQ ID NO: 6471514 - DNA, 20 bp, Homo sapiens
tctgacaagggctgacctgc

SEQ ID NO: 6471515 - DNA, 13 bp, Homo sapiens
tctgacacacagc

SEQ ID NO: 6471516 - DNA, 15 bp, Homo sapiens
tctgacacacagctc

SEQ ID NO: 6471517 - DNA, 16 bp, Homo sapiens
tctgacacacagctct

SEQ ID NO: 6471518 - DNA, 15 bp, Homo sapiens
tctgacacatgctct

SEQ ID NO: 6471519 - DNA, 13 bp, Homo sapiens
tctgacacctatt

SEQ ID NO: 6471520 - DNA, 20 bp, Homo sapiens
tctgacacctattttagaca

SEQ ID NO: 6471521 - DNA, 18 bp, Homo sapiens
tctgacagattgacaggg

SEQ ID NO: 6471522 - DNA, 14 bp, Homo sapiens
tctgacagcagcat

SEQ ID NO: 6471523 - DNA, 22 bp, Homo sapiens
tctgacagcagcatctctacct

SEQ ID NO: 6471524 - DNA, 23 bp, Homo sapiens
tctgacagcaggccactagtgac

SEQ ID NO: 6471525 - DNA, 12 bp, Homo sapiens
tctgacagccca

SEQ ID NO: 6471526 - DNA, 14 bp, Homo sapiens
tctgacagcctcag

SEQ ID NO: 6471527 - DNA, 22 bp, Homo sapiens
tctgacaggcgcaactcctcca

SEQ ID NO: 6471528 - DNA, 15 bp, Homo sapiens
tctgacagtagctct

SEQ ID NO: 6471529 - DNA, 18 bp, Homo sapiens
tctgacagtccacagggg

SEQ ID NO: 6471530 - DNA, 15 bp, Homo sapiens
tctgacagtctcaaa

SEQ ID NO: 6471531 - DNA, 18 bp, Homo sapiens
tctgacagttactcttca

SEQ ID NO: 6471532 - DNA, 22 bp, Homo sapiens
tctgacataaacccatctgtaa

SEQ ID NO: 6471533 - DNA, 13 bp, Homo sapiens
tctgacataatcc

SEQ ID NO: 6471534 - DNA, 17 bp, Homo sapiens
tctgacatattatgcct

SEQ ID NO: 6471535 - DNA, 13 bp, Homo sapiens
tctgacatcaagt

SEQ ID NO: 6471536 - DNA, 12 bp, Homo sapiens
tctgacatcagc

SEQ ID NO: 6471537 - DNA, 13 bp, Homo sapiens
tctgacatcagca

SEQ ID NO: 6471538 - DNA, 14 bp, Homo sapiens
tctgacatcagcac

SEQ ID NO: 6471539 - DNA, 16 bp, Homo sapiens
tctgacatcccttcct

SEQ ID NO: 6471540 - DNA, 12 bp, Homo sapiens
tctgacatctct

SEQ ID NO: 6471541 - DNA, 13 bp, Homo sapiens
tctgacatgcatt

SEQ ID NO: 6471542 - DNA, 17 bp, Homo sapiens
tctgacatgcattgttg

SEQ ID NO: 6471543 - DNA, 16 bp, Homo sapiens
tctgacatgtaagaaa

SEQ ID NO: 6471544 - DNA, 18 bp, Homo sapiens
tctgacatgtaagaaaat

SEQ ID NO: 6471545 - DNA, 20 bp, Homo sapiens
tctgacatgtttgtgctctg

SEQ ID NO: 6471546 - DNA, 22 bp, Homo sapiens
tctgacatgtttgtgctctgtt

SEQ ID NO: 6471547 - DNA, 15 bp, Homo sapiens
tctgacattaacagt

SEQ ID NO: 6471548 - DNA, 13 bp, Homo sapiens
tctgacattcatt

SEQ ID NO: 6471549 - DNA, 22 bp, Homo sapiens
tctgaccaaaaccagagggcag

SEQ ID NO: 6471550 - DNA, 15 bp, Homo sapiens
tctgaccaaaatgtg

SEQ ID NO: 6471551 - DNA, 17 bp, Homo sapiens
tctgaccaaaatgtgtt

SEQ ID NO: 6471552 - DNA, 21 bp, Homo sapiens
tctgaccaataaaaaaataag

SEQ ID NO: 6471553 - DNA, 14 bp, Homo sapiens
tctgaccacagaca

SEQ ID NO: 6471554 - DNA, 23 bp, Homo sapiens
tctgaccagtttaacctgatgca

SEQ ID NO: 6471555 - DNA, 13 bp, Homo sapiens
tctgaccatctgt

SEQ ID NO: 6471556 - DNA, 16 bp, Homo sapiens
tctgaccatctgtgac

SEQ ID NO: 6471557 - DNA, 15 bp, Homo sapiens
tctgacccaaagcaa

SEQ ID NO: 6471558 - DNA, 17 bp, Homo sapiens
tctgacccaaagcaaaa

SEQ ID NO: 6471559 - DNA, 15 bp, Homo sapiens
tctgacccagtgaga

SEQ ID NO: 6471560 - DNA, 22 bp, Homo sapiens
tctgacccagtgcccccactga

SEQ ID NO: 6471561 - DNA, 21 bp, Homo sapiens
tctgacccatagcactcttgt

SEQ ID NO: 6471562 - DNA, 16 bp, Homo sapiens
tctgacccatgctgcc

SEQ ID NO: 6471563 - DNA, 18 bp, Homo sapiens
tctgacccatgctgccct

SEQ ID NO: 6471564 - DNA, 22 bp, Homo sapiens
tctgacccatgctgccctgtga

SEQ ID NO: 6471565 - DNA, 16 bp, Homo sapiens
tctgaccccagcccag

SEQ ID NO: 6471566 - DNA, 22 bp, Homo sapiens
tctgaccccagcccagacagca

SEQ ID NO: 6471567 - DNA, 21 bp, Homo sapiens
tctgaccccagtggaaaacaa

SEQ ID NO: 6471568 - DNA, 16 bp, Homo sapiens
tctgacccctcctcac

SEQ ID NO: 6471569 - DNA, 17 bp, Homo sapiens
tctgacccctcctcact

SEQ ID NO: 6471570 - DNA, 17 bp, Homo sapiens
tctgaccctcccagtct

SEQ ID NO: 6471571 - DNA, 17 bp, Homo sapiens
tctgaccctccttctat

SEQ ID NO: 6471572 - DNA, 20 bp, Homo sapiens
tctgaccctccttctatttt

SEQ ID NO: 6471573 - DNA, 16 bp, Homo sapiens
tctgaccctctcccca

SEQ ID NO: 6471574 - DNA, 19 bp, Homo sapiens
tctgaccctgcttcaaata

SEQ ID NO: 6471575 - DNA, 17 bp, Homo sapiens
tctgacccttctacatt

SEQ ID NO: 6471576 - DNA, 17 bp, Homo sapiens
tctgaccgattccttta

SEQ ID NO: 6471577 - DNA, 17 bp, Homo sapiens
tctgaccgggtctgctt

SEQ ID NO: 6471578 - DNA, 23 bp, Homo sapiens
tctgacctaaaagttgaaaagcc

SEQ ID NO: 6471579 - DNA, 19 bp, Homo sapiens
tctgacctcatgagtgtca

SEQ ID NO: 6471580 - DNA, 14 bp, Homo sapiens
tctgacctcctctg

SEQ ID NO: 6471581 - DNA, 15 bp, Homo sapiens
tctgacctcctctgg

SEQ ID NO: 6471582 - DNA, 19 bp, Homo sapiens
tctgacctcctctgggccc

SEQ ID NO: 6471583 - DNA, 22 bp, Homo sapiens
tctgacctctacggacctcaca

SEQ ID NO: 6471584 - DNA, 12 bp, Homo sapiens
tctgacctctgc

SEQ ID NO: 6471585 - DNA, 19 bp, Homo sapiens
tctgacctctgctgagtgc

SEQ ID NO: 6471586 - DNA, 22 bp, Homo sapiens
tctgacctctgctgagtgctgg

SEQ ID NO: 6471587 - DNA, 16 bp, Homo sapiens
tctgacctcttggcca

SEQ ID NO: 6471588 - DNA, 18 bp, Homo sapiens
tctgacctcttggccaca

SEQ ID NO: 6471589 - DNA, 14 bp, Homo sapiens
tctgacctgcaggc

SEQ ID NO: 6471590 - DNA, 21 bp, Homo sapiens
tctgacctgcaggccaagagc

SEQ ID NO: 6471591 - DNA, 16 bp, Homo sapiens
tctgacctgcccccgc

SEQ ID NO: 6471592 - DNA, 23 bp, Homo sapiens
tctgacctggcatctaattctga

SEQ ID NO: 6471593 - DNA, 13 bp, Homo sapiens
tctgacctggtgg

SEQ ID NO: 6471594 - DNA, 14 bp, Homo sapiens
tctgaccttaaatg

SEQ ID NO: 6471595 - DNA, 21 bp, Homo sapiens
tctgaccttcagctcacgctt

SEQ ID NO: 6471596 - DNA, 15 bp, Homo sapiens
tctgacgaaggtcct

SEQ ID NO: 6471597 - DNA, 20 bp, Homo sapiens
tctgacgagtgtccatagat

SEQ ID NO: 6471598 - DNA, 23 bp, Homo sapiens
tctgacgattttggaaatgagaa

SEQ ID NO: 6471599 - DNA, 14 bp, Homo sapiens
tctgacgcagcctg

SEQ ID NO: 6471600 - DNA, 19 bp, Homo sapiens
tctgacgcagcctgagaat

SEQ ID NO: 6471601 - DNA, 16 bp, Homo sapiens
tctgacggccctgcaa

SEQ ID NO: 6471602 - DNA, 17 bp, Homo sapiens
tctgacggccctgcaat

SEQ ID NO: 6471603 - DNA, 17 bp, Homo sapiens
tctgactaggctgatca

SEQ ID NO: 6471604 - DNA, 17 bp, Homo sapiens
tctgactagtagatttc

SEQ ID NO: 6471605 - DNA, 14 bp, Homo sapiens
tctgactatgacat

SEQ ID NO: 6471606 - DNA, 23 bp, Homo sapiens
tctgactcaccacgatgacgcct

SEQ ID NO: 6471607 - DNA, 13 bp, Homo sapiens
tctgactcagggc

SEQ ID NO: 6471608 - DNA, 20 bp, Homo sapiens
tctgactcagggctcctggg

SEQ ID NO: 6471609 - DNA, 19 bp, Homo sapiens
tctgactcatatcccctat

SEQ ID NO: 6471610 - DNA, 12 bp, Homo sapiens
tctgactccaga

SEQ ID NO: 6471611 - DNA, 13 bp, Homo sapiens
tctgactccagag

SEQ ID NO: 6471612 - DNA, 19 bp, Homo sapiens
tctgactccagagtctgag

SEQ ID NO: 6471613 - DNA, 20 bp, Homo sapiens
tctgactccagagtctgagc

SEQ ID NO: 6471614 - DNA, 22 bp, Homo sapiens
tctgactccagagtctgagccc

SEQ ID NO: 6471615 - DNA, 13 bp, Homo sapiens
tctgactccagtg

SEQ ID NO: 6471616 - DNA, 15 bp, Homo sapiens
tctgactccctcccc

SEQ ID NO: 6471617 - DNA, 16 bp, Homo sapiens
tctgactcggtttctc

SEQ ID NO: 6471618 - DNA, 18 bp, Homo sapiens
tctgactcggtttctcca

SEQ ID NO: 6471619 - DNA, 19 bp, Homo sapiens
tctgactcggtttctccaa

SEQ ID NO: 6471620 - DNA, 20 bp, Homo sapiens
tctgactcggtttctccaaa

SEQ ID NO: 6471621 - DNA, 12 bp, Homo sapiens
tctgactctcaa

SEQ ID NO: 6471622 - DNA, 15 bp, Homo sapiens
tctgactctcaaatc

SEQ ID NO: 6471623 - DNA, 13 bp, Homo sapiens
tctgactctgagt

SEQ ID NO: 6471624 - DNA, 14 bp, Homo sapiens
tctgactctggacc

SEQ ID NO: 6471625 - DNA, 22 bp, Homo sapiens
tctgactcttgcctttccacct

SEQ ID NO: 6471626 - DNA, 23 bp, Homo sapiens
tctgactcttgcctttccacctg

SEQ ID NO: 6471627 - DNA, 13 bp, Homo sapiens
tctgactgacatg

SEQ ID NO: 6471628 - DNA, 21 bp, Homo sapiens
tctgactgagagcccactgca

SEQ ID NO: 6471629 - DNA, 16 bp, Homo sapiens
tctgactgatgctttc

SEQ ID NO: 6471630 - DNA, 12 bp, Homo sapiens
tctgactgatgg

SEQ ID NO: 6471631 - DNA, 20 bp, Homo sapiens
tctgactgatggtttggaaa

SEQ ID NO: 6471632 - DNA, 19 bp, Homo sapiens
tctgactgcaacttctgtc

SEQ ID NO: 6471633 - DNA, 22 bp, Homo sapiens
tctgactgcaacttctgtccct

SEQ ID NO: 6471634 - DNA, 16 bp, Homo sapiens
tctgactgccaagcca

SEQ ID NO: 6471635 - DNA, 17 bp, Homo sapiens
tctgactgccaagccag

SEQ ID NO: 6471636 - DNA, 19 bp, Homo sapiens
tctgactgccaagccagat

SEQ ID NO: 6471637 - DNA, 14 bp, Homo sapiens
tctgactgtgtgtg

SEQ ID NO: 6471638 - DNA, 11 bp, Homo sapiens
tctgactgttt

SEQ ID NO: 6471639 - DNA, 12 bp, Homo sapiens
tctgactgttta

SEQ ID NO: 6471640 - DNA, 17 bp, Homo sapiens
tctgactgtttatttaa

SEQ ID NO: 6471641 - DNA, 21 bp, Homo sapiens
tctgactgtttccatcaaggg

SEQ ID NO: 6471642 - DNA, 20 bp, Homo sapiens
tctgacttaagcaaaagaaa

SEQ ID NO: 6471643 - DNA, 23 bp, Homo sapiens
tctgacttaagcaaaagaaaaag

SEQ ID NO: 6471644 - DNA, 22 bp, Homo sapiens
tctgacttctagctgtctgtga

SEQ ID NO: 6471645 - DNA, 17 bp, Homo sapiens
tctgacttctcacttcc

SEQ ID NO: 6471646 - DNA, 19 bp, Homo sapiens
tctgacttctcacttccta

SEQ ID NO: 6471647 - DNA, 17 bp, Homo sapiens
tctgacttctcaggaag

SEQ ID NO: 6471648 - DNA, 18 bp, Homo sapiens
tctgacttctcaggaaga

SEQ ID NO: 6471649 - DNA, 15 bp, Homo sapiens
tctgacttctgcctg

SEQ ID NO: 6471650 - DNA, 14 bp, Homo sapiens
tctgacttggggac

SEQ ID NO: 6471651 - DNA, 14 bp, Homo sapiens
tctgactttacact

SEQ ID NO: 6471652 - DNA, 14 bp, Homo sapiens
tctgactttacttg

SEQ ID NO: 6471653 - DNA, 13 bp, Homo sapiens
tctgacttttaca

SEQ ID NO: 6471654 - DNA, 12 bp, Homo sapiens
tctgacttttgt

SEQ ID NO: 6471655 - DNA, 22 bp, Homo sapiens
tctgagaaaatgcgagactctg

SEQ ID NO: 6471656 - DNA, 14 bp, Homo sapiens
tctgagaaactcta

SEQ ID NO: 6471657 - DNA, 19 bp, Homo sapiens
tctgagaaagactattcaa

SEQ ID NO: 6471658 - DNA, 22 bp, Homo sapiens
tctgagaaagactattcaaaca

SEQ ID NO: 6471659 - DNA, 20 bp, Homo sapiens
tctgagaaataggtatcaaa

SEQ ID NO: 6471660 - DNA, 15 bp, Homo sapiens
tctgagaactgactt

SEQ ID NO: 6471661 - DNA, 19 bp, Homo sapiens
tctgagaagaggagccctc

SEQ ID NO: 6471662 - DNA, 15 bp, Homo sapiens
tctgagaagcgctgc

SEQ ID NO: 6471663 - DNA, 19 bp, Homo sapiens
tctgagaagcgctgccctg

SEQ ID NO: 6471664 - DNA, 23 bp, Homo sapiens
tgcccctcgcacacagggctcac

SEQ ID NO: 6471665 - DNA, 22 bp, Homo sapiens
tgcccctcgccagcttctcctg

SEQ ID NO: 6471666 - DNA, 18 bp, Homo sapiens
tgcccctctactgttgca

SEQ ID NO: 6471667 - DNA, 15 bp, Homo sapiens
tgcccctctctccat

SEQ ID NO: 6471668 - DNA, 14 bp, Homo sapiens
tgcccctctctggg

SEQ ID NO: 6471669 - DNA, 14 bp, Homo sapiens
tgcccctctgttct

SEQ ID NO: 6471670 - DNA, 18 bp, Homo sapiens
tgcccctctgttctctcc

SEQ ID NO: 6471671 - DNA, 16 bp, Homo sapiens
tgcccctctttctctt

SEQ ID NO: 6471672 - DNA, 21 bp, Homo sapiens
tgcccctctttctctttcttc

SEQ ID NO: 6471673 - DNA, 17 bp, Homo sapiens
tgcccctgatcactccc

SEQ ID NO: 6471674 - DNA, 16 bp, Homo sapiens
tgcccctgcagtttgg

SEQ ID NO: 6471675 - DNA, 11 bp, Homo sapiens
tgcccctgcca

SEQ ID NO: 6471676 - DNA, 15 bp, Homo sapiens
tgcccctgccaaggc

SEQ ID NO: 6471677 - DNA, 15 bp, Homo sapiens
tgcccctgccccaac

SEQ ID NO: 6471678 - DNA, 15 bp, Homo sapiens
tgcccctgcccctgc

SEQ ID NO: 6471679 - DNA, 16 bp, Homo sapiens
tgcccctgcccgagag

SEQ ID NO: 6471680 - DNA, 18 bp, Homo sapiens
tgcccctgccctgaggag

SEQ ID NO: 6471681 - DNA, 20 bp, Homo sapiens
tgcccctgctcactgggccc

SEQ ID NO: 6471682 - DNA, 14 bp, Homo sapiens
tgcccctgctctgt

SEQ ID NO: 6471683 - DNA, 19 bp, Homo sapiens
tgcccctgctctgtagcca

SEQ ID NO: 6471684 - DNA, 14 bp, Homo sapiens
tgcccctgctgcct

SEQ ID NO: 6471685 - DNA, 13 bp, Homo sapiens
tgcccctgctgct

SEQ ID NO: 6471686 - DNA, 17 bp, Homo sapiens
tgcccctggacctggga

SEQ ID NO: 6471687 - DNA, 17 bp, Homo sapiens
tgcccctggcagcccct

SEQ ID NO: 6471688 - DNA, 22 bp, Homo sapiens
tgcccctggcccatctcagcct

SEQ ID NO: 6471689 - DNA, 12 bp, Homo sapiens
tgcccctggctt

SEQ ID NO: 6471690 - DNA, 22 bp, Homo sapiens
tgcccctgtaaggtttcaatgc

SEQ ID NO: 6471691 - DNA, 17 bp, Homo sapiens
tgcccctgtaggttgct

SEQ ID NO: 6471692 - DNA, 21 bp, Homo sapiens
tgcccctgtcccacctggctc

SEQ ID NO: 6471693 - DNA, 23 bp, Homo sapiens
tgcccctgtctggaagacgtggc

SEQ ID NO: 6471694 - DNA, 16 bp, Homo sapiens
tgcccctgttcatgtt

SEQ ID NO: 6471695 - DNA, 21 bp, Homo sapiens
tgccccttaaacacaggctgt

SEQ ID NO: 6471696 - DNA, 23 bp, Homo sapiens
tgccccttaaatttctgccctga

SEQ ID NO: 6471697 - DNA, 21 bp, Homo sapiens
tgccccttcccatctcttcct

SEQ ID NO: 6471698 - DNA, 16 bp, Homo sapiens
tgccccttccccaaga

SEQ ID NO: 6471699 - DNA, 18 bp, Homo sapiens
tgccccttccccatctcc

SEQ ID NO: 6471700 - DNA, 19 bp, Homo sapiens
tgccccttccccatgctca

SEQ ID NO: 6471701 - DNA, 15 bp, Homo sapiens
tgccccttccctggg

SEQ ID NO: 6471702 - DNA, 18 bp, Homo sapiens
tgccccttccgccactgg

SEQ ID NO: 6471703 - DNA, 18 bp, Homo sapiens
tgccccttctacactctc

SEQ ID NO: 6471704 - DNA, 21 bp, Homo sapiens
tgccccttgacaactggcagg

SEQ ID NO: 6471705 - DNA, 17 bp, Homo sapiens
tgccccttgaccccaca

SEQ ID NO: 6471706 - DNA, 14 bp, Homo sapiens
tgccccttgcaagc

SEQ ID NO: 6471707 - DNA, 15 bp, Homo sapiens
tgccccttgcaagcc

SEQ ID NO: 6471708 - DNA, 17 bp, Homo sapiens
tgccccttgcaagccat

SEQ ID NO: 6471709 - DNA, 13 bp, Homo sapiens
tgccccttgccat

SEQ ID NO: 6471710 - DNA, 18 bp, Homo sapiens
tgccccttggatcaagca

SEQ ID NO: 6471711 - DNA, 13 bp, Homo sapiens
tgccccttggtcc

SEQ ID NO: 6471712 - DNA, 15 bp, Homo sapiens
tgccccttggtcctg

SEQ ID NO: 6471713 - DNA, 16 bp, Homo sapiens
tgccccttggtcctgg

SEQ ID NO: 6471714 - DNA, 18 bp, Homo sapiens
tgccccttggtcctggca

SEQ ID NO: 6471715 - DNA, 13 bp, Homo sapiens
tgcccctttcctt

SEQ ID NO: 6471716 - DNA, 18 bp, Homo sapiens
tgcccctttccttcactg

SEQ ID NO: 6471717 - DNA, 14 bp, Homo sapiens
tgcccctttctgga

SEQ ID NO: 6471718 - DNA, 16 bp, Homo sapiens
tgcccgactgactgga

SEQ ID NO: 6471719 - DNA, 18 bp, Homo sapiens
tgcccgactgactggagg

SEQ ID NO: 6471720 - DNA, 22 bp, Homo sapiens
tgcccgagagagaccccaccgc

SEQ ID NO: 6471721 - DNA, 13 bp, Homo sapiens
tgcccgagagctc

SEQ ID NO: 6471722 - DNA, 16 bp, Homo sapiens
tgcccgagagctctta

SEQ ID NO: 6471723 - DNA, 16 bp, Homo sapiens
tgcccgagctggtgca

SEQ ID NO: 6471724 - DNA, 16 bp, Homo sapiens
tgcccgagggagggga

SEQ ID NO: 6471725 - DNA, 19 bp, Homo sapiens
tgcccgagggcagccccct

SEQ ID NO: 6471726 - DNA, 23 bp, Homo sapiens
tgcccgagggcagccccctccct

SEQ ID NO: 6471727 - DNA, 17 bp, Homo sapiens
tgcccgaggtcgctgca

SEQ ID NO: 6471728 - DNA, 15 bp, Homo sapiens
tgcccgaggttcctg

SEQ ID NO: 6471729 - DNA, 16 bp, Homo sapiens
tgcccgaggttcctgt

SEQ ID NO: 6471730 - DNA, 17 bp, Homo sapiens
tgcccgaggttcctgtc

SEQ ID NO: 6471731 - DNA, 16 bp, Homo sapiens
tgcccgatccagattc

SEQ ID NO: 6471732 - DNA, 14 bp, Homo sapiens
tgcccgcacagcag

SEQ ID NO: 6471733 - DNA, 14 bp, Homo sapiens
tgcccgcacccctc

SEQ ID NO: 6471734 - DNA, 20 bp, Homo sapiens
tgcccgcacccctccctgct

SEQ ID NO: 6471735 - DNA, 23 bp, Homo sapiens
tgcccgcacccctccctgcttgc

SEQ ID NO: 6471736 - DNA, 18 bp, Homo sapiens
tgcccgcaccctggcctg

SEQ ID NO: 6471737 - DNA, 20 bp, Homo sapiens
tgcccgcaccctggcctggt

SEQ ID NO: 6471738 - DNA, 23 bp, Homo sapiens
tgcccgccacatggtgtggccat

SEQ ID NO: 6471739 - DNA, 13 bp, Homo sapiens
tgcccgccaccac

SEQ ID NO: 6471740 - DNA, 14 bp, Homo sapiens
tgcccgccagcctc

SEQ ID NO: 6471741 - DNA, 14 bp, Homo sapiens
tgcccgcccacctc

SEQ ID NO: 6471742 - DNA, 20 bp, Homo sapiens
tgcccgcccacctctgctgc

SEQ ID NO: 6471743 - DNA, 21 bp, Homo sapiens
tgcccgcccacctctgctgcc

SEQ ID NO: 6471744 - DNA, 22 bp, Homo sapiens
tgcccgcccacctctgctgccc

SEQ ID NO: 6471745 - DNA, 16 bp, Homo sapiens
tgcccgccccaagccc

SEQ ID NO: 6471746 - DNA, 15 bp, Homo sapiens
tgcccgcccggggag

SEQ ID NO: 6471747 - DNA, 17 bp, Homo sapiens
tgcccgccctccaccca

SEQ ID NO: 6471748 - DNA, 15 bp, Homo sapiens
tgcccgccctgcccc

SEQ ID NO: 6471749 - DNA, 13 bp, Homo sapiens
tgcccgccctggg

SEQ ID NO: 6471750 - DNA, 14 bp, Homo sapiens
tgcccgcctaagac

SEQ ID NO: 6471751 - DNA, 20 bp, Homo sapiens
tgcccgcctaagaccctgaa

SEQ ID NO: 6471752 - DNA, 18 bp, Homo sapiens
tgcccgcctgcccacctg

SEQ ID NO: 6471753 - DNA, 20 bp, Homo sapiens
tgcccgcctgggtctcctaa

SEQ ID NO: 6471754 - DNA, 23 bp, Homo sapiens
tgcccgcgggagacagcttctct

SEQ ID NO: 6471755 - DNA, 15 bp, Homo sapiens
tgcccgctcccaacc

SEQ ID NO: 6471756 - DNA, 20 bp, Homo sapiens
tgcccgctcccaacccccct

SEQ ID NO: 6471757 - DNA, 23 bp, Homo sapiens
tgcccgctcccacagcttcctga

SEQ ID NO: 6471758 - DNA, 14 bp, Homo sapiens
tgcccgctcccagt

SEQ ID NO: 6471759 - DNA, 17 bp, Homo sapiens
tgcccgctcccagtgtc

SEQ ID NO: 6471760 - DNA, 13 bp, Homo sapiens
tgcccgctcctcg

SEQ ID NO: 6471761 - DNA, 18 bp, Homo sapiens
tgcccgctgcgctgccct

SEQ ID NO: 6471762 - DNA, 19 bp, Homo sapiens
tgcccgctgcgctgccctg

SEQ ID NO: 6471763 - DNA, 21 bp, Homo sapiens
tgcccgctgcgctgccctgca

SEQ ID NO: 6471764 - DNA, 23 bp, Homo sapiens
tgcccggagcagcagcttctcca

SEQ ID NO: 6471765 - DNA, 16 bp, Homo sapiens
tgcccggattctggga

SEQ ID NO: 6471766 - DNA, 17 bp, Homo sapiens
tgcccggattctgggag

SEQ ID NO: 6471767 - DNA, 18 bp, Homo sapiens
tgcccggattctgggagg

SEQ ID NO: 6471768 - DNA, 22 bp, Homo sapiens
tgcccggattctgggaggaagc

SEQ ID NO: 6471769 - DNA, 16 bp, Homo sapiens
tgcccggcccaggagc

SEQ ID NO: 6471770 - DNA, 22 bp, Homo sapiens
tgcccggccccaccccctgggc

SEQ ID NO: 6471771 - DNA, 23 bp, Homo sapiens
tgcccggccccaccccctgggca

SEQ ID NO: 6471772 - DNA, 14 bp, Homo sapiens
tgcccggcctccct

SEQ ID NO: 6471773 - DNA, 16 bp, Homo sapiens
tgcccggcgccgggca

SEQ ID NO: 6471774 - DNA, 15 bp, Homo sapiens
tgcccggcgcctgcc

SEQ ID NO: 6471775 - DNA, 16 bp, Homo sapiens
tgcccggcgcctgccc

SEQ ID NO: 6471776 - DNA, 17 bp, Homo sapiens
tgcccggcgcctgccct

SEQ ID NO: 6471777 - DNA, 19 bp, Homo sapiens
tgcccggctaatgtttgta

SEQ ID NO: 6471778 - DNA, 22 bp, Homo sapiens
tgcccggctaatttttttgtat

SEQ ID NO: 6471779 - DNA, 12 bp, Homo sapiens
tgcccggctgcg

SEQ ID NO: 6471780 - DNA, 14 bp, Homo sapiens
tgcccggctgcgga

SEQ ID NO: 6471781 - DNA, 21 bp, Homo sapiens
tgcccgggaaggtcaccagca

SEQ ID NO: 6471782 - DNA, 19 bp, Homo sapiens
tgcccgggacccccgtctc

SEQ ID NO: 6471783 - DNA, 14 bp, Homo sapiens
tgcccggggagctg

SEQ ID NO: 6471784 - DNA, 16 bp, Homo sapiens
tgcccggggatccccc

SEQ ID NO: 6471785 - DNA, 14 bp, Homo sapiens
tgcccggggcagca

SEQ ID NO: 6471786 - DNA, 23 bp, Homo sapiens
tgcccggggcagcagcagccctg

SEQ ID NO: 6471787 - DNA, 21 bp, Homo sapiens
tgcccggggtggggtgcactc

SEQ ID NO: 6471788 - DNA, 23 bp, Homo sapiens
tgcccggggtggggtgcactcgc

SEQ ID NO: 6471789 - DNA, 16 bp, Homo sapiens
tgcccggtgcagggcc

SEQ ID NO: 6471790 - DNA, 18 bp, Homo sapiens
tgcccggtgcagggcctg

SEQ ID NO: 6471791 - DNA, 19 bp, Homo sapiens
tgcccggtgcagggcctgg

SEQ ID NO: 6471792 - DNA, 20 bp, Homo sapiens
tgcccggtgcagggcctggc

SEQ ID NO: 6471793 - DNA, 16 bp, Homo sapiens
tgcccggtgccatctt

SEQ ID NO: 6471794 - DNA, 20 bp, Homo sapiens
tgcccgtcggccctgcgtcg

SEQ ID NO: 6471795 - DNA, 17 bp, Homo sapiens
tgcccgtctctctccca

SEQ ID NO: 6471796 - DNA, 19 bp, Homo sapiens
tgcccgtctctctcccatg

SEQ ID NO: 6471797 - DNA, 13 bp, Homo sapiens
tgcccgtcttcag

SEQ ID NO: 6471798 - DNA, 15 bp, Homo sapiens
tgcccgtgccctggt

SEQ ID NO: 6471799 - DNA, 13 bp, Homo sapiens
tgcccgtgcctct

SEQ ID NO: 6471800 - DNA, 14 bp, Homo sapiens
tgcccgtgtggcct

SEQ ID NO: 6471801 - DNA, 15 bp, Homo sapiens
tgcccgtgtggcctg

SEQ ID NO: 6471802 - DNA, 24 bp, Homo sapiens
tgcccgttgccgggcctggactgt

SEQ ID NO: 6471803 - DNA, 21 bp, Homo sapiens
tgcccgttgtctaggagacag

SEQ ID NO: 6471804 - DNA, 22 bp, Homo sapiens
tgccctaacctctgagtcacca

SEQ ID NO: 6471805 - DNA, 14 bp, Homo sapiens
tgccctaactctgc

SEQ ID NO: 6471806 - DNA, 21 bp, Homo sapiens
tgccctaactctgcccaccct

SEQ ID NO: 6471807 - DNA, 15 bp, Homo sapiens
tgccctaagcagaaa

SEQ ID NO: 6471808 - DNA, 17 bp, Homo sapiens
tgccctaagcagaaagt

SEQ ID NO: 6471809 - DNA, 18 bp, Homo sapiens
tgccctaagcagaaagtg

SEQ ID NO: 6471810 - DNA, 20 bp, Homo sapiens
tgccctaagcccccagggcc

SEQ ID NO: 6471811 - DNA, 23 bp, Homo sapiens
tgccctaagtgatttccacaggt

SEQ ID NO: 6471812 - DNA, 21 bp, Homo sapiens
tgccctaattaaaaactgtga

SEQ ID NO: 6471813 - DNA, 19 bp, Homo sapiens
tgccctaattcatctttta

SEQ ID NO: 6471814 - DNA, 20 bp, Homo sapiens
tgccctaattcatcttttaa

SEQ ID NO: 6471815 - DNA, 22 bp, Homo sapiens
tgccctacagcaccctgtggtc

SEQ ID NO: 6471816 - DNA, 15 bp, Homo sapiens
tgccctactcactct

SEQ ID NO: 6471817 - DNA, 17 bp, Homo sapiens
tgccctagatcaacaga

SEQ ID NO: 6471818 - DNA, 19 bp, Homo sapiens
tgccctagcagtttgcctc

SEQ ID NO: 6471819 - DNA, 17 bp, Homo sapiens
tgccctagcccagactc

SEQ ID NO: 6471820 - DNA, 19 bp, Homo sapiens
tgccctagcccagactctg

SEQ ID NO: 6471821 - DNA, 17 bp, Homo sapiens
tgccctaggatatgccc

SEQ ID NO: 6471822 - DNA, 15 bp, Homo sapiens
tgccctagggctcag

SEQ ID NO: 6471823 - DNA, 17 bp, Homo sapiens
tgccctagggctcagag

SEQ ID NO: 6471824 - DNA, 18 bp, Homo sapiens
tgccctagggctcagagg

SEQ ID NO: 6471825 - DNA, 22 bp, Homo sapiens
tgccctataacccctgcctgga

SEQ ID NO: 6471826 - DNA, 20 bp, Homo sapiens
tgccctattataattgtcat

SEQ ID NO: 6471827 - DNA, 19 bp, Homo sapiens
tgccctattgtaagttgtt

SEQ ID NO: 6471828 - DNA, 19 bp, Homo sapiens
tgccctcaaaatctttaga

SEQ ID NO: 6471829 - DNA, 19 bp, Homo sapiens
tgccctcaagagcaaagta

SEQ ID NO: 6471830 - DNA, 15 bp, Homo sapiens
tgccctcaccaccac

SEQ ID NO: 6471831 - DNA, 16 bp, Homo sapiens
tgccctcaccacccac

SEQ ID NO: 6471832 - DNA, 14 bp, Homo sapiens
tgccctcaccccaa

SEQ ID NO: 6471833 - DNA, 21 bp, Homo sapiens
tgccctcaccccaatccctgc

SEQ ID NO: 6471834 - DNA, 12 bp, Homo sapiens
tgccctcagctc

SEQ ID NO: 6471835 - DNA, 12 bp, Homo sapiens
tgccctcagggg

SEQ ID NO: 6471836 - DNA, 23 bp, Homo sapiens
tgccctcatcccgacctcttaga

SEQ ID NO: 6471837 - DNA, 19 bp, Homo sapiens
tgccctcatggcccctctg

SEQ ID NO: 6471838 - DNA, 18 bp, Homo sapiens
tgccctcattttatgtca

SEQ ID NO: 6471839 - DNA, 13 bp, Homo sapiens
tgccctccaaaga

SEQ ID NO: 6471840 - DNA, 23 bp, Homo sapiens
tgccctccacccacacctgcccg

SEQ ID NO: 6471841 - DNA, 12 bp, Homo sapiens
tgccctccagct

SEQ ID NO: 6471842 - DNA, 16 bp, Homo sapiens
tctgagaagctctgaa

SEQ ID NO: 6471843 - DNA, 19 bp, Homo sapiens
tctgagaaggccctgtgcc

SEQ ID NO: 6471844 - DNA, 20 bp, Homo sapiens
tctgagaaggtccttaatga

SEQ ID NO: 6471845 - DNA, 16 bp, Homo sapiens
tctgagaagtacttta

SEQ ID NO: 6471846 - DNA, 12 bp, Homo sapiens
tctgagaatgaa

SEQ ID NO: 6471847 - DNA, 14 bp, Homo sapiens
tctgagaattgcaa

SEQ ID NO: 6471848 - DNA, 15 bp, Homo sapiens
tctgagaattgcaaa

SEQ ID NO: 6471849 - DNA, 16 bp, Homo sapiens
tctgagacaaaagaaa

SEQ ID NO: 6471850 - DNA, 19 bp, Homo sapiens
tctgagacaaagcaatgga

SEQ ID NO: 6471851 - DNA, 15 bp, Homo sapiens
tctgagaccagcctg

SEQ ID NO: 6471852 - DNA, 12 bp, Homo sapiens
tctgagaccagt

SEQ ID NO: 6471853 - DNA, 18 bp, Homo sapiens
tctgagacccttttctca

SEQ ID NO: 6471854 - DNA, 13 bp, Homo sapiens
tctgagactcaca

SEQ ID NO: 6471855 - DNA, 21 bp, Homo sapiens
tctgagactcgcgacaatgca

SEQ ID NO: 6471856 - DNA, 15 bp, Homo sapiens
tctgagactggcaga

SEQ ID NO: 6471857 - DNA, 17 bp, Homo sapiens
tctgagagaccatctcc

SEQ ID NO: 6471858 - DNA, 18 bp, Homo sapiens
tctgagagaccatctcct

SEQ ID NO: 6471859 - DNA, 19 bp, Homo sapiens
tctgagagaccatctccta

SEQ ID NO: 6471860 - DNA, 20 bp, Homo sapiens
tctgagagaggctaaaatgt

SEQ ID NO: 6471861 - DNA, 15 bp, Homo sapiens
tctgagagcaaactg

SEQ ID NO: 6471862 - DNA, 16 bp, Homo sapiens
tctgagagcaaactgg

SEQ ID NO: 6471863 - DNA, 19 bp, Homo sapiens
tctgagagcaaagtgacct

SEQ ID NO: 6471864 - DNA, 21 bp, Homo sapiens
tctgagagcgaattgtgtgga

SEQ ID NO: 6471865 - DNA, 16 bp, Homo sapiens
tctgagaggctctccg

SEQ ID NO: 6471866 - DNA, 21 bp, Homo sapiens
tctgagaggctctccgtgcag

SEQ ID NO: 6471867 - DNA, 15 bp, Homo sapiens
tctgagagtcattca

SEQ ID NO: 6471868 - DNA, 19 bp, Homo sapiens
tctgagagtcattcaggtg

SEQ ID NO: 6471869 - DNA, 19 bp, Homo sapiens
tctgagagtctagattctc

SEQ ID NO: 6471870 - DNA, 16 bp, Homo sapiens
tctgagatccagcaca

SEQ ID NO: 6471871 - DNA, 16 bp, Homo sapiens
tctgagatgctcactt

SEQ ID NO: 6471872 - DNA, 19 bp, Homo sapiens
tctgagatttttttgtgta

SEQ ID NO: 6471873 - DNA, 23 bp, Homo sapiens
tctgagatttttttgtgtatgtt

SEQ ID NO: 6471874 - DNA, 17 bp, Homo sapiens
tctgagcaaaggccctg

SEQ ID NO: 6471875 - DNA, 12 bp, Homo sapiens
tctgagcaaata

SEQ ID NO: 6471876 - DNA, 22 bp, Homo sapiens
tctgagcaaggagtttaaatga

SEQ ID NO: 6471877 - DNA, 21 bp, Homo sapiens
tctgagcaccccctcattccc

SEQ ID NO: 6471878 - DNA, 22 bp, Homo sapiens
tctgagcaccccctcattcccc

SEQ ID NO: 6471879 - DNA, 23 bp, Homo sapiens
tctgagcagacagggcgtcctct

SEQ ID NO: 6471880 - DNA, 20 bp, Homo sapiens
tctgagcagcctctgccagg

SEQ ID NO: 6471881 - DNA, 17 bp, Homo sapiens
tctgagcagcgagcctg

SEQ ID NO: 6471882 - DNA, 19 bp, Homo sapiens
tctgagcagcgagcctgct

SEQ ID NO: 6471883 - DNA, 21 bp, Homo sapiens
tctgagcagcgagcctgctag

SEQ ID NO: 6471884 - DNA, 21 bp, Homo sapiens
tctgagcaggaagcgagcaga

SEQ ID NO: 6471885 - DNA, 23 bp, Homo sapiens
tctgagcaggggaacaaaataag

SEQ ID NO: 6471886 - DNA, 14 bp, Homo sapiens
tctgagcaggggca

SEQ ID NO: 6471887 - DNA, 15 bp, Homo sapiens
tctgagcaggggcag

SEQ ID NO: 6471888 - DNA, 16 bp, Homo sapiens
tctgagcaggggcagg

SEQ ID NO: 6471889 - DNA, 21 bp, Homo sapiens
tctgagcaggtacatttctga

SEQ ID NO: 6471890 - DNA, 19 bp, Homo sapiens
tctgagcagtgaatgattc

SEQ ID NO: 6471891 - DNA, 13 bp, Homo sapiens
tctgagcagtggg

SEQ ID NO: 6471892 - DNA, 14 bp, Homo sapiens
tctgagcagtgggg

SEQ ID NO: 6471893 - DNA, 15 bp, Homo sapiens
tctgagcagtgggga

SEQ ID NO: 6471894 - DNA, 18 bp, Homo sapiens
tctgagccaaagagaatg

SEQ ID NO: 6471895 - DNA, 15 bp, Homo sapiens
tctgagccaaccttg

SEQ ID NO: 6471896 - DNA, 20 bp, Homo sapiens
tctgagccaagggagggaag

SEQ ID NO: 6471897 - DNA, 23 bp, Homo sapiens
tctgagccaagggagggaagggc

SEQ ID NO: 6471898 - DNA, 15 bp, Homo sapiens
tctgagccacagtgg

SEQ ID NO: 6471899 - DNA, 17 bp, Homo sapiens
tctgagccacagtggga

SEQ ID NO: 6471900 - DNA, 14 bp, Homo sapiens
tctgagccaggagc

SEQ ID NO: 6471901 - DNA, 12 bp, Homo sapiens
tctgagccagtt

SEQ ID NO: 6471902 - DNA, 15 bp, Homo sapiens
tctgagcccaaccct

SEQ ID NO: 6471903 - DNA, 19 bp, Homo sapiens
tctgagcccaacccttcta

SEQ ID NO: 6471904 - DNA, 14 bp, Homo sapiens
tctgagcccaggcc

SEQ ID NO: 6471905 - DNA, 12 bp, Homo sapiens
tctgagcccatg

SEQ ID NO: 6471906 - DNA, 23 bp, Homo sapiens
tctgagcccatgttctgccccca

SEQ ID NO: 6471907 - DNA, 18 bp, Homo sapiens
tctgagcccatttctggg

SEQ ID NO: 6471908 - DNA, 14 bp, Homo sapiens
tctgagccccagcc

SEQ ID NO: 6471909 - DNA, 21 bp, Homo sapiens
tctgagcccccacctgcctga

SEQ ID NO: 6471910 - DNA, 18 bp, Homo sapiens
tctgagcccccggctagt

SEQ ID NO: 6471911 - DNA, 13 bp, Homo sapiens
tctgagccccctg

SEQ ID NO: 6471912 - DNA, 16 bp, Homo sapiens
tctgagccccctgtgc

SEQ ID NO: 6471913 - DNA, 19 bp, Homo sapiens
tctgagccccctgtgccca

SEQ ID NO: 6471914 - DNA, 16 bp, Homo sapiens
tctgagcccctgggac

SEQ ID NO: 6471915 - DNA, 20 bp, Homo sapiens
tctgagcccgggctgcctgg

SEQ ID NO: 6471916 - DNA, 23 bp, Homo sapiens
tctgagcccggtaagagcaaaag

SEQ ID NO: 6471917 - DNA, 17 bp, Homo sapiens
tctgagccctccctctt

SEQ ID NO: 6471918 - DNA, 21 bp, Homo sapiens
tctgagccctccctcttccca

SEQ ID NO: 6471919 - DNA, 18 bp, Homo sapiens
tctgagcctctctcggtc

SEQ ID NO: 6471920 - DNA, 18 bp, Homo sapiens
tctgagccttgagagaaa

SEQ ID NO: 6471921 - DNA, 16 bp, Homo sapiens
tctgagcggccgcctg

SEQ ID NO: 6471922 - DNA, 17 bp, Homo sapiens
tctgagcggccgcctgt

SEQ ID NO: 6471923 - DNA, 21 bp, Homo sapiens
tctgagcggccgcctgtcctt

SEQ ID NO: 6471924 - DNA, 17 bp, Homo sapiens
tctgagcggcgcagagc

SEQ ID NO: 6471925 - DNA, 23 bp, Homo sapiens
tctgagctagttggttgaatttt

SEQ ID NO: 6471926 - DNA, 17 bp, Homo sapiens
tctgagctatttcatct

SEQ ID NO: 6471927 - DNA, 20 bp, Homo sapiens
tctgagctcctgtcccctgc

SEQ ID NO: 6471928 - DNA, 18 bp, Homo sapiens
tctgagctctgcatttgt

SEQ ID NO: 6471929 - DNA, 18 bp, Homo sapiens
tctgagctgagccaggct

SEQ ID NO: 6471930 - DNA, 16 bp, Homo sapiens
tctgagctgcagcctg

SEQ ID NO: 6471931 - DNA, 20 bp, Homo sapiens
tctgagctggccctttccag

SEQ ID NO: 6471932 - DNA, 12 bp, Homo sapiens
tctgagctgggc

SEQ ID NO: 6471933 - DNA, 14 bp, Homo sapiens
tctgagctggggag

SEQ ID NO: 6471934 - DNA, 15 bp, Homo sapiens
tctgagctggggagg

SEQ ID NO: 6471935 - DNA, 16 bp, Homo sapiens
tctgagctggggaggt

SEQ ID NO: 6471936 - DNA, 17 bp, Homo sapiens
tctgagctggggaggtg

SEQ ID NO: 6471937 - DNA, 16 bp, Homo sapiens
tctgagctggggtggg

SEQ ID NO: 6471938 - DNA, 10 bp, Homo sapiens
tctgagctgt

SEQ ID NO: 6471939 - DNA, 22 bp, Homo sapiens
tctgagctgttatcttgtgtat

SEQ ID NO: 6471940 - DNA, 18 bp, Homo sapiens
tctgagcttctaaactga

SEQ ID NO: 6471941 - DNA, 13 bp, Homo sapiens
tctgagctttgtt

SEQ ID NO: 6471942 - DNA, 14 bp, Homo sapiens
tctgagctttgtta

SEQ ID NO: 6471943 - DNA, 18 bp, Homo sapiens
tctgagcttttcatggaa

SEQ ID NO: 6471944 - DNA, 20 bp, Homo sapiens
tctgagcttttcatggaagt

SEQ ID NO: 6471945 - DNA, 22 bp, Homo sapiens
tctgagcttttcatggaagtgg

SEQ ID NO: 6471946 - DNA, 23 bp, Homo sapiens
tctgaggaaaatggaagacctaa

SEQ ID NO: 6471947 - DNA, 15 bp, Homo sapiens
tctgaggaagtctta

SEQ ID NO: 6471948 - DNA, 18 bp, Homo sapiens
tctgaggaatccagaccc

SEQ ID NO: 6471949 - DNA, 18 bp, Homo sapiens
tctgaggaattctgtata

SEQ ID NO: 6471950 - DNA, 19 bp, Homo sapiens
tctgaggaattctgtatag

SEQ ID NO: 6471951 - DNA, 20 bp, Homo sapiens
tctgaggaattctgtataga

SEQ ID NO: 6471952 - DNA, 12 bp, Homo sapiens
tctgaggacaag

SEQ ID NO: 6471953 - DNA, 14 bp, Homo sapiens
tctgaggacaagag

SEQ ID NO: 6471954 - DNA, 20 bp, Homo sapiens
tctgaggacactaaccacgc

SEQ ID NO: 6471955 - DNA, 19 bp, Homo sapiens
tctgaggacagagcttgaa

SEQ ID NO: 6471956 - DNA, 20 bp, Homo sapiens
tctgaggacatggagagaga

SEQ ID NO: 6471957 - DNA, 20 bp, Homo sapiens
tctgaggacattccaagaca

SEQ ID NO: 6471958 - DNA, 15 bp, Homo sapiens
tctgaggactgtcct

SEQ ID NO: 6471959 - DNA, 21 bp, Homo sapiens
tctgaggagtaagtgtacaat

SEQ ID NO: 6471960 - DNA, 22 bp, Homo sapiens
tctgaggagtaagtgtacaatt

SEQ ID NO: 6471961 - DNA, 23 bp, Homo sapiens
tctgaggagtaagtgtacaattg

SEQ ID NO: 6471962 - DNA, 13 bp, Homo sapiens
tctgaggagtcca

SEQ ID NO: 6471963 - DNA, 23 bp, Homo sapiens
tctgaggagtggagttctctgtt

SEQ ID NO: 6471964 - DNA, 19 bp, Homo sapiens
tctgaggatgtagagagaa

SEQ ID NO: 6471965 - DNA, 18 bp, Homo sapiens
tctgaggcaaccccctcg

SEQ ID NO: 6471966 - DNA, 14 bp, Homo sapiens
tctgaggcaaggcc

SEQ ID NO: 6471967 - DNA, 20 bp, Homo sapiens
tctgaggcaaggcccagacc

SEQ ID NO: 6471968 - DNA, 22 bp, Homo sapiens
tctgaggcaaggcccagacctg

SEQ ID NO: 6471969 - DNA, 18 bp, Homo sapiens
tctgaggcagatgagctt

SEQ ID NO: 6471970 - DNA, 22 bp, Homo sapiens
tctgaggcagttgacggggcag

SEQ ID NO: 6471971 - DNA, 18 bp, Homo sapiens
tctgaggcatcctctgac

SEQ ID NO: 6471972 - DNA, 16 bp, Homo sapiens
tctgaggccagaaagg

SEQ ID NO: 6471973 - DNA, 17 bp, Homo sapiens
tctgaggccagaaaggt

SEQ ID NO: 6471974 - DNA, 20 bp, Homo sapiens
tctgaggccagaaaggtgtg

SEQ ID NO: 6471975 - DNA, 20 bp, Homo sapiens
tctgaggccagcctggcctc

SEQ ID NO: 6471976 - DNA, 18 bp, Homo sapiens
tctgaggccccaggccct

SEQ ID NO: 6471977 - DNA, 13 bp, Homo sapiens
tctgaggcccctg

SEQ ID NO: 6471978 - DNA, 14 bp, Homo sapiens
tctgaggccctgcc

SEQ ID NO: 6471979 - DNA, 17 bp, Homo sapiens
tctgaggccgttgctga

SEQ ID NO: 6471980 - DNA, 21 bp, Homo sapiens
tctgaggccgttgctgactta

SEQ ID NO: 6471981 - DNA, 14 bp, Homo sapiens
tctgaggcctcatc

SEQ ID NO: 6471982 - DNA, 21 bp, Homo sapiens
tctgaggcctgccccctgggc

SEQ ID NO: 6471983 - DNA, 19 bp, Homo sapiens
tctgaggctctttctgggc

SEQ ID NO: 6471984 - DNA, 11 bp, Homo sapiens
tctgaggctgt

SEQ ID NO: 6471985 - DNA, 16 bp, Homo sapiens
tctgaggcttccagag

SEQ ID NO: 6471986 - DNA, 19 bp, Homo sapiens
tctgaggcttccagagagt

SEQ ID NO: 6471987 - DNA, 16 bp, Homo sapiens
tctgagggaaatgttt

SEQ ID NO: 6471988 - DNA, 17 bp, Homo sapiens
tctgagggaaatgtttt

SEQ ID NO: 6471989 - DNA, 17 bp, Homo sapiens
tctgagggagaggctgt

SEQ ID NO: 6471990 - DNA, 17 bp, Homo sapiens
tctgagggaggaggcca

SEQ ID NO: 6471991 - DNA, 18 bp, Homo sapiens
tctgagggaggaggccac

SEQ ID NO: 6471992 - DNA, 17 bp, Homo sapiens
tctgagggcttgtagtt

SEQ ID NO: 6471993 - DNA, 19 bp, Homo sapiens
tctgaggggctaccaggaa

SEQ ID NO: 6471994 - DNA, 23 bp, Homo sapiens
tctgaggggtgtccgagaggctg

SEQ ID NO: 6471995 - DNA, 15 bp, Homo sapiens
tctgaggtaagtgta

SEQ ID NO: 6471996 - DNA, 22 bp, Homo sapiens
tctgaggtaagtgtatgatctt

SEQ ID NO: 6471997 - DNA, 18 bp, Homo sapiens
tctgaggtcaataaagca

SEQ ID NO: 6471998 - DNA, 20 bp, Homo sapiens
tctgaggtcaataaagcaga

SEQ ID NO: 6471999 - DNA, 21 bp, Homo sapiens
tctgaggtcaataaagcagag

SEQ ID NO: 6472000 - DNA, 20 bp, Homo sapiens
tctgaggtcccttcaaggcc

SEQ ID NO: 6472001 - DNA, 17 bp, Homo sapiens
tctgaggtcctgagcac

SEQ ID NO: 6472002 - DNA, 18 bp, Homo sapiens
tctgaggtgacttaaaaa

SEQ ID NO: 6472003 - DNA, 18 bp, Homo sapiens
tctgaggttggatttgct

SEQ ID NO: 6472004 - DNA, 13 bp, Homo sapiens
tctgagtacagag

SEQ ID NO: 6472005 - DNA, 17 bp, Homo sapiens
tctgagtacttgatttc

SEQ ID NO: 6472006 - DNA, 18 bp, Homo sapiens
tctgagtagtggccactg

SEQ ID NO: 6472007 - DNA, 23 bp, Homo sapiens
tctgagtatctcctcgcaagctg

SEQ ID NO: 6472008 - DNA, 16 bp, Homo sapiens
tctgagtcaaatccag

SEQ ID NO: 6472009 - DNA, 17 bp, Homo sapiens
tctgagtcaaatccagt

SEQ ID NO: 6472010 - DNA, 20 bp, Homo sapiens
tctgagtcaaatccagtggt

SEQ ID NO: 6472011 - DNA, 22 bp, Homo sapiens
tctgagtcaaatccagtggtgg

SEQ ID NO: 6472012 - DNA, 20 bp, Homo sapiens
tctgagtcagagccatgtct

SEQ ID NO: 6472013 - DNA, 16 bp, Homo sapiens
tctgagtcagaggaca

SEQ ID NO: 6472014 - DNA, 15 bp, Homo sapiens
tctgagtcagctgac

SEQ ID NO: 6472015 - DNA, 15 bp, Homo sapiens
tctgagtccactgct

SEQ ID NO: 6472016 - DNA, 18 bp, Homo sapiens
tctgagtccactgctcca

SEQ ID NO: 6472017 - DNA, 17 bp, Homo sapiens
tctgagtccagctcccc

SEQ ID NO: 6472018 - DNA, 16 bp, Homo sapiens
tctgagtcctgagact

SEQ ID NO: 6472019 - DNA, 16 bp, Homo sapiens
tgccctccagggccag

SEQ ID NO: 6472020 - DNA, 22 bp, Homo sapiens
tgccctccagggccaggattca

SEQ ID NO: 6472021 - DNA, 14 bp, Homo sapiens
tgccctccatcccg

SEQ ID NO: 6472022 - DNA, 14 bp, Homo sapiens
tgccctcccagacc

SEQ ID NO: 6472023 - DNA, 17 bp, Homo sapiens
tgccctcccaggaccct

SEQ ID NO: 6472024 - DNA, 18 bp, Homo sapiens
tgccctcccaggaccctc

SEQ ID NO: 6472025 - DNA, 22 bp, Homo sapiens
tgccctcccatgttgcatgcct

SEQ ID NO: 6472026 - DNA, 15 bp, Homo sapiens
tgccctccccagagc

SEQ ID NO: 6472027 - DNA, 16 bp, Homo sapiens
tgccctccccagagca

SEQ ID NO: 6472028 - DNA, 17 bp, Homo sapiens
tgccctccccagagcac

SEQ ID NO: 6472029 - DNA, 20 bp, Homo sapiens
tgccctccccagagcactgg

SEQ ID NO: 6472030 - DNA, 11 bp, Homo sapiens
tgccctccccc

SEQ ID NO: 6472031 - DNA, 12 bp, Homo sapiens
tgccctccccca

SEQ ID NO: 6472032 - DNA, 15 bp, Homo sapiens
tgccctcccctcagc

SEQ ID NO: 6472033 - DNA, 16 bp, Homo sapiens
tgccctcccctcagcg

SEQ ID NO: 6472034 - DNA, 21 bp, Homo sapiens
tgccctcccctcagcgcaggc

SEQ ID NO: 6472035 - DNA, 17 bp, Homo sapiens
tgccctccccttcccct

SEQ ID NO: 6472036 - DNA, 16 bp, Homo sapiens
tgccctccctccttcc

SEQ ID NO: 6472037 - DNA, 20 bp, Homo sapiens
tgccctccctcggccccacc

SEQ ID NO: 6472038 - DNA, 14 bp, Homo sapiens
tgccctccctgctg

SEQ ID NO: 6472039 - DNA, 17 bp, Homo sapiens
tgccctccctgctgcca

SEQ ID NO: 6472040 - DNA, 22 bp, Homo sapiens
tgccctccctgctgccaggctc

SEQ ID NO: 6472041 - DNA, 14 bp, Homo sapiens
tgccctccctggcc

SEQ ID NO: 6472042 - DNA, 21 bp, Homo sapiens
tgccctccctggggtccttgc

SEQ ID NO: 6472043 - DNA, 13 bp, Homo sapiens
tgccctcccttct

SEQ ID NO: 6472044 - DNA, 14 bp, Homo sapiens
tgccctcccttctc

SEQ ID NO: 6472045 - DNA, 17 bp, Homo sapiens
tgccctcccttcttgtg

SEQ ID NO: 6472046 - DNA, 21 bp, Homo sapiens
tgccctccgaagagagttctg

SEQ ID NO: 6472047 - DNA, 23 bp, Homo sapiens
tgccctccgccccgtccccccat

SEQ ID NO: 6472048 - DNA, 15 bp, Homo sapiens
tgccctccgcccttc

SEQ ID NO: 6472049 - DNA, 12 bp, Homo sapiens
tgccctccggag

SEQ ID NO: 6472050 - DNA, 17 bp, Homo sapiens
tgccctccggaggagca

SEQ ID NO: 6472051 - DNA, 20 bp, Homo sapiens
tgccctccggaggagcagcc

SEQ ID NO: 6472052 - DNA, 21 bp, Homo sapiens
tgccctccggaggagcagcct

SEQ ID NO: 6472053 - DNA, 22 bp, Homo sapiens
tgccctccggaggagcagcctc

SEQ ID NO: 6472054 - DNA, 22 bp, Homo sapiens
tgccctccgtcctggcagggca

SEQ ID NO: 6472055 - DNA, 16 bp, Homo sapiens
tgccctcctctcccgt

SEQ ID NO: 6472056 - DNA, 22 bp, Homo sapiens
tgccctcctctcccgtctcgcc

SEQ ID NO: 6472057 - DNA, 11 bp, Homo sapiens
tgccctcctgg

SEQ ID NO: 6472058 - DNA, 15 bp, Homo sapiens
tgccctcctggacaa

SEQ ID NO: 6472059 - DNA, 14 bp, Homo sapiens
tgccctcctgggcc

SEQ ID NO: 6472060 - DNA, 14 bp, Homo sapiens
tgccctcctggtga

SEQ ID NO: 6472061 - DNA, 20 bp, Homo sapiens
tgccctcctgtgctcagccc

SEQ ID NO: 6472062 - DNA, 22 bp, Homo sapiens
tgccctccttgtccacccacct

SEQ ID NO: 6472063 - DNA, 15 bp, Homo sapiens
tgccctcgctgcttc

SEQ ID NO: 6472064 - DNA, 19 bp, Homo sapiens
tgccctcgggcgagtcact

SEQ ID NO: 6472065 - DNA, 19 bp, Homo sapiens
tgccctcgggtggggctgg

SEQ ID NO: 6472066 - DNA, 20 bp, Homo sapiens
tgccctcgtggccagcccgg

SEQ ID NO: 6472067 - DNA, 24 bp, Homo sapiens
tgccctctatttattagccaactg

SEQ ID NO: 6472068 - DNA, 15 bp, Homo sapiens
tgccctctcactgac

SEQ ID NO: 6472069 - DNA, 22 bp, Homo sapiens
tgccctctcactgacttctccc

SEQ ID NO: 6472070 - DNA, 14 bp, Homo sapiens
tgccctctccacac

SEQ ID NO: 6472071 - DNA, 18 bp, Homo sapiens
tgccctctccacacccat

SEQ ID NO: 6472072 - DNA, 16 bp, Homo sapiens
tgccctctcccctcag

SEQ ID NO: 6472073 - DNA, 13 bp, Homo sapiens
tgccctctccctg

SEQ ID NO: 6472074 - DNA, 22 bp, Homo sapiens
tgccctctccctgtgttctggg

SEQ ID NO: 6472075 - DNA, 12 bp, Homo sapiens
tgccctctcctg

SEQ ID NO: 6472076 - DNA, 14 bp, Homo sapiens
tgccctctcctggg

SEQ ID NO: 6472077 - DNA, 15 bp, Homo sapiens
tgccctctcctgggc

SEQ ID NO: 6472078 - DNA, 18 bp, Homo sapiens
tgccctctcctgggcagc

SEQ ID NO: 6472079 - DNA, 20 bp, Homo sapiens
tgccctctcctgggcagctg

SEQ ID NO: 6472080 - DNA, 23 bp, Homo sapiens
tgccctctcctgggcagctgcct

SEQ ID NO: 6472081 - DNA, 16 bp, Homo sapiens
tgccctctccttcctt

SEQ ID NO: 6472082 - DNA, 14 bp, Homo sapiens
tgccctctctcagt

SEQ ID NO: 6472083 - DNA, 12 bp, Homo sapiens
tgccctctctga

SEQ ID NO: 6472084 - DNA, 21 bp, Homo sapiens
tgccctctctgagtctggact

SEQ ID NO: 6472085 - DNA, 12 bp, Homo sapiens
tgccctctctgc

SEQ ID NO: 6472086 - DNA, 12 bp, Homo sapiens
tgccctctgctc

SEQ ID NO: 6472087 - DNA, 14 bp, Homo sapiens
tgccctctgctcta

SEQ ID NO: 6472088 - DNA, 19 bp, Homo sapiens
tgccctctgctctgcctgg

SEQ ID NO: 6472089 - DNA, 21 bp, Homo sapiens
tgccctctgctctgcctggag

SEQ ID NO: 6472090 - DNA, 17 bp, Homo sapiens
tgccctctgctgctgcc

SEQ ID NO: 6472091 - DNA, 20 bp, Homo sapiens
tgccctctgctgctgcccgg

SEQ ID NO: 6472092 - DNA, 12 bp, Homo sapiens
tgccctctggat

SEQ ID NO: 6472093 - DNA, 19 bp, Homo sapiens
tgccctctgggctctgagt

SEQ ID NO: 6472094 - DNA, 21 bp, Homo sapiens
tgccctcttctcacagtcaaa

SEQ ID NO: 6472095 - DNA, 15 bp, Homo sapiens
tgccctctttagcca

SEQ ID NO: 6472096 - DNA, 17 bp, Homo sapiens
tgccctgaaagggccct

SEQ ID NO: 6472097 - DNA, 18 bp, Homo sapiens
tgccctgaccatgcattt

SEQ ID NO: 6472098 - DNA, 15 bp, Homo sapiens
tgccctgacctccca

SEQ ID NO: 6472099 - DNA, 17 bp, Homo sapiens
tgccctgacctcccagc

SEQ ID NO: 6472100 - DNA, 20 bp, Homo sapiens
tgccctgacctcccagccct

SEQ ID NO: 6472101 - DNA, 18 bp, Homo sapiens
tgccctgagcactcctgg

SEQ ID NO: 6472102 - DNA, 22 bp, Homo sapiens
tgccctgagccagggtctccag

SEQ ID NO: 6472103 - DNA, 13 bp, Homo sapiens
tgccctgagccct

SEQ ID NO: 6472104 - DNA, 12 bp, Homo sapiens
tgccctgagctt

SEQ ID NO: 6472105 - DNA, 23 bp, Homo sapiens
tgccctgagctttccggggagga

SEQ ID NO: 6472106 - DNA, 16 bp, Homo sapiens
tgccctgaggagggcc

SEQ ID NO: 6472107 - DNA, 20 bp, Homo sapiens
tgccctgaggagggccctga

SEQ ID NO: 6472108 - DNA, 14 bp, Homo sapiens
tgccctgaggggcc

SEQ ID NO: 6472109 - DNA, 17 bp, Homo sapiens
tgccctgaggggcctgc

SEQ ID NO: 6472110 - DNA, 15 bp, Homo sapiens
tgccctgaggggctg

SEQ ID NO: 6472111 - DNA, 19 bp, Homo sapiens
tgccctgaggggctgggga

SEQ ID NO: 6472112 - DNA, 21 bp, Homo sapiens
tgccctgaggggctggggagg

SEQ ID NO: 6472113 - DNA, 23 bp, Homo sapiens
tgccctgagtggatctccaagga

SEQ ID NO: 6472114 - DNA, 14 bp, Homo sapiens
tgccctgcaccttg

SEQ ID NO: 6472115 - DNA, 14 bp, Homo sapiens
tgccctgcagcacg

SEQ ID NO: 6472116 - DNA, 12 bp, Homo sapiens
tgccctgcaggc

SEQ ID NO: 6472117 - DNA, 20 bp, Homo sapiens
tgccctgcaggcacagagga

SEQ ID NO: 6472118 - DNA, 20 bp, Homo sapiens
tgccctgccaagcctggagc

SEQ ID NO: 6472119 - DNA, 15 bp, Homo sapiens
tgccctgccacctgt

SEQ ID NO: 6472120 - DNA, 16 bp, Homo sapiens
tgccctgccaggctgt

SEQ ID NO: 6472121 - DNA, 16 bp, Homo sapiens
tgccctgcccaacctc

SEQ ID NO: 6472122 - DNA, 16 bp, Homo sapiens
tgccctgcccacctgg

SEQ ID NO: 6472123 - DNA, 15 bp, Homo sapiens
tgccctgcccaggta

SEQ ID NO: 6472124 - DNA, 22 bp, Homo sapiens
tgccctgcccaggtatcctggg

SEQ ID NO: 6472125 - DNA, 22 bp, Homo sapiens
tgccctgcccatactgagcctg

SEQ ID NO: 6472126 - DNA, 23 bp, Homo sapiens
tgccctgcccatactgagcctgc

SEQ ID NO: 6472127 - DNA, 16 bp, Homo sapiens
tgccctgcccccacga

SEQ ID NO: 6472128 - DNA, 11 bp, Homo sapiens
tgccctgccct

SEQ ID NO: 6472129 - DNA, 15 bp, Homo sapiens
tgccctgccctcctg

SEQ ID NO: 6472130 - DNA, 15 bp, Homo sapiens
tgccctgccctgcca

SEQ ID NO: 6472131 - DNA, 15 bp, Homo sapiens
tgccctgcccttcct

SEQ ID NO: 6472132 - DNA, 17 bp, Homo sapiens
tgccctgcccttcctca

SEQ ID NO: 6472133 - DNA, 18 bp, Homo sapiens
tgccctgcctcagccagg

SEQ ID NO: 6472134 - DNA, 12 bp, Homo sapiens
tgccctgcctgc

SEQ ID NO: 6472135 - DNA, 14 bp, Homo sapiens
tgccctgcctgccc

SEQ ID NO: 6472136 - DNA, 16 bp, Homo sapiens
tgccctgcctgcccac

SEQ ID NO: 6472137 - DNA, 18 bp, Homo sapiens
tgccctgcctgcccactt

SEQ ID NO: 6472138 - DNA, 17 bp, Homo sapiens
tgccctgcctgggcctt

SEQ ID NO: 6472139 - DNA, 17 bp, Homo sapiens
tgccctgccttgccgct

SEQ ID NO: 6472140 - DNA, 23 bp, Homo sapiens
tgccctgcgaagtggctctcagg

SEQ ID NO: 6472141 - DNA, 15 bp, Homo sapiens
tgccctgcggctctg

SEQ ID NO: 6472142 - DNA, 18 bp, Homo sapiens
tgccctgcggctctggaa

SEQ ID NO: 6472143 - DNA, 19 bp, Homo sapiens
tgccctgcggctctggaaa

SEQ ID NO: 6472144 - DNA, 13 bp, Homo sapiens
tgccctgcgtccc

SEQ ID NO: 6472145 - DNA, 10 bp, Homo sapiens
tgccctgcta

SEQ ID NO: 6472146 - DNA, 19 bp, Homo sapiens
tgccctgctctgcccaggc

SEQ ID NO: 6472147 - DNA, 21 bp, Homo sapiens
tgccctgctctgcccaggcaa

SEQ ID NO: 6472148 - DNA, 17 bp, Homo sapiens
tgccctgctgagcacag

SEQ ID NO: 6472149 - DNA, 21 bp, Homo sapiens
tgccctgctgccgcctcccag

SEQ ID NO: 6472150 - DNA, 13 bp, Homo sapiens
tgccctgctgttt

SEQ ID NO: 6472151 - DNA, 15 bp, Homo sapiens
tgccctgctttgcaa

SEQ ID NO: 6472152 - DNA, 14 bp, Homo sapiens
tgccctggaaccta

SEQ ID NO: 6472153 - DNA, 17 bp, Homo sapiens
tgccctggactgtttca

SEQ ID NO: 6472154 - DNA, 18 bp, Homo sapiens
tgccctggagcctcagca

SEQ ID NO: 6472155 - DNA, 20 bp, Homo sapiens
tgccctggagcctcagcagc

SEQ ID NO: 6472156 - DNA, 22 bp, Homo sapiens
tgccctggagcctcagcagcaa

SEQ ID NO: 6472157 - DNA, 23 bp, Homo sapiens
tgccctggagcctcagcagcaaa

SEQ ID NO: 6472158 - DNA, 19 bp, Homo sapiens
tgccctggaggaaccgaaa

SEQ ID NO: 6472159 - DNA, 13 bp, Homo sapiens
tgccctggaggga

SEQ ID NO: 6472160 - DNA, 15 bp, Homo sapiens
tgccctggagggagg

SEQ ID NO: 6472161 - DNA, 16 bp, Homo sapiens
tgccctggaggtggct

SEQ ID NO: 6472162 - DNA, 18 bp, Homo sapiens
tgccctggatgcccagga

SEQ ID NO: 6472163 - DNA, 23 bp, Homo sapiens
tgccctggcagggtcatcctgtg

SEQ ID NO: 6472164 - DNA, 19 bp, Homo sapiens
tgccctggccactggccct

SEQ ID NO: 6472165 - DNA, 12 bp, Homo sapiens
tgccctggccta

SEQ ID NO: 6472166 - DNA, 14 bp, Homo sapiens
tgccctggcctacc

SEQ ID NO: 6472167 - DNA, 23 bp, Homo sapiens
tgccctggcctaccacagctgcc

SEQ ID NO: 6472168 - DNA, 14 bp, Homo sapiens
tgccctggctccag

SEQ ID NO: 6472169 - DNA, 21 bp, Homo sapiens
tgccctggctccagtgaaact

SEQ ID NO: 6472170 - DNA, 18 bp, Homo sapiens
tgccctggctccttgcag

SEQ ID NO: 6472171 - DNA, 15 bp, Homo sapiens
tgccctgggaggcag

SEQ ID NO: 6472172 - DNA, 17 bp, Homo sapiens
tgccctgggaggcagtg

SEQ ID NO: 6472173 - DNA, 16 bp, Homo sapiens
tgccctgggatgcctc

SEQ ID NO: 6472174 - DNA, 19 bp, Homo sapiens
tgccctgggatgcctcacc

SEQ ID NO: 6472175 - DNA, 16 bp, Homo sapiens
tgccctgggatgtcca

SEQ ID NO: 6472176 - DNA, 23 bp, Homo sapiens
tgccctgggccaaaaccaatgct

SEQ ID NO: 6472177 - DNA, 13 bp, Homo sapiens
tgccctgggccag

SEQ ID NO: 6472178 - DNA, 18 bp, Homo sapiens
tgccctgggccaggcagg

SEQ ID NO: 6472179 - DNA, 19 bp, Homo sapiens
tgccctgggcgagcccctc

SEQ ID NO: 6472180 - DNA, 19 bp, Homo sapiens
tgccctgggctgcctcctc

SEQ ID NO: 6472181 - DNA, 12 bp, Homo sapiens
tgccctggggca

SEQ ID NO: 6472182 - DNA, 22 bp, Homo sapiens
tgccctggggcatccaccttcc

SEQ ID NO: 6472183 - DNA, 23 bp, Homo sapiens
tgccctgggggataccagctgag

SEQ ID NO: 6472184 - DNA, 17 bp, Homo sapiens
tgccctggtagggcagt

SEQ ID NO: 6472185 - DNA, 21 bp, Homo sapiens
tgccctggtgaatcacctggc

SEQ ID NO: 6472186 - DNA, 22 bp, Homo sapiens
tgccctggtgaatcacctggct

SEQ ID NO: 6472187 - DNA, 12 bp, Homo sapiens
tgccctggtgct

SEQ ID NO: 6472188 - DNA, 16 bp, Homo sapiens
tgccctggtgctgcca

SEQ ID NO: 6472189 - DNA, 21 bp, Homo sapiens
tgccctggtgctgccacactt

SEQ ID NO: 6472190 - DNA, 22 bp, Homo sapiens
tgccctggtggagaaagcactg

SEQ ID NO: 6472191 - DNA, 22 bp, Homo sapiens
tgccctggtggccctctcccct

SEQ ID NO: 6472192 - DNA, 15 bp, Homo sapiens
tgccctggtttcact

SEQ ID NO: 6472193 - DNA, 17 bp, Homo sapiens
tgccctggtttcctgcc

SEQ ID NO: 6472194 - DNA, 23 bp, Homo sapiens
tgccctggtttcctgccctggga

SEQ ID NO: 6472195 - DNA, 20 bp, Homo sapiens
tgccctgtacctctctctgc

SEQ ID NO: 6472196 - DNA, 12 bp, Homo sapiens
tgccctgtagct

SEQ ID NO: 6472197 - DNA, 14 bp, Homo sapiens
tgccctgtagctcc

SEQ ID NO: 6472198 - DNA, 17 bp, Homo sapiens
tctgagtctagatacag

SEQ ID NO: 6472199 - DNA, 12 bp, Homo sapiens
tctgagtctatg

SEQ ID NO: 6472200 - DNA, 15 bp, Homo sapiens
tctgagtctcttgga

SEQ ID NO: 6472201 - DNA, 15 bp, Homo sapiens
tctgagtctggactt

SEQ ID NO: 6472202 - DNA, 20 bp, Homo sapiens
tctgagtgaacctgtataag

SEQ ID NO: 6472203 - DNA, 19 bp, Homo sapiens
tctgagtgaatactttgat

SEQ ID NO: 6472204 - DNA, 22 bp, Homo sapiens
tctgagtgacatgggtgtgcca

SEQ ID NO: 6472205 - DNA, 18 bp, Homo sapiens
tctgagtgagttttactc

SEQ ID NO: 6472206 - DNA, 22 bp, Homo sapiens
tctgagtgcaaacttcagagtt

SEQ ID NO: 6472207 - DNA, 16 bp, Homo sapiens
tctgagtgccttctgt

SEQ ID NO: 6472208 - DNA, 22 bp, Homo sapiens
tctgagtggggcttcctgggca

SEQ ID NO: 6472209 - DNA, 15 bp, Homo sapiens
tctgagtgtctctgc

SEQ ID NO: 6472210 - DNA, 16 bp, Homo sapiens
tctgagtgtctctgcc

SEQ ID NO: 6472211 - DNA, 14 bp, Homo sapiens
tctgagtgttgaag

SEQ ID NO: 6472212 - DNA, 24 bp, Homo sapiens
tctgagtgtttttactacagttgt

SEQ ID NO: 6472213 - DNA, 22 bp, Homo sapiens
tctgagttaggttccagcatgt

SEQ ID NO: 6472214 - DNA, 18 bp, Homo sapiens
tctgagttctctttctta

SEQ ID NO: 6472215 - DNA, 21 bp, Homo sapiens
tctgagttctctttcttagtc

SEQ ID NO: 6472216 - DNA, 15 bp, Homo sapiens
tctgagttcttgtgt

SEQ ID NO: 6472217 - DNA, 20 bp, Homo sapiens
tctgagttcttgtgtcctgg

SEQ ID NO: 6472218 - DNA, 14 bp, Homo sapiens
tctgagttttacca

SEQ ID NO: 6472219 - DNA, 19 bp, Homo sapiens
tctgataaaattgtgatgt

SEQ ID NO: 6472220 - DNA, 21 bp, Homo sapiens
tctgataaaattgtgatgttt

SEQ ID NO: 6472221 - DNA, 13 bp, Homo sapiens
tctgataaacaca

SEQ ID NO: 6472222 - DNA, 17 bp, Homo sapiens
tctgataaagttcctta

SEQ ID NO: 6472223 - DNA, 18 bp, Homo sapiens
tctgataaagttgagaga

SEQ ID NO: 6472224 - DNA, 14 bp, Homo sapiens
tctgataactagat

SEQ ID NO: 6472225 - DNA, 22 bp, Homo sapiens
tctgataactagatggtgctga

SEQ ID NO: 6472226 - DNA, 22 bp, Homo sapiens
tctgataagaacccagggtgga

SEQ ID NO: 6472227 - DNA, 22 bp, Homo sapiens
tctgataagactggaaaatagt

SEQ ID NO: 6472228 - DNA, 19 bp, Homo sapiens
tctgataagagaatcaaca

SEQ ID NO: 6472229 - DNA, 14 bp, Homo sapiens
tctgataagctgtt

SEQ ID NO: 6472230 - DNA, 22 bp, Homo sapiens
tctgataagcttcctagaaagt

SEQ ID NO: 6472231 - DNA, 13 bp, Homo sapiens
tctgataatatat

SEQ ID NO: 6472232 - DNA, 18 bp, Homo sapiens
tctgataatatattttca

SEQ ID NO: 6472233 - DNA, 15 bp, Homo sapiens
tctgataatgaaaat

SEQ ID NO: 6472234 - DNA, 14 bp, Homo sapiens
tctgataatgtatt

SEQ ID NO: 6472235 - DNA, 18 bp, Homo sapiens
tctgataatttattgtct

SEQ ID NO: 6472236 - DNA, 20 bp, Homo sapiens
tctgataatttattgtcttt

SEQ ID NO: 6472237 - DNA, 14 bp, Homo sapiens
tctgatacacagta

SEQ ID NO: 6472238 - DNA, 23 bp, Homo sapiens
tctgataccttctggctgtgcta

SEQ ID NO: 6472239 - DNA, 19 bp, Homo sapiens
tctgatactttagtacaat

SEQ ID NO: 6472240 - DNA, 13 bp, Homo sapiens
tctgatagacttt

SEQ ID NO: 6472241 - DNA, 22 bp, Homo sapiens
tctgatagactttgtgaatctg

SEQ ID NO: 6472242 - DNA, 22 bp, Homo sapiens
tctgatagagtttaacagatat

SEQ ID NO: 6472243 - DNA, 16 bp, Homo sapiens
tctgataggaaaagaa

SEQ ID NO: 6472244 - DNA, 15 bp, Homo sapiens
tctgataggaacaga

SEQ ID NO: 6472245 - DNA, 21 bp, Homo sapiens
tctgatagggtttgtgacagg

SEQ ID NO: 6472246 - DNA, 22 bp, Homo sapiens
tctgatagggtttgtgacaggg

SEQ ID NO: 6472247 - DNA, 15 bp, Homo sapiens
tctgatatcagcact

SEQ ID NO: 6472248 - DNA, 22 bp, Homo sapiens
tctgatatcaggaaatatctgt

SEQ ID NO: 6472249 - DNA, 14 bp, Homo sapiens
tctgatatgggact

SEQ ID NO: 6472250 - DNA, 15 bp, Homo sapiens
tctgatatgggactg

SEQ ID NO: 6472251 - DNA, 17 bp, Homo sapiens
tctgatattaaagattt

SEQ ID NO: 6472252 - DNA, 13 bp, Homo sapiens
tctgatattaatc

SEQ ID NO: 6472253 - DNA, 17 bp, Homo sapiens
tctgatattaatcaaaa

SEQ ID NO: 6472254 - DNA, 20 bp, Homo sapiens
tctgatattcaaacacacag

SEQ ID NO: 6472255 - DNA, 19 bp, Homo sapiens
tctgatattccatgaatgt

SEQ ID NO: 6472256 - DNA, 22 bp, Homo sapiens
tctgatattccatgaatgtatc

SEQ ID NO: 6472257 - DNA, 23 bp, Homo sapiens
tctgatattgcagtaatgatatt

SEQ ID NO: 6472258 - DNA, 13 bp, Homo sapiens
tctgatcaagagt

SEQ ID NO: 6472259 - DNA, 14 bp, Homo sapiens
tctgatcaatcatt

SEQ ID NO: 6472260 - DNA, 14 bp, Homo sapiens
tctgatcacaactt

SEQ ID NO: 6472261 - DNA, 19 bp, Homo sapiens
tctgatcacaacttttctg

SEQ ID NO: 6472262 - DNA, 20 bp, Homo sapiens
tctgatcacattcttcaaag

SEQ ID NO: 6472263 - DNA, 20 bp, Homo sapiens
tctgatcacccccctgctta

SEQ ID NO: 6472264 - DNA, 16 bp, Homo sapiens
tctgatcacttcatgt

SEQ ID NO: 6472265 - DNA, 14 bp, Homo sapiens
tctgatccagtttt

SEQ ID NO: 6472266 - DNA, 17 bp, Homo sapiens
tctgatcccctttggtt

SEQ ID NO: 6472267 - DNA, 18 bp, Homo sapiens
tctgatcccctttggttt

SEQ ID NO: 6472268 - DNA, 15 bp, Homo sapiens
tctgatccctctggg

SEQ ID NO: 6472269 - DNA, 22 bp, Homo sapiens
tctgatccctctgggggctctg

SEQ ID NO: 6472270 - DNA, 23 bp, Homo sapiens
tctgatccctctgggggctctgg

SEQ ID NO: 6472271 - DNA, 21 bp, Homo sapiens
tctgatcctcagcccctccag

SEQ ID NO: 6472272 - DNA, 14 bp, Homo sapiens
tctgatcctctctt

SEQ ID NO: 6472273 - DNA, 14 bp, Homo sapiens
tctgatcggccagt

SEQ ID NO: 6472274 - DNA, 18 bp, Homo sapiens
tctgatcgggataacaaa

SEQ ID NO: 6472275 - DNA, 20 bp, Homo sapiens
tctgatcgggataacaaaat

SEQ ID NO: 6472276 - DNA, 23 bp, Homo sapiens
tctgatcgggataacaaaatcac

SEQ ID NO: 6472277 - DNA, 15 bp, Homo sapiens
tctgatcgtctcggc

SEQ ID NO: 6472278 - DNA, 18 bp, Homo sapiens
tctgatctaacaaaataa

SEQ ID NO: 6472279 - DNA, 13 bp, Homo sapiens
tctgatctataca

SEQ ID NO: 6472280 - DNA, 14 bp, Homo sapiens
tctgatctgaggct

SEQ ID NO: 6472281 - DNA, 18 bp, Homo sapiens
tctgatctgtactttgtg

SEQ ID NO: 6472282 - DNA, 12 bp, Homo sapiens
tctgatctgtga

SEQ ID NO: 6472283 - DNA, 18 bp, Homo sapiens
tctgatctgtgctttcca

SEQ ID NO: 6472284 - DNA, 21 bp, Homo sapiens
tctgatcttggaaaaacagcg

SEQ ID NO: 6472285 - DNA, 15 bp, Homo sapiens
tctgatgaaaaattg

SEQ ID NO: 6472286 - DNA, 22 bp, Homo sapiens
tctgatgaaaaattgctgactg

SEQ ID NO: 6472287 - DNA, 21 bp, Homo sapiens
tctgatgaaaatattctgatt

SEQ ID NO: 6472288 - DNA, 15 bp, Homo sapiens
tctgatgaaatgtta

SEQ ID NO: 6472289 - DNA, 20 bp, Homo sapiens
tctgatgaaatgttaacaat

SEQ ID NO: 6472290 - DNA, 17 bp, Homo sapiens
tctgatgacgcctgtct

SEQ ID NO: 6472291 - DNA, 15 bp, Homo sapiens
tctgatgaggcattt

SEQ ID NO: 6472292 - DNA, 16 bp, Homo sapiens
tctgatgaggcatttt

SEQ ID NO: 6472293 - DNA, 16 bp, Homo sapiens
tctgatgatgtgcctg

SEQ ID NO: 6472294 - DNA, 16 bp, Homo sapiens
tctgatgcaagcaaga

SEQ ID NO: 6472295 - DNA, 21 bp, Homo sapiens
tctgatgcaagcaagaaacac

SEQ ID NO: 6472296 - DNA, 23 bp, Homo sapiens
tctgatgcaagcaagaaacactg

SEQ ID NO: 6472297 - DNA, 12 bp, Homo sapiens
tctgatgcagaa

SEQ ID NO: 6472298 - DNA, 16 bp, Homo sapiens
tctgatgcagtgccct

SEQ ID NO: 6472299 - DNA, 20 bp, Homo sapiens
tctgatgcagtgccctagaa

SEQ ID NO: 6472300 - DNA, 23 bp, Homo sapiens
tctgatgcagtgccctagaaggg

SEQ ID NO: 6472301 - DNA, 15 bp, Homo sapiens
tctgatgccaaagct

SEQ ID NO: 6472302 - DNA, 17 bp, Homo sapiens
tctgatgccaaagctgc

SEQ ID NO: 6472303 - DNA, 16 bp, Homo sapiens
tctgatgcccaccgag

SEQ ID NO: 6472304 - DNA, 18 bp, Homo sapiens
tctgatgctaggttgttt

SEQ ID NO: 6472305 - DNA, 17 bp, Homo sapiens
tctgatgcttacatctg

SEQ ID NO: 6472306 - DNA, 20 bp, Homo sapiens
tctgatggaactgtgtattt

SEQ ID NO: 6472307 - DNA, 21 bp, Homo sapiens
tctgatggaactgtgtattta

SEQ ID NO: 6472308 - DNA, 20 bp, Homo sapiens
tctgatggaatgtgccacct

SEQ ID NO: 6472309 - DNA, 23 bp, Homo sapiens
tctgatggcacttttgagctcct

SEQ ID NO: 6472310 - DNA, 21 bp, Homo sapiens
tctgatggccttaatttcctt

SEQ ID NO: 6472311 - DNA, 22 bp, Homo sapiens
tctgatggccttaatttccttt

SEQ ID NO: 6472312 - DNA, 16 bp, Homo sapiens
tctgatggctgctcca

SEQ ID NO: 6472313 - DNA, 18 bp, Homo sapiens
tctgatggcttctccagg

SEQ ID NO: 6472314 - DNA, 19 bp, Homo sapiens
tctgatgggaggaaagtag

SEQ ID NO: 6472315 - DNA, 15 bp, Homo sapiens
tctgatgtactctaa

SEQ ID NO: 6472316 - DNA, 15 bp, Homo sapiens
tctgatgtataatgt

SEQ ID NO: 6472317 - DNA, 16 bp, Homo sapiens
tctgatgtataatgta

SEQ ID NO: 6472318 - DNA, 17 bp, Homo sapiens
tctgatgtataatgtaa

SEQ ID NO: 6472319 - DNA, 14 bp, Homo sapiens
tctgatgtctctaa

SEQ ID NO: 6472320 - DNA, 19 bp, Homo sapiens
tctgatgttctttccatga

SEQ ID NO: 6472321 - DNA, 16 bp, Homo sapiens
tctgatgtttcatatt

SEQ ID NO: 6472322 - DNA, 15 bp, Homo sapiens
tctgatgtttctgtg

SEQ ID NO: 6472323 - DNA, 13 bp, Homo sapiens
tctgatgtttgtt

SEQ ID NO: 6472324 - DNA, 21 bp, Homo sapiens
tctgatgttttgatgccattt

SEQ ID NO: 6472325 - DNA, 19 bp, Homo sapiens
tctgattaaaatgcttcct

SEQ ID NO: 6472326 - DNA, 21 bp, Homo sapiens
tctgattaaatttaatatact

SEQ ID NO: 6472327 - DNA, 15 bp, Homo sapiens
tctgattaagcattc

SEQ ID NO: 6472328 - DNA, 13 bp, Homo sapiens
tctgattacatgt

SEQ ID NO: 6472329 - DNA, 13 bp, Homo sapiens
tctgattagaagt

SEQ ID NO: 6472330 - DNA, 21 bp, Homo sapiens
tctgattagagtgcaaaagtg

SEQ ID NO: 6472331 - DNA, 20 bp, Homo sapiens
tctgattagttgacagtatt

SEQ ID NO: 6472332 - DNA, 17 bp, Homo sapiens
tctgattataagacaat

SEQ ID NO: 6472333 - DNA, 21 bp, Homo sapiens
tctgattataccatgtgtgct

SEQ ID NO: 6472334 - DNA, 18 bp, Homo sapiens
tctgattatcaggtactg

SEQ ID NO: 6472335 - DNA, 19 bp, Homo sapiens
tctgattatgtaagcattt

SEQ ID NO: 6472336 - DNA, 19 bp, Homo sapiens
tctgattatttgcagctgc

SEQ ID NO: 6472337 - DNA, 13 bp, Homo sapiens
tctgattcaaaag

SEQ ID NO: 6472338 - DNA, 22 bp, Homo sapiens
tctgattcacctcttcctctgg

SEQ ID NO: 6472339 - DNA, 18 bp, Homo sapiens
tctgattcactattagag

SEQ ID NO: 6472340 - DNA, 18 bp, Homo sapiens
tctgattcccaagctctg

SEQ ID NO: 6472341 - DNA, 20 bp, Homo sapiens
tctgattcccaagctctgct

SEQ ID NO: 6472342 - DNA, 17 bp, Homo sapiens
tctgattccgcaccctg

SEQ ID NO: 6472343 - DNA, 21 bp, Homo sapiens
tctgattccgcaccctgccta

SEQ ID NO: 6472344 - DNA, 13 bp, Homo sapiens
tctgattccttta

SEQ ID NO: 6472345 - DNA, 13 bp, Homo sapiens
tctgattctatgc

SEQ ID NO: 6472346 - DNA, 13 bp, Homo sapiens
tctgattctatgt

SEQ ID NO: 6472347 - DNA, 17 bp, Homo sapiens
tctgattctatgtaact

SEQ ID NO: 6472348 - DNA, 12 bp, Homo sapiens
tctgattctgat

SEQ ID NO: 6472349 - DNA, 15 bp, Homo sapiens
tctgattctggcttt

SEQ ID NO: 6472350 - DNA, 23 bp, Homo sapiens
tctgattctggctttaagccttc

SEQ ID NO: 6472351 - DNA, 15 bp, Homo sapiens
tctgattcttcaaag

SEQ ID NO: 6472352 - DNA, 14 bp, Homo sapiens
tctgattgaaacat

SEQ ID NO: 6472353 - DNA, 20 bp, Homo sapiens
tctgattgaaacatgaaaca

SEQ ID NO: 6472354 - DNA, 12 bp, Homo sapiens
tctgattgattt

SEQ ID NO: 6472355 - DNA, 16 bp, Homo sapiens
tctgattgctatcagc

SEQ ID NO: 6472356 - DNA, 23 bp, Homo sapiens
tctgattggacattttcttcaga

SEQ ID NO: 6472357 - DNA, 18 bp, Homo sapiens
tctgattggctcacccaa

SEQ ID NO: 6472358 - DNA, 13 bp, Homo sapiens
tctgattggcttg

SEQ ID NO: 6472359 - DNA, 20 bp, Homo sapiens
tctgattgtaacgttgctgt

SEQ ID NO: 6472360 - DNA, 22 bp, Homo sapiens
tctgattgtaacgttgctgtgg

SEQ ID NO: 6472361 - DNA, 13 bp, Homo sapiens
tctgattgtgttg

SEQ ID NO: 6472362 - DNA, 19 bp, Homo sapiens
tctgattgttcctccccag

SEQ ID NO: 6472363 - DNA, 18 bp, Homo sapiens
tctgatttaatgttttct

SEQ ID NO: 6472364 - DNA, 20 bp, Homo sapiens
tctgatttaatgttttctgc

SEQ ID NO: 6472365 - DNA, 13 bp, Homo sapiens
tctgatttaattg

SEQ ID NO: 6472366 - DNA, 18 bp, Homo sapiens
tctgatttactctttggg

SEQ ID NO: 6472367 - DNA, 20 bp, Homo sapiens
tctgatttattttgtatgaa

SEQ ID NO: 6472368 - DNA, 22 bp, Homo sapiens
tctgatttattttgtatgaaat

SEQ ID NO: 6472369 - DNA, 16 bp, Homo sapiens
tctgatttcagttttt

SEQ ID NO: 6472370 - DNA, 13 bp, Homo sapiens
tctgatttcatta

SEQ ID NO: 6472371 - DNA, 16 bp, Homo sapiens
tctgatttctgaacta

SEQ ID NO: 6472372 - DNA, 20 bp, Homo sapiens
tctgatttcttttcaccatt

SEQ ID NO: 6472373 - DNA, 14 bp, Homo sapiens
tctgatttgcaaat

SEQ ID NO: 6472374 - DNA, 17 bp, Homo sapiens
tctgatttgctgctctt

SEQ ID NO: 6472375 - DNA, 21 bp, Homo sapiens
tctgatttgtaatgagcacct

SEQ ID NO: 6472376 - DNA, 22 bp, Homo sapiens
tgccctgtcaagcttctctgtt

SEQ ID NO: 6472377 - DNA, 16 bp, Homo sapiens
tgccctgtcaggaggc

SEQ ID NO: 6472378 - DNA, 19 bp, Homo sapiens
tgccctgtcaggaggcaga

SEQ ID NO: 6472379 - DNA, 21 bp, Homo sapiens
tgccctgtccaaaagcgccct

SEQ ID NO: 6472380 - DNA, 17 bp, Homo sapiens
tgccctgtgagagccac

SEQ ID NO: 6472381 - DNA, 21 bp, Homo sapiens
tgccctgtgagagccacgctg

SEQ ID NO: 6472382 - DNA, 23 bp, Homo sapiens
tgccctgtgagagccacgctggc

SEQ ID NO: 6472383 - DNA, 12 bp, Homo sapiens
tgccctgtgccg

SEQ ID NO: 6472384 - DNA, 20 bp, Homo sapiens
tgccctgtgccgcactctgg

SEQ ID NO: 6472385 - DNA, 16 bp, Homo sapiens
tgccctgtggacagga

SEQ ID NO: 6472386 - DNA, 14 bp, Homo sapiens
tgccctgtggattc

SEQ ID NO: 6472387 - DNA, 15 bp, Homo sapiens
tgccctgtgggagag

SEQ ID NO: 6472388 - DNA, 14 bp, Homo sapiens
tgccctgtgtggct

SEQ ID NO: 6472389 - DNA, 19 bp, Homo sapiens
tgccctgtgttctttcccc

SEQ ID NO: 6472390 - DNA, 19 bp, Homo sapiens
tgccctgttaaaagatgaa

SEQ ID NO: 6472391 - DNA, 17 bp, Homo sapiens
tgccctgttcaaagtac

SEQ ID NO: 6472392 - DNA, 17 bp, Homo sapiens
tgccctgttcatgtgcc

SEQ ID NO: 6472393 - DNA, 23 bp, Homo sapiens
tgccctgttcatgtgcctctgcg

SEQ ID NO: 6472394 - DNA, 18 bp, Homo sapiens
tgccctgttggtttcaca

SEQ ID NO: 6472395 - DNA, 19 bp, Homo sapiens
tgcccttaaaataatgatt

SEQ ID NO: 6472396 - DNA, 23 bp, Homo sapiens
tgcccttaaggatcaccccagcc

SEQ ID NO: 6472397 - DNA, 19 bp, Homo sapiens
tgcccttacacgtgcgtgt

SEQ ID NO: 6472398 - DNA, 17 bp, Homo sapiens
tgcccttaccccacaca

SEQ ID NO: 6472399 - DNA, 22 bp, Homo sapiens
tgcccttacctgccaggaagcc

SEQ ID NO: 6472400 - DNA, 20 bp, Homo sapiens
tgcccttacctgtctctctc

SEQ ID NO: 6472401 - DNA, 17 bp, Homo sapiens
tgcccttcactttctcc

SEQ ID NO: 6472402 - DNA, 23 bp, Homo sapiens
tgcccttcagcatcctcagttcc

SEQ ID NO: 6472403 - DNA, 20 bp, Homo sapiens
tgcccttcaggacccttcta

SEQ ID NO: 6472404 - DNA, 15 bp, Homo sapiens
tgcccttcataccct

SEQ ID NO: 6472405 - DNA, 22 bp, Homo sapiens
tgcccttccccctttctctgcc

SEQ ID NO: 6472406 - DNA, 12 bp, Homo sapiens
tgcccttccctg

SEQ ID NO: 6472407 - DNA, 16 bp, Homo sapiens
tgcccttccctgtccc

SEQ ID NO: 6472408 - DNA, 14 bp, Homo sapiens
tgcccttcctcagg

SEQ ID NO: 6472409 - DNA, 15 bp, Homo sapiens
tgcccttcctgaccc

SEQ ID NO: 6472410 - DNA, 14 bp, Homo sapiens
tgcccttcgctgcc

SEQ ID NO: 6472411 - DNA, 18 bp, Homo sapiens
tgcccttctcaagacttt

SEQ ID NO: 6472412 - DNA, 13 bp, Homo sapiens
tgcccttctttct

SEQ ID NO: 6472413 - DNA, 18 bp, Homo sapiens
tgcccttgaaccccctcc

SEQ ID NO: 6472414 - DNA, 18 bp, Homo sapiens
tgcccttgccctgacctc

SEQ ID NO: 6472415 - DNA, 17 bp, Homo sapiens
tgcccttgctccagcct

SEQ ID NO: 6472416 - DNA, 13 bp, Homo sapiens
tgcccttgctgcc

SEQ ID NO: 6472417 - DNA, 14 bp, Homo sapiens
tgcccttgctgccc

SEQ ID NO: 6472418 - DNA, 14 bp, Homo sapiens
tgcccttgctgggc

SEQ ID NO: 6472419 - DNA, 18 bp, Homo sapiens
tgcccttgctgggcctgg

SEQ ID NO: 6472420 - DNA, 20 bp, Homo sapiens
tgcccttggtagcagcctgg

SEQ ID NO: 6472421 - DNA, 15 bp, Homo sapiens
tgcccttgtctgaga

SEQ ID NO: 6472422 - DNA, 15 bp, Homo sapiens
tgccctttagggctg

SEQ ID NO: 6472423 - DNA, 19 bp, Homo sapiens
tgccctttagggctgttgc

SEQ ID NO: 6472424 - DNA, 12 bp, Homo sapiens
tgccctttccat

SEQ ID NO: 6472425 - DNA, 17 bp, Homo sapiens
tgccctttccatattta

SEQ ID NO: 6472426 - DNA, 22 bp, Homo sapiens
tgccctttcctaggcccaggcc

SEQ ID NO: 6472427 - DNA, 17 bp, Homo sapiens
tgccctttggccaacag

SEQ ID NO: 6472428 - DNA, 21 bp, Homo sapiens
tgccctttggggttgcccagc

SEQ ID NO: 6472429 - DNA, 15 bp, Homo sapiens
tgccctttgtcctcc

SEQ ID NO: 6472430 - DNA, 18 bp, Homo sapiens
tgcccttttaaatggcat

SEQ ID NO: 6472431 - DNA, 17 bp, Homo sapiens
tgcccttttttctgcct

SEQ ID NO: 6472432 - DNA, 16 bp, Homo sapiens
tgccgaaactggaagt

SEQ ID NO: 6472433 - DNA, 15 bp, Homo sapiens
tgccgaacacacatc

SEQ ID NO: 6472434 - DNA, 20 bp, Homo sapiens
tgccgaacattaggaattgt

SEQ ID NO: 6472435 - DNA, 21 bp, Homo sapiens
tgccgaagaattgtcttgcaa

SEQ ID NO: 6472436 - DNA, 19 bp, Homo sapiens
tgccgaagtccagctttct

SEQ ID NO: 6472437 - DNA, 18 bp, Homo sapiens
tgccgaatttggtacaca

SEQ ID NO: 6472438 - DNA, 21 bp, Homo sapiens
tgccgaatttggtacacatgt

SEQ ID NO: 6472439 - DNA, 15 bp, Homo sapiens
tgccgacagaaggaa

SEQ ID NO: 6472440 - DNA, 23 bp, Homo sapiens
tgccgacatccctcccccagcag

SEQ ID NO: 6472441 - DNA, 15 bp, Homo sapiens
tgccgacggagccac

SEQ ID NO: 6472442 - DNA, 18 bp, Homo sapiens
tgccgacggagccactgg

SEQ ID NO: 6472443 - DNA, 19 bp, Homo sapiens
tgccgacggagccactggg

SEQ ID NO: 6472444 - DNA, 14 bp, Homo sapiens
tgccgactggctgt

SEQ ID NO: 6472445 - DNA, 16 bp, Homo sapiens
tgccgactggctgtga

SEQ ID NO: 6472446 - DNA, 17 bp, Homo sapiens
tgccgagcaaccgtggc

SEQ ID NO: 6472447 - DNA, 19 bp, Homo sapiens
tgccgagcaaccgtggccc

SEQ ID NO: 6472448 - DNA, 13 bp, Homo sapiens
tgccgagccagca

SEQ ID NO: 6472449 - DNA, 16 bp, Homo sapiens
tgccgagccagcaaga

SEQ ID NO: 6472450 - DNA, 17 bp, Homo sapiens
tgccgagcctaatgaaa

SEQ ID NO: 6472451 - DNA, 17 bp, Homo sapiens
tgccgaggagccaggca

SEQ ID NO: 6472452 - DNA, 14 bp, Homo sapiens
tgccgagggctggc

SEQ ID NO: 6472453 - DNA, 16 bp, Homo sapiens
tgccgagtgccccaga

SEQ ID NO: 6472454 - DNA, 18 bp, Homo sapiens
tgccgagtgctctgatgc

SEQ ID NO: 6472455 - DNA, 22 bp, Homo sapiens
tgccgatgcccaatccaggccc

SEQ ID NO: 6472456 - DNA, 17 bp, Homo sapiens
tgccgatttcctaagct

SEQ ID NO: 6472457 - DNA, 20 bp, Homo sapiens
tgccgattttgtaaatgttc

SEQ ID NO: 6472458 - DNA, 15 bp, Homo sapiens
tgccgcaaattgtac

SEQ ID NO: 6472459 - DNA, 14 bp, Homo sapiens
tgccgcaaggccct

SEQ ID NO: 6472460 - DNA, 15 bp, Homo sapiens
tgccgcaaggccctg

SEQ ID NO: 6472461 - DNA, 19 bp, Homo sapiens
tgccgcaaggccctgtccc

SEQ ID NO: 6472462 - DNA, 20 bp, Homo sapiens
tgccgcaaggccctgtccca

SEQ ID NO: 6472463 - DNA, 12 bp, Homo sapiens
tgccgcacccca

SEQ ID NO: 6472464 - DNA, 15 bp, Homo sapiens
tgccgcaccccagag

SEQ ID NO: 6472465 - DNA, 14 bp, Homo sapiens
tgccgcactctggc

SEQ ID NO: 6472466 - DNA, 19 bp, Homo sapiens
tgccgcagacgggcacaga

SEQ ID NO: 6472467 - DNA, 21 bp, Homo sapiens
tgccgcagacgggcacagaca

SEQ ID NO: 6472468 - DNA, 13 bp, Homo sapiens
tgccgcagagctg

SEQ ID NO: 6472469 - DNA, 15 bp, Homo sapiens
tgccgcagagctggc

SEQ ID NO: 6472470 - DNA, 12 bp, Homo sapiens
tgccgcagccct

SEQ ID NO: 6472471 - DNA, 17 bp, Homo sapiens
tgccgcagggagggctg

SEQ ID NO: 6472472 - DNA, 21 bp, Homo sapiens
tgccgcaggtgggtgctgccc

SEQ ID NO: 6472473 - DNA, 23 bp, Homo sapiens
tgccgcaggtgggtgctgccctg

SEQ ID NO: 6472474 - DNA, 16 bp, Homo sapiens
tgccgcatctgcctgg

SEQ ID NO: 6472475 - DNA, 22 bp, Homo sapiens
tgccgcatctgcctggagcctg

SEQ ID NO: 6472476 - DNA, 22 bp, Homo sapiens
tgccgccactggctgtgcctcc

SEQ ID NO: 6472477 - DNA, 16 bp, Homo sapiens
tgccgccagctgccgc

SEQ ID NO: 6472478 - DNA, 12 bp, Homo sapiens
tgccgcccacct

SEQ ID NO: 6472479 - DNA, 15 bp, Homo sapiens
tgccgccccacccag

SEQ ID NO: 6472480 - DNA, 16 bp, Homo sapiens
tgccgcccccgcctgg

SEQ ID NO: 6472481 - DNA, 18 bp, Homo sapiens
tgccgcccccgcctgggc

SEQ ID NO: 6472482 - DNA, 21 bp, Homo sapiens
tgccgcccccgcctgggcacc

SEQ ID NO: 6472483 - DNA, 22 bp, Homo sapiens
tgccgcccccgcctgggcaccg

SEQ ID NO: 6472484 - DNA, 20 bp, Homo sapiens
tgccgccctgtgggagccgc

SEQ ID NO: 6472485 - DNA, 19 bp, Homo sapiens
tgccgccgcccgctgggga

SEQ ID NO: 6472486 - DNA, 14 bp, Homo sapiens
tgccgccgccgtgg

SEQ ID NO: 6472487 - DNA, 14 bp, Homo sapiens
tgccgccgcctccc

SEQ ID NO: 6472488 - DNA, 18 bp, Homo sapiens
tgccgccgcctcgcccac

SEQ ID NO: 6472489 - DNA, 16 bp, Homo sapiens
tgccgcctcaatgtgg

SEQ ID NO: 6472490 - DNA, 16 bp, Homo sapiens
tgccgcctcccagcct

SEQ ID NO: 6472491 - DNA, 13 bp, Homo sapiens
tgccgcctcccgg

SEQ ID NO: 6472492 - DNA, 19 bp, Homo sapiens
tgccgcctcccgggaagca

SEQ ID NO: 6472493 - DNA, 12 bp, Homo sapiens
tgccgcctgccc

SEQ ID NO: 6472494 - DNA, 12 bp, Homo sapiens
tgccgcctgcgt

SEQ ID NO: 6472495 - DNA, 14 bp, Homo sapiens
tgccgcctgctcct

SEQ ID NO: 6472496 - DNA, 13 bp, Homo sapiens
tgccgcctgggaa

SEQ ID NO: 6472497 - DNA, 21 bp, Homo sapiens
tgccgcctgtcaataaatgtt

SEQ ID NO: 6472498 - DNA, 16 bp, Homo sapiens
tgccgcgatgggtcag

SEQ ID NO: 6472499 - DNA, 16 bp, Homo sapiens
tgccgcgggcggccag

SEQ ID NO: 6472500 - DNA, 21 bp, Homo sapiens
tgccgcgtcgccctcccaggc

SEQ ID NO: 6472501 - DNA, 20 bp, Homo sapiens
tgccgcgtgcgaccagaggt

SEQ ID NO: 6472502 - DNA, 17 bp, Homo sapiens
tgccgctacctccctcc

SEQ ID NO: 6472503 - DNA, 13 bp, Homo sapiens
tgccgctcccctt

SEQ ID NO: 6472504 - DNA, 17 bp, Homo sapiens
tgccgctctctctgagg

SEQ ID NO: 6472505 - DNA, 15 bp, Homo sapiens
tgccgctcttctgtc

SEQ ID NO: 6472506 - DNA, 21 bp, Homo sapiens
tgccgctcttctgtcatcccg

SEQ ID NO: 6472507 - DNA, 13 bp, Homo sapiens
tgccgctgatgtt

SEQ ID NO: 6472508 - DNA, 17 bp, Homo sapiens
tgccgctgcacctgcct

SEQ ID NO: 6472509 - DNA, 17 bp, Homo sapiens
tgccgctgcaggaaaca

SEQ ID NO: 6472510 - DNA, 14 bp, Homo sapiens
tgccgctgccaccc

SEQ ID NO: 6472511 - DNA, 19 bp, Homo sapiens
tgccgctgccatgctttga

SEQ ID NO: 6472512 - DNA, 14 bp, Homo sapiens
tgccgctgccccca

SEQ ID NO: 6472513 - DNA, 19 bp, Homo sapiens
tgccgctgcccccaccctg

SEQ ID NO: 6472514 - DNA, 16 bp, Homo sapiens
tgccgctgtctctgag

SEQ ID NO: 6472515 - DNA, 22 bp, Homo sapiens
tgccgctgtgtccccgcgggca

SEQ ID NO: 6472516 - DNA, 16 bp, Homo sapiens
tgccgctttctctgag

SEQ ID NO: 6472517 - DNA, 23 bp, Homo sapiens
tgccgcttttgtgcctctcacag

SEQ ID NO: 6472518 - DNA, 19 bp, Homo sapiens
tgccggaaagagagctgga

SEQ ID NO: 6472519 - DNA, 21 bp, Homo sapiens
tgccggaggagcatgcgcaga

SEQ ID NO: 6472520 - DNA, 14 bp, Homo sapiens
tgccggcacagctg

SEQ ID NO: 6472521 - DNA, 14 bp, Homo sapiens
tgccggcagtgctg

SEQ ID NO: 6472522 - DNA, 22 bp, Homo sapiens
tgccggcatctcccctagctca

SEQ ID NO: 6472523 - DNA, 14 bp, Homo sapiens
tgccggccttggcc

SEQ ID NO: 6472524 - DNA, 21 bp, Homo sapiens
tgccggccttggccttggggc

SEQ ID NO: 6472525 - DNA, 17 bp, Homo sapiens
tgccggcggcagcccca

SEQ ID NO: 6472526 - DNA, 16 bp, Homo sapiens
tgccggctctggctct

SEQ ID NO: 6472527 - DNA, 15 bp, Homo sapiens
tgccggctctgggcc

SEQ ID NO: 6472528 - DNA, 16 bp, Homo sapiens
tgccggctctgggcct

SEQ ID NO: 6472529 - DNA, 13 bp, Homo sapiens
tgccgggccccca

SEQ ID NO: 6472530 - DNA, 20 bp, Homo sapiens
tgccgggcccccaccgccgg

SEQ ID NO: 6472531 - DNA, 20 bp, Homo sapiens
tgccgggcctggactgtcct

SEQ ID NO: 6472532 - DNA, 21 bp, Homo sapiens
tgccgggcctggactgtccta

SEQ ID NO: 6472533 - DNA, 13 bp, Homo sapiens
tgccgggcctggg

SEQ ID NO: 6472534 - DNA, 21 bp, Homo sapiens
tgccgggcctgggcctcctgg

SEQ ID NO: 6472535 - DNA, 14 bp, Homo sapiens
tgccgggcgccagg

SEQ ID NO: 6472536 - DNA, 13 bp, Homo sapiens
tgccggggacaga

SEQ ID NO: 6472537 - DNA, 18 bp, Homo sapiens
tgccgggttttatatttt

SEQ ID NO: 6472538 - DNA, 17 bp, Homo sapiens
tgccggtacacagccag

SEQ ID NO: 6472539 - DNA, 19 bp, Homo sapiens
tgccggtaccagcctgact

SEQ ID NO: 6472540 - DNA, 22 bp, Homo sapiens
tgccggtcatttgaatgagacc

SEQ ID NO: 6472541 - DNA, 15 bp, Homo sapiens
tgccggtgagaccca

SEQ ID NO: 6472542 - DNA, 19 bp, Homo sapiens
tgccggtgggaccctgtcc

SEQ ID NO: 6472543 - DNA, 13 bp, Homo sapiens
tgccgtaattatg

SEQ ID NO: 6472544 - DNA, 14 bp, Homo sapiens
tgccgtaatttaac

SEQ ID NO: 6472545 - DNA, 20 bp, Homo sapiens
tgccgtagcttcagccaggc

SEQ ID NO: 6472546 - DNA, 20 bp, Homo sapiens
tgccgtcactattcatcaat

SEQ ID NO: 6472547 - DNA, 15 bp, Homo sapiens
tgccgtccctcctgt

SEQ ID NO: 6472548 - DNA, 19 bp, Homo sapiens
tgccgtcctgctggagtga

SEQ ID NO: 6472549 - DNA, 22 bp, Homo sapiens
tgccgtcctggactctgtgtga

SEQ ID NO: 6472550 - DNA, 17 bp, Homo sapiens
tgccgtctacctgaggg

SEQ ID NO: 6472551 - DNA, 20 bp, Homo sapiens
tgccgtctcatatttttaca

SEQ ID NO: 6472552 - DNA, 13 bp, Homo sapiens
tgccgtctctcct

SEQ ID NO: 6472553 - DNA, 14 bp, Homo sapiens
tgccgtctctggag

SEQ ID NO: 6472554 - DNA, 13 bp, Homo sapiens
tgccgtgagcagg

SEQ ID NO: 6472555 - DNA, 20 bp, Homo sapiens
tctgatttgtccctatgcat

SEQ ID NO: 6472556 - DNA, 15 bp, Homo sapiens
tctgatttgtcctgc

SEQ ID NO: 6472557 - DNA, 16 bp, Homo sapiens
tctgattttaatgaaa

SEQ ID NO: 6472558 - DNA, 17 bp, Homo sapiens
tctgattttaatgaaat

SEQ ID NO: 6472559 - DNA, 18 bp, Homo sapiens
tctgattttaatgaaatc

SEQ ID NO: 6472560 - DNA, 13 bp, Homo sapiens
tctgattttagga

SEQ ID NO: 6472561 - DNA, 22 bp, Homo sapiens
tctgattttaggagctaaggct

SEQ ID NO: 6472562 - DNA, 17 bp, Homo sapiens
tctgattttgaggttta

SEQ ID NO: 6472563 - DNA, 16 bp, Homo sapiens
tctgatttttaaagta

SEQ ID NO: 6472564 - DNA, 14 bp, Homo sapiens
tctgatttttatga

SEQ ID NO: 6472565 - DNA, 17 bp, Homo sapiens
tctgatttttctctttt

SEQ ID NO: 6472566 - DNA, 18 bp, Homo sapiens
tctgatttttctcttttt

SEQ ID NO: 6472567 - DNA, 17 bp, Homo sapiens
tctgattttttccccct

SEQ ID NO: 6472568 - DNA, 12 bp, Homo sapiens
tctgcaaaaaga

SEQ ID NO: 6472569 - DNA, 19 bp, Homo sapiens
tctgcaaaaagatttaaca

SEQ ID NO: 6472570 - DNA, 21 bp, Homo sapiens
tctgcaaaaagatttaacaaa

SEQ ID NO: 6472571 - DNA, 20 bp, Homo sapiens
tctgcaaaaatatttataaa

SEQ ID NO: 6472572 - DNA, 15 bp, Homo sapiens
tctgcaaaaggagag

SEQ ID NO: 6472573 - DNA, 16 bp, Homo sapiens
tctgcaaaaggagaga

SEQ ID NO: 6472574 - DNA, 14 bp, Homo sapiens
tctgcaaaatacac

SEQ ID NO: 6472575 - DNA, 20 bp, Homo sapiens
tctgcaaaatgaggaatgta

SEQ ID NO: 6472576 - DNA, 22 bp, Homo sapiens
tctgcaaaatgaggaatgtata

SEQ ID NO: 6472577 - DNA, 23 bp, Homo sapiens
tctgcaaaatgaggaatgtatat

SEQ ID NO: 6472578 - DNA, 18 bp, Homo sapiens
tctgcaaaatgtagaaat

SEQ ID NO: 6472579 - DNA, 16 bp, Homo sapiens
tctgcaaacaaacacc

SEQ ID NO: 6472580 - DNA, 19 bp, Homo sapiens
tctgcaaacaatgaagaat

SEQ ID NO: 6472581 - DNA, 14 bp, Homo sapiens
tctgcaaactgcct

SEQ ID NO: 6472582 - DNA, 15 bp, Homo sapiens
tctgcaaaggagggc

SEQ ID NO: 6472583 - DNA, 17 bp, Homo sapiens
tctgcaaaggagggcct

SEQ ID NO: 6472584 - DNA, 23 bp, Homo sapiens
tctgcaaaggagggcctcagaga

SEQ ID NO: 6472585 - DNA, 18 bp, Homo sapiens
tctgcaaaggcctgggct

SEQ ID NO: 6472586 - DNA, 14 bp, Homo sapiens
tctgcaaatagaaa

SEQ ID NO: 6472587 - DNA, 16 bp, Homo sapiens
tctgcaaatagtttca

SEQ ID NO: 6472588 - DNA, 13 bp, Homo sapiens
tctgcaacaaaaa

SEQ ID NO: 6472589 - DNA, 16 bp, Homo sapiens
tctgcaacaagcatgc

SEQ ID NO: 6472590 - DNA, 12 bp, Homo sapiens
tctgcaacatgg

SEQ ID NO: 6472591 - DNA, 13 bp, Homo sapiens
tctgcaacatgga

SEQ ID NO: 6472592 - DNA, 18 bp, Homo sapiens
tctgcaacatttgacaaa

SEQ ID NO: 6472593 - DNA, 15 bp, Homo sapiens
tctgcaactagccaa

SEQ ID NO: 6472594 - DNA, 15 bp, Homo sapiens
tctgcaactccatcc

SEQ ID NO: 6472595 - DNA, 14 bp, Homo sapiens
tctgcaactctgaa

SEQ ID NO: 6472596 - DNA, 17 bp, Homo sapiens
tctgcaactgctcagct

SEQ ID NO: 6472597 - DNA, 22 bp, Homo sapiens
tctgcaactgctcagctctggt

SEQ ID NO: 6472598 - DNA, 15 bp, Homo sapiens
tctgcaactggagag

SEQ ID NO: 6472599 - DNA, 22 bp, Homo sapiens
tctgcaactttaagcagctctt

SEQ ID NO: 6472600 - DNA, 20 bp, Homo sapiens
tctgcaagaattaaaactga

SEQ ID NO: 6472601 - DNA, 20 bp, Homo sapiens
tctgcaagattctgtgggca

SEQ ID NO: 6472602 - DNA, 14 bp, Homo sapiens
tctgcaagcctgcg

SEQ ID NO: 6472603 - DNA, 18 bp, Homo sapiens
tctgcaagcttcttgctg

SEQ ID NO: 6472604 - DNA, 21 bp, Homo sapiens
tctgcaaggattttttaaaaa

SEQ ID NO: 6472605 - DNA, 22 bp, Homo sapiens
tctgcaaggattttttaaaaat

SEQ ID NO: 6472606 - DNA, 14 bp, Homo sapiens
tctgcaagggccca

SEQ ID NO: 6472607 - DNA, 15 bp, Homo sapiens
tctgcaagtcagagg

SEQ ID NO: 6472608 - DNA, 13 bp, Homo sapiens
tctgcaagtgctc

SEQ ID NO: 6472609 - DNA, 17 bp, Homo sapiens
tctgcaagtgtctggag

SEQ ID NO: 6472610 - DNA, 18 bp, Homo sapiens
tctgcaagtgtctggagc

SEQ ID NO: 6472611 - DNA, 19 bp, Homo sapiens
tctgcaatgggcactggga

SEQ ID NO: 6472612 - DNA, 21 bp, Homo sapiens
tctgcaatgggcactgggatg

SEQ ID NO: 6472613 - DNA, 13 bp, Homo sapiens
tctgcaatggtga

SEQ ID NO: 6472614 - DNA, 21 bp, Homo sapiens
tctgcaatgtttttgtgtaga

SEQ ID NO: 6472615 - DNA, 14 bp, Homo sapiens
tctgcaattcaaaa

SEQ ID NO: 6472616 - DNA, 16 bp, Homo sapiens
tctgcaattcaaaagt

SEQ ID NO: 6472617 - DNA, 23 bp, Homo sapiens
tctgcaattcaaaagttccaaga

SEQ ID NO: 6472618 - DNA, 20 bp, Homo sapiens
tctgcaattcccctctgctg

SEQ ID NO: 6472619 - DNA, 14 bp, Homo sapiens
tctgcaattttact

SEQ ID NO: 6472620 - DNA, 16 bp, Homo sapiens
tctgcaattttactgt

SEQ ID NO: 6472621 - DNA, 18 bp, Homo sapiens
tctgcacaaagatgtctt

SEQ ID NO: 6472622 - DNA, 14 bp, Homo sapiens
tctgcacaagctgc

SEQ ID NO: 6472623 - DNA, 18 bp, Homo sapiens
tctgcacacacctccgag

SEQ ID NO: 6472624 - DNA, 23 bp, Homo sapiens
tctgcacacacctccgagacagt

SEQ ID NO: 6472625 - DNA, 22 bp, Homo sapiens
tctgcacacataacacacatca

SEQ ID NO: 6472626 - DNA, 21 bp, Homo sapiens
tctgcacagacaagcagccct

SEQ ID NO: 6472627 - DNA, 17 bp, Homo sapiens
tctgcacagctggcctc

SEQ ID NO: 6472628 - DNA, 17 bp, Homo sapiens
tctgcacagcttttcca

SEQ ID NO: 6472629 - DNA, 20 bp, Homo sapiens
tctgcacatgcagctgcacc

SEQ ID NO: 6472630 - DNA, 21 bp, Homo sapiens
tctgcacatgcagctgcaccc

SEQ ID NO: 6472631 - DNA, 22 bp, Homo sapiens
tctgcacatgcagctgcaccct

SEQ ID NO: 6472632 - DNA, 22 bp, Homo sapiens
tctgcacatgtcttgtacatgt

SEQ ID NO: 6472633 - DNA, 17 bp, Homo sapiens
tctgcaccaccatgccc

SEQ ID NO: 6472634 - DNA, 19 bp, Homo sapiens
tctgcacccagaaattcct

SEQ ID NO: 6472635 - DNA, 15 bp, Homo sapiens
tctgcacccaggggt

SEQ ID NO: 6472636 - DNA, 21 bp, Homo sapiens
tctgcacccagggtcccagcc

SEQ ID NO: 6472637 - DNA, 12 bp, Homo sapiens
tctgcaccccac

SEQ ID NO: 6472638 - DNA, 16 bp, Homo sapiens
tctgcacccccctggg

SEQ ID NO: 6472639 - DNA, 21 bp, Homo sapiens
tctgcacccctctgccctcat

SEQ ID NO: 6472640 - DNA, 15 bp, Homo sapiens
tctgcaccccttctc

SEQ ID NO: 6472641 - DNA, 22 bp, Homo sapiens
tctgcaccccttctctcctccc

SEQ ID NO: 6472642 - DNA, 15 bp, Homo sapiens
tctgcacccgcctcg

SEQ ID NO: 6472643 - DNA, 15 bp, Homo sapiens
tctgcaccctccacc

SEQ ID NO: 6472644 - DNA, 19 bp, Homo sapiens
tctgcaccctccaccctgt

SEQ ID NO: 6472645 - DNA, 24 bp, Homo sapiens
tctgcaccctggggcctggacctg

SEQ ID NO: 6472646 - DNA, 13 bp, Homo sapiens
tctgcacccttct

SEQ ID NO: 6472647 - DNA, 22 bp, Homo sapiens
tctgcaccgccggccagctggg

SEQ ID NO: 6472648 - DNA, 23 bp, Homo sapiens
tctgcaccgccggccagctggga

SEQ ID NO: 6472649 - DNA, 22 bp, Homo sapiens
tctgcacctccgcttgccagag

SEQ ID NO: 6472650 - DNA, 16 bp, Homo sapiens
tctgcacctcttggct

SEQ ID NO: 6472651 - DNA, 22 bp, Homo sapiens
tctgcacctgtctcatagcctc

SEQ ID NO: 6472652 - DNA, 19 bp, Homo sapiens
tctgcaccttagaaaaaaa

SEQ ID NO: 6472653 - DNA, 15 bp, Homo sapiens
tctgcaccttatctt

SEQ ID NO: 6472654 - DNA, 16 bp, Homo sapiens
tctgcaccttatctta

SEQ ID NO: 6472655 - DNA, 22 bp, Homo sapiens
tctgcaccttctgacgcagcct

SEQ ID NO: 6472656 - DNA, 22 bp, Homo sapiens
tctgcacgctcaatgcccagta

SEQ ID NO: 6472657 - DNA, 15 bp, Homo sapiens
tctgcacgctgccca

SEQ ID NO: 6472658 - DNA, 16 bp, Homo sapiens
tctgcacgctgcccag

SEQ ID NO: 6472659 - DNA, 19 bp, Homo sapiens
tctgcacgtgcacacacct

SEQ ID NO: 6472660 - DNA, 23 bp, Homo sapiens
tctgcacgtgcacacacctgcac

SEQ ID NO: 6472661 - DNA, 14 bp, Homo sapiens
tctgcactaagaga

SEQ ID NO: 6472662 - DNA, 21 bp, Homo sapiens
tctgcactactcctctgcagt

SEQ ID NO: 6472663 - DNA, 18 bp, Homo sapiens
tctgcactactgacatgt

SEQ ID NO: 6472664 - DNA, 18 bp, Homo sapiens
tctgcactatatgcaaac

SEQ ID NO: 6472665 - DNA, 16 bp, Homo sapiens
tctgcactcagaaaat

SEQ ID NO: 6472666 - DNA, 15 bp, Homo sapiens
tctgcactccatggc

SEQ ID NO: 6472667 - DNA, 18 bp, Homo sapiens
tctgcactccatggccac

SEQ ID NO: 6472668 - DNA, 21 bp, Homo sapiens
tctgcactccatggccacccc

SEQ ID NO: 6472669 - DNA, 16 bp, Homo sapiens
tctgcactcccctgct

SEQ ID NO: 6472670 - DNA, 18 bp, Homo sapiens
tctgcactcccctgctgg

SEQ ID NO: 6472671 - DNA, 17 bp, Homo sapiens
tctgcactcctgtctct

SEQ ID NO: 6472672 - DNA, 23 bp, Homo sapiens
tctgcactcctgtctcttgggaa

SEQ ID NO: 6472673 - DNA, 21 bp, Homo sapiens
tctgcactcctttatctgtaa

SEQ ID NO: 6472674 - DNA, 15 bp, Homo sapiens
tctgcactctaaact

SEQ ID NO: 6472675 - DNA, 18 bp, Homo sapiens
tctgcactctaaactgca

SEQ ID NO: 6472676 - DNA, 23 bp, Homo sapiens
tctgcactctccaccctggctgg

SEQ ID NO: 6472677 - DNA, 22 bp, Homo sapiens
tctgcactcttgtacaaaagaa

SEQ ID NO: 6472678 - DNA, 13 bp, Homo sapiens
tctgcactgaaaa

SEQ ID NO: 6472679 - DNA, 22 bp, Homo sapiens
tctgcactgaatggctgacctg

SEQ ID NO: 6472680 - DNA, 19 bp, Homo sapiens
tctgcactgaggatttctt

SEQ ID NO: 6472681 - DNA, 13 bp, Homo sapiens
tctgcactgggtg

SEQ ID NO: 6472682 - DNA, 15 bp, Homo sapiens
tctgcacttaaatat

SEQ ID NO: 6472683 - DNA, 16 bp, Homo sapiens
tctgcacttaaatatc

SEQ ID NO: 6472684 - DNA, 15 bp, Homo sapiens
tctgcacttctgttc

SEQ ID NO: 6472685 - DNA, 15 bp, Homo sapiens
tctgcagaaacagaa

SEQ ID NO: 6472686 - DNA, 21 bp, Homo sapiens
tctgcagaaggaaaaatgtgt

SEQ ID NO: 6472687 - DNA, 23 bp, Homo sapiens
tctgcagaaggaaaaatgtgtaa

SEQ ID NO: 6472688 - DNA, 22 bp, Homo sapiens
tctgcagaatccctttgcacct

SEQ ID NO: 6472689 - DNA, 18 bp, Homo sapiens
tctgcagaatgggccact

SEQ ID NO: 6472690 - DNA, 20 bp, Homo sapiens
tctgcagacaagtcttgctg

SEQ ID NO: 6472691 - DNA, 15 bp, Homo sapiens
tctgcagacctggtt

SEQ ID NO: 6472692 - DNA, 19 bp, Homo sapiens
tctgcagacttcccagcta

SEQ ID NO: 6472693 - DNA, 13 bp, Homo sapiens
tctgcagaggcag

SEQ ID NO: 6472694 - DNA, 15 bp, Homo sapiens
tctgcagaggcagca

SEQ ID NO: 6472695 - DNA, 17 bp, Homo sapiens
tctgcagaggcagcagg

SEQ ID NO: 6472696 - DNA, 19 bp, Homo sapiens
tctgcagaggcagcaggag

SEQ ID NO: 6472697 - DNA, 20 bp, Homo sapiens
tctgcagaggcagcaggagc

SEQ ID NO: 6472698 - DNA, 15 bp, Homo sapiens
tctgcagataaacag

SEQ ID NO: 6472699 - DNA, 18 bp, Homo sapiens
tctgcagataaacagtag

SEQ ID NO: 6472700 - DNA, 16 bp, Homo sapiens
tctgcagatggaaagt

SEQ ID NO: 6472701 - DNA, 17 bp, Homo sapiens
tctgcagcaataaagca

SEQ ID NO: 6472702 - DNA, 16 bp, Homo sapiens
tctgcagcatgacctg

SEQ ID NO: 6472703 - DNA, 16 bp, Homo sapiens
tctgcagccagcccag

SEQ ID NO: 6472704 - DNA, 18 bp, Homo sapiens
tctgcagccagcccagcc

SEQ ID NO: 6472705 - DNA, 21 bp, Homo sapiens
tctgcagcccacagaggacag

SEQ ID NO: 6472706 - DNA, 22 bp, Homo sapiens
tctgcagcccacagaggacagt

SEQ ID NO: 6472707 - DNA, 14 bp, Homo sapiens
tctgcagcccagcc

SEQ ID NO: 6472708 - DNA, 20 bp, Homo sapiens
tctgcagcccagcctagtca

SEQ ID NO: 6472709 - DNA, 13 bp, Homo sapiens
tctgcagcccagg

SEQ ID NO: 6472710 - DNA, 11 bp, Homo sapiens
tctgcagccct

SEQ ID NO: 6472711 - DNA, 17 bp, Homo sapiens
tctgcagcccttgggca

SEQ ID NO: 6472712 - DNA, 21 bp, Homo sapiens
tctgcagccggaggaggagat

SEQ ID NO: 6472713 - DNA, 14 bp, Homo sapiens
tctgcagcctcaga

SEQ ID NO: 6472714 - DNA, 18 bp, Homo sapiens
tctgcagcctgagctcca

SEQ ID NO: 6472715 - DNA, 23 bp, Homo sapiens
tctgcagcctgagctccaccctc

SEQ ID NO: 6472716 - DNA, 15 bp, Homo sapiens
tctgcagcctgctgg

SEQ ID NO: 6472717 - DNA, 18 bp, Homo sapiens
tctgcagcctgctggggc

SEQ ID NO: 6472718 - DNA, 19 bp, Homo sapiens
tctgcagcctgctggggct

SEQ ID NO: 6472719 - DNA, 22 bp, Homo sapiens
tctgcagctatgcgcaatgtgg

SEQ ID NO: 6472720 - DNA, 15 bp, Homo sapiens
tctgcagctcctgga

SEQ ID NO: 6472721 - DNA, 13 bp, Homo sapiens
tctgcagctgccg

SEQ ID NO: 6472722 - DNA, 15 bp, Homo sapiens
tctgcagctgtttta

SEQ ID NO: 6472723 - DNA, 19 bp, Homo sapiens
tctgcagctttcaagctca

SEQ ID NO: 6472724 - DNA, 21 bp, Homo sapiens
tctgcagctttggctgcacgt

SEQ ID NO: 6472725 - DNA, 12 bp, Homo sapiens
tctgcaggaaat

SEQ ID NO: 6472726 - DNA, 23 bp, Homo sapiens
tctgcaggaatcccggctccaga

SEQ ID NO: 6472727 - DNA, 15 bp, Homo sapiens
tctgcaggcaccggg

SEQ ID NO: 6472728 - DNA, 14 bp, Homo sapiens
tctgcaggcacctt

SEQ ID NO: 6472729 - DNA, 17 bp, Homo sapiens
tctgcaggcaccttagt

SEQ ID NO: 6472730 - DNA, 13 bp, Homo sapiens
tctgcaggcagac

SEQ ID NO: 6472731 - DNA, 13 bp, Homo sapiens
tctgcaggcaggg

SEQ ID NO: 6472732 - DNA, 12 bp, Homo sapiens
tctgcaggccac

SEQ ID NO: 6472733 - DNA, 13 bp, Homo sapiens
tgccgtggagctt

SEQ ID NO: 6472734 - DNA, 13 bp, Homo sapiens
tgccgtggcacca

SEQ ID NO: 6472735 - DNA, 13 bp, Homo sapiens
tgccgtgggaatt

SEQ ID NO: 6472736 - DNA, 18 bp, Homo sapiens
tgccgtgggcaaggatac

SEQ ID NO: 6472737 - DNA, 20 bp, Homo sapiens
tgccgtgggcctgtcgtgcc

SEQ ID NO: 6472738 - DNA, 16 bp, Homo sapiens
tgccgtgtgagtgtga

SEQ ID NO: 6472739 - DNA, 23 bp, Homo sapiens
tgccgtgtgagtgtgacagggcc

SEQ ID NO: 6472740 - DNA, 20 bp, Homo sapiens
tgccgttacttttcatattt

SEQ ID NO: 6472741 - DNA, 15 bp, Homo sapiens
tgccgttctgcaccc

SEQ ID NO: 6472742 - DNA, 21 bp, Homo sapiens
tgcctaaaaattcccttcctg

SEQ ID NO: 6472743 - DNA, 13 bp, Homo sapiens
tgcctaaaatgtt

SEQ ID NO: 6472744 - DNA, 18 bp, Homo sapiens
tgcctaaaattgtatgaa

SEQ ID NO: 6472745 - DNA, 16 bp, Homo sapiens
tgcctaaaattttaga

SEQ ID NO: 6472746 - DNA, 19 bp, Homo sapiens
tgcctaaagcccattgctg

SEQ ID NO: 6472747 - DNA, 23 bp, Homo sapiens
tgcctaaagcccattgctgcaaa

SEQ ID NO: 6472748 - DNA, 21 bp, Homo sapiens
tgcctaaatacttttttctat

SEQ ID NO: 6472749 - DNA, 16 bp, Homo sapiens
tgcctaaatccaaaga

SEQ ID NO: 6472750 - DNA, 18 bp, Homo sapiens
tgcctaaatccactctgc

SEQ ID NO: 6472751 - DNA, 13 bp, Homo sapiens
tgcctaaatccat

SEQ ID NO: 6472752 - DNA, 20 bp, Homo sapiens
tgcctaaatccatttggaaa

SEQ ID NO: 6472753 - DNA, 22 bp, Homo sapiens
tgcctaaatccatttggaaatc

SEQ ID NO: 6472754 - DNA, 23 bp, Homo sapiens
tgcctaaatccatttggaaatct

SEQ ID NO: 6472755 - DNA, 19 bp, Homo sapiens
tgcctaaatcccaagaaat

SEQ ID NO: 6472756 - DNA, 14 bp, Homo sapiens
tgcctaaatttcac

SEQ ID NO: 6472757 - DNA, 13 bp, Homo sapiens
tgcctaacagaaa

SEQ ID NO: 6472758 - DNA, 14 bp, Homo sapiens
tgcctaaccaggcc

SEQ ID NO: 6472759 - DNA, 15 bp, Homo sapiens
tgcctaaccaggccc

SEQ ID NO: 6472760 - DNA, 19 bp, Homo sapiens
tgcctaaccaggcccagcc

SEQ ID NO: 6472761 - DNA, 19 bp, Homo sapiens
tgcctaaccatgggctcag

SEQ ID NO: 6472762 - DNA, 22 bp, Homo sapiens
tgcctaaccatgggctcagggc

SEQ ID NO: 6472763 - DNA, 16 bp, Homo sapiens
tgcctaacctgggacc

SEQ ID NO: 6472764 - DNA, 17 bp, Homo sapiens
tgcctaactccttacag

SEQ ID NO: 6472765 - DNA, 16 bp, Homo sapiens
tgcctaacttgtaaaa

SEQ ID NO: 6472766 - DNA, 19 bp, Homo sapiens
tgcctaagaataaacattt

SEQ ID NO: 6472767 - DNA, 18 bp, Homo sapiens
tgcctaagcattgcctgg

SEQ ID NO: 6472768 - DNA, 12 bp, Homo sapiens
tgcctaaggact

SEQ ID NO: 6472769 - DNA, 17 bp, Homo sapiens
tgcctaaggccagccat

SEQ ID NO: 6472770 - DNA, 19 bp, Homo sapiens
tgcctaaggctgaacttgt

SEQ ID NO: 6472771 - DNA, 13 bp, Homo sapiens
tgcctaagtatta

SEQ ID NO: 6472772 - DNA, 14 bp, Homo sapiens
tgcctaagtggctg

SEQ ID NO: 6472773 - DNA, 12 bp, Homo sapiens
tgcctaataaaa

SEQ ID NO: 6472774 - DNA, 17 bp, Homo sapiens
tgcctaataaagagact

SEQ ID NO: 6472775 - DNA, 21 bp, Homo sapiens
tgcctaatacattaaagcagt

SEQ ID NO: 6472776 - DNA, 13 bp, Homo sapiens
tgcctaatcactc

SEQ ID NO: 6472777 - DNA, 18 bp, Homo sapiens
tgcctaattcctggcatg

SEQ ID NO: 6472778 - DNA, 23 bp, Homo sapiens
tgcctaattcctggcatgacact

SEQ ID NO: 6472779 - DNA, 18 bp, Homo sapiens
tgcctacaaccatccctg

SEQ ID NO: 6472780 - DNA, 22 bp, Homo sapiens
tgcctacaaccatccctgccac

SEQ ID NO: 6472781 - DNA, 17 bp, Homo sapiens
tgcctacaataaaaaga

SEQ ID NO: 6472782 - DNA, 19 bp, Homo sapiens
tgcctacaatgggaaaact

SEQ ID NO: 6472783 - DNA, 22 bp, Homo sapiens
tgcctacagaacttcagaaaga

SEQ ID NO: 6472784 - DNA, 23 bp, Homo sapiens
tgcctacagaacttcagaaagac

SEQ ID NO: 6472785 - DNA, 13 bp, Homo sapiens
tgcctacagccag

SEQ ID NO: 6472786 - DNA, 20 bp, Homo sapiens
tgcctacatcccgggcctca

SEQ ID NO: 6472787 - DNA, 13 bp, Homo sapiens
tgcctacattagt

SEQ ID NO: 6472788 - DNA, 14 bp, Homo sapiens
tgcctacattccct

SEQ ID NO: 6472789 - DNA, 17 bp, Homo sapiens
tgcctacattccctggc

SEQ ID NO: 6472790 - DNA, 15 bp, Homo sapiens
tgcctacatttatca

SEQ ID NO: 6472791 - DNA, 23 bp, Homo sapiens
tgcctaccagtcgccctctgtgc

SEQ ID NO: 6472792 - DNA, 22 bp, Homo sapiens
tgcctacggagggtgggctctg

SEQ ID NO: 6472793 - DNA, 17 bp, Homo sapiens
tgcctacgtgacaacac

SEQ ID NO: 6472794 - DNA, 18 bp, Homo sapiens
tgcctacgtgacaacaca

SEQ ID NO: 6472795 - DNA, 15 bp, Homo sapiens
tgcctactatgtgcg

SEQ ID NO: 6472796 - DNA, 18 bp, Homo sapiens
tgcctactatgtgcgaga

SEQ ID NO: 6472797 - DNA, 14 bp, Homo sapiens
tgcctactctttgt

SEQ ID NO: 6472798 - DNA, 23 bp, Homo sapiens
tgcctactctttgttttctttcc

SEQ ID NO: 6472799 - DNA, 12 bp, Homo sapiens
tgcctactgcat

SEQ ID NO: 6472800 - DNA, 15 bp, Homo sapiens
tgcctactgcccctg

SEQ ID NO: 6472801 - DNA, 16 bp, Homo sapiens
tgcctactgcccctgc

SEQ ID NO: 6472802 - DNA, 16 bp, Homo sapiens
tgcctactggatgctt

SEQ ID NO: 6472803 - DNA, 19 bp, Homo sapiens
tgcctactgttactctaaa

SEQ ID NO: 6472804 - DNA, 17 bp, Homo sapiens
tgcctacttgtaatttc

SEQ ID NO: 6472805 - DNA, 13 bp, Homo sapiens
tgcctacttttct

SEQ ID NO: 6472806 - DNA, 17 bp, Homo sapiens
tgcctacttttggcctc

SEQ ID NO: 6472807 - DNA, 17 bp, Homo sapiens
tgcctagaaatatcttt

SEQ ID NO: 6472808 - DNA, 15 bp, Homo sapiens
tgcctagactgttac

SEQ ID NO: 6472809 - DNA, 21 bp, Homo sapiens
tgcctagagatatttcaagct

SEQ ID NO: 6472810 - DNA, 23 bp, Homo sapiens
tgcctagatccacgtgtggcctc

SEQ ID NO: 6472811 - DNA, 20 bp, Homo sapiens
tgcctagattaggtagactt

SEQ ID NO: 6472812 - DNA, 16 bp, Homo sapiens
tgcctagcaagctggc

SEQ ID NO: 6472813 - DNA, 19 bp, Homo sapiens
tgcctagcaagctggcctc

SEQ ID NO: 6472814 - DNA, 18 bp, Homo sapiens
tgcctagcatggggtcag

SEQ ID NO: 6472815 - DNA, 22 bp, Homo sapiens
tgcctagccccaggtcttttct

SEQ ID NO: 6472816 - DNA, 22 bp, Homo sapiens
tgcctaggagctggctggcagg

SEQ ID NO: 6472817 - DNA, 18 bp, Homo sapiens
tgcctaggaggccttctc

SEQ ID NO: 6472818 - DNA, 18 bp, Homo sapiens
tgcctaggattgtgcctg

SEQ ID NO: 6472819 - DNA, 15 bp, Homo sapiens
tgcctaggcagccag

SEQ ID NO: 6472820 - DNA, 23 bp, Homo sapiens
tgcctaggcagccagctacaggc

SEQ ID NO: 6472821 - DNA, 22 bp, Homo sapiens
tgcctaggccaaatgcacaagc

SEQ ID NO: 6472822 - DNA, 14 bp, Homo sapiens
tgcctaggccagct

SEQ ID NO: 6472823 - DNA, 15 bp, Homo sapiens
tgcctaggccagctc

SEQ ID NO: 6472824 - DNA, 14 bp, Homo sapiens
tgcctaggcctggg

SEQ ID NO: 6472825 - DNA, 16 bp, Homo sapiens
tgcctaggcctgggca

SEQ ID NO: 6472826 - DNA, 20 bp, Homo sapiens
tgcctaggcctgggcagtgg

SEQ ID NO: 6472827 - DNA, 14 bp, Homo sapiens
tgcctaggctgacc

SEQ ID NO: 6472828 - DNA, 22 bp, Homo sapiens
tgcctaggttggtttcccctgc

SEQ ID NO: 6472829 - DNA, 17 bp, Homo sapiens
tgcctagtattgacaaa

SEQ ID NO: 6472830 - DNA, 21 bp, Homo sapiens
tgcctagtattgacaaaatgt

SEQ ID NO: 6472831 - DNA, 22 bp, Homo sapiens
tgcctagtattgacaaaatgtt

SEQ ID NO: 6472832 - DNA, 16 bp, Homo sapiens
tgcctagtgatgtaga

SEQ ID NO: 6472833 - DNA, 15 bp, Homo sapiens
tgcctagtgctacag

SEQ ID NO: 6472834 - DNA, 23 bp, Homo sapiens
tgcctagtttcttacacactgtc

SEQ ID NO: 6472835 - DNA, 13 bp, Homo sapiens
tgcctagttttta

SEQ ID NO: 6472836 - DNA, 17 bp, Homo sapiens
tgcctataaaggaaaca

SEQ ID NO: 6472837 - DNA, 22 bp, Homo sapiens
tgcctataaccatgttctatat

SEQ ID NO: 6472838 - DNA, 16 bp, Homo sapiens
tgcctataagccaaaa

SEQ ID NO: 6472839 - DNA, 16 bp, Homo sapiens
tgcctatagtcccact

SEQ ID NO: 6472840 - DNA, 15 bp, Homo sapiens
tgcctatatctgaga

SEQ ID NO: 6472841 - DNA, 17 bp, Homo sapiens
tgcctatatctgagaga

SEQ ID NO: 6472842 - DNA, 21 bp, Homo sapiens
tgcctatatgagaagaatagc

SEQ ID NO: 6472843 - DNA, 22 bp, Homo sapiens
tgcctatattaaaggtatacaa

SEQ ID NO: 6472844 - DNA, 20 bp, Homo sapiens
tgcctatcacctcttatgca

SEQ ID NO: 6472845 - DNA, 15 bp, Homo sapiens
tgcctatcctctgta

SEQ ID NO: 6472846 - DNA, 15 bp, Homo sapiens
tgcctatcctgctgt

SEQ ID NO: 6472847 - DNA, 17 bp, Homo sapiens
tgcctatcctgctgttc

SEQ ID NO: 6472848 - DNA, 23 bp, Homo sapiens
tgcctatcctgctgttctagcac

SEQ ID NO: 6472849 - DNA, 22 bp, Homo sapiens
tgcctatctttaaacatttcaa

SEQ ID NO: 6472850 - DNA, 18 bp, Homo sapiens
tgcctatgatactgtctc

SEQ ID NO: 6472851 - DNA, 20 bp, Homo sapiens
tgcctatgcactgaagagct

SEQ ID NO: 6472852 - DNA, 21 bp, Homo sapiens
tgcctatgcactgaagagctc

SEQ ID NO: 6472853 - DNA, 16 bp, Homo sapiens
tgcctatgtctcctct

SEQ ID NO: 6472854 - DNA, 19 bp, Homo sapiens
tgcctattcacgccgtaat

SEQ ID NO: 6472855 - DNA, 22 bp, Homo sapiens
tgcctattcccacacctccaca

SEQ ID NO: 6472856 - DNA, 18 bp, Homo sapiens
tgcctattgctagagctc

SEQ ID NO: 6472857 - DNA, 15 bp, Homo sapiens
tgcctatttattcat

SEQ ID NO: 6472858 - DNA, 23 bp, Homo sapiens
tgcctatttattggggatctgca

SEQ ID NO: 6472859 - DNA, 12 bp, Homo sapiens
tgcctcaaataa

SEQ ID NO: 6472860 - DNA, 15 bp, Homo sapiens
tgcctcaacagcagg

SEQ ID NO: 6472861 - DNA, 18 bp, Homo sapiens
tgcctcaacagcaggagg

SEQ ID NO: 6472862 - DNA, 21 bp, Homo sapiens
tgcctcaacagcaggaggcac

SEQ ID NO: 6472863 - DNA, 22 bp, Homo sapiens
tgcctcaacagcaggaggcaca

SEQ ID NO: 6472864 - DNA, 23 bp, Homo sapiens
tgcctcaactccaccctctgcga

SEQ ID NO: 6472865 - DNA, 16 bp, Homo sapiens
tgcctcaactccagga

SEQ ID NO: 6472866 - DNA, 22 bp, Homo sapiens
tgcctcaagaaattgcctcctt

SEQ ID NO: 6472867 - DNA, 14 bp, Homo sapiens
tgcctcaataaagc

SEQ ID NO: 6472868 - DNA, 23 bp, Homo sapiens
tgcctcaatgtgaatcagaccct

SEQ ID NO: 6472869 - DNA, 23 bp, Homo sapiens
tgcctcaatgtgaccaggggtga

SEQ ID NO: 6472870 - DNA, 14 bp, Homo sapiens
tgcctcacatctcc

SEQ ID NO: 6472871 - DNA, 18 bp, Homo sapiens
tgcctcaccacacccagg

SEQ ID NO: 6472872 - DNA, 15 bp, Homo sapiens
tgcctcaccccttgc

SEQ ID NO: 6472873 - DNA, 16 bp, Homo sapiens
tgcctcaccgcttccc

SEQ ID NO: 6472874 - DNA, 22 bp, Homo sapiens
tgcctcaccgcttccctcctgc

SEQ ID NO: 6472875 - DNA, 15 bp, Homo sapiens
tgcctcacctcgaaa

SEQ ID NO: 6472876 - DNA, 23 bp, Homo sapiens
tgcctcacctggtcgccaatcca

SEQ ID NO: 6472877 - DNA, 22 bp, Homo sapiens
tgcctcaccttccaacactcca

SEQ ID NO: 6472878 - DNA, 18 bp, Homo sapiens
tgcctcaccttggggcct

SEQ ID NO: 6472879 - DNA, 23 bp, Homo sapiens
tgcctcaccttggggccttgatg

SEQ ID NO: 6472880 - DNA, 15 bp, Homo sapiens
tgcctcactaatttt

SEQ ID NO: 6472881 - DNA, 13 bp, Homo sapiens
tgcctcactgtga

SEQ ID NO: 6472882 - DNA, 20 bp, Homo sapiens
tgcctcactgtgacctgctc

SEQ ID NO: 6472883 - DNA, 21 bp, Homo sapiens
tgcctcactgtgacctgctcc

SEQ ID NO: 6472884 - DNA, 15 bp, Homo sapiens
tgcctcactttcttc

SEQ ID NO: 6472885 - DNA, 15 bp, Homo sapiens
tgcctcagagaccag

SEQ ID NO: 6472886 - DNA, 15 bp, Homo sapiens
tgcctcagagcaggc

SEQ ID NO: 6472887 - DNA, 23 bp, Homo sapiens
tgcctcagccacttgcctgtgct

SEQ ID NO: 6472888 - DNA, 16 bp, Homo sapiens
tgcctcagccagccct

SEQ ID NO: 6472889 - DNA, 22 bp, Homo sapiens
tgcctcagccagccctggaggc

SEQ ID NO: 6472890 - DNA, 13 bp, Homo sapiens
tgcctcagcctcc

SEQ ID NO: 6472891 - DNA, 16 bp, Homo sapiens
tgcctcagcctcccga

SEQ ID NO: 6472892 - DNA, 17 bp, Homo sapiens
tgcctcagcctcccgag

SEQ ID NO: 6472893 - DNA, 17 bp, Homo sapiens
tgcctcagcctccctgg

SEQ ID NO: 6472894 - DNA, 14 bp, Homo sapiens
tgcctcagcctccg

SEQ ID NO: 6472895 - DNA, 15 bp, Homo sapiens
tgcctcagccttcca

SEQ ID NO: 6472896 - DNA, 18 bp, Homo sapiens
tgcctcagccttctgagt

SEQ ID NO: 6472897 - DNA, 16 bp, Homo sapiens
tgcctcagcgctgccc

SEQ ID NO: 6472898 - DNA, 23 bp, Homo sapiens
tgcctcagcgctgcccacaccac

SEQ ID NO: 6472899 - DNA, 15 bp, Homo sapiens
tgcctcagctaccta

SEQ ID NO: 6472900 - DNA, 21 bp, Homo sapiens
tgcctcagctcagcttcgtgc

SEQ ID NO: 6472901 - DNA, 15 bp, Homo sapiens
tgcctcagctgaccc

SEQ ID NO: 6472902 - DNA, 19 bp, Homo sapiens
tgcctcagctgacccggcc

SEQ ID NO: 6472903 - DNA, 22 bp, Homo sapiens
tgcctcagctgctcgcacagat

SEQ ID NO: 6472904 - DNA, 15 bp, Homo sapiens
tgcctcagcttccca

SEQ ID NO: 6472905 - DNA, 23 bp, Homo sapiens
tgcctcagcttcccaagtagctg

SEQ ID NO: 6472906 - DNA, 17 bp, Homo sapiens
tgcctcagcttccccag

SEQ ID NO: 6472907 - DNA, 20 bp, Homo sapiens
tgcctcaggcactctcctgt

SEQ ID NO: 6472908 - DNA, 20 bp, Homo sapiens
tgcctcagggccaagccggc

SEQ ID NO: 6472909 - DNA, 21 bp, Homo sapiens
tgcctcagggccaagccggcc

SEQ ID NO: 6472910 - DNA, 15 bp, Homo sapiens
tctgcaggccaccag

SEQ ID NO: 6472911 - DNA, 21 bp, Homo sapiens
tctgcaggccaccagctgctg

SEQ ID NO: 6472912 - DNA, 23 bp, Homo sapiens
tctgcaggccacccccacctccc

SEQ ID NO: 6472913 - DNA, 17 bp, Homo sapiens
tctgcaggccactgtga

SEQ ID NO: 6472914 - DNA, 19 bp, Homo sapiens
tctgcaggccactgtgagc

SEQ ID NO: 6472915 - DNA, 22 bp, Homo sapiens
tctgcaggcctaggtgcagctc

SEQ ID NO: 6472916 - DNA, 14 bp, Homo sapiens
tctgcaggctgggg

SEQ ID NO: 6472917 - DNA, 13 bp, Homo sapiens
tctgcagggagca

SEQ ID NO: 6472918 - DNA, 16 bp, Homo sapiens
tctgcagggagcaact

SEQ ID NO: 6472919 - DNA, 12 bp, Homo sapiens
tctgcagggcag

SEQ ID NO: 6472920 - DNA, 16 bp, Homo sapiens
tctgcagggcagcctg

SEQ ID NO: 6472921 - DNA, 22 bp, Homo sapiens
tctgcaggggcctggaggaatc

SEQ ID NO: 6472922 - DNA, 21 bp, Homo sapiens
tctgcaggggtctgggagtca

SEQ ID NO: 6472923 - DNA, 13 bp, Homo sapiens
tctgcaggtccct

SEQ ID NO: 6472924 - DNA, 18 bp, Homo sapiens
tctgcaggtccctaataa

SEQ ID NO: 6472925 - DNA, 23 bp, Homo sapiens
tctgcaggtccctaataaagctg

SEQ ID NO: 6472926 - DNA, 21 bp, Homo sapiens
tctgcaggtgagcagacagga

SEQ ID NO: 6472927 - DNA, 22 bp, Homo sapiens
tctgcaggttgaagccatgtct

SEQ ID NO: 6472928 - DNA, 21 bp, Homo sapiens
tctgcagtaggggacccagag

SEQ ID NO: 6472929 - DNA, 16 bp, Homo sapiens
tctgcagtattctgta

SEQ ID NO: 6472930 - DNA, 16 bp, Homo sapiens
tctgcagtcagactga

SEQ ID NO: 6472931 - DNA, 19 bp, Homo sapiens
tctgcagtcctactcaagc

SEQ ID NO: 6472932 - DNA, 22 bp, Homo sapiens
tctgcagtcctcggcagctccg

SEQ ID NO: 6472933 - DNA, 12 bp, Homo sapiens
tctgcagtcctg

SEQ ID NO: 6472934 - DNA, 20 bp, Homo sapiens
tctgcagtcctggccccctc

SEQ ID NO: 6472935 - DNA, 14 bp, Homo sapiens
tctgcagtctcatt

SEQ ID NO: 6472936 - DNA, 17 bp, Homo sapiens
tctgcagtctcatttct

SEQ ID NO: 6472937 - DNA, 14 bp, Homo sapiens
tctgcagtgccttg

SEQ ID NO: 6472938 - DNA, 15 bp, Homo sapiens
tctgcagtgccttgg

SEQ ID NO: 6472939 - DNA, 16 bp, Homo sapiens
tctgcagtgtgccccc

SEQ ID NO: 6472940 - DNA, 23 bp, Homo sapiens
tctgcagtgttctgtgaatagca

SEQ ID NO: 6472941 - DNA, 17 bp, Homo sapiens
tctgcagttttgacatt

SEQ ID NO: 6472942 - DNA, 18 bp, Homo sapiens
tctgcataagtaattaaa

SEQ ID NO: 6472943 - DNA, 16 bp, Homo sapiens
tctgcatagacaaagg

SEQ ID NO: 6472944 - DNA, 23 bp, Homo sapiens
tctgcatatatgtctctttggag

SEQ ID NO: 6472945 - DNA, 15 bp, Homo sapiens
tctgcatatgttgaa

SEQ ID NO: 6472946 - DNA, 16 bp, Homo sapiens
tctgcatatgttgaat

SEQ ID NO: 6472947 - DNA, 19 bp, Homo sapiens
tctgcatatgttgaatact

SEQ ID NO: 6472948 - DNA, 15 bp, Homo sapiens
tctgcatatttctgt

SEQ ID NO: 6472949 - DNA, 20 bp, Homo sapiens
tctgcatcagctttttgtat

SEQ ID NO: 6472950 - DNA, 13 bp, Homo sapiens
tctgcatcatcat

SEQ ID NO: 6472951 - DNA, 16 bp, Homo sapiens
tctgcatcatcatcac

SEQ ID NO: 6472952 - DNA, 23 bp, Homo sapiens
tctgcatccagagattcattttc

SEQ ID NO: 6472953 - DNA, 14 bp, Homo sapiens
tctgcatcctctgg

SEQ ID NO: 6472954 - DNA, 17 bp, Homo sapiens
tctgcatctactcccaa

SEQ ID NO: 6472955 - DNA, 11 bp, Homo sapiens
tctgcatctcc

SEQ ID NO: 6472956 - DNA, 13 bp, Homo sapiens
tctgcatctccac

SEQ ID NO: 6472957 - DNA, 18 bp, Homo sapiens
tctgcatctcctgtcttt

SEQ ID NO: 6472958 - DNA, 14 bp, Homo sapiens
tctgcatcttcagt

SEQ ID NO: 6472959 - DNA, 17 bp, Homo sapiens
tctgcatcttggggaca

SEQ ID NO: 6472960 - DNA, 22 bp, Homo sapiens
tctgcatcttggggacatctct

SEQ ID NO: 6472961 - DNA, 13 bp, Homo sapiens
tctgcatgattag

SEQ ID NO: 6472962 - DNA, 21 bp, Homo sapiens
tctgcatgattagtgcaataa

SEQ ID NO: 6472963 - DNA, 17 bp, Homo sapiens
tctgcatgctcctctgc

SEQ ID NO: 6472964 - DNA, 15 bp, Homo sapiens
tctgcatggattcag

SEQ ID NO: 6472965 - DNA, 17 bp, Homo sapiens
tctgcatggcagaagcg

SEQ ID NO: 6472966 - DNA, 17 bp, Homo sapiens
tctgcatgtaaaatctt

SEQ ID NO: 6472967 - DNA, 20 bp, Homo sapiens
tctgcatgtaaaatcttcag

SEQ ID NO: 6472968 - DNA, 15 bp, Homo sapiens
tctgcatgttttcca

SEQ ID NO: 6472969 - DNA, 16 bp, Homo sapiens
tctgcattaataatag

SEQ ID NO: 6472970 - DNA, 16 bp, Homo sapiens
tctgcattctagtact

SEQ ID NO: 6472971 - DNA, 20 bp, Homo sapiens
tctgcattgttattgtggaa

SEQ ID NO: 6472972 - DNA, 21 bp, Homo sapiens
tctgcattgttattgtggaag

SEQ ID NO: 6472973 - DNA, 15 bp, Homo sapiens
tctgcatttaaaaaa

SEQ ID NO: 6472974 - DNA, 13 bp, Homo sapiens
tctgcatttagca

SEQ ID NO: 6472975 - DNA, 14 bp, Homo sapiens
tctgcatttagcac

SEQ ID NO: 6472976 - DNA, 15 bp, Homo sapiens
tctgcatttagcaca

SEQ ID NO: 6472977 - DNA, 14 bp, Homo sapiens
tctgcatttagctg

SEQ ID NO: 6472978 - DNA, 15 bp, Homo sapiens
tctgcatttcatatt

SEQ ID NO: 6472979 - DNA, 15 bp, Homo sapiens
tctgcatttcggtgg

SEQ ID NO: 6472980 - DNA, 15 bp, Homo sapiens
tctgcatttgtctat

SEQ ID NO: 6472981 - DNA, 10 bp, Homo sapiens
tctgcatttt

SEQ ID NO: 6472982 - DNA, 13 bp, Homo sapiens
tctgcattttctc

SEQ ID NO: 6472983 - DNA, 15 bp, Homo sapiens
tctgcattttctcag

SEQ ID NO: 6472984 - DNA, 18 bp, Homo sapiens
tctgcattttctcaggca

SEQ ID NO: 6472985 - DNA, 19 bp, Homo sapiens
tctgcattttgctattgta

SEQ ID NO: 6472986 - DNA, 18 bp, Homo sapiens
tctgcatttttctgcaga

SEQ ID NO: 6472987 - DNA, 20 bp, Homo sapiens
tctgcatttttctgcagaag

SEQ ID NO: 6472988 - DNA, 15 bp, Homo sapiens
tctgccaaaatgcaa

SEQ ID NO: 6472989 - DNA, 13 bp, Homo sapiens
tctgccaaacaca

SEQ ID NO: 6472990 - DNA, 17 bp, Homo sapiens
tctgccaacatgaggac

SEQ ID NO: 6472991 - DNA, 18 bp, Homo sapiens
tctgccaacatgaggaca

SEQ ID NO: 6472992 - DNA, 19 bp, Homo sapiens
tctgccaacatgaggacag

SEQ ID NO: 6472993 - DNA, 20 bp, Homo sapiens
tctgccaacatgaggacaga

SEQ ID NO: 6472994 - DNA, 21 bp, Homo sapiens
tctgccaacatgaggacagaa

SEQ ID NO: 6472995 - DNA, 17 bp, Homo sapiens
tctgccaacctaaaact

SEQ ID NO: 6472996 - DNA, 12 bp, Homo sapiens
tctgccaaggcc

SEQ ID NO: 6472997 - DNA, 16 bp, Homo sapiens
tctgccaagtcagttc

SEQ ID NO: 6472998 - DNA, 19 bp, Homo sapiens
tctgccaatcggctacccc

SEQ ID NO: 6472999 - DNA, 20 bp, Homo sapiens
tctgccaatcggctacccct

SEQ ID NO: 6473000 - DNA, 18 bp, Homo sapiens
tctgccaatctgtacaaa

SEQ ID NO: 6473001 - DNA, 20 bp, Homo sapiens
tctgccaatctgtacaaaat

SEQ ID NO: 6473002 - DNA, 17 bp, Homo sapiens
tctgccacaagggcagt

SEQ ID NO: 6473003 - DNA, 16 bp, Homo sapiens
tctgccacagagagtc

SEQ ID NO: 6473004 - DNA, 16 bp, Homo sapiens
tctgccaccaaaggcc

SEQ ID NO: 6473005 - DNA, 19 bp, Homo sapiens
tctgccaccaaaggccagg

SEQ ID NO: 6473006 - DNA, 15 bp, Homo sapiens
tctgccaccagcccc

SEQ ID NO: 6473007 - DNA, 18 bp, Homo sapiens
tctgccacccactcagga

SEQ ID NO: 6473008 - DNA, 17 bp, Homo sapiens
tctgccaccctgctgag

SEQ ID NO: 6473009 - DNA, 10 bp, Homo sapiens
tctgccacct

SEQ ID NO: 6473010 - DNA, 20 bp, Homo sapiens
tctgccacctcccctatcca

SEQ ID NO: 6473011 - DNA, 15 bp, Homo sapiens
tctgccactgaggag

SEQ ID NO: 6473012 - DNA, 14 bp, Homo sapiens
tctgccactgggac

SEQ ID NO: 6473013 - DNA, 15 bp, Homo sapiens
tctgccacttcccag

SEQ ID NO: 6473014 - DNA, 17 bp, Homo sapiens
tctgccacttcccaggt

SEQ ID NO: 6473015 - DNA, 15 bp, Homo sapiens
tctgccacttctgcg

SEQ ID NO: 6473016 - DNA, 23 bp, Homo sapiens
tctgccagaagatcccctcagga

SEQ ID NO: 6473017 - DNA, 12 bp, Homo sapiens
tctgccagacct

SEQ ID NO: 6473018 - DNA, 19 bp, Homo sapiens
tctgccagacctgcatggt

SEQ ID NO: 6473019 - DNA, 23 bp, Homo sapiens
tctgccagatgtcctaatggtga

SEQ ID NO: 6473020 - DNA, 17 bp, Homo sapiens
tctgccagcaaagagga

SEQ ID NO: 6473021 - DNA, 15 bp, Homo sapiens
tctgccagccagcag

SEQ ID NO: 6473022 - DNA, 19 bp, Homo sapiens
tctgccagccagcagccag

SEQ ID NO: 6473023 - DNA, 13 bp, Homo sapiens
tctgccagctcca

SEQ ID NO: 6473024 - DNA, 17 bp, Homo sapiens
tctgccagctccacagg

SEQ ID NO: 6473025 - DNA, 15 bp, Homo sapiens
tctgccaggagacag

SEQ ID NO: 6473026 - DNA, 12 bp, Homo sapiens
tctgccaggcaa

SEQ ID NO: 6473027 - DNA, 16 bp, Homo sapiens
tctgccaggcactctc

SEQ ID NO: 6473028 - DNA, 16 bp, Homo sapiens
tctgccaggcccatct

SEQ ID NO: 6473029 - DNA, 23 bp, Homo sapiens
tctgccaggcccccaagcctgca

SEQ ID NO: 6473030 - DNA, 20 bp, Homo sapiens
tctgccaggcccccaccaca

SEQ ID NO: 6473031 - DNA, 23 bp, Homo sapiens
tctgccaggcccccaccacacat

SEQ ID NO: 6473032 - DNA, 13 bp, Homo sapiens
tctgccaggcctg

SEQ ID NO: 6473033 - DNA, 18 bp, Homo sapiens
tctgccagggatggcagt

SEQ ID NO: 6473034 - DNA, 23 bp, Homo sapiens
tctgccagggatggcagtggctg

SEQ ID NO: 6473035 - DNA, 19 bp, Homo sapiens
tctgccagggcccctctcc

SEQ ID NO: 6473036 - DNA, 18 bp, Homo sapiens
tctgccaggggtaacctg

SEQ ID NO: 6473037 - DNA, 23 bp, Homo sapiens
tctgccaggggtaacctggccac

SEQ ID NO: 6473038 - DNA, 14 bp, Homo sapiens
tctgccagtcctgt

SEQ ID NO: 6473039 - DNA, 23 bp, Homo sapiens
tctgccatattctgttggccagt

SEQ ID NO: 6473040 - DNA, 13 bp, Homo sapiens
tctgccatcaact

SEQ ID NO: 6473041 - DNA, 15 bp, Homo sapiens
tctgccatcagcccc

SEQ ID NO: 6473042 - DNA, 17 bp, Homo sapiens
tctgccatcagcccctg

SEQ ID NO: 6473043 - DNA, 20 bp, Homo sapiens
tctgccatcagcccctgctg

SEQ ID NO: 6473044 - DNA, 16 bp, Homo sapiens
tctgccatcctccctg

SEQ ID NO: 6473045 - DNA, 21 bp, Homo sapiens
tctgccatctaatggcttcag

SEQ ID NO: 6473046 - DNA, 19 bp, Homo sapiens
tctgccatgaactggaggc

SEQ ID NO: 6473047 - DNA, 23 bp, Homo sapiens
tctgccattgggaccctccagtg

SEQ ID NO: 6473048 - DNA, 19 bp, Homo sapiens
tctgcccaaattatgtgaa

SEQ ID NO: 6473049 - DNA, 18 bp, Homo sapiens
tctgcccaattggaggaa

SEQ ID NO: 6473050 - DNA, 18 bp, Homo sapiens
tctgcccacacctcggcc

SEQ ID NO: 6473051 - DNA, 12 bp, Homo sapiens
tctgcccacccc

SEQ ID NO: 6473052 - DNA, 19 bp, Homo sapiens
tctgcccaccccgcctctg

SEQ ID NO: 6473053 - DNA, 21 bp, Homo sapiens
tctgcccaccccgcctctggg

SEQ ID NO: 6473054 - DNA, 16 bp, Homo sapiens
tctgcccaccgacccc

SEQ ID NO: 6473055 - DNA, 22 bp, Homo sapiens
tctgcccacctcagcctcccaa

SEQ ID NO: 6473056 - DNA, 15 bp, Homo sapiens
tctgcccacctctct

SEQ ID NO: 6473057 - DNA, 16 bp, Homo sapiens
tctgcccacctggggt

SEQ ID NO: 6473058 - DNA, 19 bp, Homo sapiens
tctgcccacgatcccctcc

SEQ ID NO: 6473059 - DNA, 23 bp, Homo sapiens
tctgcccacgatcccctccccca

SEQ ID NO: 6473060 - DNA, 17 bp, Homo sapiens
tctgcccactccctgca

SEQ ID NO: 6473061 - DNA, 23 bp, Homo sapiens
tctgcccactccctgcaacctga

SEQ ID NO: 6473062 - DNA, 13 bp, Homo sapiens
tctgcccagagct

SEQ ID NO: 6473063 - DNA, 22 bp, Homo sapiens
tctgcccagccgggcacagtgg

SEQ ID NO: 6473064 - DNA, 13 bp, Homo sapiens
tctgcccagcctg

SEQ ID NO: 6473065 - DNA, 16 bp, Homo sapiens
tctgcccaggcaagga

SEQ ID NO: 6473066 - DNA, 21 bp, Homo sapiens
tctgcccaggcaaggaacaga

SEQ ID NO: 6473067 - DNA, 22 bp, Homo sapiens
tctgcccaggcactgctaggct

SEQ ID NO: 6473068 - DNA, 14 bp, Homo sapiens
tctgcccaggggtg

SEQ ID NO: 6473069 - DNA, 22 bp, Homo sapiens
tctgcccaggggtgccccctcc

SEQ ID NO: 6473070 - DNA, 14 bp, Homo sapiens
tctgcccatgccta

SEQ ID NO: 6473071 - DNA, 16 bp, Homo sapiens
tctgcccattccccag

SEQ ID NO: 6473072 - DNA, 12 bp, Homo sapiens
tctgccccaagc

SEQ ID NO: 6473073 - DNA, 14 bp, Homo sapiens
tctgccccaagcag

SEQ ID NO: 6473074 - DNA, 17 bp, Homo sapiens
tctgccccaagcagcca

SEQ ID NO: 6473075 - DNA, 19 bp, Homo sapiens
tctgccccaagcagccagc

SEQ ID NO: 6473076 - DNA, 20 bp, Homo sapiens
tctgccccaagcagccagcc

SEQ ID NO: 6473077 - DNA, 22 bp, Homo sapiens
tctgccccaagcccccaacccc

SEQ ID NO: 6473078 - DNA, 14 bp, Homo sapiens
tctgccccaagggg

SEQ ID NO: 6473079 - DNA, 12 bp, Homo sapiens
tctgccccaccc

SEQ ID NO: 6473080 - DNA, 23 bp, Homo sapiens
tctgccccacccaagcccaaact

SEQ ID NO: 6473081 - DNA, 21 bp, Homo sapiens
tctgccccacgctgtggccct

SEQ ID NO: 6473082 - DNA, 14 bp, Homo sapiens
tctgccccagaaca

SEQ ID NO: 6473083 - DNA, 14 bp, Homo sapiens
tctgccccagaggc

SEQ ID NO: 6473084 - DNA, 15 bp, Homo sapiens
tctgccccagagtgg

SEQ ID NO: 6473085 - DNA, 16 bp, Homo sapiens
tctgccccagcccaga

SEQ ID NO: 6473086 - DNA, 21 bp, Homo sapiens
tctgccccaggtacacctccc

SEQ ID NO: 6473087 - DNA, 13 bp, Homo sapiens
tctgccccagtag

SEQ ID NO: 6473088 - DNA, 19 bp, Homo sapiens
tctgccccagtagtcagaa

SEQ ID NO: 6473089 - DNA, 20 bp, Homo sapiens
tgcctcagtagcatctcagt

SEQ ID NO: 6473090 - DNA, 15 bp, Homo sapiens
tgcctcagtctgctt

SEQ ID NO: 6473091 - DNA, 16 bp, Homo sapiens
tgcctcagtggcagca

SEQ ID NO: 6473092 - DNA, 17 bp, Homo sapiens
tgcctcagtggcagcat

SEQ ID NO: 6473093 - DNA, 20 bp, Homo sapiens
tgcctcagtggcagcatcct

SEQ ID NO: 6473094 - DNA, 15 bp, Homo sapiens
tgcctcagtgtattt

SEQ ID NO: 6473095 - DNA, 19 bp, Homo sapiens
tgcctcagtgtatttgtat

SEQ ID NO: 6473096 - DNA, 17 bp, Homo sapiens
tgcctcagttttccttc

SEQ ID NO: 6473097 - DNA, 21 bp, Homo sapiens
tgcctcagttttccttctgtt

SEQ ID NO: 6473098 - DNA, 23 bp, Homo sapiens
tgcctcagttttccttctgttaa

SEQ ID NO: 6473099 - DNA, 23 bp, Homo sapiens
tgcctcataaattaatgattctg

SEQ ID NO: 6473100 - DNA, 14 bp, Homo sapiens
tgcctcatgaccct

SEQ ID NO: 6473101 - DNA, 16 bp, Homo sapiens
tgcctcatgaccctcc

SEQ ID NO: 6473102 - DNA, 20 bp, Homo sapiens
tgcctcatgaccctcctgtc

SEQ ID NO: 6473103 - DNA, 16 bp, Homo sapiens
tgcctcatgctctcta

SEQ ID NO: 6473104 - DNA, 18 bp, Homo sapiens
tgcctcatggccagcgcc

SEQ ID NO: 6473105 - DNA, 18 bp, Homo sapiens
tgcctcatttatttattg

SEQ ID NO: 6473106 - DNA, 22 bp, Homo sapiens
tgcctcatttcttcctctgcat

SEQ ID NO: 6473107 - DNA, 16 bp, Homo sapiens
tgcctcattttgcttc

SEQ ID NO: 6473108 - DNA, 16 bp, Homo sapiens
tgcctcatttttttcc

SEQ ID NO: 6473109 - DNA, 19 bp, Homo sapiens
tgcctccaagcggccctgt

SEQ ID NO: 6473110 - DNA, 22 bp, Homo sapiens
tgcctccaagcggccctgtgtg

SEQ ID NO: 6473111 - DNA, 16 bp, Homo sapiens
tgcctccaagttcaaa

SEQ ID NO: 6473112 - DNA, 17 bp, Homo sapiens
tgcctccaagttcaaaa

SEQ ID NO: 6473113 - DNA, 21 bp, Homo sapiens
tgcctccaattggtgcttcag

SEQ ID NO: 6473114 - DNA, 16 bp, Homo sapiens
tgcctccacatgctgc

SEQ ID NO: 6473115 - DNA, 22 bp, Homo sapiens
tgcctccacatgctgcctggca

SEQ ID NO: 6473116 - DNA, 17 bp, Homo sapiens
tgcctccaccaccactg

SEQ ID NO: 6473117 - DNA, 15 bp, Homo sapiens
tgcctccaccagcaa

SEQ ID NO: 6473118 - DNA, 17 bp, Homo sapiens
tgcctccaccagcaagg

SEQ ID NO: 6473119 - DNA, 16 bp, Homo sapiens
tgcctccacccacagt

SEQ ID NO: 6473120 - DNA, 16 bp, Homo sapiens
tgcctccacccgtcct

SEQ ID NO: 6473121 - DNA, 14 bp, Homo sapiens
tgcctccaccctct

SEQ ID NO: 6473122 - DNA, 16 bp, Homo sapiens
tgcctccaccctctga

SEQ ID NO: 6473123 - DNA, 19 bp, Homo sapiens
tgcctccaccgagccagct

SEQ ID NO: 6473124 - DNA, 21 bp, Homo sapiens
tgcctccaccgagccagcttg

SEQ ID NO: 6473125 - DNA, 15 bp, Homo sapiens
tgcctccagcctggt

SEQ ID NO: 6473126 - DNA, 23 bp, Homo sapiens
tgcctccagcctggtggcccagc

SEQ ID NO: 6473127 - DNA, 13 bp, Homo sapiens
tgcctccagctgt

SEQ ID NO: 6473128 - DNA, 14 bp, Homo sapiens
tgcctccagctgtc

SEQ ID NO: 6473129 - DNA, 20 bp, Homo sapiens
tgcctccaggaccttgcttc

SEQ ID NO: 6473130 - DNA, 22 bp, Homo sapiens
tgcctccaggaccttgcttcct

SEQ ID NO: 6473131 - DNA, 12 bp, Homo sapiens
tgcctccagggc

SEQ ID NO: 6473132 - DNA, 17 bp, Homo sapiens
tgcctccagggctggac

SEQ ID NO: 6473133 - DNA, 18 bp, Homo sapiens
tgcctccagggctggact

SEQ ID NO: 6473134 - DNA, 14 bp, Homo sapiens
tgcctccatctttt

SEQ ID NO: 6473135 - DNA, 17 bp, Homo sapiens
tgcctccatctttttct

SEQ ID NO: 6473136 - DNA, 23 bp, Homo sapiens
tgcctccatgatgcaagccagct

SEQ ID NO: 6473137 - DNA, 15 bp, Homo sapiens
tgcctccatggtgcc

SEQ ID NO: 6473138 - DNA, 18 bp, Homo sapiens
tgcctccatggtgcctct

SEQ ID NO: 6473139 - DNA, 16 bp, Homo sapiens
tgcctccatgtagaac

SEQ ID NO: 6473140 - DNA, 19 bp, Homo sapiens
tgcctcccaaagtgctggg

SEQ ID NO: 6473141 - DNA, 20 bp, Homo sapiens
tgcctcccaaagtgctggga

SEQ ID NO: 6473142 - DNA, 18 bp, Homo sapiens
tgcctcccaagcagctga

SEQ ID NO: 6473143 - DNA, 17 bp, Homo sapiens
tgcctcccaagctcaga

SEQ ID NO: 6473144 - DNA, 18 bp, Homo sapiens
tgcctcccacacttgctg

SEQ ID NO: 6473145 - DNA, 22 bp, Homo sapiens
tgcctcccacacttgctggggc

SEQ ID NO: 6473146 - DNA, 16 bp, Homo sapiens
tgcctcccacttcact

SEQ ID NO: 6473147 - DNA, 12 bp, Homo sapiens
tgcctcccagcc

SEQ ID NO: 6473148 - DNA, 15 bp, Homo sapiens
tgcctcccagccctg

SEQ ID NO: 6473149 - DNA, 21 bp, Homo sapiens
tgcctcccagccctgccagga

SEQ ID NO: 6473150 - DNA, 23 bp, Homo sapiens
tgcctcccagccctgccaggagg

SEQ ID NO: 6473151 - DNA, 19 bp, Homo sapiens
tgcctcccagccctgccca

SEQ ID NO: 6473152 - DNA, 14 bp, Homo sapiens
tgcctcccaggcaa

SEQ ID NO: 6473153 - DNA, 23 bp, Homo sapiens
tgcctcccaggcaagcagctggt

SEQ ID NO: 6473154 - DNA, 16 bp, Homo sapiens
tgcctcccaggttcca

SEQ ID NO: 6473155 - DNA, 22 bp, Homo sapiens
tgcctcccatcacccgctaaga

SEQ ID NO: 6473156 - DNA, 17 bp, Homo sapiens
tgcctcccattctgcac

SEQ ID NO: 6473157 - DNA, 18 bp, Homo sapiens
tgcctcccattctgcacc

SEQ ID NO: 6473158 - DNA, 20 bp, Homo sapiens
tgcctccccaaccctgcccc

SEQ ID NO: 6473159 - DNA, 21 bp, Homo sapiens
tgcctccccaaccctgcccct

SEQ ID NO: 6473160 - DNA, 22 bp, Homo sapiens
tgcctccccaaccctgcccctg

SEQ ID NO: 6473161 - DNA, 17 bp, Homo sapiens
tgcctccccccagaccc

SEQ ID NO: 6473162 - DNA, 23 bp, Homo sapiens
tgcctccccggaagtgccttaac

SEQ ID NO: 6473163 - DNA, 14 bp, Homo sapiens
tgcctcccctccgc

SEQ ID NO: 6473164 - DNA, 15 bp, Homo sapiens
tgcctcccctcctct

SEQ ID NO: 6473165 - DNA, 17 bp, Homo sapiens
tgcctcccctctccttc

SEQ ID NO: 6473166 - DNA, 12 bp, Homo sapiens
tgcctcccgaga

SEQ ID NO: 6473167 - DNA, 24 bp, Homo sapiens
tgcctcccgcctcccgccaccctg

SEQ ID NO: 6473168 - DNA, 24 bp, Homo sapiens
tgcctcccggctttgcagggagac

SEQ ID NO: 6473169 - DNA, 21 bp, Homo sapiens
tgcctccctcaccctgagccc

SEQ ID NO: 6473170 - DNA, 18 bp, Homo sapiens
tgcctccctccccagtgc

SEQ ID NO: 6473171 - DNA, 18 bp, Homo sapiens
tgcctccctgggccacct

SEQ ID NO: 6473172 - DNA, 14 bp, Homo sapiens
tgcctccctggtga

SEQ ID NO: 6473173 - DNA, 20 bp, Homo sapiens
tgcctcccttcccagtgggc

SEQ ID NO: 6473174 - DNA, 16 bp, Homo sapiens
tgcctcccttcctccg

SEQ ID NO: 6473175 - DNA, 12 bp, Homo sapiens
tgcctcccttga

SEQ ID NO: 6473176 - DNA, 19 bp, Homo sapiens
tgcctccgcctcagtaaga

SEQ ID NO: 6473177 - DNA, 15 bp, Homo sapiens
tgcctccgctggctt

SEQ ID NO: 6473178 - DNA, 20 bp, Homo sapiens
tgcctccggccctgccccac

SEQ ID NO: 6473179 - DNA, 20 bp, Homo sapiens
tgcctccggcctgcactccc

SEQ ID NO: 6473180 - DNA, 14 bp, Homo sapiens
tgcctccgggcctc

SEQ ID NO: 6473181 - DNA, 18 bp, Homo sapiens
tgcctccgggcctcggcc

SEQ ID NO: 6473182 - DNA, 22 bp, Homo sapiens
tgcctccgggcctcggcctggc

SEQ ID NO: 6473183 - DNA, 11 bp, Homo sapiens
tgcctcctcaa

SEQ ID NO: 6473184 - DNA, 12 bp, Homo sapiens
tgcctcctcacc

SEQ ID NO: 6473185 - DNA, 12 bp, Homo sapiens
tgcctcctcagg

SEQ ID NO: 6473186 - DNA, 14 bp, Homo sapiens
tgcctcctccctcc

SEQ ID NO: 6473187 - DNA, 17 bp, Homo sapiens
tgcctcctccctggctg

SEQ ID NO: 6473188 - DNA, 18 bp, Homo sapiens
tgcctcctccctggctgc

SEQ ID NO: 6473189 - DNA, 19 bp, Homo sapiens
tgcctcctccctggctgca

SEQ ID NO: 6473190 - DNA, 20 bp, Homo sapiens
tgcctcctccctggctgcag

SEQ ID NO: 6473191 - DNA, 11 bp, Homo sapiens
tgcctcctcct

SEQ ID NO: 6473192 - DNA, 12 bp, Homo sapiens
tgcctcctcctc

SEQ ID NO: 6473193 - DNA, 13 bp, Homo sapiens
tgcctcctcctca

SEQ ID NO: 6473194 - DNA, 14 bp, Homo sapiens
tgcctcctcctgag

SEQ ID NO: 6473195 - DNA, 20 bp, Homo sapiens
tgcctcctcctgccctccgc

SEQ ID NO: 6473196 - DNA, 19 bp, Homo sapiens
tgcctcctctcctcctcag

SEQ ID NO: 6473197 - DNA, 15 bp, Homo sapiens
tgcctcctctctccc

SEQ ID NO: 6473198 - DNA, 16 bp, Homo sapiens
tgcctcctctctccct

SEQ ID NO: 6473199 - DNA, 21 bp, Homo sapiens
tgcctcctctctccctgcctc

SEQ ID NO: 6473200 - DNA, 22 bp, Homo sapiens
tgcctcctctctccctgcctca

SEQ ID NO: 6473201 - DNA, 23 bp, Homo sapiens
tgcctcctctctccctgcctcac

SEQ ID NO: 6473202 - DNA, 14 bp, Homo sapiens
tgcctcctctgtcc

SEQ ID NO: 6473203 - DNA, 15 bp, Homo sapiens
tgcctcctctgtcct

SEQ ID NO: 6473204 - DNA, 14 bp, Homo sapiens
tgcctcctcttcaa

SEQ ID NO: 6473205 - DNA, 13 bp, Homo sapiens
tgcctcctgcagt

SEQ ID NO: 6473206 - DNA, 14 bp, Homo sapiens
tgcctcctgcagtt

SEQ ID NO: 6473207 - DNA, 23 bp, Homo sapiens
tgcctcctgccaccccttcctcc

SEQ ID NO: 6473208 - DNA, 14 bp, Homo sapiens
tgcctcctgccctt

SEQ ID NO: 6473209 - DNA, 12 bp, Homo sapiens
tgcctcctgcct

SEQ ID NO: 6473210 - DNA, 14 bp, Homo sapiens
tgcctcctgcgccc

SEQ ID NO: 6473211 - DNA, 11 bp, Homo sapiens
tgcctcctgga

SEQ ID NO: 6473212 - DNA, 14 bp, Homo sapiens
tgcctcctggctca

SEQ ID NO: 6473213 - DNA, 14 bp, Homo sapiens
tgcctcctgggaag

SEQ ID NO: 6473214 - DNA, 19 bp, Homo sapiens
tgcctcctggtctcttcac

SEQ ID NO: 6473215 - DNA, 14 bp, Homo sapiens
tgcctcctgttctg

SEQ ID NO: 6473216 - DNA, 13 bp, Homo sapiens
tgcctccttcctc

SEQ ID NO: 6473217 - DNA, 18 bp, Homo sapiens
tgcctccttgatatttgt

SEQ ID NO: 6473218 - DNA, 17 bp, Homo sapiens
tgcctccttgccagccc

SEQ ID NO: 6473219 - DNA, 20 bp, Homo sapiens
tgcctccttggtaaatacaa

SEQ ID NO: 6473220 - DNA, 17 bp, Homo sapiens
tgcctcctttgtgagga

SEQ ID NO: 6473221 - DNA, 20 bp, Homo sapiens
tgcctcctttgtgaggaagc

SEQ ID NO: 6473222 - DNA, 21 bp, Homo sapiens
tgcctcctttgtgaggaagcc

SEQ ID NO: 6473223 - DNA, 17 bp, Homo sapiens
tgcctccttttttctta

SEQ ID NO: 6473224 - DNA, 17 bp, Homo sapiens
tgcctcgaaagtgtcat

SEQ ID NO: 6473225 - DNA, 18 bp, Homo sapiens
tgcctcgaactggctgca

SEQ ID NO: 6473226 - DNA, 23 bp, Homo sapiens
tgcctcgacacgtgggctcccct

SEQ ID NO: 6473227 - DNA, 15 bp, Homo sapiens
tgcctcgaggcaccg

SEQ ID NO: 6473228 - DNA, 21 bp, Homo sapiens
tgcctcgaggcaccggcgctg

SEQ ID NO: 6473229 - DNA, 14 bp, Homo sapiens
tgcctcgagtcccc

SEQ ID NO: 6473230 - DNA, 17 bp, Homo sapiens
tgcctcgcccccacttt

SEQ ID NO: 6473231 - DNA, 15 bp, Homo sapiens
tgcctcgccttgtgt

SEQ ID NO: 6473232 - DNA, 16 bp, Homo sapiens
tgcctcgccttgtgtt

SEQ ID NO: 6473233 - DNA, 19 bp, Homo sapiens
tgcctcgccttgtgttacg

SEQ ID NO: 6473234 - DNA, 22 bp, Homo sapiens
tgcctcgctcaccgctggccct

SEQ ID NO: 6473235 - DNA, 14 bp, Homo sapiens
tgcctcgctccctt

SEQ ID NO: 6473236 - DNA, 15 bp, Homo sapiens
tgcctcggctcctgc

SEQ ID NO: 6473237 - DNA, 18 bp, Homo sapiens
tgcctcggctcctgctgc

SEQ ID NO: 6473238 - DNA, 20 bp, Homo sapiens
tgcctcggctcctgctgcac

SEQ ID NO: 6473239 - DNA, 21 bp, Homo sapiens
tgcctcggctcctgctgcacc

SEQ ID NO: 6473240 - DNA, 21 bp, Homo sapiens
tgcctcggctggctcccctgc

SEQ ID NO: 6473241 - DNA, 23 bp, Homo sapiens
tgcctcggctggctcccctgcag

SEQ ID NO: 6473242 - DNA, 18 bp, Homo sapiens
tgcctcgggaacctcact

SEQ ID NO: 6473243 - DNA, 18 bp, Homo sapiens
tgcctcgtagagtgacct

SEQ ID NO: 6473244 - DNA, 14 bp, Homo sapiens
tgcctctaactccc

SEQ ID NO: 6473245 - DNA, 16 bp, Homo sapiens
tgcctctaactccctc

SEQ ID NO: 6473246 - DNA, 17 bp, Homo sapiens
tgcctctaactccctcc

SEQ ID NO: 6473247 - DNA, 19 bp, Homo sapiens
tgcctctaactccctcctc

SEQ ID NO: 6473248 - DNA, 17 bp, Homo sapiens
tgcctctaaggccaagg

SEQ ID NO: 6473249 - DNA, 18 bp, Homo sapiens
tgcctctaaggccaaggc

SEQ ID NO: 6473250 - DNA, 22 bp, Homo sapiens
tgcctctacacaggggccctgt

SEQ ID NO: 6473251 - DNA, 15 bp, Homo sapiens
tgcctctacctgaca

SEQ ID NO: 6473252 - DNA, 23 bp, Homo sapiens
tgcctctactgggaaggctactt

SEQ ID NO: 6473253 - DNA, 12 bp, Homo sapiens
tgcctctagctg

SEQ ID NO: 6473254 - DNA, 14 bp, Homo sapiens
tgcctctagctgaa

SEQ ID NO: 6473255 - DNA, 23 bp, Homo sapiens
tgcctctagtccccaaggcctct

SEQ ID NO: 6473256 - DNA, 21 bp, Homo sapiens
tgcctctatccctggccacct

SEQ ID NO: 6473257 - DNA, 15 bp, Homo sapiens
tgcctctatgccctg

SEQ ID NO: 6473258 - DNA, 17 bp, Homo sapiens
tgcctctatgccctgca

SEQ ID NO: 6473259 - DNA, 18 bp, Homo sapiens
tgcctctatgccctgcag

SEQ ID NO: 6473260 - DNA, 20 bp, Homo sapiens
tgcctctatgccctgcagag

SEQ ID NO: 6473261 - DNA, 21 bp, Homo sapiens
tgcctctatgccctgcagagc

SEQ ID NO: 6473262 - DNA, 22 bp, Homo sapiens
tgcctctcaactgccctaagtc

SEQ ID NO: 6473263 - DNA, 12 bp, Homo sapiens
tgcctctcacac

SEQ ID NO: 6473264 - DNA, 19 bp, Homo sapiens
tgcctctcacacacataga

SEQ ID NO: 6473265 - DNA, 13 bp, Homo sapiens
tgcctctccaggc

SEQ ID NO: 6473266 - DNA, 20 bp, Homo sapiens
tgcctctcccacgatgtcaa

SEQ ID NO: 6473267 - DNA, 23 bp, Homo sapiens
tctgccccagtagtcagaagcag

SEQ ID NO: 6473268 - DNA, 20 bp, Homo sapiens
tctgccccatcattgcacct

SEQ ID NO: 6473269 - DNA, 23 bp, Homo sapiens
tctgccccatcattgcacctgca

SEQ ID NO: 6473270 - DNA, 18 bp, Homo sapiens
tctgccccatcctccagc

SEQ ID NO: 6473271 - DNA, 18 bp, Homo sapiens
tctgcccccaaaagtgtc

SEQ ID NO: 6473272 - DNA, 19 bp, Homo sapiens
tctgcccccaactcccgga

SEQ ID NO: 6473273 - DNA, 21 bp, Homo sapiens
tctgcccccaactcccggagg

SEQ ID NO: 6473274 - DNA, 15 bp, Homo sapiens
tctgcccccagccca

SEQ ID NO: 6473275 - DNA, 19 bp, Homo sapiens
tctgcccccagcccaaagg

SEQ ID NO: 6473276 - DNA, 19 bp, Homo sapiens
tctgcccccagcctctgtc

SEQ ID NO: 6473277 - DNA, 14 bp, Homo sapiens
tctgccccccaggg

SEQ ID NO: 6473278 - DNA, 22 bp, Homo sapiens
tctgccccccagggctagtgaa

SEQ ID NO: 6473279 - DNA, 20 bp, Homo sapiens
tctgccccccccccccatct

SEQ ID NO: 6473280 - DNA, 14 bp, Homo sapiens
tctgcccccgctga

SEQ ID NO: 6473281 - DNA, 13 bp, Homo sapiens
tctgccccctccc

SEQ ID NO: 6473282 - DNA, 20 bp, Homo sapiens
tctgccccctcccccgcaga

SEQ ID NO: 6473283 - DNA, 24 bp, Homo sapiens
tctgccccctcccccgcagacaga

SEQ ID NO: 6473284 - DNA, 16 bp, Homo sapiens
tctgccccctgcagaa

SEQ ID NO: 6473285 - DNA, 16 bp, Homo sapiens
tctgccccctgctggc

SEQ ID NO: 6473286 - DNA, 16 bp, Homo sapiens
tctgccccgccctcct

SEQ ID NO: 6473287 - DNA, 21 bp, Homo sapiens
tctgcccctaaagatgggagg

SEQ ID NO: 6473288 - DNA, 23 bp, Homo sapiens
tctgcccctaaagatgggaggag

SEQ ID NO: 6473289 - DNA, 13 bp, Homo sapiens
tctgcccctcact

SEQ ID NO: 6473290 - DNA, 14 bp, Homo sapiens
tctgcccctcaggg

SEQ ID NO: 6473291 - DNA, 21 bp, Homo sapiens
tctgcccctcagggggccagc

SEQ ID NO: 6473292 - DNA, 12 bp, Homo sapiens
tctgcccctccc

SEQ ID NO: 6473293 - DNA, 17 bp, Homo sapiens
tctgcccctcccaaccc

SEQ ID NO: 6473294 - DNA, 13 bp, Homo sapiens
tctgcccctcccc

SEQ ID NO: 6473295 - DNA, 13 bp, Homo sapiens
tctgcccctgcag

SEQ ID NO: 6473296 - DNA, 17 bp, Homo sapiens
tctgcccctgcagctgg

SEQ ID NO: 6473297 - DNA, 12 bp, Homo sapiens
tctgccccttcc

SEQ ID NO: 6473298 - DNA, 13 bp, Homo sapiens
tctgccccttccc

SEQ ID NO: 6473299 - DNA, 15 bp, Homo sapiens
tctgccccttgggca

SEQ ID NO: 6473300 - DNA, 21 bp, Homo sapiens
tctgccccttgggcctcccac

SEQ ID NO: 6473301 - DNA, 23 bp, Homo sapiens
tctgccccttgggcctcccactc

SEQ ID NO: 6473302 - DNA, 20 bp, Homo sapiens
tctgcccgcctcggcctccc

SEQ ID NO: 6473303 - DNA, 22 bp, Homo sapiens
tctgcccgcctcggcctcccaa

SEQ ID NO: 6473304 - DNA, 20 bp, Homo sapiens
tctgcccgcctgcccacctg

SEQ ID NO: 6473305 - DNA, 17 bp, Homo sapiens
tctgcccgcgggtggct

SEQ ID NO: 6473306 - DNA, 22 bp, Homo sapiens
tctgcccgcgggtggctggagc

SEQ ID NO: 6473307 - DNA, 23 bp, Homo sapiens
tctgcccgcgggtggctggagcc

SEQ ID NO: 6473308 - DNA, 19 bp, Homo sapiens
tctgcccggctacatcagc

SEQ ID NO: 6473309 - DNA, 19 bp, Homo sapiens
tctgccctatggatttgaa

SEQ ID NO: 6473310 - DNA, 21 bp, Homo sapiens
tctgccctcattactgggcct

SEQ ID NO: 6473311 - DNA, 18 bp, Homo sapiens
tctgccctccaagacctt

SEQ ID NO: 6473312 - DNA, 19 bp, Homo sapiens
tctgccctccaagaccttc

SEQ ID NO: 6473313 - DNA, 18 bp, Homo sapiens
tctgccctccctggcctc

SEQ ID NO: 6473314 - DNA, 20 bp, Homo sapiens
tctgccctcgggtggggctg

SEQ ID NO: 6473315 - DNA, 15 bp, Homo sapiens
tctgccctctccctg

SEQ ID NO: 6473316 - DNA, 14 bp, Homo sapiens
tctgccctctgctc

SEQ ID NO: 6473317 - DNA, 15 bp, Homo sapiens
tctgccctctgctgc

SEQ ID NO: 6473318 - DNA, 13 bp, Homo sapiens
tctgccctctggg

SEQ ID NO: 6473319 - DNA, 10 bp, Homo sapiens
tctgccctgc

SEQ ID NO: 6473320 - DNA, 23 bp, Homo sapiens
tctgccctgcccatactgagcct

SEQ ID NO: 6473321 - DNA, 16 bp, Homo sapiens
tctgccctgccctggc

SEQ ID NO: 6473322 - DNA, 18 bp, Homo sapiens
tctgccctgccctggcca

SEQ ID NO: 6473323 - DNA, 19 bp, Homo sapiens
tctgccctgcctccctttc

SEQ ID NO: 6473324 - DNA, 13 bp, Homo sapiens
tctgccctgcctg

SEQ ID NO: 6473325 - DNA, 12 bp, Homo sapiens
tctgccctgcgg

SEQ ID NO: 6473326 - DNA, 12 bp, Homo sapiens
tctgccctggaa

SEQ ID NO: 6473327 - DNA, 13 bp, Homo sapiens
tctgccctggatt

SEQ ID NO: 6473328 - DNA, 23 bp, Homo sapiens
tctgccctggattggttggcaaa

SEQ ID NO: 6473329 - DNA, 16 bp, Homo sapiens
tctgccctggctgctg

SEQ ID NO: 6473330 - DNA, 17 bp, Homo sapiens
tctgccctggctgctgc

SEQ ID NO: 6473331 - DNA, 14 bp, Homo sapiens
tctgccctggctgt

SEQ ID NO: 6473332 - DNA, 22 bp, Homo sapiens
tctgccctggctgtgggtatca

SEQ ID NO: 6473333 - DNA, 16 bp, Homo sapiens
tctgccctgggctcct

SEQ ID NO: 6473334 - DNA, 14 bp, Homo sapiens
tctgccctgggttc

SEQ ID NO: 6473335 - DNA, 22 bp, Homo sapiens
tctgccctgggttcttccacag

SEQ ID NO: 6473336 - DNA, 15 bp, Homo sapiens
tctgcccttacccca

SEQ ID NO: 6473337 - DNA, 16 bp, Homo sapiens
tctgcccttcctttcc

SEQ ID NO: 6473338 - DNA, 18 bp, Homo sapiens
tctgcccttgccaacgga

SEQ ID NO: 6473339 - DNA, 23 bp, Homo sapiens
tctgcccttggttaggcattgtg

SEQ ID NO: 6473340 - DNA, 21 bp, Homo sapiens
tctgcccttgttccagctttg

SEQ ID NO: 6473341 - DNA, 20 bp, Homo sapiens
tctgccgaccgcctgcttca

SEQ ID NO: 6473342 - DNA, 19 bp, Homo sapiens
tctgccgattttgtaaatg

SEQ ID NO: 6473343 - DNA, 23 bp, Homo sapiens
tctgccgcagccctgcagagggc

SEQ ID NO: 6473344 - DNA, 15 bp, Homo sapiens
tctgccgcccacctc

SEQ ID NO: 6473345 - DNA, 14 bp, Homo sapiens
tctgccgcctcagc

SEQ ID NO: 6473346 - DNA, 20 bp, Homo sapiens
tctgccgcctcagcttctca

SEQ ID NO: 6473347 - DNA, 18 bp, Homo sapiens
tctgccgctacctccctc

SEQ ID NO: 6473348 - DNA, 19 bp, Homo sapiens
tctgccgctgccatgcttt

SEQ ID NO: 6473349 - DNA, 20 bp, Homo sapiens
tctgccgctgccatgctttg

SEQ ID NO: 6473350 - DNA, 23 bp, Homo sapiens
tctgccgctgccatgctttgagt

SEQ ID NO: 6473351 - DNA, 13 bp, Homo sapiens
tctgccgctgtgt

SEQ ID NO: 6473352 - DNA, 20 bp, Homo sapiens
tctgccgctgtgtagggacc

SEQ ID NO: 6473353 - DNA, 19 bp, Homo sapiens
tctgccggcccccaggaca

SEQ ID NO: 6473354 - DNA, 13 bp, Homo sapiens
tctgccggctctt

SEQ ID NO: 6473355 - DNA, 22 bp, Homo sapiens
tctgccggtcccccatgccacc

SEQ ID NO: 6473356 - DNA, 20 bp, Homo sapiens
tctgccggtcgggcagccag

SEQ ID NO: 6473357 - DNA, 21 bp, Homo sapiens
tctgccggtcgggcagccagc

SEQ ID NO: 6473358 - DNA, 22 bp, Homo sapiens
tctgccggtcgggcagccagca

SEQ ID NO: 6473359 - DNA, 17 bp, Homo sapiens
tctgccgtgagagccca

SEQ ID NO: 6473360 - DNA, 15 bp, Homo sapiens
tctgcctaaggactt

SEQ ID NO: 6473361 - DNA, 20 bp, Homo sapiens
tctgcctaaggacttcttta

SEQ ID NO: 6473362 - DNA, 21 bp, Homo sapiens
tctgcctaaggacttctttaa

SEQ ID NO: 6473363 - DNA, 14 bp, Homo sapiens
tctgcctaataaaa

SEQ ID NO: 6473364 - DNA, 18 bp, Homo sapiens
tctgcctagaaacagtgt

SEQ ID NO: 6473365 - DNA, 21 bp, Homo sapiens
tctgcctagatccacgtgtgg

SEQ ID NO: 6473366 - DNA, 14 bp, Homo sapiens
tctgcctaggagct

SEQ ID NO: 6473367 - DNA, 21 bp, Homo sapiens
tctgcctatgcactgaagagc

SEQ ID NO: 6473368 - DNA, 16 bp, Homo sapiens
tctgcctattgcagct

SEQ ID NO: 6473369 - DNA, 17 bp, Homo sapiens
tctgcctatttattggg

SEQ ID NO: 6473370 - DNA, 23 bp, Homo sapiens
tctgcctcaactccaccctctgc

SEQ ID NO: 6473371 - DNA, 12 bp, Homo sapiens
tctgcctcacct

SEQ ID NO: 6473372 - DNA, 18 bp, Homo sapiens
tctgcctcagcctcctga

SEQ ID NO: 6473373 - DNA, 13 bp, Homo sapiens
tctgcctcagctt

SEQ ID NO: 6473374 - DNA, 16 bp, Homo sapiens
tctgcctcagcttccc

SEQ ID NO: 6473375 - DNA, 19 bp, Homo sapiens
tctgcctcagcttcccaag

SEQ ID NO: 6473376 - DNA, 22 bp, Homo sapiens
tctgcctcatcctcctcctcat

SEQ ID NO: 6473377 - DNA, 13 bp, Homo sapiens
tctgcctccagcc

SEQ ID NO: 6473378 - DNA, 13 bp, Homo sapiens
tctgcctccagga

SEQ ID NO: 6473379 - DNA, 13 bp, Homo sapiens
tctgcctccaggt

SEQ ID NO: 6473380 - DNA, 23 bp, Homo sapiens
tctgcctccaggttgcctcaaca

SEQ ID NO: 6473381 - DNA, 19 bp, Homo sapiens
tctgcctcccacgctggga

SEQ ID NO: 6473382 - DNA, 21 bp, Homo sapiens
tctgcctcccatcacccgcta

SEQ ID NO: 6473383 - DNA, 15 bp, Homo sapiens
tctgcctccctcacc

SEQ ID NO: 6473384 - DNA, 15 bp, Homo sapiens
tctgcctcctcctca

SEQ ID NO: 6473385 - DNA, 12 bp, Homo sapiens
tctgcctcctgc

SEQ ID NO: 6473386 - DNA, 15 bp, Homo sapiens
tctgcctcctgcttt

SEQ ID NO: 6473387 - DNA, 18 bp, Homo sapiens
tctgcctcctgctttggg

SEQ ID NO: 6473388 - DNA, 13 bp, Homo sapiens
tctgcctcctggc

SEQ ID NO: 6473389 - DNA, 21 bp, Homo sapiens
tctgcctcctgggttcacgta

SEQ ID NO: 6473390 - DNA, 13 bp, Homo sapiens
tctgcctccttca

SEQ ID NO: 6473391 - DNA, 13 bp, Homo sapiens
tctgcctccttta

SEQ ID NO: 6473392 - DNA, 13 bp, Homo sapiens
tctgcctcgctca

SEQ ID NO: 6473393 - DNA, 18 bp, Homo sapiens
tctgcctctaactccctc

SEQ ID NO: 6473394 - DNA, 18 bp, Homo sapiens
tctgcctctaaggccaag

SEQ ID NO: 6473395 - DNA, 13 bp, Homo sapiens
tctgcctctccag

SEQ ID NO: 6473396 - DNA, 14 bp, Homo sapiens
tctgcctctcctcc

SEQ ID NO: 6473397 - DNA, 15 bp, Homo sapiens
tctgcctctcctcca

SEQ ID NO: 6473398 - DNA, 12 bp, Homo sapiens
tctgcctctctg

SEQ ID NO: 6473399 - DNA, 14 bp, Homo sapiens
tctgcctctcttct

SEQ ID NO: 6473400 - DNA, 16 bp, Homo sapiens
tctgcctctcttcttc

SEQ ID NO: 6473401 - DNA, 15 bp, Homo sapiens
tctgcctctgacaca

SEQ ID NO: 6473402 - DNA, 18 bp, Homo sapiens
tctgcctctgacacacag

SEQ ID NO: 6473403 - DNA, 21 bp, Homo sapiens
tctgcctctgacacacagctc

SEQ ID NO: 6473404 - DNA, 15 bp, Homo sapiens
tctgcctctgagcca

SEQ ID NO: 6473405 - DNA, 15 bp, Homo sapiens
tctgcctctgaggga

SEQ ID NO: 6473406 - DNA, 12 bp, Homo sapiens
tctgcctctggg

SEQ ID NO: 6473407 - DNA, 16 bp, Homo sapiens
tctgcctctgggcagc

SEQ ID NO: 6473408 - DNA, 19 bp, Homo sapiens
tctgcctgaagtcacacag

SEQ ID NO: 6473409 - DNA, 18 bp, Homo sapiens
tctgcctgacaaggccag

SEQ ID NO: 6473410 - DNA, 21 bp, Homo sapiens
tctgcctgacaaggccagcac

SEQ ID NO: 6473411 - DNA, 18 bp, Homo sapiens
tctgcctgaccccaggcc

SEQ ID NO: 6473412 - DNA, 17 bp, Homo sapiens
tctgcctgaccccttca

SEQ ID NO: 6473413 - DNA, 17 bp, Homo sapiens
tctgcctgagattcttt

SEQ ID NO: 6473414 - DNA, 12 bp, Homo sapiens
tctgcctgagct

SEQ ID NO: 6473415 - DNA, 21 bp, Homo sapiens
tctgcctgaggggcagcctgc

SEQ ID NO: 6473416 - DNA, 22 bp, Homo sapiens
tctgcctgaggggcagcctgcc

SEQ ID NO: 6473417 - DNA, 12 bp, Homo sapiens
tctgcctgcact

SEQ ID NO: 6473418 - DNA, 15 bp, Homo sapiens
tctgcctgcactccc

SEQ ID NO: 6473419 - DNA, 20 bp, Homo sapiens
tctgcctgcactccctggcc

SEQ ID NO: 6473420 - DNA, 23 bp, Homo sapiens
tctgcctgcactccctggccttg

SEQ ID NO: 6473421 - DNA, 17 bp, Homo sapiens
tctgcctgcccaggccc

SEQ ID NO: 6473422 - DNA, 20 bp, Homo sapiens
tctgcctgcccaggcccctg

SEQ ID NO: 6473423 - DNA, 12 bp, Homo sapiens
tctgcctgcccc

SEQ ID NO: 6473424 - DNA, 15 bp, Homo sapiens
tctgcctgccctgaa

SEQ ID NO: 6473425 - DNA, 13 bp, Homo sapiens
tctgcctgcctca

SEQ ID NO: 6473426 - DNA, 17 bp, Homo sapiens
tctgcctgcctcatgct

SEQ ID NO: 6473427 - DNA, 21 bp, Homo sapiens
tctgcctgcctcatgctctct

SEQ ID NO: 6473428 - DNA, 20 bp, Homo sapiens
tctgcctgcctcctccctcc

SEQ ID NO: 6473429 - DNA, 23 bp, Homo sapiens
tctgcctgcctcctccctcccag

SEQ ID NO: 6473430 - DNA, 16 bp, Homo sapiens
tctgcctgcctgggaa

SEQ ID NO: 6473431 - DNA, 13 bp, Homo sapiens
tctgcctgctcca

SEQ ID NO: 6473432 - DNA, 18 bp, Homo sapiens
tctgcctgctggggatta

SEQ ID NO: 6473433 - DNA, 17 bp, Homo sapiens
tctgcctggaaattctg

SEQ ID NO: 6473434 - DNA, 13 bp, Homo sapiens
tctgcctggagca

SEQ ID NO: 6473435 - DNA, 15 bp, Homo sapiens
tctgcctggagcagg

SEQ ID NO: 6473436 - DNA, 13 bp, Homo sapiens
tctgcctggagcc

SEQ ID NO: 6473437 - DNA, 22 bp, Homo sapiens
tctgcctggaggcaaaggcctg

SEQ ID NO: 6473438 - DNA, 12 bp, Homo sapiens
tctgcctggagt

SEQ ID NO: 6473439 - DNA, 13 bp, Homo sapiens
tctgcctggcctg

SEQ ID NO: 6473440 - DNA, 14 bp, Homo sapiens
tctgcctggcctgg

SEQ ID NO: 6473441 - DNA, 16 bp, Homo sapiens
tctgcctggcctggct

SEQ ID NO: 6473442 - DNA, 18 bp, Homo sapiens
tctgcctggcctggctcc

SEQ ID NO: 6473443 - DNA, 19 bp, Homo sapiens
tctgcctggcctggctccc

SEQ ID NO: 6473444 - DNA, 10 bp, Homo sapiens
tctgcctggg

SEQ ID NO: 6473445 - DNA, 18 bp, Homo sapiens
tctgcctgggatgccctt

SEQ ID NO: 6473446 - DNA, 19 bp, Homo sapiens
tgcctctccccagagcatt

SEQ ID NO: 6473447 - DNA, 13 bp, Homo sapiens
tgcctctcccgca

SEQ ID NO: 6473448 - DNA, 13 bp, Homo sapiens
tgcctctccctct

SEQ ID NO: 6473449 - DNA, 14 bp, Homo sapiens
tgcctctccctctg

SEQ ID NO: 6473450 - DNA, 17 bp, Homo sapiens
tgcctctccctgctgct

SEQ ID NO: 6473451 - DNA, 18 bp, Homo sapiens
tgcctctccctggccctc

SEQ ID NO: 6473452 - DNA, 14 bp, Homo sapiens
tgcctctccctggg

SEQ ID NO: 6473453 - DNA, 15 bp, Homo sapiens
tgcctctccctgggt

SEQ ID NO: 6473454 - DNA, 20 bp, Homo sapiens
tgcctctcctttgtatatta

SEQ ID NO: 6473455 - DNA, 20 bp, Homo sapiens
tgcctctcgctcctcaaccc

SEQ ID NO: 6473456 - DNA, 9 bp, Homo sapiens
tgcctctct

SEQ ID NO: 6473457 - DNA, 14 bp, Homo sapiens
tgcctctctcaggc

SEQ ID NO: 6473458 - DNA, 23 bp, Homo sapiens
tgcctctctcatggcttgggctg

SEQ ID NO: 6473459 - DNA, 21 bp, Homo sapiens
tgcctctctgcaggtccctaa

SEQ ID NO: 6473460 - DNA, 14 bp, Homo sapiens
tgcctctctgccag

SEQ ID NO: 6473461 - DNA, 21 bp, Homo sapiens
tgcctctctggaaagaggctc

SEQ ID NO: 6473462 - DNA, 16 bp, Homo sapiens
tgcctctcttgcccct

SEQ ID NO: 6473463 - DNA, 18 bp, Homo sapiens
tgcctctcttgccccttg

SEQ ID NO: 6473464 - DNA, 12 bp, Homo sapiens
tgcctctgaaaa

SEQ ID NO: 6473465 - DNA, 13 bp, Homo sapiens
tgcctctgaaact

SEQ ID NO: 6473466 - DNA, 19 bp, Homo sapiens
tgcctctgaactgctgctg

SEQ ID NO: 6473467 - DNA, 14 bp, Homo sapiens
tgcctctgacacac

SEQ ID NO: 6473468 - DNA, 20 bp, Homo sapiens
tgcctctgacacacagctct

SEQ ID NO: 6473469 - DNA, 22 bp, Homo sapiens
tgcctctgacacacagctctgt

SEQ ID NO: 6473470 - DNA, 13 bp, Homo sapiens
tgcctctgacagc

SEQ ID NO: 6473471 - DNA, 22 bp, Homo sapiens
tgcctctgacagcagcctgtga

SEQ ID NO: 6473472 - DNA, 21 bp, Homo sapiens
tgcctctgacagtccacaggg

SEQ ID NO: 6473473 - DNA, 11 bp, Homo sapiens
tgcctctgacc

SEQ ID NO: 6473474 - DNA, 10 bp, Homo sapiens
tgcctctgag

SEQ ID NO: 6473475 - DNA, 16 bp, Homo sapiens
tgcctctgagcttcta

SEQ ID NO: 6473476 - DNA, 15 bp, Homo sapiens
tgcctctgaggccag

SEQ ID NO: 6473477 - DNA, 17 bp, Homo sapiens
tgcctctgaggccagcc

SEQ ID NO: 6473478 - DNA, 23 bp, Homo sapiens
tgcctctgaggccagcctggcct

SEQ ID NO: 6473479 - DNA, 19 bp, Homo sapiens
tgcctctgatatgggactg

SEQ ID NO: 6473480 - DNA, 20 bp, Homo sapiens
tgcctctgatatgggactga

SEQ ID NO: 6473481 - DNA, 20 bp, Homo sapiens
tgcctctgattctatgtaac

SEQ ID NO: 6473482 - DNA, 23 bp, Homo sapiens
tgcctctgattctatgtaacttg

SEQ ID NO: 6473483 - DNA, 12 bp, Homo sapiens
tgcctctgcacg

SEQ ID NO: 6473484 - DNA, 17 bp, Homo sapiens
tgcctctgcacgtgcac

SEQ ID NO: 6473485 - DNA, 19 bp, Homo sapiens
tgcctctgcacgtgcacac

SEQ ID NO: 6473486 - DNA, 21 bp, Homo sapiens
tgcctctgcacgtgcacacac

SEQ ID NO: 6473487 - DNA, 22 bp, Homo sapiens
tgcctctgccaaaggatgtgat

SEQ ID NO: 6473488 - DNA, 16 bp, Homo sapiens
tgcctctgccatgccc

SEQ ID NO: 6473489 - DNA, 15 bp, Homo sapiens
tgcctctgcccttgg

SEQ ID NO: 6473490 - DNA, 12 bp, Homo sapiens
tgcctctgcctc

SEQ ID NO: 6473491 - DNA, 15 bp, Homo sapiens
tgcctctgcctccca

SEQ ID NO: 6473492 - DNA, 23 bp, Homo sapiens
tgcctctgcctcccaaagtgctg

SEQ ID NO: 6473493 - DNA, 14 bp, Homo sapiens
tgcctctgcctctg

SEQ ID NO: 6473494 - DNA, 18 bp, Homo sapiens
tgcctctgcctgtctccc

SEQ ID NO: 6473495 - DNA, 13 bp, Homo sapiens
tgcctctgcctta

SEQ ID NO: 6473496 - DNA, 19 bp, Homo sapiens
tgcctctgccttgatggag

SEQ ID NO: 6473497 - DNA, 20 bp, Homo sapiens
tgcctctgcggggcagggcc

SEQ ID NO: 6473498 - DNA, 15 bp, Homo sapiens
tgcctctgctactga

SEQ ID NO: 6473499 - DNA, 22 bp, Homo sapiens
tgcctctgctactgaggcaggg

SEQ ID NO: 6473500 - DNA, 15 bp, Homo sapiens
tgcctctgctccctc

SEQ ID NO: 6473501 - DNA, 16 bp, Homo sapiens
tgcctctgctctgtgc

SEQ ID NO: 6473502 - DNA, 18 bp, Homo sapiens
tgcctctgggcagcctgc

SEQ ID NO: 6473503 - DNA, 20 bp, Homo sapiens
tgcctctgggcagcctgctt

SEQ ID NO: 6473504 - DNA, 21 bp, Homo sapiens
tgcctctgggcagcctgcttt

SEQ ID NO: 6473505 - DNA, 11 bp, Homo sapiens
tgcctctgtcc

SEQ ID NO: 6473506 - DNA, 14 bp, Homo sapiens
tgcctctgtcccct

SEQ ID NO: 6473507 - DNA, 16 bp, Homo sapiens
tgcctctgtccccttc

SEQ ID NO: 6473508 - DNA, 16 bp, Homo sapiens
tgcctctgtcctccca

SEQ ID NO: 6473509 - DNA, 13 bp, Homo sapiens
tgcctctgtcctt

SEQ ID NO: 6473510 - DNA, 17 bp, Homo sapiens
tgcctctgtctagcatg

SEQ ID NO: 6473511 - DNA, 19 bp, Homo sapiens
tgcctctgtcttaaagaat

SEQ ID NO: 6473512 - DNA, 13 bp, Homo sapiens
tgcctctgtgcac

SEQ ID NO: 6473513 - DNA, 12 bp, Homo sapiens
tgcctctgtgct

SEQ ID NO: 6473514 - DNA, 20 bp, Homo sapiens
tgcctctgtgctgtgtatgt

SEQ ID NO: 6473515 - DNA, 21 bp, Homo sapiens
tgcctctgtgctgtgtgtgac

SEQ ID NO: 6473516 - DNA, 12 bp, Homo sapiens
tgcctctgtgga

SEQ ID NO: 6473517 - DNA, 14 bp, Homo sapiens
tgcctctgtggaag

SEQ ID NO: 6473518 - DNA, 15 bp, Homo sapiens
tgcctctgtggaaga

SEQ ID NO: 6473519 - DNA, 23 bp, Homo sapiens
tgcctctgtgtagccgccctgag

SEQ ID NO: 6473520 - DNA, 21 bp, Homo sapiens
tgcctcttaacttaaaagaac

SEQ ID NO: 6473521 - DNA, 23 bp, Homo sapiens
tgcctcttaacttaaaagaacat

SEQ ID NO: 6473522 - DNA, 16 bp, Homo sapiens
tgcctcttaggactgg

SEQ ID NO: 6473523 - DNA, 19 bp, Homo sapiens
tgcctcttatcaagtgtta

SEQ ID NO: 6473524 - DNA, 21 bp, Homo sapiens
tgcctcttccagtcttcctga

SEQ ID NO: 6473525 - DNA, 23 bp, Homo sapiens
tgcctcttccagtcttcctgaca

SEQ ID NO: 6473526 - DNA, 18 bp, Homo sapiens
tgcctcttccagtgaaca

SEQ ID NO: 6473527 - DNA, 14 bp, Homo sapiens
tgcctcttccctct

SEQ ID NO: 6473528 - DNA, 13 bp, Homo sapiens
tgcctcttcctcc

SEQ ID NO: 6473529 - DNA, 15 bp, Homo sapiens
tgcctcttctgggag

SEQ ID NO: 6473530 - DNA, 19 bp, Homo sapiens
tgcctcttctgggagggca

SEQ ID NO: 6473531 - DNA, 11 bp, Homo sapiens
tgcctcttctt

SEQ ID NO: 6473532 - DNA, 13 bp, Homo sapiens
tgcctcttctttg

SEQ ID NO: 6473533 - DNA, 20 bp, Homo sapiens
tgcctcttggcagcccttga

SEQ ID NO: 6473534 - DNA, 12 bp, Homo sapiens
tgcctcttggct

SEQ ID NO: 6473535 - DNA, 13 bp, Homo sapiens
tgcctcttgggag

SEQ ID NO: 6473536 - DNA, 15 bp, Homo sapiens
tgcctcttgggagac

SEQ ID NO: 6473537 - DNA, 13 bp, Homo sapiens
tgcctcttgtctt

SEQ ID NO: 6473538 - DNA, 17 bp, Homo sapiens
tgcctcttgtgtccctg

SEQ ID NO: 6473539 - DNA, 14 bp, Homo sapiens
tgcctcttgttgca

SEQ ID NO: 6473540 - DNA, 15 bp, Homo sapiens
tgcctcttgttgcag

SEQ ID NO: 6473541 - DNA, 18 bp, Homo sapiens
tgcctcttgttgcagaga

SEQ ID NO: 6473542 - DNA, 15 bp, Homo sapiens
tgcctcttgtttctg

SEQ ID NO: 6473543 - DNA, 19 bp, Homo sapiens
tgcctcttgtttctgtgcc

SEQ ID NO: 6473544 - DNA, 16 bp, Homo sapiens
tgcctctttaaattat

SEQ ID NO: 6473545 - DNA, 20 bp, Homo sapiens
tgcctctttaaattatgacg

SEQ ID NO: 6473546 - DNA, 12 bp, Homo sapiens
tgcctctttccc

SEQ ID NO: 6473547 - DNA, 17 bp, Homo sapiens
tgcctctttcctcctca

SEQ ID NO: 6473548 - DNA, 17 bp, Homo sapiens
tgcctctttgctgcttt

SEQ ID NO: 6473549 - DNA, 19 bp, Homo sapiens
tgcctctttgctgctttgt

SEQ ID NO: 6473550 - DNA, 20 bp, Homo sapiens
tgcctcttttacctgctgct

SEQ ID NO: 6473551 - DNA, 19 bp, Homo sapiens
tgcctcttttcacattttt

SEQ ID NO: 6473552 - DNA, 19 bp, Homo sapiens
tgcctcttttcagtagtga

SEQ ID NO: 6473553 - DNA, 21 bp, Homo sapiens
tgcctctttttaaagttcaaa

SEQ ID NO: 6473554 - DNA, 22 bp, Homo sapiens
tgcctgaaaaaactggtatgtt

SEQ ID NO: 6473555 - DNA, 19 bp, Homo sapiens
tgcctgaaacagccatgtc

SEQ ID NO: 6473556 - DNA, 15 bp, Homo sapiens
tgcctgaaacccatt

SEQ ID NO: 6473557 - DNA, 13 bp, Homo sapiens
tgcctgaaagcaa

SEQ ID NO: 6473558 - DNA, 17 bp, Homo sapiens
tgcctgaacagccctct

SEQ ID NO: 6473559 - DNA, 20 bp, Homo sapiens
tgcctgaacatccttccttc

SEQ ID NO: 6473560 - DNA, 15 bp, Homo sapiens
tgcctgaactccaga

SEQ ID NO: 6473561 - DNA, 16 bp, Homo sapiens
tgcctgaactccagag

SEQ ID NO: 6473562 - DNA, 17 bp, Homo sapiens
tgcctgaagaccccaga

SEQ ID NO: 6473563 - DNA, 18 bp, Homo sapiens
tgcctgaagaccccagat

SEQ ID NO: 6473564 - DNA, 15 bp, Homo sapiens
tgcctgaagagagga

SEQ ID NO: 6473565 - DNA, 16 bp, Homo sapiens
tgcctgaagagaggaa

SEQ ID NO: 6473566 - DNA, 17 bp, Homo sapiens
tgcctgaagtcacacag

SEQ ID NO: 6473567 - DNA, 18 bp, Homo sapiens
tgcctgaagtcacacagt

SEQ ID NO: 6473568 - DNA, 16 bp, Homo sapiens
tgcctgacaaggccag

SEQ ID NO: 6473569 - DNA, 17 bp, Homo sapiens
tgcctgacaaggccagc

SEQ ID NO: 6473570 - DNA, 21 bp, Homo sapiens
tgcctgacaccacgctggagc

SEQ ID NO: 6473571 - DNA, 23 bp, Homo sapiens
tgcctgacaccacgctggagctg

SEQ ID NO: 6473572 - DNA, 22 bp, Homo sapiens
tgcctgacactgagccccacct

SEQ ID NO: 6473573 - DNA, 19 bp, Homo sapiens
tgcctgacagagggatgga

SEQ ID NO: 6473574 - DNA, 16 bp, Homo sapiens
tgcctgacagcatcct

SEQ ID NO: 6473575 - DNA, 19 bp, Homo sapiens
tgcctgacaggctgtgact

SEQ ID NO: 6473576 - DNA, 22 bp, Homo sapiens
tgcctgaccatcccatgagcag

SEQ ID NO: 6473577 - DNA, 21 bp, Homo sapiens
tgcctgactgcccgctcctcg

SEQ ID NO: 6473578 - DNA, 20 bp, Homo sapiens
tgcctgagaatgcctaggcc

SEQ ID NO: 6473579 - DNA, 13 bp, Homo sapiens
tgcctgagaccag

SEQ ID NO: 6473580 - DNA, 17 bp, Homo sapiens
tgcctgagagcagaatg

SEQ ID NO: 6473581 - DNA, 13 bp, Homo sapiens
tgcctgagattct

SEQ ID NO: 6473582 - DNA, 20 bp, Homo sapiens
tgcctgagattctttaagga

SEQ ID NO: 6473583 - DNA, 14 bp, Homo sapiens
tgcctgagcccctc

SEQ ID NO: 6473584 - DNA, 18 bp, Homo sapiens
tgcctgagcccctcagac

SEQ ID NO: 6473585 - DNA, 20 bp, Homo sapiens
tgcctgagcccgaatttctc

SEQ ID NO: 6473586 - DNA, 11 bp, Homo sapiens
tgcctgagctg

SEQ ID NO: 6473587 - DNA, 11 bp, Homo sapiens
tgcctgagctt

SEQ ID NO: 6473588 - DNA, 19 bp, Homo sapiens
tgcctgaggaggaggacac

SEQ ID NO: 6473589 - DNA, 23 bp, Homo sapiens
tgcctgaggaggaggacacagca

SEQ ID NO: 6473590 - DNA, 17 bp, Homo sapiens
tgcctgaggctggctgg

SEQ ID NO: 6473591 - DNA, 14 bp, Homo sapiens
tgcctgagggcccc

SEQ ID NO: 6473592 - DNA, 19 bp, Homo sapiens
tgcctgagggcccctctgc

SEQ ID NO: 6473593 - DNA, 18 bp, Homo sapiens
tgcctgaggggaaagaga

SEQ ID NO: 6473594 - DNA, 18 bp, Homo sapiens
tgcctgagggtggagact

SEQ ID NO: 6473595 - DNA, 14 bp, Homo sapiens
tgcctgagggtggg

SEQ ID NO: 6473596 - DNA, 15 bp, Homo sapiens
tgcctgaggtctgta

SEQ ID NO: 6473597 - DNA, 18 bp, Homo sapiens
tgcctgaggtctgtacgt

SEQ ID NO: 6473598 - DNA, 19 bp, Homo sapiens
tgcctgagtcacccatgaa

SEQ ID NO: 6473599 - DNA, 19 bp, Homo sapiens
tgcctgagtcgtgacctgc

SEQ ID NO: 6473600 - DNA, 23 bp, Homo sapiens
tgcctgagtcgtgacctgctagg

SEQ ID NO: 6473601 - DNA, 24 bp, Homo sapiens
tgcctgagtcgtgacctgctaggc

SEQ ID NO: 6473602 - DNA, 16 bp, Homo sapiens
tgcctgagtgcctggc

SEQ ID NO: 6473603 - DNA, 18 bp, Homo sapiens
tgcctgagttataaatat

SEQ ID NO: 6473604 - DNA, 22 bp, Homo sapiens
tgcctgagttataaatattttt

SEQ ID NO: 6473605 - DNA, 14 bp, Homo sapiens
tgcctgatataaat

SEQ ID NO: 6473606 - DNA, 15 bp, Homo sapiens
tgcctgatataaatg

SEQ ID NO: 6473607 - DNA, 15 bp, Homo sapiens
tgcctgatcagaaac

SEQ ID NO: 6473608 - DNA, 17 bp, Homo sapiens
tgcctgatcagaaacca

SEQ ID NO: 6473609 - DNA, 15 bp, Homo sapiens
tgcctgatccctgaa

SEQ ID NO: 6473610 - DNA, 22 bp, Homo sapiens
tgcctgatccctgaacccctgg

SEQ ID NO: 6473611 - DNA, 16 bp, Homo sapiens
tgcctgatgacaataa

SEQ ID NO: 6473612 - DNA, 16 bp, Homo sapiens
tgcctgatgggagtag

SEQ ID NO: 6473613 - DNA, 18 bp, Homo sapiens
tgcctgattcggctgtct

SEQ ID NO: 6473614 - DNA, 15 bp, Homo sapiens
tgcctgattttaaaa

SEQ ID NO: 6473615 - DNA, 21 bp, Homo sapiens
tgcctgcacatcatgagcctt

SEQ ID NO: 6473616 - DNA, 16 bp, Homo sapiens
tgcctgcaccaggaga

SEQ ID NO: 6473617 - DNA, 15 bp, Homo sapiens
tgcctgcactccctg

SEQ ID NO: 6473618 - DNA, 19 bp, Homo sapiens
tgcctgcactccctggcct

SEQ ID NO: 6473619 - DNA, 20 bp, Homo sapiens
tgcctgcactccctggcctt

SEQ ID NO: 6473620 - DNA, 22 bp, Homo sapiens
tgcctgcactgagagggcaagg

SEQ ID NO: 6473621 - DNA, 19 bp, Homo sapiens
tgcctgcactgggaaggaa

SEQ ID NO: 6473622 - DNA, 15 bp, Homo sapiens
tgcctgcagagagaa

SEQ ID NO: 6473623 - DNA, 16 bp, Homo sapiens
tgcctgcagagagaag

SEQ ID NO: 6473624 - DNA, 18 bp, Homo sapiens
tgcctgcagagagaagcc

SEQ ID NO: 6473625 - DNA, 13 bp, Homo sapiens
tgcctgcagagat

SEQ ID NO: 6473626 - DNA, 22 bp, Homo sapiens
tctgcctgggatgcccttcccc

SEQ ID NO: 6473627 - DNA, 14 bp, Homo sapiens
tctgcctgggatgg

SEQ ID NO: 6473628 - DNA, 11 bp, Homo sapiens
tctgcctgggc

SEQ ID NO: 6473629 - DNA, 20 bp, Homo sapiens
tctgcctgggcaatggccag

SEQ ID NO: 6473630 - DNA, 14 bp, Homo sapiens
tctgcctgggcctg

SEQ ID NO: 6473631 - DNA, 15 bp, Homo sapiens
tctgcctgggcctgt

SEQ ID NO: 6473632 - DNA, 20 bp, Homo sapiens
tctgcctgggcctgtgcagc

SEQ ID NO: 6473633 - DNA, 15 bp, Homo sapiens
tctgcctgggctctg

SEQ ID NO: 6473634 - DNA, 20 bp, Homo sapiens
tctgcctggtggtcagatgc

SEQ ID NO: 6473635 - DNA, 19 bp, Homo sapiens
tctgcctggttccctcccc

SEQ ID NO: 6473636 - DNA, 21 bp, Homo sapiens
tctgcctggttccctccccaa

SEQ ID NO: 6473637 - DNA, 23 bp, Homo sapiens
tctgcctggttccctccccaagg

SEQ ID NO: 6473638 - DNA, 13 bp, Homo sapiens
tctgcctgtaaat

SEQ ID NO: 6473639 - DNA, 18 bp, Homo sapiens
tctgcctgtccctctcag

SEQ ID NO: 6473640 - DNA, 18 bp, Homo sapiens
tctgcctgtctggtgcct

SEQ ID NO: 6473641 - DNA, 14 bp, Homo sapiens
tctgcctgtgagcc

SEQ ID NO: 6473642 - DNA, 17 bp, Homo sapiens
tctgcctgtgagccagt

SEQ ID NO: 6473643 - DNA, 22 bp, Homo sapiens
tctgcctgtgcccgctgcgctg

SEQ ID NO: 6473644 - DNA, 18 bp, Homo sapiens
tctgcctgtggccttgcc

SEQ ID NO: 6473645 - DNA, 21 bp, Homo sapiens
tctgcctgttataactctgca

SEQ ID NO: 6473646 - DNA, 17 bp, Homo sapiens
tctgcctgttctgagga

SEQ ID NO: 6473647 - DNA, 16 bp, Homo sapiens
tctgcctgttgcgtga

SEQ ID NO: 6473648 - DNA, 19 bp, Homo sapiens
tctgccttaatttttgaaa

SEQ ID NO: 6473649 - DNA, 22 bp, Homo sapiens
tctgccttaggctgctgggaga

SEQ ID NO: 6473650 - DNA, 15 bp, Homo sapiens
tctgccttatctcat

SEQ ID NO: 6473651 - DNA, 20 bp, Homo sapiens
tctgccttcacaaatgtcat

SEQ ID NO: 6473652 - DNA, 17 bp, Homo sapiens
tctgccttcaggcttct

SEQ ID NO: 6473653 - DNA, 14 bp, Homo sapiens
tctgccttccttgc

SEQ ID NO: 6473654 - DNA, 21 bp, Homo sapiens
tctgccttcgaggtcagagga

SEQ ID NO: 6473655 - DNA, 13 bp, Homo sapiens
tctgccttctcag

SEQ ID NO: 6473656 - DNA, 15 bp, Homo sapiens
tctgccttctcaggc

SEQ ID NO: 6473657 - DNA, 20 bp, Homo sapiens
tctgccttctcatgatccaa

SEQ ID NO: 6473658 - DNA, 14 bp, Homo sapiens
tctgccttctgctg

SEQ ID NO: 6473659 - DNA, 16 bp, Homo sapiens
tctgccttctgctgaa

SEQ ID NO: 6473660 - DNA, 22 bp, Homo sapiens
tctgccttgaaatacctgtttc

SEQ ID NO: 6473661 - DNA, 23 bp, Homo sapiens
tctgccttgaaatacctgtttct

SEQ ID NO: 6473662 - DNA, 23 bp, Homo sapiens
tctgccttgcacaaaaagcacaa

SEQ ID NO: 6473663 - DNA, 19 bp, Homo sapiens
tctgccttgccctcctggg

SEQ ID NO: 6473664 - DNA, 20 bp, Homo sapiens
tctgccttgctgcacctgag

SEQ ID NO: 6473665 - DNA, 12 bp, Homo sapiens
tctgccttggac

SEQ ID NO: 6473666 - DNA, 12 bp, Homo sapiens
tctgccttggcc

SEQ ID NO: 6473667 - DNA, 13 bp, Homo sapiens
tctgccttggccc

SEQ ID NO: 6473668 - DNA, 19 bp, Homo sapiens
tctgccttggttctggcca

SEQ ID NO: 6473669 - DNA, 16 bp, Homo sapiens
tctgcctttagctttg

SEQ ID NO: 6473670 - DNA, 19 bp, Homo sapiens
tctgcctttagctttgaca

SEQ ID NO: 6473671 - DNA, 12 bp, Homo sapiens
tctgcctttccc

SEQ ID NO: 6473672 - DNA, 20 bp, Homo sapiens
tctgcctttgacatttaatt

SEQ ID NO: 6473673 - DNA, 12 bp, Homo sapiens
tctgcctttgag

SEQ ID NO: 6473674 - DNA, 13 bp, Homo sapiens
tctgcctttgctc

SEQ ID NO: 6473675 - DNA, 15 bp, Homo sapiens
tctgcctttgtttct

SEQ ID NO: 6473676 - DNA, 21 bp, Homo sapiens
tctgccttttgttcatttcat

SEQ ID NO: 6473677 - DNA, 13 bp, Homo sapiens
tctgcctttttta

SEQ ID NO: 6473678 - DNA, 22 bp, Homo sapiens
tctgcgaagtcctatggaaacc

SEQ ID NO: 6473679 - DNA, 17 bp, Homo sapiens
tctgcgacgatccccat

SEQ ID NO: 6473680 - DNA, 21 bp, Homo sapiens
tctgcgagtagttccacacag

SEQ ID NO: 6473681 - DNA, 14 bp, Homo sapiens
tctgcgattttatc

SEQ ID NO: 6473682 - DNA, 15 bp, Homo sapiens
tctgcgcaccaagga

SEQ ID NO: 6473683 - DNA, 15 bp, Homo sapiens
tctgcgccacttcct

SEQ ID NO: 6473684 - DNA, 14 bp, Homo sapiens
tctgcgccccagcg

SEQ ID NO: 6473685 - DNA, 16 bp, Homo sapiens
tctgcgccccgcctcc

SEQ ID NO: 6473686 - DNA, 18 bp, Homo sapiens
tctgcgcccttgtgccct

SEQ ID NO: 6473687 - DNA, 19 bp, Homo sapiens
tctgcgcccttgtgccctg

SEQ ID NO: 6473688 - DNA, 13 bp, Homo sapiens
tctgcgccgctgt

SEQ ID NO: 6473689 - DNA, 22 bp, Homo sapiens
tctgcgccgctgtgctgttgtc

SEQ ID NO: 6473690 - DNA, 13 bp, Homo sapiens
tctgcgcctcagg

SEQ ID NO: 6473691 - DNA, 14 bp, Homo sapiens
tctgcgcctcaggc

SEQ ID NO: 6473692 - DNA, 18 bp, Homo sapiens
tctgcgcggatgtagcat

SEQ ID NO: 6473693 - DNA, 16 bp, Homo sapiens
tctgcgctgtgtacaa

SEQ ID NO: 6473694 - DNA, 17 bp, Homo sapiens
tctgcgctgtgtacaat

SEQ ID NO: 6473695 - DNA, 21 bp, Homo sapiens
tctgcgctgtgtacaatgtga

SEQ ID NO: 6473696 - DNA, 17 bp, Homo sapiens
tctgcggaccccagctg

SEQ ID NO: 6473697 - DNA, 17 bp, Homo sapiens
tctgcggatctcagctt

SEQ ID NO: 6473698 - DNA, 17 bp, Homo sapiens
tctgcggccttccaccg

SEQ ID NO: 6473699 - DNA, 16 bp, Homo sapiens
tctgcgggctccctcc

SEQ ID NO: 6473700 - DNA, 17 bp, Homo sapiens
tctgcgggctccctcct

SEQ ID NO: 6473701 - DNA, 22 bp, Homo sapiens
tctgcgggctccctcctctggc

SEQ ID NO: 6473702 - DNA, 23 bp, Homo sapiens
tctgcggggcctgaggcaagcca

SEQ ID NO: 6473703 - DNA, 17 bp, Homo sapiens
tctgcggggcttctggg

SEQ ID NO: 6473704 - DNA, 18 bp, Homo sapiens
tctgcgggggcagtgctc

SEQ ID NO: 6473705 - DNA, 22 bp, Homo sapiens
tctgcggggggtgtcttccctg

SEQ ID NO: 6473706 - DNA, 22 bp, Homo sapiens
tctgcggtgaagttgaggctta

SEQ ID NO: 6473707 - DNA, 19 bp, Homo sapiens
tctgcggtggtgccagagg

SEQ ID NO: 6473708 - DNA, 17 bp, Homo sapiens
tctgcgtcccccagccc

SEQ ID NO: 6473709 - DNA, 19 bp, Homo sapiens
tctgcgtcccccagccctc

SEQ ID NO: 6473710 - DNA, 20 bp, Homo sapiens
tctgcgtcccccagccctca

SEQ ID NO: 6473711 - DNA, 15 bp, Homo sapiens
tctgcgtctgtgttg

SEQ ID NO: 6473712 - DNA, 18 bp, Homo sapiens
tctgcgtggcgcaggtgc

SEQ ID NO: 6473713 - DNA, 16 bp, Homo sapiens
tctgcgtgggtcagaa

SEQ ID NO: 6473714 - DNA, 17 bp, Homo sapiens
tctgcgtgggtcagaag

SEQ ID NO: 6473715 - DNA, 15 bp, Homo sapiens
tctgcgtgtcacctg

SEQ ID NO: 6473716 - DNA, 19 bp, Homo sapiens
tctgcgtgtcacctgtgct

SEQ ID NO: 6473717 - DNA, 16 bp, Homo sapiens
tctgctaaataaacat

SEQ ID NO: 6473718 - DNA, 15 bp, Homo sapiens
tctgctaaattgatg

SEQ ID NO: 6473719 - DNA, 17 bp, Homo sapiens
tctgctaaatttcaaat

SEQ ID NO: 6473720 - DNA, 14 bp, Homo sapiens
tctgctaactctgt

SEQ ID NO: 6473721 - DNA, 23 bp, Homo sapiens
tctgctaagtaatttagaagata

SEQ ID NO: 6473722 - DNA, 20 bp, Homo sapiens
tctgctaagttctcccaaca

SEQ ID NO: 6473723 - DNA, 19 bp, Homo sapiens
tctgctacgttcctattgt

SEQ ID NO: 6473724 - DNA, 16 bp, Homo sapiens
tctgctacttcactgt

SEQ ID NO: 6473725 - DNA, 18 bp, Homo sapiens
tctgctacttcactgtca

SEQ ID NO: 6473726 - DNA, 13 bp, Homo sapiens
tctgctagaaagt

SEQ ID NO: 6473727 - DNA, 21 bp, Homo sapiens
tctgctagactcctcaggaga

SEQ ID NO: 6473728 - DNA, 17 bp, Homo sapiens
tctgctagagcagacag

SEQ ID NO: 6473729 - DNA, 18 bp, Homo sapiens
tctgctagagcagacagg

SEQ ID NO: 6473730 - DNA, 17 bp, Homo sapiens
tctgctagatttctaca

SEQ ID NO: 6473731 - DNA, 21 bp, Homo sapiens
tctgctagatttctacattaa

SEQ ID NO: 6473732 - DNA, 22 bp, Homo sapiens
tctgctagccaatattaaaaga

SEQ ID NO: 6473733 - DNA, 14 bp, Homo sapiens
tctgctaggcgctg

SEQ ID NO: 6473734 - DNA, 17 bp, Homo sapiens
tctgctagtgctgtaat

SEQ ID NO: 6473735 - DNA, 16 bp, Homo sapiens
tctgctatgcattttc

SEQ ID NO: 6473736 - DNA, 20 bp, Homo sapiens
tctgctatgcattttcttca

SEQ ID NO: 6473737 - DNA, 23 bp, Homo sapiens
tctgctatgcattttcttcacag

SEQ ID NO: 6473738 - DNA, 20 bp, Homo sapiens
tctgctatttttaatttcct

SEQ ID NO: 6473739 - DNA, 17 bp, Homo sapiens
tctgctcacagtaaccc

SEQ ID NO: 6473740 - DNA, 18 bp, Homo sapiens
tctgctcacattccctct

SEQ ID NO: 6473741 - DNA, 20 bp, Homo sapiens
tctgctcacattccctctca

SEQ ID NO: 6473742 - DNA, 21 bp, Homo sapiens
tctgctcagaggccttgctgt

SEQ ID NO: 6473743 - DNA, 18 bp, Homo sapiens
tctgctcagagtctatca

SEQ ID NO: 6473744 - DNA, 18 bp, Homo sapiens
tctgctcagcaggcccta

SEQ ID NO: 6473745 - DNA, 17 bp, Homo sapiens
tctgctcagccctggag

SEQ ID NO: 6473746 - DNA, 14 bp, Homo sapiens
tctgctcagctctg

SEQ ID NO: 6473747 - DNA, 16 bp, Homo sapiens
tctgctcagctctggg

SEQ ID NO: 6473748 - DNA, 15 bp, Homo sapiens
tctgctcagcttctc

SEQ ID NO: 6473749 - DNA, 18 bp, Homo sapiens
tctgctcagcttctcctg

SEQ ID NO: 6473750 - DNA, 15 bp, Homo sapiens
tctgctcaggcctcc

SEQ ID NO: 6473751 - DNA, 14 bp, Homo sapiens
tctgctcagggccg

SEQ ID NO: 6473752 - DNA, 22 bp, Homo sapiens
tctgctcagtaatttgaggaca

SEQ ID NO: 6473753 - DNA, 17 bp, Homo sapiens
tctgctcataggacctg

SEQ ID NO: 6473754 - DNA, 22 bp, Homo sapiens
tctgctcatcattctctgtctc

SEQ ID NO: 6473755 - DNA, 16 bp, Homo sapiens
tctgctcatctacaca

SEQ ID NO: 6473756 - DNA, 16 bp, Homo sapiens
tctgctcattaaactg

SEQ ID NO: 6473757 - DNA, 18 bp, Homo sapiens
tctgctccaacagacacc

SEQ ID NO: 6473758 - DNA, 12 bp, Homo sapiens
tctgctccacca

SEQ ID NO: 6473759 - DNA, 14 bp, Homo sapiens
tctgctccaccctt

SEQ ID NO: 6473760 - DNA, 16 bp, Homo sapiens
tctgctccacccttgg

SEQ ID NO: 6473761 - DNA, 21 bp, Homo sapiens
tctgctccacccttggcctgt

SEQ ID NO: 6473762 - DNA, 15 bp, Homo sapiens
tctgctccagacagg

SEQ ID NO: 6473763 - DNA, 23 bp, Homo sapiens
tctgctccagcaactgcccttcc

SEQ ID NO: 6473764 - DNA, 14 bp, Homo sapiens
tctgctccagctct

SEQ ID NO: 6473765 - DNA, 20 bp, Homo sapiens
tctgctccataccttttctc

SEQ ID NO: 6473766 - DNA, 13 bp, Homo sapiens
tctgctccatgca

SEQ ID NO: 6473767 - DNA, 19 bp, Homo sapiens
tctgctcccaaggggcctg

SEQ ID NO: 6473768 - DNA, 14 bp, Homo sapiens
tctgctcccacccc

SEQ ID NO: 6473769 - DNA, 20 bp, Homo sapiens
tctgctcccagatgccttct

SEQ ID NO: 6473770 - DNA, 15 bp, Homo sapiens
tctgctcccagcccc

SEQ ID NO: 6473771 - DNA, 17 bp, Homo sapiens
tctgctccctgcaagct

SEQ ID NO: 6473772 - DNA, 21 bp, Homo sapiens
tctgctcctacatccagctcc

SEQ ID NO: 6473773 - DNA, 18 bp, Homo sapiens
tctgctcctagcccagca

SEQ ID NO: 6473774 - DNA, 15 bp, Homo sapiens
tctgctcctcacccc

SEQ ID NO: 6473775 - DNA, 14 bp, Homo sapiens
tctgctcctcccat

SEQ ID NO: 6473776 - DNA, 18 bp, Homo sapiens
tctgctcctctccccagc

SEQ ID NO: 6473777 - DNA, 21 bp, Homo sapiens
tctgctcctctccccagcaag

SEQ ID NO: 6473778 - DNA, 15 bp, Homo sapiens
tctgctcctgaaaaa

SEQ ID NO: 6473779 - DNA, 12 bp, Homo sapiens
tctgctcctgga

SEQ ID NO: 6473780 - DNA, 18 bp, Homo sapiens
tctgctccttcactgttc

SEQ ID NO: 6473781 - DNA, 21 bp, Homo sapiens
tctgctcctttccccttcctt

SEQ ID NO: 6473782 - DNA, 21 bp, Homo sapiens
tctgctcgccctcctttctgt

SEQ ID NO: 6473783 - DNA, 16 bp, Homo sapiens
tctgctcgccttagca

SEQ ID NO: 6473784 - DNA, 18 bp, Homo sapiens
tctgctcggccgtcttca

SEQ ID NO: 6473785 - DNA, 20 bp, Homo sapiens
tctgctcggcttcttggacc

SEQ ID NO: 6473786 - DNA, 15 bp, Homo sapiens
tctgctctagggaat

SEQ ID NO: 6473787 - DNA, 15 bp, Homo sapiens
tctgctctatactgt

SEQ ID NO: 6473788 - DNA, 18 bp, Homo sapiens
tctgctctattatataaa

SEQ ID NO: 6473789 - DNA, 19 bp, Homo sapiens
tctgctctcctcgggccct

SEQ ID NO: 6473790 - DNA, 20 bp, Homo sapiens
tctgctctcctcgggccctg

SEQ ID NO: 6473791 - DNA, 14 bp, Homo sapiens
tctgctctccttcc

SEQ ID NO: 6473792 - DNA, 11 bp, Homo sapiens
tctgctctgag

SEQ ID NO: 6473793 - DNA, 13 bp, Homo sapiens
tctgctctgagac

SEQ ID NO: 6473794 - DNA, 14 bp, Homo sapiens
tctgctctgatgca

SEQ ID NO: 6473795 - DNA, 12 bp, Homo sapiens
tctgctctgcac

SEQ ID NO: 6473796 - DNA, 16 bp, Homo sapiens
tctgctctgcccatgc

SEQ ID NO: 6473797 - DNA, 17 bp, Homo sapiens
tctgctctgcccatgcc

SEQ ID NO: 6473798 - DNA, 16 bp, Homo sapiens
tctgctctgcctggag

SEQ ID NO: 6473799 - DNA, 21 bp, Homo sapiens
tctgctctgcgtgtcacctgt

SEQ ID NO: 6473800 - DNA, 14 bp, Homo sapiens
tctgctctgctgct

SEQ ID NO: 6473801 - DNA, 13 bp, Homo sapiens
tctgctctggaat

SEQ ID NO: 6473802 - DNA, 13 bp, Homo sapiens
tctgctctggtgg

SEQ ID NO: 6473803 - DNA, 21 bp, Homo sapiens
tctgctctggttgtttctgtt

SEQ ID NO: 6473804 - DNA, 18 bp, Homo sapiens
tctgctctgtgcctggga

SEQ ID NO: 6473805 - DNA, 14 bp, Homo sapiens
tgcctgcagagcag

SEQ ID NO: 6473806 - DNA, 19 bp, Homo sapiens
tgcctgcagaggtctgtgc

SEQ ID NO: 6473807 - DNA, 15 bp, Homo sapiens
tgcctgcagagtttg

SEQ ID NO: 6473808 - DNA, 17 bp, Homo sapiens
tgcctgcagcaggcagc

SEQ ID NO: 6473809 - DNA, 12 bp, Homo sapiens
tgcctgcagcat

SEQ ID NO: 6473810 - DNA, 15 bp, Homo sapiens
tgcctgcagccaggg

SEQ ID NO: 6473811 - DNA, 17 bp, Homo sapiens
tgcctgcagcctccccc

SEQ ID NO: 6473812 - DNA, 20 bp, Homo sapiens
tgcctgcagcctcccccaca

SEQ ID NO: 6473813 - DNA, 11 bp, Homo sapiens
tgcctgcaggc

SEQ ID NO: 6473814 - DNA, 13 bp, Homo sapiens
tgcctgcagggcc

SEQ ID NO: 6473815 - DNA, 15 bp, Homo sapiens
tgcctgcaggggagc

SEQ ID NO: 6473816 - DNA, 23 bp, Homo sapiens
tgcctgcataggagtttggagga

SEQ ID NO: 6473817 - DNA, 16 bp, Homo sapiens
tgcctgcatgagctgg

SEQ ID NO: 6473818 - DNA, 14 bp, Homo sapiens
tgcctgccaaagta

SEQ ID NO: 6473819 - DNA, 14 bp, Homo sapiens
tgcctgccaaattt

SEQ ID NO: 6473820 - DNA, 23 bp, Homo sapiens
tgcctgccaacccatcggaaagg

SEQ ID NO: 6473821 - DNA, 12 bp, Homo sapiens
tgcctgccaagc

SEQ ID NO: 6473822 - DNA, 13 bp, Homo sapiens
tgcctgccactct

SEQ ID NO: 6473823 - DNA, 14 bp, Homo sapiens
tgcctgccactgtg

SEQ ID NO: 6473824 - DNA, 14 bp, Homo sapiens
tgcctgccatgggc

SEQ ID NO: 6473825 - DNA, 13 bp, Homo sapiens
tgcctgccatgtg

SEQ ID NO: 6473826 - DNA, 21 bp, Homo sapiens
tgcctgccatgtgtgagtcac

SEQ ID NO: 6473827 - DNA, 23 bp, Homo sapiens
tgcctgccatgtgtgagtcactt

SEQ ID NO: 6473828 - DNA, 16 bp, Homo sapiens
tgcctgcccacccgtg

SEQ ID NO: 6473829 - DNA, 15 bp, Homo sapiens
tgcctgcccaggccc

SEQ ID NO: 6473830 - DNA, 17 bp, Homo sapiens
tgcctgcccaggcccct

SEQ ID NO: 6473831 - DNA, 23 bp, Homo sapiens
tgcctgcccaggcccctgccacc

SEQ ID NO: 6473832 - DNA, 15 bp, Homo sapiens
tgcctgccccaccca

SEQ ID NO: 6473833 - DNA, 20 bp, Homo sapiens
tgcctgccccccagtctccc

SEQ ID NO: 6473834 - DNA, 22 bp, Homo sapiens
tgcctgccccccagtctcccca

SEQ ID NO: 6473835 - DNA, 21 bp, Homo sapiens
tgcctgcccctaccctggact

SEQ ID NO: 6473836 - DNA, 19 bp, Homo sapiens
tgcctgcccgcacagcagc

SEQ ID NO: 6473837 - DNA, 17 bp, Homo sapiens
tgcctgcccgcaccctg

SEQ ID NO: 6473838 - DNA, 19 bp, Homo sapiens
tgcctgcccgcaccctggc

SEQ ID NO: 6473839 - DNA, 22 bp, Homo sapiens
tgcctgccctctgtctgtcttc

SEQ ID NO: 6473840 - DNA, 13 bp, Homo sapiens
tgcctgccctgaa

SEQ ID NO: 6473841 - DNA, 12 bp, Homo sapiens
tgcctgccctgg

SEQ ID NO: 6473842 - DNA, 13 bp, Homo sapiens
tgcctgccctgga

SEQ ID NO: 6473843 - DNA, 17 bp, Homo sapiens
tgcctgccctggaggga

SEQ ID NO: 6473844 - DNA, 20 bp, Homo sapiens
tgcctgccctgtcaggaggc

SEQ ID NO: 6473845 - DNA, 13 bp, Homo sapiens
tgcctgccctttg

SEQ ID NO: 6473846 - DNA, 19 bp, Homo sapiens
tgcctgccgctgcacctgc

SEQ ID NO: 6473847 - DNA, 14 bp, Homo sapiens
tgcctgcctccacc

SEQ ID NO: 6473848 - DNA, 20 bp, Homo sapiens
tgcctgcctccggccctgcc

SEQ ID NO: 6473849 - DNA, 15 bp, Homo sapiens
tgcctgcctcctagg

SEQ ID NO: 6473850 - DNA, 23 bp, Homo sapiens
tgcctgcctcctaggctggaagc

SEQ ID NO: 6473851 - DNA, 15 bp, Homo sapiens
tgcctgcctcctccc

SEQ ID NO: 6473852 - DNA, 13 bp, Homo sapiens
tgcctgcctctgc

SEQ ID NO: 6473853 - DNA, 15 bp, Homo sapiens
tgcctgcctctgcca

SEQ ID NO: 6473854 - DNA, 12 bp, Homo sapiens
tgcctgcctggg

SEQ ID NO: 6473855 - DNA, 17 bp, Homo sapiens
tgcctgcctgggcctcc

SEQ ID NO: 6473856 - DNA, 15 bp, Homo sapiens
tgcctgcctgtctgt

SEQ ID NO: 6473857 - DNA, 20 bp, Homo sapiens
tgcctgcctgtctgtctctc

SEQ ID NO: 6473858 - DNA, 19 bp, Homo sapiens
tgcctgccttaagtgagga

SEQ ID NO: 6473859 - DNA, 16 bp, Homo sapiens
tgcctgcgcagctcct

SEQ ID NO: 6473860 - DNA, 14 bp, Homo sapiens
tgcctgcgcctgct

SEQ ID NO: 6473861 - DNA, 16 bp, Homo sapiens
tgcctgcgcctgctgc

SEQ ID NO: 6473862 - DNA, 20 bp, Homo sapiens
tgcctgcgcctgctgcctgc

SEQ ID NO: 6473863 - DNA, 19 bp, Homo sapiens
tgcctgcgtgggtgtgtgc

SEQ ID NO: 6473864 - DNA, 18 bp, Homo sapiens
tgcctgctagagcaaccc

SEQ ID NO: 6473865 - DNA, 15 bp, Homo sapiens
tgcctgctatccagc

SEQ ID NO: 6473866 - DNA, 16 bp, Homo sapiens
tgcctgctatgtattt

SEQ ID NO: 6473867 - DNA, 17 bp, Homo sapiens
tgcctgctatttgaagt

SEQ ID NO: 6473868 - DNA, 13 bp, Homo sapiens
tgcctgctcagca

SEQ ID NO: 6473869 - DNA, 15 bp, Homo sapiens
tgcctgctcagcagc

SEQ ID NO: 6473870 - DNA, 23 bp, Homo sapiens
tgcctgctcagcagccagtctca

SEQ ID NO: 6473871 - DNA, 14 bp, Homo sapiens
tgcctgctcccatc

SEQ ID NO: 6473872 - DNA, 22 bp, Homo sapiens
tgcctgctcccatcctgtgtgt

SEQ ID NO: 6473873 - DNA, 15 bp, Homo sapiens
tgcctgctccctgtc

SEQ ID NO: 6473874 - DNA, 18 bp, Homo sapiens
tgcctgctccctgtctgt

SEQ ID NO: 6473875 - DNA, 19 bp, Homo sapiens
tgcctgctccctgtctgtg

SEQ ID NO: 6473876 - DNA, 15 bp, Homo sapiens
tgcctgctcctgtac

SEQ ID NO: 6473877 - DNA, 16 bp, Homo sapiens
tgcctgctccttggca

SEQ ID NO: 6473878 - DNA, 16 bp, Homo sapiens
tgcctgctcgctccct

SEQ ID NO: 6473879 - DNA, 21 bp, Homo sapiens
tgcctgctctccttgccctgg

SEQ ID NO: 6473880 - DNA, 22 bp, Homo sapiens
tgcctgctctccttgccctggg

SEQ ID NO: 6473881 - DNA, 14 bp, Homo sapiens
tgcctgctctgcag

SEQ ID NO: 6473882 - DNA, 11 bp, Homo sapiens
tgcctgctctt

SEQ ID NO: 6473883 - DNA, 23 bp, Homo sapiens
tgcctgctctttggcctgatgac

SEQ ID NO: 6473884 - DNA, 23 bp, Homo sapiens
tgcctgctgaatgatttccaaag

SEQ ID NO: 6473885 - DNA, 11 bp, Homo sapiens
tgcctgctgac

SEQ ID NO: 6473886 - DNA, 11 bp, Homo sapiens
tgcctgctgct

SEQ ID NO: 6473887 - DNA, 11 bp, Homo sapiens
tgcctgctggg

SEQ ID NO: 6473888 - DNA, 13 bp, Homo sapiens
tgcctgctgggca

SEQ ID NO: 6473889 - DNA, 16 bp, Homo sapiens
tgcctgctgggcactg

SEQ ID NO: 6473890 - DNA, 20 bp, Homo sapiens
tgcctgctgggcactgggca

SEQ ID NO: 6473891 - DNA, 15 bp, Homo sapiens
tgcctgctgggctcc

SEQ ID NO: 6473892 - DNA, 16 bp, Homo sapiens
tgcctgctgggtgcca

SEQ ID NO: 6473893 - DNA, 18 bp, Homo sapiens
tgcctgctgggtgccagg

SEQ ID NO: 6473894 - DNA, 19 bp, Homo sapiens
tgcctgctgtatttatagt

SEQ ID NO: 6473895 - DNA, 11 bp, Homo sapiens
tgcctgcttcc

SEQ ID NO: 6473896 - DNA, 16 bp, Homo sapiens
tgcctgcttcctggac

SEQ ID NO: 6473897 - DNA, 17 bp, Homo sapiens
tgcctgcttcctggacc

SEQ ID NO: 6473898 - DNA, 19 bp, Homo sapiens
tgcctgcttctttccagaa

SEQ ID NO: 6473899 - DNA, 17 bp, Homo sapiens
tgcctgcttggcccggc

SEQ ID NO: 6473900 - DNA, 15 bp, Homo sapiens
tgcctgctttctcca

SEQ ID NO: 6473901 - DNA, 14 bp, Homo sapiens
tgcctgctttgaat

SEQ ID NO: 6473902 - DNA, 19 bp, Homo sapiens
tgcctgctttgacgggcca

SEQ ID NO: 6473903 - DNA, 21 bp, Homo sapiens
tgcctgctttgacgggccagg

SEQ ID NO: 6473904 - DNA, 14 bp, Homo sapiens
tgcctgcttttgat

SEQ ID NO: 6473905 - DNA, 22 bp, Homo sapiens
tgcctgctttttggaaagtcag

SEQ ID NO: 6473906 - DNA, 15 bp, Homo sapiens
tgcctggaaaacagg

SEQ ID NO: 6473907 - DNA, 18 bp, Homo sapiens
tgcctggaagagcagccc

SEQ ID NO: 6473908 - DNA, 11 bp, Homo sapiens
tgcctggaccc

SEQ ID NO: 6473909 - DNA, 12 bp, Homo sapiens
tgcctggacccg

SEQ ID NO: 6473910 - DNA, 13 bp, Homo sapiens
tgcctggagaaag

SEQ ID NO: 6473911 - DNA, 21 bp, Homo sapiens
tgcctggagaaaggatggcag

SEQ ID NO: 6473912 - DNA, 19 bp, Homo sapiens
tgcctggagacaaggtgct

SEQ ID NO: 6473913 - DNA, 18 bp, Homo sapiens
tgcctggagacgtggaac

SEQ ID NO: 6473914 - DNA, 16 bp, Homo sapiens
tgcctggagagggtct

SEQ ID NO: 6473915 - DNA, 16 bp, Homo sapiens
tgcctggagctcctgg

SEQ ID NO: 6473916 - DNA, 20 bp, Homo sapiens
tgcctggaggacctgagcct

SEQ ID NO: 6473917 - DNA, 22 bp, Homo sapiens
tgcctggaggacctgagcctgc

SEQ ID NO: 6473918 - DNA, 21 bp, Homo sapiens
tgcctggaggatccctccatc

SEQ ID NO: 6473919 - DNA, 21 bp, Homo sapiens
tgcctggaggcaaaggcctgg

SEQ ID NO: 6473920 - DNA, 14 bp, Homo sapiens
tgcctggaggccag

SEQ ID NO: 6473921 - DNA, 20 bp, Homo sapiens
tgcctggaggctcctctagg

SEQ ID NO: 6473922 - DNA, 18 bp, Homo sapiens
tgcctggaggtgtgggag

SEQ ID NO: 6473923 - DNA, 18 bp, Homo sapiens
tgcctggagtcaggtgtc

SEQ ID NO: 6473924 - DNA, 18 bp, Homo sapiens
tgcctggagtcagtagcc

SEQ ID NO: 6473925 - DNA, 23 bp, Homo sapiens
tgcctggagtcagtagccagagt

SEQ ID NO: 6473926 - DNA, 17 bp, Homo sapiens
tgcctggagtgctgtgc

SEQ ID NO: 6473927 - DNA, 23 bp, Homo sapiens
tgcctggagtgtatgactgcaca

SEQ ID NO: 6473928 - DNA, 23 bp, Homo sapiens
tgcctggatattttttgatggaa

SEQ ID NO: 6473929 - DNA, 23 bp, Homo sapiens
tgcctggatgagaaacagctcag

SEQ ID NO: 6473930 - DNA, 21 bp, Homo sapiens
tgcctggatgaggcacttctg

SEQ ID NO: 6473931 - DNA, 20 bp, Homo sapiens
tgcctggatggggctgcacc

SEQ ID NO: 6473932 - DNA, 20 bp, Homo sapiens
tgcctggattgggagccatt

SEQ ID NO: 6473933 - DNA, 9 bp, Homo sapiens
tgcctggca

SEQ ID NO: 6473934 - DNA, 15 bp, Homo sapiens
tgcctggcaggctgt

SEQ ID NO: 6473935 - DNA, 15 bp, Homo sapiens
tgcctggccactgct

SEQ ID NO: 6473936 - DNA, 18 bp, Homo sapiens
tgcctggccactgctccc

SEQ ID NO: 6473937 - DNA, 12 bp, Homo sapiens
tgcctggccagg

SEQ ID NO: 6473938 - DNA, 15 bp, Homo sapiens
tgcctggccatgctg

SEQ ID NO: 6473939 - DNA, 12 bp, Homo sapiens
tgcctggcccag

SEQ ID NO: 6473940 - DNA, 16 bp, Homo sapiens
tgcctggcccagggag

SEQ ID NO: 6473941 - DNA, 21 bp, Homo sapiens
tgcctggcccattcttgagtt

SEQ ID NO: 6473942 - DNA, 14 bp, Homo sapiens
tgcctggccccagc

SEQ ID NO: 6473943 - DNA, 17 bp, Homo sapiens
tgcctggccccagcctg

SEQ ID NO: 6473944 - DNA, 20 bp, Homo sapiens
tgcctggccccagcctgggc

SEQ ID NO: 6473945 - DNA, 12 bp, Homo sapiens
tgcctggccccc

SEQ ID NO: 6473946 - DNA, 21 bp, Homo sapiens
tgcctggcccccctccaggca

SEQ ID NO: 6473947 - DNA, 17 bp, Homo sapiens
tgcctggccccctgtcc

SEQ ID NO: 6473948 - DNA, 19 bp, Homo sapiens
tgcctggccccctgtcctc

SEQ ID NO: 6473949 - DNA, 14 bp, Homo sapiens
tgcctggcccctcc

SEQ ID NO: 6473950 - DNA, 17 bp, Homo sapiens
tgcctggcccctcctcc

SEQ ID NO: 6473951 - DNA, 17 bp, Homo sapiens
tgcctggccctcctctg

SEQ ID NO: 6473952 - DNA, 18 bp, Homo sapiens
tgcctggccctcctctgg

SEQ ID NO: 6473953 - DNA, 23 bp, Homo sapiens
tgcctggcccttgccggggcctg

SEQ ID NO: 6473954 - DNA, 15 bp, Homo sapiens
tgcctggccggccag

SEQ ID NO: 6473955 - DNA, 12 bp, Homo sapiens
tgcctggcctct

SEQ ID NO: 6473956 - DNA, 11 bp, Homo sapiens
tgcctggcctg

SEQ ID NO: 6473957 - DNA, 12 bp, Homo sapiens
tgcctggcctga

SEQ ID NO: 6473958 - DNA, 18 bp, Homo sapiens
tgcctggccttcctgtct

SEQ ID NO: 6473959 - DNA, 22 bp, Homo sapiens
tgcctggccttgtcctcagcca

SEQ ID NO: 6473960 - DNA, 13 bp, Homo sapiens
tgcctggcgggca

SEQ ID NO: 6473961 - DNA, 16 bp, Homo sapiens
tgcctggcgggcagcc

SEQ ID NO: 6473962 - DNA, 23 bp, Homo sapiens
tgcctggcgggcagcccctgctg

SEQ ID NO: 6473963 - DNA, 13 bp, Homo sapiens
tgcctggctcaga

SEQ ID NO: 6473964 - DNA, 15 bp, Homo sapiens
tgcctggctccctga

SEQ ID NO: 6473965 - DNA, 14 bp, Homo sapiens
tgcctggctctgat

SEQ ID NO: 6473966 - DNA, 15 bp, Homo sapiens
tgcctggctgggctt

SEQ ID NO: 6473967 - DNA, 23 bp, Homo sapiens
tgcctggctggtttgcccagagc

SEQ ID NO: 6473968 - DNA, 20 bp, Homo sapiens
tgcctggctgtggaggcctg

SEQ ID NO: 6473969 - DNA, 21 bp, Homo sapiens
tgcctggctgtggaggcctga

SEQ ID NO: 6473970 - DNA, 13 bp, Homo sapiens
tgcctggcttgct

SEQ ID NO: 6473971 - DNA, 18 bp, Homo sapiens
tgcctggcttgctgtggc

SEQ ID NO: 6473972 - DNA, 18 bp, Homo sapiens
tgcctgggaaccttcctg

SEQ ID NO: 6473973 - DNA, 19 bp, Homo sapiens
tgcctgggaatcctgctgc

SEQ ID NO: 6473974 - DNA, 16 bp, Homo sapiens
tgcctgggaatgtatt

SEQ ID NO: 6473975 - DNA, 18 bp, Homo sapiens
tgcctgggacggctgagc

SEQ ID NO: 6473976 - DNA, 17 bp, Homo sapiens
tgcctgggaggagtggc

SEQ ID NO: 6473977 - DNA, 22 bp, Homo sapiens
tgcctgggaggagtggccctga

SEQ ID NO: 6473978 - DNA, 22 bp, Homo sapiens
tgcctgggagttttgtattcat

SEQ ID NO: 6473979 - DNA, 21 bp, Homo sapiens
tgcctgggatccctcatcctc

SEQ ID NO: 6473980 - DNA, 20 bp, Homo sapiens
tgcctgggatcgtgcatttg

SEQ ID NO: 6473981 - DNA, 20 bp, Homo sapiens
tgcctgggcaatggccaggg

SEQ ID NO: 6473982 - DNA, 16 bp, Homo sapiens
tgcctgggcagtgccc

SEQ ID NO: 6473983 - DNA, 22 bp, Homo sapiens
tgcctgggccatgcgaggggcc

SEQ ID NO: 6473984 - DNA, 14 bp, Homo sapiens
tgcctgggcccagg

SEQ ID NO: 6473985 - DNA, 21 bp, Homo sapiens
tctgctctgttttgcatggag

SEQ ID NO: 6473986 - DNA, 13 bp, Homo sapiens
tctgctcttgcct

SEQ ID NO: 6473987 - DNA, 14 bp, Homo sapiens
tctgctcttgcctg

SEQ ID NO: 6473988 - DNA, 15 bp, Homo sapiens
tctgctcttgtttca

SEQ ID NO: 6473989 - DNA, 19 bp, Homo sapiens
tctgctctttcctcggcct

SEQ ID NO: 6473990 - DNA, 14 bp, Homo sapiens
tctgctctttctct

SEQ ID NO: 6473991 - DNA, 16 bp, Homo sapiens
tctgctctttctctgc

SEQ ID NO: 6473992 - DNA, 17 bp, Homo sapiens
tctgctctttctctgcc

SEQ ID NO: 6473993 - DNA, 23 bp, Homo sapiens
tctgctctttcttcttccacaca

SEQ ID NO: 6473994 - DNA, 23 bp, Homo sapiens
tctgctgaaagactcgagaacca

SEQ ID NO: 6473995 - DNA, 13 bp, Homo sapiens
tctgctgaacaaa

SEQ ID NO: 6473996 - DNA, 12 bp, Homo sapiens
tctgctgaacat

SEQ ID NO: 6473997 - DNA, 13 bp, Homo sapiens
tctgctgaacatt

SEQ ID NO: 6473998 - DNA, 15 bp, Homo sapiens
tctgctgaaggacag

SEQ ID NO: 6473999 - DNA, 14 bp, Homo sapiens
tctgctgaattttc

SEQ ID NO: 6474000 - DNA, 17 bp, Homo sapiens
tctgctgaattttcaca

SEQ ID NO: 6474001 - DNA, 18 bp, Homo sapiens
tctgctgacctgctgacc

SEQ ID NO: 6474002 - DNA, 19 bp, Homo sapiens
tctgctgagctctgacctg

SEQ ID NO: 6474003 - DNA, 17 bp, Homo sapiens
tctgctgagctgggccc

SEQ ID NO: 6474004 - DNA, 18 bp, Homo sapiens
tctgctgagctgggccca

SEQ ID NO: 6474005 - DNA, 11 bp, Homo sapiens
tctgctgagga

SEQ ID NO: 6474006 - DNA, 15 bp, Homo sapiens
tctgctgaggccaga

SEQ ID NO: 6474007 - DNA, 18 bp, Homo sapiens
tctgctgaggccagagga

SEQ ID NO: 6474008 - DNA, 19 bp, Homo sapiens
tctgctgaggcccagtgca

SEQ ID NO: 6474009 - DNA, 20 bp, Homo sapiens
tctgctgaggcccagtgcat

SEQ ID NO: 6474010 - DNA, 19 bp, Homo sapiens
tctgctgagtgctgggcac

SEQ ID NO: 6474011 - DNA, 22 bp, Homo sapiens
tctgctgatcctcccaggcttc

SEQ ID NO: 6474012 - DNA, 22 bp, Homo sapiens
tctgctgatgacccccccagct

SEQ ID NO: 6474013 - DNA, 16 bp, Homo sapiens
tctgctgcacagtagt

SEQ ID NO: 6474014 - DNA, 12 bp, Homo sapiens
tctgctgcacct

SEQ ID NO: 6474015 - DNA, 16 bp, Homo sapiens
tctgctgcagagcagt

SEQ ID NO: 6474016 - DNA, 17 bp, Homo sapiens
tctgctgcatccccttc

SEQ ID NO: 6474017 - DNA, 18 bp, Homo sapiens
tctgctgcatccccttcc

SEQ ID NO: 6474018 - DNA, 23 bp, Homo sapiens
tctgctgcatccccttccagctc

SEQ ID NO: 6474019 - DNA, 23 bp, Homo sapiens
tctgctgcatcgctgttctgggc

SEQ ID NO: 6474020 - DNA, 18 bp, Homo sapiens
tctgctgcccacggccac

SEQ ID NO: 6474021 - DNA, 21 bp, Homo sapiens
tctgctgcccacggccaccca

SEQ ID NO: 6474022 - DNA, 13 bp, Homo sapiens
tctgctgcccagg

SEQ ID NO: 6474023 - DNA, 19 bp, Homo sapiens
tctgctgcccaggccacag

SEQ ID NO: 6474024 - DNA, 17 bp, Homo sapiens
tctgctgcccccttccc

SEQ ID NO: 6474025 - DNA, 20 bp, Homo sapiens
tctgctgccccgcttcccca

SEQ ID NO: 6474026 - DNA, 21 bp, Homo sapiens
tctgctgccccgcttccccac

SEQ ID NO: 6474027 - DNA, 18 bp, Homo sapiens
tctgctgcccctgcagtt

SEQ ID NO: 6474028 - DNA, 14 bp, Homo sapiens
tctgctgccctcca

SEQ ID NO: 6474029 - DNA, 15 bp, Homo sapiens
tctgctgccctccat

SEQ ID NO: 6474030 - DNA, 21 bp, Homo sapiens
tctgctgccgcaggagcacct

SEQ ID NO: 6474031 - DNA, 22 bp, Homo sapiens
tctgctgccggctctgggcctg

SEQ ID NO: 6474032 - DNA, 11 bp, Homo sapiens
tctgctgcctc

SEQ ID NO: 6474033 - DNA, 13 bp, Homo sapiens
tctgctgcctcca

SEQ ID NO: 6474034 - DNA, 14 bp, Homo sapiens
tctgctgcctccaa

SEQ ID NO: 6474035 - DNA, 15 bp, Homo sapiens
tctgctgcctccaag

SEQ ID NO: 6474036 - DNA, 13 bp, Homo sapiens
tctgctgcctctg

SEQ ID NO: 6474037 - DNA, 15 bp, Homo sapiens
tctgctgcctctgaa

SEQ ID NO: 6474038 - DNA, 18 bp, Homo sapiens
tctgctgcctctgtggaa

SEQ ID NO: 6474039 - DNA, 19 bp, Homo sapiens
tctgctgcctctgtggaag

SEQ ID NO: 6474040 - DNA, 21 bp, Homo sapiens
tctgctgccttgggtttctgt

SEQ ID NO: 6474041 - DNA, 15 bp, Homo sapiens
tctgctgctcccagc

SEQ ID NO: 6474042 - DNA, 20 bp, Homo sapiens
tctgctgctctgaccttcca

SEQ ID NO: 6474043 - DNA, 14 bp, Homo sapiens
tctgctgctgcccg

SEQ ID NO: 6474044 - DNA, 11 bp, Homo sapiens
tctgctgctgg

SEQ ID NO: 6474045 - DNA, 15 bp, Homo sapiens
tctgctgctggcccc

SEQ ID NO: 6474046 - DNA, 13 bp, Homo sapiens
tctgctgctggct

SEQ ID NO: 6474047 - DNA, 17 bp, Homo sapiens
tctgctgctggctggtt

SEQ ID NO: 6474048 - DNA, 17 bp, Homo sapiens
tctgctgcttctgggcc

SEQ ID NO: 6474049 - DNA, 11 bp, Homo sapiens
tctgctgcttt

SEQ ID NO: 6474050 - DNA, 23 bp, Homo sapiens
tctgctggaagctgtcaggctgg

SEQ ID NO: 6474051 - DNA, 23 bp, Homo sapiens
tctgctggaaggggcagcaggag

SEQ ID NO: 6474052 - DNA, 20 bp, Homo sapiens
tctgctggagaaagccacgc

SEQ ID NO: 6474053 - DNA, 23 bp, Homo sapiens
tctgctggagaaagccacgccct

SEQ ID NO: 6474054 - DNA, 20 bp, Homo sapiens
tctgctggaggaggggaagc

SEQ ID NO: 6474055 - DNA, 23 bp, Homo sapiens
tctgctggagtttcatgtacaag

SEQ ID NO: 6474056 - DNA, 17 bp, Homo sapiens
tctgctggcctctgcga

SEQ ID NO: 6474057 - DNA, 19 bp, Homo sapiens
tctgctggcctctgcgagt

SEQ ID NO: 6474058 - DNA, 15 bp, Homo sapiens
tctgctggcctggat

SEQ ID NO: 6474059 - DNA, 15 bp, Homo sapiens
tctgctggcctggcc

SEQ ID NO: 6474060 - DNA, 13 bp, Homo sapiens
tctgctggctgat

SEQ ID NO: 6474061 - DNA, 18 bp, Homo sapiens
tctgctgggagttctaga

SEQ ID NO: 6474062 - DNA, 19 bp, Homo sapiens
tctgctgggagttctagaa

SEQ ID NO: 6474063 - DNA, 12 bp, Homo sapiens
tctgctgggctg

SEQ ID NO: 6474064 - DNA, 17 bp, Homo sapiens
tctgctgggctggggcc

SEQ ID NO: 6474065 - DNA, 16 bp, Homo sapiens
tctgctggggcctggg

SEQ ID NO: 6474066 - DNA, 16 bp, Homo sapiens
tctgctggtatttcta

SEQ ID NO: 6474067 - DNA, 17 bp, Homo sapiens
tctgctggtatttctaa

SEQ ID NO: 6474068 - DNA, 18 bp, Homo sapiens
tctgctggtatttctaat

SEQ ID NO: 6474069 - DNA, 21 bp, Homo sapiens
tctgctggtcacttcttctgt

SEQ ID NO: 6474070 - DNA, 15 bp, Homo sapiens
tctgctggtcttcaa

SEQ ID NO: 6474071 - DNA, 17 bp, Homo sapiens
tctgctggtcttcaatt

SEQ ID NO: 6474072 - DNA, 14 bp, Homo sapiens
tctgctggtggaaa

SEQ ID NO: 6474073 - DNA, 18 bp, Homo sapiens
tctgctggttcctgactg

SEQ ID NO: 6474074 - DNA, 16 bp, Homo sapiens
tctgctggttttaaca

SEQ ID NO: 6474075 - DNA, 21 bp, Homo sapiens
tctgctgtaataatattttag

SEQ ID NO: 6474076 - DNA, 20 bp, Homo sapiens
tctgctgtattgatatcact

SEQ ID NO: 6474077 - DNA, 21 bp, Homo sapiens
tctgctgtccagacagcctgt

SEQ ID NO: 6474078 - DNA, 16 bp, Homo sapiens
tctgctgtctcagcct

SEQ ID NO: 6474079 - DNA, 15 bp, Homo sapiens
tctgctgtgggaaaa

SEQ ID NO: 6474080 - DNA, 20 bp, Homo sapiens
tctgctgttacgtttgaagt

SEQ ID NO: 6474081 - DNA, 15 bp, Homo sapiens
tctgctgttccagtg

SEQ ID NO: 6474082 - DNA, 16 bp, Homo sapiens
tctgctgttgattcca

SEQ ID NO: 6474083 - DNA, 21 bp, Homo sapiens
tctgctgttgccatagcccca

SEQ ID NO: 6474084 - DNA, 14 bp, Homo sapiens
tctgctgtttacaa

SEQ ID NO: 6474085 - DNA, 12 bp, Homo sapiens
tctgcttaaaaa

SEQ ID NO: 6474086 - DNA, 17 bp, Homo sapiens
tctgcttaccaaaacat

SEQ ID NO: 6474087 - DNA, 16 bp, Homo sapiens
tctgcttaccacatca

SEQ ID NO: 6474088 - DNA, 16 bp, Homo sapiens
tctgcttagaaataac

SEQ ID NO: 6474089 - DNA, 22 bp, Homo sapiens
tctgcttagaaataacagaaga

SEQ ID NO: 6474090 - DNA, 16 bp, Homo sapiens
tctgcttaggagagac

SEQ ID NO: 6474091 - DNA, 23 bp, Homo sapiens
tctgcttaggtgccaggcatgtc

SEQ ID NO: 6474092 - DNA, 21 bp, Homo sapiens
tctgcttatgcagtttttcag

SEQ ID NO: 6474093 - DNA, 12 bp, Homo sapiens
tctgcttcaata

SEQ ID NO: 6474094 - DNA, 18 bp, Homo sapiens
tctgcttcaataaatctt

SEQ ID NO: 6474095 - DNA, 13 bp, Homo sapiens
tctgcttcagctt

SEQ ID NO: 6474096 - DNA, 20 bp, Homo sapiens
tctgcttcatccaatgtgaa

SEQ ID NO: 6474097 - DNA, 18 bp, Homo sapiens
tctgcttccacatgtgcc

SEQ ID NO: 6474098 - DNA, 16 bp, Homo sapiens
tctgcttccagttgga

SEQ ID NO: 6474099 - DNA, 13 bp, Homo sapiens
tctgcttcccagg

SEQ ID NO: 6474100 - DNA, 14 bp, Homo sapiens
tctgcttcccaggt

SEQ ID NO: 6474101 - DNA, 22 bp, Homo sapiens
tctgcttcccaggttcaagcga

SEQ ID NO: 6474102 - DNA, 13 bp, Homo sapiens
tctgcttcctcag

SEQ ID NO: 6474103 - DNA, 15 bp, Homo sapiens
tctgcttcctcagcc

SEQ ID NO: 6474104 - DNA, 23 bp, Homo sapiens
tctgcttcctcagggcccagcag

SEQ ID NO: 6474105 - DNA, 16 bp, Homo sapiens
tctgcttctcatccca

SEQ ID NO: 6474106 - DNA, 14 bp, Homo sapiens
tctgcttctctgac

SEQ ID NO: 6474107 - DNA, 16 bp, Homo sapiens
tctgcttctctgactt

SEQ ID NO: 6474108 - DNA, 19 bp, Homo sapiens
tctgcttctctgacttctg

SEQ ID NO: 6474109 - DNA, 12 bp, Homo sapiens
tctgcttctgca

SEQ ID NO: 6474110 - DNA, 16 bp, Homo sapiens
tctgcttcttcatctt

SEQ ID NO: 6474111 - DNA, 13 bp, Homo sapiens
tctgcttgacaga

SEQ ID NO: 6474112 - DNA, 14 bp, Homo sapiens
tctgcttgagtcag

SEQ ID NO: 6474113 - DNA, 23 bp, Homo sapiens
tctgcttgccatccctccctcca

SEQ ID NO: 6474114 - DNA, 14 bp, Homo sapiens
tctgcttgccgact

SEQ ID NO: 6474115 - DNA, 19 bp, Homo sapiens
tctgcttgcctagccccag

SEQ ID NO: 6474116 - DNA, 22 bp, Homo sapiens
tctgcttgcctagccccaggtc

SEQ ID NO: 6474117 - DNA, 18 bp, Homo sapiens
tctgcttgctcttgtcct

SEQ ID NO: 6474118 - DNA, 19 bp, Homo sapiens
tctgcttggcaatagttaa

SEQ ID NO: 6474119 - DNA, 18 bp, Homo sapiens
tctgcttggcttcccctc

SEQ ID NO: 6474120 - DNA, 21 bp, Homo sapiens
tctgctttaaagggcctgcct

SEQ ID NO: 6474121 - DNA, 17 bp, Homo sapiens
tctgctttagacttgaa

SEQ ID NO: 6474122 - DNA, 20 bp, Homo sapiens
tctgctttatcttttcataa

SEQ ID NO: 6474123 - DNA, 14 bp, Homo sapiens
tctgctttcaaagt

SEQ ID NO: 6474124 - DNA, 15 bp, Homo sapiens
tctgctttcatccag

SEQ ID NO: 6474125 - DNA, 18 bp, Homo sapiens
tctgctttcctcttcctg

SEQ ID NO: 6474126 - DNA, 20 bp, Homo sapiens
tctgctttccttttctctgc

SEQ ID NO: 6474127 - DNA, 14 bp, Homo sapiens
tctgctttctatta

SEQ ID NO: 6474128 - DNA, 13 bp, Homo sapiens
tctgctttctcta

SEQ ID NO: 6474129 - DNA, 14 bp, Homo sapiens
tctgctttctgata

SEQ ID NO: 6474130 - DNA, 17 bp, Homo sapiens
tctgctttctgcctctc

SEQ ID NO: 6474131 - DNA, 19 bp, Homo sapiens
tctgctttctgttcatctc

SEQ ID NO: 6474132 - DNA, 21 bp, Homo sapiens
tctgctttcttgccacacagt

SEQ ID NO: 6474133 - DNA, 20 bp, Homo sapiens
tctgctttgctcttcaagaa

SEQ ID NO: 6474134 - DNA, 16 bp, Homo sapiens
tctgctttggatgatt

SEQ ID NO: 6474135 - DNA, 13 bp, Homo sapiens
tctgctttgtggt

SEQ ID NO: 6474136 - DNA, 15 bp, Homo sapiens
tctgctttgttgtgt

SEQ ID NO: 6474137 - DNA, 13 bp, Homo sapiens
tctgcttttaagt

SEQ ID NO: 6474138 - DNA, 16 bp, Homo sapiens
tctgcttttaagtttt

SEQ ID NO: 6474139 - DNA, 18 bp, Homo sapiens
tctgcttttaccatgccc

SEQ ID NO: 6474140 - DNA, 22 bp, Homo sapiens
tctgcttttatctcagatgtta

SEQ ID NO: 6474141 - DNA, 13 bp, Homo sapiens
tctgcttttatta

SEQ ID NO: 6474142 - DNA, 18 bp, Homo sapiens
tctgcttttccattctgg

SEQ ID NO: 6474143 - DNA, 19 bp, Homo sapiens
tctgcttttccattctggg

SEQ ID NO: 6474144 - DNA, 16 bp, Homo sapiens
tctgcttttcctctgc

SEQ ID NO: 6474145 - DNA, 16 bp, Homo sapiens
tctgcttttctgccct

SEQ ID NO: 6474146 - DNA, 18 bp, Homo sapiens
tctgcttttctgccctgg

SEQ ID NO: 6474147 - DNA, 19 bp, Homo sapiens
tctgcttttctgccctggc

SEQ ID NO: 6474148 - DNA, 15 bp, Homo sapiens
tctgcttttgcatct

SEQ ID NO: 6474149 - DNA, 16 bp, Homo sapiens
tctgcttttgctgggg

SEQ ID NO: 6474150 - DNA, 18 bp, Homo sapiens
tctgctttttctttcttt

SEQ ID NO: 6474151 - DNA, 21 bp, Homo sapiens
tctggaaaaaaaatatatata

SEQ ID NO: 6474152 - DNA, 15 bp, Homo sapiens
tctggaaaactattg

SEQ ID NO: 6474153 - DNA, 13 bp, Homo sapiens
tctggaaaagagg

SEQ ID NO: 6474154 - DNA, 16 bp, Homo sapiens
tctggaaaagcacttt

SEQ ID NO: 6474155 - DNA, 16 bp, Homo sapiens
tctggaaaagctgggg

SEQ ID NO: 6474156 - DNA, 15 bp, Homo sapiens
tctggaaaatgcttc

SEQ ID NO: 6474157 - DNA, 16 bp, Homo sapiens
tctggaaaatgcttct

SEQ ID NO: 6474158 - DNA, 18 bp, Homo sapiens
tctggaaaatgcttcttg

SEQ ID NO: 6474159 - DNA, 12 bp, Homo sapiens
tctggaaacagc

SEQ ID NO: 6474160 - DNA, 15 bp, Homo sapiens
tctggaaactaccag

SEQ ID NO: 6474161 - DNA, 12 bp, Homo sapiens
tctggaaagaaa

SEQ ID NO: 6474162 - DNA, 14 bp, Homo sapiens
tctggaaagagctg

SEQ ID NO: 6474163 - DNA, 22 bp, Homo sapiens
tctggaaagagctgttttggat

SEQ ID NO: 6474164 - DNA, 15 bp, Homo sapiens
tctggaaaggaggaa

SEQ ID NO: 6474165 - DNA, 14 bp, Homo sapiens
tctggaaagggcac

SEQ ID NO: 6474166 - DNA, 19 bp, Homo sapiens
tgcctgggcccaggcccag

SEQ ID NO: 6474167 - DNA, 16 bp, Homo sapiens
tgcctgggcccctccc

SEQ ID NO: 6474168 - DNA, 21 bp, Homo sapiens
tgcctgggcccggaagggctt

SEQ ID NO: 6474169 - DNA, 19 bp, Homo sapiens
tgcctgggccctgggctga

SEQ ID NO: 6474170 - DNA, 23 bp, Homo sapiens
tgcctgggcctgtgcagcagccc

SEQ ID NO: 6474171 - DNA, 15 bp, Homo sapiens
tgcctgggctcagcc

SEQ ID NO: 6474172 - DNA, 18 bp, Homo sapiens
tgcctgggctcagcctgg

SEQ ID NO: 6474173 - DNA, 17 bp, Homo sapiens
tgcctgggctctggaag

SEQ ID NO: 6474174 - DNA, 19 bp, Homo sapiens
tgcctgggctgggcagcct

SEQ ID NO: 6474175 - DNA, 17 bp, Homo sapiens
tgcctggggcctccaga

SEQ ID NO: 6474176 - DNA, 21 bp, Homo sapiens
tgcctggggcctccagaagct

SEQ ID NO: 6474177 - DNA, 14 bp, Homo sapiens
tgcctggggctggc

SEQ ID NO: 6474178 - DNA, 17 bp, Homo sapiens
tgcctggggtggaggct

SEQ ID NO: 6474179 - DNA, 19 bp, Homo sapiens
tgcctggggtgttagtggc

SEQ ID NO: 6474180 - DNA, 23 bp, Homo sapiens
tgcctggggtgttagtggcaccg

SEQ ID NO: 6474181 - DNA, 17 bp, Homo sapiens
tgcctgggtaggcccca

SEQ ID NO: 6474182 - DNA, 21 bp, Homo sapiens
tgcctgggtaggccccacaag

SEQ ID NO: 6474183 - DNA, 19 bp, Homo sapiens
tgcctgggtggccatccta

SEQ ID NO: 6474184 - DNA, 13 bp, Homo sapiens
tgcctgggtggga

SEQ ID NO: 6474185 - DNA, 17 bp, Homo sapiens
tgcctgggtgggacagc

SEQ ID NO: 6474186 - DNA, 20 bp, Homo sapiens
tgcctgggtgggacagcctc

SEQ ID NO: 6474187 - DNA, 24 bp, Homo sapiens
tgcctgggtggggctgctcctcca

SEQ ID NO: 6474188 - DNA, 20 bp, Homo sapiens
tgcctgggttccccactggt

SEQ ID NO: 6474189 - DNA, 20 bp, Homo sapiens
tgcctgggttgggggcactc

SEQ ID NO: 6474190 - DNA, 15 bp, Homo sapiens
tgcctgggttttcta

SEQ ID NO: 6474191 - DNA, 22 bp, Homo sapiens
tgcctggtcctccctcccaagg

SEQ ID NO: 6474192 - DNA, 21 bp, Homo sapiens
tgcctggtctcctgcccccac

SEQ ID NO: 6474193 - DNA, 18 bp, Homo sapiens
tgcctggtctgtctggat

SEQ ID NO: 6474194 - DNA, 19 bp, Homo sapiens
tgcctggtgcattgctgtg

SEQ ID NO: 6474195 - DNA, 18 bp, Homo sapiens
tgcctggtggcagctgcg

SEQ ID NO: 6474196 - DNA, 12 bp, Homo sapiens
tgcctggtgggg

SEQ ID NO: 6474197 - DNA, 18 bp, Homo sapiens
tgcctggttcgtgccatg

SEQ ID NO: 6474198 - DNA, 15 bp, Homo sapiens
tgcctgtaaacatag

SEQ ID NO: 6474199 - DNA, 18 bp, Homo sapiens
tgcctgtaacaatgtaat

SEQ ID NO: 6474200 - DNA, 15 bp, Homo sapiens
tgcctgtaacttgag

SEQ ID NO: 6474201 - DNA, 15 bp, Homo sapiens
tgcctgtaatcccag

SEQ ID NO: 6474202 - DNA, 19 bp, Homo sapiens
tgcctgtaatcccagctac

SEQ ID NO: 6474203 - DNA, 15 bp, Homo sapiens
tgcctgtaattaaac

SEQ ID NO: 6474204 - DNA, 13 bp, Homo sapiens
tgcctgtacagaa

SEQ ID NO: 6474205 - DNA, 22 bp, Homo sapiens
tgcctgtagagccagccttggt

SEQ ID NO: 6474206 - DNA, 21 bp, Homo sapiens
tgcctgtagcaatggccagag

SEQ ID NO: 6474207 - DNA, 15 bp, Homo sapiens
tgcctgtagcagtga

SEQ ID NO: 6474208 - DNA, 18 bp, Homo sapiens
tgcctgtagcccactctg

SEQ ID NO: 6474209 - DNA, 20 bp, Homo sapiens
tgcctgtagcccactctgct

SEQ ID NO: 6474210 - DNA, 19 bp, Homo sapiens
tgcctgtagctttcctggt

SEQ ID NO: 6474211 - DNA, 20 bp, Homo sapiens
tgcctgtagctttcctggtc

SEQ ID NO: 6474212 - DNA, 15 bp, Homo sapiens
tgcctgtagtcccag

SEQ ID NO: 6474213 - DNA, 16 bp, Homo sapiens
tgcctgtagtcccagg

SEQ ID NO: 6474214 - DNA, 20 bp, Homo sapiens
tgcctgtagtctcagctagt

SEQ ID NO: 6474215 - DNA, 13 bp, Homo sapiens
tgcctgtagtgcc

SEQ ID NO: 6474216 - DNA, 18 bp, Homo sapiens
tgcctgtagttaggaaat

SEQ ID NO: 6474217 - DNA, 16 bp, Homo sapiens
tgcctgtatactttag

SEQ ID NO: 6474218 - DNA, 20 bp, Homo sapiens
tgcctgtattcccagctact

SEQ ID NO: 6474219 - DNA, 14 bp, Homo sapiens
tgcctgtatttcca

SEQ ID NO: 6474220 - DNA, 15 bp, Homo sapiens
tgcctgtatttccaa

SEQ ID NO: 6474221 - DNA, 20 bp, Homo sapiens
tgcctgtatttgagagactg

SEQ ID NO: 6474222 - DNA, 14 bp, Homo sapiens
tgcctgtcaagttt

SEQ ID NO: 6474223 - DNA, 21 bp, Homo sapiens
tgcctgtcacgctctggtgca

SEQ ID NO: 6474224 - DNA, 22 bp, Homo sapiens
tgcctgtcaggaccattttaga

SEQ ID NO: 6474225 - DNA, 16 bp, Homo sapiens
tgcctgtcaggctctg

SEQ ID NO: 6474226 - DNA, 21 bp, Homo sapiens
tgcctgtcaggctctggccct

SEQ ID NO: 6474227 - DNA, 20 bp, Homo sapiens
tgcctgtccagcctgggcag

SEQ ID NO: 6474228 - DNA, 17 bp, Homo sapiens
tgcctgtccccatgctt

SEQ ID NO: 6474229 - DNA, 11 bp, Homo sapiens
tgcctgtccct

SEQ ID NO: 6474230 - DNA, 14 bp, Homo sapiens
tgcctgtccctctc

SEQ ID NO: 6474231 - DNA, 22 bp, Homo sapiens
tgcctgtcctagtctcctttga

SEQ ID NO: 6474232 - DNA, 23 bp, Homo sapiens
tgcctgtcctagtctcctttgaa

SEQ ID NO: 6474233 - DNA, 14 bp, Homo sapiens
tgcctgtcctgaaa

SEQ ID NO: 6474234 - DNA, 19 bp, Homo sapiens
tgcctgtcctgaaagcggc

SEQ ID NO: 6474235 - DNA, 15 bp, Homo sapiens
tgcctgtcctttcag

SEQ ID NO: 6474236 - DNA, 16 bp, Homo sapiens
tgcctgtcctttcagt

SEQ ID NO: 6474237 - DNA, 14 bp, Homo sapiens
tgcctgtctccatg

SEQ ID NO: 6474238 - DNA, 23 bp, Homo sapiens
tgcctgtctcctttgcaggctca

SEQ ID NO: 6474239 - DNA, 14 bp, Homo sapiens
tgcctgtctgcccc

SEQ ID NO: 6474240 - DNA, 16 bp, Homo sapiens
tgcctgtctggctcag

SEQ ID NO: 6474241 - DNA, 17 bp, Homo sapiens
tgcctgtctggctcagg

SEQ ID NO: 6474242 - DNA, 15 bp, Homo sapiens
tgcctgtctgtccaa

SEQ ID NO: 6474243 - DNA, 18 bp, Homo sapiens
tgcctgtctgtctctcca

SEQ ID NO: 6474244 - DNA, 21 bp, Homo sapiens
tgcctgtctgtctctccatct

SEQ ID NO: 6474245 - DNA, 18 bp, Homo sapiens
tgcctgtctgttacactg

SEQ ID NO: 6474246 - DNA, 17 bp, Homo sapiens
tgcctgtgaactgaact

SEQ ID NO: 6474247 - DNA, 18 bp, Homo sapiens
tgcctgtgaactgaactc

SEQ ID NO: 6474248 - DNA, 20 bp, Homo sapiens
tgcctgtgaagaaccctgca

SEQ ID NO: 6474249 - DNA, 16 bp, Homo sapiens
tgcctgtgaagcagtc

SEQ ID NO: 6474250 - DNA, 17 bp, Homo sapiens
tgcctgtgaccggggtc

SEQ ID NO: 6474251 - DNA, 23 bp, Homo sapiens
tgcctgtgaccggggtcctgagg

SEQ ID NO: 6474252 - DNA, 17 bp, Homo sapiens
tgcctgtgactgtaaag

SEQ ID NO: 6474253 - DNA, 11 bp, Homo sapiens
tgcctgtgcca

SEQ ID NO: 6474254 - DNA, 14 bp, Homo sapiens
tgcctgtgccaata

SEQ ID NO: 6474255 - DNA, 13 bp, Homo sapiens
tgcctgtgcctgc

SEQ ID NO: 6474256 - DNA, 23 bp, Homo sapiens
tgcctgtgcctgccatgggccag

SEQ ID NO: 6474257 - DNA, 15 bp, Homo sapiens
tgcctgtgctcctgc

SEQ ID NO: 6474258 - DNA, 17 bp, Homo sapiens
tgcctgtgctcctgccc

SEQ ID NO: 6474259 - DNA, 13 bp, Homo sapiens
tgcctgtgcttct

SEQ ID NO: 6474260 - DNA, 14 bp, Homo sapiens
tgcctgtggaactg

SEQ ID NO: 6474261 - DNA, 21 bp, Homo sapiens
tgcctgtggaatctggagtga

SEQ ID NO: 6474262 - DNA, 23 bp, Homo sapiens
tgcctgtggagacagccctgcct

SEQ ID NO: 6474263 - DNA, 18 bp, Homo sapiens
tgcctgtggcagaaaaga

SEQ ID NO: 6474264 - DNA, 13 bp, Homo sapiens
tgcctgtggcccc

SEQ ID NO: 6474265 - DNA, 23 bp, Homo sapiens
tgcctgtggtgaagtgtggctgg

SEQ ID NO: 6474266 - DNA, 14 bp, Homo sapiens
tgcctgtggtgagg

SEQ ID NO: 6474267 - DNA, 15 bp, Homo sapiens
tgcctgtgtatggaa

SEQ ID NO: 6474268 - DNA, 13 bp, Homo sapiens
tgcctgtgtcctg

SEQ ID NO: 6474269 - DNA, 23 bp, Homo sapiens
tgcctgtgtgagcatctctgtgt

SEQ ID NO: 6474270 - DNA, 12 bp, Homo sapiens
tgcctgtgtgcg

SEQ ID NO: 6474271 - DNA, 22 bp, Homo sapiens
tgcctgtgtttcatgttctgtg

SEQ ID NO: 6474272 - DNA, 15 bp, Homo sapiens
tgcctgttaatttat

SEQ ID NO: 6474273 - DNA, 21 bp, Homo sapiens
tgcctgttaatttataatgta

SEQ ID NO: 6474274 - DNA, 18 bp, Homo sapiens
tgcctgttataactctgc

SEQ ID NO: 6474275 - DNA, 20 bp, Homo sapiens
tgcctgttcagctccagctc

SEQ ID NO: 6474276 - DNA, 18 bp, Homo sapiens
tgcctgttcagttacaga

SEQ ID NO: 6474277 - DNA, 20 bp, Homo sapiens
tgcctgttcagttacagaaa

SEQ ID NO: 6474278 - DNA, 22 bp, Homo sapiens
tgcctgttcagttacagaaagt

SEQ ID NO: 6474279 - DNA, 14 bp, Homo sapiens
tgcctgttcctccc

SEQ ID NO: 6474280 - DNA, 14 bp, Homo sapiens
tgcctgttctccag

SEQ ID NO: 6474281 - DNA, 14 bp, Homo sapiens
tgcctgttctgctt

SEQ ID NO: 6474282 - DNA, 19 bp, Homo sapiens
tgcctgttgatctatggga

SEQ ID NO: 6474283 - DNA, 14 bp, Homo sapiens
tgcctgttgcaggc

SEQ ID NO: 6474284 - DNA, 15 bp, Homo sapiens
tgcctgttggcaggc

SEQ ID NO: 6474285 - DNA, 22 bp, Homo sapiens
tgcctgttggcaggcccactcc

SEQ ID NO: 6474286 - DNA, 16 bp, Homo sapiens
tgcctgttggctgctg

SEQ ID NO: 6474287 - DNA, 14 bp, Homo sapiens
tgcctgtttcccag

SEQ ID NO: 6474288 - DNA, 16 bp, Homo sapiens
tgcctgtttctgattt

SEQ ID NO: 6474289 - DNA, 16 bp, Homo sapiens
tgcctgtttcttctct

SEQ ID NO: 6474290 - DNA, 16 bp, Homo sapiens
tgcctgtttggggagg

SEQ ID NO: 6474291 - DNA, 13 bp, Homo sapiens
tgcctgttttgat

SEQ ID NO: 6474292 - DNA, 22 bp, Homo sapiens
tgccttaaaaccaaagagggct

SEQ ID NO: 6474293 - DNA, 20 bp, Homo sapiens
tgccttaaaaggagagaaga

SEQ ID NO: 6474294 - DNA, 15 bp, Homo sapiens
tgccttaaaatggaa

SEQ ID NO: 6474295 - DNA, 19 bp, Homo sapiens
tgccttaaacactcacctt

SEQ ID NO: 6474296 - DNA, 22 bp, Homo sapiens
tgccttaaacactcaccttcta

SEQ ID NO: 6474297 - DNA, 17 bp, Homo sapiens
tgccttaaacctacctc

SEQ ID NO: 6474298 - DNA, 16 bp, Homo sapiens
tgccttaaacctgaag

SEQ ID NO: 6474299 - DNA, 19 bp, Homo sapiens
tgccttaaacctgaagatg

SEQ ID NO: 6474300 - DNA, 21 bp, Homo sapiens
tgccttaaacctgaagatgtc

SEQ ID NO: 6474301 - DNA, 17 bp, Homo sapiens
tgccttaaagtcagtaa

SEQ ID NO: 6474302 - DNA, 16 bp, Homo sapiens
tgccttaacctgggac

SEQ ID NO: 6474303 - DNA, 13 bp, Homo sapiens
tgccttaagcaga

SEQ ID NO: 6474304 - DNA, 20 bp, Homo sapiens
tgccttaagcagaacaaatg

SEQ ID NO: 6474305 - DNA, 15 bp, Homo sapiens
tgccttaagtgagga

SEQ ID NO: 6474306 - DNA, 14 bp, Homo sapiens
tgccttaagtttta

SEQ ID NO: 6474307 - DNA, 18 bp, Homo sapiens
tgccttaagttttagtct

SEQ ID NO: 6474308 - DNA, 13 bp, Homo sapiens
tgccttaataaat

SEQ ID NO: 6474309 - DNA, 15 bp, Homo sapiens
tgccttaataaatat

SEQ ID NO: 6474310 - DNA, 18 bp, Homo sapiens
tgccttaataaatatgta

SEQ ID NO: 6474311 - DNA, 21 bp, Homo sapiens
tgccttaattcttacctcatt

SEQ ID NO: 6474312 - DNA, 12 bp, Homo sapiens
tgccttaattta

SEQ ID NO: 6474313 - DNA, 23 bp, Homo sapiens
tgccttaatttagaaactgaaaa

SEQ ID NO: 6474314 - DNA, 18 bp, Homo sapiens
tgccttaatttttgaaaa

SEQ ID NO: 6474315 - DNA, 14 bp, Homo sapiens
tgccttacacaaag

SEQ ID NO: 6474316 - DNA, 20 bp, Homo sapiens
tgccttacagacagaatata

SEQ ID NO: 6474317 - DNA, 18 bp, Homo sapiens
tgccttacatcttttcta

SEQ ID NO: 6474318 - DNA, 17 bp, Homo sapiens
tgccttaccgagagcca

SEQ ID NO: 6474319 - DNA, 19 bp, Homo sapiens
tgccttaccgagagccaaa

SEQ ID NO: 6474320 - DNA, 18 bp, Homo sapiens
tgccttacctcctgccca

SEQ ID NO: 6474321 - DNA, 19 bp, Homo sapiens
tgccttacctcctgcccag

SEQ ID NO: 6474322 - DNA, 23 bp, Homo sapiens
tgccttacctcctgcccaggaga

SEQ ID NO: 6474323 - DNA, 21 bp, Homo sapiens
tgccttactaaatatgggaat

SEQ ID NO: 6474324 - DNA, 23 bp, Homo sapiens
tgccttactattgtattatagta

SEQ ID NO: 6474325 - DNA, 18 bp, Homo sapiens
tgccttactcttcttgaa

SEQ ID NO: 6474326 - DNA, 17 bp, Homo sapiens
tgccttactttgtatga

SEQ ID NO: 6474327 - DNA, 18 bp, Homo sapiens
tgccttactttgtatgat

SEQ ID NO: 6474328 - DNA, 22 bp, Homo sapiens
tgccttagaaatgtaaactgcc

SEQ ID NO: 6474329 - DNA, 18 bp, Homo sapiens
tgccttagaggagcccac

SEQ ID NO: 6474330 - DNA, 14 bp, Homo sapiens
tgccttagcacttc

SEQ ID NO: 6474331 - DNA, 15 bp, Homo sapiens
tgccttagcaggggt

SEQ ID NO: 6474332 - DNA, 19 bp, Homo sapiens
tgccttagcatgtgactcc

SEQ ID NO: 6474333 - DNA, 14 bp, Homo sapiens
tgccttagcctctt

SEQ ID NO: 6474334 - DNA, 17 bp, Homo sapiens
tgccttagcctcttgga

SEQ ID NO: 6474335 - DNA, 16 bp, Homo sapiens
tgccttagcttcagga

SEQ ID NO: 6474336 - DNA, 17 bp, Homo sapiens
tgccttaggaatactgt

SEQ ID NO: 6474337 - DNA, 17 bp, Homo sapiens
tgccttaggcctacctg

SEQ ID NO: 6474338 - DNA, 18 bp, Homo sapiens
tgccttaggctgctggga

SEQ ID NO: 6474339 - DNA, 22 bp, Homo sapiens
tgccttagggtttgcagagtgg

SEQ ID NO: 6474340 - DNA, 18 bp, Homo sapiens
tgccttatcaaataatat

SEQ ID NO: 6474341 - DNA, 14 bp, Homo sapiens
tgccttatctcatt

SEQ ID NO: 6474342 - DNA, 15 bp, Homo sapiens
tgccttatctcattt

SEQ ID NO: 6474343 - DNA, 18 bp, Homo sapiens
tgccttatctcttctcac

SEQ ID NO: 6474344 - DNA, 17 bp, Homo sapiens
tctggaaatccagctgg

SEQ ID NO: 6474345 - DNA, 19 bp, Homo sapiens
tctggaaatccagctggtt

SEQ ID NO: 6474346 - DNA, 10 bp, Homo sapiens
tctggaaatt

SEQ ID NO: 6474347 - DNA, 21 bp, Homo sapiens
tctggaaattcttccctgggg

SEQ ID NO: 6474348 - DNA, 12 bp, Homo sapiens
tctggaaatttt

SEQ ID NO: 6474349 - DNA, 14 bp, Homo sapiens
tctggaaattttgt

SEQ ID NO: 6474350 - DNA, 22 bp, Homo sapiens
tctggaacaacttgtagcagct

SEQ ID NO: 6474351 - DNA, 14 bp, Homo sapiens
tctggaacccagac

SEQ ID NO: 6474352 - DNA, 19 bp, Homo sapiens
tctggaaccccccaggccc

SEQ ID NO: 6474353 - DNA, 23 bp, Homo sapiens
tctggaactgctgctgacccctg

SEQ ID NO: 6474354 - DNA, 14 bp, Homo sapiens
tctggaagaaaaaa

SEQ ID NO: 6474355 - DNA, 20 bp, Homo sapiens
tctggaagaaagccctgtgc

SEQ ID NO: 6474356 - DNA, 14 bp, Homo sapiens
tctggaagaagagg

SEQ ID NO: 6474357 - DNA, 16 bp, Homo sapiens
tctggaagaagaggag

SEQ ID NO: 6474358 - DNA, 18 bp, Homo sapiens
tctggaagaagaggagga

SEQ ID NO: 6474359 - DNA, 20 bp, Homo sapiens
tctggaagactgctcccggc

SEQ ID NO: 6474360 - DNA, 18 bp, Homo sapiens
tctggaagattcttactg

SEQ ID NO: 6474361 - DNA, 19 bp, Homo sapiens
tctggaagattttcattga

SEQ ID NO: 6474362 - DNA, 17 bp, Homo sapiens
tctggaagcaaatggca

SEQ ID NO: 6474363 - DNA, 17 bp, Homo sapiens
tctggaagcccctgggc

SEQ ID NO: 6474364 - DNA, 16 bp, Homo sapiens
tctggaagcctgctga

SEQ ID NO: 6474365 - DNA, 17 bp, Homo sapiens
tctggaagcctgctgat

SEQ ID NO: 6474366 - DNA, 12 bp, Homo sapiens
tctggaagctga

SEQ ID NO: 6474367 - DNA, 17 bp, Homo sapiens
tctggaagctgagcagg

SEQ ID NO: 6474368 - DNA, 19 bp, Homo sapiens
tctggaaggctggctgagt

SEQ ID NO: 6474369 - DNA, 14 bp, Homo sapiens
tctggaaggggcag

SEQ ID NO: 6474370 - DNA, 15 bp, Homo sapiens
tctggaaggggcagc

SEQ ID NO: 6474371 - DNA, 16 bp, Homo sapiens
tctggaaggggcagcc

SEQ ID NO: 6474372 - DNA, 20 bp, Homo sapiens
tctggaaggggcagccctga

SEQ ID NO: 6474373 - DNA, 23 bp, Homo sapiens
tctggaagtggagttgactctgg

SEQ ID NO: 6474374 - DNA, 18 bp, Homo sapiens
tctggaagtttctggtgc

SEQ ID NO: 6474375 - DNA, 19 bp, Homo sapiens
tctggaataaagttgcaga

SEQ ID NO: 6474376 - DNA, 15 bp, Homo sapiens
tctggaatactgaaa

SEQ ID NO: 6474377 - DNA, 16 bp, Homo sapiens
tctggaatactgaaaa

SEQ ID NO: 6474378 - DNA, 13 bp, Homo sapiens
tctggaatattgt

SEQ ID NO: 6474379 - DNA, 15 bp, Homo sapiens
tctggaatattgtga

SEQ ID NO: 6474380 - DNA, 15 bp, Homo sapiens
tctggaatctgaggc

SEQ ID NO: 6474381 - DNA, 19 bp, Homo sapiens
tctggaatctgaggcatcc

SEQ ID NO: 6474382 - DNA, 16 bp, Homo sapiens
tctggaatcttcccca

SEQ ID NO: 6474383 - DNA, 17 bp, Homo sapiens
tctggaatcttccccaa

SEQ ID NO: 6474384 - DNA, 15 bp, Homo sapiens
tctggaatgcttctg

SEQ ID NO: 6474385 - DNA, 18 bp, Homo sapiens
tctggaatgcttgctgta

SEQ ID NO: 6474386 - DNA, 22 bp, Homo sapiens
tctggaatgtaatcaatgtttc

SEQ ID NO: 6474387 - DNA, 14 bp, Homo sapiens
tctggaatgtgaag

SEQ ID NO: 6474388 - DNA, 21 bp, Homo sapiens
tctggaatgtttttccctccc

SEQ ID NO: 6474389 - DNA, 19 bp, Homo sapiens
tctggaatttaaggcccaa

SEQ ID NO: 6474390 - DNA, 21 bp, Homo sapiens
tctggaatttacctccccttt

SEQ ID NO: 6474391 - DNA, 16 bp, Homo sapiens
tctggacaaatgtata

SEQ ID NO: 6474392 - DNA, 15 bp, Homo sapiens
tctggacaagaagag

SEQ ID NO: 6474393 - DNA, 13 bp, Homo sapiens
tctggacagcaga

SEQ ID NO: 6474394 - DNA, 18 bp, Homo sapiens
tctggacagcagaagcct

SEQ ID NO: 6474395 - DNA, 17 bp, Homo sapiens
tctggacagcagcagga

SEQ ID NO: 6474396 - DNA, 13 bp, Homo sapiens
tctggacagcttg

SEQ ID NO: 6474397 - DNA, 19 bp, Homo sapiens
tctggacaggatgtgtttg

SEQ ID NO: 6474398 - DNA, 21 bp, Homo sapiens
tctggacaggcatgttctctg

SEQ ID NO: 6474399 - DNA, 23 bp, Homo sapiens
tctggacagtacctgattgtatt

SEQ ID NO: 6474400 - DNA, 18 bp, Homo sapiens
tctggacagtcagctctt

SEQ ID NO: 6474401 - DNA, 18 bp, Homo sapiens
tctggacattctctttga

SEQ ID NO: 6474402 - DNA, 22 bp, Homo sapiens
tctggaccatacgcggaggagt

SEQ ID NO: 6474403 - DNA, 14 bp, Homo sapiens
tctggaccatgctg

SEQ ID NO: 6474404 - DNA, 16 bp, Homo sapiens
tctggaccccaggcca

SEQ ID NO: 6474405 - DNA, 18 bp, Homo sapiens
tctggaccccatctgtga

SEQ ID NO: 6474406 - DNA, 20 bp, Homo sapiens
tctggaccccatctgtgaat

SEQ ID NO: 6474407 - DNA, 17 bp, Homo sapiens
tctggacccctgggcct

SEQ ID NO: 6474408 - DNA, 18 bp, Homo sapiens
tctggacccttctgaagc

SEQ ID NO: 6474409 - DNA, 17 bp, Homo sapiens
tctggacccttggcctc

SEQ ID NO: 6474410 - DNA, 14 bp, Homo sapiens
tctggacctcagga

SEQ ID NO: 6474411 - DNA, 20 bp, Homo sapiens
tctggacctcaggagggcag

SEQ ID NO: 6474412 - DNA, 20 bp, Homo sapiens
tctggacctccccctcttgg

SEQ ID NO: 6474413 - DNA, 16 bp, Homo sapiens
tctggacctctcttgt

SEQ ID NO: 6474414 - DNA, 12 bp, Homo sapiens
tctggacctgcc

SEQ ID NO: 6474415 - DNA, 17 bp, Homo sapiens
tctggacggcaggctca

SEQ ID NO: 6474416 - DNA, 19 bp, Homo sapiens
tctggacggcaggctcact

SEQ ID NO: 6474417 - DNA, 22 bp, Homo sapiens
tctggacggcaggctcactgcc

SEQ ID NO: 6474418 - DNA, 16 bp, Homo sapiens
tctggacgtgaaatac

SEQ ID NO: 6474419 - DNA, 14 bp, Homo sapiens
tctggactaaaact

SEQ ID NO: 6474420 - DNA, 18 bp, Homo sapiens
tctggactagaaaatctg

SEQ ID NO: 6474421 - DNA, 17 bp, Homo sapiens
tctggactatattggga

SEQ ID NO: 6474422 - DNA, 21 bp, Homo sapiens
tctggactcccactctttgaa

SEQ ID NO: 6474423 - DNA, 22 bp, Homo sapiens
tctggactcccactctttgaat

SEQ ID NO: 6474424 - DNA, 16 bp, Homo sapiens
tctggactctgcccca

SEQ ID NO: 6474425 - DNA, 17 bp, Homo sapiens
tctggactctgccccaa

SEQ ID NO: 6474426 - DNA, 13 bp, Homo sapiens
tctggactgaagc

SEQ ID NO: 6474427 - DNA, 19 bp, Homo sapiens
tctggactggaaagcacaa

SEQ ID NO: 6474428 - DNA, 23 bp, Homo sapiens
tctggactggaaagcacaagact

SEQ ID NO: 6474429 - DNA, 17 bp, Homo sapiens
tctggactgttctgtag

SEQ ID NO: 6474430 - DNA, 13 bp, Homo sapiens
tctggagaaaaag

SEQ ID NO: 6474431 - DNA, 21 bp, Homo sapiens
tctggagaaagggccctgggc

SEQ ID NO: 6474432 - DNA, 16 bp, Homo sapiens
tctggagaagcagtga

SEQ ID NO: 6474433 - DNA, 19 bp, Homo sapiens
tctggagaagctcccagga

SEQ ID NO: 6474434 - DNA, 15 bp, Homo sapiens
tctggagaagttttt

SEQ ID NO: 6474435 - DNA, 16 bp, Homo sapiens
tctggagaataattct

SEQ ID NO: 6474436 - DNA, 20 bp, Homo sapiens
tctggagacagaaccagcag

SEQ ID NO: 6474437 - DNA, 22 bp, Homo sapiens
tctggagacagccccagagcag

SEQ ID NO: 6474438 - DNA, 24 bp, Homo sapiens
tctggagacagccccagagcaggg

SEQ ID NO: 6474439 - DNA, 16 bp, Homo sapiens
tctggagaccaccagg

SEQ ID NO: 6474440 - DNA, 17 bp, Homo sapiens
tctggagaccaggactc

SEQ ID NO: 6474441 - DNA, 20 bp, Homo sapiens
tctggagaccaggactctgc

SEQ ID NO: 6474442 - DNA, 20 bp, Homo sapiens
tctggagaccagggagcctt

SEQ ID NO: 6474443 - DNA, 15 bp, Homo sapiens
tctggagagaaacaa

SEQ ID NO: 6474444 - DNA, 18 bp, Homo sapiens
tctggagagcctgcaccc

SEQ ID NO: 6474445 - DNA, 14 bp, Homo sapiens
tctggagagctaga

SEQ ID NO: 6474446 - DNA, 21 bp, Homo sapiens
tctggagaggaagccagtgga

SEQ ID NO: 6474447 - DNA, 15 bp, Homo sapiens
tctggagcatttctc

SEQ ID NO: 6474448 - DNA, 13 bp, Homo sapiens
tctggagccacct

SEQ ID NO: 6474449 - DNA, 15 bp, Homo sapiens
tctggagccacctgt

SEQ ID NO: 6474450 - DNA, 20 bp, Homo sapiens
tctggagccacctgtcccac

SEQ ID NO: 6474451 - DNA, 14 bp, Homo sapiens
tctggagccagccg

SEQ ID NO: 6474452 - DNA, 23 bp, Homo sapiens
tctggagcccactgtacttgctc

SEQ ID NO: 6474453 - DNA, 16 bp, Homo sapiens
tctggagcccctatcc

SEQ ID NO: 6474454 - DNA, 17 bp, Homo sapiens
tctggagcccctcctcc

SEQ ID NO: 6474455 - DNA, 22 bp, Homo sapiens
tctggagcccgcctgcgccccc

SEQ ID NO: 6474456 - DNA, 14 bp, Homo sapiens
tctggagcggctgc

SEQ ID NO: 6474457 - DNA, 18 bp, Homo sapiens
tctggagctgggagacaa

SEQ ID NO: 6474458 - DNA, 20 bp, Homo sapiens
tctggagcttaattttctgt

SEQ ID NO: 6474459 - DNA, 16 bp, Homo sapiens
tctggaggaagttctc

SEQ ID NO: 6474460 - DNA, 23 bp, Homo sapiens
tctggaggccgaggaccaccagc

SEQ ID NO: 6474461 - DNA, 14 bp, Homo sapiens
tctggaggcctctg

SEQ ID NO: 6474462 - DNA, 15 bp, Homo sapiens
tctggaggcctctgg

SEQ ID NO: 6474463 - DNA, 19 bp, Homo sapiens
tctggaggccttccagctg

SEQ ID NO: 6474464 - DNA, 20 bp, Homo sapiens
tctggaggccttccagctgc

SEQ ID NO: 6474465 - DNA, 23 bp, Homo sapiens
tctggaggccttccagctgctgt

SEQ ID NO: 6474466 - DNA, 17 bp, Homo sapiens
tctggaggctgcagagc

SEQ ID NO: 6474467 - DNA, 13 bp, Homo sapiens
tctggagggctgg

SEQ ID NO: 6474468 - DNA, 18 bp, Homo sapiens
tctggaggggagagcttt

SEQ ID NO: 6474469 - DNA, 14 bp, Homo sapiens
tctggaggggaggg

SEQ ID NO: 6474470 - DNA, 21 bp, Homo sapiens
tctggaggggagggggatccg

SEQ ID NO: 6474471 - DNA, 17 bp, Homo sapiens
tctggaggggcccctgc

SEQ ID NO: 6474472 - DNA, 22 bp, Homo sapiens
tctggaggtcccagacatgctg

SEQ ID NO: 6474473 - DNA, 17 bp, Homo sapiens
tctggaggttgataact

SEQ ID NO: 6474474 - DNA, 20 bp, Homo sapiens
tctggaggttgataactttg

SEQ ID NO: 6474475 - DNA, 15 bp, Homo sapiens
tctggagtcacatca

SEQ ID NO: 6474476 - DNA, 22 bp, Homo sapiens
tctggagtcacatcagtgagga

SEQ ID NO: 6474477 - DNA, 17 bp, Homo sapiens
tctggagtcccacccgg

SEQ ID NO: 6474478 - DNA, 13 bp, Homo sapiens
tctggagtctgaa

SEQ ID NO: 6474479 - DNA, 21 bp, Homo sapiens
tctggagtctgaaggagagga

SEQ ID NO: 6474480 - DNA, 23 bp, Homo sapiens
tctggagtctgaaggagaggagt

SEQ ID NO: 6474481 - DNA, 20 bp, Homo sapiens
tctggagtgatggtgtcctt

SEQ ID NO: 6474482 - DNA, 18 bp, Homo sapiens
tctggagtgattctagag

SEQ ID NO: 6474483 - DNA, 20 bp, Homo sapiens
tctggagtgcccccagccca

SEQ ID NO: 6474484 - DNA, 14 bp, Homo sapiens
tctggagtggccac

SEQ ID NO: 6474485 - DNA, 15 bp, Homo sapiens
tctggagtggccact

SEQ ID NO: 6474486 - DNA, 14 bp, Homo sapiens
tctggagtgggcag

SEQ ID NO: 6474487 - DNA, 15 bp, Homo sapiens
tctggagtgtgtggg

SEQ ID NO: 6474488 - DNA, 16 bp, Homo sapiens
tctggagttgatctgg

SEQ ID NO: 6474489 - DNA, 17 bp, Homo sapiens
tctggagttgatctgga

SEQ ID NO: 6474490 - DNA, 22 bp, Homo sapiens
tctggataaaccaccctctggg

SEQ ID NO: 6474491 - DNA, 23 bp, Homo sapiens
tctggataaaccaccctctgggg

SEQ ID NO: 6474492 - DNA, 21 bp, Homo sapiens
tctggataacttccacagggt

SEQ ID NO: 6474493 - DNA, 15 bp, Homo sapiens
tctggatatttgcac

SEQ ID NO: 6474494 - DNA, 20 bp, Homo sapiens
tctggatatttgcacttatg

SEQ ID NO: 6474495 - DNA, 13 bp, Homo sapiens
tctggatcagtaa

SEQ ID NO: 6474496 - DNA, 22 bp, Homo sapiens
tctggatccatggggggagaag

SEQ ID NO: 6474497 - DNA, 24 bp, Homo sapiens
tctggatcccgaggtatggcagag

SEQ ID NO: 6474498 - DNA, 24 bp, Homo sapiens
tctggatcctgctgtggcctcact

SEQ ID NO: 6474499 - DNA, 15 bp, Homo sapiens
tctggatccttccca

SEQ ID NO: 6474500 - DNA, 16 bp, Homo sapiens
tctggatccttcccaa

SEQ ID NO: 6474501 - DNA, 17 bp, Homo sapiens
tctggatccttcccaag

SEQ ID NO: 6474502 - DNA, 22 bp, Homo sapiens
tctggatctatctgtattttca

SEQ ID NO: 6474503 - DNA, 15 bp, Homo sapiens
tctggatctcctgct

SEQ ID NO: 6474504 - DNA, 16 bp, Homo sapiens
tctggatctcctgctg

SEQ ID NO: 6474505 - DNA, 22 bp, Homo sapiens
tctggatgcacagatgccatgg

SEQ ID NO: 6474506 - DNA, 16 bp, Homo sapiens
tctggatgcatttcca

SEQ ID NO: 6474507 - DNA, 20 bp, Homo sapiens
tctggatggccgggctgctg

SEQ ID NO: 6474508 - DNA, 18 bp, Homo sapiens
tctggatggtgtgccttc

SEQ ID NO: 6474509 - DNA, 22 bp, Homo sapiens
tctggatggtgtgccttccaga

SEQ ID NO: 6474510 - DNA, 12 bp, Homo sapiens
tctggatgtaaa

SEQ ID NO: 6474511 - DNA, 16 bp, Homo sapiens
tctggatgtctggctc

SEQ ID NO: 6474512 - DNA, 17 bp, Homo sapiens
tctggattaggtctctg

SEQ ID NO: 6474513 - DNA, 13 bp, Homo sapiens
tctggattataaa

SEQ ID NO: 6474514 - DNA, 18 bp, Homo sapiens
tctggattcagccttctt

SEQ ID NO: 6474515 - DNA, 15 bp, Homo sapiens
tctggattcatattt

SEQ ID NO: 6474516 - DNA, 16 bp, Homo sapiens
tctggattcatattta

SEQ ID NO: 6474517 - DNA, 14 bp, Homo sapiens
tctggattcccagg

SEQ ID NO: 6474518 - DNA, 15 bp, Homo sapiens
tctggattccctttt

SEQ ID NO: 6474519 - DNA, 22 bp, Homo sapiens
tctggattctgggaggcaagaa

SEQ ID NO: 6474520 - DNA, 15 bp, Homo sapiens
tctggattcttggcc

SEQ ID NO: 6474521 - DNA, 15 bp, Homo sapiens
tctggatttggtgct

SEQ ID NO: 6474522 - DNA, 17 bp, Homo sapiens
tgccttatctgttcctt

SEQ ID NO: 6474523 - DNA, 21 bp, Homo sapiens
tgccttatgcaaggggaaacc

SEQ ID NO: 6474524 - DNA, 16 bp, Homo sapiens
tgccttatggaacact

SEQ ID NO: 6474525 - DNA, 20 bp, Homo sapiens
tgccttatggaacactctga

SEQ ID NO: 6474526 - DNA, 16 bp, Homo sapiens
tgccttatgggctgaa

SEQ ID NO: 6474527 - DNA, 17 bp, Homo sapiens
tgccttatgtaattatt

SEQ ID NO: 6474528 - DNA, 17 bp, Homo sapiens
tgccttatgttgaaaaa

SEQ ID NO: 6474529 - DNA, 23 bp, Homo sapiens
tgccttattagagtgtctttcca

SEQ ID NO: 6474530 - DNA, 18 bp, Homo sapiens
tgccttattcagggaagg

SEQ ID NO: 6474531 - DNA, 12 bp, Homo sapiens
tgccttatttgt

SEQ ID NO: 6474532 - DNA, 18 bp, Homo sapiens
tgccttatttgtctgtaa

SEQ ID NO: 6474533 - DNA, 23 bp, Homo sapiens
tgccttatttgtctgtaaaaaat

SEQ ID NO: 6474534 - DNA, 16 bp, Homo sapiens
tgccttcaacacagct

SEQ ID NO: 6474535 - DNA, 20 bp, Homo sapiens
tgccttcaacacagcttgtc

SEQ ID NO: 6474536 - DNA, 12 bp, Homo sapiens
tgccttcaagaa

SEQ ID NO: 6474537 - DNA, 15 bp, Homo sapiens
tgccttcaaggactg

SEQ ID NO: 6474538 - DNA, 20 bp, Homo sapiens
tgccttcacatttggggttt

SEQ ID NO: 6474539 - DNA, 17 bp, Homo sapiens
tgccttcaccctgaaca

SEQ ID NO: 6474540 - DNA, 16 bp, Homo sapiens
tgccttcagatgttct

SEQ ID NO: 6474541 - DNA, 13 bp, Homo sapiens
tgccttcagctct

SEQ ID NO: 6474542 - DNA, 17 bp, Homo sapiens
tgccttcagctctacag

SEQ ID NO: 6474543 - DNA, 14 bp, Homo sapiens
tgccttcagctgtt

SEQ ID NO: 6474544 - DNA, 24 bp, Homo sapiens
tgccttcatggaactcagctgtct

SEQ ID NO: 6474545 - DNA, 19 bp, Homo sapiens
tgccttcattacctttttt

SEQ ID NO: 6474546 - DNA, 14 bp, Homo sapiens
tgccttccaccctg

SEQ ID NO: 6474547 - DNA, 16 bp, Homo sapiens
tgccttccaccctgcc

SEQ ID NO: 6474548 - DNA, 20 bp, Homo sapiens
tgccttccaccctgccctgg

SEQ ID NO: 6474549 - DNA, 23 bp, Homo sapiens
tgccttccaccctgccctggcct

SEQ ID NO: 6474550 - DNA, 22 bp, Homo sapiens
tgccttccaggaaatgggcttt

SEQ ID NO: 6474551 - DNA, 17 bp, Homo sapiens
tgccttccaggagcaat

SEQ ID NO: 6474552 - DNA, 23 bp, Homo sapiens
tgccttccaggcgtagggccagg

SEQ ID NO: 6474553 - DNA, 13 bp, Homo sapiens
tgccttccataat

SEQ ID NO: 6474554 - DNA, 13 bp, Homo sapiens
tgccttcccctgt

SEQ ID NO: 6474555 - DNA, 22 bp, Homo sapiens
tgccttccccttgaacctcatt

SEQ ID NO: 6474556 - DNA, 14 bp, Homo sapiens
tgccttcccttctc

SEQ ID NO: 6474557 - DNA, 21 bp, Homo sapiens
tgccttccgacaccactggga

SEQ ID NO: 6474558 - DNA, 20 bp, Homo sapiens
tgccttcctaagcctgtggc

SEQ ID NO: 6474559 - DNA, 17 bp, Homo sapiens
tgccttcctcatcccct

SEQ ID NO: 6474560 - DNA, 14 bp, Homo sapiens
tgccttcctcctgg

SEQ ID NO: 6474561 - DNA, 20 bp, Homo sapiens
tgccttcctcctgggccctc

SEQ ID NO: 6474562 - DNA, 14 bp, Homo sapiens
tgccttcctcgtgc

SEQ ID NO: 6474563 - DNA, 16 bp, Homo sapiens
tgccttcctcgtgcag

SEQ ID NO: 6474564 - DNA, 14 bp, Homo sapiens
tgccttcctctgag

SEQ ID NO: 6474565 - DNA, 12 bp, Homo sapiens
tgccttcctgag

SEQ ID NO: 6474566 - DNA, 16 bp, Homo sapiens
tgccttccttagcagc

SEQ ID NO: 6474567 - DNA, 22 bp, Homo sapiens
tgccttcctttctccaggacca

SEQ ID NO: 6474568 - DNA, 23 bp, Homo sapiens
tgccttcgcaccttgctgtgtga

SEQ ID NO: 6474569 - DNA, 20 bp, Homo sapiens
tgccttcgcttcttgcctct

SEQ ID NO: 6474570 - DNA, 18 bp, Homo sapiens
tgccttcggtacccacca

SEQ ID NO: 6474571 - DNA, 15 bp, Homo sapiens
tgccttctcaactcc

SEQ ID NO: 6474572 - DNA, 13 bp, Homo sapiens
tgccttctcacca

SEQ ID NO: 6474573 - DNA, 16 bp, Homo sapiens
tgccttctcaccagct

SEQ ID NO: 6474574 - DNA, 17 bp, Homo sapiens
tgccttctcaccagctg

SEQ ID NO: 6474575 - DNA, 20 bp, Homo sapiens
tgccttctcaccagctgcaa

SEQ ID NO: 6474576 - DNA, 17 bp, Homo sapiens
tgccttctcactagctg

SEQ ID NO: 6474577 - DNA, 18 bp, Homo sapiens
tgccttctcccctccacg

SEQ ID NO: 6474578 - DNA, 17 bp, Homo sapiens
tgccttctccctgggaa

SEQ ID NO: 6474579 - DNA, 18 bp, Homo sapiens
tgccttctcctctctggg

SEQ ID NO: 6474580 - DNA, 19 bp, Homo sapiens
tgccttctcctctctgggc

SEQ ID NO: 6474581 - DNA, 21 bp, Homo sapiens
tgccttctcctctctgggcct

SEQ ID NO: 6474582 - DNA, 17 bp, Homo sapiens
tgccttctccttcccca

SEQ ID NO: 6474583 - DNA, 21 bp, Homo sapiens
tgccttctccttccccaggat

SEQ ID NO: 6474584 - DNA, 21 bp, Homo sapiens
tgccttctctcagctcccagg

SEQ ID NO: 6474585 - DNA, 15 bp, Homo sapiens
tgccttctgaaatgt

SEQ ID NO: 6474586 - DNA, 22 bp, Homo sapiens
tgccttctgacggccctgcaat

SEQ ID NO: 6474587 - DNA, 13 bp, Homo sapiens
tgccttctgctga

SEQ ID NO: 6474588 - DNA, 20 bp, Homo sapiens
tgccttctggttatttatgg

SEQ ID NO: 6474589 - DNA, 12 bp, Homo sapiens
tgccttctgtcc

SEQ ID NO: 6474590 - DNA, 14 bp, Homo sapiens
tgccttctgtctct

SEQ ID NO: 6474591 - DNA, 17 bp, Homo sapiens
tgccttctgtctcttgc

SEQ ID NO: 6474592 - DNA, 21 bp, Homo sapiens
tgccttcttattctcactcca

SEQ ID NO: 6474593 - DNA, 16 bp, Homo sapiens
tgccttcttcacccag

SEQ ID NO: 6474594 - DNA, 17 bp, Homo sapiens
tgccttcttcacccagc

SEQ ID NO: 6474595 - DNA, 14 bp, Homo sapiens
tgccttcttcaggg

SEQ ID NO: 6474596 - DNA, 18 bp, Homo sapiens
tgccttcttcagggcctg

SEQ ID NO: 6474597 - DNA, 13 bp, Homo sapiens
tgccttcttccag

SEQ ID NO: 6474598 - DNA, 19 bp, Homo sapiens
tgccttcttccaggatcag

SEQ ID NO: 6474599 - DNA, 21 bp, Homo sapiens
tgccttcttcggggaactcct

SEQ ID NO: 6474600 - DNA, 22 bp, Homo sapiens
tgccttcttcggggaactcctg

SEQ ID NO: 6474601 - DNA, 23 bp, Homo sapiens
tgccttcttcggggaactcctgg

SEQ ID NO: 6474602 - DNA, 22 bp, Homo sapiens
tgccttcttctttttgctgttg

SEQ ID NO: 6474603 - DNA, 13 bp, Homo sapiens
tgccttctttact

SEQ ID NO: 6474604 - DNA, 14 bp, Homo sapiens
tgccttctttgaag

SEQ ID NO: 6474605 - DNA, 16 bp, Homo sapiens
tgccttcttttgatta

SEQ ID NO: 6474606 - DNA, 15 bp, Homo sapiens
tgccttgaaaaatga

SEQ ID NO: 6474607 - DNA, 17 bp, Homo sapiens
tgccttgaaaaatgaca

SEQ ID NO: 6474608 - DNA, 15 bp, Homo sapiens
tgccttgaaatacct

SEQ ID NO: 6474609 - DNA, 14 bp, Homo sapiens
tgccttgaaatcaa

SEQ ID NO: 6474610 - DNA, 21 bp, Homo sapiens
tgccttgaaatttacacagtg

SEQ ID NO: 6474611 - DNA, 23 bp, Homo sapiens
tgccttgaaatttacacagtgag

SEQ ID NO: 6474612 - DNA, 19 bp, Homo sapiens
tgccttgaacctgtgagta

SEQ ID NO: 6474613 - DNA, 15 bp, Homo sapiens
tgccttgaagccact

SEQ ID NO: 6474614 - DNA, 14 bp, Homo sapiens
tgccttgacaaact

SEQ ID NO: 6474615 - DNA, 21 bp, Homo sapiens
tgccttgacaaacttctttca

SEQ ID NO: 6474616 - DNA, 18 bp, Homo sapiens
tgccttgacaacagactg

SEQ ID NO: 6474617 - DNA, 14 bp, Homo sapiens
tgccttgagaatga

SEQ ID NO: 6474618 - DNA, 14 bp, Homo sapiens
tgccttgagacccc

SEQ ID NO: 6474619 - DNA, 18 bp, Homo sapiens
tgccttgagtccccaggg

SEQ ID NO: 6474620 - DNA, 17 bp, Homo sapiens
tgccttgataaatatat

SEQ ID NO: 6474621 - DNA, 18 bp, Homo sapiens
tgccttgataaatatata

SEQ ID NO: 6474622 - DNA, 19 bp, Homo sapiens
tgccttgataaatatatat

SEQ ID NO: 6474623 - DNA, 17 bp, Homo sapiens
tgccttgatgaagcccg

SEQ ID NO: 6474624 - DNA, 22 bp, Homo sapiens
tgccttgatggagaaggaaaag

SEQ ID NO: 6474625 - DNA, 21 bp, Homo sapiens
tgccttgatgttgtgttgtta

SEQ ID NO: 6474626 - DNA, 17 bp, Homo sapiens
tgccttgatgtttctat

SEQ ID NO: 6474627 - DNA, 19 bp, Homo sapiens
tgccttgattttaattcag

SEQ ID NO: 6474628 - DNA, 22 bp, Homo sapiens
tgccttgattttaattcaggtg

SEQ ID NO: 6474629 - DNA, 16 bp, Homo sapiens
tgccttgcactgtggt

SEQ ID NO: 6474630 - DNA, 13 bp, Homo sapiens
tgccttgcagcca

SEQ ID NO: 6474631 - DNA, 21 bp, Homo sapiens
tgccttgcagccacatggccc

SEQ ID NO: 6474632 - DNA, 15 bp, Homo sapiens
tgccttgcatttgta

SEQ ID NO: 6474633 - DNA, 19 bp, Homo sapiens
tgccttgcatttgtacctt

SEQ ID NO: 6474634 - DNA, 13 bp, Homo sapiens
tgccttgccctcc

SEQ ID NO: 6474635 - DNA, 16 bp, Homo sapiens
tgccttgccctcctgg

SEQ ID NO: 6474636 - DNA, 18 bp, Homo sapiens
tgccttgccgctcccctt

SEQ ID NO: 6474637 - DNA, 20 bp, Homo sapiens
tgccttgccgctccccttgg

SEQ ID NO: 6474638 - DNA, 16 bp, Homo sapiens
tgccttgctcctagca

SEQ ID NO: 6474639 - DNA, 21 bp, Homo sapiens
tgccttgctcggcgcccacca

SEQ ID NO: 6474640 - DNA, 17 bp, Homo sapiens
tgccttgctgcacctga

SEQ ID NO: 6474641 - DNA, 20 bp, Homo sapiens
tgccttgctgcacctgaggc

SEQ ID NO: 6474642 - DNA, 22 bp, Homo sapiens
tgccttgctgttggtcatgtgg

SEQ ID NO: 6474643 - DNA, 11 bp, Homo sapiens
tgccttgcttc

SEQ ID NO: 6474644 - DNA, 16 bp, Homo sapiens
tgccttgcttctccca

SEQ ID NO: 6474645 - DNA, 24 bp, Homo sapiens
tgccttgcttctcccatttcctga

SEQ ID NO: 6474646 - DNA, 23 bp, Homo sapiens
tgccttggaaatagaaagaagcc

SEQ ID NO: 6474647 - DNA, 20 bp, Homo sapiens
tgccttggaggaaatgtgct

SEQ ID NO: 6474648 - DNA, 22 bp, Homo sapiens
tgccttggccccccaaagtgct

SEQ ID NO: 6474649 - DNA, 18 bp, Homo sapiens
tgccttggcccctccctc

SEQ ID NO: 6474650 - DNA, 20 bp, Homo sapiens
tgccttgggccttgctgctg

SEQ ID NO: 6474651 - DNA, 21 bp, Homo sapiens
tgccttgggccttgctgctgc

SEQ ID NO: 6474652 - DNA, 22 bp, Homo sapiens
tgccttgggccttgctgctgct

SEQ ID NO: 6474653 - DNA, 15 bp, Homo sapiens
tgccttgggcctttc

SEQ ID NO: 6474654 - DNA, 16 bp, Homo sapiens
tgccttgggcgggcca

SEQ ID NO: 6474655 - DNA, 24 bp, Homo sapiens
tgccttgggcgggccatttcacat

SEQ ID NO: 6474656 - DNA, 17 bp, Homo sapiens
tgccttgggctgctcct

SEQ ID NO: 6474657 - DNA, 18 bp, Homo sapiens
tgccttggggaaatgtgg

SEQ ID NO: 6474658 - DNA, 13 bp, Homo sapiens
tgccttggtgccg

SEQ ID NO: 6474659 - DNA, 15 bp, Homo sapiens
tgccttggttctggc

SEQ ID NO: 6474660 - DNA, 19 bp, Homo sapiens
tgccttggttctggccacc

SEQ ID NO: 6474661 - DNA, 16 bp, Homo sapiens
tgccttggtttcctga

SEQ ID NO: 6474662 - DNA, 19 bp, Homo sapiens
tgccttgtacttttcattt

SEQ ID NO: 6474663 - DNA, 22 bp, Homo sapiens
tgccttgtagatggagcaagtg

SEQ ID NO: 6474664 - DNA, 13 bp, Homo sapiens
tgccttgtataaa

SEQ ID NO: 6474665 - DNA, 16 bp, Homo sapiens
tgccttgtataatatt

SEQ ID NO: 6474666 - DNA, 19 bp, Homo sapiens
tgccttgtatgcaaatgag

SEQ ID NO: 6474667 - DNA, 15 bp, Homo sapiens
tgccttgtccaggaa

SEQ ID NO: 6474668 - DNA, 19 bp, Homo sapiens
tgccttgtccaggaactgc

SEQ ID NO: 6474669 - DNA, 19 bp, Homo sapiens
tgccttgtgaaggaattat

SEQ ID NO: 6474670 - DNA, 18 bp, Homo sapiens
tgccttgtttaatgttaa

SEQ ID NO: 6474671 - DNA, 20 bp, Homo sapiens
tgccttgtttgagtttttcc

SEQ ID NO: 6474672 - DNA, 18 bp, Homo sapiens
tgcctttaaagtatgaat

SEQ ID NO: 6474673 - DNA, 12 bp, Homo sapiens
tgcctttaacag

SEQ ID NO: 6474674 - DNA, 22 bp, Homo sapiens
tgcctttaacagaaactttcaa

SEQ ID NO: 6474675 - DNA, 18 bp, Homo sapiens
tgcctttaagccaaagaa

SEQ ID NO: 6474676 - DNA, 17 bp, Homo sapiens
tgcctttaaggagaaga

SEQ ID NO: 6474677 - DNA, 11 bp, Homo sapiens
tgcctttagaa

SEQ ID NO: 6474678 - DNA, 18 bp, Homo sapiens
tgcctttagcctggacca

SEQ ID NO: 6474679 - DNA, 18 bp, Homo sapiens
tgcctttagcgtgtaaat

SEQ ID NO: 6474680 - DNA, 14 bp, Homo sapiens
tgcctttaggcagg

SEQ ID NO: 6474681 - DNA, 13 bp, Homo sapiens
tgcctttatatac

SEQ ID NO: 6474682 - DNA, 23 bp, Homo sapiens
tgcctttatatttcacaggctgt

SEQ ID NO: 6474683 - DNA, 21 bp, Homo sapiens
tgcctttatctaaggaaacat

SEQ ID NO: 6474684 - DNA, 22 bp, Homo sapiens
tgcctttatctaaggaaacatt

SEQ ID NO: 6474685 - DNA, 19 bp, Homo sapiens
tgcctttatctctgaggct

SEQ ID NO: 6474686 - DNA, 18 bp, Homo sapiens
tgcctttatttctgtatc

SEQ ID NO: 6474687 - DNA, 16 bp, Homo sapiens
tgcctttatttgctgt

SEQ ID NO: 6474688 - DNA, 17 bp, Homo sapiens
tgcctttcaaatttaga

SEQ ID NO: 6474689 - DNA, 12 bp, Homo sapiens
tgcctttcacag

SEQ ID NO: 6474690 - DNA, 18 bp, Homo sapiens
tgcctttcacagcttctt

SEQ ID NO: 6474691 - DNA, 19 bp, Homo sapiens
tgcctttcagaagtgattt

SEQ ID NO: 6474692 - DNA, 19 bp, Homo sapiens
tgcctttcaggatctattt

SEQ ID NO: 6474693 - DNA, 15 bp, Homo sapiens
tgcctttccacctgc

SEQ ID NO: 6474694 - DNA, 18 bp, Homo sapiens
tgcctttccacctgcttt

SEQ ID NO: 6474695 - DNA, 11 bp, Homo sapiens
tgcctttccag

SEQ ID NO: 6474696 - DNA, 14 bp, Homo sapiens
tgcctttccccatt

SEQ ID NO: 6474697 - DNA, 15 bp, Homo sapiens
tgcctttcccccctc

SEQ ID NO: 6474698 - DNA, 11 bp, Homo sapiens
tgcctttctcg

SEQ ID NO: 6474699 - DNA, 11 bp, Homo sapiens
tgcctttctct

SEQ ID NO: 6474700 - DNA, 18 bp, Homo sapiens
tctggatttggtgctgga

SEQ ID NO: 6474701 - DNA, 14 bp, Homo sapiens
tctggattttcaaa

SEQ ID NO: 6474702 - DNA, 15 bp, Homo sapiens
tctggattttcaaag

SEQ ID NO: 6474703 - DNA, 17 bp, Homo sapiens
tctggattttcccctga

SEQ ID NO: 6474704 - DNA, 16 bp, Homo sapiens
tctggatttttacaaa

SEQ ID NO: 6474705 - DNA, 19 bp, Homo sapiens
tctggcaaaaaggagcctt

SEQ ID NO: 6474706 - DNA, 19 bp, Homo sapiens
tctggcaaacatgtgcaac

SEQ ID NO: 6474707 - DNA, 19 bp, Homo sapiens
tctggcaaacttttctttc

SEQ ID NO: 6474708 - DNA, 18 bp, Homo sapiens
tctggcaaagttatattt

SEQ ID NO: 6474709 - DNA, 21 bp, Homo sapiens
tctggcaaatattttgtcact

SEQ ID NO: 6474710 - DNA, 16 bp, Homo sapiens
tctggcaacatcttta

SEQ ID NO: 6474711 - DNA, 23 bp, Homo sapiens
tctggcaaggactttgtacattt

SEQ ID NO: 6474712 - DNA, 22 bp, Homo sapiens
tctggcaatggatgaactgaaa

SEQ ID NO: 6474713 - DNA, 22 bp, Homo sapiens
tctggcacacagtaggtgctca

SEQ ID NO: 6474714 - DNA, 16 bp, Homo sapiens
tctggcacactccctc

SEQ ID NO: 6474715 - DNA, 13 bp, Homo sapiens
tctggcacagcct

SEQ ID NO: 6474716 - DNA, 14 bp, Homo sapiens
tctggcacagcctg

SEQ ID NO: 6474717 - DNA, 15 bp, Homo sapiens
tctggcacagcctgc

SEQ ID NO: 6474718 - DNA, 16 bp, Homo sapiens
tctggcacagcctgca

SEQ ID NO: 6474719 - DNA, 21 bp, Homo sapiens
tctggcacagtgatgccgggc

SEQ ID NO: 6474720 - DNA, 20 bp, Homo sapiens
tctggcaccactagggtcct

SEQ ID NO: 6474721 - DNA, 16 bp, Homo sapiens
tctggcacgtggccag

SEQ ID NO: 6474722 - DNA, 19 bp, Homo sapiens
tctggcagagcctctgaga

SEQ ID NO: 6474723 - DNA, 12 bp, Homo sapiens
tctggcagatga

SEQ ID NO: 6474724 - DNA, 13 bp, Homo sapiens
tctggcagccaca

SEQ ID NO: 6474725 - DNA, 15 bp, Homo sapiens
tctggcagccacact

SEQ ID NO: 6474726 - DNA, 22 bp, Homo sapiens
tctggcagccacacttctcagg

SEQ ID NO: 6474727 - DNA, 13 bp, Homo sapiens
tctggcagcctca

SEQ ID NO: 6474728 - DNA, 15 bp, Homo sapiens
tctggcagcctcaga

SEQ ID NO: 6474729 - DNA, 19 bp, Homo sapiens
tctggcagcctcagaggcc

SEQ ID NO: 6474730 - DNA, 16 bp, Homo sapiens
tctggcagcctcccat

SEQ ID NO: 6474731 - DNA, 16 bp, Homo sapiens
tctggcagctcagaga

SEQ ID NO: 6474732 - DNA, 21 bp, Homo sapiens
tctggcagctcagagagggtg

SEQ ID NO: 6474733 - DNA, 13 bp, Homo sapiens
tctggcaggacct

SEQ ID NO: 6474734 - DNA, 21 bp, Homo sapiens
tctggcaggctactctgccca

SEQ ID NO: 6474735 - DNA, 23 bp, Homo sapiens
tctggcagggatgggtttgcttt

SEQ ID NO: 6474736 - DNA, 22 bp, Homo sapiens
tctggcaggtcctcccctctct

SEQ ID NO: 6474737 - DNA, 18 bp, Homo sapiens
tctggcattagaattatt

SEQ ID NO: 6474738 - DNA, 19 bp, Homo sapiens
tctggcattctacacctgg

SEQ ID NO: 6474739 - DNA, 23 bp, Homo sapiens
tctggcattctacacctggacca

SEQ ID NO: 6474740 - DNA, 17 bp, Homo sapiens
tctggcattttctgttc

SEQ ID NO: 6474741 - DNA, 18 bp, Homo sapiens
tctggcattttctgttcc

SEQ ID NO: 6474742 - DNA, 14 bp, Homo sapiens
tctggccaaatatg

SEQ ID NO: 6474743 - DNA, 16 bp, Homo sapiens
tctggccaaatatgca

SEQ ID NO: 6474744 - DNA, 14 bp, Homo sapiens
tctggccacactgg

SEQ ID NO: 6474745 - DNA, 15 bp, Homo sapiens
tctggccacactggg

SEQ ID NO: 6474746 - DNA, 22 bp, Homo sapiens
tctggccacatcagccccacag

SEQ ID NO: 6474747 - DNA, 10 bp, Homo sapiens
tctggccacc

SEQ ID NO: 6474748 - DNA, 12 bp, Homo sapiens
tctggccaccct

SEQ ID NO: 6474749 - DNA, 18 bp, Homo sapiens
tctggccaggcactgcct

SEQ ID NO: 6474750 - DNA, 21 bp, Homo sapiens
tctggccagtgtttaaaactt

SEQ ID NO: 6474751 - DNA, 20 bp, Homo sapiens
tctggccattttggaaagca

SEQ ID NO: 6474752 - DNA, 19 bp, Homo sapiens
tctggcccaagctgggctc

SEQ ID NO: 6474753 - DNA, 16 bp, Homo sapiens
tctggcccaccagggt

SEQ ID NO: 6474754 - DNA, 13 bp, Homo sapiens
tctggcccagcca

SEQ ID NO: 6474755 - DNA, 14 bp, Homo sapiens
tctggcccaggctg

SEQ ID NO: 6474756 - DNA, 15 bp, Homo sapiens
tctggcccaggctgg

SEQ ID NO: 6474757 - DNA, 20 bp, Homo sapiens
tctggcccagggtgtttgca

SEQ ID NO: 6474758 - DNA, 14 bp, Homo sapiens
tctggccccagcct

SEQ ID NO: 6474759 - DNA, 13 bp, Homo sapiens
tctggccccaggc

SEQ ID NO: 6474760 - DNA, 13 bp, Homo sapiens
tctggccccgcta

SEQ ID NO: 6474761 - DNA, 19 bp, Homo sapiens
tctggccctcacccctgcc

SEQ ID NO: 6474762 - DNA, 14 bp, Homo sapiens
tctggccctggccc

SEQ ID NO: 6474763 - DNA, 15 bp, Homo sapiens
tctggccctggccct

SEQ ID NO: 6474764 - DNA, 12 bp, Homo sapiens
tctggccctggg

SEQ ID NO: 6474765 - DNA, 13 bp, Homo sapiens
tctggccctgtgt

SEQ ID NO: 6474766 - DNA, 14 bp, Homo sapiens
tctggccctgtgta

SEQ ID NO: 6474767 - DNA, 15 bp, Homo sapiens
tctggccctgttgtg

SEQ ID NO: 6474768 - DNA, 10 bp, Homo sapiens
tctggccctt

SEQ ID NO: 6474769 - DNA, 14 bp, Homo sapiens
tctggcccttacac

SEQ ID NO: 6474770 - DNA, 22 bp, Homo sapiens
tctggcccttacacactcaggc

SEQ ID NO: 6474771 - DNA, 24 bp, Homo sapiens
tctggcccttacacactcaggcct

SEQ ID NO: 6474772 - DNA, 17 bp, Homo sapiens
tctggcccttctttcag

SEQ ID NO: 6474773 - DNA, 19 bp, Homo sapiens
tctggcccttgcctttgtg

SEQ ID NO: 6474774 - DNA, 22 bp, Homo sapiens
tctggcccttgcctttgtggcc

SEQ ID NO: 6474775 - DNA, 13 bp, Homo sapiens
tctggcccttgga

SEQ ID NO: 6474776 - DNA, 19 bp, Homo sapiens
tctggccggtgctgggttc

SEQ ID NO: 6474777 - DNA, 22 bp, Homo sapiens
tctggcctagtggggaggggcc

SEQ ID NO: 6474778 - DNA, 17 bp, Homo sapiens
tctggcctatgaccctg

SEQ ID NO: 6474779 - DNA, 20 bp, Homo sapiens
tctggcctatgaccctgtgc

SEQ ID NO: 6474780 - DNA, 23 bp, Homo sapiens
tctggcctatgaccctgtgcctg

SEQ ID NO: 6474781 - DNA, 16 bp, Homo sapiens
tctggcctcacgtgtc

SEQ ID NO: 6474782 - DNA, 12 bp, Homo sapiens
tctggcctcagc

SEQ ID NO: 6474783 - DNA, 13 bp, Homo sapiens
tctggcctcaggt

SEQ ID NO: 6474784 - DNA, 18 bp, Homo sapiens
tctggcctcaggtgggcc

SEQ ID NO: 6474785 - DNA, 14 bp, Homo sapiens
tctggcctctgctg

SEQ ID NO: 6474786 - DNA, 19 bp, Homo sapiens
tctggcctctgctgaatgc

SEQ ID NO: 6474787 - DNA, 14 bp, Homo sapiens
tctggcctgaggtc

SEQ ID NO: 6474788 - DNA, 15 bp, Homo sapiens
tctgtccccggggca

SEQ ID NO: 6474789 - DNA, 15 bp, Homo sapiens
tctgtccccttctct

SEQ ID NO: 6474790 - DNA, 22 bp, Homo sapiens
tctgtccccttctctcatctct

SEQ ID NO: 6474791 - DNA, 13 bp, Homo sapiens
tctgtcccgggta

SEQ ID NO: 6474792 - DNA, 16 bp, Homo sapiens
tctgtccctaaacata

SEQ ID NO: 6474793 - DNA, 19 bp, Homo sapiens
tctgtccctaaacatagtg

SEQ ID NO: 6474794 - DNA, 23 bp, Homo sapiens
tctgtccctaaacatagtggtat

SEQ ID NO: 6474795 - DNA, 22 bp, Homo sapiens
tctgtccctattatttgcccta

SEQ ID NO: 6474796 - DNA, 21 bp, Homo sapiens
tctgtccctcactgccttcca

SEQ ID NO: 6474797 - DNA, 15 bp, Homo sapiens
tctgtccctccaaag

SEQ ID NO: 6474798 - DNA, 18 bp, Homo sapiens
tctgtccctctccttgcc

SEQ ID NO: 6474799 - DNA, 15 bp, Homo sapiens
tctgtccctctttgc

SEQ ID NO: 6474800 - DNA, 21 bp, Homo sapiens
tctgtccctgaactcccagaa

SEQ ID NO: 6474801 - DNA, 15 bp, Homo sapiens
tctgtccctgtaaaa

SEQ ID NO: 6474802 - DNA, 15 bp, Homo sapiens
tctgtccctgtccct

SEQ ID NO: 6474803 - DNA, 19 bp, Homo sapiens
tctgtccctgtccttccct

SEQ ID NO: 6474804 - DNA, 20 bp, Homo sapiens
tctgtccctgtccttccctg

SEQ ID NO: 6474805 - DNA, 14 bp, Homo sapiens
tctgtcccttgctg

SEQ ID NO: 6474806 - DNA, 17 bp, Homo sapiens
tctgtccgagtgtgcca

SEQ ID NO: 6474807 - DNA, 15 bp, Homo sapiens
tctgtccgtgcccct

SEQ ID NO: 6474808 - DNA, 23 bp, Homo sapiens
tctgtccgtggaaaatttcagtc

SEQ ID NO: 6474809 - DNA, 15 bp, Homo sapiens
tctgtcctacaatct

SEQ ID NO: 6474810 - DNA, 19 bp, Homo sapiens
tctgtcctactctgtgtca

SEQ ID NO: 6474811 - DNA, 22 bp, Homo sapiens
tctgtcctatggagcctctgca

SEQ ID NO: 6474812 - DNA, 15 bp, Homo sapiens
tctgtcctcaccctg

SEQ ID NO: 6474813 - DNA, 19 bp, Homo sapiens
tctgtcctcagccttgcca

SEQ ID NO: 6474814 - DNA, 23 bp, Homo sapiens
tctgtcctcagccttgccagaga

SEQ ID NO: 6474815 - DNA, 15 bp, Homo sapiens
tctgtcctcttggcc

SEQ ID NO: 6474816 - DNA, 16 bp, Homo sapiens
tctgtcctgagaagca

SEQ ID NO: 6474817 - DNA, 18 bp, Homo sapiens
tctgtcctggctgtgcac

SEQ ID NO: 6474818 - DNA, 12 bp, Homo sapiens
tctgtcctggga

SEQ ID NO: 6474819 - DNA, 21 bp, Homo sapiens
tctgtcctgggcatgggtcca

SEQ ID NO: 6474820 - DNA, 11 bp, Homo sapiens
tctgtcctggt

SEQ ID NO: 6474821 - DNA, 13 bp, Homo sapiens
tctgtcctggtca

SEQ ID NO: 6474822 - DNA, 14 bp, Homo sapiens
tctgtcctggtcag

SEQ ID NO: 6474823 - DNA, 14 bp, Homo sapiens
tctgtccttcagat

SEQ ID NO: 6474824 - DNA, 21 bp, Homo sapiens
tctgtccttccaacctgttca

SEQ ID NO: 6474825 - DNA, 16 bp, Homo sapiens
tctgtccttcccccag

SEQ ID NO: 6474826 - DNA, 17 bp, Homo sapiens
tctgtccttcccccagc

SEQ ID NO: 6474827 - DNA, 18 bp, Homo sapiens
tctgtccttcccccagca

SEQ ID NO: 6474828 - DNA, 19 bp, Homo sapiens
tctgtccttttggcactga

SEQ ID NO: 6474829 - DNA, 21 bp, Homo sapiens
tctgtccttttggcactgaga

SEQ ID NO: 6474830 - DNA, 14 bp, Homo sapiens
tctgtcgcccttct

SEQ ID NO: 6474831 - DNA, 20 bp, Homo sapiens
tctgtcgcccttctcccggc

SEQ ID NO: 6474832 - DNA, 16 bp, Homo sapiens
tctgtcgccttagcat

SEQ ID NO: 6474833 - DNA, 22 bp, Homo sapiens
tctgtcgccttagcatgtttgc

SEQ ID NO: 6474834 - DNA, 15 bp, Homo sapiens
tctgtcgtccccaga

SEQ ID NO: 6474835 - DNA, 16 bp, Homo sapiens
tctgtcgtccccagac

SEQ ID NO: 6474836 - DNA, 20 bp, Homo sapiens
tctgtcgtccccagaccagt

SEQ ID NO: 6474837 - DNA, 16 bp, Homo sapiens
tctgtctaaaaaccag

SEQ ID NO: 6474838 - DNA, 22 bp, Homo sapiens
tctgtctacaaatataagattt

SEQ ID NO: 6474839 - DNA, 14 bp, Homo sapiens
tctgtctacatttc

SEQ ID NO: 6474840 - DNA, 21 bp, Homo sapiens
tctgtctactaagtgatgctg

SEQ ID NO: 6474841 - DNA, 15 bp, Homo sapiens
tctgtctactgtggt

SEQ ID NO: 6474842 - DNA, 18 bp, Homo sapiens
tctgtctacttgctcagg

SEQ ID NO: 6474843 - DNA, 15 bp, Homo sapiens
tctgtctactttctc

SEQ ID NO: 6474844 - DNA, 19 bp, Homo sapiens
tctgtctactttctcttgt

SEQ ID NO: 6474845 - DNA, 17 bp, Homo sapiens
tctgtctagaatcctgc

SEQ ID NO: 6474846 - DNA, 21 bp, Homo sapiens
tctgtctagaatcctgcttta

SEQ ID NO: 6474847 - DNA, 18 bp, Homo sapiens
tctgtctaggttaaagct

SEQ ID NO: 6474848 - DNA, 22 bp, Homo sapiens
tctgtctataggacttaattta

SEQ ID NO: 6474849 - DNA, 14 bp, Homo sapiens
tctgtctcaaaaaa

SEQ ID NO: 6474850 - DNA, 23 bp, Homo sapiens
tctgtctcaaaaaaaaaaagaaa

SEQ ID NO: 6474851 - DNA, 21 bp, Homo sapiens
tctgtctcaaaaaataaaaat

SEQ ID NO: 6474852 - DNA, 19 bp, Homo sapiens
tctgtctcagacttttgta

SEQ ID NO: 6474853 - DNA, 15 bp, Homo sapiens
tctgtctcatatgat

SEQ ID NO: 6474854 - DNA, 12 bp, Homo sapiens
tctgtctcatcc

SEQ ID NO: 6474855 - DNA, 13 bp, Homo sapiens
tctgtctcatcca

SEQ ID NO: 6474856 - DNA, 18 bp, Homo sapiens
tctgtctcatcctcctgg

SEQ ID NO: 6474857 - DNA, 19 bp, Homo sapiens
tctgtctcatcctcctgga

SEQ ID NO: 6474858 - DNA, 20 bp, Homo sapiens
tctgtctcatcctcctggaa

SEQ ID NO: 6474859 - DNA, 15 bp, Homo sapiens
tctgtctccagcttc

SEQ ID NO: 6474860 - DNA, 14 bp, Homo sapiens
tctgtctccaggca

SEQ ID NO: 6474861 - DNA, 22 bp, Homo sapiens
tctgtctccctataatgctgga

SEQ ID NO: 6474862 - DNA, 23 bp, Homo sapiens
tctgtctccctcccctctcagaa

SEQ ID NO: 6474863 - DNA, 17 bp, Homo sapiens
tctgtctcccttctctc

SEQ ID NO: 6474864 - DNA, 15 bp, Homo sapiens
tctgtctcctccgtg

SEQ ID NO: 6474865 - DNA, 21 bp, Homo sapiens
tctgtctcgagcgccctgcag

SEQ ID NO: 6474866 - DNA, 19 bp, Homo sapiens
tctgtctcgatgcctgatt

SEQ ID NO: 6474867 - DNA, 20 bp, Homo sapiens
tctgtctcgatgcctgattc

SEQ ID NO: 6474868 - DNA, 17 bp, Homo sapiens
tctgtctcggctctgca

SEQ ID NO: 6474869 - DNA, 13 bp, Homo sapiens
tctgtctctcttg

SEQ ID NO: 6474870 - DNA, 13 bp, Homo sapiens
tctgtctctgctt

SEQ ID NO: 6474871 - DNA, 22 bp, Homo sapiens
tctgtctctggattatattatg

SEQ ID NO: 6474872 - DNA, 14 bp, Homo sapiens
tctgtctctgtgga

SEQ ID NO: 6474873 - DNA, 14 bp, Homo sapiens
tctgtctgagccct

SEQ ID NO: 6474874 - DNA, 16 bp, Homo sapiens
tctgtctgagccctgc

SEQ ID NO: 6474875 - DNA, 22 bp, Homo sapiens
tctgtctgagccctgccctcac

SEQ ID NO: 6474876 - DNA, 14 bp, Homo sapiens
tctgtctgattcta

SEQ ID NO: 6474877 - DNA, 18 bp, Homo sapiens
tctgtctgccaacctaaa

SEQ ID NO: 6474878 - DNA, 13 bp, Homo sapiens
tctgtctgccctt

SEQ ID NO: 6474879 - DNA, 14 bp, Homo sapiens
tctgtctgctctgc

SEQ ID NO: 6474880 - DNA, 15 bp, Homo sapiens
tctgtctgctcttat

SEQ ID NO: 6474881 - DNA, 14 bp, Homo sapiens
tctgtctgctttgg

SEQ ID NO: 6474882 - DNA, 18 bp, Homo sapiens
tctgtctggagtgacaga

SEQ ID NO: 6474883 - DNA, 12 bp, Homo sapiens
tctgtctggatc

SEQ ID NO: 6474884 - DNA, 14 bp, Homo sapiens
tctgtctggccagg

SEQ ID NO: 6474885 - DNA, 13 bp, Homo sapiens
tctgtctggtggc

SEQ ID NO: 6474886 - DNA, 15 bp, Homo sapiens
tctgtctgtcccaaa

SEQ ID NO: 6474887 - DNA, 13 bp, Homo sapiens
tctgtctgtccta

SEQ ID NO: 6474888 - DNA, 22 bp, Homo sapiens
tctgtctgtccttccttccatt

SEQ ID NO: 6474889 - DNA, 16 bp, Homo sapiens
tgctagctctgagcca

SEQ ID NO: 6474890 - DNA, 16 bp, Homo sapiens
tgctagctgtctctct

SEQ ID NO: 6474891 - DNA, 20 bp, Homo sapiens
tgctagcttgacacagtcag

SEQ ID NO: 6474892 - DNA, 12 bp, Homo sapiens
tgctagctttcc

SEQ ID NO: 6474893 - DNA, 16 bp, Homo sapiens
tgctaggaacactcct

SEQ ID NO: 6474894 - DNA, 21 bp, Homo sapiens
tgctaggaacactccttcaca

SEQ ID NO: 6474895 - DNA, 12 bp, Homo sapiens
tgctaggaagag

SEQ ID NO: 6474896 - DNA, 18 bp, Homo sapiens
tgctaggaagaggagtgg

SEQ ID NO: 6474897 - DNA, 14 bp, Homo sapiens
tgctaggagcccca

SEQ ID NO: 6474898 - DNA, 22 bp, Homo sapiens
tgctaggagccccagcttcctg

SEQ ID NO: 6474899 - DNA, 15 bp, Homo sapiens
tgctaggataaacca

SEQ ID NO: 6474900 - DNA, 18 bp, Homo sapiens
tgctaggccagagcccac

SEQ ID NO: 6474901 - DNA, 24 bp, Homo sapiens
tgctaggctaccctcctctagaag

SEQ ID NO: 6474902 - DNA, 22 bp, Homo sapiens
tgctaggggaaggactggccgt

SEQ ID NO: 6474903 - DNA, 19 bp, Homo sapiens
tgctagggtgcctgctctc

SEQ ID NO: 6474904 - DNA, 20 bp, Homo sapiens
tgctagggtgcctgctctcc

SEQ ID NO: 6474905 - DNA, 20 bp, Homo sapiens
tgctagggttaggaggtcct

SEQ ID NO: 6474906 - DNA, 14 bp, Homo sapiens
tgctaggtaaagag

SEQ ID NO: 6474907 - DNA, 19 bp, Homo sapiens
tgctaggtataaaaaataa

SEQ ID NO: 6474908 - DNA, 14 bp, Homo sapiens
tgctaggtgggcca

SEQ ID NO: 6474909 - DNA, 17 bp, Homo sapiens
tgctaggtgggccagcc

SEQ ID NO: 6474910 - DNA, 21 bp, Homo sapiens
tgctaggtgggccagcccctc

SEQ ID NO: 6474911 - DNA, 16 bp, Homo sapiens
tgctaggtgtctggga

SEQ ID NO: 6474912 - DNA, 18 bp, Homo sapiens
tgctaggtgtctgggatc

SEQ ID NO: 6474913 - DNA, 23 bp, Homo sapiens
tgctaggttaattccaattatat

SEQ ID NO: 6474914 - DNA, 16 bp, Homo sapiens
tgctagtaattggaaa

SEQ ID NO: 6474915 - DNA, 15 bp, Homo sapiens
tgctagtacctgtaa

SEQ ID NO: 6474916 - DNA, 14 bp, Homo sapiens
tgctagtagtgttc

SEQ ID NO: 6474917 - DNA, 20 bp, Homo sapiens
tgctagtatttgaattaaaa

SEQ ID NO: 6474918 - DNA, 22 bp, Homo sapiens
tgctagtatttgaattaaaact

SEQ ID NO: 6474919 - DNA, 18 bp, Homo sapiens
tgctagtcgcccctcaga

SEQ ID NO: 6474920 - DNA, 22 bp, Homo sapiens
tgctagtgaaatggctggggcc

SEQ ID NO: 6474921 - DNA, 16 bp, Homo sapiens
tgctagtgatttcatt

SEQ ID NO: 6474922 - DNA, 18 bp, Homo sapiens
tgctagtttattggaagt

SEQ ID NO: 6474923 - DNA, 13 bp, Homo sapiens
tgctagttttaca

SEQ ID NO: 6474924 - DNA, 20 bp, Homo sapiens
tgctataaagctagatgctt

SEQ ID NO: 6474925 - DNA, 16 bp, Homo sapiens
tgctataaatgccaga

SEQ ID NO: 6474926 - DNA, 17 bp, Homo sapiens
tgctataaatgccagag

SEQ ID NO: 6474927 - DNA, 19 bp, Homo sapiens
tgctataaatgccagagcc

SEQ ID NO: 6474928 - DNA, 16 bp, Homo sapiens
tgctataacattctga

SEQ ID NO: 6474929 - DNA, 13 bp, Homo sapiens
tgctataagaaaa

SEQ ID NO: 6474930 - DNA, 21 bp, Homo sapiens
tgctatacacaagcaatgcaa

SEQ ID NO: 6474931 - DNA, 13 bp, Homo sapiens
tgctatactgcat

SEQ ID NO: 6474932 - DNA, 21 bp, Homo sapiens
tgctatagcctaagcggctgt

SEQ ID NO: 6474933 - DNA, 19 bp, Homo sapiens
tgctataggctggagaagc

SEQ ID NO: 6474934 - DNA, 13 bp, Homo sapiens
tgctatagtattt

SEQ ID NO: 6474935 - DNA, 22 bp, Homo sapiens
tgctatagtatttgattcaaaa

SEQ ID NO: 6474936 - DNA, 12 bp, Homo sapiens
tgctatagtgac

SEQ ID NO: 6474937 - DNA, 15 bp, Homo sapiens
tgctatagtgacatg

SEQ ID NO: 6474938 - DNA, 19 bp, Homo sapiens
tgctatagtgacatgcagt

SEQ ID NO: 6474939 - DNA, 22 bp, Homo sapiens
tgctatagtgtataccacctgt

SEQ ID NO: 6474940 - DNA, 15 bp, Homo sapiens
tgctatataaataaa

SEQ ID NO: 6474941 - DNA, 12 bp, Homo sapiens
tgctatataatt

SEQ ID NO: 6474942 - DNA, 13 bp, Homo sapiens
tgctatataattg

SEQ ID NO: 6474943 - DNA, 17 bp, Homo sapiens
tgctatatatataaata

SEQ ID NO: 6474944 - DNA, 16 bp, Homo sapiens
tgctatatccagttcc

SEQ ID NO: 6474945 - DNA, 17 bp, Homo sapiens
tgctatattgcccaggc

SEQ ID NO: 6474946 - DNA, 16 bp, Homo sapiens
tgctatattttcatga

SEQ ID NO: 6474947 - DNA, 22 bp, Homo sapiens
tgctatatttttaaagaaggag

SEQ ID NO: 6474948 - DNA, 13 bp, Homo sapiens
tgctatcaagaaa

SEQ ID NO: 6474949 - DNA, 16 bp, Homo sapiens
tgctatcaagaaatgc

SEQ ID NO: 6474950 - DNA, 24 bp, Homo sapiens
tgctatcacagactctgctagtga

SEQ ID NO: 6474951 - DNA, 12 bp, Homo sapiens
tgctatcagcaa

SEQ ID NO: 6474952 - DNA, 15 bp, Homo sapiens
tgctatcagttttat

SEQ ID NO: 6474953 - DNA, 18 bp, Homo sapiens
tgctatcagttttatagc

SEQ ID NO: 6474954 - DNA, 22 bp, Homo sapiens
tgctatcatatattataagatt

SEQ ID NO: 6474955 - DNA, 14 bp, Homo sapiens
tgctatccaatgat

SEQ ID NO: 6474956 - DNA, 17 bp, Homo sapiens
tgctatccaatgatata

SEQ ID NO: 6474957 - DNA, 20 bp, Homo sapiens
tgctatccaatgatatagga

SEQ ID NO: 6474958 - DNA, 13 bp, Homo sapiens
tgctatccagccg

SEQ ID NO: 6474959 - DNA, 15 bp, Homo sapiens
tgctatccagccgca

SEQ ID NO: 6474960 - DNA, 16 bp, Homo sapiens
tgctatccagccgcaa

SEQ ID NO: 6474961 - DNA, 15 bp, Homo sapiens
tgctatccatttctc

SEQ ID NO: 6474962 - DNA, 14 bp, Homo sapiens
tgctatcctgcagg

SEQ ID NO: 6474963 - DNA, 18 bp, Homo sapiens
tgctatcctgcaggaaat

SEQ ID NO: 6474964 - DNA, 20 bp, Homo sapiens
tgctatcctgcaggaaatat

SEQ ID NO: 6474965 - DNA, 19 bp, Homo sapiens
tgctatcgccctcctttcc

SEQ ID NO: 6474966 - DNA, 22 bp, Homo sapiens
tgctatcgccctcctttccctt

SEQ ID NO: 6474967 - DNA, 23 bp, Homo sapiens
tgctatcggcagatgatgctttg

SEQ ID NO: 6474968 - DNA, 17 bp, Homo sapiens
tgctatctactaagttt

SEQ ID NO: 6474969 - DNA, 19 bp, Homo sapiens
tgctatctcccccagcccc

SEQ ID NO: 6474970 - DNA, 15 bp, Homo sapiens
tgctatctctattat

SEQ ID NO: 6474971 - DNA, 21 bp, Homo sapiens
tgctatctctgtgtgcacaaa

SEQ ID NO: 6474972 - DNA, 18 bp, Homo sapiens
tgctatctgaactaattc

SEQ ID NO: 6474973 - DNA, 22 bp, Homo sapiens
tgctatctgaactaattcattt

SEQ ID NO: 6474974 - DNA, 17 bp, Homo sapiens
tgctatcttaattttgg

SEQ ID NO: 6474975 - DNA, 18 bp, Homo sapiens
tgctatcttaattttggt

SEQ ID NO: 6474976 - DNA, 21 bp, Homo sapiens
tgctatgaaacaatcttccaa

SEQ ID NO: 6474977 - DNA, 23 bp, Homo sapiens
tgctatgaaacaatcttccaaag

SEQ ID NO: 6474978 - DNA, 20 bp, Homo sapiens
tgctatgaaaggaataaaac

SEQ ID NO: 6474979 - DNA, 14 bp, Homo sapiens
tgctatgaagccaa

SEQ ID NO: 6474980 - DNA, 17 bp, Homo sapiens
tgctatgacagctggct

SEQ ID NO: 6474981 - DNA, 15 bp, Homo sapiens
tgctatgacatgcaa

SEQ ID NO: 6474982 - DNA, 22 bp, Homo sapiens
tgctatgagctggggatgtctc

SEQ ID NO: 6474983 - DNA, 21 bp, Homo sapiens
tgctatgatgttagttttcct

SEQ ID NO: 6474984 - DNA, 22 bp, Homo sapiens
tgctatgcaaaaaattctttag

SEQ ID NO: 6474985 - DNA, 18 bp, Homo sapiens
tgctatgcatatttatag

SEQ ID NO: 6474986 - DNA, 15 bp, Homo sapiens
tgctatgcattttct

SEQ ID NO: 6474987 - DNA, 15 bp, Homo sapiens
tgctatgccaagcca

SEQ ID NO: 6474988 - DNA, 18 bp, Homo sapiens
tgctatggacgacctcca

SEQ ID NO: 6474989 - DNA, 14 bp, Homo sapiens
tgctatggagagga

SEQ ID NO: 6474990 - DNA, 14 bp, Homo sapiens
tgctatggttttct

SEQ ID NO: 6474991 - DNA, 18 bp, Homo sapiens
tgctatgtcatttcatgt

SEQ ID NO: 6474992 - DNA, 21 bp, Homo sapiens
tgctatgtcccaagagccata

SEQ ID NO: 6474993 - DNA, 12 bp, Homo sapiens
tgctatgtgttt

SEQ ID NO: 6474994 - DNA, 15 bp, Homo sapiens
tgctatgttagaagt

SEQ ID NO: 6474995 - DNA, 22 bp, Homo sapiens
tgctatgttattttcagtgctt

SEQ ID NO: 6474996 - DNA, 17 bp, Homo sapiens
tgctatgttctgtcttc

SEQ ID NO: 6474997 - DNA, 12 bp, Homo sapiens
tgctattaaagt

SEQ ID NO: 6474998 - DNA, 13 bp, Homo sapiens
tgctattacatgt

SEQ ID NO: 6474999 - DNA, 15 bp, Homo sapiens
tgctattacatgtgt

SEQ ID NO: 6475000 - DNA, 18 bp, Homo sapiens
tgctattatactgttatc

SEQ ID NO: 6475001 - DNA, 22 bp, Homo sapiens
tgctattatgtaacatccagaa

SEQ ID NO: 6475002 - DNA, 17 bp, Homo sapiens
tgctattcgtaagttct

SEQ ID NO: 6475003 - DNA, 19 bp, Homo sapiens
tgctattcgtaagttctgt

SEQ ID NO: 6475004 - DNA, 20 bp, Homo sapiens
tgctattcgtaagttctgtg

SEQ ID NO: 6475005 - DNA, 15 bp, Homo sapiens
tgctattctagagct

SEQ ID NO: 6475006 - DNA, 11 bp, Homo sapiens
tgctattctgt

SEQ ID NO: 6475007 - DNA, 15 bp, Homo sapiens
tgctattctgtgttg

SEQ ID NO: 6475008 - DNA, 13 bp, Homo sapiens
tgctattgaactg

SEQ ID NO: 6475009 - DNA, 16 bp, Homo sapiens
tgctattgaactgagc

SEQ ID NO: 6475010 - DNA, 17 bp, Homo sapiens
tgctattgaactgagcc

SEQ ID NO: 6475011 - DNA, 14 bp, Homo sapiens
tgctattggggttg

SEQ ID NO: 6475012 - DNA, 13 bp, Homo sapiens
tgctattgtaaat

SEQ ID NO: 6475013 - DNA, 17 bp, Homo sapiens
tgctattgtaaatatgt

SEQ ID NO: 6475014 - DNA, 16 bp, Homo sapiens
tgctattgtaaggtct

SEQ ID NO: 6475015 - DNA, 18 bp, Homo sapiens
tgctatttaaatagataa

SEQ ID NO: 6475016 - DNA, 22 bp, Homo sapiens
tgctatttaacattttacagta

SEQ ID NO: 6475017 - DNA, 14 bp, Homo sapiens
tgctatttacaaat

SEQ ID NO: 6475018 - DNA, 16 bp, Homo sapiens
tgctatttatattcat

SEQ ID NO: 6475019 - DNA, 16 bp, Homo sapiens
tgctatttattttcct

SEQ ID NO: 6475020 - DNA, 18 bp, Homo sapiens
tgctatttattttcctaa

SEQ ID NO: 6475021 - DNA, 18 bp, Homo sapiens
tgctatttcaataacaga

SEQ ID NO: 6475022 - DNA, 16 bp, Homo sapiens
tgctatttcagccaat

SEQ ID NO: 6475023 - DNA, 21 bp, Homo sapiens
tgctatttcagccaatctgga

SEQ ID NO: 6475024 - DNA, 12 bp, Homo sapiens
tgctatttctat

SEQ ID NO: 6475025 - DNA, 15 bp, Homo sapiens
tgctatttctattcc

SEQ ID NO: 6475026 - DNA, 16 bp, Homo sapiens
tgctatttctggcctc

SEQ ID NO: 6475027 - DNA, 22 bp, Homo sapiens
tgctatttctggcctcagcagg

SEQ ID NO: 6475028 - DNA, 24 bp, Homo sapiens
tgctatttgagcatgcacagctgc

SEQ ID NO: 6475029 - DNA, 22 bp, Homo sapiens
tgctatttgctttagagacagg

SEQ ID NO: 6475030 - DNA, 14 bp, Homo sapiens
tgctatttgtgtaa

SEQ ID NO: 6475031 - DNA, 18 bp, Homo sapiens
tgctatttgtgtaactga

SEQ ID NO: 6475032 - DNA, 19 bp, Homo sapiens
tgctatttgtgtaactgaa

SEQ ID NO: 6475033 - DNA, 22 bp, Homo sapiens
tgctattttaataaagattcta

SEQ ID NO: 6475034 - DNA, 12 bp, Homo sapiens
tgctattttact

SEQ ID NO: 6475035 - DNA, 17 bp, Homo sapiens
tgctattttactgtctt

SEQ ID NO: 6475036 - DNA, 18 bp, Homo sapiens
tgctattttactgtctta

SEQ ID NO: 6475037 - DNA, 16 bp, Homo sapiens
tgctatttttgtaaag

SEQ ID NO: 6475038 - DNA, 22 bp, Homo sapiens
tgctatttttgtaaagtttccg

SEQ ID NO: 6475039 - DNA, 21 bp, Homo sapiens
tgctattttttttaaatcaaa

SEQ ID NO: 6475040 - DNA, 15 bp, Homo sapiens
tgctcaaaaaatgag

SEQ ID NO: 6475041 - DNA, 19 bp, Homo sapiens
tgctcaaaataaaaagcct

SEQ ID NO: 6475042 - DNA, 12 bp, Homo sapiens
tgctcaaaattg

SEQ ID NO: 6475043 - DNA, 20 bp, Homo sapiens
tgctcaaaattttaaaaata

SEQ ID NO: 6475044 - DNA, 15 bp, Homo sapiens
tgctcaaagaaatct

SEQ ID NO: 6475045 - DNA, 14 bp, Homo sapiens
tgctcaaagatgta

SEQ ID NO: 6475046 - DNA, 16 bp, Homo sapiens
tgctcaaagatgtact

SEQ ID NO: 6475047 - DNA, 18 bp, Homo sapiens
tgctcaaagatgtactga

SEQ ID NO: 6475048 - DNA, 23 bp, Homo sapiens
tgctcaaagatgtactgagagga

SEQ ID NO: 6475049 - DNA, 19 bp, Homo sapiens
tgctcaaatctattcagac

SEQ ID NO: 6475050 - DNA, 18 bp, Homo sapiens
tgctcaaattactaatga

SEQ ID NO: 6475051 - DNA, 18 bp, Homo sapiens
tgctcaaccactgtggcg

SEQ ID NO: 6475052 - DNA, 15 bp, Homo sapiens
tgctcaaccagacag

SEQ ID NO: 6475053 - DNA, 20 bp, Homo sapiens
tgctcaacccccctcccaga

SEQ ID NO: 6475054 - DNA, 19 bp, Homo sapiens
tgctcaacctctctccttc

SEQ ID NO: 6475055 - DNA, 13 bp, Homo sapiens
tgctcaacttgca

SEQ ID NO: 6475056 - DNA, 20 bp, Homo sapiens
tgctcaacttgcaaaatcag

SEQ ID NO: 6475057 - DNA, 22 bp, Homo sapiens
tgctcaagaagacatggagact

SEQ ID NO: 6475058 - DNA, 16 bp, Homo sapiens
tgctcaagcagcaaaa

SEQ ID NO: 6475059 - DNA, 17 bp, Homo sapiens
tgctcaagcagcaaaat

SEQ ID NO: 6475060 - DNA, 19 bp, Homo sapiens
tgctcaagcagcaaaatcc

SEQ ID NO: 6475061 - DNA, 21 bp, Homo sapiens
tgctcaagcagcaaaatcctt

SEQ ID NO: 6475062 - DNA, 22 bp, Homo sapiens
tgctcaagcagcaaaatcctta

SEQ ID NO: 6475063 - DNA, 20 bp, Homo sapiens
tgctcaaggaccaagagcaa

SEQ ID NO: 6475064 - DNA, 18 bp, Homo sapiens
tgctcaagttcaccagca

SEQ ID NO: 6475065 - DNA, 18 bp, Homo sapiens
tgctcaataaacttgtgc

SEQ ID NO: 6475066 - DNA, 15 bp, Homo sapiens
tgctcaataaaggtc

SEQ ID NO: 6475067 - DNA, 15 bp, Homo sapiens
tctgtctgtctctcc

SEQ ID NO: 6475068 - DNA, 17 bp, Homo sapiens
tctgtctgtctgtgggc

SEQ ID NO: 6475069 - DNA, 18 bp, Homo sapiens
tctgtctgtgcacatgcc

SEQ ID NO: 6475070 - DNA, 14 bp, Homo sapiens
tctgtcttaaagaa

SEQ ID NO: 6475071 - DNA, 12 bp, Homo sapiens
tctgtcttcaca

SEQ ID NO: 6475072 - DNA, 22 bp, Homo sapiens
tctgtcttcaggctctgcccag

SEQ ID NO: 6475073 - DNA, 14 bp, Homo sapiens
tctgtcttcccaaa

SEQ ID NO: 6475074 - DNA, 14 bp, Homo sapiens
tctgtcttcctggt

SEQ ID NO: 6475075 - DNA, 12 bp, Homo sapiens
tctgtcttgaag

SEQ ID NO: 6475076 - DNA, 19 bp, Homo sapiens
tctgtcttggctttcatgt

SEQ ID NO: 6475077 - DNA, 14 bp, Homo sapiens
tctgtcttgtaata

SEQ ID NO: 6475078 - DNA, 19 bp, Homo sapiens
tctgtcttgttaatgcttt

SEQ ID NO: 6475079 - DNA, 23 bp, Homo sapiens
tctgtctttagaatcgctttcct

SEQ ID NO: 6475080 - DNA, 23 bp, Homo sapiens
tctgtctttatgatttcatgatt

SEQ ID NO: 6475081 - DNA, 19 bp, Homo sapiens
tctgtctttcactggaatg

SEQ ID NO: 6475082 - DNA, 20 bp, Homo sapiens
tctgtctttcactggaatga

SEQ ID NO: 6475083 - DNA, 19 bp, Homo sapiens
tctgtctttcatctcccag

SEQ ID NO: 6475084 - DNA, 17 bp, Homo sapiens
tctgtctttccactctg

SEQ ID NO: 6475085 - DNA, 14 bp, Homo sapiens
tctgtctttgcaaa

SEQ ID NO: 6475086 - DNA, 22 bp, Homo sapiens
tctgtctttgcggggcctgtct

SEQ ID NO: 6475087 - DNA, 12 bp, Homo sapiens
tctgtcttttaa

SEQ ID NO: 6475088 - DNA, 14 bp, Homo sapiens
tctgtcttttctcc

SEQ ID NO: 6475089 - DNA, 20 bp, Homo sapiens
tctgtcttttctcctccgcc

SEQ ID NO: 6475090 - DNA, 14 bp, Homo sapiens
tctgtcttttctgg

SEQ ID NO: 6475091 - DNA, 19 bp, Homo sapiens
tctgtcttttggagaacca

SEQ ID NO: 6475092 - DNA, 19 bp, Homo sapiens
tctgtctttttccttcctg

SEQ ID NO: 6475093 - DNA, 22 bp, Homo sapiens
tctgtgaaacctgtgaagctga

SEQ ID NO: 6475094 - DNA, 14 bp, Homo sapiens
tctgtgaaagaaga

SEQ ID NO: 6475095 - DNA, 12 bp, Homo sapiens
tctgtgaaatat

SEQ ID NO: 6475096 - DNA, 15 bp, Homo sapiens
tctgtgaaatatcat

SEQ ID NO: 6475097 - DNA, 16 bp, Homo sapiens
tctgtgaaatttgtaa

SEQ ID NO: 6475098 - DNA, 19 bp, Homo sapiens
tctgtgaacaagcttcagt

SEQ ID NO: 6475099 - DNA, 17 bp, Homo sapiens
tctgtgaacgatttaga

SEQ ID NO: 6475100 - DNA, 18 bp, Homo sapiens
tctgtgaacgtggcccgc

SEQ ID NO: 6475101 - DNA, 17 bp, Homo sapiens
tctgtgaacttgaaatt

SEQ ID NO: 6475102 - DNA, 14 bp, Homo sapiens
tctgtgaagaagcc

SEQ ID NO: 6475103 - DNA, 17 bp, Homo sapiens
tctgtgaagaagccctg

SEQ ID NO: 6475104 - DNA, 18 bp, Homo sapiens
tctgtgaagaagccctgt

SEQ ID NO: 6475105 - DNA, 14 bp, Homo sapiens
tctgtgaagaatga

SEQ ID NO: 6475106 - DNA, 19 bp, Homo sapiens
tctgtgaagccctttgcct

SEQ ID NO: 6475107 - DNA, 19 bp, Homo sapiens
tctgtgaagcctttatcta

SEQ ID NO: 6475108 - DNA, 11 bp, Homo sapiens
tctgtgaataa

SEQ ID NO: 6475109 - DNA, 13 bp, Homo sapiens
tctgtgaataagc

SEQ ID NO: 6475110 - DNA, 16 bp, Homo sapiens
tctgtgaataagccat

SEQ ID NO: 6475111 - DNA, 13 bp, Homo sapiens
tctgtgaatacaa

SEQ ID NO: 6475112 - DNA, 15 bp, Homo sapiens
tctgtgaatacaatt

SEQ ID NO: 6475113 - DNA, 20 bp, Homo sapiens
tctgtgaatacaattaaagg

SEQ ID NO: 6475114 - DNA, 16 bp, Homo sapiens
tctgtgacacatcgtt

SEQ ID NO: 6475115 - DNA, 16 bp, Homo sapiens
tctgtgacatcctgct

SEQ ID NO: 6475116 - DNA, 15 bp, Homo sapiens
tctgtgacatttatg

SEQ ID NO: 6475117 - DNA, 23 bp, Homo sapiens
tctgtgaccaaaataccttggtc

SEQ ID NO: 6475118 - DNA, 16 bp, Homo sapiens
tctgtgaccaatgtct

SEQ ID NO: 6475119 - DNA, 13 bp, Homo sapiens
tctgtgacccact

SEQ ID NO: 6475120 - DNA, 23 bp, Homo sapiens
tctgtgacccacttctcatcaca

SEQ ID NO: 6475121 - DNA, 16 bp, Homo sapiens
tctgtgacccctcctt

SEQ ID NO: 6475122 - DNA, 16 bp, Homo sapiens
tctgtgaccgccctcc

SEQ ID NO: 6475123 - DNA, 19 bp, Homo sapiens
tctgtgacctgtcagaata

SEQ ID NO: 6475124 - DNA, 21 bp, Homo sapiens
tctgtgacctgtcagaataaa

SEQ ID NO: 6475125 - DNA, 14 bp, Homo sapiens
tctgtgacgcagac

SEQ ID NO: 6475126 - DNA, 19 bp, Homo sapiens
tctgtgacttagtggacag

SEQ ID NO: 6475127 - DNA, 14 bp, Homo sapiens
tctgtgacttatct

SEQ ID NO: 6475128 - DNA, 19 bp, Homo sapiens
tctgtgagaaggtttattg

SEQ ID NO: 6475129 - DNA, 20 bp, Homo sapiens
tctgtgagaaggtttattgt

SEQ ID NO: 6475130 - DNA, 23 bp, Homo sapiens
tctgtgagaggcagctatctgca

SEQ ID NO: 6475131 - DNA, 22 bp, Homo sapiens
tctgtgagatgctagaactccc

SEQ ID NO: 6475132 - DNA, 19 bp, Homo sapiens
tctgtgagatggctggctg

SEQ ID NO: 6475133 - DNA, 19 bp, Homo sapiens
tctgtgagattcattcatg

SEQ ID NO: 6475134 - DNA, 16 bp, Homo sapiens
tctgtgagccccacag

SEQ ID NO: 6475135 - DNA, 20 bp, Homo sapiens
tctgtgaggaaagcacacag

SEQ ID NO: 6475136 - DNA, 21 bp, Homo sapiens
tctgtgagggtgctgactggc

SEQ ID NO: 6475137 - DNA, 16 bp, Homo sapiens
tctgtgaggtgctgat

SEQ ID NO: 6475138 - DNA, 18 bp, Homo sapiens
tctgtgagtacctggtca

SEQ ID NO: 6475139 - DNA, 18 bp, Homo sapiens
tctgtgagtgcgtctgag

SEQ ID NO: 6475140 - DNA, 14 bp, Homo sapiens
tctgtgataacaga

SEQ ID NO: 6475141 - DNA, 22 bp, Homo sapiens
tctgtgatcaccctctcggcct

SEQ ID NO: 6475142 - DNA, 21 bp, Homo sapiens
tctgtgatccttggtgctgtg

SEQ ID NO: 6475143 - DNA, 22 bp, Homo sapiens
tctgtgatccttggtgctgtgt

SEQ ID NO: 6475144 - DNA, 15 bp, Homo sapiens
tctgtgatctaagca

SEQ ID NO: 6475145 - DNA, 16 bp, Homo sapiens
tctgtgatctctgctg

SEQ ID NO: 6475146 - DNA, 23 bp, Homo sapiens
tctgtgatggatggacacaaaaa

SEQ ID NO: 6475147 - DNA, 21 bp, Homo sapiens
tctgtgattaaatctccagct

SEQ ID NO: 6475148 - DNA, 14 bp, Homo sapiens
tctgtgattacata

SEQ ID NO: 6475149 - DNA, 19 bp, Homo sapiens
tctgtgattacatagatca

SEQ ID NO: 6475150 - DNA, 21 bp, Homo sapiens
tctgtgattacatagatcagc

SEQ ID NO: 6475151 - DNA, 12 bp, Homo sapiens
tctgtgattggc

SEQ ID NO: 6475152 - DNA, 22 bp, Homo sapiens
tctgtgatttttttttttaatt

SEQ ID NO: 6475153 - DNA, 13 bp, Homo sapiens
tctgtgcaataaa

SEQ ID NO: 6475154 - DNA, 18 bp, Homo sapiens
tctgtgcaataaaataac

SEQ ID NO: 6475155 - DNA, 16 bp, Homo sapiens
tctgtgcaatggaata

SEQ ID NO: 6475156 - DNA, 17 bp, Homo sapiens
tctgtgcacactaagaa

SEQ ID NO: 6475157 - DNA, 22 bp, Homo sapiens
tctgtgcactagcctgtgatta

SEQ ID NO: 6475158 - DNA, 20 bp, Homo sapiens
tctgtgcagatgagcagtca

SEQ ID NO: 6475159 - DNA, 14 bp, Homo sapiens
tctgtgcagatgct

SEQ ID NO: 6475160 - DNA, 22 bp, Homo sapiens
tctgtgcaggatatttgcacta

SEQ ID NO: 6475161 - DNA, 15 bp, Homo sapiens
tctgtgcaggctgca

SEQ ID NO: 6475162 - DNA, 14 bp, Homo sapiens
tctgtgcagggctg

SEQ ID NO: 6475163 - DNA, 16 bp, Homo sapiens
tctgtgcagggctggt

SEQ ID NO: 6475164 - DNA, 19 bp, Homo sapiens
tctgtgcagggctggtttg

SEQ ID NO: 6475165 - DNA, 20 bp, Homo sapiens
tctgtgcagggctggtttgt

SEQ ID NO: 6475166 - DNA, 18 bp, Homo sapiens
tctgtgcagggtattaac

SEQ ID NO: 6475167 - DNA, 17 bp, Homo sapiens
tctgtgcagtcatcaac

SEQ ID NO: 6475168 - DNA, 18 bp, Homo sapiens
tctgtgcatctggcctgg

SEQ ID NO: 6475169 - DNA, 17 bp, Homo sapiens
tctgtgcatggtggcac

SEQ ID NO: 6475170 - DNA, 19 bp, Homo sapiens
tctgtgcatggtggcacca

SEQ ID NO: 6475171 - DNA, 20 bp, Homo sapiens
tctgtgcattgtggctgtca

SEQ ID NO: 6475172 - DNA, 19 bp, Homo sapiens
tctgtgcatttgtgtctgc

SEQ ID NO: 6475173 - DNA, 23 bp, Homo sapiens
tctgtgccacgctcctctgtttg

SEQ ID NO: 6475174 - DNA, 22 bp, Homo sapiens
tctgtgccagagcctggggctc

SEQ ID NO: 6475175 - DNA, 23 bp, Homo sapiens
tctgtgccagagcctggggctct

SEQ ID NO: 6475176 - DNA, 15 bp, Homo sapiens
tctgtgccatttctc

SEQ ID NO: 6475177 - DNA, 21 bp, Homo sapiens
tctgtgccattttctgtaaag

SEQ ID NO: 6475178 - DNA, 20 bp, Homo sapiens
tctgtgcccacggtctgagc

SEQ ID NO: 6475179 - DNA, 21 bp, Homo sapiens
tctgtgcccacggtctgagct

SEQ ID NO: 6475180 - DNA, 19 bp, Homo sapiens
tctgtgcccagctcagtct

SEQ ID NO: 6475181 - DNA, 15 bp, Homo sapiens
tctgtgcccagggtg

SEQ ID NO: 6475182 - DNA, 15 bp, Homo sapiens
tctgtgcccatgggc

SEQ ID NO: 6475183 - DNA, 19 bp, Homo sapiens
tctgtgcccatgggcactg

SEQ ID NO: 6475184 - DNA, 15 bp, Homo sapiens
tctgtgcccctgtaa

SEQ ID NO: 6475185 - DNA, 22 bp, Homo sapiens
tctgtgcccctgtaaatagttt

SEQ ID NO: 6475186 - DNA, 18 bp, Homo sapiens
tctgtgccccttccgcca

SEQ ID NO: 6475187 - DNA, 19 bp, Homo sapiens
tctgtgcccgaggttcctg

SEQ ID NO: 6475188 - DNA, 18 bp, Homo sapiens
tctgtgccctccaaagag

SEQ ID NO: 6475189 - DNA, 21 bp, Homo sapiens
tctgtgccgccacctctacct

SEQ ID NO: 6475190 - DNA, 12 bp, Homo sapiens
tctgtgcctaat

SEQ ID NO: 6475191 - DNA, 14 bp, Homo sapiens
tctgtgcctaataa

SEQ ID NO: 6475192 - DNA, 14 bp, Homo sapiens
tctgtgcctcagtg

SEQ ID NO: 6475193 - DNA, 17 bp, Homo sapiens
tctgtgcctcagtgaga

SEQ ID NO: 6475194 - DNA, 20 bp, Homo sapiens
tctgtgcctccaggaccagg

SEQ ID NO: 6475195 - DNA, 13 bp, Homo sapiens
tctgtgcctcccc

SEQ ID NO: 6475196 - DNA, 17 bp, Homo sapiens
tctgtgcctgaatattt

SEQ ID NO: 6475197 - DNA, 20 bp, Homo sapiens
tctgtgcctgactctgtgct

SEQ ID NO: 6475198 - DNA, 16 bp, Homo sapiens
tctgtgcctgcactga

SEQ ID NO: 6475199 - DNA, 22 bp, Homo sapiens
tctgtgcctgcactgagagggc

SEQ ID NO: 6475200 - DNA, 22 bp, Homo sapiens
tctgtgccttcttttgattatg

SEQ ID NO: 6475201 - DNA, 16 bp, Homo sapiens
tctgtgcgtagaagtt

SEQ ID NO: 6475202 - DNA, 14 bp, Homo sapiens
tctgtgcgtctgtg

SEQ ID NO: 6475203 - DNA, 16 bp, Homo sapiens
tctgtgcgtctgtgtg

SEQ ID NO: 6475204 - DNA, 20 bp, Homo sapiens
tctgtgcgtctgtgtgttta

SEQ ID NO: 6475205 - DNA, 22 bp, Homo sapiens
tctgtgcgtgaaacacaccagg

SEQ ID NO: 6475206 - DNA, 12 bp, Homo sapiens
tctgtgcgtgtg

SEQ ID NO: 6475207 - DNA, 21 bp, Homo sapiens
tctgtgctagggaaacttccc

SEQ ID NO: 6475208 - DNA, 13 bp, Homo sapiens
tctgtgctccaag

SEQ ID NO: 6475209 - DNA, 15 bp, Homo sapiens
tctgtgctctgtcct

SEQ ID NO: 6475210 - DNA, 22 bp, Homo sapiens
tctgtgctcttttggtggggag

SEQ ID NO: 6475211 - DNA, 14 bp, Homo sapiens
tctgtgctgacatg

SEQ ID NO: 6475212 - DNA, 13 bp, Homo sapiens
tctgtgctgagca

SEQ ID NO: 6475213 - DNA, 19 bp, Homo sapiens
tctgtgctgagcacagaga

SEQ ID NO: 6475214 - DNA, 15 bp, Homo sapiens
tctgtgctgccctgc

SEQ ID NO: 6475215 - DNA, 23 bp, Homo sapiens
tctgtgctgccctgctctgggga

SEQ ID NO: 6475216 - DNA, 19 bp, Homo sapiens
tctgtgctggagatgtttt

SEQ ID NO: 6475217 - DNA, 13 bp, Homo sapiens
tctgtgctgtgcc

SEQ ID NO: 6475218 - DNA, 19 bp, Homo sapiens
tctgtgctgtgcctgctag

SEQ ID NO: 6475219 - DNA, 23 bp, Homo sapiens
tctgtgctgtgcctgctagagca

SEQ ID NO: 6475220 - DNA, 21 bp, Homo sapiens
tctgtgctttccagctcaccc

SEQ ID NO: 6475221 - DNA, 17 bp, Homo sapiens
tctgtggaaaaataaag

SEQ ID NO: 6475222 - DNA, 16 bp, Homo sapiens
tctgtggaaaacaatt

SEQ ID NO: 6475223 - DNA, 19 bp, Homo sapiens
tctgtggaaaagccatctc

SEQ ID NO: 6475224 - DNA, 20 bp, Homo sapiens
tctgtggaaagtgtaaagca

SEQ ID NO: 6475225 - DNA, 22 bp, Homo sapiens
tctgtggaaagtgtaaagcatt

SEQ ID NO: 6475226 - DNA, 11 bp, Homo sapiens
tctgtggaaga

SEQ ID NO: 6475227 - DNA, 14 bp, Homo sapiens
tctgtggaagagat

SEQ ID NO: 6475228 - DNA, 21 bp, Homo sapiens
tctgtggaagtagctttgaac

SEQ ID NO: 6475229 - DNA, 12 bp, Homo sapiens
tctgtggaattc

SEQ ID NO: 6475230 - DNA, 19 bp, Homo sapiens
tctgtggacactgtggaaa

SEQ ID NO: 6475231 - DNA, 16 bp, Homo sapiens
tctgtggagaatgtac

SEQ ID NO: 6475232 - DNA, 16 bp, Homo sapiens
tctgtggagatgccca

SEQ ID NO: 6475233 - DNA, 18 bp, Homo sapiens
tctgtggagatggactca

SEQ ID NO: 6475234 - DNA, 13 bp, Homo sapiens
tctgtggagcgcc

SEQ ID NO: 6475235 - DNA, 21 bp, Homo sapiens
tctgtggagcgtccttgtccc

SEQ ID NO: 6475236 - DNA, 22 bp, Homo sapiens
tctgtggagctgccacagagaa

SEQ ID NO: 6475237 - DNA, 22 bp, Homo sapiens
tctgtggagggagggcagctgg

SEQ ID NO: 6475238 - DNA, 21 bp, Homo sapiens
tctgtggatcagcattttaga

SEQ ID NO: 6475239 - DNA, 16 bp, Homo sapiens
tctgtggattctatat

SEQ ID NO: 6475240 - DNA, 20 bp, Homo sapiens
tctgtggattctatatttca

SEQ ID NO: 6475241 - DNA, 20 bp, Homo sapiens
tctgtggccagcctggcatc

SEQ ID NO: 6475242 - DNA, 12 bp, Homo sapiens
tctgtggccagg

SEQ ID NO: 6475243 - DNA, 15 bp, Homo sapiens
tctgtggccaggagc

SEQ ID NO: 6475244 - DNA, 20 bp, Homo sapiens
tctgtggccaggagccctgg

SEQ ID NO: 6475245 - DNA, 21 bp, Homo sapiens
tgctcaataaatgattcttag

SEQ ID NO: 6475246 - DNA, 23 bp, Homo sapiens
tgctcaatgaaaccttcctcttg

SEQ ID NO: 6475247 - DNA, 16 bp, Homo sapiens
tgctcaatgccattgt

SEQ ID NO: 6475248 - DNA, 13 bp, Homo sapiens
tgctcaatgtgct

SEQ ID NO: 6475249 - DNA, 15 bp, Homo sapiens
tgctcaatttcagca

SEQ ID NO: 6475250 - DNA, 19 bp, Homo sapiens
tgctcacacaatcagacca

SEQ ID NO: 6475251 - DNA, 14 bp, Homo sapiens
tgctcacaccccat

SEQ ID NO: 6475252 - DNA, 20 bp, Homo sapiens
tgctcacagggatgctggtg

SEQ ID NO: 6475253 - DNA, 21 bp, Homo sapiens
tgctcacagggatgctggtgg

SEQ ID NO: 6475254 - DNA, 13 bp, Homo sapiens
tgctcacagtctc

SEQ ID NO: 6475255 - DNA, 16 bp, Homo sapiens
tgctcacatatctgtc

SEQ ID NO: 6475256 - DNA, 15 bp, Homo sapiens
tgctcacatgtcttt

SEQ ID NO: 6475257 - DNA, 17 bp, Homo sapiens
tgctcacattccctctc

SEQ ID NO: 6475258 - DNA, 14 bp, Homo sapiens
tgctcaccacctgc

SEQ ID NO: 6475259 - DNA, 17 bp, Homo sapiens
tgctcaccacctgcctc

SEQ ID NO: 6475260 - DNA, 18 bp, Homo sapiens
tgctcaccacctgcctct

SEQ ID NO: 6475261 - DNA, 18 bp, Homo sapiens
tgctcaccagccctgcag

SEQ ID NO: 6475262 - DNA, 14 bp, Homo sapiens
tgctcacccaggac

SEQ ID NO: 6475263 - DNA, 22 bp, Homo sapiens
tgctcacccaggacctctgggg

SEQ ID NO: 6475264 - DNA, 16 bp, Homo sapiens
tgctcacccattgtct

SEQ ID NO: 6475265 - DNA, 19 bp, Homo sapiens
tgctcacccattgtctcat

SEQ ID NO: 6475266 - DNA, 18 bp, Homo sapiens
tgctcaccctctcttggt

SEQ ID NO: 6475267 - DNA, 18 bp, Homo sapiens
tgctcaccgactcacctg

SEQ ID NO: 6475268 - DNA, 12 bp, Homo sapiens
tgctcacctcta

SEQ ID NO: 6475269 - DNA, 22 bp, Homo sapiens
tgctcacctcttctttaccaga

SEQ ID NO: 6475270 - DNA, 12 bp, Homo sapiens
tgctcacctggg

SEQ ID NO: 6475271 - DNA, 13 bp, Homo sapiens
tgctcacctgggg

SEQ ID NO: 6475272 - DNA, 22 bp, Homo sapiens
tgctcacctggggtgtgggagg

SEQ ID NO: 6475273 - DNA, 20 bp, Homo sapiens
tgctcacctgtgtgcccagc

SEQ ID NO: 6475274 - DNA, 16 bp, Homo sapiens
tgctcacgctcccccg

SEQ ID NO: 6475275 - DNA, 17 bp, Homo sapiens
tgctcacgtcaaatgca

SEQ ID NO: 6475276 - DNA, 17 bp, Homo sapiens
tgctcacgtctctgccg

SEQ ID NO: 6475277 - DNA, 22 bp, Homo sapiens
tgctcacgtctctgccgcctgc

SEQ ID NO: 6475278 - DNA, 23 bp, Homo sapiens
tgctcacgtctgtgagtctgtcc

SEQ ID NO: 6475279 - DNA, 15 bp, Homo sapiens
tgctcacgtgtcctt

SEQ ID NO: 6475280 - DNA, 21 bp, Homo sapiens
tgctcacgttaccttgacaca

SEQ ID NO: 6475281 - DNA, 22 bp, Homo sapiens
tgctcacgttaccttgacacat

SEQ ID NO: 6475282 - DNA, 22 bp, Homo sapiens
tgctcactcactcactccaaga

SEQ ID NO: 6475283 - DNA, 13 bp, Homo sapiens
tgctcactcagga

SEQ ID NO: 6475284 - DNA, 12 bp, Homo sapiens
tgctcactccct

SEQ ID NO: 6475285 - DNA, 15 bp, Homo sapiens
tgctcactccctaaa

SEQ ID NO: 6475286 - DNA, 14 bp, Homo sapiens
tgctcactgggccc

SEQ ID NO: 6475287 - DNA, 20 bp, Homo sapiens
tgctcactgtgtataggaat

SEQ ID NO: 6475288 - DNA, 21 bp, Homo sapiens
tgctcacttaaacaatgtcct

SEQ ID NO: 6475289 - DNA, 16 bp, Homo sapiens
tgctcacttttgtgaa

SEQ ID NO: 6475290 - DNA, 20 bp, Homo sapiens
tgctcacttttgtgaaagct

SEQ ID NO: 6475291 - DNA, 23 bp, Homo sapiens
tgctcacttttgtgaaagctgct

SEQ ID NO: 6475292 - DNA, 16 bp, Homo sapiens
tgctcagaacttgctg

SEQ ID NO: 6475293 - DNA, 21 bp, Homo sapiens
tgctcagaacttgctgctgtc

SEQ ID NO: 6475294 - DNA, 22 bp, Homo sapiens
tgctcagaagagaatcaaggcc

SEQ ID NO: 6475295 - DNA, 18 bp, Homo sapiens
tgctcagaagccagtctg

SEQ ID NO: 6475296 - DNA, 22 bp, Homo sapiens
tgctcagaagccagtctgcgtc

SEQ ID NO: 6475297 - DNA, 13 bp, Homo sapiens
tgctcagaattca

SEQ ID NO: 6475298 - DNA, 19 bp, Homo sapiens
tgctcagacgagacaccct

SEQ ID NO: 6475299 - DNA, 20 bp, Homo sapiens
tgctcagagacctgaagtgt

SEQ ID NO: 6475300 - DNA, 16 bp, Homo sapiens
tgctcagagctttaaa

SEQ ID NO: 6475301 - DNA, 18 bp, Homo sapiens
tgctcagagtgaagagtg

SEQ ID NO: 6475302 - DNA, 20 bp, Homo sapiens
tgctcagcaaggggctctgc

SEQ ID NO: 6475303 - DNA, 17 bp, Homo sapiens
tgctcagcagtgagagc

SEQ ID NO: 6475304 - DNA, 13 bp, Homo sapiens
tgctcagcatgat

SEQ ID NO: 6475305 - DNA, 12 bp, Homo sapiens
tgctcagccaag

SEQ ID NO: 6475306 - DNA, 23 bp, Homo sapiens
tgctcagcccatcccctgcctct

SEQ ID NO: 6475307 - DNA, 19 bp, Homo sapiens
tgctcagccccagacctgc

SEQ ID NO: 6475308 - DNA, 18 bp, Homo sapiens
tgctcagccccagcttat

SEQ ID NO: 6475309 - DNA, 11 bp, Homo sapiens
tgctcagccct

SEQ ID NO: 6475310 - DNA, 17 bp, Homo sapiens
tgctcagccctgaggac

SEQ ID NO: 6475311 - DNA, 19 bp, Homo sapiens
tgctcagccctgaggacag

SEQ ID NO: 6475312 - DNA, 13 bp, Homo sapiens
tgctcagccctgg

SEQ ID NO: 6475313 - DNA, 15 bp, Homo sapiens
tgctcagccctggag

SEQ ID NO: 6475314 - DNA, 23 bp, Homo sapiens
tgctcagccctggaggtgccagc

SEQ ID NO: 6475315 - DNA, 18 bp, Homo sapiens
tgctcagcctcatcctga

SEQ ID NO: 6475316 - DNA, 13 bp, Homo sapiens
tgctcagccttgc

SEQ ID NO: 6475317 - DNA, 21 bp, Homo sapiens
tgctcagccttgctgctctgc

SEQ ID NO: 6475318 - DNA, 13 bp, Homo sapiens
tgctcagctccta

SEQ ID NO: 6475319 - DNA, 15 bp, Homo sapiens
tgctcagctcctacc

SEQ ID NO: 6475320 - DNA, 20 bp, Homo sapiens
tgctcagctctgggccattc

SEQ ID NO: 6475321 - DNA, 22 bp, Homo sapiens
tgctcagctgcgcccccttctt

SEQ ID NO: 6475322 - DNA, 21 bp, Homo sapiens
tgctcagctgtggctggagga

SEQ ID NO: 6475323 - DNA, 12 bp, Homo sapiens
tgctcagcttct

SEQ ID NO: 6475324 - DNA, 15 bp, Homo sapiens
tgctcagcttctcct

SEQ ID NO: 6475325 - DNA, 20 bp, Homo sapiens
tgctcagcttctcctgtgtg

SEQ ID NO: 6475326 - DNA, 14 bp, Homo sapiens
tgctcaggactcag

SEQ ID NO: 6475327 - DNA, 23 bp, Homo sapiens
tgctcaggactcagaagcctctg

SEQ ID NO: 6475328 - DNA, 14 bp, Homo sapiens
tgctcaggagccct

SEQ ID NO: 6475329 - DNA, 19 bp, Homo sapiens
tgctcaggagccctgggag

SEQ ID NO: 6475330 - DNA, 20 bp, Homo sapiens
tgctcaggagccctgggagg

SEQ ID NO: 6475331 - DNA, 22 bp, Homo sapiens
tgctcaggcctcacctcccagg

SEQ ID NO: 6475332 - DNA, 19 bp, Homo sapiens
tgctcaggcctcacctggc

SEQ ID NO: 6475333 - DNA, 15 bp, Homo sapiens
tgctcaggcctccct

SEQ ID NO: 6475334 - DNA, 18 bp, Homo sapiens
tgctcaggctccccaaga

SEQ ID NO: 6475335 - DNA, 20 bp, Homo sapiens
tgctcaggctggtcttgaac

SEQ ID NO: 6475336 - DNA, 19 bp, Homo sapiens
tgctcaggcttgaaatgca

SEQ ID NO: 6475337 - DNA, 19 bp, Homo sapiens
tgctcagggaaaagcagct

SEQ ID NO: 6475338 - DNA, 20 bp, Homo sapiens
tgctcagggaaatggccttc

SEQ ID NO: 6475339 - DNA, 13 bp, Homo sapiens
tgctcagggcatg

SEQ ID NO: 6475340 - DNA, 18 bp, Homo sapiens
tgctcagggcatgcttat

SEQ ID NO: 6475341 - DNA, 14 bp, Homo sapiens
tgctcaggggccct

SEQ ID NO: 6475342 - DNA, 19 bp, Homo sapiens
tgctcaggggcgtgtggct

SEQ ID NO: 6475343 - DNA, 21 bp, Homo sapiens
tgctcagggggcgcctgtggt

SEQ ID NO: 6475344 - DNA, 13 bp, Homo sapiens
tgctcaggtactt

SEQ ID NO: 6475345 - DNA, 16 bp, Homo sapiens
tgctcagtagtcagac

SEQ ID NO: 6475346 - DNA, 12 bp, Homo sapiens
tgctcagtattg

SEQ ID NO: 6475347 - DNA, 13 bp, Homo sapiens
tgctcagtattga

SEQ ID NO: 6475348 - DNA, 18 bp, Homo sapiens
tgctcagtccctctgggt

SEQ ID NO: 6475349 - DNA, 16 bp, Homo sapiens
tgctcagtcgccctgt

SEQ ID NO: 6475350 - DNA, 14 bp, Homo sapiens
tgctcagtctcctt

SEQ ID NO: 6475351 - DNA, 15 bp, Homo sapiens
tgctcagtctccttg

SEQ ID NO: 6475352 - DNA, 18 bp, Homo sapiens
tgctcagtgatctcactt

SEQ ID NO: 6475353 - DNA, 13 bp, Homo sapiens
tgctcagtgcctt

SEQ ID NO: 6475354 - DNA, 15 bp, Homo sapiens
tgctcagtgcttggg

SEQ ID NO: 6475355 - DNA, 18 bp, Homo sapiens
tgctcagtggatcacaca

SEQ ID NO: 6475356 - DNA, 23 bp, Homo sapiens
tgctcagtgggtaaaattagatg

SEQ ID NO: 6475357 - DNA, 13 bp, Homo sapiens
tgctcagtgtcca

SEQ ID NO: 6475358 - DNA, 22 bp, Homo sapiens
tgctcagtgtccagcttccaaa

SEQ ID NO: 6475359 - DNA, 23 bp, Homo sapiens
tgctcagtgtccagcttccaaag

SEQ ID NO: 6475360 - DNA, 19 bp, Homo sapiens
tgctcagtgtctggctgca

SEQ ID NO: 6475361 - DNA, 16 bp, Homo sapiens
tgctcagtgtttcata

SEQ ID NO: 6475362 - DNA, 15 bp, Homo sapiens
tgctcagttccaatg

SEQ ID NO: 6475363 - DNA, 20 bp, Homo sapiens
tgctcagttccaatgtgccc

SEQ ID NO: 6475364 - DNA, 13 bp, Homo sapiens
tgctcagttgcta

SEQ ID NO: 6475365 - DNA, 14 bp, Homo sapiens
tgctcagttgctaa

SEQ ID NO: 6475366 - DNA, 15 bp, Homo sapiens
tgctcagttgtactt

SEQ ID NO: 6475367 - DNA, 13 bp, Homo sapiens
tgctcagttgtag

SEQ ID NO: 6475368 - DNA, 17 bp, Homo sapiens
tgctcagttgtagaatg

SEQ ID NO: 6475369 - DNA, 18 bp, Homo sapiens
tgctcagttgtagaatgt

SEQ ID NO: 6475370 - DNA, 19 bp, Homo sapiens
tgctcagttgtagaatgta

SEQ ID NO: 6475371 - DNA, 21 bp, Homo sapiens
tgctcagttgtagaatgtatt

SEQ ID NO: 6475372 - DNA, 14 bp, Homo sapiens
tgctcataactaga

SEQ ID NO: 6475373 - DNA, 21 bp, Homo sapiens
tgctcataagtaaatgtcttc

SEQ ID NO: 6475374 - DNA, 19 bp, Homo sapiens
tgctcatactacattgagt

SEQ ID NO: 6475375 - DNA, 20 bp, Homo sapiens
tgctcataggacctgcatcc

SEQ ID NO: 6475376 - DNA, 23 bp, Homo sapiens
tgctcatattgtgattctgcctt

SEQ ID NO: 6475377 - DNA, 15 bp, Homo sapiens
tgctcatcacccagt

SEQ ID NO: 6475378 - DNA, 23 bp, Homo sapiens
tgctcatcacccagtcctggcca

SEQ ID NO: 6475379 - DNA, 19 bp, Homo sapiens
tgctcatcattctctgtct

SEQ ID NO: 6475380 - DNA, 21 bp, Homo sapiens
tgctcatcattctctgtctca

SEQ ID NO: 6475381 - DNA, 23 bp, Homo sapiens
tgctcatcattctctgtctcatc

SEQ ID NO: 6475382 - DNA, 23 bp, Homo sapiens
tgctcatctcagtcctcaaagct

SEQ ID NO: 6475383 - DNA, 17 bp, Homo sapiens
tgctcatctgcagcctc

SEQ ID NO: 6475384 - DNA, 18 bp, Homo sapiens
tgctcatctgcagcctcc

SEQ ID NO: 6475385 - DNA, 14 bp, Homo sapiens
tgctcatctgctgg

SEQ ID NO: 6475386 - DNA, 15 bp, Homo sapiens
tgctcatctgctggt

SEQ ID NO: 6475387 - DNA, 15 bp, Homo sapiens
tgctcatgagctcct

SEQ ID NO: 6475388 - DNA, 14 bp, Homo sapiens
tgctcatgctgctc

SEQ ID NO: 6475389 - DNA, 11 bp, Homo sapiens
tgctcatggaa

SEQ ID NO: 6475390 - DNA, 16 bp, Homo sapiens
tgctcatgggaagaac

SEQ ID NO: 6475391 - DNA, 19 bp, Homo sapiens
tgctcatgtatatttagtt

SEQ ID NO: 6475392 - DNA, 22 bp, Homo sapiens
tgctcatgtccctgtccccagg

SEQ ID NO: 6475393 - DNA, 18 bp, Homo sapiens
tgctcatgtgtgtggtca

SEQ ID NO: 6475394 - DNA, 19 bp, Homo sapiens
tgctcatgtgtgtggtcag

SEQ ID NO: 6475395 - DNA, 20 bp, Homo sapiens
tgctcatgtttggaaagctg

SEQ ID NO: 6475396 - DNA, 22 bp, Homo sapiens
tgctcatgtttggaaagctgaa

SEQ ID NO: 6475397 - DNA, 16 bp, Homo sapiens
tgctcattaaactgat

SEQ ID NO: 6475398 - DNA, 22 bp, Homo sapiens
tgctcattacagttctttcctc

SEQ ID NO: 6475399 - DNA, 16 bp, Homo sapiens
tgctcattccatgact

SEQ ID NO: 6475400 - DNA, 14 bp, Homo sapiens
tgctcattccgagg

SEQ ID NO: 6475401 - DNA, 18 bp, Homo sapiens
tgctcattccttctggag

SEQ ID NO: 6475402 - DNA, 21 bp, Homo sapiens
tgctcattctaatgatggccc

SEQ ID NO: 6475403 - DNA, 20 bp, Homo sapiens
tgctcattgtataagccccg

SEQ ID NO: 6475404 - DNA, 14 bp, Homo sapiens
tgctcatttcagga

SEQ ID NO: 6475405 - DNA, 20 bp, Homo sapiens
tgctcatttgagaactgtca

SEQ ID NO: 6475406 - DNA, 15 bp, Homo sapiens
tgctcattttctggt

SEQ ID NO: 6475407 - DNA, 19 bp, Homo sapiens
tgctcattttctggtttgg

SEQ ID NO: 6475408 - DNA, 13 bp, Homo sapiens
tgctcattttctt

SEQ ID NO: 6475409 - DNA, 13 bp, Homo sapiens
tgctccaaatgtc

SEQ ID NO: 6475410 - DNA, 16 bp, Homo sapiens
tgctccaacagacacc

SEQ ID NO: 6475411 - DNA, 17 bp, Homo sapiens
tgctccaacagacaccc

SEQ ID NO: 6475412 - DNA, 20 bp, Homo sapiens
tgctccaacagacaccctcc

SEQ ID NO: 6475413 - DNA, 22 bp, Homo sapiens
tgctccaacagacaccctccac

SEQ ID NO: 6475414 - DNA, 23 bp, Homo sapiens
tgctccaacctcccggggggacg

SEQ ID NO: 6475415 - DNA, 13 bp, Homo sapiens
tgctccaactcca

SEQ ID NO: 6475416 - DNA, 17 bp, Homo sapiens
tgctccaagatgttctc

SEQ ID NO: 6475417 - DNA, 19 bp, Homo sapiens
tgctccaagatgttctcct

SEQ ID NO: 6475418 - DNA, 20 bp, Homo sapiens
tgctccaagatgttctcctg

SEQ ID NO: 6475419 - DNA, 21 bp, Homo sapiens
tgctccaagatgttctcctga

SEQ ID NO: 6475420 - DNA, 14 bp, Homo sapiens
tgctccaaggcagt

SEQ ID NO: 6475421 - DNA, 16 bp, Homo sapiens
tgctccaagggacagg

SEQ ID NO: 6475422 - DNA, 14 bp, Homo sapiens
tgctccaatctgtc

SEQ ID NO: 6475423 - DNA, 16 bp, Homo sapiens
tctgtggccagttgac

SEQ ID NO: 6475424 - DNA, 15 bp, Homo sapiens
tctgtggcctggggc

SEQ ID NO: 6475425 - DNA, 17 bp, Homo sapiens
tctgtggcctgtctcta

SEQ ID NO: 6475426 - DNA, 22 bp, Homo sapiens
tctgtggcgatatgagagggat

SEQ ID NO: 6475427 - DNA, 13 bp, Homo sapiens
tctgtggctggct

SEQ ID NO: 6475428 - DNA, 19 bp, Homo sapiens
tctgtggctggctctacct

SEQ ID NO: 6475429 - DNA, 16 bp, Homo sapiens
tctgtgggactggccc

SEQ ID NO: 6475430 - DNA, 21 bp, Homo sapiens
tctgtgggactggcccacccc

SEQ ID NO: 6475431 - DNA, 13 bp, Homo sapiens
tctgtgggatata

SEQ ID NO: 6475432 - DNA, 17 bp, Homo sapiens
tctgtgggcagctggct

SEQ ID NO: 6475433 - DNA, 18 bp, Homo sapiens
tctgtgggcagctggctc

SEQ ID NO: 6475434 - DNA, 22 bp, Homo sapiens
tctgtgggcagctggctctgaa

SEQ ID NO: 6475435 - DNA, 19 bp, Homo sapiens
tctgtgggccctaccctcc

SEQ ID NO: 6475436 - DNA, 22 bp, Homo sapiens
tctgtgggccctaccctcctgc

SEQ ID NO: 6475437 - DNA, 16 bp, Homo sapiens
tctgtgggctgcactc

SEQ ID NO: 6475438 - DNA, 16 bp, Homo sapiens
tctgtgggcttcagca

SEQ ID NO: 6475439 - DNA, 15 bp, Homo sapiens
tctgtgggcttggcc

SEQ ID NO: 6475440 - DNA, 19 bp, Homo sapiens
tctgtgggcttggccttgt

SEQ ID NO: 6475441 - DNA, 14 bp, Homo sapiens
tctgtggggactcc

SEQ ID NO: 6475442 - DNA, 22 bp, Homo sapiens
tctgtgggggtcatcagggagg

SEQ ID NO: 6475443 - DNA, 18 bp, Homo sapiens
tctgtgggtctccatcct

SEQ ID NO: 6475444 - DNA, 19 bp, Homo sapiens
tctgtgggtgacccaggtc

SEQ ID NO: 6475445 - DNA, 22 bp, Homo sapiens
tctgtgggtgatggggaggggc

SEQ ID NO: 6475446 - DNA, 22 bp, Homo sapiens
tctgtgggtttctaaagctgcc

SEQ ID NO: 6475447 - DNA, 15 bp, Homo sapiens
tctgtggtgcagtgt

SEQ ID NO: 6475448 - DNA, 16 bp, Homo sapiens
tctgtggtgcagtgtg

SEQ ID NO: 6475449 - DNA, 17 bp, Homo sapiens
tctgtggtgcagtgtgt

SEQ ID NO: 6475450 - DNA, 11 bp, Homo sapiens
tctgtggtggg

SEQ ID NO: 6475451 - DNA, 19 bp, Homo sapiens
tctgtggttcctctgctca

SEQ ID NO: 6475452 - DNA, 15 bp, Homo sapiens
tctgtggttctataa

SEQ ID NO: 6475453 - DNA, 19 bp, Homo sapiens
tctgtggttggctgggaaa

SEQ ID NO: 6475454 - DNA, 23 bp, Homo sapiens
tctgtggttttcccctccctggg

SEQ ID NO: 6475455 - DNA, 15 bp, Homo sapiens
tctgtgtaaagactt

SEQ ID NO: 6475456 - DNA, 20 bp, Homo sapiens
tctgtgtaacatccaagcca

SEQ ID NO: 6475457 - DNA, 22 bp, Homo sapiens
tctgtgtaaccagctcagtgtt

SEQ ID NO: 6475458 - DNA, 23 bp, Homo sapiens
tctgtgtaaccagctcagtgttt

SEQ ID NO: 6475459 - DNA, 18 bp, Homo sapiens
tctgtgtaatctctgatt

SEQ ID NO: 6475460 - DNA, 19 bp, Homo sapiens
tctgtgtaccacttcctga

SEQ ID NO: 6475461 - DNA, 20 bp, Homo sapiens
tctgtgtaccacttctgtgg

SEQ ID NO: 6475462 - DNA, 14 bp, Homo sapiens
tctgtgtagagaat

SEQ ID NO: 6475463 - DNA, 15 bp, Homo sapiens
tctgtgtagagaatg

SEQ ID NO: 6475464 - DNA, 17 bp, Homo sapiens
tctgtgtagccgccctg

SEQ ID NO: 6475465 - DNA, 18 bp, Homo sapiens
tctgtgtagccgccctga

SEQ ID NO: 6475466 - DNA, 22 bp, Homo sapiens
tctgtgtatacatatgtatgtg

SEQ ID NO: 6475467 - DNA, 13 bp, Homo sapiens
tctgtgtatatct

SEQ ID NO: 6475468 - DNA, 14 bp, Homo sapiens
tctgtgtatatctc

SEQ ID NO: 6475469 - DNA, 18 bp, Homo sapiens
tctgtgtatatctcttgg

SEQ ID NO: 6475470 - DNA, 20 bp, Homo sapiens
tctgtgtatatctcttggaa

SEQ ID NO: 6475471 - DNA, 14 bp, Homo sapiens
tctgtgtatattat

SEQ ID NO: 6475472 - DNA, 13 bp, Homo sapiens
tctgtgtattaac

SEQ ID NO: 6475473 - DNA, 23 bp, Homo sapiens
tctgtgtcaaggtgaagcacata

SEQ ID NO: 6475474 - DNA, 19 bp, Homo sapiens
tctgtgtcacgtgaccctg

SEQ ID NO: 6475475 - DNA, 17 bp, Homo sapiens
tctgtgtcactggctgc

SEQ ID NO: 6475476 - DNA, 14 bp, Homo sapiens
tctgtgtcagcatt

SEQ ID NO: 6475477 - DNA, 20 bp, Homo sapiens
tctgtgtcaggtggggcagc

SEQ ID NO: 6475478 - DNA, 22 bp, Homo sapiens
tctgtgtcaggtggggcagctt

SEQ ID NO: 6475479 - DNA, 15 bp, Homo sapiens
tctgtgtcatttctt

SEQ ID NO: 6475480 - DNA, 23 bp, Homo sapiens
tctgtgtcctctgcctgggctct

SEQ ID NO: 6475481 - DNA, 16 bp, Homo sapiens
tctgtgtctaagattc

SEQ ID NO: 6475482 - DNA, 17 bp, Homo sapiens
tctgtgtctaagattct

SEQ ID NO: 6475483 - DNA, 12 bp, Homo sapiens
tctgtgtctgct

SEQ ID NO: 6475484 - DNA, 14 bp, Homo sapiens
tctgtgtctgctgt

SEQ ID NO: 6475485 - DNA, 15 bp, Homo sapiens
tctgtgtctgtgttt

SEQ ID NO: 6475486 - DNA, 15 bp, Homo sapiens
tctgtgtctttctct

SEQ ID NO: 6475487 - DNA, 22 bp, Homo sapiens
tctgtgtgaatgtgggcactgg

SEQ ID NO: 6475488 - DNA, 12 bp, Homo sapiens
tctgtgtggcaa

SEQ ID NO: 6475489 - DNA, 17 bp, Homo sapiens
tctgtgtggcaaacatt

SEQ ID NO: 6475490 - DNA, 17 bp, Homo sapiens
tctgtgtggcaaattaa

SEQ ID NO: 6475491 - DNA, 21 bp, Homo sapiens
tctgtgtggccagcagcctct

SEQ ID NO: 6475492 - DNA, 20 bp, Homo sapiens
tctgtgtgggactgtacaca

SEQ ID NO: 6475493 - DNA, 22 bp, Homo sapiens
tctgtgtggggttctcagtgcc

SEQ ID NO: 6475494 - DNA, 16 bp, Homo sapiens
tctgtgtggtatattg

SEQ ID NO: 6475495 - DNA, 18 bp, Homo sapiens
tctgtgtggtctccagct

SEQ ID NO: 6475496 - DNA, 17 bp, Homo sapiens
tctgtgtggtgcattcc

SEQ ID NO: 6475497 - DNA, 19 bp, Homo sapiens
tctgtgtggtgcattcctg

SEQ ID NO: 6475498 - DNA, 19 bp, Homo sapiens
tctgtgtggtggagccagg

SEQ ID NO: 6475499 - DNA, 21 bp, Homo sapiens
tctgtgtgtatattgagaatc

SEQ ID NO: 6475500 - DNA, 18 bp, Homo sapiens
tctgtgtgtcagttttca

SEQ ID NO: 6475501 - DNA, 19 bp, Homo sapiens
tctgtgtgtcagttttcat

SEQ ID NO: 6475502 - DNA, 16 bp, Homo sapiens
tctgtgtgtctgatgt

SEQ ID NO: 6475503 - DNA, 18 bp, Homo sapiens
tctgtgtgtgacccctcc

SEQ ID NO: 6475504 - DNA, 19 bp, Homo sapiens
tctgtgtgtgacccctcct

SEQ ID NO: 6475505 - DNA, 18 bp, Homo sapiens
tctgtgtgtgtgtatgtg

SEQ ID NO: 6475506 - DNA, 23 bp, Homo sapiens
tctgtgtgtgttcttcaagccag

SEQ ID NO: 6475507 - DNA, 12 bp, Homo sapiens
tctgtgtgttcc

SEQ ID NO: 6475508 - DNA, 15 bp, Homo sapiens
tctgtgtgtttgtgt

SEQ ID NO: 6475509 - DNA, 15 bp, Homo sapiens
tctgtgttcccagag

SEQ ID NO: 6475510 - DNA, 20 bp, Homo sapiens
tctgtgttcccagaggcagg

SEQ ID NO: 6475511 - DNA, 18 bp, Homo sapiens
tctgtgttctaacttatt

SEQ ID NO: 6475512 - DNA, 22 bp, Homo sapiens
tctgtgttctcaacacacagta

SEQ ID NO: 6475513 - DNA, 13 bp, Homo sapiens
tctgtgttgcttc

SEQ ID NO: 6475514 - DNA, 23 bp, Homo sapiens
tctgtgttggcccaagctcttgt

SEQ ID NO: 6475515 - DNA, 12 bp, Homo sapiens
tctgtgtttaaa

SEQ ID NO: 6475516 - DNA, 19 bp, Homo sapiens
tctgtgtttaatttcttca

SEQ ID NO: 6475517 - DNA, 23 bp, Homo sapiens
tctgtgtttaatttcttcaaaat

SEQ ID NO: 6475518 - DNA, 12 bp, Homo sapiens
tctgtgtttaca

SEQ ID NO: 6475519 - DNA, 14 bp, Homo sapiens
tctgtgtttacaga

SEQ ID NO: 6475520 - DNA, 12 bp, Homo sapiens
tctgtgtttatt

SEQ ID NO: 6475521 - DNA, 14 bp, Homo sapiens
tctgtgtttctgga

SEQ ID NO: 6475522 - DNA, 15 bp, Homo sapiens
tctgtgtttctggag

SEQ ID NO: 6475523 - DNA, 20 bp, Homo sapiens
tctgtgtttgaccttcacat

SEQ ID NO: 6475524 - DNA, 14 bp, Homo sapiens
tctgtgttttcaga

SEQ ID NO: 6475525 - DNA, 18 bp, Homo sapiens
tctgtgttttgaaagaat

SEQ ID NO: 6475526 - DNA, 20 bp, Homo sapiens
tctgttaaaactcaaggctt

SEQ ID NO: 6475527 - DNA, 20 bp, Homo sapiens
tctgttaaaatctattctgt

SEQ ID NO: 6475528 - DNA, 13 bp, Homo sapiens
tctgttaaaatgc

SEQ ID NO: 6475529 - DNA, 15 bp, Homo sapiens
tctgttaaaatgcat

SEQ ID NO: 6475530 - DNA, 22 bp, Homo sapiens
tctgttaaatatttttgtacat

SEQ ID NO: 6475531 - DNA, 16 bp, Homo sapiens
tctgttaactgaatac

SEQ ID NO: 6475532 - DNA, 17 bp, Homo sapiens
tctgttaactgaatacc

SEQ ID NO: 6475533 - DNA, 16 bp, Homo sapiens
tctgttaagaaaggat

SEQ ID NO: 6475534 - DNA, 18 bp, Homo sapiens
tctgttaagaaaggatat

SEQ ID NO: 6475535 - DNA, 18 bp, Homo sapiens
tctgttaaggttgaactt

SEQ ID NO: 6475536 - DNA, 19 bp, Homo sapiens
tctgttaaggttgaacttt

SEQ ID NO: 6475537 - DNA, 17 bp, Homo sapiens
tctgttaagtggtttca

SEQ ID NO: 6475538 - DNA, 17 bp, Homo sapiens
tctgttaatctttttca

SEQ ID NO: 6475539 - DNA, 21 bp, Homo sapiens
tctgttaatgcattctttctt

SEQ ID NO: 6475540 - DNA, 16 bp, Homo sapiens
tctgttaatgttaatt

SEQ ID NO: 6475541 - DNA, 20 bp, Homo sapiens
tctgttaatgttaattaaag

SEQ ID NO: 6475542 - DNA, 15 bp, Homo sapiens
tctgttacaaaagaa

SEQ ID NO: 6475543 - DNA, 14 bp, Homo sapiens
tctgttacaaaatg

SEQ ID NO: 6475544 - DNA, 22 bp, Homo sapiens
tctgttacaaaatgtaactgtt

SEQ ID NO: 6475545 - DNA, 20 bp, Homo sapiens
tctgttacacaaagaaccac

SEQ ID NO: 6475546 - DNA, 19 bp, Homo sapiens
tctgttacacaatatgtgt

SEQ ID NO: 6475547 - DNA, 19 bp, Homo sapiens
tctgttacactttttggaa

SEQ ID NO: 6475548 - DNA, 20 bp, Homo sapiens
tctgttaccataagtctgat

SEQ ID NO: 6475549 - DNA, 13 bp, Homo sapiens
tctgttacccagg

SEQ ID NO: 6475550 - DNA, 23 bp, Homo sapiens
tctgttacccagggctctgcagc

SEQ ID NO: 6475551 - DNA, 20 bp, Homo sapiens
tctgttacctctgacatcaa

SEQ ID NO: 6475552 - DNA, 19 bp, Homo sapiens
tctgttactccaaaaagaa

SEQ ID NO: 6475553 - DNA, 22 bp, Homo sapiens
tctgttactccaaaaagaaata

SEQ ID NO: 6475554 - DNA, 21 bp, Homo sapiens
tctgttactccattactgtga

SEQ ID NO: 6475555 - DNA, 12 bp, Homo sapiens
tctgttactgaa

SEQ ID NO: 6475556 - DNA, 15 bp, Homo sapiens
tctgttactgaaatg

SEQ ID NO: 6475557 - DNA, 13 bp, Homo sapiens
tctgttagatgct

SEQ ID NO: 6475558 - DNA, 14 bp, Homo sapiens
tctgttagatgcta

SEQ ID NO: 6475559 - DNA, 14 bp, Homo sapiens
tctgttagctgctc

SEQ ID NO: 6475560 - DNA, 18 bp, Homo sapiens
tctgttagctgctcactt

SEQ ID NO: 6475561 - DNA, 14 bp, Homo sapiens
tctgttagggcctt

SEQ ID NO: 6475562 - DNA, 14 bp, Homo sapiens
tctgttatacccca

SEQ ID NO: 6475563 - DNA, 18 bp, Homo sapiens
tctgttatataaatggtt

SEQ ID NO: 6475564 - DNA, 19 bp, Homo sapiens
tctgttatatcccctgcta

SEQ ID NO: 6475565 - DNA, 18 bp, Homo sapiens
tctgttatctcaggtgag

SEQ ID NO: 6475566 - DNA, 17 bp, Homo sapiens
tctgttatgctgtgaca

SEQ ID NO: 6475567 - DNA, 19 bp, Homo sapiens
tctgttatgtactgtacta

SEQ ID NO: 6475568 - DNA, 23 bp, Homo sapiens
tctgttattcttcaaacacaagt

SEQ ID NO: 6475569 - DNA, 14 bp, Homo sapiens
tctgttattgtatt

SEQ ID NO: 6475570 - DNA, 17 bp, Homo sapiens
tctgttatttatttcag

SEQ ID NO: 6475571 - DNA, 22 bp, Homo sapiens
tctgttcacagtctctggaaaa

SEQ ID NO: 6475572 - DNA, 17 bp, Homo sapiens
tctgttcagattaaaaa

SEQ ID NO: 6475573 - DNA, 14 bp, Homo sapiens
tctgttcagcgttt

SEQ ID NO: 6475574 - DNA, 19 bp, Homo sapiens
tctgttcagcgttttgcaa

SEQ ID NO: 6475575 - DNA, 19 bp, Homo sapiens
tctgttcagttaagttctt

SEQ ID NO: 6475576 - DNA, 17 bp, Homo sapiens
tctgttcagtttcccca

SEQ ID NO: 6475577 - DNA, 15 bp, Homo sapiens
tctgttcatctcttt

SEQ ID NO: 6475578 - DNA, 19 bp, Homo sapiens
tctgttcatctctttgtcc

SEQ ID NO: 6475579 - DNA, 14 bp, Homo sapiens
tctgttcatttcta

SEQ ID NO: 6475580 - DNA, 13 bp, Homo sapiens
tctgttccaaatt

SEQ ID NO: 6475581 - DNA, 17 bp, Homo sapiens
tctgttccaaattcagt

SEQ ID NO: 6475582 - DNA, 18 bp, Homo sapiens
tctgttccaacctcctgc

SEQ ID NO: 6475583 - DNA, 15 bp, Homo sapiens
tctgttccaagtgtg

SEQ ID NO: 6475584 - DNA, 18 bp, Homo sapiens
tctgttccaagtgtgtgt

SEQ ID NO: 6475585 - DNA, 16 bp, Homo sapiens
tctgttccaggtttct

SEQ ID NO: 6475586 - DNA, 23 bp, Homo sapiens
tctgttccaggtttttctggcat

SEQ ID NO: 6475587 - DNA, 15 bp, Homo sapiens
tctgttcccagcccc

SEQ ID NO: 6475588 - DNA, 16 bp, Homo sapiens
tctgttcccagcccct

SEQ ID NO: 6475589 - DNA, 21 bp, Homo sapiens
tctgttcccagcccctcctcc

SEQ ID NO: 6475590 - DNA, 22 bp, Homo sapiens
tctgttcccagcccctcctccc

SEQ ID NO: 6475591 - DNA, 23 bp, Homo sapiens
tctgttcccagcccctcctccct

SEQ ID NO: 6475592 - DNA, 22 bp, Homo sapiens
tctgttcccagcccctgcagat

SEQ ID NO: 6475593 - DNA, 14 bp, Homo sapiens
tctgttccccaccc

SEQ ID NO: 6475594 - DNA, 18 bp, Homo sapiens
tctgttcccccaccctcc

SEQ ID NO: 6475595 - DNA, 23 bp, Homo sapiens
tctgttcccctgtcctgtgaatg

SEQ ID NO: 6475596 - DNA, 20 bp, Homo sapiens
tctgttccctatggagaggc

SEQ ID NO: 6475597 - DNA, 19 bp, Homo sapiens
tctgttcccttcctcaccc

SEQ ID NO: 6475598 - DNA, 22 bp, Homo sapiens
tctgttcccttcctctgtgcca

SEQ ID NO: 6475599 - DNA, 22 bp, Homo sapiens
tctgttcctggctcagcctcaa

SEQ ID NO: 6475600 - DNA, 15 bp, Homo sapiens
tgctccaatttcccc

SEQ ID NO: 6475601 - DNA, 15 bp, Homo sapiens
tgctccacactcaga

SEQ ID NO: 6475602 - DNA, 12 bp, Homo sapiens
tgctccacagtg

SEQ ID NO: 6475603 - DNA, 15 bp, Homo sapiens
tgctccaccccactc

SEQ ID NO: 6475604 - DNA, 16 bp, Homo sapiens
tgctccacccttggcc

SEQ ID NO: 6475605 - DNA, 21 bp, Homo sapiens
tgctccaccttgaacctgtca

SEQ ID NO: 6475606 - DNA, 21 bp, Homo sapiens
tgctccacctttcagcccacg

SEQ ID NO: 6475607 - DNA, 16 bp, Homo sapiens
tgctccagaagatgcc

SEQ ID NO: 6475608 - DNA, 22 bp, Homo sapiens
tgctccagaagatgccagcttc

SEQ ID NO: 6475609 - DNA, 14 bp, Homo sapiens
tgctccagacctga

SEQ ID NO: 6475610 - DNA, 19 bp, Homo sapiens
tgctccagacctgcccctc

SEQ ID NO: 6475611 - DNA, 20 bp, Homo sapiens
tgctccagacctgcccctcc

SEQ ID NO: 6475612 - DNA, 17 bp, Homo sapiens
tgctccagattctgatg

SEQ ID NO: 6475613 - DNA, 19 bp, Homo sapiens
tgctccagcaactgccctt

SEQ ID NO: 6475614 - DNA, 20 bp, Homo sapiens
tgctccagcactcaataaag

SEQ ID NO: 6475615 - DNA, 15 bp, Homo sapiens
tgctccagcagcaca

SEQ ID NO: 6475616 - DNA, 16 bp, Homo sapiens
tgctccagcagcacac

SEQ ID NO: 6475617 - DNA, 21 bp, Homo sapiens
tgctccagcagcacacctcag

SEQ ID NO: 6475618 - DNA, 19 bp, Homo sapiens
tgctccagcagtgctgggc

SEQ ID NO: 6475619 - DNA, 21 bp, Homo sapiens
tgctccagcagtgctgggccc

SEQ ID NO: 6475620 - DNA, 19 bp, Homo sapiens
tgctccagcctctgccgct

SEQ ID NO: 6475621 - DNA, 12 bp, Homo sapiens
tgctccagcctg

SEQ ID NO: 6475622 - DNA, 17 bp, Homo sapiens
tgctccagcctgacaac

SEQ ID NO: 6475623 - DNA, 13 bp, Homo sapiens
tgctccagcctgg

SEQ ID NO: 6475624 - DNA, 12 bp, Homo sapiens
tgctccagctct

SEQ ID NO: 6475625 - DNA, 19 bp, Homo sapiens
tgctccagctctggcatgg

SEQ ID NO: 6475626 - DNA, 18 bp, Homo sapiens
tgctccagctgtcgtctg

SEQ ID NO: 6475627 - DNA, 13 bp, Homo sapiens
tgctccaggcctg

SEQ ID NO: 6475628 - DNA, 14 bp, Homo sapiens
tgctccaggcctgc

SEQ ID NO: 6475629 - DNA, 16 bp, Homo sapiens
tgctccaggcctgcag

SEQ ID NO: 6475630 - DNA, 17 bp, Homo sapiens
tgctccaggcttcctgc

SEQ ID NO: 6475631 - DNA, 20 bp, Homo sapiens
tgctccaggcttcctgccct

SEQ ID NO: 6475632 - DNA, 24 bp, Homo sapiens
tgctccaggcttcctgccctagca

SEQ ID NO: 6475633 - DNA, 12 bp, Homo sapiens
tgctccagggtc

SEQ ID NO: 6475634 - DNA, 15 bp, Homo sapiens
tgctccagggtcagg

SEQ ID NO: 6475635 - DNA, 23 bp, Homo sapiens
tgctccagtataaattacatgca

SEQ ID NO: 6475636 - DNA, 23 bp, Homo sapiens
tgctccagtcaacaaactatttc

SEQ ID NO: 6475637 - DNA, 18 bp, Homo sapiens
tgctccataccttttctc

SEQ ID NO: 6475638 - DNA, 15 bp, Homo sapiens
tgctccatagagcag

SEQ ID NO: 6475639 - DNA, 23 bp, Homo sapiens
tgctccatagtttggcatttgca

SEQ ID NO: 6475640 - DNA, 15 bp, Homo sapiens
tgctccatatttgat

SEQ ID NO: 6475641 - DNA, 12 bp, Homo sapiens
tgctccatctcc

SEQ ID NO: 6475642 - DNA, 24 bp, Homo sapiens
tgctccatctccgcctccacactg

SEQ ID NO: 6475643 - DNA, 20 bp, Homo sapiens
tgctccatgactggctgtct

SEQ ID NO: 6475644 - DNA, 13 bp, Homo sapiens
tgctccatgcaga

SEQ ID NO: 6475645 - DNA, 19 bp, Homo sapiens
tgctccatggatgcatgcc

SEQ ID NO: 6475646 - DNA, 14 bp, Homo sapiens
tgctccattcctga

SEQ ID NO: 6475647 - DNA, 23 bp, Homo sapiens
tgctccatttataaccccagcct

SEQ ID NO: 6475648 - DNA, 18 bp, Homo sapiens
tgctccattttcttgtca

SEQ ID NO: 6475649 - DNA, 18 bp, Homo sapiens
tgctcccaaatgcagctt

SEQ ID NO: 6475650 - DNA, 15 bp, Homo sapiens
tgctcccaagcccct

SEQ ID NO: 6475651 - DNA, 16 bp, Homo sapiens
tgctcccaagcccctg

SEQ ID NO: 6475652 - DNA, 19 bp, Homo sapiens
tgctcccaagcccctgacc

SEQ ID NO: 6475653 - DNA, 21 bp, Homo sapiens
tgctcccaaggggcctgagca

SEQ ID NO: 6475654 - DNA, 22 bp, Homo sapiens
tgctcccaaggggcctgagcag

SEQ ID NO: 6475655 - DNA, 13 bp, Homo sapiens
tgctcccacccca

SEQ ID NO: 6475656 - DNA, 19 bp, Homo sapiens
tgctcccaccccagaaatc

SEQ ID NO: 6475657 - DNA, 22 bp, Homo sapiens
tgctcccaccccagaaatcact

SEQ ID NO: 6475658 - DNA, 23 bp, Homo sapiens
tgctcccaccccagaaatcactg

SEQ ID NO: 6475659 - DNA, 15 bp, Homo sapiens
tgctcccacctcctg

SEQ ID NO: 6475660 - DNA, 15 bp, Homo sapiens
tgctcccacctggct

SEQ ID NO: 6475661 - DNA, 22 bp, Homo sapiens
tgctcccacggggaccactggg

SEQ ID NO: 6475662 - DNA, 17 bp, Homo sapiens
tgctcccagcagcccta

SEQ ID NO: 6475663 - DNA, 18 bp, Homo sapiens
tgctcccagcatttgtcc

SEQ ID NO: 6475664 - DNA, 17 bp, Homo sapiens
tgctcccagcctgctga

SEQ ID NO: 6475665 - DNA, 12 bp, Homo sapiens
tgctcccaggat

SEQ ID NO: 6475666 - DNA, 18 bp, Homo sapiens
tgctcccaggccccaggc

SEQ ID NO: 6475667 - DNA, 23 bp, Homo sapiens
tgctcccaggccccaggcctgtg

SEQ ID NO: 6475668 - DNA, 16 bp, Homo sapiens
tgctcccagtcctgcc

SEQ ID NO: 6475669 - DNA, 19 bp, Homo sapiens
tgctcccagtgccaaactt

SEQ ID NO: 6475670 - DNA, 22 bp, Homo sapiens
tgctcccagtgggagcttcccg

SEQ ID NO: 6475671 - DNA, 23 bp, Homo sapiens
tgctcccagtgggagcttcccgg

SEQ ID NO: 6475672 - DNA, 16 bp, Homo sapiens
tgctcccatctcctga

SEQ ID NO: 6475673 - DNA, 20 bp, Homo sapiens
tgctcccattcctccctccg

SEQ ID NO: 6475674 - DNA, 20 bp, Homo sapiens
tgctccccacagcgtccctg

SEQ ID NO: 6475675 - DNA, 22 bp, Homo sapiens
tgctccccacagcgtccctggc

SEQ ID NO: 6475676 - DNA, 22 bp, Homo sapiens
tgctccccagccctggctctgc

SEQ ID NO: 6475677 - DNA, 16 bp, Homo sapiens
tgctccccaggccacc

SEQ ID NO: 6475678 - DNA, 23 bp, Homo sapiens
tgctcccccaccccctccccagg

SEQ ID NO: 6475679 - DNA, 19 bp, Homo sapiens
tgctcccccatcctcccct

SEQ ID NO: 6475680 - DNA, 21 bp, Homo sapiens
tgctcccccatcctccccttc

SEQ ID NO: 6475681 - DNA, 22 bp, Homo sapiens
tgctcccccatcctccccttcc

SEQ ID NO: 6475682 - DNA, 23 bp, Homo sapiens
tgctcccccatcctccccttccc

SEQ ID NO: 6475683 - DNA, 15 bp, Homo sapiens
tgctcccccgccctg

SEQ ID NO: 6475684 - DNA, 15 bp, Homo sapiens
tgctcccctctgaaa

SEQ ID NO: 6475685 - DNA, 21 bp, Homo sapiens
tgctcccctgagaccaccccc

SEQ ID NO: 6475686 - DNA, 24 bp, Homo sapiens
tgctcccctgccacactgatggct

SEQ ID NO: 6475687 - DNA, 16 bp, Homo sapiens
tgctcccctgctcggc

SEQ ID NO: 6475688 - DNA, 18 bp, Homo sapiens
tgctcccctgtgccagcc

SEQ ID NO: 6475689 - DNA, 16 bp, Homo sapiens
tgctccccttcccctt

SEQ ID NO: 6475690 - DNA, 13 bp, Homo sapiens
tgctcccctttgg

SEQ ID NO: 6475691 - DNA, 18 bp, Homo sapiens
tgctcccgccccagggtc

SEQ ID NO: 6475692 - DNA, 23 bp, Homo sapiens
tgctcccgccccagggtctgaaa

SEQ ID NO: 6475693 - DNA, 23 bp, Homo sapiens
tgctcccgcctgattggggcctc

SEQ ID NO: 6475694 - DNA, 18 bp, Homo sapiens
tgctccctaagccagcct

SEQ ID NO: 6475695 - DNA, 20 bp, Homo sapiens
tgctccctaagccagcctgg

SEQ ID NO: 6475696 - DNA, 15 bp, Homo sapiens
tgctccctcacatgt

SEQ ID NO: 6475697 - DNA, 14 bp, Homo sapiens
tgctccctcagact

SEQ ID NO: 6475698 - DNA, 19 bp, Homo sapiens
tgctccctcagactggggc

SEQ ID NO: 6475699 - DNA, 17 bp, Homo sapiens
tgctccctcagcctcag

SEQ ID NO: 6475700 - DNA, 18 bp, Homo sapiens
tgctccctcagcctcaga

SEQ ID NO: 6475701 - DNA, 13 bp, Homo sapiens
tgctccctccaga

SEQ ID NO: 6475702 - DNA, 17 bp, Homo sapiens
tgctccctcccctgccc

SEQ ID NO: 6475703 - DNA, 20 bp, Homo sapiens
tgctccctcccctgccctgg

SEQ ID NO: 6475704 - DNA, 23 bp, Homo sapiens
tgctccctctccaagacagcagc

SEQ ID NO: 6475705 - DNA, 22 bp, Homo sapiens
tgctccctctctccacacggag

SEQ ID NO: 6475706 - DNA, 14 bp, Homo sapiens
tgctccctgaagcc

SEQ ID NO: 6475707 - DNA, 17 bp, Homo sapiens
tgctccctgaagccagc

SEQ ID NO: 6475708 - DNA, 19 bp, Homo sapiens
tgctccctgaagccagcct

SEQ ID NO: 6475709 - DNA, 13 bp, Homo sapiens
tgctccctgactg

SEQ ID NO: 6475710 - DNA, 14 bp, Homo sapiens
tgctccctgactgg

SEQ ID NO: 6475711 - DNA, 22 bp, Homo sapiens
tgctccctgattaaagtgcctt

SEQ ID NO: 6475712 - DNA, 21 bp, Homo sapiens
tgctccctgcaagctccgcct

SEQ ID NO: 6475713 - DNA, 17 bp, Homo sapiens
tgctccctgcctcctgc

SEQ ID NO: 6475714 - DNA, 15 bp, Homo sapiens
tgctccctgctccca

SEQ ID NO: 6475715 - DNA, 19 bp, Homo sapiens
tgctccctgctcccaggga

SEQ ID NO: 6475716 - DNA, 19 bp, Homo sapiens
tgctccctggaggcacgca

SEQ ID NO: 6475717 - DNA, 12 bp, Homo sapiens
tgctccctgtct

SEQ ID NO: 6475718 - DNA, 15 bp, Homo sapiens
tgctccctgtctgtg

SEQ ID NO: 6475719 - DNA, 18 bp, Homo sapiens
tgctccctgtctgtgtcc

SEQ ID NO: 6475720 - DNA, 21 bp, Homo sapiens
tgctccctgtctgtgtcccag

SEQ ID NO: 6475721 - DNA, 22 bp, Homo sapiens
tgctccctgtctgtgtcccagc

SEQ ID NO: 6475722 - DNA, 12 bp, Homo sapiens
tgctccctgtgt

SEQ ID NO: 6475723 - DNA, 12 bp, Homo sapiens
tgctcccttcaa

SEQ ID NO: 6475724 - DNA, 20 bp, Homo sapiens
tgctcccttcgctctgctgg

SEQ ID NO: 6475725 - DNA, 12 bp, Homo sapiens
tgctccctttta

SEQ ID NO: 6475726 - DNA, 18 bp, Homo sapiens
tgctccgaggacccagga

SEQ ID NO: 6475727 - DNA, 17 bp, Homo sapiens
tgctccgaggactggac

SEQ ID NO: 6475728 - DNA, 15 bp, Homo sapiens
tgctccgccaggaag

SEQ ID NO: 6475729 - DNA, 15 bp, Homo sapiens
tgctccgccatggtg

SEQ ID NO: 6475730 - DNA, 23 bp, Homo sapiens
tgctccgcccgctcctgccgcag

SEQ ID NO: 6475731 - DNA, 17 bp, Homo sapiens
tgctccgctcccaccgc

SEQ ID NO: 6475732 - DNA, 20 bp, Homo sapiens
tgctccgctgctccttggct

SEQ ID NO: 6475733 - DNA, 16 bp, Homo sapiens
tgctccggcctgcgtc

SEQ ID NO: 6475734 - DNA, 16 bp, Homo sapiens
tgctccgtagctctgc

SEQ ID NO: 6475735 - DNA, 14 bp, Homo sapiens
tgctccgtgcctcc

SEQ ID NO: 6475736 - DNA, 16 bp, Homo sapiens
tgctccgtgcctccac

SEQ ID NO: 6475737 - DNA, 13 bp, Homo sapiens
tgctccgtggact

SEQ ID NO: 6475738 - DNA, 17 bp, Homo sapiens
tgctccgtggaggaggt

SEQ ID NO: 6475739 - DNA, 19 bp, Homo sapiens
tgctccgtgtgtctcatgc

SEQ ID NO: 6475740 - DNA, 14 bp, Homo sapiens
tgctcctacatcca

SEQ ID NO: 6475741 - DNA, 22 bp, Homo sapiens
tgctcctacatccagctcctct

SEQ ID NO: 6475742 - DNA, 19 bp, Homo sapiens
tgctcctagagaggagaaa

SEQ ID NO: 6475743 - DNA, 24 bp, Homo sapiens
tgctcctagagggaggggcctagg

SEQ ID NO: 6475744 - DNA, 12 bp, Homo sapiens
tgctcctcaccc

SEQ ID NO: 6475745 - DNA, 10 bp, Homo sapiens
tgctcctcat

SEQ ID NO: 6475746 - DNA, 14 bp, Homo sapiens
tgctcctcatctgc

SEQ ID NO: 6475747 - DNA, 12 bp, Homo sapiens
tgctcctcatgg

SEQ ID NO: 6475748 - DNA, 12 bp, Homo sapiens
tgctcctccagg

SEQ ID NO: 6475749 - DNA, 21 bp, Homo sapiens
tgctcctccagtacaataaat

SEQ ID NO: 6475750 - DNA, 11 bp, Homo sapiens
tgctcctccct

SEQ ID NO: 6475751 - DNA, 12 bp, Homo sapiens
tgctcctccctc

SEQ ID NO: 6475752 - DNA, 14 bp, Homo sapiens
tgctcctccctccc

SEQ ID NO: 6475753 - DNA, 15 bp, Homo sapiens
tgctcctccctctga

SEQ ID NO: 6475754 - DNA, 13 bp, Homo sapiens
tgctcctccctgc

SEQ ID NO: 6475755 - DNA, 15 bp, Homo sapiens
tgctcctccctgccc

SEQ ID NO: 6475756 - DNA, 18 bp, Homo sapiens
tgctcctccctgcccccc

SEQ ID NO: 6475757 - DNA, 15 bp, Homo sapiens
tgctcctccctggct

SEQ ID NO: 6475758 - DNA, 23 bp, Homo sapiens
tgctcctccctggctgccctggc

SEQ ID NO: 6475759 - DNA, 11 bp, Homo sapiens
tgctcctcctg

SEQ ID NO: 6475760 - DNA, 13 bp, Homo sapiens
tgctcctcctgcc

SEQ ID NO: 6475761 - DNA, 19 bp, Homo sapiens
tgctcctcggccagagctc

SEQ ID NO: 6475762 - DNA, 11 bp, Homo sapiens
tgctcctctcc

SEQ ID NO: 6475763 - DNA, 15 bp, Homo sapiens
tgctcctctccaggc

SEQ ID NO: 6475764 - DNA, 18 bp, Homo sapiens
tgctcctctccccagcaa

SEQ ID NO: 6475765 - DNA, 21 bp, Homo sapiens
tgctcctctcgcacaatgcat

SEQ ID NO: 6475766 - DNA, 15 bp, Homo sapiens
tgctcctctcttggg

SEQ ID NO: 6475767 - DNA, 14 bp, Homo sapiens
tgctcctctgcctg

SEQ ID NO: 6475768 - DNA, 15 bp, Homo sapiens
tgctcctcttcccca

SEQ ID NO: 6475769 - DNA, 22 bp, Homo sapiens
tgctcctcttgttcctgaaatg

SEQ ID NO: 6475770 - DNA, 14 bp, Homo sapiens
tgctcctctttccc

SEQ ID NO: 6475771 - DNA, 19 bp, Homo sapiens
tgctcctctttcccctcct

SEQ ID NO: 6475772 - DNA, 23 bp, Homo sapiens
tgctcctgaaccagtcctgctgc

SEQ ID NO: 6475773 - DNA, 23 bp, Homo sapiens
tgctcctgacttagcccgtcacc

SEQ ID NO: 6475774 - DNA, 16 bp, Homo sapiens
tgctcctgagccccca

SEQ ID NO: 6475775 - DNA, 13 bp, Homo sapiens
tgctcctgcccac

SEQ ID NO: 6475776 - DNA, 15 bp, Homo sapiens
tgctcctgcccagcc

SEQ ID NO: 6475777 - DNA, 15 bp, Homo sapiens
tgctcctgcttttct

SEQ ID NO: 6475778 - DNA, 22 bp, Homo sapiens
tgctcctgcttttctgtcctgg

SEQ ID NO: 6475779 - DNA, 15 bp, Homo sapiens
tctgttccttcacat

SEQ ID NO: 6475780 - DNA, 18 bp, Homo sapiens
tctgttccttcctccact

SEQ ID NO: 6475781 - DNA, 19 bp, Homo sapiens
tctgttcctttctctgggc

SEQ ID NO: 6475782 - DNA, 22 bp, Homo sapiens
tctgttccttttctctcctgtg

SEQ ID NO: 6475783 - DNA, 20 bp, Homo sapiens
tctgttctacatagatgctt

SEQ ID NO: 6475784 - DNA, 14 bp, Homo sapiens
tctgttctacccgt

SEQ ID NO: 6475785 - DNA, 14 bp, Homo sapiens
tctgttctactctt

SEQ ID NO: 6475786 - DNA, 17 bp, Homo sapiens
tctgttctacttgatat

SEQ ID NO: 6475787 - DNA, 20 bp, Homo sapiens
tctgttctagttttttactt

SEQ ID NO: 6475788 - DNA, 12 bp, Homo sapiens
tctgttctatgg

SEQ ID NO: 6475789 - DNA, 13 bp, Homo sapiens
tctgttctcacat

SEQ ID NO: 6475790 - DNA, 17 bp, Homo sapiens
tctgttctctcccctca

SEQ ID NO: 6475791 - DNA, 12 bp, Homo sapiens
tctgttctctgc

SEQ ID NO: 6475792 - DNA, 14 bp, Homo sapiens
tctgttctctgctg

SEQ ID NO: 6475793 - DNA, 15 bp, Homo sapiens
tctgttctctgctga

SEQ ID NO: 6475794 - DNA, 16 bp, Homo sapiens
tctgttctgatattaa

SEQ ID NO: 6475795 - DNA, 23 bp, Homo sapiens
tctgttctgccccctcagggatg

SEQ ID NO: 6475796 - DNA, 18 bp, Homo sapiens
tctgttctgctcccagat

SEQ ID NO: 6475797 - DNA, 17 bp, Homo sapiens
tctgttctggtggcccc

SEQ ID NO: 6475798 - DNA, 18 bp, Homo sapiens
tctgttctggtggcccca

SEQ ID NO: 6475799 - DNA, 12 bp, Homo sapiens
tctgttctgtgg

SEQ ID NO: 6475800 - DNA, 15 bp, Homo sapiens
tctgttcttacaaat

SEQ ID NO: 6475801 - DNA, 16 bp, Homo sapiens
tctgttcttacaaatg

SEQ ID NO: 6475802 - DNA, 19 bp, Homo sapiens
tctgttcttcctcagccag

SEQ ID NO: 6475803 - DNA, 18 bp, Homo sapiens
tctgttctttaatttatt

SEQ ID NO: 6475804 - DNA, 22 bp, Homo sapiens
tctgttctttccaaagtacact

SEQ ID NO: 6475805 - DNA, 13 bp, Homo sapiens
tctgttgaacagc

SEQ ID NO: 6475806 - DNA, 12 bp, Homo sapiens
tctgttgaagtt

SEQ ID NO: 6475807 - DNA, 13 bp, Homo sapiens
tctgttgaccagg

SEQ ID NO: 6475808 - DNA, 13 bp, Homo sapiens
tctgttgacctgt

SEQ ID NO: 6475809 - DNA, 16 bp, Homo sapiens
tctgttgcaagtgcaa

SEQ ID NO: 6475810 - DNA, 16 bp, Homo sapiens
tctgttgcaattagga

SEQ ID NO: 6475811 - DNA, 18 bp, Homo sapiens
tctgttgccacaaccctg

SEQ ID NO: 6475812 - DNA, 22 bp, Homo sapiens
tctgttgccacccaggtgatgt

SEQ ID NO: 6475813 - DNA, 15 bp, Homo sapiens
tctgttgccaggcta

SEQ ID NO: 6475814 - DNA, 12 bp, Homo sapiens
tctgttgcccag

SEQ ID NO: 6475815 - DNA, 13 bp, Homo sapiens
tctgttgcccagg

SEQ ID NO: 6475816 - DNA, 20 bp, Homo sapiens
tctgttgcccaggctggcct

SEQ ID NO: 6475817 - DNA, 21 bp, Homo sapiens
tctgttgcccaggctggcctg

SEQ ID NO: 6475818 - DNA, 12 bp, Homo sapiens
tctgttgcctcc

SEQ ID NO: 6475819 - DNA, 19 bp, Homo sapiens
tctgttgcctcctctctcc

SEQ ID NO: 6475820 - DNA, 19 bp, Homo sapiens
tctgttgccttatttctca

SEQ ID NO: 6475821 - DNA, 15 bp, Homo sapiens
tctgttgctgcctca

SEQ ID NO: 6475822 - DNA, 12 bp, Homo sapiens
tctgttgctggt

SEQ ID NO: 6475823 - DNA, 14 bp, Homo sapiens
tctgttgctggtct

SEQ ID NO: 6475824 - DNA, 13 bp, Homo sapiens
tctgttggagaaa

SEQ ID NO: 6475825 - DNA, 18 bp, Homo sapiens
tctgttggattccatgct

SEQ ID NO: 6475826 - DNA, 23 bp, Homo sapiens
tctgttggccagcacgttctcca

SEQ ID NO: 6475827 - DNA, 17 bp, Homo sapiens
tctgttggccagtgtga

SEQ ID NO: 6475828 - DNA, 12 bp, Homo sapiens
tctgttggccta

SEQ ID NO: 6475829 - DNA, 23 bp, Homo sapiens
tctgttgggtggcatcattccag

SEQ ID NO: 6475830 - DNA, 19 bp, Homo sapiens
tctgttggtccactgtgtt

SEQ ID NO: 6475831 - DNA, 18 bp, Homo sapiens
tctgttggtctacagaaa

SEQ ID NO: 6475832 - DNA, 18 bp, Homo sapiens
tctgttggtctgccttct

SEQ ID NO: 6475833 - DNA, 22 bp, Homo sapiens
tctgttggtctgccttctgctg

SEQ ID NO: 6475834 - DNA, 16 bp, Homo sapiens
tctgttgtaaagagtg

SEQ ID NO: 6475835 - DNA, 12 bp, Homo sapiens
tctgttgtaata

SEQ ID NO: 6475836 - DNA, 19 bp, Homo sapiens
tctgttgtaatttaatgac

SEQ ID NO: 6475837 - DNA, 17 bp, Homo sapiens
tctgttgtactatggaa

SEQ ID NO: 6475838 - DNA, 14 bp, Homo sapiens
tctgttgtcaaact

SEQ ID NO: 6475839 - DNA, 17 bp, Homo sapiens
tctgttgtcaccttcac

SEQ ID NO: 6475840 - DNA, 15 bp, Homo sapiens
tctgttgtcctcccc

SEQ ID NO: 6475841 - DNA, 23 bp, Homo sapiens
tctgttgtcgtaaagatttgggt

SEQ ID NO: 6475842 - DNA, 13 bp, Homo sapiens
tctgttgtctgcg

SEQ ID NO: 6475843 - DNA, 14 bp, Homo sapiens
tctgttgtgttcac

SEQ ID NO: 6475844 - DNA, 20 bp, Homo sapiens
tctgttgtgtttgtcaaaaa

SEQ ID NO: 6475845 - DNA, 19 bp, Homo sapiens
tctgttgttcagtcctctg

SEQ ID NO: 6475846 - DNA, 14 bp, Homo sapiens
tctgttgttccaaa

SEQ ID NO: 6475847 - DNA, 15 bp, Homo sapiens
tctgttgttccattt

SEQ ID NO: 6475848 - DNA, 16 bp, Homo sapiens
tctgttgttctgtggt

SEQ ID NO: 6475849 - DNA, 15 bp, Homo sapiens
tctgttgtttgaaga

SEQ ID NO: 6475850 - DNA, 19 bp, Homo sapiens
tctgttgttttgtgtatat

SEQ ID NO: 6475851 - DNA, 12 bp, Homo sapiens
tctgttgttttt

SEQ ID NO: 6475852 - DNA, 14 bp, Homo sapiens
tctgtttaaagtgg

SEQ ID NO: 6475853 - DNA, 13 bp, Homo sapiens
tctgtttaagaaa

SEQ ID NO: 6475854 - DNA, 19 bp, Homo sapiens
tctgtttaagaaaagtatt

SEQ ID NO: 6475855 - DNA, 15 bp, Homo sapiens
tctgtttaatactca

SEQ ID NO: 6475856 - DNA, 14 bp, Homo sapiens
tctgtttacagtgt

SEQ ID NO: 6475857 - DNA, 18 bp, Homo sapiens
tctgtttaccctccctgt

SEQ ID NO: 6475858 - DNA, 23 bp, Homo sapiens
tctgtttaccctccctgtcccct

SEQ ID NO: 6475859 - DNA, 17 bp, Homo sapiens
tctgtttagaggaggca

SEQ ID NO: 6475860 - DNA, 23 bp, Homo sapiens
tctgtttagataatacaccacta

SEQ ID NO: 6475861 - DNA, 15 bp, Homo sapiens
tctgtttaggaagaa

SEQ ID NO: 6475862 - DNA, 17 bp, Homo sapiens
tctgtttataattgttt

SEQ ID NO: 6475863 - DNA, 16 bp, Homo sapiens
tctgtttatgcttttg

SEQ ID NO: 6475864 - DNA, 20 bp, Homo sapiens
tctgtttatggccacattta

SEQ ID NO: 6475865 - DNA, 12 bp, Homo sapiens
tctgtttatgtt

SEQ ID NO: 6475866 - DNA, 21 bp, Homo sapiens
tctgtttatgttcttgcagca

SEQ ID NO: 6475867 - DNA, 23 bp, Homo sapiens
tctgtttattcttccagaatgct

SEQ ID NO: 6475868 - DNA, 13 bp, Homo sapiens
tctgtttatttga

SEQ ID NO: 6475869 - DNA, 16 bp, Homo sapiens
tctgtttcaaagcaca

SEQ ID NO: 6475870 - DNA, 23 bp, Homo sapiens
tctgtttcaaggcactctagatt

SEQ ID NO: 6475871 - DNA, 19 bp, Homo sapiens
tctgtttcataatgcagaa

SEQ ID NO: 6475872 - DNA, 12 bp, Homo sapiens
tctgtttccata

SEQ ID NO: 6475873 - DNA, 14 bp, Homo sapiens
tctgtttcctcttg

SEQ ID NO: 6475874 - DNA, 12 bp, Homo sapiens
tctgtttcctgt

SEQ ID NO: 6475875 - DNA, 13 bp, Homo sapiens
tctgtttcctttt

SEQ ID NO: 6475876 - DNA, 13 bp, Homo sapiens
tctgtttctagtt

SEQ ID NO: 6475877 - DNA, 16 bp, Homo sapiens
tctgtttctctgctgt

SEQ ID NO: 6475878 - DNA, 18 bp, Homo sapiens
tctgtttctctgctgtca

SEQ ID NO: 6475879 - DNA, 22 bp, Homo sapiens
tctgtttgaaaaacctgttctg

SEQ ID NO: 6475880 - DNA, 14 bp, Homo sapiens
tctgtttgacaaac

SEQ ID NO: 6475881 - DNA, 13 bp, Homo sapiens
tctgtttgccact

SEQ ID NO: 6475882 - DNA, 16 bp, Homo sapiens
tctgtttgcgtacttg

SEQ ID NO: 6475883 - DNA, 22 bp, Homo sapiens
tctgtttgctcacccaggacct

SEQ ID NO: 6475884 - DNA, 21 bp, Homo sapiens
tctgtttggactgcagaagca

SEQ ID NO: 6475885 - DNA, 17 bp, Homo sapiens
tctgtttggcacttgta

SEQ ID NO: 6475886 - DNA, 19 bp, Homo sapiens
tctgtttggcacttgtatt

SEQ ID NO: 6475887 - DNA, 21 bp, Homo sapiens
tctgtttggcacttgtattta

SEQ ID NO: 6475888 - DNA, 13 bp, Homo sapiens
tctgtttgtaaat

SEQ ID NO: 6475889 - DNA, 19 bp, Homo sapiens
tctgtttgtaaattatttg

SEQ ID NO: 6475890 - DNA, 13 bp, Homo sapiens
tctgtttgtatat

SEQ ID NO: 6475891 - DNA, 16 bp, Homo sapiens
tctgtttgtgggactg

SEQ ID NO: 6475892 - DNA, 15 bp, Homo sapiens
tctgtttgtgttatt

SEQ ID NO: 6475893 - DNA, 13 bp, Homo sapiens
tctgttttactgc

SEQ ID NO: 6475894 - DNA, 24 bp, Homo sapiens
tctgttttagttggaatgactgaa

SEQ ID NO: 6475895 - DNA, 20 bp, Homo sapiens
tctgttttatatagaaacac

SEQ ID NO: 6475896 - DNA, 13 bp, Homo sapiens
tctgttttatgac

SEQ ID NO: 6475897 - DNA, 13 bp, Homo sapiens
tctgttttcaagt

SEQ ID NO: 6475898 - DNA, 17 bp, Homo sapiens
tctgttttcaagtgtaa

SEQ ID NO: 6475899 - DNA, 20 bp, Homo sapiens
tctgttttcctttctcaccg

SEQ ID NO: 6475900 - DNA, 21 bp, Homo sapiens
tctgttttcgtaccttcccac

SEQ ID NO: 6475901 - DNA, 12 bp, Homo sapiens
tctgttttctgt

SEQ ID NO: 6475902 - DNA, 13 bp, Homo sapiens
tctgttttctgtg

SEQ ID NO: 6475903 - DNA, 18 bp, Homo sapiens
tctgttttctgtttgtaa

SEQ ID NO: 6475904 - DNA, 19 bp, Homo sapiens
tctgttttctgtttgtaaa

SEQ ID NO: 6475905 - DNA, 18 bp, Homo sapiens
tctgttttgagttttgta

SEQ ID NO: 6475906 - DNA, 15 bp, Homo sapiens
tctgttttgtgagaa

SEQ ID NO: 6475907 - DNA, 16 bp, Homo sapiens
tctgttttgtgagaac

SEQ ID NO: 6475908 - DNA, 14 bp, Homo sapiens
tctgttttgtgcca

SEQ ID NO: 6475909 - DNA, 14 bp, Homo sapiens
tctgttttgtgtct

SEQ ID NO: 6475910 - DNA, 16 bp, Homo sapiens
tctgttttgttaatat

SEQ ID NO: 6475911 - DNA, 22 bp, Homo sapiens
tctgttttgttaatatacccca

SEQ ID NO: 6475912 - DNA, 17 bp, Homo sapiens
tctgttttgtttcttga

SEQ ID NO: 6475913 - DNA, 15 bp, Homo sapiens
tctgtttttaaaaat

SEQ ID NO: 6475914 - DNA, 16 bp, Homo sapiens
tctgtttttctcaaat

SEQ ID NO: 6475915 - DNA, 14 bp, Homo sapiens
tctgtttttctcat

SEQ ID NO: 6475916 - DNA, 18 bp, Homo sapiens
tctgtttttcttctgaaa

SEQ ID NO: 6475917 - DNA, 16 bp, Homo sapiens
tctgtttttgtatctt

SEQ ID NO: 6475918 - DNA, 14 bp, Homo sapiens
tcttaaaaaaataa

SEQ ID NO: 6475919 - DNA, 22 bp, Homo sapiens
tcttaaaaaaataaaatatttt

SEQ ID NO: 6475920 - DNA, 13 bp, Homo sapiens
tcttaaaaaatgt

SEQ ID NO: 6475921 - DNA, 16 bp, Homo sapiens
tcttaaaaaatgtgaa

SEQ ID NO: 6475922 - DNA, 17 bp, Homo sapiens
tcttaaaaaatgtgaaa

SEQ ID NO: 6475923 - DNA, 18 bp, Homo sapiens
tcttaaaaaatgtgaaat

SEQ ID NO: 6475924 - DNA, 20 bp, Homo sapiens
tcttaaaaactgtgtatcat

SEQ ID NO: 6475925 - DNA, 16 bp, Homo sapiens
tcttaaaaagacactt

SEQ ID NO: 6475926 - DNA, 12 bp, Homo sapiens
tcttaaaaagta

SEQ ID NO: 6475927 - DNA, 13 bp, Homo sapiens
tcttaaaaagtaa

SEQ ID NO: 6475928 - DNA, 23 bp, Homo sapiens
tcttaaaaatcttggtttggtac

SEQ ID NO: 6475929 - DNA, 19 bp, Homo sapiens
tcttaaaaatgcatttaag

SEQ ID NO: 6475930 - DNA, 20 bp, Homo sapiens
tcttaaaaattatctttaaa

SEQ ID NO: 6475931 - DNA, 12 bp, Homo sapiens
tcttaaaaattt

SEQ ID NO: 6475932 - DNA, 19 bp, Homo sapiens
tcttaaaacagtgtgtgcc

SEQ ID NO: 6475933 - DNA, 13 bp, Homo sapiens
tcttaaaacctgc

SEQ ID NO: 6475934 - DNA, 19 bp, Homo sapiens
tcttaaaactataacatta

SEQ ID NO: 6475935 - DNA, 19 bp, Homo sapiens
tcttaaaagctatcttcat

SEQ ID NO: 6475936 - DNA, 12 bp, Homo sapiens
tcttaaaagtac

SEQ ID NO: 6475937 - DNA, 18 bp, Homo sapiens
tcttaaaagtactttaaa

SEQ ID NO: 6475938 - DNA, 22 bp, Homo sapiens
tcttaaaagtactttaaaaagg

SEQ ID NO: 6475939 - DNA, 20 bp, Homo sapiens
tcttaaaatacccattgccc

SEQ ID NO: 6475940 - DNA, 19 bp, Homo sapiens
tcttaaaatatagaaaact

SEQ ID NO: 6475941 - DNA, 15 bp, Homo sapiens
tcttaaaatatcttc

SEQ ID NO: 6475942 - DNA, 18 bp, Homo sapiens
tcttaaaatcaaatgtaa

SEQ ID NO: 6475943 - DNA, 20 bp, Homo sapiens
tcttaaaatcaaatgtaaat

SEQ ID NO: 6475944 - DNA, 23 bp, Homo sapiens
tcttaaaatggcaagttttccat

SEQ ID NO: 6475945 - DNA, 23 bp, Homo sapiens
tcttaaaattagtgagattaaaa

SEQ ID NO: 6475946 - DNA, 20 bp, Homo sapiens
tcttaaaattcaagaaaata

SEQ ID NO: 6475947 - DNA, 21 bp, Homo sapiens
tcttaaaattggttaatgaaa

SEQ ID NO: 6475948 - DNA, 13 bp, Homo sapiens
tcttaaacaatgt

SEQ ID NO: 6475949 - DNA, 14 bp, Homo sapiens
tcttaaacaatgta

SEQ ID NO: 6475950 - DNA, 20 bp, Homo sapiens
tcttaaacaatttgtgtaga

SEQ ID NO: 6475951 - DNA, 17 bp, Homo sapiens
tcttaaacataataaat

SEQ ID NO: 6475952 - DNA, 22 bp, Homo sapiens
tcttaaaccaacctttaaaatt

SEQ ID NO: 6475953 - DNA, 23 bp, Homo sapiens
tcttaaaccaacctttaaaattg

SEQ ID NO: 6475954 - DNA, 19 bp, Homo sapiens
tcttaaacccacataaaca

SEQ ID NO: 6475955 - DNA, 16 bp, Homo sapiens
tcttaaaccttcagtt

SEQ ID NO: 6475956 - DNA, 18 bp, Homo sapiens
tcttaaactgaaagcttt

SEQ ID NO: 6475957 - DNA, 15 bp, Homo sapiens
tcttaaacttgtgaa

SEQ ID NO: 6475958 - DNA, 16 bp, Homo sapiens
tcttaaacttgtgaat

SEQ ID NO: 6475959 - DNA, 20 bp, Homo sapiens
tcttaaagaaaacccacccc

SEQ ID NO: 6475960 - DNA, 23 bp, Homo sapiens
tgctcctgcttttctgtcctggg

SEQ ID NO: 6475961 - DNA, 19 bp, Homo sapiens
tgctcctggaacctggcag

SEQ ID NO: 6475962 - DNA, 20 bp, Homo sapiens
tgctcctggaacctggcagg

SEQ ID NO: 6475963 - DNA, 17 bp, Homo sapiens
tgctcctggccttgctg

SEQ ID NO: 6475964 - DNA, 15 bp, Homo sapiens
tgctcctggggagaa

SEQ ID NO: 6475965 - DNA, 23 bp, Homo sapiens
tgctcctgtacttgtcctcagct

SEQ ID NO: 6475966 - DNA, 12 bp, Homo sapiens
tgctcctgtggc

SEQ ID NO: 6475967 - DNA, 17 bp, Homo sapiens
tgctcctgtttaactcc

SEQ ID NO: 6475968 - DNA, 21 bp, Homo sapiens
tgctcctgtttaactccctag

SEQ ID NO: 6475969 - DNA, 17 bp, Homo sapiens
tgctccttcactgttcc

SEQ ID NO: 6475970 - DNA, 19 bp, Homo sapiens
tgctccttcagttctgctt

SEQ ID NO: 6475971 - DNA, 13 bp, Homo sapiens
tgctccttcccca

SEQ ID NO: 6475972 - DNA, 16 bp, Homo sapiens
tgctccttcccttgct

SEQ ID NO: 6475973 - DNA, 23 bp, Homo sapiens
tgctccttgagaggagaaatgca

SEQ ID NO: 6475974 - DNA, 16 bp, Homo sapiens
tgctccttggcacccc

SEQ ID NO: 6475975 - DNA, 18 bp, Homo sapiens
tgctccttggcaccccca

SEQ ID NO: 6475976 - DNA, 17 bp, Homo sapiens
tgctccttggcttacct

SEQ ID NO: 6475977 - DNA, 19 bp, Homo sapiens
tgctccttggcttacctga

SEQ ID NO: 6475978 - DNA, 12 bp, Homo sapiens
tgctccttgggc

SEQ ID NO: 6475979 - DNA, 16 bp, Homo sapiens
tgctccttgggccctt

SEQ ID NO: 6475980 - DNA, 19 bp, Homo sapiens
tgctccttgggccctttga

SEQ ID NO: 6475981 - DNA, 21 bp, Homo sapiens
tgctccttgggccctttgagt

SEQ ID NO: 6475982 - DNA, 14 bp, Homo sapiens
tgctccttgttcct

SEQ ID NO: 6475983 - DNA, 15 bp, Homo sapiens
tgctcctttccatca

SEQ ID NO: 6475984 - DNA, 16 bp, Homo sapiens
tgctcctttccatcag

SEQ ID NO: 6475985 - DNA, 19 bp, Homo sapiens
tgctcctttccatcagctt

SEQ ID NO: 6475986 - DNA, 14 bp, Homo sapiens
tgctcctttcccct

SEQ ID NO: 6475987 - DNA, 17 bp, Homo sapiens
tgctcctttctgcccag

SEQ ID NO: 6475988 - DNA, 18 bp, Homo sapiens
tgctcctttcttgtttta

SEQ ID NO: 6475989 - DNA, 20 bp, Homo sapiens
tgctccttttgtatcttcct

SEQ ID NO: 6475990 - DNA, 14 bp, Homo sapiens
tgctcgaagaacaa

SEQ ID NO: 6475991 - DNA, 23 bp, Homo sapiens
tgctcgagtcacattctgcttaa

SEQ ID NO: 6475992 - DNA, 13 bp, Homo sapiens
tgctcgcagcctg

SEQ ID NO: 6475993 - DNA, 15 bp, Homo sapiens
tgctcgcagcctggc

SEQ ID NO: 6475994 - DNA, 12 bp, Homo sapiens
tgctcgccatca

SEQ ID NO: 6475995 - DNA, 19 bp, Homo sapiens
tgctcgcccacaaactgat

SEQ ID NO: 6475996 - DNA, 19 bp, Homo sapiens
tgctcgcccaggaaggcct

SEQ ID NO: 6475997 - DNA, 23 bp, Homo sapiens
tgctcgcccaggaaggcctaggc

SEQ ID NO: 6475998 - DNA, 16 bp, Homo sapiens
tgctcgccccagcagg

SEQ ID NO: 6475999 - DNA, 13 bp, Homo sapiens
tgctcgccctgcg

SEQ ID NO: 6476000 - DNA, 14 bp, Homo sapiens
tgctcgccctgcgg

SEQ ID NO: 6476001 - DNA, 22 bp, Homo sapiens
tgctcgcctcggatcagctgag

SEQ ID NO: 6476002 - DNA, 23 bp, Homo sapiens
tgctcgcgaaggtcccacagccc

SEQ ID NO: 6476003 - DNA, 14 bp, Homo sapiens
tgctcgctgttgct

SEQ ID NO: 6476004 - DNA, 15 bp, Homo sapiens
tgctcgctgttgctg

SEQ ID NO: 6476005 - DNA, 18 bp, Homo sapiens
tgctcgctgttgctgaat

SEQ ID NO: 6476006 - DNA, 14 bp, Homo sapiens
tgctcgcttgctgg

SEQ ID NO: 6476007 - DNA, 17 bp, Homo sapiens
tgctcgcttgctggaac

SEQ ID NO: 6476008 - DNA, 14 bp, Homo sapiens
tgctcgcttttcct

SEQ ID NO: 6476009 - DNA, 12 bp, Homo sapiens
tgctcggacaca

SEQ ID NO: 6476010 - DNA, 20 bp, Homo sapiens
tgctcggctactggttacct

SEQ ID NO: 6476011 - DNA, 19 bp, Homo sapiens
tgctcgggaaggcctgagg

SEQ ID NO: 6476012 - DNA, 15 bp, Homo sapiens
tgctcgggcccaggc

SEQ ID NO: 6476013 - DNA, 16 bp, Homo sapiens
tgctcgggcccaggcc

SEQ ID NO: 6476014 - DNA, 20 bp, Homo sapiens
tgctcggggtgcacaggagg

SEQ ID NO: 6476015 - DNA, 21 bp, Homo sapiens
tgctcgggtgctgccagctgc

SEQ ID NO: 6476016 - DNA, 15 bp, Homo sapiens
tgctcggtcaggagg

SEQ ID NO: 6476017 - DNA, 21 bp, Homo sapiens
tgctcgtatctccttgattac

SEQ ID NO: 6476018 - DNA, 18 bp, Homo sapiens
tgctcgtggactgtgctg

SEQ ID NO: 6476019 - DNA, 18 bp, Homo sapiens
tgctctaatgagcatttc

SEQ ID NO: 6476020 - DNA, 21 bp, Homo sapiens
tgctctaatgagcatttcctt

SEQ ID NO: 6476021 - DNA, 19 bp, Homo sapiens
tgctctaattcttttcaaa

SEQ ID NO: 6476022 - DNA, 20 bp, Homo sapiens
tgctctaattcttttcaaaa

SEQ ID NO: 6476023 - DNA, 20 bp, Homo sapiens
tgctctacaatgacacacaa

SEQ ID NO: 6476024 - DNA, 19 bp, Homo sapiens
tgctctacccatgagcctg

SEQ ID NO: 6476025 - DNA, 20 bp, Homo sapiens
tgctctacccatgagcctgc

SEQ ID NO: 6476026 - DNA, 12 bp, Homo sapiens
tgctctacctgg

SEQ ID NO: 6476027 - DNA, 13 bp, Homo sapiens
tgctctactgtta

SEQ ID NO: 6476028 - DNA, 20 bp, Homo sapiens
tgctctactgttactaggct

SEQ ID NO: 6476029 - DNA, 20 bp, Homo sapiens
tgctctagatgagctgggcc

SEQ ID NO: 6476030 - DNA, 17 bp, Homo sapiens
tgctctagattcataaa

SEQ ID NO: 6476031 - DNA, 12 bp, Homo sapiens
tgctctagccag

SEQ ID NO: 6476032 - DNA, 14 bp, Homo sapiens
tgctctagccagga

SEQ ID NO: 6476033 - DNA, 15 bp, Homo sapiens
tgctctagccaggag

SEQ ID NO: 6476034 - DNA, 16 bp, Homo sapiens
tgctctagccaggagt

SEQ ID NO: 6476035 - DNA, 22 bp, Homo sapiens
tgctctagccaggagtctgtgc

SEQ ID NO: 6476036 - DNA, 23 bp, Homo sapiens
tgctctagccaggagtctgtgct

SEQ ID NO: 6476037 - DNA, 13 bp, Homo sapiens
tgctctagctggc

SEQ ID NO: 6476038 - DNA, 17 bp, Homo sapiens
tgctctagctggcagga

SEQ ID NO: 6476039 - DNA, 21 bp, Homo sapiens
tgctctaggctgccccgggtc

SEQ ID NO: 6476040 - DNA, 19 bp, Homo sapiens
tgctctagggaatctggat

SEQ ID NO: 6476041 - DNA, 15 bp, Homo sapiens
tgctctagtcttgct

SEQ ID NO: 6476042 - DNA, 18 bp, Homo sapiens
tgctctagtcttgctttg

SEQ ID NO: 6476043 - DNA, 14 bp, Homo sapiens
tgctctagtgcctt

SEQ ID NO: 6476044 - DNA, 14 bp, Homo sapiens
tgctctagtgggac

SEQ ID NO: 6476045 - DNA, 23 bp, Homo sapiens
tgctctataaatagtattccaat

SEQ ID NO: 6476046 - DNA, 14 bp, Homo sapiens
tgctctatactgtg

SEQ ID NO: 6476047 - DNA, 22 bp, Homo sapiens
tgctctatactgtggcctgcag

SEQ ID NO: 6476048 - DNA, 23 bp, Homo sapiens
tgctctatactgtggcctgcagg

SEQ ID NO: 6476049 - DNA, 17 bp, Homo sapiens
tgctctatctctcaaaa

SEQ ID NO: 6476050 - DNA, 21 bp, Homo sapiens
tgctctatcttgctctgtaat

SEQ ID NO: 6476051 - DNA, 16 bp, Homo sapiens
tgctctatgccaggct

SEQ ID NO: 6476052 - DNA, 19 bp, Homo sapiens
tgctctatgccaggctgtg

SEQ ID NO: 6476053 - DNA, 22 bp, Homo sapiens
tgctctatgccaggctgtgcta

SEQ ID NO: 6476054 - DNA, 18 bp, Homo sapiens
tgctctatgctttccaaa

SEQ ID NO: 6476055 - DNA, 21 bp, Homo sapiens
tgctctatgctttccaaacct

SEQ ID NO: 6476056 - DNA, 20 bp, Homo sapiens
tgctctatgtcctagtaact

SEQ ID NO: 6476057 - DNA, 14 bp, Homo sapiens
tgctctattaagat

SEQ ID NO: 6476058 - DNA, 22 bp, Homo sapiens
tgctctattaagattggaaatg

SEQ ID NO: 6476059 - DNA, 18 bp, Homo sapiens
tgctctcaaaatgtgaac

SEQ ID NO: 6476060 - DNA, 18 bp, Homo sapiens
tgctctcaaacccctgac

SEQ ID NO: 6476061 - DNA, 16 bp, Homo sapiens
tgctctcaaggcttgg

SEQ ID NO: 6476062 - DNA, 22 bp, Homo sapiens
tgctctcactgtttgtttttat

SEQ ID NO: 6476063 - DNA, 18 bp, Homo sapiens
tgctctcagcctcccaca

SEQ ID NO: 6476064 - DNA, 11 bp, Homo sapiens
tgctctcagct

SEQ ID NO: 6476065 - DNA, 17 bp, Homo sapiens
tgctctcagctccgggg

SEQ ID NO: 6476066 - DNA, 15 bp, Homo sapiens
tgctctcatttcttt

SEQ ID NO: 6476067 - DNA, 18 bp, Homo sapiens
tgctctccaagtctcagt

SEQ ID NO: 6476068 - DNA, 16 bp, Homo sapiens
tgctctccattctttt

SEQ ID NO: 6476069 - DNA, 18 bp, Homo sapiens
tgctctccattcttttaa

SEQ ID NO: 6476070 - DNA, 13 bp, Homo sapiens
tgctctcccaagg

SEQ ID NO: 6476071 - DNA, 22 bp, Homo sapiens
tgctctccccggcaggcctgag

SEQ ID NO: 6476072 - DNA, 18 bp, Homo sapiens
tgctctcccctcccagtc

SEQ ID NO: 6476073 - DNA, 14 bp, Homo sapiens
tgctctcccctgcc

SEQ ID NO: 6476074 - DNA, 22 bp, Homo sapiens
tgctctccctaaccccttgtcc

SEQ ID NO: 6476075 - DNA, 11 bp, Homo sapiens
tgctctcctca

SEQ ID NO: 6476076 - DNA, 13 bp, Homo sapiens
tgctctcctccac

SEQ ID NO: 6476077 - DNA, 14 bp, Homo sapiens
tgctctcctcttgc

SEQ ID NO: 6476078 - DNA, 13 bp, Homo sapiens
tgctctcctggag

SEQ ID NO: 6476079 - DNA, 22 bp, Homo sapiens
tgctctcctggagcaagctctg

SEQ ID NO: 6476080 - DNA, 21 bp, Homo sapiens
tgctctccttcactctgacag

SEQ ID NO: 6476081 - DNA, 18 bp, Homo sapiens
tgctctccttcctggagc

SEQ ID NO: 6476082 - DNA, 17 bp, Homo sapiens
tgctctccttgccctgg

SEQ ID NO: 6476083 - DNA, 21 bp, Homo sapiens
tgctctccttgccctgggcca

SEQ ID NO: 6476084 - DNA, 12 bp, Homo sapiens
tgctctcctttc

SEQ ID NO: 6476085 - DNA, 21 bp, Homo sapiens
tgctctcgaggcagcagtggg

SEQ ID NO: 6476086 - DNA, 19 bp, Homo sapiens
tgctctcgcacctttccaa

SEQ ID NO: 6476087 - DNA, 12 bp, Homo sapiens
tgctctctcacc

SEQ ID NO: 6476088 - DNA, 16 bp, Homo sapiens
tgctctctcattccca

SEQ ID NO: 6476089 - DNA, 11 bp, Homo sapiens
tgctctctgag

SEQ ID NO: 6476090 - DNA, 12 bp, Homo sapiens
tgctctctgaga

SEQ ID NO: 6476091 - DNA, 13 bp, Homo sapiens
tgctctctgagag

SEQ ID NO: 6476092 - DNA, 22 bp, Homo sapiens
tgctctctgaggcaaggcccag

SEQ ID NO: 6476093 - DNA, 17 bp, Homo sapiens
tgctctctgcagccagc

SEQ ID NO: 6476094 - DNA, 21 bp, Homo sapiens
tgctctctgcagccagcccag

SEQ ID NO: 6476095 - DNA, 12 bp, Homo sapiens
tgctctctgtgg

SEQ ID NO: 6476096 - DNA, 17 bp, Homo sapiens
tgctctcttcaataaac

SEQ ID NO: 6476097 - DNA, 19 bp, Homo sapiens
tgctctcttcaataaacca

SEQ ID NO: 6476098 - DNA, 14 bp, Homo sapiens
tgctctcttcagga

SEQ ID NO: 6476099 - DNA, 15 bp, Homo sapiens
tgctctcttcaggag

SEQ ID NO: 6476100 - DNA, 18 bp, Homo sapiens
tgctctgaacacgaagct

SEQ ID NO: 6476101 - DNA, 15 bp, Homo sapiens
tgctctgaatctgta

SEQ ID NO: 6476102 - DNA, 17 bp, Homo sapiens
tgctctgaatctgtaca

SEQ ID NO: 6476103 - DNA, 18 bp, Homo sapiens
tgctctgaatctgtacat

SEQ ID NO: 6476104 - DNA, 19 bp, Homo sapiens
tgctctgaatctgtacatg

SEQ ID NO: 6476105 - DNA, 20 bp, Homo sapiens
tgctctgaatgggagccaga

SEQ ID NO: 6476106 - DNA, 20 bp, Homo sapiens
tgctctgaccctgggctttc

SEQ ID NO: 6476107 - DNA, 13 bp, Homo sapiens
tgctctgacctcc

SEQ ID NO: 6476108 - DNA, 15 bp, Homo sapiens
tgctctgacctcctc

SEQ ID NO: 6476109 - DNA, 18 bp, Homo sapiens
tgctctgacctcctctgg

SEQ ID NO: 6476110 - DNA, 15 bp, Homo sapiens
tgctctgaccttcca

SEQ ID NO: 6476111 - DNA, 14 bp, Homo sapiens
tgctctgagaaatt

SEQ ID NO: 6476112 - DNA, 20 bp, Homo sapiens
tgctctgagaaattgaatgt

SEQ ID NO: 6476113 - DNA, 20 bp, Homo sapiens
tgctctgagaagaggagccc

SEQ ID NO: 6476114 - DNA, 20 bp, Homo sapiens
tgctctgagaattgttgaga

SEQ ID NO: 6476115 - DNA, 23 bp, Homo sapiens
tgctctgagacggatggaaggag

SEQ ID NO: 6476116 - DNA, 16 bp, Homo sapiens
tgctctgaggcttcca

SEQ ID NO: 6476117 - DNA, 20 bp, Homo sapiens
tgctctgaggcttccagaga

SEQ ID NO: 6476118 - DNA, 20 bp, Homo sapiens
tgctctgaggtaaaggtcca

SEQ ID NO: 6476119 - DNA, 22 bp, Homo sapiens
tgctctgaggtcaataaagcag

SEQ ID NO: 6476120 - DNA, 14 bp, Homo sapiens
tgctctgaggtccc

SEQ ID NO: 6476121 - DNA, 22 bp, Homo sapiens
tgctctgatgcagtgccctaga

SEQ ID NO: 6476122 - DNA, 16 bp, Homo sapiens
tgctctgatgcatcag

SEQ ID NO: 6476123 - DNA, 15 bp, Homo sapiens
tgctctgcaaaagga

SEQ ID NO: 6476124 - DNA, 11 bp, Homo sapiens
tgctctgcagc

SEQ ID NO: 6476125 - DNA, 19 bp, Homo sapiens
tgctctgcagcattgaagt

SEQ ID NO: 6476126 - DNA, 16 bp, Homo sapiens
tgctctgcagcccaca

SEQ ID NO: 6476127 - DNA, 15 bp, Homo sapiens
tgctctgcaggcacc

SEQ ID NO: 6476128 - DNA, 20 bp, Homo sapiens
tgctctgcaggcaccttagt

SEQ ID NO: 6476129 - DNA, 21 bp, Homo sapiens
tgctctgcaggctggggaggt

SEQ ID NO: 6476130 - DNA, 17 bp, Homo sapiens
tgctctgccatcttcag

SEQ ID NO: 6476131 - DNA, 11 bp, Homo sapiens
tgctctgccca

SEQ ID NO: 6476132 - DNA, 12 bp, Homo sapiens
tgctctgcccag

SEQ ID NO: 6476133 - DNA, 18 bp, Homo sapiens
tgctctgcccaggcaagg

SEQ ID NO: 6476134 - DNA, 16 bp, Homo sapiens
tgctctgcccatgcct

SEQ ID NO: 6476135 - DNA, 17 bp, Homo sapiens
tgctctgcccatgccta

SEQ ID NO: 6476136 - DNA, 18 bp, Homo sapiens
tgctctgccccaagcccc

SEQ ID NO: 6476137 - DNA, 14 bp, Homo sapiens
tgctctgccccagc

SEQ ID NO: 6476138 - DNA, 15 bp, Homo sapiens
tgctctgccccagct

SEQ ID NO: 6476139 - DNA, 23 bp, Homo sapiens
tcttaaagaaacagctttcaagt

SEQ ID NO: 6476140 - DNA, 18 bp, Homo sapiens
tcttaaagaatttgaaag

SEQ ID NO: 6476141 - DNA, 19 bp, Homo sapiens
tcttaaagcaaaaaatgaa

SEQ ID NO: 6476142 - DNA, 19 bp, Homo sapiens
tcttaaagctgcctgtagt

SEQ ID NO: 6476143 - DNA, 17 bp, Homo sapiens
tcttaaaggacataaaa

SEQ ID NO: 6476144 - DNA, 19 bp, Homo sapiens
tcttaaagtgccagtattt

SEQ ID NO: 6476145 - DNA, 13 bp, Homo sapiens
tcttaaagttgaa

SEQ ID NO: 6476146 - DNA, 16 bp, Homo sapiens
tcttaaagttgaattt

SEQ ID NO: 6476147 - DNA, 22 bp, Homo sapiens
tcttaaagttgaatttattggc

SEQ ID NO: 6476148 - DNA, 20 bp, Homo sapiens
tcttaaagtttaaagttgca

SEQ ID NO: 6476149 - DNA, 17 bp, Homo sapiens
tcttaaataaaaataat

SEQ ID NO: 6476150 - DNA, 16 bp, Homo sapiens
tcttaaataaaactat

SEQ ID NO: 6476151 - DNA, 17 bp, Homo sapiens
tcttaaataaaactatt

SEQ ID NO: 6476152 - DNA, 22 bp, Homo sapiens
tcttaaataaaagaaatgcaca

SEQ ID NO: 6476153 - DNA, 16 bp, Homo sapiens
tcttaaataaatcaag

SEQ ID NO: 6476154 - DNA, 19 bp, Homo sapiens
tcttaaataagaaactttt

SEQ ID NO: 6476155 - DNA, 19 bp, Homo sapiens
tcttaaataatgcttcaga

SEQ ID NO: 6476156 - DNA, 15 bp, Homo sapiens
tcttaaatacttttt

SEQ ID NO: 6476157 - DNA, 17 bp, Homo sapiens
tcttaaatactttttca

SEQ ID NO: 6476158 - DNA, 18 bp, Homo sapiens
tcttaaatactttttcag

SEQ ID NO: 6476159 - DNA, 19 bp, Homo sapiens
tcttaaatactttttcagt

SEQ ID NO: 6476160 - DNA, 13 bp, Homo sapiens
tcttaaatatctt

SEQ ID NO: 6476161 - DNA, 17 bp, Homo sapiens
tcttaaatatcttttat

SEQ ID NO: 6476162 - DNA, 17 bp, Homo sapiens
tcttaaatcagaataaa

SEQ ID NO: 6476163 - DNA, 23 bp, Homo sapiens
tcttaaatcagaataaattaata

SEQ ID NO: 6476164 - DNA, 13 bp, Homo sapiens
tcttaaatcattt

SEQ ID NO: 6476165 - DNA, 15 bp, Homo sapiens
tcttaaatcatttgg

SEQ ID NO: 6476166 - DNA, 18 bp, Homo sapiens
tcttaaatctttcttcaa

SEQ ID NO: 6476167 - DNA, 18 bp, Homo sapiens
tcttaaatgacagtgaat

SEQ ID NO: 6476168 - DNA, 15 bp, Homo sapiens
tcttaaatgctcata

SEQ ID NO: 6476169 - DNA, 13 bp, Homo sapiens
tcttaaatgtttt

SEQ ID NO: 6476170 - DNA, 19 bp, Homo sapiens
tcttaaatgttttcattgg

SEQ ID NO: 6476171 - DNA, 22 bp, Homo sapiens
tcttaaattcatttctagactc

SEQ ID NO: 6476172 - DNA, 23 bp, Homo sapiens
tcttaaattgggttcatgatgca

SEQ ID NO: 6476173 - DNA, 23 bp, Homo sapiens
tcttaaatttgggttgcaaagct

SEQ ID NO: 6476174 - DNA, 11 bp, Homo sapiens
tcttaaatttt

SEQ ID NO: 6476175 - DNA, 15 bp, Homo sapiens
tcttaaatttttcaa

SEQ ID NO: 6476176 - DNA, 22 bp, Homo sapiens
tcttaacaaaccaacatctttg

SEQ ID NO: 6476177 - DNA, 15 bp, Homo sapiens
tcttaacaaactctt

SEQ ID NO: 6476178 - DNA, 22 bp, Homo sapiens
tcttaacaagatatttatatgt

SEQ ID NO: 6476179 - DNA, 20 bp, Homo sapiens
tcttaacacagccttccttc

SEQ ID NO: 6476180 - DNA, 12 bp, Homo sapiens
tcttaacactga

SEQ ID NO: 6476181 - DNA, 13 bp, Homo sapiens
tcttaacactgaa

SEQ ID NO: 6476182 - DNA, 17 bp, Homo sapiens
tcttaaccagatcattg

SEQ ID NO: 6476183 - DNA, 22 bp, Homo sapiens
tcttaacccctaagactgcctt

SEQ ID NO: 6476184 - DNA, 16 bp, Homo sapiens
tcttaaccctgaacaa

SEQ ID NO: 6476185 - DNA, 20 bp, Homo sapiens
tcttaaccttcaaatacatt

SEQ ID NO: 6476186 - DNA, 20 bp, Homo sapiens
tcttaacctttgctatgtaa

SEQ ID NO: 6476187 - DNA, 18 bp, Homo sapiens
tcttaactaatgtaaata

SEQ ID NO: 6476188 - DNA, 23 bp, Homo sapiens
tcttaactggcctaaatttcttc

SEQ ID NO: 6476189 - DNA, 15 bp, Homo sapiens
tcttaactgtatttc

SEQ ID NO: 6476190 - DNA, 18 bp, Homo sapiens
tcttaacttaaaagaaca

SEQ ID NO: 6476191 - DNA, 23 bp, Homo sapiens
tcttaacttcttgcttctttcta

SEQ ID NO: 6476192 - DNA, 13 bp, Homo sapiens
tcttaagaaataa

SEQ ID NO: 6476193 - DNA, 16 bp, Homo sapiens
tcttaagaaataaatc

SEQ ID NO: 6476194 - DNA, 14 bp, Homo sapiens
tcttaagaaatgta

SEQ ID NO: 6476195 - DNA, 17 bp, Homo sapiens
tcttaagaattcaaatt

SEQ ID NO: 6476196 - DNA, 23 bp, Homo sapiens
tcttaagaattcaaatttgtaat

SEQ ID NO: 6476197 - DNA, 13 bp, Homo sapiens
tcttaagacagag

SEQ ID NO: 6476198 - DNA, 20 bp, Homo sapiens
tcttaagacttctctgtcct

SEQ ID NO: 6476199 - DNA, 15 bp, Homo sapiens
tcttaagacttttgg

SEQ ID NO: 6476200 - DNA, 22 bp, Homo sapiens
tcttaagagaatccacataaaa

SEQ ID NO: 6476201 - DNA, 19 bp, Homo sapiens
tcttaagagcttgatctgt

SEQ ID NO: 6476202 - DNA, 22 bp, Homo sapiens
tcttaagagcttgatctgtgat

SEQ ID NO: 6476203 - DNA, 15 bp, Homo sapiens
tcttaagagtgctaa

SEQ ID NO: 6476204 - DNA, 19 bp, Homo sapiens
tcttaagatggaaatacag

SEQ ID NO: 6476205 - DNA, 22 bp, Homo sapiens
tcttaagattccattttggaaa

SEQ ID NO: 6476206 - DNA, 23 bp, Homo sapiens
tcttaagatttctcctgactcca

SEQ ID NO: 6476207 - DNA, 22 bp, Homo sapiens
tcttaagcactttgaaaatatt

SEQ ID NO: 6476208 - DNA, 20 bp, Homo sapiens
tcttaagcagagataaataa

SEQ ID NO: 6476209 - DNA, 13 bp, Homo sapiens
tcttaagcagcat

SEQ ID NO: 6476210 - DNA, 14 bp, Homo sapiens
tcttaagcagcatg

SEQ ID NO: 6476211 - DNA, 15 bp, Homo sapiens
tcttaagcagcatgg

SEQ ID NO: 6476212 - DNA, 12 bp, Homo sapiens
tcttaagccatc

SEQ ID NO: 6476213 - DNA, 19 bp, Homo sapiens
tcttaagccatcttggtaa

SEQ ID NO: 6476214 - DNA, 18 bp, Homo sapiens
tcttaagcctaaatgcct

SEQ ID NO: 6476215 - DNA, 19 bp, Homo sapiens
tcttaaggacagtgttcaa

SEQ ID NO: 6476216 - DNA, 21 bp, Homo sapiens
tcttaaggacagtgttcaaat

SEQ ID NO: 6476217 - DNA, 23 bp, Homo sapiens
tcttaaggacagtgttcaaattc

SEQ ID NO: 6476218 - DNA, 23 bp, Homo sapiens
tcttaaggattgtgatattttta

SEQ ID NO: 6476219 - DNA, 20 bp, Homo sapiens
tcttaagggggccttggaat

SEQ ID NO: 6476220 - DNA, 21 bp, Homo sapiens
tcttaagggtcactggcctct

SEQ ID NO: 6476221 - DNA, 18 bp, Homo sapiens
tcttaaggtgaggcctgt

SEQ ID NO: 6476222 - DNA, 21 bp, Homo sapiens
tcttaagtaccaatgggaagc

SEQ ID NO: 6476223 - DNA, 16 bp, Homo sapiens
tcttaagtcagatttt

SEQ ID NO: 6476224 - DNA, 22 bp, Homo sapiens
tcttaagtgcccacatttgatg

SEQ ID NO: 6476225 - DNA, 12 bp, Homo sapiens
tcttaagtgttt

SEQ ID NO: 6476226 - DNA, 13 bp, Homo sapiens
tcttaagtgtttc

SEQ ID NO: 6476227 - DNA, 15 bp, Homo sapiens
tcttaatattgagaa

SEQ ID NO: 6476228 - DNA, 22 bp, Homo sapiens
tcttaatatttttacatgcaga

SEQ ID NO: 6476229 - DNA, 16 bp, Homo sapiens
tcttaatcaagaatat

SEQ ID NO: 6476230 - DNA, 17 bp, Homo sapiens
tcttaatcactactgta

SEQ ID NO: 6476231 - DNA, 22 bp, Homo sapiens
tcttaatcattttttatatata

SEQ ID NO: 6476232 - DNA, 14 bp, Homo sapiens
tcttaatccagtct

SEQ ID NO: 6476233 - DNA, 14 bp, Homo sapiens
tcttaatctgtgtg

SEQ ID NO: 6476234 - DNA, 15 bp, Homo sapiens
tcttaatctgtgtgt

SEQ ID NO: 6476235 - DNA, 15 bp, Homo sapiens
tcttaatctttattt

SEQ ID NO: 6476236 - DNA, 16 bp, Homo sapiens
tcttaatctttatttt

SEQ ID NO: 6476237 - DNA, 20 bp, Homo sapiens
tcttaatcttttcacaaata

SEQ ID NO: 6476238 - DNA, 22 bp, Homo sapiens
tcttaatcttttcacaaataaa

SEQ ID NO: 6476239 - DNA, 16 bp, Homo sapiens
tcttaatgaagtttga

SEQ ID NO: 6476240 - DNA, 19 bp, Homo sapiens
tcttaatgaagtttgaatg

SEQ ID NO: 6476241 - DNA, 21 bp, Homo sapiens
tcttaatgaagtttgaatgtt

SEQ ID NO: 6476242 - DNA, 18 bp, Homo sapiens
tcttaatgctttcctccc

SEQ ID NO: 6476243 - DNA, 18 bp, Homo sapiens
tcttaatggatgaaatca

SEQ ID NO: 6476244 - DNA, 20 bp, Homo sapiens
tcttaatgtctggtgtttgt

SEQ ID NO: 6476245 - DNA, 20 bp, Homo sapiens
tcttaatgtgtgtgccaatg

SEQ ID NO: 6476246 - DNA, 22 bp, Homo sapiens
tcttaatgttactcagatataa

SEQ ID NO: 6476247 - DNA, 21 bp, Homo sapiens
tcttaatgttcctcaaagctt

SEQ ID NO: 6476248 - DNA, 20 bp, Homo sapiens
tcttaattaagtaaactaat

SEQ ID NO: 6476249 - DNA, 15 bp, Homo sapiens
tcttaattctttgtt

SEQ ID NO: 6476250 - DNA, 18 bp, Homo sapiens
tcttaattctttgttctg

SEQ ID NO: 6476251 - DNA, 19 bp, Homo sapiens
tcttaattctttgttctgt

SEQ ID NO: 6476252 - DNA, 19 bp, Homo sapiens
tcttaattgccacctctaa

SEQ ID NO: 6476253 - DNA, 19 bp, Homo sapiens
tcttaattgtgtttatttt

SEQ ID NO: 6476254 - DNA, 23 bp, Homo sapiens
tcttaatttaatcttttttatgt

SEQ ID NO: 6476255 - DNA, 15 bp, Homo sapiens
tcttaatttatgtaa

SEQ ID NO: 6476256 - DNA, 20 bp, Homo sapiens
tcttaatttatgtaaggttt

SEQ ID NO: 6476257 - DNA, 17 bp, Homo sapiens
tcttaatttctatcttg

SEQ ID NO: 6476258 - DNA, 16 bp, Homo sapiens
tcttaatttggaaact

SEQ ID NO: 6476259 - DNA, 17 bp, Homo sapiens
tcttaatttggaaacta

SEQ ID NO: 6476260 - DNA, 22 bp, Homo sapiens
tcttaatttggaaactaataaa

SEQ ID NO: 6476261 - DNA, 22 bp, Homo sapiens
tcttaatttggataataaaaat

SEQ ID NO: 6476262 - DNA, 20 bp, Homo sapiens
tcttaatttggatctattta

SEQ ID NO: 6476263 - DNA, 20 bp, Homo sapiens
tcttaattttaaagacccaa

SEQ ID NO: 6476264 - DNA, 13 bp, Homo sapiens
tcttaattttcta

SEQ ID NO: 6476265 - DNA, 14 bp, Homo sapiens
tcttaattttctaa

SEQ ID NO: 6476266 - DNA, 15 bp, Homo sapiens
tcttaattttgtctt

SEQ ID NO: 6476267 - DNA, 19 bp, Homo sapiens
tcttacaaaaagaaatgtc

SEQ ID NO: 6476268 - DNA, 16 bp, Homo sapiens
tcttacaaaagctttg

SEQ ID NO: 6476269 - DNA, 20 bp, Homo sapiens
tcttacaaagtgtattttat

SEQ ID NO: 6476270 - DNA, 19 bp, Homo sapiens
tcttacaaataaagtttgt

SEQ ID NO: 6476271 - DNA, 16 bp, Homo sapiens
tcttacaaatgtgaaa

SEQ ID NO: 6476272 - DNA, 17 bp, Homo sapiens
tcttacaaccaagaaca

SEQ ID NO: 6476273 - DNA, 21 bp, Homo sapiens
tcttacaagatattgatgata

SEQ ID NO: 6476274 - DNA, 19 bp, Homo sapiens
tcttacaataattctatga

SEQ ID NO: 6476275 - DNA, 16 bp, Homo sapiens
tcttacaattgcactg

SEQ ID NO: 6476276 - DNA, 22 bp, Homo sapiens
tcttacaattgcactgctgttc

SEQ ID NO: 6476277 - DNA, 19 bp, Homo sapiens
tcttacacaagagctggag

SEQ ID NO: 6476278 - DNA, 17 bp, Homo sapiens
tcttacacactgtctgt

SEQ ID NO: 6476279 - DNA, 16 bp, Homo sapiens
tcttacacataaagca

SEQ ID NO: 6476280 - DNA, 23 bp, Homo sapiens
tcttacacatacagttttatgct

SEQ ID NO: 6476281 - DNA, 16 bp, Homo sapiens
tcttacacgaagaaat

SEQ ID NO: 6476282 - DNA, 13 bp, Homo sapiens
tcttacagcaggc

SEQ ID NO: 6476283 - DNA, 18 bp, Homo sapiens
tcttacaggcctacagaa

SEQ ID NO: 6476284 - DNA, 19 bp, Homo sapiens
tcttacagtgtttggacag

SEQ ID NO: 6476285 - DNA, 18 bp, Homo sapiens
tcttacataatttgcaat

SEQ ID NO: 6476286 - DNA, 11 bp, Homo sapiens
tcttacatatg

SEQ ID NO: 6476287 - DNA, 14 bp, Homo sapiens
tcttacatctcctt

SEQ ID NO: 6476288 - DNA, 21 bp, Homo sapiens
tcttacatctccttgatcatg

SEQ ID NO: 6476289 - DNA, 15 bp, Homo sapiens
tcttacatgtataaa

SEQ ID NO: 6476290 - DNA, 19 bp, Homo sapiens
tcttacattattaatcatt

SEQ ID NO: 6476291 - DNA, 18 bp, Homo sapiens
tcttaccaggttcactta

SEQ ID NO: 6476292 - DNA, 16 bp, Homo sapiens
tcttaccagtctcctc

SEQ ID NO: 6476293 - DNA, 17 bp, Homo sapiens
tcttaccagtctcctcc

SEQ ID NO: 6476294 - DNA, 23 bp, Homo sapiens
tcttacccacactacgcagaaga

SEQ ID NO: 6476295 - DNA, 20 bp, Homo sapiens
tcttacccacttccctgcaa

SEQ ID NO: 6476296 - DNA, 23 bp, Homo sapiens
tcttacccagattgtgtacatag

SEQ ID NO: 6476297 - DNA, 17 bp, Homo sapiens
tcttaccctctctttca

SEQ ID NO: 6476298 - DNA, 21 bp, Homo sapiens
tcttaccctgaatgtgtgccc

SEQ ID NO: 6476299 - DNA, 17 bp, Homo sapiens
tcttacccttcaatgtt

SEQ ID NO: 6476300 - DNA, 20 bp, Homo sapiens
tcttacccttcaatgttaaa

SEQ ID NO: 6476301 - DNA, 21 bp, Homo sapiens
tcttacccttctgtgcccagc

SEQ ID NO: 6476302 - DNA, 15 bp, Homo sapiens
tcttaccgaaatgaa

SEQ ID NO: 6476303 - DNA, 16 bp, Homo sapiens
tcttaccgaaatgaaa

SEQ ID NO: 6476304 - DNA, 16 bp, Homo sapiens
tcttaccgagaaaagg

SEQ ID NO: 6476305 - DNA, 20 bp, Homo sapiens
tcttaccgagaaaaggagaa

SEQ ID NO: 6476306 - DNA, 17 bp, Homo sapiens
tcttaccgtagcctccg

SEQ ID NO: 6476307 - DNA, 15 bp, Homo sapiens
tcttacctcatttgc

SEQ ID NO: 6476308 - DNA, 17 bp, Homo sapiens
tcttacctcatttgcat

SEQ ID NO: 6476309 - DNA, 10 bp, Homo sapiens
tcttacctct

SEQ ID NO: 6476310 - DNA, 15 bp, Homo sapiens
tcttacctctcatgc

SEQ ID NO: 6476311 - DNA, 15 bp, Homo sapiens
tcttacctctctggg

SEQ ID NO: 6476312 - DNA, 18 bp, Homo sapiens
tcttacctctctgggacc

SEQ ID NO: 6476313 - DNA, 15 bp, Homo sapiens
tcttacctggcagca

SEQ ID NO: 6476314 - DNA, 21 bp, Homo sapiens
tcttacgcacgatatctagtg

SEQ ID NO: 6476315 - DNA, 17 bp, Homo sapiens
tgctctgccccagcttg

SEQ ID NO: 6476316 - DNA, 12 bp, Homo sapiens
tgctctgcctct

SEQ ID NO: 6476317 - DNA, 13 bp, Homo sapiens
tgctctgcctcta

SEQ ID NO: 6476318 - DNA, 13 bp, Homo sapiens
tgctctgcctgga

SEQ ID NO: 6476319 - DNA, 16 bp, Homo sapiens
tgctctgcgtggcgca

SEQ ID NO: 6476320 - DNA, 10 bp, Homo sapiens
tgctctgctg

SEQ ID NO: 6476321 - DNA, 14 bp, Homo sapiens
tgctctgctgacag

SEQ ID NO: 6476322 - DNA, 16 bp, Homo sapiens
tgctctgctgacagac

SEQ ID NO: 6476323 - DNA, 22 bp, Homo sapiens
tgctctgctgacagacacaggc

SEQ ID NO: 6476324 - DNA, 15 bp, Homo sapiens
tgctctgctgatgac

SEQ ID NO: 6476325 - DNA, 16 bp, Homo sapiens
tgctctgcttcctcag

SEQ ID NO: 6476326 - DNA, 21 bp, Homo sapiens
tgctctggaaaacctgaggcc

SEQ ID NO: 6476327 - DNA, 16 bp, Homo sapiens
tgctctggaagagagg

SEQ ID NO: 6476328 - DNA, 13 bp, Homo sapiens
tgctctggaagcc

SEQ ID NO: 6476329 - DNA, 15 bp, Homo sapiens
tgctctggaagcctg

SEQ ID NO: 6476330 - DNA, 17 bp, Homo sapiens
tgctctggaagcctgct

SEQ ID NO: 6476331 - DNA, 22 bp, Homo sapiens
tgctctggaataaagttgcaga

SEQ ID NO: 6476332 - DNA, 14 bp, Homo sapiens
tgctctggacaggc

SEQ ID NO: 6476333 - DNA, 12 bp, Homo sapiens
tgctctggacct

SEQ ID NO: 6476334 - DNA, 13 bp, Homo sapiens
tgctctggacctg

SEQ ID NO: 6476335 - DNA, 14 bp, Homo sapiens
tgctctggacctgc

SEQ ID NO: 6476336 - DNA, 12 bp, Homo sapiens
tgctctggagca

SEQ ID NO: 6476337 - DNA, 16 bp, Homo sapiens
tgctctggagcagcca

SEQ ID NO: 6476338 - DNA, 17 bp, Homo sapiens
tgctctggagcctgcag

SEQ ID NO: 6476339 - DNA, 19 bp, Homo sapiens
tgctctggaggaagttctc

SEQ ID NO: 6476340 - DNA, 17 bp, Homo sapiens
tgctctggcaccatcag

SEQ ID NO: 6476341 - DNA, 22 bp, Homo sapiens
tgctctggcggcttcctgtcca

SEQ ID NO: 6476342 - DNA, 21 bp, Homo sapiens
tgctctggcttgccccaggac

SEQ ID NO: 6476343 - DNA, 22 bp, Homo sapiens
tgctctggcttgccccaggact

SEQ ID NO: 6476344 - DNA, 12 bp, Homo sapiens
tgctctgggacg

SEQ ID NO: 6476345 - DNA, 18 bp, Homo sapiens
tgctctgggacgtggaca

SEQ ID NO: 6476346 - DNA, 23 bp, Homo sapiens
tgctctgggagacttactgcatt

SEQ ID NO: 6476347 - DNA, 12 bp, Homo sapiens
tgctctggggat

SEQ ID NO: 6476348 - DNA, 18 bp, Homo sapiens
tgctctgggggtcccttg

SEQ ID NO: 6476349 - DNA, 17 bp, Homo sapiens
tgctctgtaaaacacac

SEQ ID NO: 6476350 - DNA, 12 bp, Homo sapiens
tgctctgtaaca

SEQ ID NO: 6476351 - DNA, 17 bp, Homo sapiens
tgctctgtagccacctc

SEQ ID NO: 6476352 - DNA, 18 bp, Homo sapiens
tgctctgtagccacctcc

SEQ ID NO: 6476353 - DNA, 22 bp, Homo sapiens
tgctctgtagccacctccttgg

SEQ ID NO: 6476354 - DNA, 20 bp, Homo sapiens
tgctctgtccaattccagag

SEQ ID NO: 6476355 - DNA, 18 bp, Homo sapiens
tgctctgtcccccaggct

SEQ ID NO: 6476356 - DNA, 15 bp, Homo sapiens
tgctctgtccttgtg

SEQ ID NO: 6476357 - DNA, 16 bp, Homo sapiens
tgctctgtctcccagg

SEQ ID NO: 6476358 - DNA, 16 bp, Homo sapiens
tgctctgtgcctggga

SEQ ID NO: 6476359 - DNA, 23 bp, Homo sapiens
tgctctgtgcctgggatcagtgg

SEQ ID NO: 6476360 - DNA, 17 bp, Homo sapiens
tgctctgtggtaagaga

SEQ ID NO: 6476361 - DNA, 16 bp, Homo sapiens
tgctctgtgtatatct

SEQ ID NO: 6476362 - DNA, 17 bp, Homo sapiens
tgctctgtgtatatctc

SEQ ID NO: 6476363 - DNA, 23 bp, Homo sapiens
tgctctgtgtatatctcttggaa

SEQ ID NO: 6476364 - DNA, 21 bp, Homo sapiens
tgctctgtgtccgtctgtgta

SEQ ID NO: 6476365 - DNA, 17 bp, Homo sapiens
tgctctgttacccaggc

SEQ ID NO: 6476366 - DNA, 15 bp, Homo sapiens
tgctctgtttcttcc

SEQ ID NO: 6476367 - DNA, 18 bp, Homo sapiens
tgctctgttttgcatgga

SEQ ID NO: 6476368 - DNA, 15 bp, Homo sapiens
tgctcttaaaaatct

SEQ ID NO: 6476369 - DNA, 15 bp, Homo sapiens
tgctcttaaaatatc

SEQ ID NO: 6476370 - DNA, 20 bp, Homo sapiens
tgctcttaaaatatcttcct

SEQ ID NO: 6476371 - DNA, 20 bp, Homo sapiens
tgctcttaagaaactatgaa

SEQ ID NO: 6476372 - DNA, 21 bp, Homo sapiens
tgctcttaattgccacctcta

SEQ ID NO: 6476373 - DNA, 14 bp, Homo sapiens
tgctcttacttccc

SEQ ID NO: 6476374 - DNA, 16 bp, Homo sapiens
tgctcttacttccccc

SEQ ID NO: 6476375 - DNA, 15 bp, Homo sapiens
tgctcttagctgtct

SEQ ID NO: 6476376 - DNA, 15 bp, Homo sapiens
tgctcttagtcccaa

SEQ ID NO: 6476377 - DNA, 14 bp, Homo sapiens
tgctcttatcccca

SEQ ID NO: 6476378 - DNA, 19 bp, Homo sapiens
tgctcttatccccagctgt

SEQ ID NO: 6476379 - DNA, 13 bp, Homo sapiens
tgctcttatttca

SEQ ID NO: 6476380 - DNA, 21 bp, Homo sapiens
tgctcttatttttgtaccata

SEQ ID NO: 6476381 - DNA, 14 bp, Homo sapiens
tgctcttcaagaaa

SEQ ID NO: 6476382 - DNA, 17 bp, Homo sapiens
tgctcttcagatgccac

SEQ ID NO: 6476383 - DNA, 15 bp, Homo sapiens
tgctcttccaaagct

SEQ ID NO: 6476384 - DNA, 12 bp, Homo sapiens
tgctcttcccac

SEQ ID NO: 6476385 - DNA, 22 bp, Homo sapiens
tgctcttctacgtataaatatg

SEQ ID NO: 6476386 - DNA, 13 bp, Homo sapiens
tgctcttctcatt

SEQ ID NO: 6476387 - DNA, 13 bp, Homo sapiens
tgctcttctccac

SEQ ID NO: 6476388 - DNA, 15 bp, Homo sapiens
tgctcttctctcccc

SEQ ID NO: 6476389 - DNA, 19 bp, Homo sapiens
tgctcttctctccccagcc

SEQ ID NO: 6476390 - DNA, 13 bp, Homo sapiens
tgctcttctgtat

SEQ ID NO: 6476391 - DNA, 15 bp, Homo sapiens
tgctcttctgttctc

SEQ ID NO: 6476392 - DNA, 16 bp, Homo sapiens
tgctcttctttctgag

SEQ ID NO: 6476393 - DNA, 16 bp, Homo sapiens
tgctcttgaacctgtg

SEQ ID NO: 6476394 - DNA, 16 bp, Homo sapiens
tgctcttgcagttgct

SEQ ID NO: 6476395 - DNA, 19 bp, Homo sapiens
tgctcttgcagttgctctg

SEQ ID NO: 6476396 - DNA, 12 bp, Homo sapiens
tgctcttgcctg

SEQ ID NO: 6476397 - DNA, 13 bp, Homo sapiens
tgctcttgcctgc

SEQ ID NO: 6476398 - DNA, 21 bp, Homo sapiens
tgctcttggctgacccctctg

SEQ ID NO: 6476399 - DNA, 14 bp, Homo sapiens
tgctcttggctgga

SEQ ID NO: 6476400 - DNA, 15 bp, Homo sapiens
tgctcttggctggac

SEQ ID NO: 6476401 - DNA, 20 bp, Homo sapiens
tgctcttggctggacccagc

SEQ ID NO: 6476402 - DNA, 21 bp, Homo sapiens
tgctcttgggcaatattctct

SEQ ID NO: 6476403 - DNA, 18 bp, Homo sapiens
tgctcttggggaagggga

SEQ ID NO: 6476404 - DNA, 22 bp, Homo sapiens
tgctcttgtcccacgtgtcttc

SEQ ID NO: 6476405 - DNA, 18 bp, Homo sapiens
tgctcttgtcctagcttg

SEQ ID NO: 6476406 - DNA, 19 bp, Homo sapiens
tgctcttgtcctagcttgg

SEQ ID NO: 6476407 - DNA, 14 bp, Homo sapiens
tgctcttgtttcac

SEQ ID NO: 6476408 - DNA, 16 bp, Homo sapiens
tgctcttgtttcactc

SEQ ID NO: 6476409 - DNA, 18 bp, Homo sapiens
tgctctttaaataataaa

SEQ ID NO: 6476410 - DNA, 12 bp, Homo sapiens
tgctctttagat

SEQ ID NO: 6476411 - DNA, 17 bp, Homo sapiens
tgctctttattgcagaa

SEQ ID NO: 6476412 - DNA, 19 bp, Homo sapiens
tgctctttcaccctgccac

SEQ ID NO: 6476413 - DNA, 12 bp, Homo sapiens
tgctctttccac

SEQ ID NO: 6476414 - DNA, 19 bp, Homo sapiens
tgctctttccacttgccct

SEQ ID NO: 6476415 - DNA, 12 bp, Homo sapiens
tgctctttccca

SEQ ID NO: 6476416 - DNA, 19 bp, Homo sapiens
tgctctttcccacccagcc

SEQ ID NO: 6476417 - DNA, 20 bp, Homo sapiens
tgctctttcccacccagcct

SEQ ID NO: 6476418 - DNA, 21 bp, Homo sapiens
tgctctttcccacccagcctg

SEQ ID NO: 6476419 - DNA, 14 bp, Homo sapiens
tgctctttcccagg

SEQ ID NO: 6476420 - DNA, 12 bp, Homo sapiens
tgctctttccct

SEQ ID NO: 6476421 - DNA, 13 bp, Homo sapiens
tgctctttccctt

SEQ ID NO: 6476422 - DNA, 16 bp, Homo sapiens
tgctctttcccttttc

SEQ ID NO: 6476423 - DNA, 16 bp, Homo sapiens
tgctctttctactctg

SEQ ID NO: 6476424 - DNA, 14 bp, Homo sapiens
tgctctttctctga

SEQ ID NO: 6476425 - DNA, 15 bp, Homo sapiens
tgctctttctctgcc

SEQ ID NO: 6476426 - DNA, 21 bp, Homo sapiens
tgctctttcttcttccacaca

SEQ ID NO: 6476427 - DNA, 19 bp, Homo sapiens
tgctctttgacaactaaaa

SEQ ID NO: 6476428 - DNA, 22 bp, Homo sapiens
tgctctttgacaactaaaatta

SEQ ID NO: 6476429 - DNA, 23 bp, Homo sapiens
tgctctttgtagctaacagtgaa

SEQ ID NO: 6476430 - DNA, 14 bp, Homo sapiens
tgctctttgtggca

SEQ ID NO: 6476431 - DNA, 19 bp, Homo sapiens
tgctctttgtggcagtggc

SEQ ID NO: 6476432 - DNA, 24 bp, Homo sapiens
tgctctttgtggcagtggccaggc

SEQ ID NO: 6476433 - DNA, 22 bp, Homo sapiens
tgctctttgttttgtgtctctt

SEQ ID NO: 6476434 - DNA, 13 bp, Homo sapiens
tgctcttttctcc

SEQ ID NO: 6476435 - DNA, 22 bp, Homo sapiens
tgctcttttgcacaaggaaata

SEQ ID NO: 6476436 - DNA, 15 bp, Homo sapiens
tgctcttttgtgatg

SEQ ID NO: 6476437 - DNA, 15 bp, Homo sapiens
tgctcttttttactc

SEQ ID NO: 6476438 - DNA, 15 bp, Homo sapiens
tgctgaaaaacacaa

SEQ ID NO: 6476439 - DNA, 16 bp, Homo sapiens
tgctgaaaaacacaac

SEQ ID NO: 6476440 - DNA, 16 bp, Homo sapiens
tgctgaaaaatgggca

SEQ ID NO: 6476441 - DNA, 21 bp, Homo sapiens
tgctgaaaaccatctggcctg

SEQ ID NO: 6476442 - DNA, 13 bp, Homo sapiens
tgctgaaaataac

SEQ ID NO: 6476443 - DNA, 18 bp, Homo sapiens
tgctgaaaatgtccttgt

SEQ ID NO: 6476444 - DNA, 23 bp, Homo sapiens
tgctgaaacacacaggccatttc

SEQ ID NO: 6476445 - DNA, 15 bp, Homo sapiens
tgctgaaacacctcc

SEQ ID NO: 6476446 - DNA, 18 bp, Homo sapiens
tgctgaaacagacatgaa

SEQ ID NO: 6476447 - DNA, 17 bp, Homo sapiens
tgctgaaactgcccact

SEQ ID NO: 6476448 - DNA, 14 bp, Homo sapiens
tgctgaaactgtgt

SEQ ID NO: 6476449 - DNA, 18 bp, Homo sapiens
tgctgaaagatatgtata

SEQ ID NO: 6476450 - DNA, 19 bp, Homo sapiens
tgctgaaagatatgtatat

SEQ ID NO: 6476451 - DNA, 12 bp, Homo sapiens
tgctgaaataaa

SEQ ID NO: 6476452 - DNA, 12 bp, Homo sapiens
tgctgaaatcta

SEQ ID NO: 6476453 - DNA, 17 bp, Homo sapiens
tgctgaacaaaattaaa

SEQ ID NO: 6476454 - DNA, 19 bp, Homo sapiens
tgctgaacacacaccagtt

SEQ ID NO: 6476455 - DNA, 22 bp, Homo sapiens
tgctgaacacacaccagtttac

SEQ ID NO: 6476456 - DNA, 17 bp, Homo sapiens
tgctgaacacagtgtct

SEQ ID NO: 6476457 - DNA, 19 bp, Homo sapiens
tgctgaacacagtgtctgt

SEQ ID NO: 6476458 - DNA, 21 bp, Homo sapiens
tgctgaacaccttgtggaagc

SEQ ID NO: 6476459 - DNA, 19 bp, Homo sapiens
tgctgaacaggaaagagct

SEQ ID NO: 6476460 - DNA, 22 bp, Homo sapiens
tgctgaacaggaaagagctagg

SEQ ID NO: 6476461 - DNA, 12 bp, Homo sapiens
tgctgaacattt

SEQ ID NO: 6476462 - DNA, 17 bp, Homo sapiens
tgctgaactccttgtta

SEQ ID NO: 6476463 - DNA, 15 bp, Homo sapiens
tgctgaactgtgcat

SEQ ID NO: 6476464 - DNA, 16 bp, Homo sapiens
tgctgaagaatctact

SEQ ID NO: 6476465 - DNA, 23 bp, Homo sapiens
tgctgaagagaggtgccggggag

SEQ ID NO: 6476466 - DNA, 14 bp, Homo sapiens
tgctgaagaggcaa

SEQ ID NO: 6476467 - DNA, 22 bp, Homo sapiens
tgctgaagatgcccctgctccc

SEQ ID NO: 6476468 - DNA, 14 bp, Homo sapiens
tgctgaagctgctg

SEQ ID NO: 6476469 - DNA, 21 bp, Homo sapiens
tgctgaagcttattaatgcta

SEQ ID NO: 6476470 - DNA, 22 bp, Homo sapiens
tgctgaagcttattaatgctaa

SEQ ID NO: 6476471 - DNA, 12 bp, Homo sapiens
tgctgaaggctc

SEQ ID NO: 6476472 - DNA, 21 bp, Homo sapiens
tgctgaaggctcgagcatgcc

SEQ ID NO: 6476473 - DNA, 22 bp, Homo sapiens
tgctgaagggaccttgaagggt

SEQ ID NO: 6476474 - DNA, 13 bp, Homo sapiens
tgctgaagggcat

SEQ ID NO: 6476475 - DNA, 21 bp, Homo sapiens
tgctgaagggcattctttccc

SEQ ID NO: 6476476 - DNA, 18 bp, Homo sapiens
tgctgaataacaacaatt

SEQ ID NO: 6476477 - DNA, 19 bp, Homo sapiens
tgctgaataacaacaattt

SEQ ID NO: 6476478 - DNA, 23 bp, Homo sapiens
tgctgaatacagaggcaactgca

SEQ ID NO: 6476479 - DNA, 21 bp, Homo sapiens
tgctgaatacgctaagcctgg

SEQ ID NO: 6476480 - DNA, 11 bp, Homo sapiens
tgctgaatagg

SEQ ID NO: 6476481 - DNA, 15 bp, Homo sapiens
tgctgaatccacctc

SEQ ID NO: 6476482 - DNA, 19 bp, Homo sapiens
tgctgaatcggaatctctg

SEQ ID NO: 6476483 - DNA, 20 bp, Homo sapiens
tgctgaatgccccctgctta

SEQ ID NO: 6476484 - DNA, 23 bp, Homo sapiens
tgctgaatgcctcgctcccttca

SEQ ID NO: 6476485 - DNA, 18 bp, Homo sapiens
tgctgaatgtaaaagaaa

SEQ ID NO: 6476486 - DNA, 16 bp, Homo sapiens
tgctgaatgtcattat

SEQ ID NO: 6476487 - DNA, 18 bp, Homo sapiens
tgctgaattcctttacaa

SEQ ID NO: 6476488 - DNA, 16 bp, Homo sapiens
tgctgaattgagaata

SEQ ID NO: 6476489 - DNA, 22 bp, Homo sapiens
tgctgaattgagaataagaatt

SEQ ID NO: 6476490 - DNA, 21 bp, Homo sapiens
tgctgaatttacagtagttaa

SEQ ID NO: 6476491 - DNA, 14 bp, Homo sapiens
tgctgaatttctaa

SEQ ID NO: 6476492 - DNA, 19 bp, Homo sapiens
tgctgaatttgtagttgtt

SEQ ID NO: 6476493 - DNA, 21 bp, Homo sapiens
tgctgacaaaaatattttcct

SEQ ID NO: 6476494 - DNA, 16 bp, Homo sapiens
tgctgacaataaagat

SEQ ID NO: 6476495 - DNA, 19 bp, Homo sapiens
tcttacgcccaacccttcc

SEQ ID NO: 6476496 - DNA, 15 bp, Homo sapiens
tcttacgctatttct

SEQ ID NO: 6476497 - DNA, 16 bp, Homo sapiens
tcttactaaaaagtat

SEQ ID NO: 6476498 - DNA, 19 bp, Homo sapiens
tcttactaaggcctttggt

SEQ ID NO: 6476499 - DNA, 14 bp, Homo sapiens
tcttactaatgtaa

SEQ ID NO: 6476500 - DNA, 21 bp, Homo sapiens
tcttactaatgtaaaatgatt

SEQ ID NO: 6476501 - DNA, 16 bp, Homo sapiens
tcttactactttaaat

SEQ ID NO: 6476502 - DNA, 17 bp, Homo sapiens
tcttactattaagcagt

SEQ ID NO: 6476503 - DNA, 15 bp, Homo sapiens
tcttactatttcaca

SEQ ID NO: 6476504 - DNA, 16 bp, Homo sapiens
tcttactcctcctctt

SEQ ID NO: 6476505 - DNA, 13 bp, Homo sapiens
tcttactctgccg

SEQ ID NO: 6476506 - DNA, 13 bp, Homo sapiens
tcttactctttcc

SEQ ID NO: 6476507 - DNA, 16 bp, Homo sapiens
tcttactgataatttt

SEQ ID NO: 6476508 - DNA, 22 bp, Homo sapiens
tcttactgcttaattcaaataa

SEQ ID NO: 6476509 - DNA, 20 bp, Homo sapiens
tcttactgcttcatgtaatt

SEQ ID NO: 6476510 - DNA, 19 bp, Homo sapiens
tcttactgggccctgggga

SEQ ID NO: 6476511 - DNA, 20 bp, Homo sapiens
tcttactggggcctggggct

SEQ ID NO: 6476512 - DNA, 14 bp, Homo sapiens
tcttactgtatttg

SEQ ID NO: 6476513 - DNA, 15 bp, Homo sapiens
tcttactgttttgag

SEQ ID NO: 6476514 - DNA, 23 bp, Homo sapiens
tcttacttactaaaatatatata

SEQ ID NO: 6476515 - DNA, 22 bp, Homo sapiens
tcttacttcacccggctgggct

SEQ ID NO: 6476516 - DNA, 15 bp, Homo sapiens
tcttacttcccccac

SEQ ID NO: 6476517 - DNA, 22 bp, Homo sapiens
tcttacttcccccaccctgggt

SEQ ID NO: 6476518 - DNA, 14 bp, Homo sapiens
tcttacttgagtat

SEQ ID NO: 6476519 - DNA, 18 bp, Homo sapiens
tcttacttgagtatcata

SEQ ID NO: 6476520 - DNA, 19 bp, Homo sapiens
tcttacttgcaaaatggag

SEQ ID NO: 6476521 - DNA, 22 bp, Homo sapiens
tcttacttgtcctttgaggccc

SEQ ID NO: 6476522 - DNA, 22 bp, Homo sapiens
tcttactttgcttgagaatcct

SEQ ID NO: 6476523 - DNA, 15 bp, Homo sapiens
tcttactttgtaaat

SEQ ID NO: 6476524 - DNA, 16 bp, Homo sapiens
tcttactttgtaaatt

SEQ ID NO: 6476525 - DNA, 22 bp, Homo sapiens
tcttactttgtaaattctgatt

SEQ ID NO: 6476526 - DNA, 13 bp, Homo sapiens
tcttactttgtgc

SEQ ID NO: 6476527 - DNA, 23 bp, Homo sapiens
tcttactttgtgcaaaagcaggc

SEQ ID NO: 6476528 - DNA, 14 bp, Homo sapiens
tcttactttgttaa

SEQ ID NO: 6476529 - DNA, 18 bp, Homo sapiens
tcttactttgttaattta

SEQ ID NO: 6476530 - DNA, 22 bp, Homo sapiens
tcttacttttcctggacttaaa

SEQ ID NO: 6476531 - DNA, 15 bp, Homo sapiens
tcttactttttgtaa

SEQ ID NO: 6476532 - DNA, 15 bp, Homo sapiens
tcttagaaaaggtga

SEQ ID NO: 6476533 - DNA, 20 bp, Homo sapiens
tcttagaaaaggtgataaaa

SEQ ID NO: 6476534 - DNA, 22 bp, Homo sapiens
tcttagaaaattaaaataggca

SEQ ID NO: 6476535 - DNA, 13 bp, Homo sapiens
tcttagaaatact

SEQ ID NO: 6476536 - DNA, 13 bp, Homo sapiens
tcttagaaatgaa

SEQ ID NO: 6476537 - DNA, 18 bp, Homo sapiens
tcttagaagaatattgta

SEQ ID NO: 6476538 - DNA, 14 bp, Homo sapiens
tcttagaagccatg

SEQ ID NO: 6476539 - DNA, 20 bp, Homo sapiens
tcttagaagccatgggacct

SEQ ID NO: 6476540 - DNA, 19 bp, Homo sapiens
tcttagacctcttcctgga

SEQ ID NO: 6476541 - DNA, 21 bp, Homo sapiens
tcttagactgagtaaagtgtt

SEQ ID NO: 6476542 - DNA, 15 bp, Homo sapiens
tcttagacttctgct

SEQ ID NO: 6476543 - DNA, 17 bp, Homo sapiens
tcttagacttttccaat

SEQ ID NO: 6476544 - DNA, 12 bp, Homo sapiens
tcttagagagag

SEQ ID NO: 6476545 - DNA, 13 bp, Homo sapiens
tcttagagagaga

SEQ ID NO: 6476546 - DNA, 21 bp, Homo sapiens
tcttagagataccctctgaga

SEQ ID NO: 6476547 - DNA, 14 bp, Homo sapiens
tcttagagatgatt

SEQ ID NO: 6476548 - DNA, 13 bp, Homo sapiens
tcttagagattaa

SEQ ID NO: 6476549 - DNA, 24 bp, Homo sapiens
tcttagagattaaaccaattataa

SEQ ID NO: 6476550 - DNA, 19 bp, Homo sapiens
tcttagagattttcatttt

SEQ ID NO: 6476551 - DNA, 20 bp, Homo sapiens
tcttagagccaagtgtcttt

SEQ ID NO: 6476552 - DNA, 21 bp, Homo sapiens
tcttagagccttttatctgca

SEQ ID NO: 6476553 - DNA, 23 bp, Homo sapiens
tcttagagtccttaagacggaag

SEQ ID NO: 6476554 - DNA, 16 bp, Homo sapiens
tcttagagtgtagctg

SEQ ID NO: 6476555 - DNA, 22 bp, Homo sapiens
tcttagagtttacagtttgtgt

SEQ ID NO: 6476556 - DNA, 17 bp, Homo sapiens
tcttagagttttattcc

SEQ ID NO: 6476557 - DNA, 17 bp, Homo sapiens
tcttagatatcttttta

SEQ ID NO: 6476558 - DNA, 23 bp, Homo sapiens
tcttagatatctttttattgatg

SEQ ID NO: 6476559 - DNA, 24 bp, Homo sapiens
tcttagatatctttttattgatgt

SEQ ID NO: 6476560 - DNA, 12 bp, Homo sapiens
tcttagatctgg

SEQ ID NO: 6476561 - DNA, 21 bp, Homo sapiens
tcttagatctggtgtccagca

SEQ ID NO: 6476562 - DNA, 22 bp, Homo sapiens
tcttagatggattctccactca

SEQ ID NO: 6476563 - DNA, 12 bp, Homo sapiens
tcttagatgtat

SEQ ID NO: 6476564 - DNA, 15 bp, Homo sapiens
tcttagatgtatata

SEQ ID NO: 6476565 - DNA, 14 bp, Homo sapiens
tcttagattatgtt

SEQ ID NO: 6476566 - DNA, 19 bp, Homo sapiens
tcttagattgggccatggc

SEQ ID NO: 6476567 - DNA, 21 bp, Homo sapiens
tcttagcatacattcagacgt

SEQ ID NO: 6476568 - DNA, 22 bp, Homo sapiens
tcttagcatagcttattattga

SEQ ID NO: 6476569 - DNA, 21 bp, Homo sapiens
tcttagccctcaccacagcct

SEQ ID NO: 6476570 - DNA, 17 bp, Homo sapiens
tcttagcctgtggcagt

SEQ ID NO: 6476571 - DNA, 22 bp, Homo sapiens
tcttagctatccttggctttca

SEQ ID NO: 6476572 - DNA, 19 bp, Homo sapiens
tcttagctcaatgagcatg

SEQ ID NO: 6476573 - DNA, 21 bp, Homo sapiens
tcttagctcaatgagcatgtt

SEQ ID NO: 6476574 - DNA, 17 bp, Homo sapiens
tcttagctcccctccaa

SEQ ID NO: 6476575 - DNA, 15 bp, Homo sapiens
tcttagctctggacg

SEQ ID NO: 6476576 - DNA, 20 bp, Homo sapiens
tcttagctctggacgtgaaa

SEQ ID NO: 6476577 - DNA, 19 bp, Homo sapiens
tcttagctctttctctatt

SEQ ID NO: 6476578 - DNA, 16 bp, Homo sapiens
tcttagctgcactgtt

SEQ ID NO: 6476579 - DNA, 17 bp, Homo sapiens
tcttagctgcactgttt

SEQ ID NO: 6476580 - DNA, 20 bp, Homo sapiens
tcttagctggatataatgta

SEQ ID NO: 6476581 - DNA, 18 bp, Homo sapiens
tcttagctgtctgctcag

SEQ ID NO: 6476582 - DNA, 22 bp, Homo sapiens
tcttagcttgtctgtgatctct

SEQ ID NO: 6476583 - DNA, 14 bp, Homo sapiens
tcttagctttacat

SEQ ID NO: 6476584 - DNA, 19 bp, Homo sapiens
tcttagctttacattttca

SEQ ID NO: 6476585 - DNA, 13 bp, Homo sapiens
tcttagctttcca

SEQ ID NO: 6476586 - DNA, 15 bp, Homo sapiens
tcttagctttccaca

SEQ ID NO: 6476587 - DNA, 14 bp, Homo sapiens
tcttagctttgaaa

SEQ ID NO: 6476588 - DNA, 15 bp, Homo sapiens
tcttagcttttaata

SEQ ID NO: 6476589 - DNA, 19 bp, Homo sapiens
tcttagcttttaatagtgt

SEQ ID NO: 6476590 - DNA, 18 bp, Homo sapiens
tcttagctttttaattgt

SEQ ID NO: 6476591 - DNA, 15 bp, Homo sapiens
tcttaggaagagaaa

SEQ ID NO: 6476592 - DNA, 17 bp, Homo sapiens
tcttaggagcaagaaga

SEQ ID NO: 6476593 - DNA, 22 bp, Homo sapiens
tcttaggagcaagaagaaaatg

SEQ ID NO: 6476594 - DNA, 19 bp, Homo sapiens
tcttaggcaatcacatagt

SEQ ID NO: 6476595 - DNA, 23 bp, Homo sapiens
tcttagggcacatgaaaaatttt

SEQ ID NO: 6476596 - DNA, 17 bp, Homo sapiens
tcttaggggattatctt

SEQ ID NO: 6476597 - DNA, 14 bp, Homo sapiens
tcttagggtacagc

SEQ ID NO: 6476598 - DNA, 18 bp, Homo sapiens
tcttaggtagtcatgctg

SEQ ID NO: 6476599 - DNA, 21 bp, Homo sapiens
tcttaggtagtcatgctgtgc

SEQ ID NO: 6476600 - DNA, 15 bp, Homo sapiens
tcttaggtcaggagt

SEQ ID NO: 6476601 - DNA, 11 bp, Homo sapiens
tcttaggtctt

SEQ ID NO: 6476602 - DNA, 14 bp, Homo sapiens
tcttaggtcttcct

SEQ ID NO: 6476603 - DNA, 19 bp, Homo sapiens
tcttaggtcttcctgtggc

SEQ ID NO: 6476604 - DNA, 14 bp, Homo sapiens
tcttaggtttactg

SEQ ID NO: 6476605 - DNA, 21 bp, Homo sapiens
tcttaggtttactgtgaagag

SEQ ID NO: 6476606 - DNA, 14 bp, Homo sapiens
tcttaggtttccac

SEQ ID NO: 6476607 - DNA, 16 bp, Homo sapiens
tcttaggtttccacgt

SEQ ID NO: 6476608 - DNA, 21 bp, Homo sapiens
tcttagtaccagagctagttt

SEQ ID NO: 6476609 - DNA, 13 bp, Homo sapiens
tcttagtccacaa

SEQ ID NO: 6476610 - DNA, 18 bp, Homo sapiens
tcttagtcctccctgctc

SEQ ID NO: 6476611 - DNA, 13 bp, Homo sapiens
tcttagtgaatgg

SEQ ID NO: 6476612 - DNA, 20 bp, Homo sapiens
tcttagtgcttcagagtttg

SEQ ID NO: 6476613 - DNA, 22 bp, Homo sapiens
tcttagtggaagacaatactcc

SEQ ID NO: 6476614 - DNA, 22 bp, Homo sapiens
tcttagttaatctttgaaaact

SEQ ID NO: 6476615 - DNA, 22 bp, Homo sapiens
tcttagttactttggaacacta

SEQ ID NO: 6476616 - DNA, 16 bp, Homo sapiens
tcttagttctcactgt

SEQ ID NO: 6476617 - DNA, 20 bp, Homo sapiens
tcttagttgacaacctagaa

SEQ ID NO: 6476618 - DNA, 21 bp, Homo sapiens
tcttagttgacaacctagaat

SEQ ID NO: 6476619 - DNA, 23 bp, Homo sapiens
tcttagttgacaacctagaatgt

SEQ ID NO: 6476620 - DNA, 15 bp, Homo sapiens
tcttagtttactgga

SEQ ID NO: 6476621 - DNA, 19 bp, Homo sapiens
tcttagtttacttatacct

SEQ ID NO: 6476622 - DNA, 15 bp, Homo sapiens
tcttagtttgaatga

SEQ ID NO: 6476623 - DNA, 16 bp, Homo sapiens
tcttagtttggattct

SEQ ID NO: 6476624 - DNA, 23 bp, Homo sapiens
tcttagtttggattcttatgtag

SEQ ID NO: 6476625 - DNA, 14 bp, Homo sapiens
tcttagtttttaaa

SEQ ID NO: 6476626 - DNA, 17 bp, Homo sapiens
tcttagtttttaaaaag

SEQ ID NO: 6476627 - DNA, 19 bp, Homo sapiens
tcttagtttttaaaaaggc

SEQ ID NO: 6476628 - DNA, 13 bp, Homo sapiens
tcttataaaatca

SEQ ID NO: 6476629 - DNA, 23 bp, Homo sapiens
tcttataaagtggacttctgaaa

SEQ ID NO: 6476630 - DNA, 11 bp, Homo sapiens
tcttataaata

SEQ ID NO: 6476631 - DNA, 14 bp, Homo sapiens
tcttataaatatga

SEQ ID NO: 6476632 - DNA, 18 bp, Homo sapiens
tcttataacattgtatgt

SEQ ID NO: 6476633 - DNA, 21 bp, Homo sapiens
tcttataacattgtatgttaa

SEQ ID NO: 6476634 - DNA, 23 bp, Homo sapiens
tcttataactgttttagaaattg

SEQ ID NO: 6476635 - DNA, 14 bp, Homo sapiens
tcttataacttctg

SEQ ID NO: 6476636 - DNA, 21 bp, Homo sapiens
tcttataacttctgaagtaat

SEQ ID NO: 6476637 - DNA, 15 bp, Homo sapiens
tcttataagaaaaca

SEQ ID NO: 6476638 - DNA, 20 bp, Homo sapiens
tcttataagaaaacatgtaa

SEQ ID NO: 6476639 - DNA, 19 bp, Homo sapiens
tcttataagaagaagagag

SEQ ID NO: 6476640 - DNA, 20 bp, Homo sapiens
tcttataatactctgttgta

SEQ ID NO: 6476641 - DNA, 13 bp, Homo sapiens
tcttataatttaa

SEQ ID NO: 6476642 - DNA, 15 bp, Homo sapiens
tcttatacatttgat

SEQ ID NO: 6476643 - DNA, 19 bp, Homo sapiens
tcttataccttctgacagc

SEQ ID NO: 6476644 - DNA, 21 bp, Homo sapiens
tcttataccttctgacagccc

SEQ ID NO: 6476645 - DNA, 16 bp, Homo sapiens
tcttatacgcttttct

SEQ ID NO: 6476646 - DNA, 18 bp, Homo sapiens
tcttatacgtctagccta

SEQ ID NO: 6476647 - DNA, 17 bp, Homo sapiens
tcttatagggtaaaaaa

SEQ ID NO: 6476648 - DNA, 17 bp, Homo sapiens
tcttataggtttccact

SEQ ID NO: 6476649 - DNA, 22 bp, Homo sapiens
tcttatagtcaatgtttctttt

SEQ ID NO: 6476650 - DNA, 17 bp, Homo sapiens
tcttatagttctaggca

SEQ ID NO: 6476651 - DNA, 18 bp, Homo sapiens
tcttatataagatcactg

SEQ ID NO: 6476652 - DNA, 22 bp, Homo sapiens
tcttatatatatattgattatt

SEQ ID NO: 6476653 - DNA, 15 bp, Homo sapiens
tcttatatatgtgaa

SEQ ID NO: 6476654 - DNA, 18 bp, Homo sapiens
tcttatatatgtgaacat

SEQ ID NO: 6476655 - DNA, 15 bp, Homo sapiens
tcttatatctgaaga

SEQ ID NO: 6476656 - DNA, 20 bp, Homo sapiens
tcttatattggtttgcacaa

SEQ ID NO: 6476657 - DNA, 23 bp, Homo sapiens
tcttatcaaggactctggtttct

SEQ ID NO: 6476658 - DNA, 15 bp, Homo sapiens
tcttatcacacttgc

SEQ ID NO: 6476659 - DNA, 15 bp, Homo sapiens
tcttatcactaagaa

SEQ ID NO: 6476660 - DNA, 20 bp, Homo sapiens
tcttatcatggtctcagtca

SEQ ID NO: 6476661 - DNA, 24 bp, Homo sapiens
tcttatccaactttttcatagtaa

SEQ ID NO: 6476662 - DNA, 15 bp, Homo sapiens
tcttatcccccccag

SEQ ID NO: 6476663 - DNA, 16 bp, Homo sapiens
tcttatcctccaccgt

SEQ ID NO: 6476664 - DNA, 19 bp, Homo sapiens
tcttatcctctctctcttc

SEQ ID NO: 6476665 - DNA, 15 bp, Homo sapiens
tcttatctactgact

SEQ ID NO: 6476666 - DNA, 16 bp, Homo sapiens
tcttatctcagatatt

SEQ ID NO: 6476667 - DNA, 20 bp, Homo sapiens
tcttatctcagatatttgca

SEQ ID NO: 6476668 - DNA, 14 bp, Homo sapiens
tcttatctgttcag

SEQ ID NO: 6476669 - DNA, 15 bp, Homo sapiens
tcttatcttctgcaa

SEQ ID NO: 6476670 - DNA, 20 bp, Homo sapiens
tcttatcttgctttggagga

SEQ ID NO: 6476671 - DNA, 13 bp, Homo sapiens
tcttatctttgat

SEQ ID NO: 6476672 - DNA, 15 bp, Homo sapiens
tgctgacaatgctgc

SEQ ID NO: 6476673 - DNA, 16 bp, Homo sapiens
tgctgacaatgctgcc

SEQ ID NO: 6476674 - DNA, 17 bp, Homo sapiens
tgctgacaatgctgcca

SEQ ID NO: 6476675 - DNA, 15 bp, Homo sapiens
tgctgacagacacag

SEQ ID NO: 6476676 - DNA, 19 bp, Homo sapiens
tgctgacagacacaggccc

SEQ ID NO: 6476677 - DNA, 22 bp, Homo sapiens
tgctgacagacacaggcccggc

SEQ ID NO: 6476678 - DNA, 13 bp, Homo sapiens
tgctgacagagcc

SEQ ID NO: 6476679 - DNA, 13 bp, Homo sapiens
tgctgacagctct

SEQ ID NO: 6476680 - DNA, 16 bp, Homo sapiens
tgctgacaggatgtgg

SEQ ID NO: 6476681 - DNA, 20 bp, Homo sapiens
tgctgacaggatgtggcact

SEQ ID NO: 6476682 - DNA, 15 bp, Homo sapiens
tgctgacaggtgatg

SEQ ID NO: 6476683 - DNA, 23 bp, Homo sapiens
tgctgacaggtgatgctctggct

SEQ ID NO: 6476684 - DNA, 17 bp, Homo sapiens
tgctgacatcatttgta

SEQ ID NO: 6476685 - DNA, 18 bp, Homo sapiens
tgctgacattcacctgcc

SEQ ID NO: 6476686 - DNA, 20 bp, Homo sapiens
tgctgaccaattgtgctgcc

SEQ ID NO: 6476687 - DNA, 23 bp, Homo sapiens
tgctgaccaattgtgctgccatt

SEQ ID NO: 6476688 - DNA, 22 bp, Homo sapiens
tgctgaccataacagtgccagc

SEQ ID NO: 6476689 - DNA, 23 bp, Homo sapiens
tgctgaccataacagtgccagct

SEQ ID NO: 6476690 - DNA, 23 bp, Homo sapiens
tgctgacccaccaaggtctcaca

SEQ ID NO: 6476691 - DNA, 18 bp, Homo sapiens
tgctgacccaggaatagt

SEQ ID NO: 6476692 - DNA, 18 bp, Homo sapiens
tgctgacccatgggcagg

SEQ ID NO: 6476693 - DNA, 19 bp, Homo sapiens
tgctgacccatgggcagga

SEQ ID NO: 6476694 - DNA, 14 bp, Homo sapiens
tgctgaccccaggt

SEQ ID NO: 6476695 - DNA, 19 bp, Homo sapiens
tgctgaccccaggtcagcc

SEQ ID NO: 6476696 - DNA, 22 bp, Homo sapiens
tgctgaccccaggtcagccctg

SEQ ID NO: 6476697 - DNA, 20 bp, Homo sapiens
tgctgacctatagtaagtgc

SEQ ID NO: 6476698 - DNA, 13 bp, Homo sapiens
tgctgacctcact

SEQ ID NO: 6476699 - DNA, 20 bp, Homo sapiens
tgctgacctcactgtcctgt

SEQ ID NO: 6476700 - DNA, 15 bp, Homo sapiens
tgctgacctccacag

SEQ ID NO: 6476701 - DNA, 14 bp, Homo sapiens
tgctgacctgctga

SEQ ID NO: 6476702 - DNA, 18 bp, Homo sapiens
tgctgaccttcacccaga

SEQ ID NO: 6476703 - DNA, 14 bp, Homo sapiens
tgctgacggccagg

SEQ ID NO: 6476704 - DNA, 21 bp, Homo sapiens
tgctgactactactctgccaa

SEQ ID NO: 6476705 - DNA, 23 bp, Homo sapiens
tgctgactccacgatcctgccac

SEQ ID NO: 6476706 - DNA, 21 bp, Homo sapiens
tgctgactccatatggaggcc

SEQ ID NO: 6476707 - DNA, 20 bp, Homo sapiens
tgctgactctctgagctggg

SEQ ID NO: 6476708 - DNA, 17 bp, Homo sapiens
tgctgactgaggcctgc

SEQ ID NO: 6476709 - DNA, 21 bp, Homo sapiens
tgctgactgggactcccagct

SEQ ID NO: 6476710 - DNA, 16 bp, Homo sapiens
tgctgactgtactcct

SEQ ID NO: 6476711 - DNA, 19 bp, Homo sapiens
tgctgactgtactcctccc

SEQ ID NO: 6476712 - DNA, 17 bp, Homo sapiens
tgctgactgtagctttg

SEQ ID NO: 6476713 - DNA, 14 bp, Homo sapiens
tgctgacttagaat

SEQ ID NO: 6476714 - DNA, 13 bp, Homo sapiens
tgctgacttccca

SEQ ID NO: 6476715 - DNA, 17 bp, Homo sapiens
tgctgagagacccaagg

SEQ ID NO: 6476716 - DNA, 16 bp, Homo sapiens
tgctgagagacctcag

SEQ ID NO: 6476717 - DNA, 19 bp, Homo sapiens
tgctgagaggcgagctcct

SEQ ID NO: 6476718 - DNA, 18 bp, Homo sapiens
tgctgagatcctggactg

SEQ ID NO: 6476719 - DNA, 21 bp, Homo sapiens
tgctgagatcgaagaggccag

SEQ ID NO: 6476720 - DNA, 21 bp, Homo sapiens
tgctgagatgtttagtagctg

SEQ ID NO: 6476721 - DNA, 20 bp, Homo sapiens
tgctgagattacaggtgtga

SEQ ID NO: 6476722 - DNA, 16 bp, Homo sapiens
tgctgagcagcccagc

SEQ ID NO: 6476723 - DNA, 18 bp, Homo sapiens
tgctgagcagcccagcac

SEQ ID NO: 6476724 - DNA, 12 bp, Homo sapiens
tgctgagccagc

SEQ ID NO: 6476725 - DNA, 13 bp, Homo sapiens
tgctgagccagct

SEQ ID NO: 6476726 - DNA, 18 bp, Homo sapiens
tgctgagccagctgcaga

SEQ ID NO: 6476727 - DNA, 21 bp, Homo sapiens
tgctgagcctcacagcagtga

SEQ ID NO: 6476728 - DNA, 16 bp, Homo sapiens
tgctgagcctgcccag

SEQ ID NO: 6476729 - DNA, 23 bp, Homo sapiens
tgctgagctctgagaggccctgg

SEQ ID NO: 6476730 - DNA, 18 bp, Homo sapiens
tgctgagctgaagaaatt

SEQ ID NO: 6476731 - DNA, 13 bp, Homo sapiens
tgctgagctgccc

SEQ ID NO: 6476732 - DNA, 17 bp, Homo sapiens
tgctgagctgcccctgc

SEQ ID NO: 6476733 - DNA, 22 bp, Homo sapiens
tgctgagctgcccctgctgctt

SEQ ID NO: 6476734 - DNA, 17 bp, Homo sapiens
tgctgagctggcccttg

SEQ ID NO: 6476735 - DNA, 13 bp, Homo sapiens
tgctgagctgggc

SEQ ID NO: 6476736 - DNA, 21 bp, Homo sapiens
tgctgagctgggcccagcccc

SEQ ID NO: 6476737 - DNA, 22 bp, Homo sapiens
tgctgagctgggcccagcccct

SEQ ID NO: 6476738 - DNA, 16 bp, Homo sapiens
tgctgagcttagcctt

SEQ ID NO: 6476739 - DNA, 10 bp, Homo sapiens
tgctgaggag

SEQ ID NO: 6476740 - DNA, 21 bp, Homo sapiens
tgctgaggaggggcctgggca

SEQ ID NO: 6476741 - DNA, 16 bp, Homo sapiens
tgctgaggagggggag

SEQ ID NO: 6476742 - DNA, 19 bp, Homo sapiens
tgctgaggagtctgaggac

SEQ ID NO: 6476743 - DNA, 20 bp, Homo sapiens
tgctgaggagtctgaggact

SEQ ID NO: 6476744 - DNA, 14 bp, Homo sapiens
tgctgaggcaccgt

SEQ ID NO: 6476745 - DNA, 22 bp, Homo sapiens
tgctgaggcaccgtccaggccc

SEQ ID NO: 6476746 - DNA, 16 bp, Homo sapiens
tgctgaggccacccac

SEQ ID NO: 6476747 - DNA, 16 bp, Homo sapiens
tgctgaggcctgggcc

SEQ ID NO: 6476748 - DNA, 10 bp, Homo sapiens
tgctgaggcg

SEQ ID NO: 6476749 - DNA, 17 bp, Homo sapiens
tgctgagggaccagcca

SEQ ID NO: 6476750 - DNA, 18 bp, Homo sapiens
tgctgagggaccgagccc

SEQ ID NO: 6476751 - DNA, 22 bp, Homo sapiens
tgctgaggggcagggagagcgc

SEQ ID NO: 6476752 - DNA, 20 bp, Homo sapiens
tgctgagggggctctttccc

SEQ ID NO: 6476753 - DNA, 22 bp, Homo sapiens
tgctgagggggctctttccctc

SEQ ID NO: 6476754 - DNA, 12 bp, Homo sapiens
tgctgagggtgt

SEQ ID NO: 6476755 - DNA, 15 bp, Homo sapiens
tgctgaggtgggcct

SEQ ID NO: 6476756 - DNA, 16 bp, Homo sapiens
tgctgaggtgggcctt

SEQ ID NO: 6476757 - DNA, 21 bp, Homo sapiens
tgctgaggttgggaaggcacc

SEQ ID NO: 6476758 - DNA, 23 bp, Homo sapiens
tgctgaggttttgaataaaaagt

SEQ ID NO: 6476759 - DNA, 22 bp, Homo sapiens
tgctgagtcccaggctgagcct

SEQ ID NO: 6476760 - DNA, 20 bp, Homo sapiens
tgctgagtccgacctggcct

SEQ ID NO: 6476761 - DNA, 17 bp, Homo sapiens
tgctgagtctcccaagg

SEQ ID NO: 6476762 - DNA, 14 bp, Homo sapiens
tgctgagtctgaag

SEQ ID NO: 6476763 - DNA, 15 bp, Homo sapiens
tgctgagtctgaagg

SEQ ID NO: 6476764 - DNA, 17 bp, Homo sapiens
tgctgagtctgaaggct

SEQ ID NO: 6476765 - DNA, 21 bp, Homo sapiens
tgctgagtctgttctggtaat

SEQ ID NO: 6476766 - DNA, 20 bp, Homo sapiens
tgctgagtgaccgggggctg

SEQ ID NO: 6476767 - DNA, 23 bp, Homo sapiens
tgctgagtgaccgggggctgctg

SEQ ID NO: 6476768 - DNA, 15 bp, Homo sapiens
tgctgagtgctgggc

SEQ ID NO: 6476769 - DNA, 16 bp, Homo sapiens
tgctgagtgctgggca

SEQ ID NO: 6476770 - DNA, 15 bp, Homo sapiens
tgctgagttgcttct

SEQ ID NO: 6476771 - DNA, 16 bp, Homo sapiens
tgctgagttgttctaa

SEQ ID NO: 6476772 - DNA, 18 bp, Homo sapiens
tgctgagtttcccttcct

SEQ ID NO: 6476773 - DNA, 15 bp, Homo sapiens
tgctgagtttgtgct

SEQ ID NO: 6476774 - DNA, 17 bp, Homo sapiens
tgctgagtttgtgctgg

SEQ ID NO: 6476775 - DNA, 17 bp, Homo sapiens
tgctgatatcaacagct

SEQ ID NO: 6476776 - DNA, 18 bp, Homo sapiens
tgctgatatttaaattca

SEQ ID NO: 6476777 - DNA, 18 bp, Homo sapiens
tgctgatcaatgaaatgc

SEQ ID NO: 6476778 - DNA, 20 bp, Homo sapiens
tgctgatcagagttcctcct

SEQ ID NO: 6476779 - DNA, 21 bp, Homo sapiens
tgctgatcatcgccagaggtg

SEQ ID NO: 6476780 - DNA, 17 bp, Homo sapiens
tgctgatccccaacctg

SEQ ID NO: 6476781 - DNA, 18 bp, Homo sapiens
tgctgatccctgctctct

SEQ ID NO: 6476782 - DNA, 22 bp, Homo sapiens
tgctgatccctgctctctgagt

SEQ ID NO: 6476783 - DNA, 17 bp, Homo sapiens
tgctgatcctgctgacc

SEQ ID NO: 6476784 - DNA, 18 bp, Homo sapiens
tgctgatcctgctgacct

SEQ ID NO: 6476785 - DNA, 14 bp, Homo sapiens
tgctgatccttgca

SEQ ID NO: 6476786 - DNA, 19 bp, Homo sapiens
tgctgatcttttaaaatca

SEQ ID NO: 6476787 - DNA, 21 bp, Homo sapiens
tgctgatgaactcttaatcaa

SEQ ID NO: 6476788 - DNA, 19 bp, Homo sapiens
tgctgatgaatcactgttt

SEQ ID NO: 6476789 - DNA, 22 bp, Homo sapiens
tgctgatgctcatggtccccat

SEQ ID NO: 6476790 - DNA, 16 bp, Homo sapiens
tgctgatgctgaaata

SEQ ID NO: 6476791 - DNA, 20 bp, Homo sapiens
tgctgatggcccctccagca

SEQ ID NO: 6476792 - DNA, 21 bp, Homo sapiens
tgctgatggcccctccagcac

SEQ ID NO: 6476793 - DNA, 13 bp, Homo sapiens
tgctgatggccct

SEQ ID NO: 6476794 - DNA, 18 bp, Homo sapiens
tgctgatggccctcatct

SEQ ID NO: 6476795 - DNA, 22 bp, Homo sapiens
tgctgatggccctcatctccag

SEQ ID NO: 6476796 - DNA, 16 bp, Homo sapiens
tgctgatggcttgaca

SEQ ID NO: 6476797 - DNA, 14 bp, Homo sapiens
tgctgatggtctgg

SEQ ID NO: 6476798 - DNA, 19 bp, Homo sapiens
tgctgatggtctggtctat

SEQ ID NO: 6476799 - DNA, 15 bp, Homo sapiens
tgctgatggtgcaat

SEQ ID NO: 6476800 - DNA, 20 bp, Homo sapiens
tgctgatggtgcaatgacct

SEQ ID NO: 6476801 - DNA, 18 bp, Homo sapiens
tgctgatgtaggagctgg

SEQ ID NO: 6476802 - DNA, 21 bp, Homo sapiens
tgctgatgtggcaactgctga

SEQ ID NO: 6476803 - DNA, 13 bp, Homo sapiens
tgctgatgttcag

SEQ ID NO: 6476804 - DNA, 17 bp, Homo sapiens
tgctgatgttcagtgta

SEQ ID NO: 6476805 - DNA, 17 bp, Homo sapiens
tgctgattatttatgac

SEQ ID NO: 6476806 - DNA, 20 bp, Homo sapiens
tgctgattcaaaccaaagct

SEQ ID NO: 6476807 - DNA, 18 bp, Homo sapiens
tgctgattcaagaaacag

SEQ ID NO: 6476808 - DNA, 21 bp, Homo sapiens
tgctgattcaagaaacagaag

SEQ ID NO: 6476809 - DNA, 16 bp, Homo sapiens
tgctgattcttgtaaa

SEQ ID NO: 6476810 - DNA, 23 bp, Homo sapiens
tgctgattgatttttttctcctt

SEQ ID NO: 6476811 - DNA, 17 bp, Homo sapiens
tgctgatttaaacacat

SEQ ID NO: 6476812 - DNA, 19 bp, Homo sapiens
tgctgatttcccctcttcc

SEQ ID NO: 6476813 - DNA, 13 bp, Homo sapiens
tgctgatttctag

SEQ ID NO: 6476814 - DNA, 16 bp, Homo sapiens
tgctgatttctagtgt

SEQ ID NO: 6476815 - DNA, 12 bp, Homo sapiens
tgctgattttaa

SEQ ID NO: 6476816 - DNA, 16 bp, Homo sapiens
tgctgattttaatgga

SEQ ID NO: 6476817 - DNA, 17 bp, Homo sapiens
tgctgattttattcttg

SEQ ID NO: 6476818 - DNA, 13 bp, Homo sapiens
tgctgattttgac

SEQ ID NO: 6476819 - DNA, 23 bp, Homo sapiens
tgctgcaaacccatgaagctggc

SEQ ID NO: 6476820 - DNA, 13 bp, Homo sapiens
tgctgcaaacctg

SEQ ID NO: 6476821 - DNA, 20 bp, Homo sapiens
tgctgcaaacctgacccctg

SEQ ID NO: 6476822 - DNA, 16 bp, Homo sapiens
tgctgcaaacttaatg

SEQ ID NO: 6476823 - DNA, 22 bp, Homo sapiens
tgctgcaaagagttatatgact

SEQ ID NO: 6476824 - DNA, 17 bp, Homo sapiens
tgctgcaaaggagaagc

SEQ ID NO: 6476825 - DNA, 15 bp, Homo sapiens
tgctgcaaagtgcaa

SEQ ID NO: 6476826 - DNA, 16 bp, Homo sapiens
tgctgcaaagtgcaaa

SEQ ID NO: 6476827 - DNA, 21 bp, Homo sapiens
tgctgcaaatagccttcctga

SEQ ID NO: 6476828 - DNA, 17 bp, Homo sapiens
tgctgcaacaaaatgta

SEQ ID NO: 6476829 - DNA, 12 bp, Homo sapiens
tgctgcaaccca

SEQ ID NO: 6476830 - DNA, 14 bp, Homo sapiens
tgctgcaacttttt

SEQ ID NO: 6476831 - DNA, 21 bp, Homo sapiens
tgctgcaacttttttatgtct

SEQ ID NO: 6476832 - DNA, 21 bp, Homo sapiens
tgctgcaaggacattcttgta

SEQ ID NO: 6476833 - DNA, 23 bp, Homo sapiens
tgctgcaaggcctttctgtgtgt

SEQ ID NO: 6476834 - DNA, 22 bp, Homo sapiens
tgctgcaaggtggcctctgcct

SEQ ID NO: 6476835 - DNA, 23 bp, Homo sapiens
tgctgcaaggtggcctctgcctg

SEQ ID NO: 6476836 - DNA, 17 bp, Homo sapiens
tgctgcacaccaaggcc

SEQ ID NO: 6476837 - DNA, 15 bp, Homo sapiens
tgctgcacagcagga

SEQ ID NO: 6476838 - DNA, 17 bp, Homo sapiens
tgctgcacagcaggacc

SEQ ID NO: 6476839 - DNA, 19 bp, Homo sapiens
tgctgcacagcaggacctg

SEQ ID NO: 6476840 - DNA, 16 bp, Homo sapiens
tgctgcacaggccctg

SEQ ID NO: 6476841 - DNA, 17 bp, Homo sapiens
tgctgcacaggccctgg

SEQ ID NO: 6476842 - DNA, 19 bp, Homo sapiens
tgctgcaccaacccagccg

SEQ ID NO: 6476843 - DNA, 13 bp, Homo sapiens
tgctgcaccagag

SEQ ID NO: 6476844 - DNA, 15 bp, Homo sapiens
tgctgcaccagagtg

SEQ ID NO: 6476845 - DNA, 14 bp, Homo sapiens
tgctgcacccaact

SEQ ID NO: 6476846 - DNA, 16 bp, Homo sapiens
tgctgcaccctgcgcc

SEQ ID NO: 6476847 - DNA, 20 bp, Homo sapiens
tgctgcaccctgcgcctcca

SEQ ID NO: 6476848 - DNA, 21 bp, Homo sapiens
tgctgcaccctgcgcctccag

SEQ ID NO: 6476849 - DNA, 15 bp, Homo sapiens
tgctgcacctgaggc

SEQ ID NO: 6476850 - DNA, 15 bp, Homo sapiens
tgctgcactaggact

SEQ ID NO: 6476851 - DNA, 17 bp, Homo sapiens
tgctgcactgccctccg

SEQ ID NO: 6476852 - DNA, 17 bp, Homo sapiens
tgctgcacttcctgttt

SEQ ID NO: 6476853 - DNA, 20 bp, Homo sapiens
tgctgcagacaaaaagaaca

SEQ ID NO: 6476854 - DNA, 13 bp, Homo sapiens
tgctgcagactca

SEQ ID NO: 6476855 - DNA, 10 bp, Homo sapiens
tgctgcagag

SEQ ID NO: 6476856 - DNA, 12 bp, Homo sapiens
tgctgcagagat

SEQ ID NO: 6476857 - DNA, 17 bp, Homo sapiens
tgctgcagagttgaggg

SEQ ID NO: 6476858 - DNA, 13 bp, Homo sapiens
tgctgcagatact

SEQ ID NO: 6476859 - DNA, 23 bp, Homo sapiens
tgctgcagattagttctttttgc

SEQ ID NO: 6476860 - DNA, 14 bp, Homo sapiens
tgctgcagctccct

SEQ ID NO: 6476861 - DNA, 20 bp, Homo sapiens
tgctgcagctccctcctcag

SEQ ID NO: 6476862 - DNA, 15 bp, Homo sapiens
tgctgcagctccctg

SEQ ID NO: 6476863 - DNA, 21 bp, Homo sapiens
tgctgcagctccctggcttct

SEQ ID NO: 6476864 - DNA, 21 bp, Homo sapiens
tgctgcaggacttgagaagac

SEQ ID NO: 6476865 - DNA, 14 bp, Homo sapiens
tgctgcaggccctc

SEQ ID NO: 6476866 - DNA, 18 bp, Homo sapiens
tgctgcaggccctccctc

SEQ ID NO: 6476867 - DNA, 21 bp, Homo sapiens
tgctgcagggctttaaaattc

SEQ ID NO: 6476868 - DNA, 19 bp, Homo sapiens
tgctgcaggggctctggag

SEQ ID NO: 6476869 - DNA, 15 bp, Homo sapiens
tgctgcagttgccag

SEQ ID NO: 6476870 - DNA, 23 bp, Homo sapiens
tgctgcagttgccagtcaccccg

SEQ ID NO: 6476871 - DNA, 19 bp, Homo sapiens
tgctgcataaatttgtaat

SEQ ID NO: 6476872 - DNA, 20 bp, Homo sapiens
tgctgcatagctctatttta

SEQ ID NO: 6476873 - DNA, 21 bp, Homo sapiens
tgctgcatagctctattttaa

SEQ ID NO: 6476874 - DNA, 14 bp, Homo sapiens
tgctgcatatttgt

SEQ ID NO: 6476875 - DNA, 16 bp, Homo sapiens
tgctgcatatttgtgc

SEQ ID NO: 6476876 - DNA, 14 bp, Homo sapiens
tgctgcatcccctt

SEQ ID NO: 6476877 - DNA, 19 bp, Homo sapiens
tgctgcatgaaaaacattc

SEQ ID NO: 6476878 - DNA, 16 bp, Homo sapiens
tgctgcatgccctctc

SEQ ID NO: 6476879 - DNA, 19 bp, Homo sapiens
tgctgcatgccctctcagg

SEQ ID NO: 6476880 - DNA, 15 bp, Homo sapiens
tgctgcatgcctggt

SEQ ID NO: 6476881 - DNA, 14 bp, Homo sapiens
tgctgcatggcagg

SEQ ID NO: 6476882 - DNA, 23 bp, Homo sapiens
tgctgcatgggttaattgagaat

SEQ ID NO: 6476883 - DNA, 18 bp, Homo sapiens
tgctgcattgagtccagc

SEQ ID NO: 6476884 - DNA, 23 bp, Homo sapiens
tgctgcatttaaaagatacagtt

SEQ ID NO: 6476885 - DNA, 17 bp, Homo sapiens
tgctgcatttggctgga

SEQ ID NO: 6476886 - DNA, 12 bp, Homo sapiens
tgctgcatttta

SEQ ID NO: 6476887 - DNA, 20 bp, Homo sapiens
tgctgcattttaagcataat

SEQ ID NO: 6476888 - DNA, 23 bp, Homo sapiens
tgctgcattttaagcataattaa

SEQ ID NO: 6476889 - DNA, 22 bp, Homo sapiens
tgctgccaaaaccacatgggct

SEQ ID NO: 6476890 - DNA, 17 bp, Homo sapiens
tgctgccaaccatacct

SEQ ID NO: 6476891 - DNA, 20 bp, Homo sapiens
tgctgccaagtcctgccttt

SEQ ID NO: 6476892 - DNA, 23 bp, Homo sapiens
tgctgccaagtcctgcctttggg

SEQ ID NO: 6476893 - DNA, 16 bp, Homo sapiens
tgctgccaatatccta

SEQ ID NO: 6476894 - DNA, 17 bp, Homo sapiens
tgctgccaatatcctaa

SEQ ID NO: 6476895 - DNA, 21 bp, Homo sapiens
tgctgccaatatcctaataaa

SEQ ID NO: 6476896 - DNA, 16 bp, Homo sapiens
tgctgccacagcaagg

SEQ ID NO: 6476897 - DNA, 19 bp, Homo sapiens
tgctgccaccaaatctgtc

SEQ ID NO: 6476898 - DNA, 22 bp, Homo sapiens
tgctgccaccaaatctgtctag

SEQ ID NO: 6476899 - DNA, 17 bp, Homo sapiens
tgctgccaccacttttg

SEQ ID NO: 6476900 - DNA, 22 bp, Homo sapiens
tgctgccaccccttggcactgt

SEQ ID NO: 6476901 - DNA, 16 bp, Homo sapiens
tgctgccactctgctg

SEQ ID NO: 6476902 - DNA, 14 bp, Homo sapiens
tgctgccactgagg

SEQ ID NO: 6476903 - DNA, 23 bp, Homo sapiens
tgctgccacttaaaaagacttga

SEQ ID NO: 6476904 - DNA, 14 bp, Homo sapiens
tgctgccacttttt

SEQ ID NO: 6476905 - DNA, 16 bp, Homo sapiens
tgctgccaggctccca

SEQ ID NO: 6476906 - DNA, 15 bp, Homo sapiens
tgctgccagggcttc

SEQ ID NO: 6476907 - DNA, 17 bp, Homo sapiens
tgctgccagtaccagcc

SEQ ID NO: 6476908 - DNA, 19 bp, Homo sapiens
tgctgccagtaccagcccc

SEQ ID NO: 6476909 - DNA, 20 bp, Homo sapiens
tgctgccagtaccagcccca

SEQ ID NO: 6476910 - DNA, 12 bp, Homo sapiens
tgctgccatcca

SEQ ID NO: 6476911 - DNA, 13 bp, Homo sapiens
tgctgccatgcca

SEQ ID NO: 6476912 - DNA, 22 bp, Homo sapiens
tgctgccatgccactgccaggc

SEQ ID NO: 6476913 - DNA, 17 bp, Homo sapiens
tgctgcccaccccctgc

SEQ ID NO: 6476914 - DNA, 22 bp, Homo sapiens
tgctgcccaccccctgctggtg

SEQ ID NO: 6476915 - DNA, 19 bp, Homo sapiens
tgctgcccacggccaccca

SEQ ID NO: 6476916 - DNA, 22 bp, Homo sapiens
tgctgcccagcagcccctgaga

SEQ ID NO: 6476917 - DNA, 23 bp, Homo sapiens
tgctgcccagcagcccctgagag

SEQ ID NO: 6476918 - DNA, 17 bp, Homo sapiens
tgctgcccagccactcc

SEQ ID NO: 6476919 - DNA, 23 bp, Homo sapiens
tgctgcccatgagcaagcctagg

SEQ ID NO: 6476920 - DNA, 20 bp, Homo sapiens
tgctgcccatgcaccttcca

SEQ ID NO: 6476921 - DNA, 14 bp, Homo sapiens
tgctgcccatgcca

SEQ ID NO: 6476922 - DNA, 13 bp, Homo sapiens
tgctgccccagct

SEQ ID NO: 6476923 - DNA, 14 bp, Homo sapiens
tgctgccccagctg

SEQ ID NO: 6476924 - DNA, 16 bp, Homo sapiens
tgctgcccccagaccc

SEQ ID NO: 6476925 - DNA, 19 bp, Homo sapiens
tgctgccccgttccctgtc

SEQ ID NO: 6476926 - DNA, 20 bp, Homo sapiens
tgctgccccgttccctgtca

SEQ ID NO: 6476927 - DNA, 21 bp, Homo sapiens
tgctgcccctgcacagcaggc

SEQ ID NO: 6476928 - DNA, 15 bp, Homo sapiens
tgctgcccctgcctt

SEQ ID NO: 6476929 - DNA, 14 bp, Homo sapiens
tgctgccccttgca

SEQ ID NO: 6476930 - DNA, 18 bp, Homo sapiens
tgctgccccttgcaagcc

SEQ ID NO: 6476931 - DNA, 21 bp, Homo sapiens
tgctgccccttgcaagccata

SEQ ID NO: 6476932 - DNA, 22 bp, Homo sapiens
tgctgccccttgcaagccataa

SEQ ID NO: 6476933 - DNA, 15 bp, Homo sapiens
tgctgcccgtgagga

SEQ ID NO: 6476934 - DNA, 20 bp, Homo sapiens
tgctgcccgtgaggaggggg

SEQ ID NO: 6476935 - DNA, 13 bp, Homo sapiens
tgctgccctccat

SEQ ID NO: 6476936 - DNA, 21 bp, Homo sapiens
tgctgccctcccacagcctcc

SEQ ID NO: 6476937 - DNA, 23 bp, Homo sapiens
tgctgccctcccacagcctcctt

SEQ ID NO: 6476938 - DNA, 23 bp, Homo sapiens
tgctgccctccccctcctctcca

SEQ ID NO: 6476939 - DNA, 11 bp, Homo sapiens
tgctgccctga

SEQ ID NO: 6476940 - DNA, 13 bp, Homo sapiens
tgctgccctgccc

SEQ ID NO: 6476941 - DNA, 19 bp, Homo sapiens
tgctgccctgcccacctgg

SEQ ID NO: 6476942 - DNA, 16 bp, Homo sapiens
tgctgccctggggcat

SEQ ID NO: 6476943 - DNA, 20 bp, Homo sapiens
tgctgccctggggcatcatg

SEQ ID NO: 6476944 - DNA, 11 bp, Homo sapiens
tgctgccctgt

SEQ ID NO: 6476945 - DNA, 14 bp, Homo sapiens
tgctgccctgtgta

SEQ ID NO: 6476946 - DNA, 20 bp, Homo sapiens
tgctgccgagggctggccgg

SEQ ID NO: 6476947 - DNA, 22 bp, Homo sapiens
tgctgccgagggctggccggga

SEQ ID NO: 6476948 - DNA, 19 bp, Homo sapiens
tgctgccgccccacccaga

SEQ ID NO: 6476949 - DNA, 23 bp, Homo sapiens
tgctgccgccccacccagatggg

SEQ ID NO: 6476950 - DNA, 19 bp, Homo sapiens
tgctgccgcctcccagcct

SEQ ID NO: 6476951 - DNA, 13 bp, Homo sapiens
tgctgcctaggct

SEQ ID NO: 6476952 - DNA, 13 bp, Homo sapiens
tgctgcctcagct

SEQ ID NO: 6476953 - DNA, 13 bp, Homo sapiens
tgctgcctcagga

SEQ ID NO: 6476954 - DNA, 15 bp, Homo sapiens
tgctgcctcaggaat

SEQ ID NO: 6476955 - DNA, 15 bp, Homo sapiens
tgctgcctccctggg

SEQ ID NO: 6476956 - DNA, 19 bp, Homo sapiens
tgctgcctcggatcccctt

SEQ ID NO: 6476957 - DNA, 20 bp, Homo sapiens
tgctgcctcggatccccttc

SEQ ID NO: 6476958 - DNA, 22 bp, Homo sapiens
tgctgcctcggatccccttcct

SEQ ID NO: 6476959 - DNA, 13 bp, Homo sapiens
tgctgcctctctt

SEQ ID NO: 6476960 - DNA, 14 bp, Homo sapiens
tgctgcctctgaaa

SEQ ID NO: 6476961 - DNA, 21 bp, Homo sapiens
tgctgcctctgaaacagaaag

SEQ ID NO: 6476962 - DNA, 19 bp, Homo sapiens
tgctgcctctttccctagg

SEQ ID NO: 6476963 - DNA, 14 bp, Homo sapiens
tgctgcctgagtca

SEQ ID NO: 6476964 - DNA, 21 bp, Homo sapiens
tgctgcctgcccgcacagcag

SEQ ID NO: 6476965 - DNA, 12 bp, Homo sapiens
tgctgcctgcct

SEQ ID NO: 6476966 - DNA, 14 bp, Homo sapiens
tgctgcctgcctgt

SEQ ID NO: 6476967 - DNA, 15 bp, Homo sapiens
tgctgcctgcctgtc

SEQ ID NO: 6476968 - DNA, 13 bp, Homo sapiens
tgctgcctggagt

SEQ ID NO: 6476969 - DNA, 16 bp, Homo sapiens
tgctgcctggagtcag

SEQ ID NO: 6476970 - DNA, 13 bp, Homo sapiens
tgctgcctggcca

SEQ ID NO: 6476971 - DNA, 14 bp, Homo sapiens
tgctgcctggccac

SEQ ID NO: 6476972 - DNA, 11 bp, Homo sapiens
tgctgcctggg

SEQ ID NO: 6476973 - DNA, 20 bp, Homo sapiens
tgctgcctgggtaggcccca

SEQ ID NO: 6476974 - DNA, 15 bp, Homo sapiens
tgctgcctgtacaga

SEQ ID NO: 6476975 - DNA, 21 bp, Homo sapiens
tgctgcctgtatttgagagac

SEQ ID NO: 6476976 - DNA, 16 bp, Homo sapiens
tgctgcctgtttgggg

SEQ ID NO: 6476977 - DNA, 19 bp, Homo sapiens
tgctgccttattcagggaa

SEQ ID NO: 6476978 - DNA, 14 bp, Homo sapiens
tgctgccttcaggg

SEQ ID NO: 6476979 - DNA, 16 bp, Homo sapiens
tgctgccttcagggag

SEQ ID NO: 6476980 - DNA, 22 bp, Homo sapiens
tgctgccttctgacggccctgc

SEQ ID NO: 6476981 - DNA, 20 bp, Homo sapiens
tgctgccttctggattcttg

SEQ ID NO: 6476982 - DNA, 13 bp, Homo sapiens
tgctgccttctgt

SEQ ID NO: 6476983 - DNA, 22 bp, Homo sapiens
tgctgccttgctgcataaaatt

SEQ ID NO: 6476984 - DNA, 19 bp, Homo sapiens
tgctgcgatgggggatcag

SEQ ID NO: 6476985 - DNA, 21 bp, Homo sapiens
tgctgcgcaccaatgcccagc

SEQ ID NO: 6476986 - DNA, 16 bp, Homo sapiens
tgctgcgcccttacct

SEQ ID NO: 6476987 - DNA, 19 bp, Homo sapiens
tgctgcgcttaccttccca

SEQ ID NO: 6476988 - DNA, 18 bp, Homo sapiens
tgctgcggaggagctgcc

SEQ ID NO: 6476989 - DNA, 17 bp, Homo sapiens
tgctgcgggggagccag

SEQ ID NO: 6476990 - DNA, 23 bp, Homo sapiens
tgctgcgtcattacagggcacag

SEQ ID NO: 6476991 - DNA, 16 bp, Homo sapiens
tgctgcgtccccactc

SEQ ID NO: 6476992 - DNA, 17 bp, Homo sapiens
tgctgcgtccccactcc

SEQ ID NO: 6476993 - DNA, 21 bp, Homo sapiens
tgctgcgtccccactcccttg

SEQ ID NO: 6476994 - DNA, 14 bp, Homo sapiens
tgctgcgtctccca

SEQ ID NO: 6476995 - DNA, 22 bp, Homo sapiens
tgctgctaagtcattggcaaag

SEQ ID NO: 6476996 - DNA, 21 bp, Homo sapiens
tgctgctaatcttcagggcac

SEQ ID NO: 6476997 - DNA, 22 bp, Homo sapiens
tgctgctaattcccaacatttc

SEQ ID NO: 6476998 - DNA, 18 bp, Homo sapiens
tgctgctaattctttgca

SEQ ID NO: 6476999 - DNA, 14 bp, Homo sapiens
tgctgctaccctcc

SEQ ID NO: 6477000 - DNA, 18 bp, Homo sapiens
tgctgctaccgccctggg

SEQ ID NO: 6477001 - DNA, 13 bp, Homo sapiens
tgctgctactacc

SEQ ID NO: 6477002 - DNA, 16 bp, Homo sapiens
tgctgctactgctgct

SEQ ID NO: 6477003 - DNA, 15 bp, Homo sapiens
tgctgctacttatat

SEQ ID NO: 6477004 - DNA, 19 bp, Homo sapiens
tgctgctagaactttttta

SEQ ID NO: 6477005 - DNA, 15 bp, Homo sapiens
tgctgctagatcttt

SEQ ID NO: 6477006 - DNA, 19 bp, Homo sapiens
tgctgctatcctgccaaaa

SEQ ID NO: 6477007 - DNA, 14 bp, Homo sapiens
tgctgctatgaaaa

SEQ ID NO: 6477008 - DNA, 20 bp, Homo sapiens
tgctgctatgaaaatgagca

SEQ ID NO: 6477009 - DNA, 16 bp, Homo sapiens
tgctgctattgctgtc

SEQ ID NO: 6477010 - DNA, 16 bp, Homo sapiens
tgctgctattttactg

SEQ ID NO: 6477011 - DNA, 19 bp, Homo sapiens
tgctgctattttactgtct

SEQ ID NO: 6477012 - DNA, 13 bp, Homo sapiens
tgctgctccatgg

SEQ ID NO: 6477013 - DNA, 19 bp, Homo sapiens
tgctgctccatggatgcat

SEQ ID NO: 6477014 - DNA, 18 bp, Homo sapiens
tgctgctcccctaaagcc

SEQ ID NO: 6477015 - DNA, 13 bp, Homo sapiens
tgctgctccctca

SEQ ID NO: 6477016 - DNA, 16 bp, Homo sapiens
tgctgctccgcccgct

SEQ ID NO: 6477017 - DNA, 20 bp, Homo sapiens
tgctgctccggtttgggctg

SEQ ID NO: 6477018 - DNA, 11 bp, Homo sapiens
tgctgctcctc

SEQ ID NO: 6477019 - DNA, 22 bp, Homo sapiens
tgctgctcctccctctgaccca

SEQ ID NO: 6477020 - DNA, 19 bp, Homo sapiens
tgctgctcctcggccagag

SEQ ID NO: 6477021 - DNA, 19 bp, Homo sapiens
tgctgctcctctttcccct

SEQ ID NO: 6477022 - DNA, 18 bp, Homo sapiens
tgctgctccttagctgcc

SEQ ID NO: 6477023 - DNA, 20 bp, Homo sapiens
tgctgctccttagctgccaa

SEQ ID NO: 6477024 - DNA, 17 bp, Homo sapiens
tgctgctcgggaaggcc

SEQ ID NO: 6477025 - DNA, 20 bp, Homo sapiens
tgctgctcgggaaggcctga

SEQ ID NO: 6477026 - DNA, 10 bp, Homo sapiens
tgctgctctc

SEQ ID NO: 6477027 - DNA, 16 bp, Homo sapiens
tcttatgaatagacat

SEQ ID NO: 6477028 - DNA, 14 bp, Homo sapiens
tcttatgatgtttt

SEQ ID NO: 6477029 - DNA, 16 bp, Homo sapiens
tcttatgatgttttcc

SEQ ID NO: 6477030 - DNA, 13 bp, Homo sapiens
tcttatgatttta

SEQ ID NO: 6477031 - DNA, 15 bp, Homo sapiens
tcttatgattttatt

SEQ ID NO: 6477032 - DNA, 20 bp, Homo sapiens
tcttatgatttttaaaagtt

SEQ ID NO: 6477033 - DNA, 15 bp, Homo sapiens
tcttatgcaaaatgg

SEQ ID NO: 6477034 - DNA, 16 bp, Homo sapiens
tcttatgcaaaatgga

SEQ ID NO: 6477035 - DNA, 14 bp, Homo sapiens
tcttatgcaatttc

SEQ ID NO: 6477036 - DNA, 20 bp, Homo sapiens
tcttatgccatttgtttatt

SEQ ID NO: 6477037 - DNA, 17 bp, Homo sapiens
tcttatgcttataatat

SEQ ID NO: 6477038 - DNA, 13 bp, Homo sapiens
tcttatgcttcca

SEQ ID NO: 6477039 - DNA, 17 bp, Homo sapiens
tcttatgcttccagaaa

SEQ ID NO: 6477040 - DNA, 20 bp, Homo sapiens
tcttatgcttccagaaacac

SEQ ID NO: 6477041 - DNA, 14 bp, Homo sapiens
tcttatggaattga

SEQ ID NO: 6477042 - DNA, 15 bp, Homo sapiens
tcttatggaattgat

SEQ ID NO: 6477043 - DNA, 14 bp, Homo sapiens
tcttatggcacaaa

SEQ ID NO: 6477044 - DNA, 16 bp, Homo sapiens
tcttatggcacaaaaa

SEQ ID NO: 6477045 - DNA, 13 bp, Homo sapiens
tcttatgggctgg

SEQ ID NO: 6477046 - DNA, 15 bp, Homo sapiens
tcttatgggctgggt

SEQ ID NO: 6477047 - DNA, 18 bp, Homo sapiens
tcttatgggctgggttct

SEQ ID NO: 6477048 - DNA, 22 bp, Homo sapiens
tcttatgggggtgtttctatct

SEQ ID NO: 6477049 - DNA, 16 bp, Homo sapiens
tcttatggtccagaaa

SEQ ID NO: 6477050 - DNA, 15 bp, Homo sapiens
tcttatgtaagtttg

SEQ ID NO: 6477051 - DNA, 19 bp, Homo sapiens
tcttatgtaagtttgcata

SEQ ID NO: 6477052 - DNA, 18 bp, Homo sapiens
tcttatgtacctctttta

SEQ ID NO: 6477053 - DNA, 20 bp, Homo sapiens
tcttatgtagagtttttatg

SEQ ID NO: 6477054 - DNA, 19 bp, Homo sapiens
tcttatgtatgataaacag

SEQ ID NO: 6477055 - DNA, 18 bp, Homo sapiens
tcttatgtatgtgaaagt

SEQ ID NO: 6477056 - DNA, 15 bp, Homo sapiens
tcttatgtgaaaaat

SEQ ID NO: 6477057 - DNA, 14 bp, Homo sapiens
tcttatgtgtgcct

SEQ ID NO: 6477058 - DNA, 12 bp, Homo sapiens
tcttattaaagt

SEQ ID NO: 6477059 - DNA, 17 bp, Homo sapiens
tcttattaaagtattct

SEQ ID NO: 6477060 - DNA, 14 bp, Homo sapiens
tcttattaaagttt

SEQ ID NO: 6477061 - DNA, 15 bp, Homo sapiens
tcttattaaagtttc

SEQ ID NO: 6477062 - DNA, 16 bp, Homo sapiens
tcttattaaagtttca

SEQ ID NO: 6477063 - DNA, 18 bp, Homo sapiens
tcttattaaagtttcaaa

SEQ ID NO: 6477064 - DNA, 19 bp, Homo sapiens
tcttattaaccaaattaac

SEQ ID NO: 6477065 - DNA, 22 bp, Homo sapiens
tcttattaatcatacaaactct

SEQ ID NO: 6477066 - DNA, 19 bp, Homo sapiens
tcttattaattcttcacct

SEQ ID NO: 6477067 - DNA, 22 bp, Homo sapiens
tcttattacccaaacccatggc

SEQ ID NO: 6477068 - DNA, 15 bp, Homo sapiens
tcttattactgagag

SEQ ID NO: 6477069 - DNA, 21 bp, Homo sapiens
tcttattaggataatacataa

SEQ ID NO: 6477070 - DNA, 17 bp, Homo sapiens
tcttattagggagaaaa

SEQ ID NO: 6477071 - DNA, 13 bp, Homo sapiens
tcttattataaaa

SEQ ID NO: 6477072 - DNA, 23 bp, Homo sapiens
tcttattatatatataatatata

SEQ ID NO: 6477073 - DNA, 16 bp, Homo sapiens
tcttattcaaagatga

SEQ ID NO: 6477074 - DNA, 18 bp, Homo sapiens
tcttattcagtaaaaaac

SEQ ID NO: 6477075 - DNA, 13 bp, Homo sapiens
tcttattcagtga

SEQ ID NO: 6477076 - DNA, 21 bp, Homo sapiens
tcttattcatgctttctcctt

SEQ ID NO: 6477077 - DNA, 15 bp, Homo sapiens
tcttattcattttct

SEQ ID NO: 6477078 - DNA, 19 bp, Homo sapiens
tcttattccaggagaaggg

SEQ ID NO: 6477079 - DNA, 14 bp, Homo sapiens
tcttattccatatt

SEQ ID NO: 6477080 - DNA, 22 bp, Homo sapiens
tcttattcccaaactacagaat

SEQ ID NO: 6477081 - DNA, 19 bp, Homo sapiens
tcttattcccccctaagct

SEQ ID NO: 6477082 - DNA, 22 bp, Homo sapiens
tcttattcccccctaagcttct

SEQ ID NO: 6477083 - DNA, 12 bp, Homo sapiens
tcttattcctaa

SEQ ID NO: 6477084 - DNA, 19 bp, Homo sapiens
tcttattcctaattcctgt

SEQ ID NO: 6477085 - DNA, 13 bp, Homo sapiens
tcttattctaata

SEQ ID NO: 6477086 - DNA, 14 bp, Homo sapiens
tcttattctctgtt

SEQ ID NO: 6477087 - DNA, 13 bp, Homo sapiens
tcttattctgtat

SEQ ID NO: 6477088 - DNA, 19 bp, Homo sapiens
tcttattgaatttgttaga

SEQ ID NO: 6477089 - DNA, 22 bp, Homo sapiens
tcttattgcaaaatagcatttg

SEQ ID NO: 6477090 - DNA, 17 bp, Homo sapiens
tcttattgcaaggcagt

SEQ ID NO: 6477091 - DNA, 21 bp, Homo sapiens
tcttattgcaaggcagtctct

SEQ ID NO: 6477092 - DNA, 14 bp, Homo sapiens
tcttattgcccacg

SEQ ID NO: 6477093 - DNA, 22 bp, Homo sapiens
tcttattgcccacgctggagtg

SEQ ID NO: 6477094 - DNA, 17 bp, Homo sapiens
tcttattgcgctgctac

SEQ ID NO: 6477095 - DNA, 16 bp, Homo sapiens
tcttattggaaatgta

SEQ ID NO: 6477096 - DNA, 16 bp, Homo sapiens
tcttattgttcctctt

SEQ ID NO: 6477097 - DNA, 17 bp, Homo sapiens
tcttattgttcgtttaa

SEQ ID NO: 6477098 - DNA, 16 bp, Homo sapiens
tcttattgttctttca

SEQ ID NO: 6477099 - DNA, 18 bp, Homo sapiens
tcttatttaatctccatt

SEQ ID NO: 6477100 - DNA, 17 bp, Homo sapiens
tcttatttaatgaaaga

SEQ ID NO: 6477101 - DNA, 21 bp, Homo sapiens
tcttatttacttgtagaaatc

SEQ ID NO: 6477102 - DNA, 14 bp, Homo sapiens
tcttatttatgtaa

SEQ ID NO: 6477103 - DNA, 15 bp, Homo sapiens
tcttatttatgtaac

SEQ ID NO: 6477104 - DNA, 14 bp, Homo sapiens
tcttatttcatgaa

SEQ ID NO: 6477105 - DNA, 13 bp, Homo sapiens
tcttatttcattt

SEQ ID NO: 6477106 - DNA, 19 bp, Homo sapiens
tcttatttcatttattttt

SEQ ID NO: 6477107 - DNA, 21 bp, Homo sapiens
tcttatttcccctttccaatt

SEQ ID NO: 6477108 - DNA, 12 bp, Homo sapiens
tcttatttctga

SEQ ID NO: 6477109 - DNA, 12 bp, Homo sapiens
tcttatttctgt

SEQ ID NO: 6477110 - DNA, 16 bp, Homo sapiens
tcttatttctttcctt

SEQ ID NO: 6477111 - DNA, 18 bp, Homo sapiens
tcttatttctttccttta

SEQ ID NO: 6477112 - DNA, 20 bp, Homo sapiens
tcttatttctttcctttaaa

SEQ ID NO: 6477113 - DNA, 12 bp, Homo sapiens
tcttatttgcaa

SEQ ID NO: 6477114 - DNA, 14 bp, Homo sapiens
tcttatttgcaata

SEQ ID NO: 6477115 - DNA, 16 bp, Homo sapiens
tcttatttgcaataaa

SEQ ID NO: 6477116 - DNA, 13 bp, Homo sapiens
tcttattttagaa

SEQ ID NO: 6477117 - DNA, 13 bp, Homo sapiens
tcttattttagta

SEQ ID NO: 6477118 - DNA, 19 bp, Homo sapiens
tcttattttctcaatctcc

SEQ ID NO: 6477119 - DNA, 12 bp, Homo sapiens
tcttattttctt

SEQ ID NO: 6477120 - DNA, 12 bp, Homo sapiens
tcttattttgca

SEQ ID NO: 6477121 - DNA, 21 bp, Homo sapiens
tcttattttgcattccagaat

SEQ ID NO: 6477122 - DNA, 17 bp, Homo sapiens
tcttattttgtaataaa

SEQ ID NO: 6477123 - DNA, 12 bp, Homo sapiens
tcttatttttcc

SEQ ID NO: 6477124 - DNA, 14 bp, Homo sapiens
tcttatttttcctg

SEQ ID NO: 6477125 - DNA, 16 bp, Homo sapiens
tcttatttttcctgtc

SEQ ID NO: 6477126 - DNA, 12 bp, Homo sapiens
tcttatttttct

SEQ ID NO: 6477127 - DNA, 16 bp, Homo sapiens
tcttatttttctaaac

SEQ ID NO: 6477128 - DNA, 16 bp, Homo sapiens
tcttatttttctagtc

SEQ ID NO: 6477129 - DNA, 16 bp, Homo sapiens
tcttatttttcttacc

SEQ ID NO: 6477130 - DNA, 15 bp, Homo sapiens
tcttcaaaaactgtt

SEQ ID NO: 6477131 - DNA, 16 bp, Homo sapiens
tcttcaaaaagcagag

SEQ ID NO: 6477132 - DNA, 17 bp, Homo sapiens
tcttcaaaaatacagaa

SEQ ID NO: 6477133 - DNA, 18 bp, Homo sapiens
tcttcaaaaatacagaat

SEQ ID NO: 6477134 - DNA, 21 bp, Homo sapiens
tcttcaaaagtaatgcctctg

SEQ ID NO: 6477135 - DNA, 14 bp, Homo sapiens
tcttcaaaatatat

SEQ ID NO: 6477136 - DNA, 21 bp, Homo sapiens
tcttcaaacacccatttttgc

SEQ ID NO: 6477137 - DNA, 14 bp, Homo sapiens
tcttcaaactttca

SEQ ID NO: 6477138 - DNA, 18 bp, Homo sapiens
tcttcaaactttcacttt

SEQ ID NO: 6477139 - DNA, 19 bp, Homo sapiens
tcttcaaactttcactttg

SEQ ID NO: 6477140 - DNA, 20 bp, Homo sapiens
tcttcaaagatagggaggga

SEQ ID NO: 6477141 - DNA, 15 bp, Homo sapiens
tcttcaaagcagagt

SEQ ID NO: 6477142 - DNA, 14 bp, Homo sapiens
tcttcaaagccttc

SEQ ID NO: 6477143 - DNA, 12 bp, Homo sapiens
tcttcaaataca

SEQ ID NO: 6477144 - DNA, 17 bp, Homo sapiens
tcttcaaatacaaagta

SEQ ID NO: 6477145 - DNA, 21 bp, Homo sapiens
tcttcaaatacaaagtaaata

SEQ ID NO: 6477146 - DNA, 21 bp, Homo sapiens
tcttcaaatctcccacaagta

SEQ ID NO: 6477147 - DNA, 14 bp, Homo sapiens
tcttcaaatgggag

SEQ ID NO: 6477148 - DNA, 22 bp, Homo sapiens
tcttcaaattaaagtgctgttt

SEQ ID NO: 6477149 - DNA, 13 bp, Homo sapiens
tcttcaaatttga

SEQ ID NO: 6477150 - DNA, 23 bp, Homo sapiens
tcttcaaatttgattctaaatag

SEQ ID NO: 6477151 - DNA, 12 bp, Homo sapiens
tcttcaacaaat

SEQ ID NO: 6477152 - DNA, 18 bp, Homo sapiens
tcttcaacaggagaattt

SEQ ID NO: 6477153 - DNA, 18 bp, Homo sapiens
tcttcaacagggaaaaca

SEQ ID NO: 6477154 - DNA, 24 bp, Homo sapiens
tcttcaacatcaatgttcattgta

SEQ ID NO: 6477155 - DNA, 21 bp, Homo sapiens
tcttcaacatcctgccagccc

SEQ ID NO: 6477156 - DNA, 22 bp, Homo sapiens
tcttcaacatgctccaaatata

SEQ ID NO: 6477157 - DNA, 20 bp, Homo sapiens
tcttcaacatgtcacactgg

SEQ ID NO: 6477158 - DNA, 15 bp, Homo sapiens
tcttcaacatgtgtg

SEQ ID NO: 6477159 - DNA, 12 bp, Homo sapiens
tcttcaaccagt

SEQ ID NO: 6477160 - DNA, 14 bp, Homo sapiens
tcttcaaccctgcc

SEQ ID NO: 6477161 - DNA, 18 bp, Homo sapiens
tcttcaaccctgccctgc

SEQ ID NO: 6477162 - DNA, 19 bp, Homo sapiens
tcttcaactcctgggctca

SEQ ID NO: 6477163 - DNA, 16 bp, Homo sapiens
tcttcaactgaccagc

SEQ ID NO: 6477164 - DNA, 19 bp, Homo sapiens
tcttcaactgaccagcctc

SEQ ID NO: 6477165 - DNA, 22 bp, Homo sapiens
tcttcaagagacccttcaaact

SEQ ID NO: 6477166 - DNA, 14 bp, Homo sapiens
tcttcaagcctggc

SEQ ID NO: 6477167 - DNA, 13 bp, Homo sapiens
tcttcaaggccaa

SEQ ID NO: 6477168 - DNA, 18 bp, Homo sapiens
tcttcaagggctgcttca

SEQ ID NO: 6477169 - DNA, 20 bp, Homo sapiens
tcttcaagtttttttcaaag

SEQ ID NO: 6477170 - DNA, 21 bp, Homo sapiens
tcttcaagtttttttcaaagt

SEQ ID NO: 6477171 - DNA, 12 bp, Homo sapiens
tcttcaataaac

SEQ ID NO: 6477172 - DNA, 20 bp, Homo sapiens
tcttcaataaaccacaagca

SEQ ID NO: 6477173 - DNA, 21 bp, Homo sapiens
tcttcaataaaccacaagcat

SEQ ID NO: 6477174 - DNA, 14 bp, Homo sapiens
tcttcaatctctgg

SEQ ID NO: 6477175 - DNA, 17 bp, Homo sapiens
tcttcaatctctgttct

SEQ ID NO: 6477176 - DNA, 19 bp, Homo sapiens
tcttcaatgtgaaactgag

SEQ ID NO: 6477177 - DNA, 24 bp, Homo sapiens
tcttcaatgtgaaactgagaccaa

SEQ ID NO: 6477178 - DNA, 19 bp, Homo sapiens
tcttcaatttgttaacaga

SEQ ID NO: 6477179 - DNA, 20 bp, Homo sapiens
tcttcaatttgttaacagag

SEQ ID NO: 6477180 - DNA, 12 bp, Homo sapiens
tcttcacaacct

SEQ ID NO: 6477181 - DNA, 15 bp, Homo sapiens
tcttcacactgcgca

SEQ ID NO: 6477182 - DNA, 19 bp, Homo sapiens
tcttcacagatttttatct

SEQ ID NO: 6477183 - DNA, 18 bp, Homo sapiens
tcttcacagctctgtgtt

SEQ ID NO: 6477184 - DNA, 15 bp, Homo sapiens
tcttcacaggcactc

SEQ ID NO: 6477185 - DNA, 15 bp, Homo sapiens
tcttcacatccattg

SEQ ID NO: 6477186 - DNA, 19 bp, Homo sapiens
tcttcacatgtttaacttt

SEQ ID NO: 6477187 - DNA, 16 bp, Homo sapiens
tcttcacatttagaat

SEQ ID NO: 6477188 - DNA, 19 bp, Homo sapiens
tcttcaccaagtgcaatag

SEQ ID NO: 6477189 - DNA, 13 bp, Homo sapiens
tcttcaccaggaa

SEQ ID NO: 6477190 - DNA, 17 bp, Homo sapiens
tcttcaccatttggcaa

SEQ ID NO: 6477191 - DNA, 20 bp, Homo sapiens
tcttcacccaccccatggag

SEQ ID NO: 6477192 - DNA, 22 bp, Homo sapiens
tcttcaccccccaatctcttgg

SEQ ID NO: 6477193 - DNA, 18 bp, Homo sapiens
tcttcaccccggcaggcc

SEQ ID NO: 6477194 - DNA, 22 bp, Homo sapiens
tcttcaccccggcaggccctgc

SEQ ID NO: 6477195 - DNA, 22 bp, Homo sapiens
tcttcacccctacactgtgaag

SEQ ID NO: 6477196 - DNA, 14 bp, Homo sapiens
tcttcaccctgtaa

SEQ ID NO: 6477197 - DNA, 23 bp, Homo sapiens
tcttcacctaagtctctgtgaat

SEQ ID NO: 6477198 - DNA, 18 bp, Homo sapiens
tcttcacctcctgccagc

SEQ ID NO: 6477199 - DNA, 17 bp, Homo sapiens
tcttcacctcttccact

SEQ ID NO: 6477200 - DNA, 18 bp, Homo sapiens
tcttcacctcttccactc

SEQ ID NO: 6477201 - DNA, 13 bp, Homo sapiens
tcttcacctgcca

SEQ ID NO: 6477202 - DNA, 14 bp, Homo sapiens
tcttcacctgccac

SEQ ID NO: 6477203 - DNA, 16 bp, Homo sapiens
tcttcacctgccacca

SEQ ID NO: 6477204 - DNA, 23 bp, Homo sapiens
tcttcacctgggcgccaactgct

SEQ ID NO: 6477205 - DNA, 14 bp, Homo sapiens
tcttcacctgttat

SEQ ID NO: 6477206 - DNA, 13 bp, Homo sapiens
tcttcaccttggt

SEQ ID NO: 6477207 - DNA, 15 bp, Homo sapiens
tcttcaccttggttt

SEQ ID NO: 6477208 - DNA, 13 bp, Homo sapiens
tgctgctctctga

SEQ ID NO: 6477209 - DNA, 16 bp, Homo sapiens
tgctgctctctgaggg

SEQ ID NO: 6477210 - DNA, 17 bp, Homo sapiens
tgctgctctctgaggga

SEQ ID NO: 6477211 - DNA, 20 bp, Homo sapiens
tgctgctctggtgcacgcct

SEQ ID NO: 6477212 - DNA, 17 bp, Homo sapiens
tgctgctcttggctgga

SEQ ID NO: 6477213 - DNA, 19 bp, Homo sapiens
tgctgctcttggctggacc

SEQ ID NO: 6477214 - DNA, 23 bp, Homo sapiens
tgctgctcttggctggacccagc

SEQ ID NO: 6477215 - DNA, 16 bp, Homo sapiens
tgctgctgagaacctg

SEQ ID NO: 6477216 - DNA, 19 bp, Homo sapiens
tgctgctgagaacctggcc

SEQ ID NO: 6477217 - DNA, 18 bp, Homo sapiens
tgctgctgagtcgctctc

SEQ ID NO: 6477218 - DNA, 11 bp, Homo sapiens
tgctgctgccc

SEQ ID NO: 6477219 - DNA, 13 bp, Homo sapiens
tgctgctgcctcc

SEQ ID NO: 6477220 - DNA, 13 bp, Homo sapiens
tgctgctgcctgc

SEQ ID NO: 6477221 - DNA, 16 bp, Homo sapiens
tgctgctgcctggcca

SEQ ID NO: 6477222 - DNA, 12 bp, Homo sapiens
tgctgctgctgc

SEQ ID NO: 6477223 - DNA, 15 bp, Homo sapiens
tgctgctgctgcacc

SEQ ID NO: 6477224 - DNA, 13 bp, Homo sapiens
tgctgctgctgcc

SEQ ID NO: 6477225 - DNA, 12 bp, Homo sapiens
tgctgctggcca

SEQ ID NO: 6477226 - DNA, 14 bp, Homo sapiens
tgctgctggccaaa

SEQ ID NO: 6477227 - DNA, 12 bp, Homo sapiens
tgctgctggctc

SEQ ID NO: 6477228 - DNA, 14 bp, Homo sapiens
tgctgctgggctca

SEQ ID NO: 6477229 - DNA, 19 bp, Homo sapiens
tgctgctggggaagacagt

SEQ ID NO: 6477230 - DNA, 23 bp, Homo sapiens
tgctgctggggaagacagtggcc

SEQ ID NO: 6477231 - DNA, 11 bp, Homo sapiens
tgctgctgtaa

SEQ ID NO: 6477232 - DNA, 20 bp, Homo sapiens
tgctgctgtaactgctgagc

SEQ ID NO: 6477233 - DNA, 24 bp, Homo sapiens
tgctgctgtaactgctgagccact

SEQ ID NO: 6477234 - DNA, 16 bp, Homo sapiens
tgctgctgtcagacga

SEQ ID NO: 6477235 - DNA, 16 bp, Homo sapiens
tgctgctgtccagtgc

SEQ ID NO: 6477236 - DNA, 12 bp, Homo sapiens
tgctgctgtgaa

SEQ ID NO: 6477237 - DNA, 14 bp, Homo sapiens
tgctgctgtgcctg

SEQ ID NO: 6477238 - DNA, 18 bp, Homo sapiens
tgctgctgtgcgtggaaa

SEQ ID NO: 6477239 - DNA, 13 bp, Homo sapiens
tgctgctgtggag

SEQ ID NO: 6477240 - DNA, 17 bp, Homo sapiens
tgctgcttaagtgcatg

SEQ ID NO: 6477241 - DNA, 20 bp, Homo sapiens
tgctgcttcaccagactttt

SEQ ID NO: 6477242 - DNA, 19 bp, Homo sapiens
tgctgcttccactcagggc

SEQ ID NO: 6477243 - DNA, 15 bp, Homo sapiens
tgctgcttccctctg

SEQ ID NO: 6477244 - DNA, 16 bp, Homo sapiens
tgctgcttccctctgc

SEQ ID NO: 6477245 - DNA, 17 bp, Homo sapiens
tgctgcttccctctgcc

SEQ ID NO: 6477246 - DNA, 12 bp, Homo sapiens
tgctgcttccta

SEQ ID NO: 6477247 - DNA, 14 bp, Homo sapiens
tgctgcttcctaac

SEQ ID NO: 6477248 - DNA, 16 bp, Homo sapiens
tgctgcttcctaactt

SEQ ID NO: 6477249 - DNA, 11 bp, Homo sapiens
tgctgcttctc

SEQ ID NO: 6477250 - DNA, 19 bp, Homo sapiens
tgctgcttctcccaggcaa

SEQ ID NO: 6477251 - DNA, 23 bp, Homo sapiens
tgctgcttctcccaggcaaggct

SEQ ID NO: 6477252 - DNA, 19 bp, Homo sapiens
tgctgcttctcctcccagc

SEQ ID NO: 6477253 - DNA, 14 bp, Homo sapiens
tgctgcttctcttg

SEQ ID NO: 6477254 - DNA, 16 bp, Homo sapiens
tgctgcttctcttggg

SEQ ID NO: 6477255 - DNA, 21 bp, Homo sapiens
tgctgcttctgaatacaaatt

SEQ ID NO: 6477256 - DNA, 15 bp, Homo sapiens
tgctgcttctgggcc

SEQ ID NO: 6477257 - DNA, 12 bp, Homo sapiens
tgctgcttgtca

SEQ ID NO: 6477258 - DNA, 15 bp, Homo sapiens
tgctgcttgtgcctc

SEQ ID NO: 6477259 - DNA, 18 bp, Homo sapiens
tgctgcttgtgcctccct

SEQ ID NO: 6477260 - DNA, 17 bp, Homo sapiens
tgctgctttaacagtgg

SEQ ID NO: 6477261 - DNA, 15 bp, Homo sapiens
tgctgctttcccctg

SEQ ID NO: 6477262 - DNA, 16 bp, Homo sapiens
tgctgctttcccctgt

SEQ ID NO: 6477263 - DNA, 18 bp, Homo sapiens
tgctgctttcccctgtgg

SEQ ID NO: 6477264 - DNA, 21 bp, Homo sapiens
tgctgctttcccctgtgggga

SEQ ID NO: 6477265 - DNA, 23 bp, Homo sapiens
tgctgctttcccctgtggggatc

SEQ ID NO: 6477266 - DNA, 15 bp, Homo sapiens
tgctgctttgcacac

SEQ ID NO: 6477267 - DNA, 15 bp, Homo sapiens
tgctgctttgcttct

SEQ ID NO: 6477268 - DNA, 15 bp, Homo sapiens
tgctgctttggggat

SEQ ID NO: 6477269 - DNA, 17 bp, Homo sapiens
tgctgctttgtccaggt

SEQ ID NO: 6477270 - DNA, 23 bp, Homo sapiens
tgctgctttgttgttctgcctgt

SEQ ID NO: 6477271 - DNA, 17 bp, Homo sapiens
tgctgcttttaaaacat

SEQ ID NO: 6477272 - DNA, 18 bp, Homo sapiens
tgctgcttttgagcctca

SEQ ID NO: 6477273 - DNA, 19 bp, Homo sapiens
tgctgcttttgagcctcag

SEQ ID NO: 6477274 - DNA, 20 bp, Homo sapiens
tgctgcttttgagcctcaga

SEQ ID NO: 6477275 - DNA, 21 bp, Homo sapiens
tgctgcttttgagcctcagac

SEQ ID NO: 6477276 - DNA, 13 bp, Homo sapiens
tgctgcttttgat

SEQ ID NO: 6477277 - DNA, 20 bp, Homo sapiens
tgctgcttttgatggctatg

SEQ ID NO: 6477278 - DNA, 22 bp, Homo sapiens
tgctgcttttgggggtcagcat

SEQ ID NO: 6477279 - DNA, 23 bp, Homo sapiens
tgctgcttttgggggtcagcatc

SEQ ID NO: 6477280 - DNA, 22 bp, Homo sapiens
tgctgctttttctgcgcttcag

SEQ ID NO: 6477281 - DNA, 20 bp, Homo sapiens
tgctgctttttgaggtggca

SEQ ID NO: 6477282 - DNA, 22 bp, Homo sapiens
tgctgctttttgaggtggcact

SEQ ID NO: 6477283 - DNA, 17 bp, Homo sapiens
tgctggaaaactgccac

SEQ ID NO: 6477284 - DNA, 21 bp, Homo sapiens
tgctggaaaatctgtaaaaaa

SEQ ID NO: 6477285 - DNA, 22 bp, Homo sapiens
tgctggaaaccaagtcaggcca

SEQ ID NO: 6477286 - DNA, 17 bp, Homo sapiens
tgctggaaaccacactt

SEQ ID NO: 6477287 - DNA, 18 bp, Homo sapiens
tgctggaaaccacacttc

SEQ ID NO: 6477288 - DNA, 12 bp, Homo sapiens
tgctggaaagag

SEQ ID NO: 6477289 - DNA, 22 bp, Homo sapiens
tgctggaaaggcccggagatgc

SEQ ID NO: 6477290 - DNA, 11 bp, Homo sapiens
tgctggaaata

SEQ ID NO: 6477291 - DNA, 21 bp, Homo sapiens
tgctggaactttagtgaaaca

SEQ ID NO: 6477292 - DNA, 18 bp, Homo sapiens
tgctggaagaaactaaaa

SEQ ID NO: 6477293 - DNA, 18 bp, Homo sapiens
tgctggaagaactgcatg

SEQ ID NO: 6477294 - DNA, 16 bp, Homo sapiens
tgctggaagacagaga

SEQ ID NO: 6477295 - DNA, 14 bp, Homo sapiens
tgctggaagcccag

SEQ ID NO: 6477296 - DNA, 15 bp, Homo sapiens
tgctggaagcccagc

SEQ ID NO: 6477297 - DNA, 17 bp, Homo sapiens
tgctggaagctgtcagg

SEQ ID NO: 6477298 - DNA, 19 bp, Homo sapiens
tgctggaagggaggaaggc

SEQ ID NO: 6477299 - DNA, 15 bp, Homo sapiens
tgctggaaggggcag

SEQ ID NO: 6477300 - DNA, 14 bp, Homo sapiens
tgctggaagtctcc

SEQ ID NO: 6477301 - DNA, 16 bp, Homo sapiens
tgctggaattccacag

SEQ ID NO: 6477302 - DNA, 17 bp, Homo sapiens
tgctggaattccacagg

SEQ ID NO: 6477303 - DNA, 16 bp, Homo sapiens
tgctggaattctaaca

SEQ ID NO: 6477304 - DNA, 18 bp, Homo sapiens
tgctggaccagctggcct

SEQ ID NO: 6477305 - DNA, 21 bp, Homo sapiens
tgctggacggggactggggat

SEQ ID NO: 6477306 - DNA, 16 bp, Homo sapiens
tgctggactgaggacc

SEQ ID NO: 6477307 - DNA, 21 bp, Homo sapiens
tgctggactggaggcccctgg

SEQ ID NO: 6477308 - DNA, 22 bp, Homo sapiens
tgctggactgttccaggccctc

SEQ ID NO: 6477309 - DNA, 21 bp, Homo sapiens
tgctggactttaaaaaaacaa

SEQ ID NO: 6477310 - DNA, 13 bp, Homo sapiens
tgctggagaaagc

SEQ ID NO: 6477311 - DNA, 21 bp, Homo sapiens
tgctggagaaagccacgccct

SEQ ID NO: 6477312 - DNA, 23 bp, Homo sapiens
tgctggagaaagccacgccctcc

SEQ ID NO: 6477313 - DNA, 13 bp, Homo sapiens
tgctggagaagag

SEQ ID NO: 6477314 - DNA, 18 bp, Homo sapiens
tgctggagaagagaggag

SEQ ID NO: 6477315 - DNA, 18 bp, Homo sapiens
tgctggagactatttaag

SEQ ID NO: 6477316 - DNA, 19 bp, Homo sapiens
tgctggagactatttaagt

SEQ ID NO: 6477317 - DNA, 13 bp, Homo sapiens
tgctggagaggtt

SEQ ID NO: 6477318 - DNA, 11 bp, Homo sapiens
tgctggagagt

SEQ ID NO: 6477319 - DNA, 16 bp, Homo sapiens
tgctggagagtggcat

SEQ ID NO: 6477320 - DNA, 20 bp, Homo sapiens
tgctggagccactaactaga

SEQ ID NO: 6477321 - DNA, 15 bp, Homo sapiens
tgctggagcctgtgt

SEQ ID NO: 6477322 - DNA, 19 bp, Homo sapiens
tgctggagcctgtgtaaca

SEQ ID NO: 6477323 - DNA, 22 bp, Homo sapiens
tgctggagcctgtgtaacagct

SEQ ID NO: 6477324 - DNA, 13 bp, Homo sapiens
tgctggagctggc

SEQ ID NO: 6477325 - DNA, 14 bp, Homo sapiens
tgctggagctggct

SEQ ID NO: 6477326 - DNA, 13 bp, Homo sapiens
tgctggaggactg

SEQ ID NO: 6477327 - DNA, 13 bp, Homo sapiens
tgctggaggcctc

SEQ ID NO: 6477328 - DNA, 17 bp, Homo sapiens
tgctggaggcctcaggt

SEQ ID NO: 6477329 - DNA, 21 bp, Homo sapiens
tgctggaggcctcaggtgctg

SEQ ID NO: 6477330 - DNA, 16 bp, Homo sapiens
tgctggagggaggctg

SEQ ID NO: 6477331 - DNA, 22 bp, Homo sapiens
tgctggaggggctgtcctcctt

SEQ ID NO: 6477332 - DNA, 14 bp, Homo sapiens
tgctggaggggtgg

SEQ ID NO: 6477333 - DNA, 16 bp, Homo sapiens
tgctggaggggtggcc

SEQ ID NO: 6477334 - DNA, 21 bp, Homo sapiens
tgctggaggggtggcccagag

SEQ ID NO: 6477335 - DNA, 19 bp, Homo sapiens
tgctggaggtagagaggtg

SEQ ID NO: 6477336 - DNA, 17 bp, Homo sapiens
tgctggaggtgggagca

SEQ ID NO: 6477337 - DNA, 12 bp, Homo sapiens
tgctggagtcca

SEQ ID NO: 6477338 - DNA, 23 bp, Homo sapiens
tgctggagtcctgttctcagagc

SEQ ID NO: 6477339 - DNA, 17 bp, Homo sapiens
tgctggagtctccagat

SEQ ID NO: 6477340 - DNA, 21 bp, Homo sapiens
tgctggagtgcagtggcacaa

SEQ ID NO: 6477341 - DNA, 15 bp, Homo sapiens
tgctggagtgctggc

SEQ ID NO: 6477342 - DNA, 23 bp, Homo sapiens
tgctggagttccggcctgggcac

SEQ ID NO: 6477343 - DNA, 20 bp, Homo sapiens
tgctggagtttcatgtacaa

SEQ ID NO: 6477344 - DNA, 15 bp, Homo sapiens
tgctggataaaatga

SEQ ID NO: 6477345 - DNA, 22 bp, Homo sapiens
tgctggatattttcaaattgta

SEQ ID NO: 6477346 - DNA, 23 bp, Homo sapiens
tgctggatcacagctgctttctg

SEQ ID NO: 6477347 - DNA, 11 bp, Homo sapiens
tgctggatgac

SEQ ID NO: 6477348 - DNA, 20 bp, Homo sapiens
tgctggatggagcccaggcg

SEQ ID NO: 6477349 - DNA, 18 bp, Homo sapiens
tgctggattgtccttgga

SEQ ID NO: 6477350 - DNA, 21 bp, Homo sapiens
tgctggattgtccttggagga

SEQ ID NO: 6477351 - DNA, 17 bp, Homo sapiens
tgctggcaaatccaggc

SEQ ID NO: 6477352 - DNA, 22 bp, Homo sapiens
tgctggcaatgagtgtgccaga

SEQ ID NO: 6477353 - DNA, 13 bp, Homo sapiens
tgctggcacagac

SEQ ID NO: 6477354 - DNA, 12 bp, Homo sapiens
tgctggcacctc

SEQ ID NO: 6477355 - DNA, 17 bp, Homo sapiens
tgctggcacctcagaca

SEQ ID NO: 6477356 - DNA, 19 bp, Homo sapiens
tgctggcacttagtaggtc

SEQ ID NO: 6477357 - DNA, 13 bp, Homo sapiens
tgctggcagggcc

SEQ ID NO: 6477358 - DNA, 17 bp, Homo sapiens
tgctggcagggccaggg

SEQ ID NO: 6477359 - DNA, 22 bp, Homo sapiens
tgctggcagggccagggcaatg

SEQ ID NO: 6477360 - DNA, 19 bp, Homo sapiens
tgctggccaaatagcaaag

SEQ ID NO: 6477361 - DNA, 15 bp, Homo sapiens
tgctggccacacagc

SEQ ID NO: 6477362 - DNA, 16 bp, Homo sapiens
tgctggccagcaccct

SEQ ID NO: 6477363 - DNA, 19 bp, Homo sapiens
tgctggccagcaccctctc

SEQ ID NO: 6477364 - DNA, 22 bp, Homo sapiens
tgctggccagcaccctctcctg

SEQ ID NO: 6477365 - DNA, 14 bp, Homo sapiens
tgctggccatggct

SEQ ID NO: 6477366 - DNA, 14 bp, Homo sapiens
tgctggcccacagc

SEQ ID NO: 6477367 - DNA, 15 bp, Homo sapiens
tgctggcccacagct

SEQ ID NO: 6477368 - DNA, 18 bp, Homo sapiens
tgctggcccacagctctg

SEQ ID NO: 6477369 - DNA, 20 bp, Homo sapiens
tgctggcccacagctctgct

SEQ ID NO: 6477370 - DNA, 12 bp, Homo sapiens
tgctggcccagc

SEQ ID NO: 6477371 - DNA, 16 bp, Homo sapiens
tgctggcccagcatgg

SEQ ID NO: 6477372 - DNA, 22 bp, Homo sapiens
tgctggcccagggcccagagcc

SEQ ID NO: 6477373 - DNA, 11 bp, Homo sapiens
tgctggcccca

SEQ ID NO: 6477374 - DNA, 12 bp, Homo sapiens
tgctggccccaa

SEQ ID NO: 6477375 - DNA, 18 bp, Homo sapiens
tgctggccccagccctgc

SEQ ID NO: 6477376 - DNA, 20 bp, Homo sapiens
tgctggccccagccctgctg

SEQ ID NO: 6477377 - DNA, 15 bp, Homo sapiens
tgctggccggacacc

SEQ ID NO: 6477378 - DNA, 17 bp, Homo sapiens
tgctggccgggcacagc

SEQ ID NO: 6477379 - DNA, 23 bp, Homo sapiens
tgctggcctcaaacagccacgag

SEQ ID NO: 6477380 - DNA, 21 bp, Homo sapiens
tgctggcctcccaataaagct

SEQ ID NO: 6477381 - DNA, 20 bp, Homo sapiens
tgctggcctccctccgtccc

SEQ ID NO: 6477382 - DNA, 18 bp, Homo sapiens
tgctggcctctctgacat

SEQ ID NO: 6477383 - DNA, 21 bp, Homo sapiens
tgctggcctcttggcacctgc

SEQ ID NO: 6477384 - DNA, 23 bp, Homo sapiens
tgctggcctcttggcacctgcct

SEQ ID NO: 6477385 - DNA, 10 bp, Homo sapiens
tgctggcctg

SEQ ID NO: 6477386 - DNA, 17 bp, Homo sapiens
tgctggcctgactggtt

SEQ ID NO: 6477387 - DNA, 15 bp, Homo sapiens
tgctggcctggatct

SEQ ID NO: 6477388 - DNA, 14 bp, Homo sapiens
tcttcacggcagga

SEQ ID NO: 6477389 - DNA, 17 bp, Homo sapiens
tcttcactacaaacacg

SEQ ID NO: 6477390 - DNA, 22 bp, Homo sapiens
tcttcactaccctgattcttga

SEQ ID NO: 6477391 - DNA, 14 bp, Homo sapiens
tcttcactcagcca

SEQ ID NO: 6477392 - DNA, 16 bp, Homo sapiens
tcttcactcagccaca

SEQ ID NO: 6477393 - DNA, 13 bp, Homo sapiens
tcttcactctggc

SEQ ID NO: 6477394 - DNA, 15 bp, Homo sapiens
tcttcactctggctt

SEQ ID NO: 6477395 - DNA, 16 bp, Homo sapiens
tcttcactctggcttc

SEQ ID NO: 6477396 - DNA, 17 bp, Homo sapiens
tcttcactctggcttca

SEQ ID NO: 6477397 - DNA, 21 bp, Homo sapiens
tcttcactcttaggcactttg

SEQ ID NO: 6477398 - DNA, 16 bp, Homo sapiens
tcttcactcttcactt

SEQ ID NO: 6477399 - DNA, 20 bp, Homo sapiens
tcttcactgcaattttgtgt

SEQ ID NO: 6477400 - DNA, 12 bp, Homo sapiens
tcttcactggct

SEQ ID NO: 6477401 - DNA, 20 bp, Homo sapiens
tcttcactggcttccatcag

SEQ ID NO: 6477402 - DNA, 14 bp, Homo sapiens
tcttcactggtgag

SEQ ID NO: 6477403 - DNA, 22 bp, Homo sapiens
tcttcactgtggccacagcccc

SEQ ID NO: 6477404 - DNA, 16 bp, Homo sapiens
tcttcacttaatccat

SEQ ID NO: 6477405 - DNA, 17 bp, Homo sapiens
tcttcacttaatccatt

SEQ ID NO: 6477406 - DNA, 13 bp, Homo sapiens
tcttcacttcctc

SEQ ID NO: 6477407 - DNA, 22 bp, Homo sapiens
tcttcacttcctccagaagcct

SEQ ID NO: 6477408 - DNA, 22 bp, Homo sapiens
tcttcacttgagttggctgtgt

SEQ ID NO: 6477409 - DNA, 17 bp, Homo sapiens
tcttcagaacacacaga

SEQ ID NO: 6477410 - DNA, 23 bp, Homo sapiens
tcttcagaacacacagactttct

SEQ ID NO: 6477411 - DNA, 18 bp, Homo sapiens
tcttcagactctcagccc

SEQ ID NO: 6477412 - DNA, 20 bp, Homo sapiens
tcttcagactctcagcccag

SEQ ID NO: 6477413 - DNA, 18 bp, Homo sapiens
tcttcagagactcctgca

SEQ ID NO: 6477414 - DNA, 23 bp, Homo sapiens
tcttcagagtttgtcatatactg

SEQ ID NO: 6477415 - DNA, 15 bp, Homo sapiens
tcttcagatcctgct

SEQ ID NO: 6477416 - DNA, 17 bp, Homo sapiens
tcttcagatcctgctgc

SEQ ID NO: 6477417 - DNA, 15 bp, Homo sapiens
tcttcagatctctaa

SEQ ID NO: 6477418 - DNA, 23 bp, Homo sapiens
tcttcagatctctaacttcacca

SEQ ID NO: 6477419 - DNA, 13 bp, Homo sapiens
tcttcagatgcca

SEQ ID NO: 6477420 - DNA, 22 bp, Homo sapiens
tcttcagatttaagttaaataa

SEQ ID NO: 6477421 - DNA, 16 bp, Homo sapiens
tcttcagcagcatcta

SEQ ID NO: 6477422 - DNA, 19 bp, Homo sapiens
tcttcagcattccctccca

SEQ ID NO: 6477423 - DNA, 13 bp, Homo sapiens
tcttcagcccagg

SEQ ID NO: 6477424 - DNA, 15 bp, Homo sapiens
tcttcagccccttct

SEQ ID NO: 6477425 - DNA, 11 bp, Homo sapiens
tcttcagccta

SEQ ID NO: 6477426 - DNA, 12 bp, Homo sapiens
tcttcagcctag

SEQ ID NO: 6477427 - DNA, 22 bp, Homo sapiens
tcttcagcctagccgacctcag

SEQ ID NO: 6477428 - DNA, 13 bp, Homo sapiens
tcttcagcctccc

SEQ ID NO: 6477429 - DNA, 15 bp, Homo sapiens
tcttcagcctccctc

SEQ ID NO: 6477430 - DNA, 22 bp, Homo sapiens
tcttcagcctctttctgtccct

SEQ ID NO: 6477431 - DNA, 15 bp, Homo sapiens
tcttcagcgagaccc

SEQ ID NO: 6477432 - DNA, 12 bp, Homo sapiens
tcttcagctgca

SEQ ID NO: 6477433 - DNA, 18 bp, Homo sapiens
tcttcagctgctgacaat

SEQ ID NO: 6477434 - DNA, 12 bp, Homo sapiens
tcttcagctggt

SEQ ID NO: 6477435 - DNA, 20 bp, Homo sapiens
tcttcagcttgtgcacaatt

SEQ ID NO: 6477436 - DNA, 17 bp, Homo sapiens
tcttcaggcttcctgca

SEQ ID NO: 6477437 - DNA, 13 bp, Homo sapiens
tcttcagggcact

SEQ ID NO: 6477438 - DNA, 15 bp, Homo sapiens
tcttcagggcctggt

SEQ ID NO: 6477439 - DNA, 19 bp, Homo sapiens
tcttcaggggtcacctcct

SEQ ID NO: 6477440 - DNA, 20 bp, Homo sapiens
tcttcaggggtcacctcctc

SEQ ID NO: 6477441 - DNA, 16 bp, Homo sapiens
tcttcagggtgagtga

SEQ ID NO: 6477442 - DNA, 15 bp, Homo sapiens
tcttcaggtaacact

SEQ ID NO: 6477443 - DNA, 23 bp, Homo sapiens
tcttcaggtggaaaaacatctga

SEQ ID NO: 6477444 - DNA, 16 bp, Homo sapiens
tcttcaggttctcatg

SEQ ID NO: 6477445 - DNA, 22 bp, Homo sapiens
tcttcagtcagaaaactttaaa

SEQ ID NO: 6477446 - DNA, 12 bp, Homo sapiens
tcttcagtcctt

SEQ ID NO: 6477447 - DNA, 17 bp, Homo sapiens
tcttcagtcctttgtct

SEQ ID NO: 6477448 - DNA, 20 bp, Homo sapiens
tcttcagtcctttgtctttc

SEQ ID NO: 6477449 - DNA, 19 bp, Homo sapiens
tcttcagtcgtctgtccca

SEQ ID NO: 6477450 - DNA, 20 bp, Homo sapiens
tcttcagtcgtctgtcccaa

SEQ ID NO: 6477451 - DNA, 18 bp, Homo sapiens
tcttcagtctcacagaga

SEQ ID NO: 6477452 - DNA, 20 bp, Homo sapiens
tcttcagtgactcctgctgg

SEQ ID NO: 6477453 - DNA, 13 bp, Homo sapiens
tcttcagtgccta

SEQ ID NO: 6477454 - DNA, 17 bp, Homo sapiens
tcttcagtgtctctgtt

SEQ ID NO: 6477455 - DNA, 19 bp, Homo sapiens
tcttcagttaattcttaga

SEQ ID NO: 6477456 - DNA, 18 bp, Homo sapiens
tcttcagttctctactcc

SEQ ID NO: 6477457 - DNA, 18 bp, Homo sapiens
tcttcagtttgcagagta

SEQ ID NO: 6477458 - DNA, 19 bp, Homo sapiens
tcttcagttttatctttaa

SEQ ID NO: 6477459 - DNA, 20 bp, Homo sapiens
tcttcataaagtacttgagt

SEQ ID NO: 6477460 - DNA, 19 bp, Homo sapiens
tcttcataccccagaaatt

SEQ ID NO: 6477461 - DNA, 21 bp, Homo sapiens
tcttcatacctacatgtattt

SEQ ID NO: 6477462 - DNA, 12 bp, Homo sapiens
tcttcatataaa

SEQ ID NO: 6477463 - DNA, 20 bp, Homo sapiens
tcttcatcagcatttaataa

SEQ ID NO: 6477464 - DNA, 17 bp, Homo sapiens
tcttcatcccattccag

SEQ ID NO: 6477465 - DNA, 18 bp, Homo sapiens
tcttcatctaatatgata

SEQ ID NO: 6477466 - DNA, 13 bp, Homo sapiens
tcttcatctccct

SEQ ID NO: 6477467 - DNA, 16 bp, Homo sapiens
tcttcatctccctgcc

SEQ ID NO: 6477468 - DNA, 19 bp, Homo sapiens
tcttcatctccctgccatc

SEQ ID NO: 6477469 - DNA, 16 bp, Homo sapiens
tcttcatctgcccaac

SEQ ID NO: 6477470 - DNA, 16 bp, Homo sapiens
tcttcatctgctacaa

SEQ ID NO: 6477471 - DNA, 18 bp, Homo sapiens
tcttcatcttcaccagag

SEQ ID NO: 6477472 - DNA, 13 bp, Homo sapiens
tcttcatcttgac

SEQ ID NO: 6477473 - DNA, 12 bp, Homo sapiens
tcttcatgaaat

SEQ ID NO: 6477474 - DNA, 14 bp, Homo sapiens
tcttcatgaacata

SEQ ID NO: 6477475 - DNA, 14 bp, Homo sapiens
tcttcatgcaatga

SEQ ID NO: 6477476 - DNA, 17 bp, Homo sapiens
tcttcatgcaatgacat

SEQ ID NO: 6477477 - DNA, 14 bp, Homo sapiens
tcttcatgcattac

SEQ ID NO: 6477478 - DNA, 21 bp, Homo sapiens
tcttcatgcattacttactgt

SEQ ID NO: 6477479 - DNA, 20 bp, Homo sapiens
tcttcatgggggtaagaaaa

SEQ ID NO: 6477480 - DNA, 16 bp, Homo sapiens
tcttcatgtccagtga

SEQ ID NO: 6477481 - DNA, 14 bp, Homo sapiens
tcttcatgttccca

SEQ ID NO: 6477482 - DNA, 16 bp, Homo sapiens
tcttcatgttcccact

SEQ ID NO: 6477483 - DNA, 21 bp, Homo sapiens
tcttcattaagccctcttcca

SEQ ID NO: 6477484 - DNA, 18 bp, Homo sapiens
tcttcattaatactgtgt

SEQ ID NO: 6477485 - DNA, 20 bp, Homo sapiens
tcttcattcccactgcactt

SEQ ID NO: 6477486 - DNA, 20 bp, Homo sapiens
tcttcattctatcaagccca

SEQ ID NO: 6477487 - DNA, 23 bp, Homo sapiens
tcttcattggctatataaaatgt

SEQ ID NO: 6477488 - DNA, 10 bp, Homo sapiens
tcttcattgt

SEQ ID NO: 6477489 - DNA, 16 bp, Homo sapiens
tcttcattgtaatctg

SEQ ID NO: 6477490 - DNA, 13 bp, Homo sapiens
tcttcatttacaa

SEQ ID NO: 6477491 - DNA, 16 bp, Homo sapiens
tcttcatttattttga

SEQ ID NO: 6477492 - DNA, 16 bp, Homo sapiens
tcttcatttcattgta

SEQ ID NO: 6477493 - DNA, 17 bp, Homo sapiens
tcttcatttcattgtat

SEQ ID NO: 6477494 - DNA, 21 bp, Homo sapiens
tcttcatttcattgtatgatg

SEQ ID NO: 6477495 - DNA, 24 bp, Homo sapiens
tcttcatttcattgtatgatgtgt

SEQ ID NO: 6477496 - DNA, 23 bp, Homo sapiens
tcttcatttctatagccaaagct

SEQ ID NO: 6477497 - DNA, 14 bp, Homo sapiens
tcttcatttctctg

SEQ ID NO: 6477498 - DNA, 17 bp, Homo sapiens
tcttcattttttaatgt

SEQ ID NO: 6477499 - DNA, 19 bp, Homo sapiens
tcttcattttttttaattg

SEQ ID NO: 6477500 - DNA, 21 bp, Homo sapiens
tcttccaaagcagagagcatt

SEQ ID NO: 6477501 - DNA, 14 bp, Homo sapiens
tcttccaaaggcag

SEQ ID NO: 6477502 - DNA, 15 bp, Homo sapiens
tcttccaaaggcagc

SEQ ID NO: 6477503 - DNA, 15 bp, Homo sapiens
tcttccaaaggcata

SEQ ID NO: 6477504 - DNA, 13 bp, Homo sapiens
tcttccaaatatt

SEQ ID NO: 6477505 - DNA, 16 bp, Homo sapiens
tcttccaacatgtgat

SEQ ID NO: 6477506 - DNA, 18 bp, Homo sapiens
tcttccaacatgtgatgt

SEQ ID NO: 6477507 - DNA, 17 bp, Homo sapiens
tcttccaaccatttatc

SEQ ID NO: 6477508 - DNA, 12 bp, Homo sapiens
tcttccaacccc

SEQ ID NO: 6477509 - DNA, 16 bp, Homo sapiens
tcttccaaccccagct

SEQ ID NO: 6477510 - DNA, 24 bp, Homo sapiens
tcttccaagcaaaggtgaagagac

SEQ ID NO: 6477511 - DNA, 18 bp, Homo sapiens
tcttccacaaagaaaatt

SEQ ID NO: 6477512 - DNA, 15 bp, Homo sapiens
tcttccacacatgca

SEQ ID NO: 6477513 - DNA, 13 bp, Homo sapiens
tcttccacagcaa

SEQ ID NO: 6477514 - DNA, 17 bp, Homo sapiens
tcttccaccagagcagg

SEQ ID NO: 6477515 - DNA, 22 bp, Homo sapiens
tcttccacctcagcctcccagg

SEQ ID NO: 6477516 - DNA, 19 bp, Homo sapiens
tcttccacctgtgccctca

SEQ ID NO: 6477517 - DNA, 13 bp, Homo sapiens
tcttccactgtgt

SEQ ID NO: 6477518 - DNA, 13 bp, Homo sapiens
tcttccactttgc

SEQ ID NO: 6477519 - DNA, 13 bp, Homo sapiens
tcttccagaaagc

SEQ ID NO: 6477520 - DNA, 14 bp, Homo sapiens
tcttccagaaagca

SEQ ID NO: 6477521 - DNA, 13 bp, Homo sapiens
tcttccagaacct

SEQ ID NO: 6477522 - DNA, 17 bp, Homo sapiens
tcttccagaagtgtgat

SEQ ID NO: 6477523 - DNA, 19 bp, Homo sapiens
tcttccagaagtgtgattg

SEQ ID NO: 6477524 - DNA, 20 bp, Homo sapiens
tcttccagaagtgtgattgg

SEQ ID NO: 6477525 - DNA, 18 bp, Homo sapiens
tcttccagagcctaagaa

SEQ ID NO: 6477526 - DNA, 12 bp, Homo sapiens
tcttccagccac

SEQ ID NO: 6477527 - DNA, 21 bp, Homo sapiens
tcttccagctgcttcagggag

SEQ ID NO: 6477528 - DNA, 23 bp, Homo sapiens
tcttccaggagccaccttgccac

SEQ ID NO: 6477529 - DNA, 14 bp, Homo sapiens
tcttccaggctggg

SEQ ID NO: 6477530 - DNA, 20 bp, Homo sapiens
tcttccaggctgggagagcc

SEQ ID NO: 6477531 - DNA, 22 bp, Homo sapiens
tcttccaggctgggagagcctt

SEQ ID NO: 6477532 - DNA, 18 bp, Homo sapiens
tcttccaggtgcccagct

SEQ ID NO: 6477533 - DNA, 22 bp, Homo sapiens
tcttccagtgaggcatctctct

SEQ ID NO: 6477534 - DNA, 17 bp, Homo sapiens
tcttccagtgcaacaaa

SEQ ID NO: 6477535 - DNA, 19 bp, Homo sapiens
tcttccagtgcaacaaaat

SEQ ID NO: 6477536 - DNA, 19 bp, Homo sapiens
tcttccagttactttccaa

SEQ ID NO: 6477537 - DNA, 18 bp, Homo sapiens
tcttccatatccgggtgc

SEQ ID NO: 6477538 - DNA, 22 bp, Homo sapiens
tcttccatatccgggtgctcaa

SEQ ID NO: 6477539 - DNA, 17 bp, Homo sapiens
tcttccatcagagatgg

SEQ ID NO: 6477540 - DNA, 17 bp, Homo sapiens
tcttccatcatcactgt

SEQ ID NO: 6477541 - DNA, 21 bp, Homo sapiens
tcttccatcatcactgtaaag

SEQ ID NO: 6477542 - DNA, 16 bp, Homo sapiens
tcttccatcatgtccc

SEQ ID NO: 6477543 - DNA, 19 bp, Homo sapiens
tcttccatctgcatcttaa

SEQ ID NO: 6477544 - DNA, 16 bp, Homo sapiens
tcttccattagaatgc

SEQ ID NO: 6477545 - DNA, 15 bp, Homo sapiens
tcttccattccttca

SEQ ID NO: 6477546 - DNA, 14 bp, Homo sapiens
tcttccatttgcaa

SEQ ID NO: 6477547 - DNA, 18 bp, Homo sapiens
tcttcccaacttgccttt

SEQ ID NO: 6477548 - DNA, 21 bp, Homo sapiens
tcttcccaacttgcctttgaa

SEQ ID NO: 6477549 - DNA, 19 bp, Homo sapiens
tcttcccaaggccagtctg

SEQ ID NO: 6477550 - DNA, 22 bp, Homo sapiens
tcttcccaagtcctcgcccccc

SEQ ID NO: 6477551 - DNA, 15 bp, Homo sapiens
tcttcccacaggagg

SEQ ID NO: 6477552 - DNA, 18 bp, Homo sapiens
tcttcccacctgtcaacc

SEQ ID NO: 6477553 - DNA, 15 bp, Homo sapiens
tcttcccactccagc

SEQ ID NO: 6477554 - DNA, 19 bp, Homo sapiens
tcttcccagaatctctgag

SEQ ID NO: 6477555 - DNA, 22 bp, Homo sapiens
tcttcccagaatctctgagcca

SEQ ID NO: 6477556 - DNA, 12 bp, Homo sapiens
tcttcccagagt

SEQ ID NO: 6477557 - DNA, 23 bp, Homo sapiens
tcttcccagcactatgctttcct

SEQ ID NO: 6477558 - DNA, 13 bp, Homo sapiens
tcttcccaggcct

SEQ ID NO: 6477559 - DNA, 14 bp, Homo sapiens
tcttcccaggcctt

SEQ ID NO: 6477560 - DNA, 12 bp, Homo sapiens
tcttcccagggt

SEQ ID NO: 6477561 - DNA, 21 bp, Homo sapiens
tcttcccagggtagcccgcct

SEQ ID NO: 6477562 - DNA, 17 bp, Homo sapiens
tcttcccataataaagc

SEQ ID NO: 6477563 - DNA, 22 bp, Homo sapiens
tcttcccatgtcccaccctccc

SEQ ID NO: 6477564 - DNA, 13 bp, Homo sapiens
tcttcccattctc

SEQ ID NO: 6477565 - DNA, 13 bp, Homo sapiens
tcttcccatttgt

SEQ ID NO: 6477566 - DNA, 14 bp, Homo sapiens
tcttcccatttgta

SEQ ID NO: 6477567 - DNA, 13 bp, Homo sapiens
tcttccccaagct

SEQ ID NO: 6477568 - DNA, 16 bp, Homo sapiens
tgctggcctggatctc

SEQ ID NO: 6477569 - DNA, 15 bp, Homo sapiens
tgctggcctggcagg

SEQ ID NO: 6477570 - DNA, 14 bp, Homo sapiens
tgctggcctggccc

SEQ ID NO: 6477571 - DNA, 15 bp, Homo sapiens
tgctggcctggccct

SEQ ID NO: 6477572 - DNA, 17 bp, Homo sapiens
tgctggccttggtatgt

SEQ ID NO: 6477573 - DNA, 14 bp, Homo sapiens
tgctggcctttgct

SEQ ID NO: 6477574 - DNA, 21 bp, Homo sapiens
tgctggcgacactcagggcag

SEQ ID NO: 6477575 - DNA, 23 bp, Homo sapiens
tgctggcgacactcagggcagct

SEQ ID NO: 6477576 - DNA, 19 bp, Homo sapiens
tgctggcggacgcagctgg

SEQ ID NO: 6477577 - DNA, 20 bp, Homo sapiens
tgctggcggcgcagagggaa

SEQ ID NO: 6477578 - DNA, 12 bp, Homo sapiens
tgctggctcagg

SEQ ID NO: 6477579 - DNA, 13 bp, Homo sapiens
tgctggctcagga

SEQ ID NO: 6477580 - DNA, 21 bp, Homo sapiens
tgctggctccacgccctgggg

SEQ ID NO: 6477581 - DNA, 22 bp, Homo sapiens
tgctggctccacgccctgggga

SEQ ID NO: 6477582 - DNA, 13 bp, Homo sapiens
tgctggctctgag

SEQ ID NO: 6477583 - DNA, 13 bp, Homo sapiens
tgctggctcttct

SEQ ID NO: 6477584 - DNA, 18 bp, Homo sapiens
tgctggctgacctgggcc

SEQ ID NO: 6477585 - DNA, 21 bp, Homo sapiens
tgctggctgcccagacccctc

SEQ ID NO: 6477586 - DNA, 13 bp, Homo sapiens
tgctggctgcccc

SEQ ID NO: 6477587 - DNA, 19 bp, Homo sapiens
tgctggctgcctctctgct

SEQ ID NO: 6477588 - DNA, 14 bp, Homo sapiens
tgctggctgcggcc

SEQ ID NO: 6477589 - DNA, 14 bp, Homo sapiens
tgctggctgctggc

SEQ ID NO: 6477590 - DNA, 16 bp, Homo sapiens
tgctggctggaaggga

SEQ ID NO: 6477591 - DNA, 21 bp, Homo sapiens
tgctggctggaagggaggagc

SEQ ID NO: 6477592 - DNA, 17 bp, Homo sapiens
tgctggctggtgcctga

SEQ ID NO: 6477593 - DNA, 15 bp, Homo sapiens
tgctggctgtgacaa

SEQ ID NO: 6477594 - DNA, 18 bp, Homo sapiens
tgctggcttcagggaggg

SEQ ID NO: 6477595 - DNA, 14 bp, Homo sapiens
tgctggcttccagc

SEQ ID NO: 6477596 - DNA, 21 bp, Homo sapiens
tgctggcttccagcttcaggc

SEQ ID NO: 6477597 - DNA, 19 bp, Homo sapiens
tgctggcttccgctgtcac

SEQ ID NO: 6477598 - DNA, 19 bp, Homo sapiens
tgctggcttttcaccccag

SEQ ID NO: 6477599 - DNA, 11 bp, Homo sapiens
tgctgggaaat

SEQ ID NO: 6477600 - DNA, 20 bp, Homo sapiens
tgctgggaaatgcagaaatc

SEQ ID NO: 6477601 - DNA, 19 bp, Homo sapiens
tgctgggaaccccgcagcc

SEQ ID NO: 6477602 - DNA, 18 bp, Homo sapiens
tgctgggaagagctcccc

SEQ ID NO: 6477603 - DNA, 15 bp, Homo sapiens
tgctgggaagcccgg

SEQ ID NO: 6477604 - DNA, 16 bp, Homo sapiens
tgctgggaagcccgga

SEQ ID NO: 6477605 - DNA, 18 bp, Homo sapiens
tgctgggaagcccggact

SEQ ID NO: 6477606 - DNA, 19 bp, Homo sapiens
tgctgggaagcccggactg

SEQ ID NO: 6477607 - DNA, 17 bp, Homo sapiens
tgctgggaatacatctg

SEQ ID NO: 6477608 - DNA, 14 bp, Homo sapiens
tgctgggacagcta

SEQ ID NO: 6477609 - DNA, 17 bp, Homo sapiens
tgctgggacagctaggc

SEQ ID NO: 6477610 - DNA, 17 bp, Homo sapiens
tgctgggaccagagcca

SEQ ID NO: 6477611 - DNA, 22 bp, Homo sapiens
tgctgggaccagagccagatgc

SEQ ID NO: 6477612 - DNA, 22 bp, Homo sapiens
tgctgggaccccagctagggct

SEQ ID NO: 6477613 - DNA, 23 bp, Homo sapiens
tgctgggactcagccttcagaca

SEQ ID NO: 6477614 - DNA, 21 bp, Homo sapiens
tgctgggagatgccattctcc

SEQ ID NO: 6477615 - DNA, 18 bp, Homo sapiens
tgctgggagatgctctct

SEQ ID NO: 6477616 - DNA, 23 bp, Homo sapiens
tgctgggagatgctctctgaggc

SEQ ID NO: 6477617 - DNA, 14 bp, Homo sapiens
tgctgggagcctct

SEQ ID NO: 6477618 - DNA, 21 bp, Homo sapiens
tgctgggagctccactctgct

SEQ ID NO: 6477619 - DNA, 23 bp, Homo sapiens
tgctgggagctccactctgcttc

SEQ ID NO: 6477620 - DNA, 21 bp, Homo sapiens
tgctgggagctgaaaaatcac

SEQ ID NO: 6477621 - DNA, 17 bp, Homo sapiens
tgctgggaggagggaga

SEQ ID NO: 6477622 - DNA, 18 bp, Homo sapiens
tgctgggaggagggagag

SEQ ID NO: 6477623 - DNA, 14 bp, Homo sapiens
tgctgggagggctg

SEQ ID NO: 6477624 - DNA, 23 bp, Homo sapiens
tgctgggaggtataggggtcctg

SEQ ID NO: 6477625 - DNA, 17 bp, Homo sapiens
tgctgggagttctagaa

SEQ ID NO: 6477626 - DNA, 21 bp, Homo sapiens
tgctgggataactggccagcc

SEQ ID NO: 6477627 - DNA, 19 bp, Homo sapiens
tgctgggatggtgggcttc

SEQ ID NO: 6477628 - DNA, 23 bp, Homo sapiens
tgctgggatggtgggcttcaggg

SEQ ID NO: 6477629 - DNA, 16 bp, Homo sapiens
tgctgggattacagac

SEQ ID NO: 6477630 - DNA, 17 bp, Homo sapiens
tgctgggattacaggtg

SEQ ID NO: 6477631 - DNA, 18 bp, Homo sapiens
tgctgggattacaggtgt

SEQ ID NO: 6477632 - DNA, 16 bp, Homo sapiens
tgctgggatttccaac

SEQ ID NO: 6477633 - DNA, 12 bp, Homo sapiens
tgctgggcactg

SEQ ID NO: 6477634 - DNA, 16 bp, Homo sapiens
tgctgggcactgccag

SEQ ID NO: 6477635 - DNA, 21 bp, Homo sapiens
tgctgggcactgctccaaggg

SEQ ID NO: 6477636 - DNA, 22 bp, Homo sapiens
tgctgggcactgctccaaggga

SEQ ID NO: 6477637 - DNA, 17 bp, Homo sapiens
tgctgggcagagggagg

SEQ ID NO: 6477638 - DNA, 21 bp, Homo sapiens
tgctgggcaggaaaccccagc

SEQ ID NO: 6477639 - DNA, 22 bp, Homo sapiens
tgctgggcatactttctctcta

SEQ ID NO: 6477640 - DNA, 14 bp, Homo sapiens
tgctgggccactgg

SEQ ID NO: 6477641 - DNA, 17 bp, Homo sapiens
tgctgggccactgggga

SEQ ID NO: 6477642 - DNA, 22 bp, Homo sapiens
tgctgggccagtggcactctgt

SEQ ID NO: 6477643 - DNA, 17 bp, Homo sapiens
tgctgggccagtggctg

SEQ ID NO: 6477644 - DNA, 12 bp, Homo sapiens
tgctgggcccag

SEQ ID NO: 6477645 - DNA, 14 bp, Homo sapiens
tgctgggcccagcc

SEQ ID NO: 6477646 - DNA, 20 bp, Homo sapiens
tgctgggcccccagcctggc

SEQ ID NO: 6477647 - DNA, 14 bp, Homo sapiens
tgctgggcccctgc

SEQ ID NO: 6477648 - DNA, 16 bp, Homo sapiens
tgctgggcccctgcct

SEQ ID NO: 6477649 - DNA, 19 bp, Homo sapiens
tgctgggcccctgcctctc

SEQ ID NO: 6477650 - DNA, 21 bp, Homo sapiens
tgctgggcccctgcctctctg

SEQ ID NO: 6477651 - DNA, 22 bp, Homo sapiens
tgctgggcccctgcctctctgc

SEQ ID NO: 6477652 - DNA, 24 bp, Homo sapiens
tgctgggcccctgcctctctgcag

SEQ ID NO: 6477653 - DNA, 16 bp, Homo sapiens
tgctgggcctctgcct

SEQ ID NO: 6477654 - DNA, 18 bp, Homo sapiens
tgctgggcggctgtgctt

SEQ ID NO: 6477655 - DNA, 14 bp, Homo sapiens
tgctgggctcagtg

SEQ ID NO: 6477656 - DNA, 17 bp, Homo sapiens
tgctgggctcagtgaag

SEQ ID NO: 6477657 - DNA, 21 bp, Homo sapiens
tgctgggctccccccagtggg

SEQ ID NO: 6477658 - DNA, 14 bp, Homo sapiens
tgctgggctctcca

SEQ ID NO: 6477659 - DNA, 16 bp, Homo sapiens
tgctgggctctccacc

SEQ ID NO: 6477660 - DNA, 23 bp, Homo sapiens
tgctgggctctccacctcagcct

SEQ ID NO: 6477661 - DNA, 24 bp, Homo sapiens
tgctgggctgacggtgcagtctgg

SEQ ID NO: 6477662 - DNA, 14 bp, Homo sapiens
tgctgggctggact

SEQ ID NO: 6477663 - DNA, 20 bp, Homo sapiens
tgctgggctggactggccat

SEQ ID NO: 6477664 - DNA, 15 bp, Homo sapiens
tgctgggctgggtgc

SEQ ID NO: 6477665 - DNA, 18 bp, Homo sapiens
tgctgggctgtctctccc

SEQ ID NO: 6477666 - DNA, 20 bp, Homo sapiens
tgctgggctgtctctccctt

SEQ ID NO: 6477667 - DNA, 17 bp, Homo sapiens
tgctgggcttgtctgta

SEQ ID NO: 6477668 - DNA, 16 bp, Homo sapiens
tgctggggaagacagt

SEQ ID NO: 6477669 - DNA, 20 bp, Homo sapiens
tgctggggacacacattctg

SEQ ID NO: 6477670 - DNA, 22 bp, Homo sapiens
tgctggggacacacattctgcc

SEQ ID NO: 6477671 - DNA, 20 bp, Homo sapiens
tgctggggacggggggcccc

SEQ ID NO: 6477672 - DNA, 23 bp, Homo sapiens
tgctggggacggggggccccagt

SEQ ID NO: 6477673 - DNA, 14 bp, Homo sapiens
tgctggggcagagt

SEQ ID NO: 6477674 - DNA, 16 bp, Homo sapiens
tgctggggcagagtgg

SEQ ID NO: 6477675 - DNA, 13 bp, Homo sapiens
tgctggggcaggg

SEQ ID NO: 6477676 - DNA, 15 bp, Homo sapiens
tgctggggcaggggg

SEQ ID NO: 6477677 - DNA, 21 bp, Homo sapiens
tgctggggcatgtgtgcctgt

SEQ ID NO: 6477678 - DNA, 22 bp, Homo sapiens
tgctggggcatgtgtgcctgtg

SEQ ID NO: 6477679 - DNA, 11 bp, Homo sapiens
tgctggggcca

SEQ ID NO: 6477680 - DNA, 15 bp, Homo sapiens
tgctggggccaggcc

SEQ ID NO: 6477681 - DNA, 16 bp, Homo sapiens
tgctggggccaggccc

SEQ ID NO: 6477682 - DNA, 17 bp, Homo sapiens
tgctggggccaggcccc

SEQ ID NO: 6477683 - DNA, 22 bp, Homo sapiens
tgctggggccaggccccatgga

SEQ ID NO: 6477684 - DNA, 18 bp, Homo sapiens
tgctggggcctcagacga

SEQ ID NO: 6477685 - DNA, 14 bp, Homo sapiens
tgctggggcctggg

SEQ ID NO: 6477686 - DNA, 23 bp, Homo sapiens
tgctggggcctgggacaactgct

SEQ ID NO: 6477687 - DNA, 10 bp, Homo sapiens
tgctggggct

SEQ ID NO: 6477688 - DNA, 13 bp, Homo sapiens
tgctggggctggt

SEQ ID NO: 6477689 - DNA, 14 bp, Homo sapiens
tgctgggggaatga

SEQ ID NO: 6477690 - DNA, 20 bp, Homo sapiens
tgctgggggaatgagcccag

SEQ ID NO: 6477691 - DNA, 13 bp, Homo sapiens
tgctgggggagcc

SEQ ID NO: 6477692 - DNA, 19 bp, Homo sapiens
tgctgggggcaactggcca

SEQ ID NO: 6477693 - DNA, 19 bp, Homo sapiens
tgctgggggcacagctgtc

SEQ ID NO: 6477694 - DNA, 20 bp, Homo sapiens
tgctgggggcacagctgtct

SEQ ID NO: 6477695 - DNA, 16 bp, Homo sapiens
tgctgggggccgccct

SEQ ID NO: 6477696 - DNA, 17 bp, Homo sapiens
tgctgggggctcccctt

SEQ ID NO: 6477697 - DNA, 19 bp, Homo sapiens
tgctggggtcaaggcagta

SEQ ID NO: 6477698 - DNA, 13 bp, Homo sapiens
tgctggggtccag

SEQ ID NO: 6477699 - DNA, 14 bp, Homo sapiens
tgctggggtccagg

SEQ ID NO: 6477700 - DNA, 18 bp, Homo sapiens
tgctggggtccagggctg

SEQ ID NO: 6477701 - DNA, 17 bp, Homo sapiens
tgctggggttatctgaa

SEQ ID NO: 6477702 - DNA, 16 bp, Homo sapiens
tgctgggtaaactgtg

SEQ ID NO: 6477703 - DNA, 13 bp, Homo sapiens
tgctgggtaataa

SEQ ID NO: 6477704 - DNA, 22 bp, Homo sapiens
tgctgggtacctggtccccact

SEQ ID NO: 6477705 - DNA, 16 bp, Homo sapiens
tgctgggtccttaaaa

SEQ ID NO: 6477706 - DNA, 13 bp, Homo sapiens
tgctgggtgccag

SEQ ID NO: 6477707 - DNA, 15 bp, Homo sapiens
tgctgggtgccaggt

SEQ ID NO: 6477708 - DNA, 14 bp, Homo sapiens
tgctgggtgcctcc

SEQ ID NO: 6477709 - DNA, 23 bp, Homo sapiens
tgctgggttctggggctgagagt

SEQ ID NO: 6477710 - DNA, 14 bp, Homo sapiens
tgctgggttggtgc

SEQ ID NO: 6477711 - DNA, 21 bp, Homo sapiens
tgctgggttggtgcacagtga

SEQ ID NO: 6477712 - DNA, 23 bp, Homo sapiens
tgctgggttggtgcacagtgatt

SEQ ID NO: 6477713 - DNA, 21 bp, Homo sapiens
tgctgggtttccacacagcct

SEQ ID NO: 6477714 - DNA, 14 bp, Homo sapiens
tgctggtaaaatga

SEQ ID NO: 6477715 - DNA, 18 bp, Homo sapiens
tgctggtaaaatgaagaa

SEQ ID NO: 6477716 - DNA, 19 bp, Homo sapiens
tgctggtaaaatgaagaat

SEQ ID NO: 6477717 - DNA, 14 bp, Homo sapiens
tgctggtagctgag

SEQ ID NO: 6477718 - DNA, 19 bp, Homo sapiens
tgctggtagctgaggggac

SEQ ID NO: 6477719 - DNA, 18 bp, Homo sapiens
tgctggtatatggcttca

SEQ ID NO: 6477720 - DNA, 22 bp, Homo sapiens
tgctggtcaagccccctttgat

SEQ ID NO: 6477721 - DNA, 19 bp, Homo sapiens
tgctggtcacagcctcctc

SEQ ID NO: 6477722 - DNA, 20 bp, Homo sapiens
tgctggtcacagcctcctct

SEQ ID NO: 6477723 - DNA, 14 bp, Homo sapiens
tgctggtcagagag

SEQ ID NO: 6477724 - DNA, 15 bp, Homo sapiens
tgctggtcagagaga

SEQ ID NO: 6477725 - DNA, 21 bp, Homo sapiens
tgctggtcagagagacctcat

SEQ ID NO: 6477726 - DNA, 13 bp, Homo sapiens
tgctggtcaggtc

SEQ ID NO: 6477727 - DNA, 15 bp, Homo sapiens
tgctggtcaggtccc

SEQ ID NO: 6477728 - DNA, 22 bp, Homo sapiens
tgctggtcaggtccccatggct

SEQ ID NO: 6477729 - DNA, 17 bp, Homo sapiens
tgctggtcatcctgggc

SEQ ID NO: 6477730 - DNA, 19 bp, Homo sapiens
tgctggtcccggggccagc

SEQ ID NO: 6477731 - DNA, 13 bp, Homo sapiens
tgctggtccgtgg

SEQ ID NO: 6477732 - DNA, 13 bp, Homo sapiens
tgctggtcctagg

SEQ ID NO: 6477733 - DNA, 14 bp, Homo sapiens
tgctggtcctaggt

SEQ ID NO: 6477734 - DNA, 13 bp, Homo sapiens
tgctggtcctgca

SEQ ID NO: 6477735 - DNA, 17 bp, Homo sapiens
tgctggtcctgcacatg

SEQ ID NO: 6477736 - DNA, 13 bp, Homo sapiens
tgctggtctcatt

SEQ ID NO: 6477737 - DNA, 15 bp, Homo sapiens
tgctggtctctggct

SEQ ID NO: 6477738 - DNA, 14 bp, Homo sapiens
tgctggtgaacact

SEQ ID NO: 6477739 - DNA, 20 bp, Homo sapiens
tgctggtgaccggcctggac

SEQ ID NO: 6477740 - DNA, 18 bp, Homo sapiens
tgctggtgagccaagcag

SEQ ID NO: 6477741 - DNA, 17 bp, Homo sapiens
tgctggtgagtgccacg

SEQ ID NO: 6477742 - DNA, 15 bp, Homo sapiens
tgctggtgccagggt

SEQ ID NO: 6477743 - DNA, 19 bp, Homo sapiens
tgctggtggaaagcgattc

SEQ ID NO: 6477744 - DNA, 20 bp, Homo sapiens
tgctggtggaggaagggctg

SEQ ID NO: 6477745 - DNA, 19 bp, Homo sapiens
tgctggtggttaaggccag

SEQ ID NO: 6477746 - DNA, 18 bp, Homo sapiens
tcttccccaatatgcctg

SEQ ID NO: 6477747 - DNA, 11 bp, Homo sapiens
tcttccccaca

SEQ ID NO: 6477748 - DNA, 13 bp, Homo sapiens
tcttccccagacg

SEQ ID NO: 6477749 - DNA, 19 bp, Homo sapiens
tcttccccagacgcctggc

SEQ ID NO: 6477750 - DNA, 19 bp, Homo sapiens
tcttccccagccctcccca

SEQ ID NO: 6477751 - DNA, 21 bp, Homo sapiens
tcttccccagggttctgtatt

SEQ ID NO: 6477752 - DNA, 19 bp, Homo sapiens
tcttccccatctcactctt

SEQ ID NO: 6477753 - DNA, 18 bp, Homo sapiens
tcttcccccatgtgcctg

SEQ ID NO: 6477754 - DNA, 21 bp, Homo sapiens
tcttcccccctctcctcccag

SEQ ID NO: 6477755 - DNA, 18 bp, Homo sapiens
tcttccccctctcccagt

SEQ ID NO: 6477756 - DNA, 14 bp, Homo sapiens
tcttcccccttccc

SEQ ID NO: 6477757 - DNA, 17 bp, Homo sapiens
tcttcccctagacctcc

SEQ ID NO: 6477758 - DNA, 22 bp, Homo sapiens
tcttcccctagacctccccctc

SEQ ID NO: 6477759 - DNA, 24 bp, Homo sapiens
tcttcccctctaatgctcacgctc

SEQ ID NO: 6477760 - DNA, 14 bp, Homo sapiens
tcttcccctgagag

SEQ ID NO: 6477761 - DNA, 14 bp, Homo sapiens
tcttccccttcctg

SEQ ID NO: 6477762 - DNA, 17 bp, Homo sapiens
tcttccccttcctgttt

SEQ ID NO: 6477763 - DNA, 15 bp, Homo sapiens
tcttccccttgccct

SEQ ID NO: 6477764 - DNA, 14 bp, Homo sapiens
tcttcccctttcct

SEQ ID NO: 6477765 - DNA, 15 bp, Homo sapiens
tcttcccctttcctg

SEQ ID NO: 6477766 - DNA, 17 bp, Homo sapiens
tcttcccctttgtcctg

SEQ ID NO: 6477767 - DNA, 16 bp, Homo sapiens
tcttcccgatgaggga

SEQ ID NO: 6477768 - DNA, 19 bp, Homo sapiens
tcttcccgccccacctccc

SEQ ID NO: 6477769 - DNA, 15 bp, Homo sapiens
tcttcccgcctcagc

SEQ ID NO: 6477770 - DNA, 13 bp, Homo sapiens
tcttcccgctccc

SEQ ID NO: 6477771 - DNA, 18 bp, Homo sapiens
tcttcccgctccccacct

SEQ ID NO: 6477772 - DNA, 22 bp, Homo sapiens
tcttccctacagttgaaaaaca

SEQ ID NO: 6477773 - DNA, 20 bp, Homo sapiens
tcttccctagagggttcctg

SEQ ID NO: 6477774 - DNA, 20 bp, Homo sapiens
tcttccctagggctgggtgt

SEQ ID NO: 6477775 - DNA, 13 bp, Homo sapiens
tcttccctcagat

SEQ ID NO: 6477776 - DNA, 10 bp, Homo sapiens
tcttccctcc

SEQ ID NO: 6477777 - DNA, 16 bp, Homo sapiens
tcttccctccttccct

SEQ ID NO: 6477778 - DNA, 17 bp, Homo sapiens
tcttccctctcgctccc

SEQ ID NO: 6477779 - DNA, 16 bp, Homo sapiens
tcttccctctctgcag

SEQ ID NO: 6477780 - DNA, 21 bp, Homo sapiens
tcttccctctgatttttcctt

SEQ ID NO: 6477781 - DNA, 13 bp, Homo sapiens
tcttccctctggg

SEQ ID NO: 6477782 - DNA, 19 bp, Homo sapiens
tcttccctctgggcctgtt

SEQ ID NO: 6477783 - DNA, 23 bp, Homo sapiens
tcttccctgaacgttttcttctt

SEQ ID NO: 6477784 - DNA, 12 bp, Homo sapiens
tcttccctgcct

SEQ ID NO: 6477785 - DNA, 13 bp, Homo sapiens
tcttccctgcttc

SEQ ID NO: 6477786 - DNA, 12 bp, Homo sapiens
tcttccctggga

SEQ ID NO: 6477787 - DNA, 14 bp, Homo sapiens
tcttccctgggaac

SEQ ID NO: 6477788 - DNA, 21 bp, Homo sapiens
tcttccctgggggtcccagga

SEQ ID NO: 6477789 - DNA, 17 bp, Homo sapiens
tcttccctgtcagcctg

SEQ ID NO: 6477790 - DNA, 16 bp, Homo sapiens
tcttcccttaactcca

SEQ ID NO: 6477791 - DNA, 14 bp, Homo sapiens
tcttcccttcccag

SEQ ID NO: 6477792 - DNA, 15 bp, Homo sapiens
tcttcccttcctcca

SEQ ID NO: 6477793 - DNA, 13 bp, Homo sapiens
tcttcccttctcc

SEQ ID NO: 6477794 - DNA, 13 bp, Homo sapiens
tcttcccttgctc

SEQ ID NO: 6477795 - DNA, 21 bp, Homo sapiens
tcttcccttttacatactgct

SEQ ID NO: 6477796 - DNA, 22 bp, Homo sapiens
tcttcccttttacatactgctg

SEQ ID NO: 6477797 - DNA, 21 bp, Homo sapiens
tcttccgaaaaatcctcttcc

SEQ ID NO: 6477798 - DNA, 21 bp, Homo sapiens
tcttccgactctttctgagtg

SEQ ID NO: 6477799 - DNA, 20 bp, Homo sapiens
tcttccgagctgctttgtgg

SEQ ID NO: 6477800 - DNA, 14 bp, Homo sapiens
tcttccgatgtttg

SEQ ID NO: 6477801 - DNA, 22 bp, Homo sapiens
tcttccgcagcccctttcccca

SEQ ID NO: 6477802 - DNA, 20 bp, Homo sapiens
tcttccggcccctcccctcc

SEQ ID NO: 6477803 - DNA, 15 bp, Homo sapiens
tcttccgggagctgg

SEQ ID NO: 6477804 - DNA, 22 bp, Homo sapiens
tcttccgtcaagtacacaaagt

SEQ ID NO: 6477805 - DNA, 14 bp, Homo sapiens
tcttccgtctcccc

SEQ ID NO: 6477806 - DNA, 20 bp, Homo sapiens
tcttccgtctcccccgtgtt

SEQ ID NO: 6477807 - DNA, 18 bp, Homo sapiens
tcttccgttggaaagaac

SEQ ID NO: 6477808 - DNA, 22 bp, Homo sapiens
tcttcctaaatttcattgtgtt

SEQ ID NO: 6477809 - DNA, 20 bp, Homo sapiens
tcttcctaattgtgccccta

SEQ ID NO: 6477810 - DNA, 17 bp, Homo sapiens
tcttcctactggtctct

SEQ ID NO: 6477811 - DNA, 20 bp, Homo sapiens
tcttcctactggtctctcta

SEQ ID NO: 6477812 - DNA, 21 bp, Homo sapiens
tcttcctagatctgcaggctg

SEQ ID NO: 6477813 - DNA, 19 bp, Homo sapiens
tcttcctagttttctcctc

SEQ ID NO: 6477814 - DNA, 21 bp, Homo sapiens
tcttcctagttttctcctccc

SEQ ID NO: 6477815 - DNA, 13 bp, Homo sapiens
tcttcctatccca

SEQ ID NO: 6477816 - DNA, 14 bp, Homo sapiens
tcttcctatcccat

SEQ ID NO: 6477817 - DNA, 15 bp, Homo sapiens
tcttcctatcccatc

SEQ ID NO: 6477818 - DNA, 16 bp, Homo sapiens
tcttcctatcccatcc

SEQ ID NO: 6477819 - DNA, 17 bp, Homo sapiens
tcttcctatcccatccc

SEQ ID NO: 6477820 - DNA, 18 bp, Homo sapiens
tcttcctatcccatccca

SEQ ID NO: 6477821 - DNA, 15 bp, Homo sapiens
tcttcctatttcaga

SEQ ID NO: 6477822 - DNA, 16 bp, Homo sapiens
tcttcctatttctgga

SEQ ID NO: 6477823 - DNA, 14 bp, Homo sapiens
tcttcctcaaaggg

SEQ ID NO: 6477824 - DNA, 14 bp, Homo sapiens
tcttcctcaagtct

SEQ ID NO: 6477825 - DNA, 23 bp, Homo sapiens
tcttcctcacactgctgtcctct

SEQ ID NO: 6477826 - DNA, 21 bp, Homo sapiens
tcttcctcacagtcccactgt

SEQ ID NO: 6477827 - DNA, 22 bp, Homo sapiens
tcttcctcacagtcccactgtg

SEQ ID NO: 6477828 - DNA, 16 bp, Homo sapiens
tcttcctcagccagcc

SEQ ID NO: 6477829 - DNA, 17 bp, Homo sapiens
tcttcctcagccagcct

SEQ ID NO: 6477830 - DNA, 15 bp, Homo sapiens
tcttcctcatcctgc

SEQ ID NO: 6477831 - DNA, 17 bp, Homo sapiens
tcttcctccaaagcctg

SEQ ID NO: 6477832 - DNA, 21 bp, Homo sapiens
tcttcctccagtctgttctca

SEQ ID NO: 6477833 - DNA, 23 bp, Homo sapiens
tcttcctccagtctgttctcaca

SEQ ID NO: 6477834 - DNA, 22 bp, Homo sapiens
tcttcctcccaagtggtgccta

SEQ ID NO: 6477835 - DNA, 14 bp, Homo sapiens
tcttcctcccctca

SEQ ID NO: 6477836 - DNA, 17 bp, Homo sapiens
tcttcctccctgggggc

SEQ ID NO: 6477837 - DNA, 18 bp, Homo sapiens
tcttcctccgaggccagt

SEQ ID NO: 6477838 - DNA, 12 bp, Homo sapiens
tcttcctcctct

SEQ ID NO: 6477839 - DNA, 14 bp, Homo sapiens
tcttcctcctgaca

SEQ ID NO: 6477840 - DNA, 15 bp, Homo sapiens
tcttcctctctctca

SEQ ID NO: 6477841 - DNA, 11 bp, Homo sapiens
tcttcctctgc

SEQ ID NO: 6477842 - DNA, 12 bp, Homo sapiens
tcttcctctgca

SEQ ID NO: 6477843 - DNA, 22 bp, Homo sapiens
tcttcctctgcaagtgctcagg

SEQ ID NO: 6477844 - DNA, 17 bp, Homo sapiens
tcttcctctgcaggaca

SEQ ID NO: 6477845 - DNA, 15 bp, Homo sapiens
tcttcctctggagct

SEQ ID NO: 6477846 - DNA, 19 bp, Homo sapiens
tcttcctctgggcagcgct

SEQ ID NO: 6477847 - DNA, 15 bp, Homo sapiens
tcttcctctggttcc

SEQ ID NO: 6477848 - DNA, 15 bp, Homo sapiens
tcttcctctgttcta

SEQ ID NO: 6477849 - DNA, 14 bp, Homo sapiens
tcttcctcttacct

SEQ ID NO: 6477850 - DNA, 15 bp, Homo sapiens
tcttcctcttagcct

SEQ ID NO: 6477851 - DNA, 20 bp, Homo sapiens
tcttcctcttagcctctgga

SEQ ID NO: 6477852 - DNA, 16 bp, Homo sapiens
tcttcctgacacttta

SEQ ID NO: 6477853 - DNA, 23 bp, Homo sapiens
tcttcctgacgaaactggccccg

SEQ ID NO: 6477854 - DNA, 21 bp, Homo sapiens
tcttcctgcaaccactctgtg

SEQ ID NO: 6477855 - DNA, 18 bp, Homo sapiens
tcttcctgcaaggactac

SEQ ID NO: 6477856 - DNA, 22 bp, Homo sapiens
tcttcctgcagaggcccagcca

SEQ ID NO: 6477857 - DNA, 22 bp, Homo sapiens
tcttcctgcagtgttttgcata

SEQ ID NO: 6477858 - DNA, 16 bp, Homo sapiens
tcttcctgccaagcca

SEQ ID NO: 6477859 - DNA, 21 bp, Homo sapiens
tcttcctgccccccttggcat

SEQ ID NO: 6477860 - DNA, 22 bp, Homo sapiens
tcttcctgcccctctttctctt

SEQ ID NO: 6477861 - DNA, 17 bp, Homo sapiens
tcttcctgcctctctca

SEQ ID NO: 6477862 - DNA, 15 bp, Homo sapiens
tcttcctgcgtagaa

SEQ ID NO: 6477863 - DNA, 16 bp, Homo sapiens
tcttcctgctcctttt

SEQ ID NO: 6477864 - DNA, 15 bp, Homo sapiens
tcttcctgctggaca

SEQ ID NO: 6477865 - DNA, 14 bp, Homo sapiens
tcttcctggaataa

SEQ ID NO: 6477866 - DNA, 18 bp, Homo sapiens
tcttcctggacagtgaga

SEQ ID NO: 6477867 - DNA, 13 bp, Homo sapiens
tcttcctgtagtg

SEQ ID NO: 6477868 - DNA, 15 bp, Homo sapiens
tcttcctgtctcctt

SEQ ID NO: 6477869 - DNA, 13 bp, Homo sapiens
tcttcctgtgatc

SEQ ID NO: 6477870 - DNA, 13 bp, Homo sapiens
tcttcctgtggct

SEQ ID NO: 6477871 - DNA, 14 bp, Homo sapiens
tcttcctgtggctc

SEQ ID NO: 6477872 - DNA, 19 bp, Homo sapiens
tcttcctgttctgtgactg

SEQ ID NO: 6477873 - DNA, 18 bp, Homo sapiens
tcttcctgttttgtacat

SEQ ID NO: 6477874 - DNA, 15 bp, Homo sapiens
tcttccttaaactcc

SEQ ID NO: 6477875 - DNA, 12 bp, Homo sapiens
tcttccttaaat

SEQ ID NO: 6477876 - DNA, 18 bp, Homo sapiens
tcttccttacctggaaaa

SEQ ID NO: 6477877 - DNA, 21 bp, Homo sapiens
tcttccttcagggatttccaa

SEQ ID NO: 6477878 - DNA, 11 bp, Homo sapiens
tcttccttccc

SEQ ID NO: 6477879 - DNA, 23 bp, Homo sapiens
tcttccttcccaactcactgtgc

SEQ ID NO: 6477880 - DNA, 12 bp, Homo sapiens
tcttccttcccc

SEQ ID NO: 6477881 - DNA, 11 bp, Homo sapiens
tcttccttccg

SEQ ID NO: 6477882 - DNA, 12 bp, Homo sapiens
tcttccttccgc

SEQ ID NO: 6477883 - DNA, 11 bp, Homo sapiens
tcttccttcct

SEQ ID NO: 6477884 - DNA, 22 bp, Homo sapiens
tcttccttctaccccaaggcca

SEQ ID NO: 6477885 - DNA, 14 bp, Homo sapiens
tcttccttctcagc

SEQ ID NO: 6477886 - DNA, 12 bp, Homo sapiens
tcttccttctct

SEQ ID NO: 6477887 - DNA, 14 bp, Homo sapiens
tcttccttctctac

SEQ ID NO: 6477888 - DNA, 13 bp, Homo sapiens
tcttccttctgcc

SEQ ID NO: 6477889 - DNA, 13 bp, Homo sapiens
tcttccttctttc

SEQ ID NO: 6477890 - DNA, 15 bp, Homo sapiens
tcttccttctttctc

SEQ ID NO: 6477891 - DNA, 18 bp, Homo sapiens
tcttccttctttctcttc

SEQ ID NO: 6477892 - DNA, 9 bp, Homo sapiens
tcttccttg

SEQ ID NO: 6477893 - DNA, 23 bp, Homo sapiens
tcttccttgaagaactgcaggcc

SEQ ID NO: 6477894 - DNA, 15 bp, Homo sapiens
tcttccttgtgagga

SEQ ID NO: 6477895 - DNA, 14 bp, Homo sapiens
tcttccttgtgatt

SEQ ID NO: 6477896 - DNA, 16 bp, Homo sapiens
tcttcctttactttcc

SEQ ID NO: 6477897 - DNA, 19 bp, Homo sapiens
tcttcctttactttccctt

SEQ ID NO: 6477898 - DNA, 22 bp, Homo sapiens
tcttcctttactttcccttgct

SEQ ID NO: 6477899 - DNA, 22 bp, Homo sapiens
tcttcctttcctttcctttctt

SEQ ID NO: 6477900 - DNA, 17 bp, Homo sapiens
tcttcctttcttgtctt

SEQ ID NO: 6477901 - DNA, 13 bp, Homo sapiens
tcttcctttgaaa

SEQ ID NO: 6477902 - DNA, 18 bp, Homo sapiens
tcttccttttcactgctg

SEQ ID NO: 6477903 - DNA, 15 bp, Homo sapiens
tcttcgactgttgtt

SEQ ID NO: 6477904 - DNA, 17 bp, Homo sapiens
tcttcgactgttgttat

SEQ ID NO: 6477905 - DNA, 22 bp, Homo sapiens
tcttcgactgttgttatctgtt

SEQ ID NO: 6477906 - DNA, 19 bp, Homo sapiens
tcttcgatgtgcccagggg

SEQ ID NO: 6477907 - DNA, 20 bp, Homo sapiens
tcttcgcctttcccaccctc

SEQ ID NO: 6477908 - DNA, 15 bp, Homo sapiens
tcttcgcgcccgccc

SEQ ID NO: 6477909 - DNA, 19 bp, Homo sapiens
tcttcgctgctagagaagg

SEQ ID NO: 6477910 - DNA, 13 bp, Homo sapiens
tcttcgctgctct

SEQ ID NO: 6477911 - DNA, 22 bp, Homo sapiens
tcttcgctgctctagctggcag

SEQ ID NO: 6477912 - DNA, 18 bp, Homo sapiens
tcttcgctggactattgt

SEQ ID NO: 6477913 - DNA, 15 bp, Homo sapiens
tcttcgctggctcct

SEQ ID NO: 6477914 - DNA, 13 bp, Homo sapiens
tcttcgggaagag

SEQ ID NO: 6477915 - DNA, 18 bp, Homo sapiens
tcttcgggaagagaggag

SEQ ID NO: 6477916 - DNA, 14 bp, Homo sapiens
tcttcgggaccagg

SEQ ID NO: 6477917 - DNA, 21 bp, Homo sapiens
tcttcgggtgtgatcatatat

SEQ ID NO: 6477918 - DNA, 20 bp, Homo sapiens
tcttcggtggccttgagtct

SEQ ID NO: 6477919 - DNA, 20 bp, Homo sapiens
tcttcggtgtttaaagtcaa

SEQ ID NO: 6477920 - DNA, 13 bp, Homo sapiens
tcttcgtatatac

SEQ ID NO: 6477921 - DNA, 16 bp, Homo sapiens
tcttcgtccttttggt

SEQ ID NO: 6477922 - DNA, 16 bp, Homo sapiens
tcttcgtggattgttt

SEQ ID NO: 6477923 - DNA, 19 bp, Homo sapiens
tcttcgttctttttaagtt

SEQ ID NO: 6477924 - DNA, 20 bp, Homo sapiens
tcttctaaaatagcaataac

SEQ ID NO: 6477925 - DNA, 22 bp, Homo sapiens
tcttctaaaattgaagagattt

SEQ ID NO: 6477926 - DNA, 13 bp, Homo sapiens
tcttctaaatgag

SEQ ID NO: 6477927 - DNA, 22 bp, Homo sapiens
tgctggtgtactctaggacttc

SEQ ID NO: 6477928 - DNA, 16 bp, Homo sapiens
tgctggtgtagtcttt

SEQ ID NO: 6477929 - DNA, 17 bp, Homo sapiens
tgctggtgtcattgctg

SEQ ID NO: 6477930 - DNA, 14 bp, Homo sapiens
tgctggtgtcctga

SEQ ID NO: 6477931 - DNA, 15 bp, Homo sapiens
tgctggtgtcctgac

SEQ ID NO: 6477932 - DNA, 22 bp, Homo sapiens
tgctggtgtcctgaccaccctc

SEQ ID NO: 6477933 - DNA, 14 bp, Homo sapiens
tgctggtgtggtct

SEQ ID NO: 6477934 - DNA, 16 bp, Homo sapiens
tgctggttcctgactg

SEQ ID NO: 6477935 - DNA, 17 bp, Homo sapiens
tgctggttcctgactgg

SEQ ID NO: 6477936 - DNA, 19 bp, Homo sapiens
tgctggttcctgactggca

SEQ ID NO: 6477937 - DNA, 14 bp, Homo sapiens
tgctggttgctgtg

SEQ ID NO: 6477938 - DNA, 23 bp, Homo sapiens
tgctggttgtcatttttgcagta

SEQ ID NO: 6477939 - DNA, 13 bp, Homo sapiens
tgctggtttgtag

SEQ ID NO: 6477940 - DNA, 22 bp, Homo sapiens
tgctggtttgtagttgaatatt

SEQ ID NO: 6477941 - DNA, 15 bp, Homo sapiens
tgctggttttaacaa

SEQ ID NO: 6477942 - DNA, 16 bp, Homo sapiens
tgctggttttaacaac

SEQ ID NO: 6477943 - DNA, 14 bp, Homo sapiens
tgctggttttccta

SEQ ID NO: 6477944 - DNA, 12 bp, Homo sapiens
tgctggtttttc

SEQ ID NO: 6477945 - DNA, 15 bp, Homo sapiens
tgctggtttttcagt

SEQ ID NO: 6477946 - DNA, 17 bp, Homo sapiens
tgctgtaaaattataaa

SEQ ID NO: 6477947 - DNA, 20 bp, Homo sapiens
tgctgtaaaattataaactt

SEQ ID NO: 6477948 - DNA, 22 bp, Homo sapiens
tgctgtaaaattataaactttt

SEQ ID NO: 6477949 - DNA, 15 bp, Homo sapiens
tgctgtaaaatttgt

SEQ ID NO: 6477950 - DNA, 22 bp, Homo sapiens
tgctgtaaaatttgtgtaaatt

SEQ ID NO: 6477951 - DNA, 20 bp, Homo sapiens
tgctgtaaataaaaatagct

SEQ ID NO: 6477952 - DNA, 20 bp, Homo sapiens
tgctgtaaataagcccagtg

SEQ ID NO: 6477953 - DNA, 17 bp, Homo sapiens
tgctgtaaatatttcat

SEQ ID NO: 6477954 - DNA, 18 bp, Homo sapiens
tgctgtaaatttggcttc

SEQ ID NO: 6477955 - DNA, 20 bp, Homo sapiens
tgctgtaaatttggcttctg

SEQ ID NO: 6477956 - DNA, 21 bp, Homo sapiens
tgctgtaactcagacattcca

SEQ ID NO: 6477957 - DNA, 22 bp, Homo sapiens
tgctgtaactcagacattccaa

SEQ ID NO: 6477958 - DNA, 17 bp, Homo sapiens
tgctgtaacttaaaata

SEQ ID NO: 6477959 - DNA, 16 bp, Homo sapiens
tgctgtaagacggcct

SEQ ID NO: 6477960 - DNA, 15 bp, Homo sapiens
tgctgtaagcacctg

SEQ ID NO: 6477961 - DNA, 19 bp, Homo sapiens
tgctgtaataatattttag

SEQ ID NO: 6477962 - DNA, 20 bp, Homo sapiens
tgctgtaataatattttaga

SEQ ID NO: 6477963 - DNA, 14 bp, Homo sapiens
tgctgtaatattgt

SEQ ID NO: 6477964 - DNA, 17 bp, Homo sapiens
tgctgtaatcggctccc

SEQ ID NO: 6477965 - DNA, 14 bp, Homo sapiens
tgctgtacaaaagc

SEQ ID NO: 6477966 - DNA, 17 bp, Homo sapiens
tgctgtacatacttttt

SEQ ID NO: 6477967 - DNA, 22 bp, Homo sapiens
tgctgtacatactttttgggtt

SEQ ID NO: 6477968 - DNA, 16 bp, Homo sapiens
tgctgtacatctattt

SEQ ID NO: 6477969 - DNA, 16 bp, Homo sapiens
tgctgtacccagatgc

SEQ ID NO: 6477970 - DNA, 20 bp, Homo sapiens
tgctgtacccttccacctcc

SEQ ID NO: 6477971 - DNA, 21 bp, Homo sapiens
tgctgtacccttccacctcct

SEQ ID NO: 6477972 - DNA, 14 bp, Homo sapiens
tgctgtacctggct

SEQ ID NO: 6477973 - DNA, 18 bp, Homo sapiens
tgctgtacctttctgaca

SEQ ID NO: 6477974 - DNA, 16 bp, Homo sapiens
tgctgtacgtactgca

SEQ ID NO: 6477975 - DNA, 23 bp, Homo sapiens
tgctgtactcttgctgatggctg

SEQ ID NO: 6477976 - DNA, 16 bp, Homo sapiens
tgctgtactgagcact

SEQ ID NO: 6477977 - DNA, 20 bp, Homo sapiens
tgctgtagaatccggtttta

SEQ ID NO: 6477978 - DNA, 15 bp, Homo sapiens
tgctgtagagacttc

SEQ ID NO: 6477979 - DNA, 15 bp, Homo sapiens
tgctgtagctgaaag

SEQ ID NO: 6477980 - DNA, 16 bp, Homo sapiens
tgctgtagctgaaaga

SEQ ID NO: 6477981 - DNA, 16 bp, Homo sapiens
tgctgtataagttatt

SEQ ID NO: 6477982 - DNA, 15 bp, Homo sapiens
tgctgtatatgcaat

SEQ ID NO: 6477983 - DNA, 20 bp, Homo sapiens
tgctgtatgaatattttata

SEQ ID NO: 6477984 - DNA, 21 bp, Homo sapiens
tgctgtatgacccctggccac

SEQ ID NO: 6477985 - DNA, 19 bp, Homo sapiens
tgctgtatggcccaggcag

SEQ ID NO: 6477986 - DNA, 17 bp, Homo sapiens
tgctgtatgtcattaaa

SEQ ID NO: 6477987 - DNA, 11 bp, Homo sapiens
tgctgtatttg

SEQ ID NO: 6477988 - DNA, 23 bp, Homo sapiens
tgctgtattttaacactttgtat

SEQ ID NO: 6477989 - DNA, 18 bp, Homo sapiens
tgctgtattttcttttta

SEQ ID NO: 6477990 - DNA, 19 bp, Homo sapiens
tgctgtattttgatataat

SEQ ID NO: 6477991 - DNA, 16 bp, Homo sapiens
tgctgtcaacttccca

SEQ ID NO: 6477992 - DNA, 18 bp, Homo sapiens
tgctgtcaagtcccccag

SEQ ID NO: 6477993 - DNA, 20 bp, Homo sapiens
tgctgtcaagttcctttggg

SEQ ID NO: 6477994 - DNA, 23 bp, Homo sapiens
tgctgtcacctcgctgggctcta

SEQ ID NO: 6477995 - DNA, 17 bp, Homo sapiens
tgctgtcactttctctc

SEQ ID NO: 6477996 - DNA, 23 bp, Homo sapiens
tgctgtcagaatattctttttat

SEQ ID NO: 6477997 - DNA, 22 bp, Homo sapiens
tgctgtcagaccttcttccaca

SEQ ID NO: 6477998 - DNA, 19 bp, Homo sapiens
tgctgtcatgcccagcttg

SEQ ID NO: 6477999 - DNA, 16 bp, Homo sapiens
tgctgtcatggtcctt

SEQ ID NO: 6478000 - DNA, 23 bp, Homo sapiens
tgctgtcatggtcctttctggaa

SEQ ID NO: 6478001 - DNA, 15 bp, Homo sapiens
tgctgtcatgtggaa

SEQ ID NO: 6478002 - DNA, 21 bp, Homo sapiens
tgctgtcattgcttcttctga

SEQ ID NO: 6478003 - DNA, 20 bp, Homo sapiens
tgctgtccacatgacctcca

SEQ ID NO: 6478004 - DNA, 21 bp, Homo sapiens
tgctgtccacatgacctccat

SEQ ID NO: 6478005 - DNA, 21 bp, Homo sapiens
tgctgtccaggcagctccctc

SEQ ID NO: 6478006 - DNA, 22 bp, Homo sapiens
tgctgtccaggcagctccctcc

SEQ ID NO: 6478007 - DNA, 23 bp, Homo sapiens
tgctgtccaggcagctccctcct

SEQ ID NO: 6478008 - DNA, 14 bp, Homo sapiens
tgctgtccagtgcc

SEQ ID NO: 6478009 - DNA, 16 bp, Homo sapiens
tgctgtccagtgccta

SEQ ID NO: 6478010 - DNA, 17 bp, Homo sapiens
tgctgtccccactgccc

SEQ ID NO: 6478011 - DNA, 21 bp, Homo sapiens
tgctgtcccctcttgccccaa

SEQ ID NO: 6478012 - DNA, 20 bp, Homo sapiens
tgctgtccccttccaggggt

SEQ ID NO: 6478013 - DNA, 20 bp, Homo sapiens
tgctgtccccttggcaggtc

SEQ ID NO: 6478014 - DNA, 12 bp, Homo sapiens
tgctgtccctcc

SEQ ID NO: 6478015 - DNA, 17 bp, Homo sapiens
tgctgtccctccccctt

SEQ ID NO: 6478016 - DNA, 20 bp, Homo sapiens
tgctgtccctgtcaggacac

SEQ ID NO: 6478017 - DNA, 14 bp, Homo sapiens
tgctgtccctgtgg

SEQ ID NO: 6478018 - DNA, 16 bp, Homo sapiens
tgctgtccctgtgggc

SEQ ID NO: 6478019 - DNA, 18 bp, Homo sapiens
tgctgtccctgtgggctc

SEQ ID NO: 6478020 - DNA, 19 bp, Homo sapiens
tgctgtccctgtgggctca

SEQ ID NO: 6478021 - DNA, 17 bp, Homo sapiens
tgctgtcccttttcctt

SEQ ID NO: 6478022 - DNA, 18 bp, Homo sapiens
tgctgtccgtgcttgctg

SEQ ID NO: 6478023 - DNA, 19 bp, Homo sapiens
tgctgtccgtgcttgctgg

SEQ ID NO: 6478024 - DNA, 23 bp, Homo sapiens
tgctgtcctaggccacaccatct

SEQ ID NO: 6478025 - DNA, 21 bp, Homo sapiens
tgctgtcctcaggtggccatg

SEQ ID NO: 6478026 - DNA, 15 bp, Homo sapiens
tgctgtcctctcccc

SEQ ID NO: 6478027 - DNA, 17 bp, Homo sapiens
tgctgtcctctccccct

SEQ ID NO: 6478028 - DNA, 22 bp, Homo sapiens
tgctgtcctctcccccttcagc

SEQ ID NO: 6478029 - DNA, 14 bp, Homo sapiens
tgctgtcctgcagt

SEQ ID NO: 6478030 - DNA, 14 bp, Homo sapiens
tgctgtcctggtgg

SEQ ID NO: 6478031 - DNA, 21 bp, Homo sapiens
tgctgtcctgtttctgtcaag

SEQ ID NO: 6478032 - DNA, 14 bp, Homo sapiens
tgctgtccttgaat

SEQ ID NO: 6478033 - DNA, 15 bp, Homo sapiens
tgctgtccttttagg

SEQ ID NO: 6478034 - DNA, 13 bp, Homo sapiens
tgctgtcgggacc

SEQ ID NO: 6478035 - DNA, 21 bp, Homo sapiens
tgctgtcgttgttgtggaagc

SEQ ID NO: 6478036 - DNA, 23 bp, Homo sapiens
tgctgtctagccttagtcaataa

SEQ ID NO: 6478037 - DNA, 20 bp, Homo sapiens
tgctgtctccataatgccac

SEQ ID NO: 6478038 - DNA, 12 bp, Homo sapiens
tgctgtctcctt

SEQ ID NO: 6478039 - DNA, 14 bp, Homo sapiens
tgctgtctctgctc

SEQ ID NO: 6478040 - DNA, 14 bp, Homo sapiens
tgctgtctgcagcc

SEQ ID NO: 6478041 - DNA, 16 bp, Homo sapiens
tgctgtctggccctgg

SEQ ID NO: 6478042 - DNA, 14 bp, Homo sapiens
tgctgtctggcttt

SEQ ID NO: 6478043 - DNA, 18 bp, Homo sapiens
tgctgtctgggtggctca

SEQ ID NO: 6478044 - DNA, 13 bp, Homo sapiens
tgctgtcttcagt

SEQ ID NO: 6478045 - DNA, 15 bp, Homo sapiens
tgctgtcttcagtct

SEQ ID NO: 6478046 - DNA, 20 bp, Homo sapiens
tgctgtcttctggtctgtgt

SEQ ID NO: 6478047 - DNA, 14 bp, Homo sapiens
tgctgtcttgcccc

SEQ ID NO: 6478048 - DNA, 12 bp, Homo sapiens
tgctgtctttgt

SEQ ID NO: 6478049 - DNA, 23 bp, Homo sapiens
tgctgtctttgtggactgtgggt

SEQ ID NO: 6478050 - DNA, 22 bp, Homo sapiens
tgctgtcttttctttgccatct

SEQ ID NO: 6478051 - DNA, 23 bp, Homo sapiens
tgctgtcttttctttgccatctc

SEQ ID NO: 6478052 - DNA, 13 bp, Homo sapiens
tgctgtgaaaaaa

SEQ ID NO: 6478053 - DNA, 15 bp, Homo sapiens
tgctgtgaaatgact

SEQ ID NO: 6478054 - DNA, 17 bp, Homo sapiens
tgctgtgaaattcccaa

SEQ ID NO: 6478055 - DNA, 20 bp, Homo sapiens
tgctgtgaacatgcctcctc

SEQ ID NO: 6478056 - DNA, 22 bp, Homo sapiens
tgctgtgaaccctggggcctga

SEQ ID NO: 6478057 - DNA, 19 bp, Homo sapiens
tgctgtgaataaaaagaaa

SEQ ID NO: 6478058 - DNA, 19 bp, Homo sapiens
tgctgtgaattagctcact

SEQ ID NO: 6478059 - DNA, 22 bp, Homo sapiens
tgctgtgacaccccccttctga

SEQ ID NO: 6478060 - DNA, 17 bp, Homo sapiens
tgctgtgacaggcagtg

SEQ ID NO: 6478061 - DNA, 19 bp, Homo sapiens
tgctgtgaccatttataat

SEQ ID NO: 6478062 - DNA, 19 bp, Homo sapiens
tgctgtgacccaagaactc

SEQ ID NO: 6478063 - DNA, 23 bp, Homo sapiens
tgctgtgaggaatgctctgtgcc

SEQ ID NO: 6478064 - DNA, 14 bp, Homo sapiens
tgctgtgaggctgt

SEQ ID NO: 6478065 - DNA, 16 bp, Homo sapiens
tgctgtgaggctgtcc

SEQ ID NO: 6478066 - DNA, 19 bp, Homo sapiens
tgctgtgaggcttgcccag

SEQ ID NO: 6478067 - DNA, 20 bp, Homo sapiens
tgctgtgaggcttgcccagg

SEQ ID NO: 6478068 - DNA, 18 bp, Homo sapiens
tgctgtgatacactgaaa

SEQ ID NO: 6478069 - DNA, 17 bp, Homo sapiens
tgctgtgcaaacagtgt

SEQ ID NO: 6478070 - DNA, 17 bp, Homo sapiens
tgctgtgcacccgtgcc

SEQ ID NO: 6478071 - DNA, 12 bp, Homo sapiens
tgctgtgcattt

SEQ ID NO: 6478072 - DNA, 17 bp, Homo sapiens
tgctgtgcccagcctcc

SEQ ID NO: 6478073 - DNA, 14 bp, Homo sapiens
tgctgtgccccacc

SEQ ID NO: 6478074 - DNA, 15 bp, Homo sapiens
tgctgtgccccacca

SEQ ID NO: 6478075 - DNA, 11 bp, Homo sapiens
tgctgtgcctg

SEQ ID NO: 6478076 - DNA, 15 bp, Homo sapiens
tgctgtgcctgctag

SEQ ID NO: 6478077 - DNA, 17 bp, Homo sapiens
tgctgtgcgcccagggc

SEQ ID NO: 6478078 - DNA, 18 bp, Homo sapiens
tgctgtgcgcccagggct

SEQ ID NO: 6478079 - DNA, 17 bp, Homo sapiens
tgctgtgctacgtgtga

SEQ ID NO: 6478080 - DNA, 15 bp, Homo sapiens
tgctgtgctgggtgc

SEQ ID NO: 6478081 - DNA, 20 bp, Homo sapiens
tgctgtgctttatttgtgaa

SEQ ID NO: 6478082 - DNA, 14 bp, Homo sapiens
tgctgtgctttgga

SEQ ID NO: 6478083 - DNA, 19 bp, Homo sapiens
tgctgtgcttttgatctct

SEQ ID NO: 6478084 - DNA, 21 bp, Homo sapiens
tgctgtgcttttgatctctgc

SEQ ID NO: 6478085 - DNA, 22 bp, Homo sapiens
tgctgtggaactacattactgt

SEQ ID NO: 6478086 - DNA, 11 bp, Homo sapiens
tgctgtggaag

SEQ ID NO: 6478087 - DNA, 23 bp, Homo sapiens
tgctgtggagctccactgccatg

SEQ ID NO: 6478088 - DNA, 16 bp, Homo sapiens
tgctgtggatgtccct

SEQ ID NO: 6478089 - DNA, 15 bp, Homo sapiens
tgctgtggccaggag

SEQ ID NO: 6478090 - DNA, 23 bp, Homo sapiens
tgctgtggccagggtgagagctg

SEQ ID NO: 6478091 - DNA, 14 bp, Homo sapiens
tgctgtggcccagt

SEQ ID NO: 6478092 - DNA, 15 bp, Homo sapiens
tgctgtggccccctg

SEQ ID NO: 6478093 - DNA, 19 bp, Homo sapiens
tgctgtggccccctgtccc

SEQ ID NO: 6478094 - DNA, 23 bp, Homo sapiens
tgctgtggccccctgtccccaag

SEQ ID NO: 6478095 - DNA, 22 bp, Homo sapiens
tgctgtggcctcacttccctgg

SEQ ID NO: 6478096 - DNA, 12 bp, Homo sapiens
tgctgtggcctg

SEQ ID NO: 6478097 - DNA, 15 bp, Homo sapiens
tgctgtggcctgggc

SEQ ID NO: 6478098 - DNA, 14 bp, Homo sapiens
tgctgtggctatgg

SEQ ID NO: 6478099 - DNA, 12 bp, Homo sapiens
tgctgtggctcc

SEQ ID NO: 6478100 - DNA, 17 bp, Homo sapiens
tgctgtgggaacgagag

SEQ ID NO: 6478101 - DNA, 19 bp, Homo sapiens
tgctgtgggcagcaccctc

SEQ ID NO: 6478102 - DNA, 21 bp, Homo sapiens
tgctgtgggcagcaccctccc

SEQ ID NO: 6478103 - DNA, 23 bp, Homo sapiens
tgctgtggggcgaattcatcccc

SEQ ID NO: 6478104 - DNA, 16 bp, Homo sapiens
tgctgtggggctggta

SEQ ID NO: 6478105 - DNA, 20 bp, Homo sapiens
tgctgtgggtattcaccacc

SEQ ID NO: 6478106 - DNA, 21 bp, Homo sapiens
tgctgtgggtgatatggacag

SEQ ID NO: 6478107 - DNA, 23 bp, Homo sapiens
tgctgtggtctataaaataaact

SEQ ID NO: 6478108 - DNA, 14 bp, Homo sapiens
tgctgtggtgggga

SEQ ID NO: 6478109 - DNA, 20 bp, Homo sapiens
tgctgtggtggggagaggca

SEQ ID NO: 6478110 - DNA, 15 bp, Homo sapiens
tgctgtggtgtgtcc

SEQ ID NO: 6478111 - DNA, 22 bp, Homo sapiens
tgctgtggttcactgcactgtt

SEQ ID NO: 6478112 - DNA, 16 bp, Homo sapiens
tgctgtggttcctggg

SEQ ID NO: 6478113 - DNA, 14 bp, Homo sapiens
tgctgtgtaaagtt

SEQ ID NO: 6478114 - DNA, 15 bp, Homo sapiens
tgctgtgtaaagtta

SEQ ID NO: 6478115 - DNA, 17 bp, Homo sapiens
tgctgtgtaaagttagt

SEQ ID NO: 6478116 - DNA, 20 bp, Homo sapiens
tgctgtgtagttccctctgc

SEQ ID NO: 6478117 - DNA, 13 bp, Homo sapiens
tgctgtgtatatg

SEQ ID NO: 6478118 - DNA, 19 bp, Homo sapiens
tgctgtgtatatggtatat

SEQ ID NO: 6478119 - DNA, 23 bp, Homo sapiens
tgctgtgtatatggtatatatac

SEQ ID NO: 6478120 - DNA, 15 bp, Homo sapiens
tgctgtgtatctgat

SEQ ID NO: 6478121 - DNA, 16 bp, Homo sapiens
tgctgtgtatctgata

SEQ ID NO: 6478122 - DNA, 19 bp, Homo sapiens
tgctgtgtccttcctccac

SEQ ID NO: 6478123 - DNA, 15 bp, Homo sapiens
tgctgtgtgaaatct

SEQ ID NO: 6478124 - DNA, 19 bp, Homo sapiens
tgctgtgtgaaatctttca

SEQ ID NO: 6478125 - DNA, 20 bp, Homo sapiens
tgctgtgtgaaatctttcaa

SEQ ID NO: 6478126 - DNA, 16 bp, Homo sapiens
tgctgtgtgaatccag

SEQ ID NO: 6478127 - DNA, 18 bp, Homo sapiens
tgctgtgtgaatccagga

SEQ ID NO: 6478128 - DNA, 19 bp, Homo sapiens
tgctgtgtgagtgagcaca

SEQ ID NO: 6478129 - DNA, 13 bp, Homo sapiens
tgctgtgtgcaga

SEQ ID NO: 6478130 - DNA, 15 bp, Homo sapiens
tgctgtgtgcagagt

SEQ ID NO: 6478131 - DNA, 13 bp, Homo sapiens
tgctgtgtgccca

SEQ ID NO: 6478132 - DNA, 15 bp, Homo sapiens
tgctgtgtgccccac

SEQ ID NO: 6478133 - DNA, 14 bp, Homo sapiens
tgctgtgtggtttg

SEQ ID NO: 6478134 - DNA, 16 bp, Homo sapiens
tgctgtgtgtgagcag

SEQ ID NO: 6478135 - DNA, 20 bp, Homo sapiens
tgctgtgtgtgagcagtgga

SEQ ID NO: 6478136 - DNA, 17 bp, Homo sapiens
tgctgtgttaagaggac

SEQ ID NO: 6478137 - DNA, 23 bp, Homo sapiens
tgctgttaaaattaatatatcat

SEQ ID NO: 6478138 - DNA, 14 bp, Homo sapiens
tgctgttaatctga

SEQ ID NO: 6478139 - DNA, 17 bp, Homo sapiens
tgctgttacagttttct

SEQ ID NO: 6478140 - DNA, 15 bp, Homo sapiens
tgctgttactgcttc

SEQ ID NO: 6478141 - DNA, 14 bp, Homo sapiens
tgctgttactgtta

SEQ ID NO: 6478142 - DNA, 16 bp, Homo sapiens
tgctgttagaatatgt

SEQ ID NO: 6478143 - DNA, 22 bp, Homo sapiens
tgctgttagtaaatttctgtga

SEQ ID NO: 6478144 - DNA, 18 bp, Homo sapiens
tgctgttagttataaaac

SEQ ID NO: 6478145 - DNA, 15 bp, Homo sapiens
tgctgttatatttca

SEQ ID NO: 6478146 - DNA, 19 bp, Homo sapiens
tgctgttatgtccagaaat

SEQ ID NO: 6478147 - DNA, 20 bp, Homo sapiens
tgctgttatgtctgtttaag

SEQ ID NO: 6478148 - DNA, 14 bp, Homo sapiens
tgctgttcacagct

SEQ ID NO: 6478149 - DNA, 16 bp, Homo sapiens
tgctgttcacagcttt

SEQ ID NO: 6478150 - DNA, 22 bp, Homo sapiens
tgctgttcacagcttttcttga

SEQ ID NO: 6478151 - DNA, 17 bp, Homo sapiens
tgctgttcatgaaagat

SEQ ID NO: 6478152 - DNA, 13 bp, Homo sapiens
tgctgttcattga

SEQ ID NO: 6478153 - DNA, 23 bp, Homo sapiens
tgctgttccaccaaatacaattc

SEQ ID NO: 6478154 - DNA, 16 bp, Homo sapiens
tgctgttcccctcttc

SEQ ID NO: 6478155 - DNA, 17 bp, Homo sapiens
tgctgttcctgctccat

SEQ ID NO: 6478156 - DNA, 18 bp, Homo sapiens
tgctgttcctgctccatg

SEQ ID NO: 6478157 - DNA, 17 bp, Homo sapiens
tgctgttcgcagcctca

SEQ ID NO: 6478158 - DNA, 13 bp, Homo sapiens
tgctgttcgttca

SEQ ID NO: 6478159 - DNA, 21 bp, Homo sapiens
tgctgttctcaatcattgtca

SEQ ID NO: 6478160 - DNA, 13 bp, Homo sapiens
tgctgttctcagg

SEQ ID NO: 6478161 - DNA, 24 bp, Homo sapiens
tgctgttctcaggacagcatccct

SEQ ID NO: 6478162 - DNA, 14 bp, Homo sapiens
tgctgttctctttg

SEQ ID NO: 6478163 - DNA, 22 bp, Homo sapiens
tgctgttctctttgctgacact

SEQ ID NO: 6478164 - DNA, 13 bp, Homo sapiens
tgctgttctggag

SEQ ID NO: 6478165 - DNA, 13 bp, Homo sapiens
tgctgttctgtgt

SEQ ID NO: 6478166 - DNA, 14 bp, Homo sapiens
tgctgttctgtgta

SEQ ID NO: 6478167 - DNA, 17 bp, Homo sapiens
tgctgttcttcagtcct

SEQ ID NO: 6478168 - DNA, 13 bp, Homo sapiens
tgctgttgaaagc

SEQ ID NO: 6478169 - DNA, 22 bp, Homo sapiens
tgctgttgaaagcaaaaatgct

SEQ ID NO: 6478170 - DNA, 13 bp, Homo sapiens
tgctgttgaagat

SEQ ID NO: 6478171 - DNA, 21 bp, Homo sapiens
tgctgttgacatatttaatgt

SEQ ID NO: 6478172 - DNA, 18 bp, Homo sapiens
tgctgttgaggtggctgt

SEQ ID NO: 6478173 - DNA, 22 bp, Homo sapiens
tgctgttgatcggtctcctagg

SEQ ID NO: 6478174 - DNA, 16 bp, Homo sapiens
tgctgttgattctttc

SEQ ID NO: 6478175 - DNA, 17 bp, Homo sapiens
tgctgttgattctttca

SEQ ID NO: 6478176 - DNA, 18 bp, Homo sapiens
tgctgttgattgctaaat

SEQ ID NO: 6478177 - DNA, 19 bp, Homo sapiens
tgctgttgattgctaaatg

SEQ ID NO: 6478178 - DNA, 22 bp, Homo sapiens
tgctgttgattgctaaatgtaa

SEQ ID NO: 6478179 - DNA, 21 bp, Homo sapiens
tgctgttgatttctttccaga

SEQ ID NO: 6478180 - DNA, 15 bp, Homo sapiens
tgctgttgccatagc

SEQ ID NO: 6478181 - DNA, 14 bp, Homo sapiens
tgctgttgctgttg

SEQ ID NO: 6478182 - DNA, 15 bp, Homo sapiens
tgctgttgcttgaat

SEQ ID NO: 6478183 - DNA, 20 bp, Homo sapiens
tgctgttgggtttttgctgt

SEQ ID NO: 6478184 - DNA, 22 bp, Homo sapiens
tgctgttgggtttttgctgttt

SEQ ID NO: 6478185 - DNA, 21 bp, Homo sapiens
tgctgttggtcctctctctgt

SEQ ID NO: 6478186 - DNA, 18 bp, Homo sapiens
tgctgttgtgcagtgtgc

SEQ ID NO: 6478187 - DNA, 15 bp, Homo sapiens
tgctgttgttatgat

SEQ ID NO: 6478188 - DNA, 17 bp, Homo sapiens
tgctgttgttatgatgt

SEQ ID NO: 6478189 - DNA, 20 bp, Homo sapiens
tgctgttgttatgatgtgct

SEQ ID NO: 6478190 - DNA, 17 bp, Homo sapiens
tgctgttgttcagaagt

SEQ ID NO: 6478191 - DNA, 14 bp, Homo sapiens
tgctgttgttctcg

SEQ ID NO: 6478192 - DNA, 21 bp, Homo sapiens
tgctgttgttgttaattttgt

SEQ ID NO: 6478193 - DNA, 18 bp, Homo sapiens
tgctgttgtttaaaataa

SEQ ID NO: 6478194 - DNA, 23 bp, Homo sapiens
tgctgttgtttctataaatgact

SEQ ID NO: 6478195 - DNA, 14 bp, Homo sapiens
tgctgtttacaaca

SEQ ID NO: 6478196 - DNA, 21 bp, Homo sapiens
tgctgtttactcccttctgta

SEQ ID NO: 6478197 - DNA, 22 bp, Homo sapiens
tgctgtttactcccttctgtag

SEQ ID NO: 6478198 - DNA, 17 bp, Homo sapiens
tgctgtttagcttcctc

SEQ ID NO: 6478199 - DNA, 19 bp, Homo sapiens
tgctgtttagcttcctcca

SEQ ID NO: 6478200 - DNA, 16 bp, Homo sapiens
tgctgtttatatatat

SEQ ID NO: 6478201 - DNA, 16 bp, Homo sapiens
tgctgtttatgacaca

SEQ ID NO: 6478202 - DNA, 17 bp, Homo sapiens
tgctgtttattaatctt

SEQ ID NO: 6478203 - DNA, 17 bp, Homo sapiens
tgctgtttcaaaaataa

SEQ ID NO: 6478204 - DNA, 12 bp, Homo sapiens
tgctgtttcctt

SEQ ID NO: 6478205 - DNA, 12 bp, Homo sapiens
tgctgtttctaa

SEQ ID NO: 6478206 - DNA, 13 bp, Homo sapiens
tgctgtttctaag

SEQ ID NO: 6478207 - DNA, 23 bp, Homo sapiens
tgctgtttctaagaaaatgtagt

SEQ ID NO: 6478208 - DNA, 15 bp, Homo sapiens
tgctgtttgaaaata

SEQ ID NO: 6478209 - DNA, 17 bp, Homo sapiens
tgctgtttgagatgtga

SEQ ID NO: 6478210 - DNA, 21 bp, Homo sapiens
tgctgtttgagatgtgatgct

SEQ ID NO: 6478211 - DNA, 16 bp, Homo sapiens
tgctgtttggtttgga

SEQ ID NO: 6478212 - DNA, 16 bp, Homo sapiens
tgctgtttgtagtgaa

SEQ ID NO: 6478213 - DNA, 13 bp, Homo sapiens
tgctgttttaaat

SEQ ID NO: 6478214 - DNA, 17 bp, Homo sapiens
tgctgttttatgtcata

SEQ ID NO: 6478215 - DNA, 20 bp, Homo sapiens
tgctgttttcatctctgcca

SEQ ID NO: 6478216 - DNA, 19 bp, Homo sapiens
tgctgttttcctcccttct

SEQ ID NO: 6478217 - DNA, 19 bp, Homo sapiens
tgctgttttctgtaaattc

SEQ ID NO: 6478218 - DNA, 20 bp, Homo sapiens
tgctgttttctgtaaattca

SEQ ID NO: 6478219 - DNA, 18 bp, Homo sapiens
tgctgttttgatttgtac

SEQ ID NO: 6478220 - DNA, 18 bp, Homo sapiens
tgctgttttgttatataa

SEQ ID NO: 6478221 - DNA, 19 bp, Homo sapiens
tgctgttttgttatataat

SEQ ID NO: 6478222 - DNA, 15 bp, Homo sapiens
tgctgttttgttctg

SEQ ID NO: 6478223 - DNA, 16 bp, Homo sapiens
tgctgttttgttctgt

SEQ ID NO: 6478224 - DNA, 18 bp, Homo sapiens
tgctgttttgttctgtgg

SEQ ID NO: 6478225 - DNA, 17 bp, Homo sapiens
tgcttaaaaaagctaat

SEQ ID NO: 6478226 - DNA, 18 bp, Homo sapiens
tgcttaaaaaataataca

SEQ ID NO: 6478227 - DNA, 23 bp, Homo sapiens
tgcttaaaaatgccaaaaacaaa

SEQ ID NO: 6478228 - DNA, 14 bp, Homo sapiens
tgcttaaaaatgta

SEQ ID NO: 6478229 - DNA, 16 bp, Homo sapiens
tgcttaaaagcatttt

SEQ ID NO: 6478230 - DNA, 22 bp, Homo sapiens
tgcttaaaagcatttttattat

SEQ ID NO: 6478231 - DNA, 17 bp, Homo sapiens
tgcttaaaataagcagg

SEQ ID NO: 6478232 - DNA, 15 bp, Homo sapiens
tgcttaaaatatgtg

SEQ ID NO: 6478233 - DNA, 14 bp, Homo sapiens
tgcttaaaccactt

SEQ ID NO: 6478234 - DNA, 21 bp, Homo sapiens
tgcttaaactaatgaacaaat

SEQ ID NO: 6478235 - DNA, 16 bp, Homo sapiens
tgcttaaactggaaag

SEQ ID NO: 6478236 - DNA, 15 bp, Homo sapiens
tgcttaaagcttccc

SEQ ID NO: 6478237 - DNA, 16 bp, Homo sapiens
tgcttaaagttgtaac

SEQ ID NO: 6478238 - DNA, 20 bp, Homo sapiens
tgcttaaagttgtaacaaat

SEQ ID NO: 6478239 - DNA, 20 bp, Homo sapiens
tgcttaaatcagttggagtt

SEQ ID NO: 6478240 - DNA, 18 bp, Homo sapiens
tgcttaaatgatcaagga

SEQ ID NO: 6478241 - DNA, 13 bp, Homo sapiens
tgcttaaatgtga

SEQ ID NO: 6478242 - DNA, 20 bp, Homo sapiens
tgcttaaatgtgaattacta

SEQ ID NO: 6478243 - DNA, 23 bp, Homo sapiens
tgcttaaatgtgaattactaact

SEQ ID NO: 6478244 - DNA, 17 bp, Homo sapiens
tgcttaaattccaagtc

SEQ ID NO: 6478245 - DNA, 15 bp, Homo sapiens
tgcttaaatttctta

SEQ ID NO: 6478246 - DNA, 16 bp, Homo sapiens
tgcttaaatttcttat

SEQ ID NO: 6478247 - DNA, 23 bp, Homo sapiens
tgcttaacagttgctttggattc

SEQ ID NO: 6478248 - DNA, 22 bp, Homo sapiens
tgcttaacagttttagaataca

SEQ ID NO: 6478249 - DNA, 21 bp, Homo sapiens
tgcttaacataaacttgtact

SEQ ID NO: 6478250 - DNA, 22 bp, Homo sapiens
tgcttaacataaacttgtactt

SEQ ID NO: 6478251 - DNA, 15 bp, Homo sapiens
tgcttaacattagat

SEQ ID NO: 6478252 - DNA, 20 bp, Homo sapiens
tgcttaacattagatgtcat

SEQ ID NO: 6478253 - DNA, 21 bp, Homo sapiens
tgcttaacattagatgtcatg

SEQ ID NO: 6478254 - DNA, 19 bp, Homo sapiens
tgcttaacttcacatattg

SEQ ID NO: 6478255 - DNA, 19 bp, Homo sapiens
tgcttaaggaaaagagaaa

SEQ ID NO: 6478256 - DNA, 16 bp, Homo sapiens
tgcttaaggcatactt

SEQ ID NO: 6478257 - DNA, 15 bp, Homo sapiens
tgcttaagtgcatgc

SEQ ID NO: 6478258 - DNA, 15 bp, Homo sapiens
tgcttaagttccagc

SEQ ID NO: 6478259 - DNA, 16 bp, Homo sapiens
tgcttaagttccagca

SEQ ID NO: 6478260 - DNA, 15 bp, Homo sapiens
tgcttaataaaagaa

SEQ ID NO: 6478261 - DNA, 20 bp, Homo sapiens
tgcttaataaaagaacatgc

SEQ ID NO: 6478262 - DNA, 23 bp, Homo sapiens
tgcttaataaaagaacatgcttg

SEQ ID NO: 6478263 - DNA, 16 bp, Homo sapiens
tgcttaatctagagct

SEQ ID NO: 6478264 - DNA, 17 bp, Homo sapiens
tgcttaatctagagcta

SEQ ID NO: 6478265 - DNA, 19 bp, Homo sapiens
tgcttaatctagagctatg

SEQ ID NO: 6478266 - DNA, 21 bp, Homo sapiens
tgcttaatctagagctatgca

SEQ ID NO: 6478267 - DNA, 21 bp, Homo sapiens
tgcttaatcttcaaagccttc

SEQ ID NO: 6478268 - DNA, 20 bp, Homo sapiens
tgcttaattcaaataataat

SEQ ID NO: 6478269 - DNA, 23 bp, Homo sapiens
tgcttaatttaaatagcattatc

SEQ ID NO: 6478270 - DNA, 13 bp, Homo sapiens
tgcttaatttcct

SEQ ID NO: 6478271 - DNA, 18 bp, Homo sapiens
tgcttaatttccttctgt

SEQ ID NO: 6478272 - DNA, 19 bp, Homo sapiens
tgcttaatttccttctgtt

SEQ ID NO: 6478273 - DNA, 13 bp, Homo sapiens
tgcttaattttga

SEQ ID NO: 6478274 - DNA, 13 bp, Homo sapiens
tgcttacaaagta

SEQ ID NO: 6478275 - DNA, 23 bp, Homo sapiens
tgcttacaatggagtctgcagtg

SEQ ID NO: 6478276 - DNA, 18 bp, Homo sapiens
tgcttacaattccctgct

SEQ ID NO: 6478277 - DNA, 17 bp, Homo sapiens
tgcttacacatctcaga

SEQ ID NO: 6478278 - DNA, 16 bp, Homo sapiens
tgcttacagtaactaa

SEQ ID NO: 6478279 - DNA, 13 bp, Homo sapiens
tgcttacagtgac

SEQ ID NO: 6478280 - DNA, 16 bp, Homo sapiens
tgcttacagtgactgt

SEQ ID NO: 6478281 - DNA, 17 bp, Homo sapiens
tgcttacagtgactgtc

SEQ ID NO: 6478282 - DNA, 17 bp, Homo sapiens
tcttctaacatgaaata

SEQ ID NO: 6478283 - DNA, 22 bp, Homo sapiens
tcttctaacatgaaatatattt

SEQ ID NO: 6478284 - DNA, 16 bp, Homo sapiens
tcttctaacctcagcc

SEQ ID NO: 6478285 - DNA, 22 bp, Homo sapiens
tcttctaactcatgggtaccca

SEQ ID NO: 6478286 - DNA, 15 bp, Homo sapiens
tcttctaagaagaca

SEQ ID NO: 6478287 - DNA, 14 bp, Homo sapiens
tcttctaataaagt

SEQ ID NO: 6478288 - DNA, 15 bp, Homo sapiens
tcttctaatcataac

SEQ ID NO: 6478289 - DNA, 20 bp, Homo sapiens
tcttctaatcataacatagt

SEQ ID NO: 6478290 - DNA, 18 bp, Homo sapiens
tcttctacaactcataca

SEQ ID NO: 6478291 - DNA, 14 bp, Homo sapiens
tcttctacactagg

SEQ ID NO: 6478292 - DNA, 18 bp, Homo sapiens
tcttctaccctcatcatc

SEQ ID NO: 6478293 - DNA, 12 bp, Homo sapiens
tcttctacttgt

SEQ ID NO: 6478294 - DNA, 22 bp, Homo sapiens
tcttctactttcatctattctt

SEQ ID NO: 6478295 - DNA, 21 bp, Homo sapiens
tcttctagaagataacatttt

SEQ ID NO: 6478296 - DNA, 22 bp, Homo sapiens
tcttctagatgattttttgaaa

SEQ ID NO: 6478297 - DNA, 18 bp, Homo sapiens
tcttctagcatatctttc

SEQ ID NO: 6478298 - DNA, 17 bp, Homo sapiens
tcttctagcatttcttc

SEQ ID NO: 6478299 - DNA, 19 bp, Homo sapiens
tcttctaggggtagctggt

SEQ ID NO: 6478300 - DNA, 19 bp, Homo sapiens
tcttctagtgatgatggtt

SEQ ID NO: 6478301 - DNA, 19 bp, Homo sapiens
tcttctatagtgatgatga

SEQ ID NO: 6478302 - DNA, 13 bp, Homo sapiens
tcttctatataat

SEQ ID NO: 6478303 - DNA, 22 bp, Homo sapiens
tcttctatataattcctgtttt

SEQ ID NO: 6478304 - DNA, 15 bp, Homo sapiens
tcttctatatccaaa

SEQ ID NO: 6478305 - DNA, 13 bp, Homo sapiens
tcttctatattaa

SEQ ID NO: 6478306 - DNA, 19 bp, Homo sapiens
tcttctatgtaggaaaaaa

SEQ ID NO: 6478307 - DNA, 10 bp, Homo sapiens
tcttctatta

SEQ ID NO: 6478308 - DNA, 19 bp, Homo sapiens
tcttctattaatcaagaga

SEQ ID NO: 6478309 - DNA, 20 bp, Homo sapiens
tcttctatttttatcatgaa

SEQ ID NO: 6478310 - DNA, 22 bp, Homo sapiens
tcttctcaaaaaataattagtt

SEQ ID NO: 6478311 - DNA, 12 bp, Homo sapiens
tcttctcaaagg

SEQ ID NO: 6478312 - DNA, 11 bp, Homo sapiens
tcttctcaagt

SEQ ID NO: 6478313 - DNA, 13 bp, Homo sapiens
tcttctcaagtgc

SEQ ID NO: 6478314 - DNA, 17 bp, Homo sapiens
tcttctcaagtgcctta

SEQ ID NO: 6478315 - DNA, 15 bp, Homo sapiens
tcttctcaagttcta

SEQ ID NO: 6478316 - DNA, 17 bp, Homo sapiens
tcttctcaagttctaag

SEQ ID NO: 6478317 - DNA, 21 bp, Homo sapiens
tcttctcaagttctaagattc

SEQ ID NO: 6478318 - DNA, 23 bp, Homo sapiens
tcttctcagagcagcactggggt

SEQ ID NO: 6478319 - DNA, 18 bp, Homo sapiens
tcttctcagctcttccat

SEQ ID NO: 6478320 - DNA, 15 bp, Homo sapiens
tcttctcatttcacc

SEQ ID NO: 6478321 - DNA, 23 bp, Homo sapiens
tcttctcatttcacccctccctt

SEQ ID NO: 6478322 - DNA, 16 bp, Homo sapiens
tcttctccaattctga

SEQ ID NO: 6478323 - DNA, 12 bp, Homo sapiens
tcttctccacca

SEQ ID NO: 6478324 - DNA, 15 bp, Homo sapiens
tcttctccacgtctt

SEQ ID NO: 6478325 - DNA, 22 bp, Homo sapiens
tcttctccacgtctttcctgct

SEQ ID NO: 6478326 - DNA, 16 bp, Homo sapiens
tcttctccactggatg

SEQ ID NO: 6478327 - DNA, 19 bp, Homo sapiens
tcttctccactttctagcc

SEQ ID NO: 6478328 - DNA, 14 bp, Homo sapiens
tcttctccagattt

SEQ ID NO: 6478329 - DNA, 14 bp, Homo sapiens
tcttctccatctgg

SEQ ID NO: 6478330 - DNA, 15 bp, Homo sapiens
tcttctccattccct

SEQ ID NO: 6478331 - DNA, 20 bp, Homo sapiens
tcttctccattccctagcag

SEQ ID NO: 6478332 - DNA, 20 bp, Homo sapiens
tcttctcccaactcagcctg

SEQ ID NO: 6478333 - DNA, 16 bp, Homo sapiens
tcttctcccagagcac

SEQ ID NO: 6478334 - DNA, 18 bp, Homo sapiens
tcttctccccacagcctc

SEQ ID NO: 6478335 - DNA, 14 bp, Homo sapiens
tcttctccccaggt

SEQ ID NO: 6478336 - DNA, 21 bp, Homo sapiens
tcttctccccttccatttctg

SEQ ID NO: 6478337 - DNA, 18 bp, Homo sapiens
tcttctcccctttcaaat

SEQ ID NO: 6478338 - DNA, 12 bp, Homo sapiens
tcttctccctgt

SEQ ID NO: 6478339 - DNA, 17 bp, Homo sapiens
tcttctcctatgtgtaa

SEQ ID NO: 6478340 - DNA, 21 bp, Homo sapiens
tcttctcctgtgatgtcccag

SEQ ID NO: 6478341 - DNA, 19 bp, Homo sapiens
tcttctccttcaaaacatt

SEQ ID NO: 6478342 - DNA, 15 bp, Homo sapiens
tcttctcctttgtca

SEQ ID NO: 6478343 - DNA, 19 bp, Homo sapiens
tcttctcctttgtcaaatg

SEQ ID NO: 6478344 - DNA, 17 bp, Homo sapiens
tcttctcgacttcagga

SEQ ID NO: 6478345 - DNA, 15 bp, Homo sapiens
tcttctcggctcagg

SEQ ID NO: 6478346 - DNA, 18 bp, Homo sapiens
tcttctcgggccaccctc

SEQ ID NO: 6478347 - DNA, 13 bp, Homo sapiens
tcttctcggggac

SEQ ID NO: 6478348 - DNA, 23 bp, Homo sapiens
tcttctcgtcctcgtttgtgttc

SEQ ID NO: 6478349 - DNA, 13 bp, Homo sapiens
tcttctctaacaa

SEQ ID NO: 6478350 - DNA, 15 bp, Homo sapiens
tcttctctagctggt

SEQ ID NO: 6478351 - DNA, 13 bp, Homo sapiens
tcttctctatatt

SEQ ID NO: 6478352 - DNA, 17 bp, Homo sapiens
tcttctctatattttta

SEQ ID NO: 6478353 - DNA, 20 bp, Homo sapiens
tcttctctattcctgaccct

SEQ ID NO: 6478354 - DNA, 12 bp, Homo sapiens
tcttctctcaga

SEQ ID NO: 6478355 - DNA, 13 bp, Homo sapiens
tcttctctcagac

SEQ ID NO: 6478356 - DNA, 18 bp, Homo sapiens
tcttctctccagctgact

SEQ ID NO: 6478357 - DNA, 18 bp, Homo sapiens
tcttctctccccagcccc

SEQ ID NO: 6478358 - DNA, 22 bp, Homo sapiens
tcttctctccccttttccttca

SEQ ID NO: 6478359 - DNA, 20 bp, Homo sapiens
tcttctctctcaattttatc

SEQ ID NO: 6478360 - DNA, 13 bp, Homo sapiens
tcttctctctggc

SEQ ID NO: 6478361 - DNA, 15 bp, Homo sapiens
tcttctctctggctc

SEQ ID NO: 6478362 - DNA, 18 bp, Homo sapiens
tcttctctctggctcagg

SEQ ID NO: 6478363 - DNA, 15 bp, Homo sapiens
tcttctctcttgatt

SEQ ID NO: 6478364 - DNA, 22 bp, Homo sapiens
tcttctctgcaatgcttctgta

SEQ ID NO: 6478365 - DNA, 15 bp, Homo sapiens
tcttctctgcacgtt

SEQ ID NO: 6478366 - DNA, 13 bp, Homo sapiens
tcttctctggaga

SEQ ID NO: 6478367 - DNA, 14 bp, Homo sapiens
tcttctcttatcct

SEQ ID NO: 6478368 - DNA, 14 bp, Homo sapiens
tcttctcttcctag

SEQ ID NO: 6478369 - DNA, 13 bp, Homo sapiens
tcttctcttcctg

SEQ ID NO: 6478370 - DNA, 14 bp, Homo sapiens
tcttctcttcctgt

SEQ ID NO: 6478371 - DNA, 14 bp, Homo sapiens
tcttctcttctctg

SEQ ID NO: 6478372 - DNA, 16 bp, Homo sapiens
tcttctcttctctgca

SEQ ID NO: 6478373 - DNA, 16 bp, Homo sapiens
tcttctcttctttggg

SEQ ID NO: 6478374 - DNA, 15 bp, Homo sapiens
tcttctcttgtgatt

SEQ ID NO: 6478375 - DNA, 19 bp, Homo sapiens
tcttctgaactcaaactga

SEQ ID NO: 6478376 - DNA, 15 bp, Homo sapiens
tcttctgaagatgga

SEQ ID NO: 6478377 - DNA, 20 bp, Homo sapiens
tcttctgaagctagaaacaa

SEQ ID NO: 6478378 - DNA, 16 bp, Homo sapiens
tcttctgacaaactgt

SEQ ID NO: 6478379 - DNA, 20 bp, Homo sapiens
tcttctgactgccccctcct

SEQ ID NO: 6478380 - DNA, 12 bp, Homo sapiens
tcttctgagcct

SEQ ID NO: 6478381 - DNA, 12 bp, Homo sapiens
tcttctgagcta

SEQ ID NO: 6478382 - DNA, 22 bp, Homo sapiens
tcttctgagcttacgtagttct

SEQ ID NO: 6478383 - DNA, 18 bp, Homo sapiens
tcttctgagtgaatgtta

SEQ ID NO: 6478384 - DNA, 21 bp, Homo sapiens
tcttctgcaacatttgacaaa

SEQ ID NO: 6478385 - DNA, 20 bp, Homo sapiens
tcttctgcaagcctcatgcc

SEQ ID NO: 6478386 - DNA, 23 bp, Homo sapiens
tcttctgcatttttcagagaata

SEQ ID NO: 6478387 - DNA, 21 bp, Homo sapiens
tcttctgccacttctgcgggc

SEQ ID NO: 6478388 - DNA, 22 bp, Homo sapiens
tcttctgccacttctgcgggct

SEQ ID NO: 6478389 - DNA, 15 bp, Homo sapiens
tcttctgccagccca

SEQ ID NO: 6478390 - DNA, 20 bp, Homo sapiens
tcttctgcccaattggagga

SEQ ID NO: 6478391 - DNA, 18 bp, Homo sapiens
tcttctgccggccctggg

SEQ ID NO: 6478392 - DNA, 13 bp, Homo sapiens
tcttctgcctccc

SEQ ID NO: 6478393 - DNA, 14 bp, Homo sapiens
tcttctgctccacc

SEQ ID NO: 6478394 - DNA, 16 bp, Homo sapiens
tcttctgctctttctt

SEQ ID NO: 6478395 - DNA, 11 bp, Homo sapiens
tcttctgctgt

SEQ ID NO: 6478396 - DNA, 16 bp, Homo sapiens
tcttctgctgttcttc

SEQ ID NO: 6478397 - DNA, 22 bp, Homo sapiens
tcttctgcttcagcctcccgag

SEQ ID NO: 6478398 - DNA, 13 bp, Homo sapiens
tcttctgctttgt

SEQ ID NO: 6478399 - DNA, 12 bp, Homo sapiens
tcttctggaatg

SEQ ID NO: 6478400 - DNA, 18 bp, Homo sapiens
tcttctggactggttttc

SEQ ID NO: 6478401 - DNA, 10 bp, Homo sapiens
tcttctggag

SEQ ID NO: 6478402 - DNA, 16 bp, Homo sapiens
tcttctggagaagctt

SEQ ID NO: 6478403 - DNA, 22 bp, Homo sapiens
tcttctggagatggaagcttgt

SEQ ID NO: 6478404 - DNA, 19 bp, Homo sapiens
tcttctggagtttctctaa

SEQ ID NO: 6478405 - DNA, 12 bp, Homo sapiens
tcttctggctca

SEQ ID NO: 6478406 - DNA, 13 bp, Homo sapiens
tcttctggctcaa

SEQ ID NO: 6478407 - DNA, 18 bp, Homo sapiens
tcttctggctcaaaaaga

SEQ ID NO: 6478408 - DNA, 21 bp, Homo sapiens
tcttctggctcaaaaagagaa

SEQ ID NO: 6478409 - DNA, 11 bp, Homo sapiens
tcttctgggca

SEQ ID NO: 6478410 - DNA, 17 bp, Homo sapiens
tcttctgggcacagtgg

SEQ ID NO: 6478411 - DNA, 16 bp, Homo sapiens
tcttctgggcaccctc

SEQ ID NO: 6478412 - DNA, 18 bp, Homo sapiens
tcttctgggcagagcctg

SEQ ID NO: 6478413 - DNA, 19 bp, Homo sapiens
tcttctgggcagagcctgt

SEQ ID NO: 6478414 - DNA, 21 bp, Homo sapiens
tcttctggggcaggctgggcc

SEQ ID NO: 6478415 - DNA, 21 bp, Homo sapiens
tcttctgggtagtcccctgtt

SEQ ID NO: 6478416 - DNA, 17 bp, Homo sapiens
tcttctgggtgtgcttt

SEQ ID NO: 6478417 - DNA, 23 bp, Homo sapiens
tcttctgggtgtgctttttggga

SEQ ID NO: 6478418 - DNA, 15 bp, Homo sapiens
tcttctggtctgtgt

SEQ ID NO: 6478419 - DNA, 23 bp, Homo sapiens
tcttctggtctgtgtgtgttctt

SEQ ID NO: 6478420 - DNA, 18 bp, Homo sapiens
tcttctggtgcatgttct

SEQ ID NO: 6478421 - DNA, 14 bp, Homo sapiens
tcttctggttttct

SEQ ID NO: 6478422 - DNA, 15 bp, Homo sapiens
tcttctgtacgtctg

SEQ ID NO: 6478423 - DNA, 19 bp, Homo sapiens
tcttctgtatactgtggag

SEQ ID NO: 6478424 - DNA, 24 bp, Homo sapiens
tcttctgtatataaatgggaacat

SEQ ID NO: 6478425 - DNA, 21 bp, Homo sapiens
tcttctgtatgtgacaacatt

SEQ ID NO: 6478426 - DNA, 22 bp, Homo sapiens
tcttctgtatttctaggcacaa

SEQ ID NO: 6478427 - DNA, 12 bp, Homo sapiens
tcttctgtcatc

SEQ ID NO: 6478428 - DNA, 12 bp, Homo sapiens
tcttctgtccat

SEQ ID NO: 6478429 - DNA, 14 bp, Homo sapiens
tcttctgtcccaag

SEQ ID NO: 6478430 - DNA, 15 bp, Homo sapiens
tcttctgtccctgtt

SEQ ID NO: 6478431 - DNA, 14 bp, Homo sapiens
tcttctgtcttgtc

SEQ ID NO: 6478432 - DNA, 16 bp, Homo sapiens
tcttctgtgaaatata

SEQ ID NO: 6478433 - DNA, 17 bp, Homo sapiens
tcttctgttatttattt

SEQ ID NO: 6478434 - DNA, 13 bp, Homo sapiens
tcttctgttccca

SEQ ID NO: 6478435 - DNA, 15 bp, Homo sapiens
tcttctgttcccaag

SEQ ID NO: 6478436 - DNA, 22 bp, Homo sapiens
tcttctgttcccaaggaagctc

SEQ ID NO: 6478437 - DNA, 13 bp, Homo sapiens
tcttctgttctca

SEQ ID NO: 6478438 - DNA, 16 bp, Homo sapiens
tcttctgttttctgtt

SEQ ID NO: 6478439 - DNA, 18 bp, Homo sapiens
tcttctgttttctgtttc

SEQ ID NO: 6478440 - DNA, 12 bp, Homo sapiens
tcttctgttttt

SEQ ID NO: 6478441 - DNA, 14 bp, Homo sapiens
tcttctgtttttct

SEQ ID NO: 6478442 - DNA, 22 bp, Homo sapiens
tcttctgtttttctcaaataaa

SEQ ID NO: 6478443 - DNA, 18 bp, Homo sapiens
tcttcttaagacttttgg

SEQ ID NO: 6478444 - DNA, 24 bp, Homo sapiens
tcttcttaatgtacatagtgctaa

SEQ ID NO: 6478445 - DNA, 15 bp, Homo sapiens
tcttcttacacttct

SEQ ID NO: 6478446 - DNA, 22 bp, Homo sapiens
tcttcttatacagataaaacat

SEQ ID NO: 6478447 - DNA, 14 bp, Homo sapiens
tcttcttatctaaa

SEQ ID NO: 6478448 - DNA, 13 bp, Homo sapiens
tcttcttcaaata

SEQ ID NO: 6478449 - DNA, 20 bp, Homo sapiens
tcttcttcaaatacaaagta

SEQ ID NO: 6478450 - DNA, 14 bp, Homo sapiens
tcttcttcaccatt

SEQ ID NO: 6478451 - DNA, 14 bp, Homo sapiens
tcttcttcattcca

SEQ ID NO: 6478452 - DNA, 22 bp, Homo sapiens
tcttcttccaaatgcagttcat

SEQ ID NO: 6478453 - DNA, 14 bp, Homo sapiens
tcttcttccaggta

SEQ ID NO: 6478454 - DNA, 13 bp, Homo sapiens
tcttcttcctggt

SEQ ID NO: 6478455 - DNA, 12 bp, Homo sapiens
tcttcttctcaa

SEQ ID NO: 6478456 - DNA, 22 bp, Homo sapiens
tcttcttctcgtcctcgtttgt

SEQ ID NO: 6478457 - DNA, 14 bp, Homo sapiens
tcttcttctcttct

SEQ ID NO: 6478458 - DNA, 14 bp, Homo sapiens
tcttcttcttttct

SEQ ID NO: 6478459 - DNA, 14 bp, Homo sapiens
tcttcttgaaaata

SEQ ID NO: 6478460 - DNA, 21 bp, Homo sapiens
tcttcttgaacactcatgctg

SEQ ID NO: 6478461 - DNA, 23 bp, Homo sapiens
tcttcttgaacactcatgctgaa

SEQ ID NO: 6478462 - DNA, 13 bp, Homo sapiens
tcttcttgcatct

SEQ ID NO: 6478463 - DNA, 17 bp, Homo sapiens
tgcttacagtttatttt

SEQ ID NO: 6478464 - DNA, 14 bp, Homo sapiens
tgcttacatctgga

SEQ ID NO: 6478465 - DNA, 20 bp, Homo sapiens
tgcttacattttaatagaga

SEQ ID NO: 6478466 - DNA, 17 bp, Homo sapiens
tgcttacatttttacaa

SEQ ID NO: 6478467 - DNA, 15 bp, Homo sapiens
tgcttaccaaaagct

SEQ ID NO: 6478468 - DNA, 18 bp, Homo sapiens
tgcttaccaaaagctcag

SEQ ID NO: 6478469 - DNA, 18 bp, Homo sapiens
tgcttacccttcaccttt

SEQ ID NO: 6478470 - DNA, 14 bp, Homo sapiens
tgcttacctaattt

SEQ ID NO: 6478471 - DNA, 17 bp, Homo sapiens
tgcttacctaatttcat

SEQ ID NO: 6478472 - DNA, 15 bp, Homo sapiens
tgcttacctcacacg

SEQ ID NO: 6478473 - DNA, 14 bp, Homo sapiens
tgcttacctctcag

SEQ ID NO: 6478474 - DNA, 15 bp, Homo sapiens
tgcttaccttctgct

SEQ ID NO: 6478475 - DNA, 14 bp, Homo sapiens
tgcttaccttgttt

SEQ ID NO: 6478476 - DNA, 15 bp, Homo sapiens
tgcttactacagaaa

SEQ ID NO: 6478477 - DNA, 22 bp, Homo sapiens
tgcttactgatatattttacaa

SEQ ID NO: 6478478 - DNA, 16 bp, Homo sapiens
tgcttacttttactgt

SEQ ID NO: 6478479 - DNA, 14 bp, Homo sapiens
tgcttactttttaa

SEQ ID NO: 6478480 - DNA, 20 bp, Homo sapiens
tgcttactttttaattttta

SEQ ID NO: 6478481 - DNA, 14 bp, Homo sapiens
tgcttagaaaagaa

SEQ ID NO: 6478482 - DNA, 21 bp, Homo sapiens
tgcttagaacccttctgcttt

SEQ ID NO: 6478483 - DNA, 24 bp, Homo sapiens
tgcttagaacccttctgctttcta

SEQ ID NO: 6478484 - DNA, 17 bp, Homo sapiens
tgcttagacataacaaa

SEQ ID NO: 6478485 - DNA, 19 bp, Homo sapiens
tgcttagaggttctgcctc

SEQ ID NO: 6478486 - DNA, 20 bp, Homo sapiens
tgcttagaggttctgcctct

SEQ ID NO: 6478487 - DNA, 19 bp, Homo sapiens
tgcttagagtgcccagcag

SEQ ID NO: 6478488 - DNA, 13 bp, Homo sapiens
tgcttagataact

SEQ ID NO: 6478489 - DNA, 20 bp, Homo sapiens
tgcttagataactcttgttt

SEQ ID NO: 6478490 - DNA, 18 bp, Homo sapiens
tgcttagcctcctgacct

SEQ ID NO: 6478491 - DNA, 19 bp, Homo sapiens
tgcttagcctgtgctggac

SEQ ID NO: 6478492 - DNA, 16 bp, Homo sapiens
tgcttagcttatcttt

SEQ ID NO: 6478493 - DNA, 21 bp, Homo sapiens
tgcttagcttatctttctttc

SEQ ID NO: 6478494 - DNA, 14 bp, Homo sapiens
tgcttaggatgtgt

SEQ ID NO: 6478495 - DNA, 19 bp, Homo sapiens
tgcttaggtgaaggcagaa

SEQ ID NO: 6478496 - DNA, 13 bp, Homo sapiens
tgcttagtaaaat

SEQ ID NO: 6478497 - DNA, 21 bp, Homo sapiens
tgcttagtcacttatttcata

SEQ ID NO: 6478498 - DNA, 23 bp, Homo sapiens
tgcttagtcacttatttcataaa

SEQ ID NO: 6478499 - DNA, 15 bp, Homo sapiens
tgcttagtgtgaagt

SEQ ID NO: 6478500 - DNA, 22 bp, Homo sapiens
tgcttataaacatttaaagaca

SEQ ID NO: 6478501 - DNA, 19 bp, Homo sapiens
tgcttataacctagttaaa

SEQ ID NO: 6478502 - DNA, 19 bp, Homo sapiens
tgcttataataaagaaaac

SEQ ID NO: 6478503 - DNA, 14 bp, Homo sapiens
tgcttataatgtgt

SEQ ID NO: 6478504 - DNA, 16 bp, Homo sapiens
tgcttataatgtgtgt

SEQ ID NO: 6478505 - DNA, 13 bp, Homo sapiens
tgcttatacactt

SEQ ID NO: 6478506 - DNA, 17 bp, Homo sapiens
tgcttataggtggcctc

SEQ ID NO: 6478507 - DNA, 19 bp, Homo sapiens
tgcttatgaatatttataa

SEQ ID NO: 6478508 - DNA, 21 bp, Homo sapiens
tgcttatgacatcacttgtac

SEQ ID NO: 6478509 - DNA, 20 bp, Homo sapiens
tgcttatgatgggctcccca

SEQ ID NO: 6478510 - DNA, 14 bp, Homo sapiens
tgcttatggtacca

SEQ ID NO: 6478511 - DNA, 16 bp, Homo sapiens
tgcttatgtcatttct

SEQ ID NO: 6478512 - DNA, 19 bp, Homo sapiens
tgcttatgttaaactctgt

SEQ ID NO: 6478513 - DNA, 16 bp, Homo sapiens
tgcttattaagaccaa

SEQ ID NO: 6478514 - DNA, 18 bp, Homo sapiens
tgcttattaagaccaaag

SEQ ID NO: 6478515 - DNA, 19 bp, Homo sapiens
tgcttattccatgactgct

SEQ ID NO: 6478516 - DNA, 15 bp, Homo sapiens
tgcttattctctcat

SEQ ID NO: 6478517 - DNA, 17 bp, Homo sapiens
tgcttattgcttagtaa

SEQ ID NO: 6478518 - DNA, 15 bp, Homo sapiens
tgcttattgtaacag

SEQ ID NO: 6478519 - DNA, 15 bp, Homo sapiens
tgcttattgtgtgtt

SEQ ID NO: 6478520 - DNA, 15 bp, Homo sapiens
tgcttattgttccaa

SEQ ID NO: 6478521 - DNA, 16 bp, Homo sapiens
tgcttattgttccaag

SEQ ID NO: 6478522 - DNA, 23 bp, Homo sapiens
tgcttattgttccaagacattgt

SEQ ID NO: 6478523 - DNA, 19 bp, Homo sapiens
tgcttattgttttattgta

SEQ ID NO: 6478524 - DNA, 19 bp, Homo sapiens
tgcttatttcatctgttct

SEQ ID NO: 6478525 - DNA, 15 bp, Homo sapiens
tgcttatttccctca

SEQ ID NO: 6478526 - DNA, 17 bp, Homo sapiens
tgcttattttaaaattt

SEQ ID NO: 6478527 - DNA, 14 bp, Homo sapiens
tgcttattttacaa

SEQ ID NO: 6478528 - DNA, 15 bp, Homo sapiens
tgcttattttattat

SEQ ID NO: 6478529 - DNA, 18 bp, Homo sapiens
tgcttatttttataatta

SEQ ID NO: 6478530 - DNA, 14 bp, Homo sapiens
tgcttcaaaccctc

SEQ ID NO: 6478531 - DNA, 22 bp, Homo sapiens
tgcttcaacaactttgtgcttt

SEQ ID NO: 6478532 - DNA, 14 bp, Homo sapiens
tgcttcaactgtct

SEQ ID NO: 6478533 - DNA, 18 bp, Homo sapiens
tgcttcaaggatcctgag

SEQ ID NO: 6478534 - DNA, 20 bp, Homo sapiens
tgcttcaaggatcctgagcc

SEQ ID NO: 6478535 - DNA, 23 bp, Homo sapiens
tgcttcaaggatcctgagccaga

SEQ ID NO: 6478536 - DNA, 16 bp, Homo sapiens
tgcttcaataaatctt

SEQ ID NO: 6478537 - DNA, 15 bp, Homo sapiens
tgcttcaatcccagc

SEQ ID NO: 6478538 - DNA, 15 bp, Homo sapiens
tgcttcaattaaaat

SEQ ID NO: 6478539 - DNA, 16 bp, Homo sapiens
tgcttcaattaaaatt

SEQ ID NO: 6478540 - DNA, 17 bp, Homo sapiens
tgcttcaattaaaatta

SEQ ID NO: 6478541 - DNA, 16 bp, Homo sapiens
tgcttcaatttcaaac

SEQ ID NO: 6478542 - DNA, 17 bp, Homo sapiens
tgcttcacaacccatct

SEQ ID NO: 6478543 - DNA, 16 bp, Homo sapiens
tgcttcacacaaagtg

SEQ ID NO: 6478544 - DNA, 21 bp, Homo sapiens
tgcttcacacaaagtgaaatt

SEQ ID NO: 6478545 - DNA, 22 bp, Homo sapiens
tgcttcacacccctcagcgctc

SEQ ID NO: 6478546 - DNA, 22 bp, Homo sapiens
tgcttcacagtacttcccaaca

SEQ ID NO: 6478547 - DNA, 22 bp, Homo sapiens
tgcttcacagtagagccagctt

SEQ ID NO: 6478548 - DNA, 12 bp, Homo sapiens
tgcttcacataa

SEQ ID NO: 6478549 - DNA, 16 bp, Homo sapiens
tgcttcaccagacttt

SEQ ID NO: 6478550 - DNA, 21 bp, Homo sapiens
tgcttcaccagacttttctct

SEQ ID NO: 6478551 - DNA, 20 bp, Homo sapiens
tgcttcacggactctttgct

SEQ ID NO: 6478552 - DNA, 17 bp, Homo sapiens
tgcttcactctatccaa

SEQ ID NO: 6478553 - DNA, 19 bp, Homo sapiens
tgcttcagatgtggagcca

SEQ ID NO: 6478554 - DNA, 15 bp, Homo sapiens
tgcttcagccctggc

SEQ ID NO: 6478555 - DNA, 18 bp, Homo sapiens
tgcttcagccctggcccc

SEQ ID NO: 6478556 - DNA, 12 bp, Homo sapiens
tgcttcagcctg

SEQ ID NO: 6478557 - DNA, 17 bp, Homo sapiens
tgcttcagcctgaggct

SEQ ID NO: 6478558 - DNA, 15 bp, Homo sapiens
tgcttcagcttgctt

SEQ ID NO: 6478559 - DNA, 20 bp, Homo sapiens
tgcttcataaatgaagcagc

SEQ ID NO: 6478560 - DNA, 15 bp, Homo sapiens
tgcttcatacaggga

SEQ ID NO: 6478561 - DNA, 19 bp, Homo sapiens
tgcttcatagtattggagc

SEQ ID NO: 6478562 - DNA, 22 bp, Homo sapiens
tgcttcatagtattggagcaca

SEQ ID NO: 6478563 - DNA, 17 bp, Homo sapiens
tgcttcatctccttttg

SEQ ID NO: 6478564 - DNA, 19 bp, Homo sapiens
tgcttcatcttcccaggta

SEQ ID NO: 6478565 - DNA, 18 bp, Homo sapiens
tgcttcatgaaaatccta

SEQ ID NO: 6478566 - DNA, 17 bp, Homo sapiens
tgcttcattaaaacaag

SEQ ID NO: 6478567 - DNA, 19 bp, Homo sapiens
tgcttcattaaaacaagag

SEQ ID NO: 6478568 - DNA, 12 bp, Homo sapiens
tgcttcattatt

SEQ ID NO: 6478569 - DNA, 21 bp, Homo sapiens
tgcttcattcaagcttcatat

SEQ ID NO: 6478570 - DNA, 15 bp, Homo sapiens
tgcttcattcaatat

SEQ ID NO: 6478571 - DNA, 14 bp, Homo sapiens
tgcttcattgaaag

SEQ ID NO: 6478572 - DNA, 16 bp, Homo sapiens
tgcttcattgttacat

SEQ ID NO: 6478573 - DNA, 17 bp, Homo sapiens
tgcttcattgtttgatt

SEQ ID NO: 6478574 - DNA, 16 bp, Homo sapiens
tgcttcattttggagc

SEQ ID NO: 6478575 - DNA, 23 bp, Homo sapiens
tgcttcatttttgtaataacatt

SEQ ID NO: 6478576 - DNA, 19 bp, Homo sapiens
tgcttccaaaagtgatagt

SEQ ID NO: 6478577 - DNA, 13 bp, Homo sapiens
tgcttccaacagg

SEQ ID NO: 6478578 - DNA, 15 bp, Homo sapiens
tgcttccaatcttgc

SEQ ID NO: 6478579 - DNA, 11 bp, Homo sapiens
tgcttccacag

SEQ ID NO: 6478580 - DNA, 17 bp, Homo sapiens
tgcttccacctcacccc

SEQ ID NO: 6478581 - DNA, 20 bp, Homo sapiens
tgcttccacctcaccccact

SEQ ID NO: 6478582 - DNA, 19 bp, Homo sapiens
tgcttccaggaaactccac

SEQ ID NO: 6478583 - DNA, 18 bp, Homo sapiens
tgcttccaggtaaaaaca

SEQ ID NO: 6478584 - DNA, 16 bp, Homo sapiens
tgcttccagtgaggct

SEQ ID NO: 6478585 - DNA, 18 bp, Homo sapiens
tgcttccagtgaggctct

SEQ ID NO: 6478586 - DNA, 19 bp, Homo sapiens
tgcttccagtgaggctctg

SEQ ID NO: 6478587 - DNA, 22 bp, Homo sapiens
tgcttccagtgaggctctgccc

SEQ ID NO: 6478588 - DNA, 23 bp, Homo sapiens
tgcttccagtgaggctctgccct

SEQ ID NO: 6478589 - DNA, 16 bp, Homo sapiens
tgcttccattaacaaa

SEQ ID NO: 6478590 - DNA, 14 bp, Homo sapiens
tgcttcccaaccta

SEQ ID NO: 6478591 - DNA, 14 bp, Homo sapiens
tgcttcccacaact

SEQ ID NO: 6478592 - DNA, 21 bp, Homo sapiens
tgcttcccacctccctgccca

SEQ ID NO: 6478593 - DNA, 23 bp, Homo sapiens
tgcttcccacctccctgcccagg

SEQ ID NO: 6478594 - DNA, 15 bp, Homo sapiens
tgcttcccactgggg

SEQ ID NO: 6478595 - DNA, 15 bp, Homo sapiens
tgcttcccagaggga

SEQ ID NO: 6478596 - DNA, 17 bp, Homo sapiens
tgcttcccagagggagc

SEQ ID NO: 6478597 - DNA, 14 bp, Homo sapiens
tgcttcccatctga

SEQ ID NO: 6478598 - DNA, 16 bp, Homo sapiens
tgcttcccccacccct

SEQ ID NO: 6478599 - DNA, 21 bp, Homo sapiens
tgcttcccccacccctccacg

SEQ ID NO: 6478600 - DNA, 14 bp, Homo sapiens
tgcttcccctccag

SEQ ID NO: 6478601 - DNA, 15 bp, Homo sapiens
tgcttccccttttgc

SEQ ID NO: 6478602 - DNA, 18 bp, Homo sapiens
tgcttccccttttgccaa

SEQ ID NO: 6478603 - DNA, 15 bp, Homo sapiens
tgcttccctaatcta

SEQ ID NO: 6478604 - DNA, 20 bp, Homo sapiens
tgcttccctctgcctgtccc

SEQ ID NO: 6478605 - DNA, 17 bp, Homo sapiens
tgcttccctgcagctga

SEQ ID NO: 6478606 - DNA, 22 bp, Homo sapiens
tgcttccctttcactgaagtga

SEQ ID NO: 6478607 - DNA, 15 bp, Homo sapiens
tgcttcctagtaagt

SEQ ID NO: 6478608 - DNA, 10 bp, Homo sapiens
tgcttcctca

SEQ ID NO: 6478609 - DNA, 14 bp, Homo sapiens
tgcttcctcctgga

SEQ ID NO: 6478610 - DNA, 15 bp, Homo sapiens
tgcttcctcctggaa

SEQ ID NO: 6478611 - DNA, 18 bp, Homo sapiens
tgcttcctctgaatatta

SEQ ID NO: 6478612 - DNA, 19 bp, Homo sapiens
tgcttcctcttttcctgct

SEQ ID NO: 6478613 - DNA, 17 bp, Homo sapiens
tgcttcctgaaagctgt

SEQ ID NO: 6478614 - DNA, 21 bp, Homo sapiens
tgcttcctgaaagctgttgga

SEQ ID NO: 6478615 - DNA, 15 bp, Homo sapiens
tgcttcctgaaataa

SEQ ID NO: 6478616 - DNA, 16 bp, Homo sapiens
tgcttcctgaaataaa

SEQ ID NO: 6478617 - DNA, 17 bp, Homo sapiens
tgcttcctgaaataaac

SEQ ID NO: 6478618 - DNA, 22 bp, Homo sapiens
tgcttcctgagctgtcccctgg

SEQ ID NO: 6478619 - DNA, 14 bp, Homo sapiens
tgcttcctgatgct

SEQ ID NO: 6478620 - DNA, 16 bp, Homo sapiens
tgcttcctgatgctgg

SEQ ID NO: 6478621 - DNA, 20 bp, Homo sapiens
tgcttcctgatgctgggcaa

SEQ ID NO: 6478622 - DNA, 19 bp, Homo sapiens
tgcttcctgttacctgtct

SEQ ID NO: 6478623 - DNA, 22 bp, Homo sapiens
tgcttccttcagtttgtaaagt

SEQ ID NO: 6478624 - DNA, 13 bp, Homo sapiens
tgcttcctttctc

SEQ ID NO: 6478625 - DNA, 20 bp, Homo sapiens
tgcttcctttctctcctggc

SEQ ID NO: 6478626 - DNA, 12 bp, Homo sapiens
tgcttccttttc

SEQ ID NO: 6478627 - DNA, 14 bp, Homo sapiens
tgcttcgactactg

SEQ ID NO: 6478628 - DNA, 15 bp, Homo sapiens
tgcttcgactactgc

SEQ ID NO: 6478629 - DNA, 15 bp, Homo sapiens
tgcttcgggcccttc

SEQ ID NO: 6478630 - DNA, 22 bp, Homo sapiens
tgcttctaagggatccagagac

SEQ ID NO: 6478631 - DNA, 24 bp, Homo sapiens
tgcttctaagggatccagagacct

SEQ ID NO: 6478632 - DNA, 16 bp, Homo sapiens
tgcttctaagtaaata

SEQ ID NO: 6478633 - DNA, 18 bp, Homo sapiens
tgcttctaagtaaataca

SEQ ID NO: 6478634 - DNA, 20 bp, Homo sapiens
tgcttctaagtaaatacaat

SEQ ID NO: 6478635 - DNA, 22 bp, Homo sapiens
tgcttctaatatttattgcttt

SEQ ID NO: 6478636 - DNA, 20 bp, Homo sapiens
tgcttctacacatttcatct

SEQ ID NO: 6478637 - DNA, 15 bp, Homo sapiens
tgcttctactccatg

SEQ ID NO: 6478638 - DNA, 16 bp, Homo sapiens
tgcttctactccatgg

SEQ ID NO: 6478639 - DNA, 18 bp, Homo sapiens
tgcttctagaaactctgg

SEQ ID NO: 6478640 - DNA, 23 bp, Homo sapiens
tgcttctagaaactctggctcag

SEQ ID NO: 6478641 - DNA, 21 bp, Homo sapiens
tgcttctagaaagcccctcac

SEQ ID NO: 6478642 - DNA, 19 bp, Homo sapiens
tgcttctaggagaactttt

SEQ ID NO: 6478643 - DNA, 18 bp, Homo sapiens
tgcttctagttctgccag

SEQ ID NO: 6478644 - DNA, 21 bp, Homo sapiens
tgcttctatcagactcagttt

SEQ ID NO: 6478645 - DNA, 19 bp, Homo sapiens
tgcttctcaccgtgcagag

SEQ ID NO: 6478646 - DNA, 12 bp, Homo sapiens
tgcttctcactg

SEQ ID NO: 6478647 - DNA, 21 bp, Homo sapiens
tgcttctcagatttctgagga

SEQ ID NO: 6478648 - DNA, 21 bp, Homo sapiens
tgcttctcagttgcagaaaat

SEQ ID NO: 6478649 - DNA, 14 bp, Homo sapiens
tgcttctcatcccc

SEQ ID NO: 6478650 - DNA, 22 bp, Homo sapiens
tgcttctccaaaaatctgcctg

SEQ ID NO: 6478651 - DNA, 15 bp, Homo sapiens
tgcttctccaaatac

SEQ ID NO: 6478652 - DNA, 13 bp, Homo sapiens
tgcttctccaaca

SEQ ID NO: 6478653 - DNA, 17 bp, Homo sapiens
tgcttctccaacactga

SEQ ID NO: 6478654 - DNA, 17 bp, Homo sapiens
tgcttctccacctcccc

SEQ ID NO: 6478655 - DNA, 17 bp, Homo sapiens
tgcttctccatgagaca

SEQ ID NO: 6478656 - DNA, 10 bp, Homo sapiens
tgcttctccc

SEQ ID NO: 6478657 - DNA, 13 bp, Homo sapiens
tgcttctcccagg

SEQ ID NO: 6478658 - DNA, 16 bp, Homo sapiens
tgcttctcccaggcaa

SEQ ID NO: 6478659 - DNA, 14 bp, Homo sapiens
tgcttctccccaga

SEQ ID NO: 6478660 - DNA, 15 bp, Homo sapiens
tgcttctccccagaa

SEQ ID NO: 6478661 - DNA, 15 bp, Homo sapiens
tgcttctccccccat

SEQ ID NO: 6478662 - DNA, 13 bp, Homo sapiens
tgcttctcccgcc

SEQ ID NO: 6478663 - DNA, 19 bp, Homo sapiens
tgcttctcccgccattggc

SEQ ID NO: 6478664 - DNA, 23 bp, Homo sapiens
tgcttctcccgccattggcctta

SEQ ID NO: 6478665 - DNA, 13 bp, Homo sapiens
tgcttctcccggg

SEQ ID NO: 6478666 - DNA, 15 bp, Homo sapiens
tgcttctcccgggga

SEQ ID NO: 6478667 - DNA, 17 bp, Homo sapiens
tgcttctcggaggccag

SEQ ID NO: 6478668 - DNA, 18 bp, Homo sapiens
tgcttctcggccagcccg

SEQ ID NO: 6478669 - DNA, 23 bp, Homo sapiens
tgcttctctagctctctaggcct

SEQ ID NO: 6478670 - DNA, 23 bp, Homo sapiens
tgcttctctctctctcacacaca

SEQ ID NO: 6478671 - DNA, 14 bp, Homo sapiens
tgcttctctgactt

SEQ ID NO: 6478672 - DNA, 22 bp, Homo sapiens
tgcttctctgacttctgcctgg

SEQ ID NO: 6478673 - DNA, 22 bp, Homo sapiens
tgcttctctgtgcaggagccag

SEQ ID NO: 6478674 - DNA, 22 bp, Homo sapiens
tgcttctcttctttattgcact

SEQ ID NO: 6478675 - DNA, 15 bp, Homo sapiens
tgcttctctttgtgc

SEQ ID NO: 6478676 - DNA, 14 bp, Homo sapiens
tgcttctgaactca

SEQ ID NO: 6478677 - DNA, 20 bp, Homo sapiens
tgcttctgaactcaagctgc

SEQ ID NO: 6478678 - DNA, 15 bp, Homo sapiens
tgcttctgaatcact

SEQ ID NO: 6478679 - DNA, 17 bp, Homo sapiens
tgcttctgaatcactgt

SEQ ID NO: 6478680 - DNA, 18 bp, Homo sapiens
tgcttctgaatgtgctga

SEQ ID NO: 6478681 - DNA, 19 bp, Homo sapiens
tgcttctgagagcaaaggg

SEQ ID NO: 6478682 - DNA, 19 bp, Homo sapiens
tgcttctgcagcaactccc

SEQ ID NO: 6478683 - DNA, 19 bp, Homo sapiens
tgcttctgcattcacagcg

SEQ ID NO: 6478684 - DNA, 21 bp, Homo sapiens
tgcttctgcccacaccgcagg

SEQ ID NO: 6478685 - DNA, 17 bp, Homo sapiens
tgcttctgcctcagctt

SEQ ID NO: 6478686 - DNA, 13 bp, Homo sapiens
tgcttctgctcac

SEQ ID NO: 6478687 - DNA, 15 bp, Homo sapiens
tgcttctgctgccct

SEQ ID NO: 6478688 - DNA, 17 bp, Homo sapiens
tgcttctgctgccctga

SEQ ID NO: 6478689 - DNA, 16 bp, Homo sapiens
tgcttctgctgcctag

SEQ ID NO: 6478690 - DNA, 14 bp, Homo sapiens
tgcttctgcttttt

SEQ ID NO: 6478691 - DNA, 23 bp, Homo sapiens
tgcttctggctttgttcttgtca

SEQ ID NO: 6478692 - DNA, 12 bp, Homo sapiens
tgcttctgggaa

SEQ ID NO: 6478693 - DNA, 14 bp, Homo sapiens
tgcttctgggaagg

SEQ ID NO: 6478694 - DNA, 12 bp, Homo sapiens
tgcttctgtagc

SEQ ID NO: 6478695 - DNA, 17 bp, Homo sapiens
tgcttctgtagcttcta

SEQ ID NO: 6478696 - DNA, 17 bp, Homo sapiens
tgcttctgtagtactcc

SEQ ID NO: 6478697 - DNA, 15 bp, Homo sapiens
tgcttcttaaggtcc

SEQ ID NO: 6478698 - DNA, 20 bp, Homo sapiens
tgcttcttcatcttgacatg

SEQ ID NO: 6478699 - DNA, 14 bp, Homo sapiens
tgcttcttctcagg

SEQ ID NO: 6478700 - DNA, 16 bp, Homo sapiens
tgcttcttctcaggca

SEQ ID NO: 6478701 - DNA, 17 bp, Homo sapiens
tgcttcttctctccaca

SEQ ID NO: 6478702 - DNA, 13 bp, Homo sapiens
tgcttcttgcccc

SEQ ID NO: 6478703 - DNA, 15 bp, Homo sapiens
tgcttcttgcccctt

SEQ ID NO: 6478704 - DNA, 16 bp, Homo sapiens
tgcttcttgccccttg

SEQ ID NO: 6478705 - DNA, 21 bp, Homo sapiens
tgcttcttgccccttgggcct

SEQ ID NO: 6478706 - DNA, 15 bp, Homo sapiens
tgcttcttgtaatat

SEQ ID NO: 6478707 - DNA, 19 bp, Homo sapiens
tgcttcttgtaatatttct

SEQ ID NO: 6478708 - DNA, 20 bp, Homo sapiens
tgcttcttgtgaaggccatg

SEQ ID NO: 6478709 - DNA, 17 bp, Homo sapiens
tgcttcttgtgtttgaa

SEQ ID NO: 6478710 - DNA, 16 bp, Homo sapiens
tgcttcttgtgtttta

SEQ ID NO: 6478711 - DNA, 16 bp, Homo sapiens
tgcttctttccagaaa

SEQ ID NO: 6478712 - DNA, 12 bp, Homo sapiens
tgcttctttcct

SEQ ID NO: 6478713 - DNA, 19 bp, Homo sapiens
tgcttctttctttgggaat

SEQ ID NO: 6478714 - DNA, 16 bp, Homo sapiens
tgcttctttgtaatga

SEQ ID NO: 6478715 - DNA, 19 bp, Homo sapiens
tgcttcttttagtcagaaa

SEQ ID NO: 6478716 - DNA, 22 bp, Homo sapiens
tgcttgaaaaatgtgcaaaaca

SEQ ID NO: 6478717 - DNA, 21 bp, Homo sapiens
tgcttgaaagaaaatatgcat

SEQ ID NO: 6478718 - DNA, 21 bp, Homo sapiens
tgcttgaaattactgtgtaaa

SEQ ID NO: 6478719 - DNA, 15 bp, Homo sapiens
tgcttgaacccagga

SEQ ID NO: 6478720 - DNA, 17 bp, Homo sapiens
tgcttgaacccaggaga

SEQ ID NO: 6478721 - DNA, 20 bp, Homo sapiens
tgcttgaacccaggaggtgg

SEQ ID NO: 6478722 - DNA, 21 bp, Homo sapiens
tgcttgaacccaggaggtgga

SEQ ID NO: 6478723 - DNA, 19 bp, Homo sapiens
tgcttgaacctgtgaggaa

SEQ ID NO: 6478724 - DNA, 13 bp, Homo sapiens
tgcttgaagattc

SEQ ID NO: 6478725 - DNA, 16 bp, Homo sapiens
tgcttgaagattcagg

SEQ ID NO: 6478726 - DNA, 13 bp, Homo sapiens
tgcttgaaggaac

SEQ ID NO: 6478727 - DNA, 19 bp, Homo sapiens
tgcttgaaggaacagtgct

SEQ ID NO: 6478728 - DNA, 12 bp, Homo sapiens
tgcttgaataaa

SEQ ID NO: 6478729 - DNA, 16 bp, Homo sapiens
tgcttgacaaaggagc

SEQ ID NO: 6478730 - DNA, 20 bp, Homo sapiens
tgcttgacatacctaccagt

SEQ ID NO: 6478731 - DNA, 18 bp, Homo sapiens
tgcttgaccctgaaatat

SEQ ID NO: 6478732 - DNA, 19 bp, Homo sapiens
tgcttgaccgtactctcac

SEQ ID NO: 6478733 - DNA, 13 bp, Homo sapiens
tgcttgactctca

SEQ ID NO: 6478734 - DNA, 14 bp, Homo sapiens
tgcttgactttcca

SEQ ID NO: 6478735 - DNA, 17 bp, Homo sapiens
tgcttgactttccagaa

SEQ ID NO: 6478736 - DNA, 21 bp, Homo sapiens
tgcttgactttccagaatgac

SEQ ID NO: 6478737 - DNA, 16 bp, Homo sapiens
tgcttgagcaataaag

SEQ ID NO: 6478738 - DNA, 13 bp, Homo sapiens
tgcttgagcccag

SEQ ID NO: 6478739 - DNA, 18 bp, Homo sapiens
tgcttgagcccagaactt

SEQ ID NO: 6478740 - DNA, 16 bp, Homo sapiens
tgcttgagcccaggag

SEQ ID NO: 6478741 - DNA, 14 bp, Homo sapiens
tgcttgagctcagg

SEQ ID NO: 6478742 - DNA, 16 bp, Homo sapiens
tgcttgagctttctgt

SEQ ID NO: 6478743 - DNA, 20 bp, Homo sapiens
tgcttgaggaggggcacctg

SEQ ID NO: 6478744 - DNA, 21 bp, Homo sapiens
tgcttgaggcaactcatctta

SEQ ID NO: 6478745 - DNA, 13 bp, Homo sapiens
tgcttgagtggac

SEQ ID NO: 6478746 - DNA, 19 bp, Homo sapiens
tgcttgagtggacagcagc

SEQ ID NO: 6478747 - DNA, 21 bp, Homo sapiens
tgcttgagtggacagcagctg

SEQ ID NO: 6478748 - DNA, 15 bp, Homo sapiens
tgcttgataatatat

SEQ ID NO: 6478749 - DNA, 17 bp, Homo sapiens
tgcttgataatatataa

SEQ ID NO: 6478750 - DNA, 21 bp, Homo sapiens
tgcttgatataataattactt

SEQ ID NO: 6478751 - DNA, 16 bp, Homo sapiens
tgcttgatattttcta

SEQ ID NO: 6478752 - DNA, 13 bp, Homo sapiens
tgcttgatccaga

SEQ ID NO: 6478753 - DNA, 15 bp, Homo sapiens
tgcttgatccagaag

SEQ ID NO: 6478754 - DNA, 19 bp, Homo sapiens
tgcttgatgggattctgga

SEQ ID NO: 6478755 - DNA, 22 bp, Homo sapiens
tgcttgatgggattctggacag

SEQ ID NO: 6478756 - DNA, 14 bp, Homo sapiens
tgcttgatgttaca

SEQ ID NO: 6478757 - DNA, 14 bp, Homo sapiens
tgcttgattttgta

SEQ ID NO: 6478758 - DNA, 22 bp, Homo sapiens
tgcttgcaatctaatctgaact

SEQ ID NO: 6478759 - DNA, 15 bp, Homo sapiens
tgcttgcacacttcc

SEQ ID NO: 6478760 - DNA, 21 bp, Homo sapiens
tgcttgcacacttccccatct

SEQ ID NO: 6478761 - DNA, 15 bp, Homo sapiens
tgcttgcagccagga

SEQ ID NO: 6478762 - DNA, 16 bp, Homo sapiens
tgcttgcagccaggag

SEQ ID NO: 6478763 - DNA, 13 bp, Homo sapiens
tgcttgcaggagg

SEQ ID NO: 6478764 - DNA, 16 bp, Homo sapiens
tgcttgcagtagattt

SEQ ID NO: 6478765 - DNA, 16 bp, Homo sapiens
tgcttgcatcctattt

SEQ ID NO: 6478766 - DNA, 18 bp, Homo sapiens
tgcttgcatcctatttgg

SEQ ID NO: 6478767 - DNA, 18 bp, Homo sapiens
tgcttgcatctgcacata

SEQ ID NO: 6478768 - DNA, 19 bp, Homo sapiens
tgcttgcatggagaatggg

SEQ ID NO: 6478769 - DNA, 17 bp, Homo sapiens
tgcttgcatttctttat

SEQ ID NO: 6478770 - DNA, 18 bp, Homo sapiens
tgcttgccaaagtacaga

SEQ ID NO: 6478771 - DNA, 22 bp, Homo sapiens
tgcttgccaaggcagaggcctg

SEQ ID NO: 6478772 - DNA, 23 bp, Homo sapiens
tgcttgccaaggcagaggcctgg

SEQ ID NO: 6478773 - DNA, 17 bp, Homo sapiens
tgcttgccacagagcgg

SEQ ID NO: 6478774 - DNA, 16 bp, Homo sapiens
tgcttgccatccctcc

SEQ ID NO: 6478775 - DNA, 21 bp, Homo sapiens
tgcttgcccagggtgcagtgt

SEQ ID NO: 6478776 - DNA, 13 bp, Homo sapiens
tgcttgcccgctc

SEQ ID NO: 6478777 - DNA, 15 bp, Homo sapiens
tgcttgcccgctccc

SEQ ID NO: 6478778 - DNA, 18 bp, Homo sapiens
tgcttgccctaagcagaa

SEQ ID NO: 6478779 - DNA, 20 bp, Homo sapiens
tgcttgccctaagcagaaag

SEQ ID NO: 6478780 - DNA, 15 bp, Homo sapiens
tgcttgccctccaaa

SEQ ID NO: 6478781 - DNA, 21 bp, Homo sapiens
tgcttgccctccaaatgtcct

SEQ ID NO: 6478782 - DNA, 18 bp, Homo sapiens
tgcttgccgaaactggaa

SEQ ID NO: 6478783 - DNA, 23 bp, Homo sapiens
tgcttgccgactggctgtgagac

SEQ ID NO: 6478784 - DNA, 22 bp, Homo sapiens
tgcttgcctagggcctggtcca

SEQ ID NO: 6478785 - DNA, 15 bp, Homo sapiens
tgcttgcctctctgt

SEQ ID NO: 6478786 - DNA, 12 bp, Homo sapiens
tgcttgcctgaa

SEQ ID NO: 6478787 - DNA, 20 bp, Homo sapiens
tgcttgcctgcagggccatg

SEQ ID NO: 6478788 - DNA, 19 bp, Homo sapiens
tgcttgcctgcgttttgga

SEQ ID NO: 6478789 - DNA, 18 bp, Homo sapiens
tgcttgcggcaaaaggaa

SEQ ID NO: 6478790 - DNA, 20 bp, Homo sapiens
tgcttgctaatatttccaga

SEQ ID NO: 6478791 - DNA, 18 bp, Homo sapiens
tgcttgctgctgatttaa

SEQ ID NO: 6478792 - DNA, 14 bp, Homo sapiens
tgcttgctgtgtga

SEQ ID NO: 6478793 - DNA, 14 bp, Homo sapiens
tgcttgcttagagt

SEQ ID NO: 6478794 - DNA, 24 bp, Homo sapiens
tgcttgcttagagtgcccagcaga

SEQ ID NO: 6478795 - DNA, 13 bp, Homo sapiens
tgcttgcttgggg

SEQ ID NO: 6478796 - DNA, 14 bp, Homo sapiens
tgcttgctttatta

SEQ ID NO: 6478797 - DNA, 15 bp, Homo sapiens
tgcttgcttttgcct

SEQ ID NO: 6478798 - DNA, 22 bp, Homo sapiens
tgcttgcttttgcctctgccca

SEQ ID NO: 6478799 - DNA, 19 bp, Homo sapiens
tgcttggaaattccttgcc

SEQ ID NO: 6478800 - DNA, 20 bp, Homo sapiens
tgcttggaaattccttgccc

SEQ ID NO: 6478801 - DNA, 16 bp, Homo sapiens
tgcttggaagccaggt

SEQ ID NO: 6478802 - DNA, 21 bp, Homo sapiens
tgcttggaatatctgctgtat

SEQ ID NO: 6478803 - DNA, 20 bp, Homo sapiens
tgcttggacctcgtgcttta

SEQ ID NO: 6478804 - DNA, 14 bp, Homo sapiens
tgcttggaggaagg

SEQ ID NO: 6478805 - DNA, 14 bp, Homo sapiens
tgcttggaggcctc

SEQ ID NO: 6478806 - DNA, 15 bp, Homo sapiens
tgcttggaggcctca

SEQ ID NO: 6478807 - DNA, 17 bp, Homo sapiens
tgcttggaggcctcaga

SEQ ID NO: 6478808 - DNA, 14 bp, Homo sapiens
tgcttggaggggga

SEQ ID NO: 6478809 - DNA, 18 bp, Homo sapiens
tgcttggagtgccccaag

SEQ ID NO: 6478810 - DNA, 21 bp, Homo sapiens
tgcttggagtgccccaaggag

SEQ ID NO: 6478811 - DNA, 21 bp, Homo sapiens
tgcttggatccatacaaaact

SEQ ID NO: 6478812 - DNA, 22 bp, Homo sapiens
tgcttggcaatagttaagtcaa

SEQ ID NO: 6478813 - DNA, 12 bp, Homo sapiens
tgcttggccaga

SEQ ID NO: 6478814 - DNA, 13 bp, Homo sapiens
tgcttggcccagg

SEQ ID NO: 6478815 - DNA, 18 bp, Homo sapiens
tgcttggcccaggagttt

SEQ ID NO: 6478816 - DNA, 14 bp, Homo sapiens
tgcttggcccaggg

SEQ ID NO: 6478817 - DNA, 12 bp, Homo sapiens
tgcttggccctt

SEQ ID NO: 6478818 - DNA, 12 bp, Homo sapiens
tgcttggctgcc

SEQ ID NO: 6478819 - DNA, 15 bp, Homo sapiens
tgcttggctgcccca

SEQ ID NO: 6478820 - DNA, 19 bp, Homo sapiens
tgcttggctgcttggcctt

SEQ ID NO: 6478821 - DNA, 17 bp, Homo sapiens
tgcttggcttcccctcc

SEQ ID NO: 6478822 - DNA, 20 bp, Homo sapiens
tcttcttgcatctaatgaaa

SEQ ID NO: 6478823 - DNA, 17 bp, Homo sapiens
tcttcttgctgcagcct

SEQ ID NO: 6478824 - DNA, 13 bp, Homo sapiens
tcttcttgggccc

SEQ ID NO: 6478825 - DNA, 14 bp, Homo sapiens
tcttcttgtttctc

SEQ ID NO: 6478826 - DNA, 16 bp, Homo sapiens
tcttctttaagccata

SEQ ID NO: 6478827 - DNA, 21 bp, Homo sapiens
tcttctttaatttttctgttg

SEQ ID NO: 6478828 - DNA, 16 bp, Homo sapiens
tcttctttagatgcca

SEQ ID NO: 6478829 - DNA, 17 bp, Homo sapiens
tcttctttattattcct

SEQ ID NO: 6478830 - DNA, 18 bp, Homo sapiens
tcttctttattgcactag

SEQ ID NO: 6478831 - DNA, 20 bp, Homo sapiens
tcttctttattgcactagga

SEQ ID NO: 6478832 - DNA, 17 bp, Homo sapiens
tcttctttcagacttgc

SEQ ID NO: 6478833 - DNA, 23 bp, Homo sapiens
tcttctttcatctggggatgaca

SEQ ID NO: 6478834 - DNA, 15 bp, Homo sapiens
tcttctttcatgtaa

SEQ ID NO: 6478835 - DNA, 17 bp, Homo sapiens
tcttctttccacctttc

SEQ ID NO: 6478836 - DNA, 12 bp, Homo sapiens
tcttctttccca

SEQ ID NO: 6478837 - DNA, 15 bp, Homo sapiens
tcttctttccctgga

SEQ ID NO: 6478838 - DNA, 18 bp, Homo sapiens
tcttctttccctggacag

SEQ ID NO: 6478839 - DNA, 18 bp, Homo sapiens
tcttctttcctttactcc

SEQ ID NO: 6478840 - DNA, 17 bp, Homo sapiens
tcttctttctccatgga

SEQ ID NO: 6478841 - DNA, 22 bp, Homo sapiens
tcttctttctgaagatcaattt

SEQ ID NO: 6478842 - DNA, 14 bp, Homo sapiens
tcttctttctgaga

SEQ ID NO: 6478843 - DNA, 14 bp, Homo sapiens
tcttctttcttcca

SEQ ID NO: 6478844 - DNA, 13 bp, Homo sapiens
tcttctttctttc

SEQ ID NO: 6478845 - DNA, 19 bp, Homo sapiens
tcttctttgactataacaa

SEQ ID NO: 6478846 - DNA, 15 bp, Homo sapiens
tcttctttgatagtg

SEQ ID NO: 6478847 - DNA, 12 bp, Homo sapiens
tcttctttggaa

SEQ ID NO: 6478848 - DNA, 12 bp, Homo sapiens
tcttctttgtgc

SEQ ID NO: 6478849 - DNA, 17 bp, Homo sapiens
tcttctttgtgcctgag

SEQ ID NO: 6478850 - DNA, 16 bp, Homo sapiens
tcttctttgtgccttt

SEQ ID NO: 6478851 - DNA, 20 bp, Homo sapiens
tcttctttgtgcctttggcc

SEQ ID NO: 6478852 - DNA, 14 bp, Homo sapiens
tcttctttgtggtc

SEQ ID NO: 6478853 - DNA, 22 bp, Homo sapiens
tcttcttttaaaccattttctt

SEQ ID NO: 6478854 - DNA, 22 bp, Homo sapiens
tcttcttttgagcaactttctt

SEQ ID NO: 6478855 - DNA, 18 bp, Homo sapiens
tcttcttttggcttccat

SEQ ID NO: 6478856 - DNA, 14 bp, Homo sapiens
tcttcttttgggag

SEQ ID NO: 6478857 - DNA, 19 bp, Homo sapiens
tcttcttttgtggtgtctt

SEQ ID NO: 6478858 - DNA, 22 bp, Homo sapiens
tcttcttttgtggtgtcttcca

SEQ ID NO: 6478859 - DNA, 17 bp, Homo sapiens
tcttctttttgctgttg

SEQ ID NO: 6478860 - DNA, 19 bp, Homo sapiens
tcttctttttgcttcaaaa

SEQ ID NO: 6478861 - DNA, 15 bp, Homo sapiens
tcttcttttttatct

SEQ ID NO: 6478862 - DNA, 18 bp, Homo sapiens
tcttctttttttgtgatg

SEQ ID NO: 6478863 - DNA, 16 bp, Homo sapiens
tcttgaaaaaaaatag

SEQ ID NO: 6478864 - DNA, 18 bp, Homo sapiens
tcttgaaaaaaaatagat

SEQ ID NO: 6478865 - DNA, 18 bp, Homo sapiens
tcttgaaaaagtattgtt

SEQ ID NO: 6478866 - DNA, 22 bp, Homo sapiens
tcttgaaaactgggacgtgtat

SEQ ID NO: 6478867 - DNA, 16 bp, Homo sapiens
tcttgaaaagaatcta

SEQ ID NO: 6478868 - DNA, 13 bp, Homo sapiens
tcttgaaaagcct

SEQ ID NO: 6478869 - DNA, 15 bp, Homo sapiens
tcttgaaaagccttg

SEQ ID NO: 6478870 - DNA, 12 bp, Homo sapiens
tcttgaaaagtt

SEQ ID NO: 6478871 - DNA, 15 bp, Homo sapiens
tcttgaaaagttcag

SEQ ID NO: 6478872 - DNA, 17 bp, Homo sapiens
tcttgaaaagttcaggg

SEQ ID NO: 6478873 - DNA, 21 bp, Homo sapiens
tcttgaaaataagattccaga

SEQ ID NO: 6478874 - DNA, 17 bp, Homo sapiens
tcttgaaaatgccacca

SEQ ID NO: 6478875 - DNA, 18 bp, Homo sapiens
tcttgaaacctgatgtca

SEQ ID NO: 6478876 - DNA, 21 bp, Homo sapiens
tcttgaaacctgttaaaacaa

SEQ ID NO: 6478877 - DNA, 21 bp, Homo sapiens
tcttgaaatataggaacttaa

SEQ ID NO: 6478878 - DNA, 13 bp, Homo sapiens
tcttgaaatgaaa

SEQ ID NO: 6478879 - DNA, 14 bp, Homo sapiens
tcttgaaattaaga

SEQ ID NO: 6478880 - DNA, 14 bp, Homo sapiens
tcttgaaattgaag

SEQ ID NO: 6478881 - DNA, 15 bp, Homo sapiens
tcttgaaattgaaga

SEQ ID NO: 6478882 - DNA, 19 bp, Homo sapiens
tcttgaacattgtggacaa

SEQ ID NO: 6478883 - DNA, 22 bp, Homo sapiens
tcttgaaccccaaatgctctct

SEQ ID NO: 6478884 - DNA, 20 bp, Homo sapiens
tcttgaacgagcagcccagg

SEQ ID NO: 6478885 - DNA, 12 bp, Homo sapiens
tcttgaactcct

SEQ ID NO: 6478886 - DNA, 16 bp, Homo sapiens
tcttgaactcctgacc

SEQ ID NO: 6478887 - DNA, 17 bp, Homo sapiens
tcttgaactcctgacct

SEQ ID NO: 6478888 - DNA, 17 bp, Homo sapiens
tcttgaactgagcttgg

SEQ ID NO: 6478889 - DNA, 15 bp, Homo sapiens
tcttgaacttgaaaa

SEQ ID NO: 6478890 - DNA, 19 bp, Homo sapiens
tcttgaagaataaattcta

SEQ ID NO: 6478891 - DNA, 14 bp, Homo sapiens
tcttgaagaatatt

SEQ ID NO: 6478892 - DNA, 20 bp, Homo sapiens
tcttgaagagaaaaaagtca

SEQ ID NO: 6478893 - DNA, 21 bp, Homo sapiens
tcttgaagagaaaaaagtcac

SEQ ID NO: 6478894 - DNA, 22 bp, Homo sapiens
tcttgaagagaaaaaagtcacc

SEQ ID NO: 6478895 - DNA, 18 bp, Homo sapiens
tcttgaagctgggctgtc

SEQ ID NO: 6478896 - DNA, 17 bp, Homo sapiens
tcttgaaggaaaaattc

SEQ ID NO: 6478897 - DNA, 19 bp, Homo sapiens
tcttgaaggaaaaattcaa

SEQ ID NO: 6478898 - DNA, 13 bp, Homo sapiens
tcttgaaggtgct

SEQ ID NO: 6478899 - DNA, 22 bp, Homo sapiens
tcttgaaggtgctgccacccct

SEQ ID NO: 6478900 - DNA, 20 bp, Homo sapiens
tcttgaagtcagccacactg

SEQ ID NO: 6478901 - DNA, 22 bp, Homo sapiens
tcttgaagtcagccacactggg

SEQ ID NO: 6478902 - DNA, 18 bp, Homo sapiens
tcttgaagtcctggcttc

SEQ ID NO: 6478903 - DNA, 18 bp, Homo sapiens
tcttgaagtctgtacaga

SEQ ID NO: 6478904 - DNA, 16 bp, Homo sapiens
tcttgaagtgaaatct

SEQ ID NO: 6478905 - DNA, 11 bp, Homo sapiens
tcttgaataaa

SEQ ID NO: 6478906 - DNA, 22 bp, Homo sapiens
tcttgaataacttttttatatt

SEQ ID NO: 6478907 - DNA, 16 bp, Homo sapiens
tcttgaataatgtaag

SEQ ID NO: 6478908 - DNA, 18 bp, Homo sapiens
tcttgaatactctgccct

SEQ ID NO: 6478909 - DNA, 20 bp, Homo sapiens
tcttgaatactctgccctct

SEQ ID NO: 6478910 - DNA, 21 bp, Homo sapiens
tcttgaatagattttctctgg

SEQ ID NO: 6478911 - DNA, 23 bp, Homo sapiens
tcttgaatatgggcggaagtact

SEQ ID NO: 6478912 - DNA, 16 bp, Homo sapiens
tcttgaatccttccat

SEQ ID NO: 6478913 - DNA, 19 bp, Homo sapiens
tcttgaatgtggtctcagg

SEQ ID NO: 6478914 - DNA, 15 bp, Homo sapiens
tcttgaattattttg

SEQ ID NO: 6478915 - DNA, 17 bp, Homo sapiens
tcttgaattattttgca

SEQ ID NO: 6478916 - DNA, 14 bp, Homo sapiens
tcttgaattcctct

SEQ ID NO: 6478917 - DNA, 20 bp, Homo sapiens
tcttgaattcctctcaaatt

SEQ ID NO: 6478918 - DNA, 13 bp, Homo sapiens
tcttgaatttaat

SEQ ID NO: 6478919 - DNA, 14 bp, Homo sapiens
tcttgaatttttga

SEQ ID NO: 6478920 - DNA, 22 bp, Homo sapiens
tcttgacaagctgacttggcac

SEQ ID NO: 6478921 - DNA, 21 bp, Homo sapiens
tcttgacaccagctgttctgt

SEQ ID NO: 6478922 - DNA, 14 bp, Homo sapiens
tcttgacagcagga

SEQ ID NO: 6478923 - DNA, 16 bp, Homo sapiens
tcttgacatttatcac

SEQ ID NO: 6478924 - DNA, 13 bp, Homo sapiens
tcttgaccaacag

SEQ ID NO: 6478925 - DNA, 16 bp, Homo sapiens
tcttgacctctccagc

SEQ ID NO: 6478926 - DNA, 22 bp, Homo sapiens
tcttgacctctccagcatccca

SEQ ID NO: 6478927 - DNA, 20 bp, Homo sapiens
tcttgacctgaactctgcaa

SEQ ID NO: 6478928 - DNA, 23 bp, Homo sapiens
tcttgacgggagcattggcccct

SEQ ID NO: 6478929 - DNA, 13 bp, Homo sapiens
tcttgactattgg

SEQ ID NO: 6478930 - DNA, 14 bp, Homo sapiens
tcttgactcaggtg

SEQ ID NO: 6478931 - DNA, 21 bp, Homo sapiens
tcttgactcaggtggtgtcct

SEQ ID NO: 6478932 - DNA, 21 bp, Homo sapiens
tcttgactctaaatgcagttt

SEQ ID NO: 6478933 - DNA, 23 bp, Homo sapiens
tcttgactgtcttccctctctat

SEQ ID NO: 6478934 - DNA, 13 bp, Homo sapiens
tcttgactttctg

SEQ ID NO: 6478935 - DNA, 15 bp, Homo sapiens
tcttgactttctgat

SEQ ID NO: 6478936 - DNA, 20 bp, Homo sapiens
tcttgagaccagcctgccag

SEQ ID NO: 6478937 - DNA, 17 bp, Homo sapiens
tcttgagagaaaagaaa

SEQ ID NO: 6478938 - DNA, 18 bp, Homo sapiens
tcttgagagaaaagaaaa

SEQ ID NO: 6478939 - DNA, 21 bp, Homo sapiens
tcttgagagaaaagaaaaata

SEQ ID NO: 6478940 - DNA, 17 bp, Homo sapiens
tcttgagagctcaggca

SEQ ID NO: 6478941 - DNA, 19 bp, Homo sapiens
tcttgagagctcaggcagc

SEQ ID NO: 6478942 - DNA, 21 bp, Homo sapiens
tcttgagaggagacttgtgaa

SEQ ID NO: 6478943 - DNA, 22 bp, Homo sapiens
tcttgagatgtattatgcaaag

SEQ ID NO: 6478944 - DNA, 22 bp, Homo sapiens
tcttgagcaaggcaagaagtgg

SEQ ID NO: 6478945 - DNA, 17 bp, Homo sapiens
tcttgagcaagttcctt

SEQ ID NO: 6478946 - DNA, 15 bp, Homo sapiens
tcttgagcaatgttt

SEQ ID NO: 6478947 - DNA, 23 bp, Homo sapiens
tcttgagcagctgaattggctgc

SEQ ID NO: 6478948 - DNA, 14 bp, Homo sapiens
tcttgagcagtggc

SEQ ID NO: 6478949 - DNA, 17 bp, Homo sapiens
tcttgagccacagtcac

SEQ ID NO: 6478950 - DNA, 16 bp, Homo sapiens
tcttgagccagccagg

SEQ ID NO: 6478951 - DNA, 18 bp, Homo sapiens
tcttgagccttgaacttt

SEQ ID NO: 6478952 - DNA, 23 bp, Homo sapiens
tcttgagctagaccaaggtcaga

SEQ ID NO: 6478953 - DNA, 12 bp, Homo sapiens
tcttgagctggc

SEQ ID NO: 6478954 - DNA, 14 bp, Homo sapiens
tcttgagctggcct

SEQ ID NO: 6478955 - DNA, 16 bp, Homo sapiens
tcttgaggaaaatatt

SEQ ID NO: 6478956 - DNA, 21 bp, Homo sapiens
tcttgaggaataaatgccttt

SEQ ID NO: 6478957 - DNA, 14 bp, Homo sapiens
tcttgagggacaat

SEQ ID NO: 6478958 - DNA, 18 bp, Homo sapiens
tcttgaggggaccaggag

SEQ ID NO: 6478959 - DNA, 20 bp, Homo sapiens
tcttgaggtactctgcacat

SEQ ID NO: 6478960 - DNA, 18 bp, Homo sapiens
tcttgaggtaggagaggc

SEQ ID NO: 6478961 - DNA, 15 bp, Homo sapiens
tcttgaggtctcttt

SEQ ID NO: 6478962 - DNA, 19 bp, Homo sapiens
tcttgaggtctcttttctc

SEQ ID NO: 6478963 - DNA, 20 bp, Homo sapiens
tcttgaggtctcttttctct

SEQ ID NO: 6478964 - DNA, 22 bp, Homo sapiens
tcttgaggtctcttttctctac

SEQ ID NO: 6478965 - DNA, 18 bp, Homo sapiens
tcttgagtactagaattt

SEQ ID NO: 6478966 - DNA, 18 bp, Homo sapiens
tcttgagtagatctgctt

SEQ ID NO: 6478967 - DNA, 20 bp, Homo sapiens
tcttgagtataagaaatgca

SEQ ID NO: 6478968 - DNA, 17 bp, Homo sapiens
tcttgagtgggccccct

SEQ ID NO: 6478969 - DNA, 14 bp, Homo sapiens
tcttgagtgtctat

SEQ ID NO: 6478970 - DNA, 20 bp, Homo sapiens
tcttgagttgtttttgtata

SEQ ID NO: 6478971 - DNA, 21 bp, Homo sapiens
tcttgagttgtttttgtatat

SEQ ID NO: 6478972 - DNA, 21 bp, Homo sapiens
tcttgagtttgtcgctcatgt

SEQ ID NO: 6478973 - DNA, 15 bp, Homo sapiens
tcttgataaagtgga

SEQ ID NO: 6478974 - DNA, 20 bp, Homo sapiens
tcttgataaatgactgtttt

SEQ ID NO: 6478975 - DNA, 21 bp, Homo sapiens
tcttgataattgtgtagtaat

SEQ ID NO: 6478976 - DNA, 14 bp, Homo sapiens
tcttgatacattca

SEQ ID NO: 6478977 - DNA, 18 bp, Homo sapiens
tcttgatacattcaaatt

SEQ ID NO: 6478978 - DNA, 21 bp, Homo sapiens
tcttgatacccccctctgtct

SEQ ID NO: 6478979 - DNA, 22 bp, Homo sapiens
tcttgatacccccctctgtctt

SEQ ID NO: 6478980 - DNA, 16 bp, Homo sapiens
tcttgatcagttaaga

SEQ ID NO: 6478981 - DNA, 16 bp, Homo sapiens
tcttgatcattccggt

SEQ ID NO: 6478982 - DNA, 16 bp, Homo sapiens
tcttgatcctccaatg

SEQ ID NO: 6478983 - DNA, 21 bp, Homo sapiens
tcttgatcctccaatgtctaa

SEQ ID NO: 6478984 - DNA, 22 bp, Homo sapiens
tcttgatctagatacaggactg

SEQ ID NO: 6478985 - DNA, 16 bp, Homo sapiens
tcttgatctcctgagc

SEQ ID NO: 6478986 - DNA, 14 bp, Homo sapiens
tcttgatctctaat

SEQ ID NO: 6478987 - DNA, 16 bp, Homo sapiens
tcttgatctctaatga

SEQ ID NO: 6478988 - DNA, 19 bp, Homo sapiens
tcttgatctctcttgtcct

SEQ ID NO: 6478989 - DNA, 17 bp, Homo sapiens
tcttgatctgctcagcc

SEQ ID NO: 6478990 - DNA, 23 bp, Homo sapiens
tcttgatctgctcagccctggag

SEQ ID NO: 6478991 - DNA, 22 bp, Homo sapiens
tcttgatgaaaagctttgtttg

SEQ ID NO: 6478992 - DNA, 15 bp, Homo sapiens
tcttgatgactgctg

SEQ ID NO: 6478993 - DNA, 16 bp, Homo sapiens
tcttgatgactggaat

SEQ ID NO: 6478994 - DNA, 19 bp, Homo sapiens
tcttgatgactggaatttt

SEQ ID NO: 6478995 - DNA, 14 bp, Homo sapiens
tcttgatgtaaaat

SEQ ID NO: 6478996 - DNA, 15 bp, Homo sapiens
tcttgatgtaaaatc

SEQ ID NO: 6478997 - DNA, 19 bp, Homo sapiens
tcttgatgtaaaatcttgt

SEQ ID NO: 6478998 - DNA, 22 bp, Homo sapiens
tcttgatgtaaaatcttgtcat

SEQ ID NO: 6478999 - DNA, 16 bp, Homo sapiens
tcttgatgtgaagata

SEQ ID NO: 6479000 - DNA, 18 bp, Homo sapiens
tgcttgggaccagaagtg

SEQ ID NO: 6479001 - DNA, 21 bp, Homo sapiens
tgcttgggacgtgtacagcac

SEQ ID NO: 6479002 - DNA, 22 bp, Homo sapiens
tgcttgggagcctgtggccagc

SEQ ID NO: 6479003 - DNA, 23 bp, Homo sapiens
tgcttgggagcctgtggccagca

SEQ ID NO: 6479004 - DNA, 18 bp, Homo sapiens
tgcttgggccactgccct

SEQ ID NO: 6479005 - DNA, 16 bp, Homo sapiens
tgcttgggccctgcat

SEQ ID NO: 6479006 - DNA, 12 bp, Homo sapiens
tgcttgggctga

SEQ ID NO: 6479007 - DNA, 16 bp, Homo sapiens
tgcttgggcttcatcc

SEQ ID NO: 6479008 - DNA, 19 bp, Homo sapiens
tgcttgggcttcatcctcc

SEQ ID NO: 6479009 - DNA, 22 bp, Homo sapiens
tgcttggggaatgttgttttct

SEQ ID NO: 6479010 - DNA, 13 bp, Homo sapiens
tgcttggggcctg

SEQ ID NO: 6479011 - DNA, 12 bp, Homo sapiens
tgcttggggcta

SEQ ID NO: 6479012 - DNA, 19 bp, Homo sapiens
tgcttgggggtttttgaag

SEQ ID NO: 6479013 - DNA, 20 bp, Homo sapiens
tgcttgggtcctactcctgg

SEQ ID NO: 6479014 - DNA, 13 bp, Homo sapiens
tgcttgggtctct

SEQ ID NO: 6479015 - DNA, 16 bp, Homo sapiens
tgcttgggtctctctc

SEQ ID NO: 6479016 - DNA, 20 bp, Homo sapiens
tgcttgggtctctctccatt

SEQ ID NO: 6479017 - DNA, 15 bp, Homo sapiens
tgcttgggtggagaa

SEQ ID NO: 6479018 - DNA, 14 bp, Homo sapiens
tgcttgggttcctt

SEQ ID NO: 6479019 - DNA, 16 bp, Homo sapiens
tgcttggtctgtttga

SEQ ID NO: 6479020 - DNA, 17 bp, Homo sapiens
tgcttggtgctggttta

SEQ ID NO: 6479021 - DNA, 19 bp, Homo sapiens
tgcttggtggggctcgtgg

SEQ ID NO: 6479022 - DNA, 15 bp, Homo sapiens
tgcttgtaaaaccaa

SEQ ID NO: 6479023 - DNA, 21 bp, Homo sapiens
tgcttgtaatcaagcctttat

SEQ ID NO: 6479024 - DNA, 22 bp, Homo sapiens
tgcttgtacactcattcattac

SEQ ID NO: 6479025 - DNA, 18 bp, Homo sapiens
tgcttgtacagtgtcaga

SEQ ID NO: 6479026 - DNA, 16 bp, Homo sapiens
tgcttgtacataatgc

SEQ ID NO: 6479027 - DNA, 22 bp, Homo sapiens
tgcttgtacataatgcgtgcat

SEQ ID NO: 6479028 - DNA, 12 bp, Homo sapiens
tgcttgtacctc

SEQ ID NO: 6479029 - DNA, 18 bp, Homo sapiens
tgcttgtactaagccagg

SEQ ID NO: 6479030 - DNA, 16 bp, Homo sapiens
tgcttgtactgggaca

SEQ ID NO: 6479031 - DNA, 13 bp, Homo sapiens
tgcttgtagaagt

SEQ ID NO: 6479032 - DNA, 21 bp, Homo sapiens
tgcttgtagttgaataaaaat

SEQ ID NO: 6479033 - DNA, 15 bp, Homo sapiens
tgcttgtataggttt

SEQ ID NO: 6479034 - DNA, 14 bp, Homo sapiens
tgcttgtattgtaa

SEQ ID NO: 6479035 - DNA, 19 bp, Homo sapiens
tgcttgtattgtaaatgtg

SEQ ID NO: 6479036 - DNA, 19 bp, Homo sapiens
tgcttgtattttttaatgc

SEQ ID NO: 6479037 - DNA, 14 bp, Homo sapiens
tgcttgtcatccac

SEQ ID NO: 6479038 - DNA, 17 bp, Homo sapiens
tgcttgtcattctgcta

SEQ ID NO: 6479039 - DNA, 15 bp, Homo sapiens
tgcttgtcattgact

SEQ ID NO: 6479040 - DNA, 14 bp, Homo sapiens
tgcttgtcctgctc

SEQ ID NO: 6479041 - DNA, 18 bp, Homo sapiens
tgcttgtcctgctctctt

SEQ ID NO: 6479042 - DNA, 16 bp, Homo sapiens
tgcttgtcctgggcct

SEQ ID NO: 6479043 - DNA, 21 bp, Homo sapiens
tgcttgtcgctttctcagtgt

SEQ ID NO: 6479044 - DNA, 16 bp, Homo sapiens
tgcttgtgaaaatgtg

SEQ ID NO: 6479045 - DNA, 20 bp, Homo sapiens
tgcttgtgaaaatgtgttct

SEQ ID NO: 6479046 - DNA, 18 bp, Homo sapiens
tgcttgtgaaaggaaaga

SEQ ID NO: 6479047 - DNA, 19 bp, Homo sapiens
tgcttgtgcctacctggcc

SEQ ID NO: 6479048 - DNA, 22 bp, Homo sapiens
tgcttgtgcctcccttcccagt

SEQ ID NO: 6479049 - DNA, 19 bp, Homo sapiens
tgcttgtgctcatgtgtgt

SEQ ID NO: 6479050 - DNA, 15 bp, Homo sapiens
tgcttgtgtgtatgt

SEQ ID NO: 6479051 - DNA, 18 bp, Homo sapiens
tgcttgtgtgtatgtcta

SEQ ID NO: 6479052 - DNA, 12 bp, Homo sapiens
tgcttgtgttaa

SEQ ID NO: 6479053 - DNA, 22 bp, Homo sapiens
tgcttgtgttgggccccaggga

SEQ ID NO: 6479054 - DNA, 12 bp, Homo sapiens
tgcttgttacat

SEQ ID NO: 6479055 - DNA, 17 bp, Homo sapiens
tgcttgttagagagaaa

SEQ ID NO: 6479056 - DNA, 14 bp, Homo sapiens
tgcttgttcttcct

SEQ ID NO: 6479057 - DNA, 23 bp, Homo sapiens
tgcttgttgggattcctgaccca

SEQ ID NO: 6479058 - DNA, 14 bp, Homo sapiens
tgcttgtttcctag

SEQ ID NO: 6479059 - DNA, 13 bp, Homo sapiens
tgcttgtttcttg

SEQ ID NO: 6479060 - DNA, 23 bp, Homo sapiens
tgcttgtttgctcacctggggtg

SEQ ID NO: 6479061 - DNA, 12 bp, Homo sapiens
tgcttgttttat

SEQ ID NO: 6479062 - DNA, 23 bp, Homo sapiens
tgctttaaaaactatttaacttg

SEQ ID NO: 6479063 - DNA, 12 bp, Homo sapiens
tgctttaaaaca

SEQ ID NO: 6479064 - DNA, 22 bp, Homo sapiens
tgctttaaagagtcctccttcc

SEQ ID NO: 6479065 - DNA, 16 bp, Homo sapiens
tgctttaaagataaaa

SEQ ID NO: 6479066 - DNA, 19 bp, Homo sapiens
tgctttaaagggcctgcct

SEQ ID NO: 6479067 - DNA, 20 bp, Homo sapiens
tgctttaaagggcctgcctg

SEQ ID NO: 6479068 - DNA, 17 bp, Homo sapiens
tgctttaaagtacctgt

SEQ ID NO: 6479069 - DNA, 15 bp, Homo sapiens
tgctttaaagtgtaa

SEQ ID NO: 6479070 - DNA, 20 bp, Homo sapiens
tgctttaaatagatttcagc

SEQ ID NO: 6479071 - DNA, 13 bp, Homo sapiens
tgctttaaatagt

SEQ ID NO: 6479072 - DNA, 13 bp, Homo sapiens
tgctttaaattaa

SEQ ID NO: 6479073 - DNA, 13 bp, Homo sapiens
tgctttaacagtg

SEQ ID NO: 6479074 - DNA, 16 bp, Homo sapiens
tgctttaacttttaaa

SEQ ID NO: 6479075 - DNA, 23 bp, Homo sapiens
tgctttaatatagctatcatttc

SEQ ID NO: 6479076 - DNA, 22 bp, Homo sapiens
tgctttaatgagtgcacctgcc

SEQ ID NO: 6479077 - DNA, 23 bp, Homo sapiens
tgctttaatgagtgcacctgcct

SEQ ID NO: 6479078 - DNA, 15 bp, Homo sapiens
tgctttaattaatta

SEQ ID NO: 6479079 - DNA, 20 bp, Homo sapiens
tgctttaattaattaagtat

SEQ ID NO: 6479080 - DNA, 20 bp, Homo sapiens
tgctttaattgtgaattgat

SEQ ID NO: 6479081 - DNA, 14 bp, Homo sapiens
tgctttaattttag

SEQ ID NO: 6479082 - DNA, 20 bp, Homo sapiens
tgctttacaacttgaatgct

SEQ ID NO: 6479083 - DNA, 13 bp, Homo sapiens
tgctttacaggat

SEQ ID NO: 6479084 - DNA, 23 bp, Homo sapiens
tgctttacaggatcatgtaaatg

SEQ ID NO: 6479085 - DNA, 19 bp, Homo sapiens
tgctttacagtcaatagtg

SEQ ID NO: 6479086 - DNA, 22 bp, Homo sapiens
tgctttaccaaacagcaaacca

SEQ ID NO: 6479087 - DNA, 13 bp, Homo sapiens
tgctttaccttta

SEQ ID NO: 6479088 - DNA, 21 bp, Homo sapiens
tgctttacctttaaaatcatt

SEQ ID NO: 6479089 - DNA, 14 bp, Homo sapiens
tgctttactgtcaa

SEQ ID NO: 6479090 - DNA, 16 bp, Homo sapiens
tgctttagacttgaaa

SEQ ID NO: 6479091 - DNA, 22 bp, Homo sapiens
tgctttagatgtgtatacagaa

SEQ ID NO: 6479092 - DNA, 18 bp, Homo sapiens
tgctttaggattgaagtg

SEQ ID NO: 6479093 - DNA, 20 bp, Homo sapiens
tgctttagtacaatagtata

SEQ ID NO: 6479094 - DNA, 12 bp, Homo sapiens
tgctttataaaa

SEQ ID NO: 6479095 - DNA, 20 bp, Homo sapiens
tgctttataccccatttgat

SEQ ID NO: 6479096 - DNA, 17 bp, Homo sapiens
tgctttatcagaagcaa

SEQ ID NO: 6479097 - DNA, 16 bp, Homo sapiens
tgctttatccacattg

SEQ ID NO: 6479098 - DNA, 21 bp, Homo sapiens
tgctttatccacattgtagcc

SEQ ID NO: 6479099 - DNA, 17 bp, Homo sapiens
tgctttatgctgaaaca

SEQ ID NO: 6479100 - DNA, 20 bp, Homo sapiens
tgctttattaatgttttcaa

SEQ ID NO: 6479101 - DNA, 14 bp, Homo sapiens
tgctttattgaatt

SEQ ID NO: 6479102 - DNA, 17 bp, Homo sapiens
tgctttattgcctctgt

SEQ ID NO: 6479103 - DNA, 18 bp, Homo sapiens
tgctttatttatggctta

SEQ ID NO: 6479104 - DNA, 13 bp, Homo sapiens
tgctttatttgta

SEQ ID NO: 6479105 - DNA, 14 bp, Homo sapiens
tgctttatttgtaa

SEQ ID NO: 6479106 - DNA, 15 bp, Homo sapiens
tgctttatttgtaaa

SEQ ID NO: 6479107 - DNA, 16 bp, Homo sapiens
tgctttatttgtaaat

SEQ ID NO: 6479108 - DNA, 13 bp, Homo sapiens
tgctttattttag

SEQ ID NO: 6479109 - DNA, 14 bp, Homo sapiens
tgctttatttttca

SEQ ID NO: 6479110 - DNA, 18 bp, Homo sapiens
tgctttatttttcattac

SEQ ID NO: 6479111 - DNA, 23 bp, Homo sapiens
tgctttcaagatctaaatcatat

SEQ ID NO: 6479112 - DNA, 12 bp, Homo sapiens
tgctttcaattg

SEQ ID NO: 6479113 - DNA, 11 bp, Homo sapiens
tgctttcacat

SEQ ID NO: 6479114 - DNA, 12 bp, Homo sapiens
tgctttcagata

SEQ ID NO: 6479115 - DNA, 21 bp, Homo sapiens
tgctttcagatactggattgt

SEQ ID NO: 6479116 - DNA, 13 bp, Homo sapiens
tgctttcaggtct

SEQ ID NO: 6479117 - DNA, 16 bp, Homo sapiens
tgctttcagtgcctgc

SEQ ID NO: 6479118 - DNA, 20 bp, Homo sapiens
tgctttcagtgcctgctgtt

SEQ ID NO: 6479119 - DNA, 17 bp, Homo sapiens
tgctttcatgtttaaga

SEQ ID NO: 6479120 - DNA, 20 bp, Homo sapiens
tgctttcatgtttaagaaat

SEQ ID NO: 6479121 - DNA, 12 bp, Homo sapiens
tgctttccagct

SEQ ID NO: 6479122 - DNA, 13 bp, Homo sapiens
tgctttccagctc

SEQ ID NO: 6479123 - DNA, 14 bp, Homo sapiens
tgctttccagctca

SEQ ID NO: 6479124 - DNA, 20 bp, Homo sapiens
tgctttccattcgtgaaaac

SEQ ID NO: 6479125 - DNA, 21 bp, Homo sapiens
tgctttccattcgtgaaaaca

SEQ ID NO: 6479126 - DNA, 19 bp, Homo sapiens
tgctttcccaccagcatgt

SEQ ID NO: 6479127 - DNA, 16 bp, Homo sapiens
tgctttccctccccaa

SEQ ID NO: 6479128 - DNA, 22 bp, Homo sapiens
tgctttcctaaagtctctgctg

SEQ ID NO: 6479129 - DNA, 18 bp, Homo sapiens
tgctttcctctgagattc

SEQ ID NO: 6479130 - DNA, 20 bp, Homo sapiens
tgctttcctctgagattcta

SEQ ID NO: 6479131 - DNA, 18 bp, Homo sapiens
tgctttcctcttactttc

SEQ ID NO: 6479132 - DNA, 23 bp, Homo sapiens
tgctttcctcttactttcagttt

SEQ ID NO: 6479133 - DNA, 14 bp, Homo sapiens
tgctttcctgcctc

SEQ ID NO: 6479134 - DNA, 14 bp, Homo sapiens
tgctttcctgggcc

SEQ ID NO: 6479135 - DNA, 15 bp, Homo sapiens
tgctttcctgggcct

SEQ ID NO: 6479136 - DNA, 15 bp, Homo sapiens
tgctttccttcatct

SEQ ID NO: 6479137 - DNA, 18 bp, Homo sapiens
tgctttcgaactgctagt

SEQ ID NO: 6479138 - DNA, 21 bp, Homo sapiens
tgctttcggagctcctgtcca

SEQ ID NO: 6479139 - DNA, 18 bp, Homo sapiens
tgctttcgtagcccctgc

SEQ ID NO: 6479140 - DNA, 20 bp, Homo sapiens
tgctttcgtctccagcccct

SEQ ID NO: 6479141 - DNA, 14 bp, Homo sapiens
tgctttctagcaaa

SEQ ID NO: 6479142 - DNA, 12 bp, Homo sapiens
tgctttctattg

SEQ ID NO: 6479143 - DNA, 18 bp, Homo sapiens
tgctttctattgtacaga

SEQ ID NO: 6479144 - DNA, 12 bp, Homo sapiens
tgctttctccat

SEQ ID NO: 6479145 - DNA, 22 bp, Homo sapiens
tgctttctcctttaattgtaaa

SEQ ID NO: 6479146 - DNA, 18 bp, Homo sapiens
tgctttctctctcatgcc

SEQ ID NO: 6479147 - DNA, 16 bp, Homo sapiens
tgctttctctttcagt

SEQ ID NO: 6479148 - DNA, 14 bp, Homo sapiens
tgctttctgaaatt

SEQ ID NO: 6479149 - DNA, 14 bp, Homo sapiens
tgctttctgaactc

SEQ ID NO: 6479150 - DNA, 15 bp, Homo sapiens
tgctttctgaagctt

SEQ ID NO: 6479151 - DNA, 20 bp, Homo sapiens
tgctttctgaagctttacca

SEQ ID NO: 6479152 - DNA, 12 bp, Homo sapiens
tgctttctgaat

SEQ ID NO: 6479153 - DNA, 13 bp, Homo sapiens
tgctttctgaatt

SEQ ID NO: 6479154 - DNA, 14 bp, Homo sapiens
tgctttctgaattg

SEQ ID NO: 6479155 - DNA, 12 bp, Homo sapiens
tgctttctgata

SEQ ID NO: 6479156 - DNA, 16 bp, Homo sapiens
tgctttctgatacatc

SEQ ID NO: 6479157 - DNA, 19 bp, Homo sapiens
tgctttctgcctctcctcc

SEQ ID NO: 6479158 - DNA, 12 bp, Homo sapiens
tgctttctgctc

SEQ ID NO: 6479159 - DNA, 20 bp, Homo sapiens
tgctttctgctcagcttctc

SEQ ID NO: 6479160 - DNA, 18 bp, Homo sapiens
tgctttctgtgaaagcct

SEQ ID NO: 6479161 - DNA, 19 bp, Homo sapiens
tgctttctgtgaaagcctt

SEQ ID NO: 6479162 - DNA, 13 bp, Homo sapiens
tgctttctgtgga

SEQ ID NO: 6479163 - DNA, 18 bp, Homo sapiens
tgctttctgttcatctct

SEQ ID NO: 6479164 - DNA, 23 bp, Homo sapiens
tgctttctgttgtcattgctgtt

SEQ ID NO: 6479165 - DNA, 14 bp, Homo sapiens
tgctttcttaccta

SEQ ID NO: 6479166 - DNA, 18 bp, Homo sapiens
tgctttcttcctgcatag

SEQ ID NO: 6479167 - DNA, 18 bp, Homo sapiens
tgctttcttctcctgtga

SEQ ID NO: 6479168 - DNA, 14 bp, Homo sapiens
tgctttcttctctg

SEQ ID NO: 6479169 - DNA, 16 bp, Homo sapiens
tgctttcttctctgcc

SEQ ID NO: 6479170 - DNA, 15 bp, Homo sapiens
tgctttctttcgttt

SEQ ID NO: 6479171 - DNA, 11 bp, Homo sapiens
tgctttgaaaa

SEQ ID NO: 6479172 - DNA, 22 bp, Homo sapiens
tgctttgaaaaagttaatgctt

SEQ ID NO: 6479173 - DNA, 12 bp, Homo sapiens
tgctttgaaaat

SEQ ID NO: 6479174 - DNA, 14 bp, Homo sapiens
tgctttgaagcagt

SEQ ID NO: 6479175 - DNA, 22 bp, Homo sapiens
tgctttgaagcagttgtgtcag

SEQ ID NO: 6479176 - DNA, 20 bp, Homo sapiens
tgctttgaagtagctctttt

SEQ ID NO: 6479177 - DNA, 18 bp, Homo sapiens
tgctttgaatgcatgtgt

SEQ ID NO: 6479178 - DNA, 18 bp, Homo sapiens
tgctttgacgggccaggc

SEQ ID NO: 6479179 - DNA, 21 bp, Homo sapiens
tgctttgagaccagaagaaaa

SEQ ID NO: 6479180 - DNA, 13 bp, Homo sapiens
tcttgatgtttag

SEQ ID NO: 6479181 - DNA, 17 bp, Homo sapiens
tcttgattaatgtactt

SEQ ID NO: 6479182 - DNA, 23 bp, Homo sapiens
tcttgattataaatgtttggaaa

SEQ ID NO: 6479183 - DNA, 17 bp, Homo sapiens
tcttgattcctggctct

SEQ ID NO: 6479184 - DNA, 20 bp, Homo sapiens
tcttgatttgttttagaatg

SEQ ID NO: 6479185 - DNA, 15 bp, Homo sapiens
tcttgatttttacat

SEQ ID NO: 6479186 - DNA, 13 bp, Homo sapiens
tcttgcaaaacaa

SEQ ID NO: 6479187 - DNA, 18 bp, Homo sapiens
tcttgcaaagcctttaaa

SEQ ID NO: 6479188 - DNA, 14 bp, Homo sapiens
tcttgcaacttcag

SEQ ID NO: 6479189 - DNA, 22 bp, Homo sapiens
tcttgcaagctccagtagctcc

SEQ ID NO: 6479190 - DNA, 13 bp, Homo sapiens
tcttgcaatggca

SEQ ID NO: 6479191 - DNA, 19 bp, Homo sapiens
tcttgcaatggcagccttg

SEQ ID NO: 6479192 - DNA, 16 bp, Homo sapiens
tcttgcaccaaattat

SEQ ID NO: 6479193 - DNA, 21 bp, Homo sapiens
tcttgcaccaaattatcttga

SEQ ID NO: 6479194 - DNA, 14 bp, Homo sapiens
tcttgcacccgcct

SEQ ID NO: 6479195 - DNA, 14 bp, Homo sapiens
tcttgcactgaggt

SEQ ID NO: 6479196 - DNA, 15 bp, Homo sapiens
tcttgcactgtccag

SEQ ID NO: 6479197 - DNA, 16 bp, Homo sapiens
tcttgcactgtccagc

SEQ ID NO: 6479198 - DNA, 17 bp, Homo sapiens
tcttgcagcatttacta

SEQ ID NO: 6479199 - DNA, 22 bp, Homo sapiens
tcttgcagcatttactatgcac

SEQ ID NO: 6479200 - DNA, 13 bp, Homo sapiens
tcttgcagtgatt

SEQ ID NO: 6479201 - DNA, 23 bp, Homo sapiens
tcttgcagtggacggagagcctt

SEQ ID NO: 6479202 - DNA, 18 bp, Homo sapiens
tcttgcataagcctcagg

SEQ ID NO: 6479203 - DNA, 21 bp, Homo sapiens
tcttgcataagcctcaggcct

SEQ ID NO: 6479204 - DNA, 16 bp, Homo sapiens
tcttgcatccttccta

SEQ ID NO: 6479205 - DNA, 18 bp, Homo sapiens
tcttgcatccttcctata

SEQ ID NO: 6479206 - DNA, 22 bp, Homo sapiens
tcttgcatccttcctataactt

SEQ ID NO: 6479207 - DNA, 15 bp, Homo sapiens
tcttgcatggatttg

SEQ ID NO: 6479208 - DNA, 20 bp, Homo sapiens
tcttgcatggtttggagctg

SEQ ID NO: 6479209 - DNA, 19 bp, Homo sapiens
tcttgcattgtgacaagaa

SEQ ID NO: 6479210 - DNA, 14 bp, Homo sapiens
tcttgcatttcact

SEQ ID NO: 6479211 - DNA, 21 bp, Homo sapiens
tcttgccaaaaagcacaagat

SEQ ID NO: 6479212 - DNA, 23 bp, Homo sapiens
tcttgccaacctgtaataaatat

SEQ ID NO: 6479213 - DNA, 14 bp, Homo sapiens
tcttgccacatctt

SEQ ID NO: 6479214 - DNA, 18 bp, Homo sapiens
tcttgccacatcttgaaa

SEQ ID NO: 6479215 - DNA, 18 bp, Homo sapiens
tcttgccacatttctgat

SEQ ID NO: 6479216 - DNA, 14 bp, Homo sapiens
tcttgccaccctct

SEQ ID NO: 6479217 - DNA, 18 bp, Homo sapiens
tcttgccaccctctggga

SEQ ID NO: 6479218 - DNA, 16 bp, Homo sapiens
tcttgccactgcctct

SEQ ID NO: 6479219 - DNA, 17 bp, Homo sapiens
tcttgccactgcctctt

SEQ ID NO: 6479220 - DNA, 16 bp, Homo sapiens
tcttgccactgtactc

SEQ ID NO: 6479221 - DNA, 11 bp, Homo sapiens
tcttgccagcc

SEQ ID NO: 6479222 - DNA, 12 bp, Homo sapiens
tcttgccagcca

SEQ ID NO: 6479223 - DNA, 15 bp, Homo sapiens
tcttgccagccagaa

SEQ ID NO: 6479224 - DNA, 20 bp, Homo sapiens
tcttgccagccagaagcctc

SEQ ID NO: 6479225 - DNA, 18 bp, Homo sapiens
tcttgccagcctcaggct

SEQ ID NO: 6479226 - DNA, 16 bp, Homo sapiens
tcttgccagcctcctt

SEQ ID NO: 6479227 - DNA, 23 bp, Homo sapiens
tcttgccagcctccttgctgacc

SEQ ID NO: 6479228 - DNA, 11 bp, Homo sapiens
tcttgccagct

SEQ ID NO: 6479229 - DNA, 12 bp, Homo sapiens
tcttgccagctc

SEQ ID NO: 6479230 - DNA, 16 bp, Homo sapiens
tcttgccatcctgatg

SEQ ID NO: 6479231 - DNA, 18 bp, Homo sapiens
tcttgcccatcctgactg

SEQ ID NO: 6479232 - DNA, 23 bp, Homo sapiens
tcttgccccaacccccagcaccc

SEQ ID NO: 6479233 - DNA, 17 bp, Homo sapiens
tcttgccccactccctg

SEQ ID NO: 6479234 - DNA, 20 bp, Homo sapiens
tcttgccccagtttggggtg

SEQ ID NO: 6479235 - DNA, 14 bp, Homo sapiens
tcttgccccatcac

SEQ ID NO: 6479236 - DNA, 12 bp, Homo sapiens
tcttgcccccca

SEQ ID NO: 6479237 - DNA, 13 bp, Homo sapiens
tcttgccccctca

SEQ ID NO: 6479238 - DNA, 23 bp, Homo sapiens
tcttgccccctttgaccttcccc

SEQ ID NO: 6479239 - DNA, 20 bp, Homo sapiens
tcttgcccctccagagacag

SEQ ID NO: 6479240 - DNA, 15 bp, Homo sapiens
tcttgccccttgtcc

SEQ ID NO: 6479241 - DNA, 18 bp, Homo sapiens
tcttgcccgcacccctcc

SEQ ID NO: 6479242 - DNA, 22 bp, Homo sapiens
tcttgccctattataattgtca

SEQ ID NO: 6479243 - DNA, 13 bp, Homo sapiens
tcttgccctgagc

SEQ ID NO: 6479244 - DNA, 20 bp, Homo sapiens
tcttgcccttccctgtccct

SEQ ID NO: 6479245 - DNA, 17 bp, Homo sapiens
tcttgccgaggagccag

SEQ ID NO: 6479246 - DNA, 16 bp, Homo sapiens
tcttgcctaaatccca

SEQ ID NO: 6479247 - DNA, 16 bp, Homo sapiens
tcttgcctaggccaaa

SEQ ID NO: 6479248 - DNA, 18 bp, Homo sapiens
tcttgcctcagcttcccc

SEQ ID NO: 6479249 - DNA, 19 bp, Homo sapiens
tcttgcctcagcttcccca

SEQ ID NO: 6479250 - DNA, 15 bp, Homo sapiens
tcttgcctccaggtg

SEQ ID NO: 6479251 - DNA, 17 bp, Homo sapiens
tcttgcctccaggtgca

SEQ ID NO: 6479252 - DNA, 18 bp, Homo sapiens
tcttgcctccaggtgcag

SEQ ID NO: 6479253 - DNA, 14 bp, Homo sapiens
tcttgcctctctca

SEQ ID NO: 6479254 - DNA, 15 bp, Homo sapiens
tcttgcctctgtgct

SEQ ID NO: 6479255 - DNA, 18 bp, Homo sapiens
tcttgcctgaatccatca

SEQ ID NO: 6479256 - DNA, 22 bp, Homo sapiens
tcttgcctgaggctcaagaggc

SEQ ID NO: 6479257 - DNA, 14 bp, Homo sapiens
tcttgcctgcaccc

SEQ ID NO: 6479258 - DNA, 15 bp, Homo sapiens
tcttgcctgcaccct

SEQ ID NO: 6479259 - DNA, 16 bp, Homo sapiens
tcttgcctgctgggct

SEQ ID NO: 6479260 - DNA, 17 bp, Homo sapiens
tcttgcctgctgggctc

SEQ ID NO: 6479261 - DNA, 23 bp, Homo sapiens
tcttgcctgtttcccaggcccac

SEQ ID NO: 6479262 - DNA, 22 bp, Homo sapiens
tcttgccttaaccagtctctca

SEQ ID NO: 6479263 - DNA, 22 bp, Homo sapiens
tcttgcctttccacctgctttc

SEQ ID NO: 6479264 - DNA, 20 bp, Homo sapiens
tcttgcgaatccaagctccc

SEQ ID NO: 6479265 - DNA, 16 bp, Homo sapiens
tcttgcgatccttaat

SEQ ID NO: 6479266 - DNA, 19 bp, Homo sapiens
tcttgcggcaccgcccacc

SEQ ID NO: 6479267 - DNA, 20 bp, Homo sapiens
tcttgcggcaccgcccaccc

SEQ ID NO: 6479268 - DNA, 15 bp, Homo sapiens
tcttgcgggcctgga

SEQ ID NO: 6479269 - DNA, 17 bp, Homo sapiens
tcttgctaagctccagc

SEQ ID NO: 6479270 - DNA, 19 bp, Homo sapiens
tcttgctaatcagtgtctc

SEQ ID NO: 6479271 - DNA, 20 bp, Homo sapiens
tcttgctaatcagtgtctca

SEQ ID NO: 6479272 - DNA, 21 bp, Homo sapiens
tcttgctaatcagtgtctcac

SEQ ID NO: 6479273 - DNA, 14 bp, Homo sapiens
tcttgctaccagta

SEQ ID NO: 6479274 - DNA, 16 bp, Homo sapiens
tcttgctactgaaaaa

SEQ ID NO: 6479275 - DNA, 22 bp, Homo sapiens
tcttgctagacaaggttgctgt

SEQ ID NO: 6479276 - DNA, 17 bp, Homo sapiens
tcttgctatataaataa

SEQ ID NO: 6479277 - DNA, 18 bp, Homo sapiens
tcttgctatataaataaa

SEQ ID NO: 6479278 - DNA, 19 bp, Homo sapiens
tcttgctatattgcccagg

SEQ ID NO: 6479279 - DNA, 20 bp, Homo sapiens
tcttgctatcggggaagcca

SEQ ID NO: 6479280 - DNA, 18 bp, Homo sapiens
tcttgctatttgagcatg

SEQ ID NO: 6479281 - DNA, 16 bp, Homo sapiens
tcttgctcactcccta

SEQ ID NO: 6479282 - DNA, 18 bp, Homo sapiens
tcttgctccaataaagga

SEQ ID NO: 6479283 - DNA, 18 bp, Homo sapiens
tcttgctcccttcagccc

SEQ ID NO: 6479284 - DNA, 12 bp, Homo sapiens
tcttgctcctgt

SEQ ID NO: 6479285 - DNA, 17 bp, Homo sapiens
tcttgctctatctctca

SEQ ID NO: 6479286 - DNA, 18 bp, Homo sapiens
tcttgctctatctctcaa

SEQ ID NO: 6479287 - DNA, 12 bp, Homo sapiens
tcttgctctcct

SEQ ID NO: 6479288 - DNA, 22 bp, Homo sapiens
tcttgctctctctccctgcctt

SEQ ID NO: 6479289 - DNA, 23 bp, Homo sapiens
tcttgctctctctccctgccttt

SEQ ID NO: 6479290 - DNA, 13 bp, Homo sapiens
tcttgctctgcca

SEQ ID NO: 6479291 - DNA, 13 bp, Homo sapiens
tcttgctctgctg

SEQ ID NO: 6479292 - DNA, 23 bp, Homo sapiens
tcttgctctgctgacagacacag

SEQ ID NO: 6479293 - DNA, 13 bp, Homo sapiens
tcttgctctgtaa

SEQ ID NO: 6479294 - DNA, 14 bp, Homo sapiens
tcttgctctgtaat

SEQ ID NO: 6479295 - DNA, 14 bp, Homo sapiens
tcttgctctgtccc

SEQ ID NO: 6479296 - DNA, 17 bp, Homo sapiens
tcttgctgatggctgct

SEQ ID NO: 6479297 - DNA, 19 bp, Homo sapiens
tcttgctgatggctgctag

SEQ ID NO: 6479298 - DNA, 20 bp, Homo sapiens
tcttgctgatggctgctaga

SEQ ID NO: 6479299 - DNA, 18 bp, Homo sapiens
tcttgctgcactctgtag

SEQ ID NO: 6479300 - DNA, 13 bp, Homo sapiens
tcttgctgcaggc

SEQ ID NO: 6479301 - DNA, 15 bp, Homo sapiens
tcttgctgcaggccc

SEQ ID NO: 6479302 - DNA, 18 bp, Homo sapiens
tcttgctgccctgcccca

SEQ ID NO: 6479303 - DNA, 14 bp, Homo sapiens
tcttgctgctagaa

SEQ ID NO: 6479304 - DNA, 15 bp, Homo sapiens
tcttgctgctagaac

SEQ ID NO: 6479305 - DNA, 20 bp, Homo sapiens
tcttgctgctagaacttttt

SEQ ID NO: 6479306 - DNA, 12 bp, Homo sapiens
tcttgctgctta

SEQ ID NO: 6479307 - DNA, 13 bp, Homo sapiens
tcttgctggaaga

SEQ ID NO: 6479308 - DNA, 15 bp, Homo sapiens
tcttgctggaagaca

SEQ ID NO: 6479309 - DNA, 23 bp, Homo sapiens
tcttgctggctacgcctcttctg

SEQ ID NO: 6479310 - DNA, 22 bp, Homo sapiens
tcttgctggttgtcatttttgc

SEQ ID NO: 6479311 - DNA, 22 bp, Homo sapiens
tcttgctgtaactcagacattc

SEQ ID NO: 6479312 - DNA, 17 bp, Homo sapiens
tcttgctgtctctgctc

SEQ ID NO: 6479313 - DNA, 12 bp, Homo sapiens
tcttgctgtgaa

SEQ ID NO: 6479314 - DNA, 13 bp, Homo sapiens
tcttgctgtggtc

SEQ ID NO: 6479315 - DNA, 19 bp, Homo sapiens
tcttgctgttaaaaataat

SEQ ID NO: 6479316 - DNA, 15 bp, Homo sapiens
tcttgctgttgacat

SEQ ID NO: 6479317 - DNA, 13 bp, Homo sapiens
tcttgctgtttct

SEQ ID NO: 6479318 - DNA, 19 bp, Homo sapiens
tcttgcttaccttgactgt

SEQ ID NO: 6479319 - DNA, 12 bp, Homo sapiens
tcttgcttcaga

SEQ ID NO: 6479320 - DNA, 14 bp, Homo sapiens
tcttgcttcagtca

SEQ ID NO: 6479321 - DNA, 22 bp, Homo sapiens
tcttgcttccctaatctatggt

SEQ ID NO: 6479322 - DNA, 23 bp, Homo sapiens
tcttgcttccctaatctatggtc

SEQ ID NO: 6479323 - DNA, 12 bp, Homo sapiens
tcttgcttctgg

SEQ ID NO: 6479324 - DNA, 16 bp, Homo sapiens
tcttgcttggaagcca

SEQ ID NO: 6479325 - DNA, 13 bp, Homo sapiens
tcttgcttgggaa

SEQ ID NO: 6479326 - DNA, 18 bp, Homo sapiens
tcttgcttgtacctctgg

SEQ ID NO: 6479327 - DNA, 21 bp, Homo sapiens
tcttgcttgtcattgactctt

SEQ ID NO: 6479328 - DNA, 14 bp, Homo sapiens
tcttgctttatact

SEQ ID NO: 6479329 - DNA, 13 bp, Homo sapiens
tcttgctttctct

SEQ ID NO: 6479330 - DNA, 17 bp, Homo sapiens
tcttgcttttctttgga

SEQ ID NO: 6479331 - DNA, 16 bp, Homo sapiens
tcttggaaaaagtgat

SEQ ID NO: 6479332 - DNA, 20 bp, Homo sapiens
tcttggaaatgttaagaaag

SEQ ID NO: 6479333 - DNA, 15 bp, Homo sapiens
tcttggaactgcacc

SEQ ID NO: 6479334 - DNA, 19 bp, Homo sapiens
tcttggaactgtcccagct

SEQ ID NO: 6479335 - DNA, 20 bp, Homo sapiens
tcttggaagctgtttggaaa

SEQ ID NO: 6479336 - DNA, 18 bp, Homo sapiens
tcttggaagtacatgaat

SEQ ID NO: 6479337 - DNA, 22 bp, Homo sapiens
tcttggaagtgtgtggaaggca

SEQ ID NO: 6479338 - DNA, 17 bp, Homo sapiens
tcttggaattttgtaaa

SEQ ID NO: 6479339 - DNA, 23 bp, Homo sapiens
tcttggaattttgtaaaaagaaa

SEQ ID NO: 6479340 - DNA, 15 bp, Homo sapiens
tcttggacaaatcac

SEQ ID NO: 6479341 - DNA, 17 bp, Homo sapiens
tcttggacactgtacaa

SEQ ID NO: 6479342 - DNA, 20 bp, Homo sapiens
tcttggaccatgccagattc

SEQ ID NO: 6479343 - DNA, 16 bp, Homo sapiens
tcttggaccatggtag

SEQ ID NO: 6479344 - DNA, 22 bp, Homo sapiens
tcttggaccatggtagaaaatg

SEQ ID NO: 6479345 - DNA, 15 bp, Homo sapiens
tcttggacccacctg

SEQ ID NO: 6479346 - DNA, 13 bp, Homo sapiens
tcttggaccctgg

SEQ ID NO: 6479347 - DNA, 18 bp, Homo sapiens
tcttggacctatcaaaaa

SEQ ID NO: 6479348 - DNA, 16 bp, Homo sapiens
tcttggacctctgctc

SEQ ID NO: 6479349 - DNA, 14 bp, Homo sapiens
tcttggagaacttt

SEQ ID NO: 6479350 - DNA, 12 bp, Homo sapiens
tcttggagaagt

SEQ ID NO: 6479351 - DNA, 12 bp, Homo sapiens
tcttggagagga

SEQ ID NO: 6479352 - DNA, 15 bp, Homo sapiens
tcttggagcctgcag

SEQ ID NO: 6479353 - DNA, 19 bp, Homo sapiens
tcttggagcctgcagagct

SEQ ID NO: 6479354 - DNA, 19 bp, Homo sapiens
tcttggagctttggaatat

SEQ ID NO: 6479355 - DNA, 19 bp, Homo sapiens
tcttggagcttttttgcat

SEQ ID NO: 6479356 - DNA, 18 bp, Homo sapiens
tcttggagtgccaagttt

SEQ ID NO: 6479357 - DNA, 20 bp, Homo sapiens
tcttggataccagctcaggg

SEQ ID NO: 6479358 - DNA, 18 bp, Homo sapiens
tcttggatgggacatttt

SEQ ID NO: 6479359 - DNA, 21 bp, Homo sapiens
tcttggattagcctttgacat

SEQ ID NO: 6479360 - DNA, 24 bp, Homo sapiens
tgctttgagaccagaagaaaagac

SEQ ID NO: 6479361 - DNA, 15 bp, Homo sapiens
tgctttgagagagaa

SEQ ID NO: 6479362 - DNA, 13 bp, Homo sapiens
tgctttgagattt

SEQ ID NO: 6479363 - DNA, 18 bp, Homo sapiens
tgctttgagcccacagga

SEQ ID NO: 6479364 - DNA, 21 bp, Homo sapiens
tgctttgagtccacgcccacc

SEQ ID NO: 6479365 - DNA, 13 bp, Homo sapiens
tgctttgatatat

SEQ ID NO: 6479366 - DNA, 13 bp, Homo sapiens
tgctttgatattt

SEQ ID NO: 6479367 - DNA, 17 bp, Homo sapiens
tgctttgatttacagca

SEQ ID NO: 6479368 - DNA, 12 bp, Homo sapiens
tgctttgcaaac

SEQ ID NO: 6479369 - DNA, 14 bp, Homo sapiens
tgctttgcacagga

SEQ ID NO: 6479370 - DNA, 17 bp, Homo sapiens
tgctttgcacaggaaag

SEQ ID NO: 6479371 - DNA, 20 bp, Homo sapiens
tgctttgcatctttgttact

SEQ ID NO: 6479372 - DNA, 14 bp, Homo sapiens
tgctttgcattact

SEQ ID NO: 6479373 - DNA, 15 bp, Homo sapiens
tgctttgcattttct

SEQ ID NO: 6479374 - DNA, 22 bp, Homo sapiens
tgctttgccataaccacattta

SEQ ID NO: 6479375 - DNA, 17 bp, Homo sapiens
tgctttgcccacatgcc

SEQ ID NO: 6479376 - DNA, 15 bp, Homo sapiens
tgctttgcccctgag

SEQ ID NO: 6479377 - DNA, 22 bp, Homo sapiens
tgctttgcccttctttctaccc

SEQ ID NO: 6479378 - DNA, 21 bp, Homo sapiens
tgctttgcctctaccagttgg

SEQ ID NO: 6479379 - DNA, 17 bp, Homo sapiens
tgctttgctagatgctg

SEQ ID NO: 6479380 - DNA, 15 bp, Homo sapiens
tgctttgctgcacag

SEQ ID NO: 6479381 - DNA, 20 bp, Homo sapiens
tgctttgctgcacagcagga

SEQ ID NO: 6479382 - DNA, 15 bp, Homo sapiens
tgctttgctggagtc

SEQ ID NO: 6479383 - DNA, 13 bp, Homo sapiens
tgctttgctttct

SEQ ID NO: 6479384 - DNA, 14 bp, Homo sapiens
tgctttgctttctg

SEQ ID NO: 6479385 - DNA, 17 bp, Homo sapiens
tgctttggaaaacccag

SEQ ID NO: 6479386 - DNA, 22 bp, Homo sapiens
tgctttggacctaaatggcctc

SEQ ID NO: 6479387 - DNA, 23 bp, Homo sapiens
tgctttggattctctaagatgaa

SEQ ID NO: 6479388 - DNA, 14 bp, Homo sapiens
tgctttggcaatgc

SEQ ID NO: 6479389 - DNA, 13 bp, Homo sapiens
tgctttggccttt

SEQ ID NO: 6479390 - DNA, 17 bp, Homo sapiens
tgctttgggaggccaag

SEQ ID NO: 6479391 - DNA, 19 bp, Homo sapiens
tgctttgggaggccaaggc

SEQ ID NO: 6479392 - DNA, 20 bp, Homo sapiens
tgctttgggaggccaaggca

SEQ ID NO: 6479393 - DNA, 15 bp, Homo sapiens
tgctttgggctgccc

SEQ ID NO: 6479394 - DNA, 16 bp, Homo sapiens
tgctttgggctgccct

SEQ ID NO: 6479395 - DNA, 17 bp, Homo sapiens
tgctttgggctgccctg

SEQ ID NO: 6479396 - DNA, 17 bp, Homo sapiens
tgctttgggcttgggcc

SEQ ID NO: 6479397 - DNA, 19 bp, Homo sapiens
tgctttgggctttgcaggc

SEQ ID NO: 6479398 - DNA, 19 bp, Homo sapiens
tgctttggtcacttttaga

SEQ ID NO: 6479399 - DNA, 21 bp, Homo sapiens
tgctttggtcacttttagatg

SEQ ID NO: 6479400 - DNA, 13 bp, Homo sapiens
tgctttggttaat

SEQ ID NO: 6479401 - DNA, 19 bp, Homo sapiens
tgctttgtaagatccaccc

SEQ ID NO: 6479402 - DNA, 21 bp, Homo sapiens
tgctttgtaatattctcccca

SEQ ID NO: 6479403 - DNA, 12 bp, Homo sapiens
tgctttgtagct

SEQ ID NO: 6479404 - DNA, 20 bp, Homo sapiens
tgctttgtagcttaaaaaaa

SEQ ID NO: 6479405 - DNA, 21 bp, Homo sapiens
tgctttgtagcttaaaaaaag

SEQ ID NO: 6479406 - DNA, 19 bp, Homo sapiens
tgctttgtaggtgtctcat

SEQ ID NO: 6479407 - DNA, 19 bp, Homo sapiens
tgctttgtagtttgcccag

SEQ ID NO: 6479408 - DNA, 22 bp, Homo sapiens
tgctttgtatcagtcagtgctg

SEQ ID NO: 6479409 - DNA, 19 bp, Homo sapiens
tgctttgtcatccatgcgt

SEQ ID NO: 6479410 - DNA, 24 bp, Homo sapiens
tgctttgtccatgatgtccttgtt

SEQ ID NO: 6479411 - DNA, 16 bp, Homo sapiens
tgctttgtctcctcta

SEQ ID NO: 6479412 - DNA, 17 bp, Homo sapiens
tgctttgtctcctctat

SEQ ID NO: 6479413 - DNA, 16 bp, Homo sapiens
tgctttgtctggcctc

SEQ ID NO: 6479414 - DNA, 17 bp, Homo sapiens
tgctttgtctggcctca

SEQ ID NO: 6479415 - DNA, 16 bp, Homo sapiens
tgctttgtgatttttg

SEQ ID NO: 6479416 - DNA, 16 bp, Homo sapiens
tgctttgtgcatatgt

SEQ ID NO: 6479417 - DNA, 17 bp, Homo sapiens
tgctttgtgcctttggg

SEQ ID NO: 6479418 - DNA, 11 bp, Homo sapiens
tgctttgtgtc

SEQ ID NO: 6479419 - DNA, 15 bp, Homo sapiens
tgctttgtgttcagt

SEQ ID NO: 6479420 - DNA, 22 bp, Homo sapiens
tgctttgttattaatattgtgc

SEQ ID NO: 6479421 - DNA, 15 bp, Homo sapiens
tgctttgttgtgtgc

SEQ ID NO: 6479422 - DNA, 16 bp, Homo sapiens
tgctttgttgtgtgcc

SEQ ID NO: 6479423 - DNA, 19 bp, Homo sapiens
tgctttgttgtgtgcctct

SEQ ID NO: 6479424 - DNA, 23 bp, Homo sapiens
tgctttgttgtgtgcctctagct

SEQ ID NO: 6479425 - DNA, 24 bp, Homo sapiens
tgctttgttgtgtgcctctagctg

SEQ ID NO: 6479426 - DNA, 14 bp, Homo sapiens
tgctttgtttggat

SEQ ID NO: 6479427 - DNA, 21 bp, Homo sapiens
tgctttgttttggctgctctc

SEQ ID NO: 6479428 - DNA, 18 bp, Homo sapiens
tgctttgttttgtttgtg

SEQ ID NO: 6479429 - DNA, 17 bp, Homo sapiens
tgcttttaaaaaaaaat

SEQ ID NO: 6479430 - DNA, 22 bp, Homo sapiens
tgcttttaaaaattttgtcctt

SEQ ID NO: 6479431 - DNA, 14 bp, Homo sapiens
tgcttttaaaacat

SEQ ID NO: 6479432 - DNA, 13 bp, Homo sapiens
tgcttttaaaact

SEQ ID NO: 6479433 - DNA, 14 bp, Homo sapiens
tgcttttaaaacta

SEQ ID NO: 6479434 - DNA, 19 bp, Homo sapiens
tgcttttaaggaaaggcaa

SEQ ID NO: 6479435 - DNA, 13 bp, Homo sapiens
tgcttttaagttt

SEQ ID NO: 6479436 - DNA, 14 bp, Homo sapiens
tgcttttaatgaat

SEQ ID NO: 6479437 - DNA, 20 bp, Homo sapiens
tgcttttaatgaatttaagg

SEQ ID NO: 6479438 - DNA, 12 bp, Homo sapiens
tgcttttagaat

SEQ ID NO: 6479439 - DNA, 24 bp, Homo sapiens
tgcttttagtattttagtgaactt

SEQ ID NO: 6479440 - DNA, 19 bp, Homo sapiens
tgcttttagtgtgtgcata

SEQ ID NO: 6479441 - DNA, 19 bp, Homo sapiens
tgcttttagttcatatata

SEQ ID NO: 6479442 - DNA, 16 bp, Homo sapiens
tgcttttatagttgta

SEQ ID NO: 6479443 - DNA, 21 bp, Homo sapiens
tgcttttatatggcccagcct

SEQ ID NO: 6479444 - DNA, 22 bp, Homo sapiens
tgcttttatatggcccagcctt

SEQ ID NO: 6479445 - DNA, 13 bp, Homo sapiens
tgcttttatccac

SEQ ID NO: 6479446 - DNA, 15 bp, Homo sapiens
tgcttttatccactg

SEQ ID NO: 6479447 - DNA, 15 bp, Homo sapiens
tgcttttattttgaa

SEQ ID NO: 6479448 - DNA, 21 bp, Homo sapiens
tgcttttattttgaaaagctt

SEQ ID NO: 6479449 - DNA, 20 bp, Homo sapiens
tgcttttcatgcaaactctt

SEQ ID NO: 6479450 - DNA, 13 bp, Homo sapiens
tgcttttccagga

SEQ ID NO: 6479451 - DNA, 15 bp, Homo sapiens
tgcttttccctagtg

SEQ ID NO: 6479452 - DNA, 14 bp, Homo sapiens
tgcttttccctctt

SEQ ID NO: 6479453 - DNA, 17 bp, Homo sapiens
tgcttttccctttgtga

SEQ ID NO: 6479454 - DNA, 21 bp, Homo sapiens
tgcttttccctttgtgagtca

SEQ ID NO: 6479455 - DNA, 17 bp, Homo sapiens
tgcttttcctcaagcaa

SEQ ID NO: 6479456 - DNA, 18 bp, Homo sapiens
tgcttttcctcaagcaat

SEQ ID NO: 6479457 - DNA, 22 bp, Homo sapiens
tgcttttccttggggcaggcag

SEQ ID NO: 6479458 - DNA, 15 bp, Homo sapiens
tgcttttctcatggt

SEQ ID NO: 6479459 - DNA, 12 bp, Homo sapiens
tgcttttctcca

SEQ ID NO: 6479460 - DNA, 20 bp, Homo sapiens
tgcttttctccaatatcagt

SEQ ID NO: 6479461 - DNA, 13 bp, Homo sapiens
tgcttttctccca

SEQ ID NO: 6479462 - DNA, 17 bp, Homo sapiens
tgcttttctcccagaag

SEQ ID NO: 6479463 - DNA, 17 bp, Homo sapiens
tgcttttctctcagcat

SEQ ID NO: 6479464 - DNA, 15 bp, Homo sapiens
tgcttttctgccctg

SEQ ID NO: 6479465 - DNA, 15 bp, Homo sapiens
tgcttttctgtcagt

SEQ ID NO: 6479466 - DNA, 16 bp, Homo sapiens
tgcttttctgtcctgg

SEQ ID NO: 6479467 - DNA, 17 bp, Homo sapiens
tgcttttctgtcctggg

SEQ ID NO: 6479468 - DNA, 15 bp, Homo sapiens
tgcttttgaacgtat

SEQ ID NO: 6479469 - DNA, 20 bp, Homo sapiens
tgcttttgatgtgaaaatca

SEQ ID NO: 6479470 - DNA, 17 bp, Homo sapiens
tgcttttgcaaataact

SEQ ID NO: 6479471 - DNA, 17 bp, Homo sapiens
tgcttttgcagaaatca

SEQ ID NO: 6479472 - DNA, 21 bp, Homo sapiens
tgcttttgcatttctcttcct

SEQ ID NO: 6479473 - DNA, 18 bp, Homo sapiens
tgcttttgcccattttga

SEQ ID NO: 6479474 - DNA, 13 bp, Homo sapiens
tgcttttgctgct

SEQ ID NO: 6479475 - DNA, 16 bp, Homo sapiens
tgcttttgcttgcaat

SEQ ID NO: 6479476 - DNA, 21 bp, Homo sapiens
tgcttttggcaaaactctact

SEQ ID NO: 6479477 - DNA, 18 bp, Homo sapiens
tgcttttggggctcttga

SEQ ID NO: 6479478 - DNA, 15 bp, Homo sapiens
tgcttttgtgtctac

SEQ ID NO: 6479479 - DNA, 21 bp, Homo sapiens
tgcttttgtgtctaccttgtt

SEQ ID NO: 6479480 - DNA, 19 bp, Homo sapiens
tgcttttgttgtgactttt

SEQ ID NO: 6479481 - DNA, 21 bp, Homo sapiens
tgcttttgtttgctcttttaa

SEQ ID NO: 6479482 - DNA, 20 bp, Homo sapiens
tgctttttaaactgatgtat

SEQ ID NO: 6479483 - DNA, 23 bp, Homo sapiens
tgctttttaatattgatatgctt

SEQ ID NO: 6479484 - DNA, 16 bp, Homo sapiens
tgctttttagaaagca

SEQ ID NO: 6479485 - DNA, 16 bp, Homo sapiens
tgctttttataaaaag

SEQ ID NO: 6479486 - DNA, 15 bp, Homo sapiens
tgctttttatttctg

SEQ ID NO: 6479487 - DNA, 17 bp, Homo sapiens
tgctttttcatcaaaac

SEQ ID NO: 6479488 - DNA, 21 bp, Homo sapiens
tgctttttccaactcagaaat

SEQ ID NO: 6479489 - DNA, 21 bp, Homo sapiens
tgctttttcctctcattgtct

SEQ ID NO: 6479490 - DNA, 13 bp, Homo sapiens
tgctttttctaat

SEQ ID NO: 6479491 - DNA, 14 bp, Homo sapiens
tgctttttctcaga

SEQ ID NO: 6479492 - DNA, 13 bp, Homo sapiens
tgctttttctgac

SEQ ID NO: 6479493 - DNA, 14 bp, Homo sapiens
tgctttttgaaatg

SEQ ID NO: 6479494 - DNA, 23 bp, Homo sapiens
tgcttttttatggcgattcccat

SEQ ID NO: 6479495 - DNA, 19 bp, Homo sapiens
tgcttttttccaaaacaaa

SEQ ID NO: 6479496 - DNA, 20 bp, Homo sapiens
tgcttttttccaaaacaaaa

SEQ ID NO: 6479497 - DNA, 13 bp, Homo sapiens
tgcttttttgcaa

SEQ ID NO: 6479498 - DNA, 18 bp, Homo sapiens
tgcttttttgcaataagg

SEQ ID NO: 6479499 - DNA, 21 bp, Homo sapiens
tgcttttttgttttgtgctaa

SEQ ID NO: 6479500 - DNA, 16 bp, Homo sapiens
tgctttttttcttaaa

SEQ ID NO: 6479501 - DNA, 18 bp, Homo sapiens
tgctttttttcttaaaag

SEQ ID NO: 6479502 - DNA, 20 bp, Homo sapiens
tgctttttttgaaactttga

SEQ ID NO: 6479503 - DNA, 14 bp, Homo sapiens
tgcttttttttcct

SEQ ID NO: 6479504 - DNA, 17 bp, Homo sapiens
tgcttttttttttccag

SEQ ID NO: 6479505 - DNA, 19 bp, Homo sapiens
tgcttttttttttccagca

SEQ ID NO: 6479506 - DNA, 17 bp, Homo sapiens
tggaaaaaaaaaaaaga

SEQ ID NO: 6479507 - DNA, 18 bp, Homo sapiens
tggaaaaaaaaaacaaaa

SEQ ID NO: 6479508 - DNA, 17 bp, Homo sapiens
tggaaaaaaaaaagaca

SEQ ID NO: 6479509 - DNA, 14 bp, Homo sapiens
tggaaaaaaacata

SEQ ID NO: 6479510 - DNA, 15 bp, Homo sapiens
tggaaaaaaacataa

SEQ ID NO: 6479511 - DNA, 18 bp, Homo sapiens
tggaaaaaaacataaaaa

SEQ ID NO: 6479512 - DNA, 15 bp, Homo sapiens
tggaaaaaactctga

SEQ ID NO: 6479513 - DNA, 13 bp, Homo sapiens
tggaaaaaatatt

SEQ ID NO: 6479514 - DNA, 13 bp, Homo sapiens
tggaaaaaccttg

SEQ ID NO: 6479515 - DNA, 20 bp, Homo sapiens
tggaaaaactgagacaggca

SEQ ID NO: 6479516 - DNA, 18 bp, Homo sapiens
tggaaaaagaaagaaaca

SEQ ID NO: 6479517 - DNA, 15 bp, Homo sapiens
tggaaaaagaaattc

SEQ ID NO: 6479518 - DNA, 12 bp, Homo sapiens
tggaaaaagtga

SEQ ID NO: 6479519 - DNA, 17 bp, Homo sapiens
tggaaaaataacaacta

SEQ ID NO: 6479520 - DNA, 17 bp, Homo sapiens
tggaaaaatagcctgcc

SEQ ID NO: 6479521 - DNA, 11 bp, Homo sapiens
tggaaaaatga

SEQ ID NO: 6479522 - DNA, 13 bp, Homo sapiens
tggaaaaatgcca

SEQ ID NO: 6479523 - DNA, 19 bp, Homo sapiens
tggaaaaatgggtctttta

SEQ ID NO: 6479524 - DNA, 13 bp, Homo sapiens
tggaaaaatgtca

SEQ ID NO: 6479525 - DNA, 15 bp, Homo sapiens
tggaaaaatgtcact

SEQ ID NO: 6479526 - DNA, 17 bp, Homo sapiens
tggaaaaattaagttgt

SEQ ID NO: 6479527 - DNA, 16 bp, Homo sapiens
tggaaaaattccagaa

SEQ ID NO: 6479528 - DNA, 18 bp, Homo sapiens
tggaaaaattgagatgga

SEQ ID NO: 6479529 - DNA, 17 bp, Homo sapiens
tggaaaacaaggaagtc

SEQ ID NO: 6479530 - DNA, 19 bp, Homo sapiens
tggaaaacaatttgcataa

SEQ ID NO: 6479531 - DNA, 14 bp, Homo sapiens
tggaaaacagagta

SEQ ID NO: 6479532 - DNA, 15 bp, Homo sapiens
tggaaaacagggtgc

SEQ ID NO: 6479533 - DNA, 13 bp, Homo sapiens
tggaaaacatatg

SEQ ID NO: 6479534 - DNA, 21 bp, Homo sapiens
tggaaaacctgaggccaaata

SEQ ID NO: 6479535 - DNA, 12 bp, Homo sapiens
tggaaaactaac

SEQ ID NO: 6479536 - DNA, 13 bp, Homo sapiens
tggaaaactaact

SEQ ID NO: 6479537 - DNA, 15 bp, Homo sapiens
tggaaaactcacaga

SEQ ID NO: 6479538 - DNA, 16 bp, Homo sapiens
tggaaaactgcctgtt

SEQ ID NO: 6479539 - DNA, 13 bp, Homo sapiens
tggaaaactgtta

SEQ ID NO: 6479540 - DNA, 21 bp, Homo sapiens
tcttggattggtaccagagcc

SEQ ID NO: 6479541 - DNA, 14 bp, Homo sapiens
tcttggcaaatttt

SEQ ID NO: 6479542 - DNA, 15 bp, Homo sapiens
tcttggcaagatgtt

SEQ ID NO: 6479543 - DNA, 24 bp, Homo sapiens
tcttggcaataaattttgaaaagt

SEQ ID NO: 6479544 - DNA, 22 bp, Homo sapiens
tcttggcacatttaagagacag

SEQ ID NO: 6479545 - DNA, 14 bp, Homo sapiens
tcttggcacctgcc

SEQ ID NO: 6479546 - DNA, 15 bp, Homo sapiens
tcttggcacctgcct

SEQ ID NO: 6479547 - DNA, 16 bp, Homo sapiens
tcttggcacctgccta

SEQ ID NO: 6479548 - DNA, 17 bp, Homo sapiens
tcttggcacctgcctag

SEQ ID NO: 6479549 - DNA, 23 bp, Homo sapiens
tcttggcagcttaacattgactt

SEQ ID NO: 6479550 - DNA, 19 bp, Homo sapiens
tcttggcattttcctcgcc

SEQ ID NO: 6479551 - DNA, 15 bp, Homo sapiens
tcttggcccagcact

SEQ ID NO: 6479552 - DNA, 18 bp, Homo sapiens
tcttggcccctgtgtgag

SEQ ID NO: 6479553 - DNA, 17 bp, Homo sapiens
tcttggccctcctcagc

SEQ ID NO: 6479554 - DNA, 18 bp, Homo sapiens
tcttggccgactcaggga

SEQ ID NO: 6479555 - DNA, 22 bp, Homo sapiens
tcttggccgactcagggaccta

SEQ ID NO: 6479556 - DNA, 12 bp, Homo sapiens
tcttggcctccc

SEQ ID NO: 6479557 - DNA, 22 bp, Homo sapiens
tcttggcctcccaaagtgctgg

SEQ ID NO: 6479558 - DNA, 13 bp, Homo sapiens
tcttggcctgcct

SEQ ID NO: 6479559 - DNA, 18 bp, Homo sapiens
tcttggcctgcctcccag

SEQ ID NO: 6479560 - DNA, 13 bp, Homo sapiens
tcttggcctttgc

SEQ ID NO: 6479561 - DNA, 14 bp, Homo sapiens
tcttggcctttgca

SEQ ID NO: 6479562 - DNA, 20 bp, Homo sapiens
tcttggctcgtttgggctca

SEQ ID NO: 6479563 - DNA, 17 bp, Homo sapiens
tcttggctgacccctct

SEQ ID NO: 6479564 - DNA, 19 bp, Homo sapiens
tcttggctgcctgtgggct

SEQ ID NO: 6479565 - DNA, 23 bp, Homo sapiens
tcttggctgtgagcaactgcgac

SEQ ID NO: 6479566 - DNA, 16 bp, Homo sapiens
tcttggcttaatcatt

SEQ ID NO: 6479567 - DNA, 19 bp, Homo sapiens
tcttggcttaatcattttc

SEQ ID NO: 6479568 - DNA, 19 bp, Homo sapiens
tcttggcttactgcagcct

SEQ ID NO: 6479569 - DNA, 13 bp, Homo sapiens
tcttggcttctgg

SEQ ID NO: 6479570 - DNA, 17 bp, Homo sapiens
tcttggcttggtgagga

SEQ ID NO: 6479571 - DNA, 11 bp, Homo sapiens
tcttggctttg

SEQ ID NO: 6479572 - DNA, 18 bp, Homo sapiens
tcttggctttgttttgtt

SEQ ID NO: 6479573 - DNA, 15 bp, Homo sapiens
tcttgggaaacaccc

SEQ ID NO: 6479574 - DNA, 18 bp, Homo sapiens
tcttgggaaagagacaga

SEQ ID NO: 6479575 - DNA, 14 bp, Homo sapiens
tcttgggaaatatg

SEQ ID NO: 6479576 - DNA, 16 bp, Homo sapiens
tcttgggaactccact

SEQ ID NO: 6479577 - DNA, 21 bp, Homo sapiens
tcttgggaactccactctcct

SEQ ID NO: 6479578 - DNA, 15 bp, Homo sapiens
tcttgggaagcagtt

SEQ ID NO: 6479579 - DNA, 16 bp, Homo sapiens
tcttgggaagcagttt

SEQ ID NO: 6479580 - DNA, 20 bp, Homo sapiens
tcttgggaagcagtttcaga

SEQ ID NO: 6479581 - DNA, 15 bp, Homo sapiens
tcttgggactgctgt

SEQ ID NO: 6479582 - DNA, 21 bp, Homo sapiens
tcttgggagggaatgggacag

SEQ ID NO: 6479583 - DNA, 15 bp, Homo sapiens
tcttgggatctcagg

SEQ ID NO: 6479584 - DNA, 17 bp, Homo sapiens
tcttgggcaatattctc

SEQ ID NO: 6479585 - DNA, 19 bp, Homo sapiens
tcttgggcagagctggctc

SEQ ID NO: 6479586 - DNA, 21 bp, Homo sapiens
tcttgggcagagctggctctg

SEQ ID NO: 6479587 - DNA, 13 bp, Homo sapiens
tcttgggcaggca

SEQ ID NO: 6479588 - DNA, 18 bp, Homo sapiens
tcttgggcaggcagagag

SEQ ID NO: 6479589 - DNA, 20 bp, Homo sapiens
tcttgggccaagccagctgc

SEQ ID NO: 6479590 - DNA, 20 bp, Homo sapiens
tcttgggccccagaccccag

SEQ ID NO: 6479591 - DNA, 13 bp, Homo sapiens
tcttgggccctcc

SEQ ID NO: 6479592 - DNA, 11 bp, Homo sapiens
tcttgggcctg

SEQ ID NO: 6479593 - DNA, 20 bp, Homo sapiens
tcttgggcctgacctccagt

SEQ ID NO: 6479594 - DNA, 15 bp, Homo sapiens
tcttgggcctggccc

SEQ ID NO: 6479595 - DNA, 22 bp, Homo sapiens
tcttgggctactggcagctcct

SEQ ID NO: 6479596 - DNA, 14 bp, Homo sapiens
tcttgggctgagtg

SEQ ID NO: 6479597 - DNA, 16 bp, Homo sapiens
tcttgggctgagtgca

SEQ ID NO: 6479598 - DNA, 23 bp, Homo sapiens
tcttgggctgagtgcagccaaag

SEQ ID NO: 6479599 - DNA, 22 bp, Homo sapiens
tcttggggaaatagcttcagga

SEQ ID NO: 6479600 - DNA, 17 bp, Homo sapiens
tcttggggaccctgcct

SEQ ID NO: 6479601 - DNA, 23 bp, Homo sapiens
tcttggggagtttagggtggggg

SEQ ID NO: 6479602 - DNA, 16 bp, Homo sapiens
tcttggggcaagactg

SEQ ID NO: 6479603 - DNA, 13 bp, Homo sapiens
tcttggggcccag

SEQ ID NO: 6479604 - DNA, 18 bp, Homo sapiens
tcttggggcccagtgcat

SEQ ID NO: 6479605 - DNA, 15 bp, Homo sapiens
tcttggggctgatga

SEQ ID NO: 6479606 - DNA, 20 bp, Homo sapiens
tcttggggctgatgaagaag

SEQ ID NO: 6479607 - DNA, 19 bp, Homo sapiens
tcttgggggggtggccgct

SEQ ID NO: 6479608 - DNA, 23 bp, Homo sapiens
tcttgggggtcacccatggcctc

SEQ ID NO: 6479609 - DNA, 21 bp, Homo sapiens
tcttgggggtcaggggggaga

SEQ ID NO: 6479610 - DNA, 19 bp, Homo sapiens
tcttggggtcccagggaag

SEQ ID NO: 6479611 - DNA, 15 bp, Homo sapiens
tcttggggttcatag

SEQ ID NO: 6479612 - DNA, 21 bp, Homo sapiens
tcttggggttcataggggcag

SEQ ID NO: 6479613 - DNA, 16 bp, Homo sapiens
tcttgggtaggcggga

SEQ ID NO: 6479614 - DNA, 16 bp, Homo sapiens
tcttgggtctatgcct

SEQ ID NO: 6479615 - DNA, 15 bp, Homo sapiens
tcttgggtgggtgaa

SEQ ID NO: 6479616 - DNA, 20 bp, Homo sapiens
tcttgggtgtattctctgta

SEQ ID NO: 6479617 - DNA, 14 bp, Homo sapiens
tcttggtaaaacat

SEQ ID NO: 6479618 - DNA, 20 bp, Homo sapiens
tcttggtaaagtccttttct

SEQ ID NO: 6479619 - DNA, 14 bp, Homo sapiens
tcttggtaacaaat

SEQ ID NO: 6479620 - DNA, 14 bp, Homo sapiens
tcttggtaagaagc

SEQ ID NO: 6479621 - DNA, 19 bp, Homo sapiens
tcttggtagttctgtgcct

SEQ ID NO: 6479622 - DNA, 22 bp, Homo sapiens
tcttggtatgggctgttctgtt

SEQ ID NO: 6479623 - DNA, 14 bp, Homo sapiens
tcttggtatttgga

SEQ ID NO: 6479624 - DNA, 16 bp, Homo sapiens
tcttggtcatttgcca

SEQ ID NO: 6479625 - DNA, 14 bp, Homo sapiens
tcttggtcctgctg

SEQ ID NO: 6479626 - DNA, 17 bp, Homo sapiens
tcttggtcctgtcaccc

SEQ ID NO: 6479627 - DNA, 13 bp, Homo sapiens
tcttggtctcccg

SEQ ID NO: 6479628 - DNA, 20 bp, Homo sapiens
tcttggtctctttctttcca

SEQ ID NO: 6479629 - DNA, 15 bp, Homo sapiens
tcttggtcttcccag

SEQ ID NO: 6479630 - DNA, 14 bp, Homo sapiens
tcttggtgaaataa

SEQ ID NO: 6479631 - DNA, 22 bp, Homo sapiens
tcttggtgaaataataaaatgc

SEQ ID NO: 6479632 - DNA, 19 bp, Homo sapiens
tcttggtgatggagtgtgc

SEQ ID NO: 6479633 - DNA, 20 bp, Homo sapiens
tcttggtgggtgtggccagc

SEQ ID NO: 6479634 - DNA, 13 bp, Homo sapiens
tcttggtgtaact

SEQ ID NO: 6479635 - DNA, 15 bp, Homo sapiens
tcttggtgtaactta

SEQ ID NO: 6479636 - DNA, 21 bp, Homo sapiens
tcttggtgtaacttaaatatt

SEQ ID NO: 6479637 - DNA, 20 bp, Homo sapiens
tcttggtgtcaaatttttaa

SEQ ID NO: 6479638 - DNA, 18 bp, Homo sapiens
tcttggttccagcctgcc

SEQ ID NO: 6479639 - DNA, 14 bp, Homo sapiens
tcttggttcctggg

SEQ ID NO: 6479640 - DNA, 15 bp, Homo sapiens
tcttggttcctgttt

SEQ ID NO: 6479641 - DNA, 17 bp, Homo sapiens
tcttggttcctgtttga

SEQ ID NO: 6479642 - DNA, 15 bp, Homo sapiens
tcttggttctaaagg

SEQ ID NO: 6479643 - DNA, 20 bp, Homo sapiens
tcttggttcttatttaagta

SEQ ID NO: 6479644 - DNA, 15 bp, Homo sapiens
tcttggttgaggaaa

SEQ ID NO: 6479645 - DNA, 13 bp, Homo sapiens
tcttggttgccag

SEQ ID NO: 6479646 - DNA, 15 bp, Homo sapiens
tcttggtttatgtct

SEQ ID NO: 6479647 - DNA, 15 bp, Homo sapiens
tcttggtttccttcc

SEQ ID NO: 6479648 - DNA, 13 bp, Homo sapiens
tcttggtttctgg

SEQ ID NO: 6479649 - DNA, 18 bp, Homo sapiens
tcttggtttctggataaa

SEQ ID NO: 6479650 - DNA, 14 bp, Homo sapiens
tcttggtttgggga

SEQ ID NO: 6479651 - DNA, 18 bp, Homo sapiens
tcttggtttggggagaaa

SEQ ID NO: 6479652 - DNA, 17 bp, Homo sapiens
tcttggtttggtacagt

SEQ ID NO: 6479653 - DNA, 14 bp, Homo sapiens
tcttggtttgtaaa

SEQ ID NO: 6479654 - DNA, 16 bp, Homo sapiens
tcttggtttgtaaatt

SEQ ID NO: 6479655 - DNA, 20 bp, Homo sapiens
tcttggttttccctttgcct

SEQ ID NO: 6479656 - DNA, 15 bp, Homo sapiens
tcttggttttctctc

SEQ ID NO: 6479657 - DNA, 18 bp, Homo sapiens
tcttggttttctctctgg

SEQ ID NO: 6479658 - DNA, 19 bp, Homo sapiens
tcttggttttctctctgga

SEQ ID NO: 6479659 - DNA, 21 bp, Homo sapiens
tcttggttttgtattgtttaa

SEQ ID NO: 6479660 - DNA, 13 bp, Homo sapiens
tcttgtaaaaaga

SEQ ID NO: 6479661 - DNA, 22 bp, Homo sapiens
tcttgtaaaaaggggaggagaa

SEQ ID NO: 6479662 - DNA, 20 bp, Homo sapiens
tcttgtaaaactgtgacatt

SEQ ID NO: 6479663 - DNA, 18 bp, Homo sapiens
tcttgtaaacctggaggg

SEQ ID NO: 6479664 - DNA, 14 bp, Homo sapiens
tcttgtaaatgtgt

SEQ ID NO: 6479665 - DNA, 18 bp, Homo sapiens
tcttgtaaatgtgttgga

SEQ ID NO: 6479666 - DNA, 22 bp, Homo sapiens
tcttgtaaatgtgttggacaaa

SEQ ID NO: 6479667 - DNA, 17 bp, Homo sapiens
tcttgtaaatgtttctt

SEQ ID NO: 6479668 - DNA, 17 bp, Homo sapiens
tcttgtaagattttgaa

SEQ ID NO: 6479669 - DNA, 19 bp, Homo sapiens
tcttgtaagattttgaaaa

SEQ ID NO: 6479670 - DNA, 13 bp, Homo sapiens
tcttgtaagtatt

SEQ ID NO: 6479671 - DNA, 11 bp, Homo sapiens
tcttgtaattt

SEQ ID NO: 6479672 - DNA, 19 bp, Homo sapiens
tcttgtacatgtgtagcct

SEQ ID NO: 6479673 - DNA, 11 bp, Homo sapiens
tcttgtaccat

SEQ ID NO: 6479674 - DNA, 16 bp, Homo sapiens
tcttgtaccatagaaa

SEQ ID NO: 6479675 - DNA, 22 bp, Homo sapiens
tcttgtaccatagaaaaatgta

SEQ ID NO: 6479676 - DNA, 20 bp, Homo sapiens
tcttgtacttctgtgttcat

SEQ ID NO: 6479677 - DNA, 17 bp, Homo sapiens
tcttgtagtcttggcta

SEQ ID NO: 6479678 - DNA, 20 bp, Homo sapiens
tcttgtatctggattcaaat

SEQ ID NO: 6479679 - DNA, 15 bp, Homo sapiens
tcttgtatggtttgc

SEQ ID NO: 6479680 - DNA, 14 bp, Homo sapiens
tcttgtattcatga

SEQ ID NO: 6479681 - DNA, 15 bp, Homo sapiens
tcttgtatttaaaaa

SEQ ID NO: 6479682 - DNA, 15 bp, Homo sapiens
tcttgtatttattgg

SEQ ID NO: 6479683 - DNA, 20 bp, Homo sapiens
tcttgtatttgggccaaggt

SEQ ID NO: 6479684 - DNA, 21 bp, Homo sapiens
tcttgtatttgggccaaggtg

SEQ ID NO: 6479685 - DNA, 16 bp, Homo sapiens
tcttgtcaattatgtt

SEQ ID NO: 6479686 - DNA, 17 bp, Homo sapiens
tcttgtcacccaggctg

SEQ ID NO: 6479687 - DNA, 18 bp, Homo sapiens
tcttgtcacccaggctgg

SEQ ID NO: 6479688 - DNA, 11 bp, Homo sapiens
tcttgtcagaa

SEQ ID NO: 6479689 - DNA, 13 bp, Homo sapiens
tcttgtcagaatt

SEQ ID NO: 6479690 - DNA, 21 bp, Homo sapiens
tcttgtcagaattggcctcag

SEQ ID NO: 6479691 - DNA, 14 bp, Homo sapiens
tcttgtcagacata

SEQ ID NO: 6479692 - DNA, 19 bp, Homo sapiens
tcttgtcagacataaagcc

SEQ ID NO: 6479693 - DNA, 23 bp, Homo sapiens
tcttgtcagacataaagccatgt

SEQ ID NO: 6479694 - DNA, 18 bp, Homo sapiens
tcttgtcataaaatgcat

SEQ ID NO: 6479695 - DNA, 16 bp, Homo sapiens
tcttgtcatacaaatt

SEQ ID NO: 6479696 - DNA, 14 bp, Homo sapiens
tcttgtcatctttt

SEQ ID NO: 6479697 - DNA, 23 bp, Homo sapiens
tcttgtcattctcatccaaaagt

SEQ ID NO: 6479698 - DNA, 13 bp, Homo sapiens
tcttgtcatttta

SEQ ID NO: 6479699 - DNA, 13 bp, Homo sapiens
tcttgtcattttt

SEQ ID NO: 6479700 - DNA, 14 bp, Homo sapiens
tcttgtccacagtc

SEQ ID NO: 6479701 - DNA, 15 bp, Homo sapiens
tcttgtccacagtct

SEQ ID NO: 6479702 - DNA, 19 bp, Homo sapiens
tcttgtccacattctactt

SEQ ID NO: 6479703 - DNA, 22 bp, Homo sapiens
tcttgtccacggggctcactct

SEQ ID NO: 6479704 - DNA, 22 bp, Homo sapiens
tcttgtccatgtggttcttcaa

SEQ ID NO: 6479705 - DNA, 19 bp, Homo sapiens
tcttgtcccaattaaaata

SEQ ID NO: 6479706 - DNA, 13 bp, Homo sapiens
tcttgtccctgtc

SEQ ID NO: 6479707 - DNA, 20 bp, Homo sapiens
tcttgtccctttccctacct

SEQ ID NO: 6479708 - DNA, 21 bp, Homo sapiens
tcttgtcctcttctgctcttt

SEQ ID NO: 6479709 - DNA, 14 bp, Homo sapiens
tcttgtcctggccc

SEQ ID NO: 6479710 - DNA, 20 bp, Homo sapiens
tcttgtcctggcccttcagt

SEQ ID NO: 6479711 - DNA, 12 bp, Homo sapiens
tcttgtctataa

SEQ ID NO: 6479712 - DNA, 15 bp, Homo sapiens
tcttgtctataaagc

SEQ ID NO: 6479713 - DNA, 16 bp, Homo sapiens
tcttgtctataaagca

SEQ ID NO: 6479714 - DNA, 14 bp, Homo sapiens
tcttgtctcaatgc

SEQ ID NO: 6479715 - DNA, 12 bp, Homo sapiens
tcttgtctcaga

SEQ ID NO: 6479716 - DNA, 13 bp, Homo sapiens
tcttgtctccact

SEQ ID NO: 6479717 - DNA, 13 bp, Homo sapiens
tcttgtctcccct

SEQ ID NO: 6479718 - DNA, 13 bp, Homo sapiens
tcttgtctctgag

SEQ ID NO: 6479719 - DNA, 15 bp, Homo sapiens
tcttgtctctgaggc

SEQ ID NO: 6479720 - DNA, 16 bp, Homo sapiens
tggaaaacttagtttg

SEQ ID NO: 6479721 - DNA, 20 bp, Homo sapiens
tggaaaacttagtttgtgaa

SEQ ID NO: 6479722 - DNA, 22 bp, Homo sapiens
tggaaaagaatccctgcagcct

SEQ ID NO: 6479723 - DNA, 23 bp, Homo sapiens
tggaaaagaatccctgcagcctg

SEQ ID NO: 6479724 - DNA, 14 bp, Homo sapiens
tggaaaagacagaa

SEQ ID NO: 6479725 - DNA, 14 bp, Homo sapiens
tggaaaagagctgg

SEQ ID NO: 6479726 - DNA, 14 bp, Homo sapiens
tggaaaagctgggg

SEQ ID NO: 6479727 - DNA, 22 bp, Homo sapiens
tggaaaagcttaaaaaaattac

SEQ ID NO: 6479728 - DNA, 16 bp, Homo sapiens
tggaaaaggaagacta

SEQ ID NO: 6479729 - DNA, 18 bp, Homo sapiens
tggaaaaggaagactaga

SEQ ID NO: 6479730 - DNA, 21 bp, Homo sapiens
tggaaaagtcacacagacaca

SEQ ID NO: 6479731 - DNA, 18 bp, Homo sapiens
tggaaaagtgatgtattt

SEQ ID NO: 6479732 - DNA, 21 bp, Homo sapiens
tggaaaagtgatgtattttca

SEQ ID NO: 6479733 - DNA, 16 bp, Homo sapiens
tggaaaagtgtccttc

SEQ ID NO: 6479734 - DNA, 15 bp, Homo sapiens
tggaaaataaaaatg

SEQ ID NO: 6479735 - DNA, 13 bp, Homo sapiens
tggaaaataaaca

SEQ ID NO: 6479736 - DNA, 16 bp, Homo sapiens
tggaaaataaattatt

SEQ ID NO: 6479737 - DNA, 22 bp, Homo sapiens
tggaaaatagtttgcaacatat

SEQ ID NO: 6479738 - DNA, 14 bp, Homo sapiens
tggaaaatatacaa

SEQ ID NO: 6479739 - DNA, 23 bp, Homo sapiens
tggaaaatgacctcaaggaagct

SEQ ID NO: 6479740 - DNA, 21 bp, Homo sapiens
tggaaaatgatctagttcctg

SEQ ID NO: 6479741 - DNA, 16 bp, Homo sapiens
tggaaaatgtcctgtg

SEQ ID NO: 6479742 - DNA, 19 bp, Homo sapiens
tggaaaattaattctaaac

SEQ ID NO: 6479743 - DNA, 22 bp, Homo sapiens
tggaaaattcagataatggtaa

SEQ ID NO: 6479744 - DNA, 15 bp, Homo sapiens
tggaaaattcatttt

SEQ ID NO: 6479745 - DNA, 15 bp, Homo sapiens
tggaaaattttctcc

SEQ ID NO: 6479746 - DNA, 19 bp, Homo sapiens
tggaaaattttctccttgg

SEQ ID NO: 6479747 - DNA, 14 bp, Homo sapiens
tggaaacaaaacag

SEQ ID NO: 6479748 - DNA, 13 bp, Homo sapiens
tggaaacaaagtg

SEQ ID NO: 6479749 - DNA, 17 bp, Homo sapiens
tggaaacaagtcagtca

SEQ ID NO: 6479750 - DNA, 22 bp, Homo sapiens
tggaaacaagtgaccccagggc

SEQ ID NO: 6479751 - DNA, 17 bp, Homo sapiens
tggaaacaatcctgtta

SEQ ID NO: 6479752 - DNA, 12 bp, Homo sapiens
tggaaacaatgt

SEQ ID NO: 6479753 - DNA, 15 bp, Homo sapiens
tggaaacaatgtgga

SEQ ID NO: 6479754 - DNA, 15 bp, Homo sapiens
tggaaacaccactgc

SEQ ID NO: 6479755 - DNA, 19 bp, Homo sapiens
tggaaacactaaatgttaa

SEQ ID NO: 6479756 - DNA, 20 bp, Homo sapiens
tggaaacactaaatgttaaa

SEQ ID NO: 6479757 - DNA, 22 bp, Homo sapiens
tggaaacactaaatgttaaaga

SEQ ID NO: 6479758 - DNA, 14 bp, Homo sapiens
tggaaacagaagac

SEQ ID NO: 6479759 - DNA, 22 bp, Homo sapiens
tggaaacagacagggagaagtt

SEQ ID NO: 6479760 - DNA, 15 bp, Homo sapiens
tggaaacagaggtaa

SEQ ID NO: 6479761 - DNA, 16 bp, Homo sapiens
tggaaacagaggtaaa

SEQ ID NO: 6479762 - DNA, 22 bp, Homo sapiens
tggaaacagctcgactttaaaa

SEQ ID NO: 6479763 - DNA, 14 bp, Homo sapiens
tggaaacagggcag

SEQ ID NO: 6479764 - DNA, 14 bp, Homo sapiens
tggaaacatctgat

SEQ ID NO: 6479765 - DNA, 17 bp, Homo sapiens
tggaaacattacagttc

SEQ ID NO: 6479766 - DNA, 23 bp, Homo sapiens
tggaaacatttacaataaatatt

SEQ ID NO: 6479767 - DNA, 20 bp, Homo sapiens
tggaaacatttatattttta

SEQ ID NO: 6479768 - DNA, 22 bp, Homo sapiens
tggaaacattttatactgtaca

SEQ ID NO: 6479769 - DNA, 15 bp, Homo sapiens
tggaaacattttctt

SEQ ID NO: 6479770 - DNA, 19 bp, Homo sapiens
tggaaaccaaaaggccgtg

SEQ ID NO: 6479771 - DNA, 19 bp, Homo sapiens
tggaaaccacacttcttga

SEQ ID NO: 6479772 - DNA, 21 bp, Homo sapiens
tggaaaccaccttaaaacatt

SEQ ID NO: 6479773 - DNA, 20 bp, Homo sapiens
tggaaaccatgcactagcca

SEQ ID NO: 6479774 - DNA, 20 bp, Homo sapiens
tggaaacctagccagcttca

SEQ ID NO: 6479775 - DNA, 17 bp, Homo sapiens
tggaaacctctacatat

SEQ ID NO: 6479776 - DNA, 17 bp, Homo sapiens
tggaaacctgaaaaaaa

SEQ ID NO: 6479777 - DNA, 14 bp, Homo sapiens
tggaaacctgccct

SEQ ID NO: 6479778 - DNA, 16 bp, Homo sapiens
tggaaacctgccctgc

SEQ ID NO: 6479779 - DNA, 24 bp, Homo sapiens
tggaaacctgccctgcctgagggc

SEQ ID NO: 6479780 - DNA, 19 bp, Homo sapiens
tggaaaccttccacccagt

SEQ ID NO: 6479781 - DNA, 14 bp, Homo sapiens
tggaaacgcactta

SEQ ID NO: 6479782 - DNA, 16 bp, Homo sapiens
tggaaacgcacttaca

SEQ ID NO: 6479783 - DNA, 13 bp, Homo sapiens
tggaaactaataa

SEQ ID NO: 6479784 - DNA, 23 bp, Homo sapiens
tggaaactaataaaatattttct

SEQ ID NO: 6479785 - DNA, 18 bp, Homo sapiens
tggaaactatgtgttttt

SEQ ID NO: 6479786 - DNA, 17 bp, Homo sapiens
tggaaactcaaggaaaa

SEQ ID NO: 6479787 - DNA, 23 bp, Homo sapiens
tggaaactcaaggaaaagttctt

SEQ ID NO: 6479788 - DNA, 18 bp, Homo sapiens
tggaaactcagccgtagg

SEQ ID NO: 6479789 - DNA, 16 bp, Homo sapiens
tggaaactgaatgctc

SEQ ID NO: 6479790 - DNA, 15 bp, Homo sapiens
tggaaactgctaaat

SEQ ID NO: 6479791 - DNA, 17 bp, Homo sapiens
tggaaactgctaaattc

SEQ ID NO: 6479792 - DNA, 19 bp, Homo sapiens
tggaaactgctaaattcta

SEQ ID NO: 6479793 - DNA, 20 bp, Homo sapiens
tggaaactgctaaattctat

SEQ ID NO: 6479794 - DNA, 20 bp, Homo sapiens
tggaaactggactcacattc

SEQ ID NO: 6479795 - DNA, 21 bp, Homo sapiens
tggaaactgttgccagagatg

SEQ ID NO: 6479796 - DNA, 17 bp, Homo sapiens
tggaaactgttggttga

SEQ ID NO: 6479797 - DNA, 14 bp, Homo sapiens
tggaaacttctgta

SEQ ID NO: 6479798 - DNA, 22 bp, Homo sapiens
tggaaacttttgttagggctgc

SEQ ID NO: 6479799 - DNA, 13 bp, Homo sapiens
tggaaagaacatt

SEQ ID NO: 6479800 - DNA, 10 bp, Homo sapiens
tggaaagaag

SEQ ID NO: 6479801 - DNA, 13 bp, Homo sapiens
tggaaagaaggaa

SEQ ID NO: 6479802 - DNA, 15 bp, Homo sapiens
tggaaagaaggaaaa

SEQ ID NO: 6479803 - DNA, 19 bp, Homo sapiens
tggaaagaaggaaaaaagg

SEQ ID NO: 6479804 - DNA, 21 bp, Homo sapiens
tggaaagaaggaaaaaaggag

SEQ ID NO: 6479805 - DNA, 20 bp, Homo sapiens
tggaaagactgattgtttta

SEQ ID NO: 6479806 - DNA, 13 bp, Homo sapiens
tggaaagactggg

SEQ ID NO: 6479807 - DNA, 23 bp, Homo sapiens
tggaaagacttctcaaagagaat

SEQ ID NO: 6479808 - DNA, 20 bp, Homo sapiens
tggaaagagctgttttggat

SEQ ID NO: 6479809 - DNA, 17 bp, Homo sapiens
tggaaagaggctctgga

SEQ ID NO: 6479810 - DNA, 20 bp, Homo sapiens
tggaaagagtgttggtgttg

SEQ ID NO: 6479811 - DNA, 15 bp, Homo sapiens
tggaaagatggggag

SEQ ID NO: 6479812 - DNA, 15 bp, Homo sapiens
tggaaagatgttaag

SEQ ID NO: 6479813 - DNA, 19 bp, Homo sapiens
tggaaagatgttaagcatt

SEQ ID NO: 6479814 - DNA, 20 bp, Homo sapiens
tggaaagattgtgtctggtc

SEQ ID NO: 6479815 - DNA, 19 bp, Homo sapiens
tggaaagcaaggtttcctt

SEQ ID NO: 6479816 - DNA, 21 bp, Homo sapiens
tggaaagcacaagactggccc

SEQ ID NO: 6479817 - DNA, 20 bp, Homo sapiens
tggaaagcagagcctcctgg

SEQ ID NO: 6479818 - DNA, 19 bp, Homo sapiens
tggaaagcatcacctcagg

SEQ ID NO: 6479819 - DNA, 20 bp, Homo sapiens
tggaaagcatcacctcaggc

SEQ ID NO: 6479820 - DNA, 21 bp, Homo sapiens
tggaaagcatcacctcaggcc

SEQ ID NO: 6479821 - DNA, 12 bp, Homo sapiens
tggaaagccagg

SEQ ID NO: 6479822 - DNA, 16 bp, Homo sapiens
tggaaagcctctgctg

SEQ ID NO: 6479823 - DNA, 17 bp, Homo sapiens
tggaaaggaaaaaagaa

SEQ ID NO: 6479824 - DNA, 17 bp, Homo sapiens
tggaaaggaaagatgat

SEQ ID NO: 6479825 - DNA, 20 bp, Homo sapiens
tggaaaggaagaatgcagag

SEQ ID NO: 6479826 - DNA, 12 bp, Homo sapiens
tggaaaggaatg

SEQ ID NO: 6479827 - DNA, 13 bp, Homo sapiens
tggaaaggaccaa

SEQ ID NO: 6479828 - DNA, 17 bp, Homo sapiens
tggaaaggagaggaaag

SEQ ID NO: 6479829 - DNA, 22 bp, Homo sapiens
tggaaaggagcctaggccaggt

SEQ ID NO: 6479830 - DNA, 15 bp, Homo sapiens
tggaaaggatcacag

SEQ ID NO: 6479831 - DNA, 17 bp, Homo sapiens
tggaaaggatcacagat

SEQ ID NO: 6479832 - DNA, 21 bp, Homo sapiens
tggaaaggatctgtgattggc

SEQ ID NO: 6479833 - DNA, 22 bp, Homo sapiens
tggaaaggatctgtgattggct

SEQ ID NO: 6479834 - DNA, 13 bp, Homo sapiens
tggaaaggcagct

SEQ ID NO: 6479835 - DNA, 17 bp, Homo sapiens
tggaaaggccagcagcc

SEQ ID NO: 6479836 - DNA, 13 bp, Homo sapiens
tggaaaggctcag

SEQ ID NO: 6479837 - DNA, 13 bp, Homo sapiens
tggaaaggggaga

SEQ ID NO: 6479838 - DNA, 19 bp, Homo sapiens
tggaaaggggagagcctgc

SEQ ID NO: 6479839 - DNA, 21 bp, Homo sapiens
tggaaaggggagagcctgctg

SEQ ID NO: 6479840 - DNA, 17 bp, Homo sapiens
tggaaaggggaggagct

SEQ ID NO: 6479841 - DNA, 17 bp, Homo sapiens
tggaaaggggggagctg

SEQ ID NO: 6479842 - DNA, 18 bp, Homo sapiens
tggaaaggggggagctgg

SEQ ID NO: 6479843 - DNA, 16 bp, Homo sapiens
tggaaagggtgtggct

SEQ ID NO: 6479844 - DNA, 22 bp, Homo sapiens
tggaaagggtgtggcttggaac

SEQ ID NO: 6479845 - DNA, 19 bp, Homo sapiens
tggaaaggtcattgtggct

SEQ ID NO: 6479846 - DNA, 22 bp, Homo sapiens
tggaaaggtcctgctgtggaaa

SEQ ID NO: 6479847 - DNA, 22 bp, Homo sapiens
tggaaaggtttcaagacttgat

SEQ ID NO: 6479848 - DNA, 23 bp, Homo sapiens
tggaaaggtttcaagacttgata

SEQ ID NO: 6479849 - DNA, 19 bp, Homo sapiens
tggaaagtaactcatttgt

SEQ ID NO: 6479850 - DNA, 15 bp, Homo sapiens
tggaaagtaactgtg

SEQ ID NO: 6479851 - DNA, 14 bp, Homo sapiens
tggaaagtgaattt

SEQ ID NO: 6479852 - DNA, 16 bp, Homo sapiens
tggaaagtgaatttga

SEQ ID NO: 6479853 - DNA, 20 bp, Homo sapiens
tggaaagtgaatttgaatga

SEQ ID NO: 6479854 - DNA, 16 bp, Homo sapiens
tggaaagtgtaaagca

SEQ ID NO: 6479855 - DNA, 17 bp, Homo sapiens
tggaaagtgtaaagcat

SEQ ID NO: 6479856 - DNA, 17 bp, Homo sapiens
tggaaagttcagccaga

SEQ ID NO: 6479857 - DNA, 22 bp, Homo sapiens
tggaaagttcttaggcaccata

SEQ ID NO: 6479858 - DNA, 15 bp, Homo sapiens
tggaaagttgggccc

SEQ ID NO: 6479859 - DNA, 20 bp, Homo sapiens
tggaaagttgggcccctgag

SEQ ID NO: 6479860 - DNA, 16 bp, Homo sapiens
tggaaagttttctcca

SEQ ID NO: 6479861 - DNA, 13 bp, Homo sapiens
tggaaataaaaag

SEQ ID NO: 6479862 - DNA, 17 bp, Homo sapiens
tggaaataaacctggag

SEQ ID NO: 6479863 - DNA, 19 bp, Homo sapiens
tggaaataaacctggagat

SEQ ID NO: 6479864 - DNA, 22 bp, Homo sapiens
tggaaataaacctggagatgat

SEQ ID NO: 6479865 - DNA, 23 bp, Homo sapiens
tggaaataaacctggagatgatg

SEQ ID NO: 6479866 - DNA, 12 bp, Homo sapiens
tggaaataaagt

SEQ ID NO: 6479867 - DNA, 14 bp, Homo sapiens
tggaaataaagtca

SEQ ID NO: 6479868 - DNA, 12 bp, Homo sapiens
tggaaataataa

SEQ ID NO: 6479869 - DNA, 13 bp, Homo sapiens
tggaaataataaa

SEQ ID NO: 6479870 - DNA, 14 bp, Homo sapiens
tggaaatacacagt

SEQ ID NO: 6479871 - DNA, 16 bp, Homo sapiens
tggaaatacagttatt

SEQ ID NO: 6479872 - DNA, 22 bp, Homo sapiens
tggaaatacagttgttggcctc

SEQ ID NO: 6479873 - DNA, 13 bp, Homo sapiens
tggaaatacattt

SEQ ID NO: 6479874 - DNA, 14 bp, Homo sapiens
tggaaatacattta

SEQ ID NO: 6479875 - DNA, 17 bp, Homo sapiens
tggaaatacatttagaa

SEQ ID NO: 6479876 - DNA, 17 bp, Homo sapiens
tggaaataccaggacca

SEQ ID NO: 6479877 - DNA, 15 bp, Homo sapiens
tggaaatactagatt

SEQ ID NO: 6479878 - DNA, 20 bp, Homo sapiens
tggaaatactgatggaagca

SEQ ID NO: 6479879 - DNA, 14 bp, Homo sapiens
tggaaatagaaaga

SEQ ID NO: 6479880 - DNA, 22 bp, Homo sapiens
tggaaatagaaagaagccatat

SEQ ID NO: 6479881 - DNA, 21 bp, Homo sapiens
tggaaatagaaatttccagag

SEQ ID NO: 6479882 - DNA, 21 bp, Homo sapiens
tggaaatataggctatgtaat

SEQ ID NO: 6479883 - DNA, 22 bp, Homo sapiens
tggaaatatcagttactcagcc

SEQ ID NO: 6479884 - DNA, 21 bp, Homo sapiens
tggaaatatgcaacctgtgca

SEQ ID NO: 6479885 - DNA, 13 bp, Homo sapiens
tggaaatattaaa

SEQ ID NO: 6479886 - DNA, 16 bp, Homo sapiens
tggaaatattaagaac

SEQ ID NO: 6479887 - DNA, 16 bp, Homo sapiens
tggaaatattatgcaa

SEQ ID NO: 6479888 - DNA, 19 bp, Homo sapiens
tggaaatattctatgacca

SEQ ID NO: 6479889 - DNA, 18 bp, Homo sapiens
tggaaatcaaatgtaaag

SEQ ID NO: 6479890 - DNA, 20 bp, Homo sapiens
tggaaatcaatcagaaggta

SEQ ID NO: 6479891 - DNA, 24 bp, Homo sapiens
tggaaatcaatcagaaggtattct

SEQ ID NO: 6479892 - DNA, 18 bp, Homo sapiens
tggaaatcagccaagttt

SEQ ID NO: 6479893 - DNA, 17 bp, Homo sapiens
tggaaatcataccagtt

SEQ ID NO: 6479894 - DNA, 22 bp, Homo sapiens
tggaaatcctagtttcctctcc

SEQ ID NO: 6479895 - DNA, 17 bp, Homo sapiens
tggaaatcctgccctgg

SEQ ID NO: 6479896 - DNA, 20 bp, Homo sapiens
tggaaatcctgccctggagg

SEQ ID NO: 6479897 - DNA, 13 bp, Homo sapiens
tcttgtctctggg

SEQ ID NO: 6479898 - DNA, 16 bp, Homo sapiens
tcttgtctgatttctt

SEQ ID NO: 6479899 - DNA, 12 bp, Homo sapiens
tcttgtctgtta

SEQ ID NO: 6479900 - DNA, 20 bp, Homo sapiens
tcttgtcttcctatttcaga

SEQ ID NO: 6479901 - DNA, 17 bp, Homo sapiens
tcttgtctttgtccctg

SEQ ID NO: 6479902 - DNA, 15 bp, Homo sapiens
tcttgtcttttcaga

SEQ ID NO: 6479903 - DNA, 17 bp, Homo sapiens
tcttgtgaaaataattg

SEQ ID NO: 6479904 - DNA, 18 bp, Homo sapiens
tcttgtgaaaccacaggc

SEQ ID NO: 6479905 - DNA, 13 bp, Homo sapiens
tcttgtgaaattg

SEQ ID NO: 6479906 - DNA, 18 bp, Homo sapiens
tcttgtgaaattgtgtag

SEQ ID NO: 6479907 - DNA, 17 bp, Homo sapiens
tcttgtgaactgtcttg

SEQ ID NO: 6479908 - DNA, 17 bp, Homo sapiens
tcttgtgaactttgaat

SEQ ID NO: 6479909 - DNA, 16 bp, Homo sapiens
tcttgtgaaggccatg

SEQ ID NO: 6479910 - DNA, 17 bp, Homo sapiens
tcttgtgactcagcaga

SEQ ID NO: 6479911 - DNA, 13 bp, Homo sapiens
tcttgtgaggaaa

SEQ ID NO: 6479912 - DNA, 18 bp, Homo sapiens
tcttgtgatgtattcttt

SEQ ID NO: 6479913 - DNA, 22 bp, Homo sapiens
tcttgtgatgtttgctcagagg

SEQ ID NO: 6479914 - DNA, 17 bp, Homo sapiens
tcttgtgatttggttgc

SEQ ID NO: 6479915 - DNA, 11 bp, Homo sapiens
tcttgtgcata

SEQ ID NO: 6479916 - DNA, 14 bp, Homo sapiens
tcttgtgcatgcaa

SEQ ID NO: 6479917 - DNA, 15 bp, Homo sapiens
tcttgtgcatgcaaa

SEQ ID NO: 6479918 - DNA, 15 bp, Homo sapiens
tcttgtgccctgggc

SEQ ID NO: 6479919 - DNA, 16 bp, Homo sapiens
tcttgtgcctcggcct

SEQ ID NO: 6479920 - DNA, 18 bp, Homo sapiens
tcttgtgctagaatactt

SEQ ID NO: 6479921 - DNA, 21 bp, Homo sapiens
tcttgtgctagaatacttttt

SEQ ID NO: 6479922 - DNA, 23 bp, Homo sapiens
tcttgtgctagaatactttttaa

SEQ ID NO: 6479923 - DNA, 19 bp, Homo sapiens
tcttgtgctcacgctcccc

SEQ ID NO: 6479924 - DNA, 22 bp, Homo sapiens
tcttgtgctcagcatgattctt

SEQ ID NO: 6479925 - DNA, 17 bp, Homo sapiens
tcttgtggaagacactt

SEQ ID NO: 6479926 - DNA, 23 bp, Homo sapiens
tcttgtggaagacacttgctgag

SEQ ID NO: 6479927 - DNA, 18 bp, Homo sapiens
tcttgtgggagacagcag

SEQ ID NO: 6479928 - DNA, 22 bp, Homo sapiens
tcttgtgggagacagcagcctg

SEQ ID NO: 6479929 - DNA, 20 bp, Homo sapiens
tcttgtggtgtaaagctggc

SEQ ID NO: 6479930 - DNA, 21 bp, Homo sapiens
tcttgtggtgtaaagctggcc

SEQ ID NO: 6479931 - DNA, 24 bp, Homo sapiens
tcttgtggtgtaaagctggccctg

SEQ ID NO: 6479932 - DNA, 15 bp, Homo sapiens
tcttgtggttaaaaa

SEQ ID NO: 6479933 - DNA, 17 bp, Homo sapiens
tcttgtggttgtgtgtg

SEQ ID NO: 6479934 - DNA, 17 bp, Homo sapiens
tcttgtgtatttcagtt

SEQ ID NO: 6479935 - DNA, 21 bp, Homo sapiens
tcttgtgtcatcaagtagtag

SEQ ID NO: 6479936 - DNA, 18 bp, Homo sapiens
tcttgtgtctactctagg

SEQ ID NO: 6479937 - DNA, 20 bp, Homo sapiens
tcttgtgtctttggaggtgc

SEQ ID NO: 6479938 - DNA, 18 bp, Homo sapiens
tcttgtgtgattaactta

SEQ ID NO: 6479939 - DNA, 21 bp, Homo sapiens
tcttgtgtgtttattgtcaaa

SEQ ID NO: 6479940 - DNA, 10 bp, Homo sapiens
tcttgtgtta

SEQ ID NO: 6479941 - DNA, 13 bp, Homo sapiens
tcttgtgttaact

SEQ ID NO: 6479942 - DNA, 15 bp, Homo sapiens
tcttgtgttaacttg

SEQ ID NO: 6479943 - DNA, 18 bp, Homo sapiens
tcttgtgttaacttgcct

SEQ ID NO: 6479944 - DNA, 15 bp, Homo sapiens
tcttgtgttcgtgtt

SEQ ID NO: 6479945 - DNA, 20 bp, Homo sapiens
tcttgtgttgttttctctga

SEQ ID NO: 6479946 - DNA, 17 bp, Homo sapiens
tcttgtgtttgaaacac

SEQ ID NO: 6479947 - DNA, 13 bp, Homo sapiens
tcttgtgtttgct

SEQ ID NO: 6479948 - DNA, 15 bp, Homo sapiens
tcttgtgtttgctgc

SEQ ID NO: 6479949 - DNA, 17 bp, Homo sapiens
tcttgttaatattcttt

SEQ ID NO: 6479950 - DNA, 21 bp, Homo sapiens
tcttgttaatattctttcaat

SEQ ID NO: 6479951 - DNA, 13 bp, Homo sapiens
tcttgttaatgca

SEQ ID NO: 6479952 - DNA, 14 bp, Homo sapiens
tcttgttaatttca

SEQ ID NO: 6479953 - DNA, 16 bp, Homo sapiens
tcttgttaatttcatt

SEQ ID NO: 6479954 - DNA, 21 bp, Homo sapiens
tcttgttactccctgttattt

SEQ ID NO: 6479955 - DNA, 13 bp, Homo sapiens
tcttgttactgct

SEQ ID NO: 6479956 - DNA, 18 bp, Homo sapiens
tcttgttagatttttaac

SEQ ID NO: 6479957 - DNA, 17 bp, Homo sapiens
tcttgttatgtacaaac

SEQ ID NO: 6479958 - DNA, 20 bp, Homo sapiens
tcttgttattaatgtttctt

SEQ ID NO: 6479959 - DNA, 21 bp, Homo sapiens
tcttgttattgaagtgttctg

SEQ ID NO: 6479960 - DNA, 22 bp, Homo sapiens
tcttgttcatgttttgctaatg

SEQ ID NO: 6479961 - DNA, 16 bp, Homo sapiens
tcttgttcgcacaatc

SEQ ID NO: 6479962 - DNA, 21 bp, Homo sapiens
tcttgttgctcaaaaaatgag

SEQ ID NO: 6479963 - DNA, 22 bp, Homo sapiens
tcttgttgctcaaaaaatgagc

SEQ ID NO: 6479964 - DNA, 18 bp, Homo sapiens
tcttgttgctgtacaaaa

SEQ ID NO: 6479965 - DNA, 19 bp, Homo sapiens
tcttgttgctttgttgcac

SEQ ID NO: 6479966 - DNA, 17 bp, Homo sapiens
tcttgttggtgcacagc

SEQ ID NO: 6479967 - DNA, 13 bp, Homo sapiens
tcttgttgtttat

SEQ ID NO: 6479968 - DNA, 21 bp, Homo sapiens
tcttgttgtttatatgaaaac

SEQ ID NO: 6479969 - DNA, 23 bp, Homo sapiens
tcttgttgtttatatgaaaacac

SEQ ID NO: 6479970 - DNA, 10 bp, Homo sapiens
tcttgtttaa

SEQ ID NO: 6479971 - DNA, 14 bp, Homo sapiens
tcttgtttaaaaaa

SEQ ID NO: 6479972 - DNA, 17 bp, Homo sapiens
tcttgtttaaaaaaaga

SEQ ID NO: 6479973 - DNA, 13 bp, Homo sapiens
tcttgtttatagc

SEQ ID NO: 6479974 - DNA, 13 bp, Homo sapiens
tcttgtttattga

SEQ ID NO: 6479975 - DNA, 13 bp, Homo sapiens
tcttgtttctcca

SEQ ID NO: 6479976 - DNA, 11 bp, Homo sapiens
tcttgtttctg

SEQ ID NO: 6479977 - DNA, 20 bp, Homo sapiens
tcttgtttctgaagtactta

SEQ ID NO: 6479978 - DNA, 12 bp, Homo sapiens
tcttgtttctgc

SEQ ID NO: 6479979 - DNA, 12 bp, Homo sapiens
tcttgtttctgt

SEQ ID NO: 6479980 - DNA, 15 bp, Homo sapiens
tcttgtttctgtgcc

SEQ ID NO: 6479981 - DNA, 16 bp, Homo sapiens
tcttgtttctgtttag

SEQ ID NO: 6479982 - DNA, 17 bp, Homo sapiens
tcttgtttgtcagcatc

SEQ ID NO: 6479983 - DNA, 20 bp, Homo sapiens
tcttgtttgtcagcatctga

SEQ ID NO: 6479984 - DNA, 13 bp, Homo sapiens
tcttgttttgctt

SEQ ID NO: 6479985 - DNA, 15 bp, Homo sapiens
tcttgttttgttata

SEQ ID NO: 6479986 - DNA, 15 bp, Homo sapiens
tcttgttttgtttgt

SEQ ID NO: 6479987 - DNA, 17 bp, Homo sapiens
tcttgttttgtttgtct

SEQ ID NO: 6479988 - DNA, 22 bp, Homo sapiens
tcttgttttgtttgtctctcct

SEQ ID NO: 6479989 - DNA, 16 bp, Homo sapiens
tcttgtttttaagttt

SEQ ID NO: 6479990 - DNA, 20 bp, Homo sapiens
tcttgtttttattaatttat

SEQ ID NO: 6479991 - DNA, 21 bp, Homo sapiens
tcttgtttttattaatttata

SEQ ID NO: 6479992 - DNA, 22 bp, Homo sapiens
tcttgtttttccactactgcta

SEQ ID NO: 6479993 - DNA, 18 bp, Homo sapiens
tcttgttttttttttcca

SEQ ID NO: 6479994 - DNA, 21 bp, Homo sapiens
tcttgttttttttttccactt

SEQ ID NO: 6479995 - DNA, 19 bp, Homo sapiens
tctttaaaaaaaaatcttg

SEQ ID NO: 6479996 - DNA, 15 bp, Homo sapiens
tctttaaaaaagaaa

SEQ ID NO: 6479997 - DNA, 19 bp, Homo sapiens
tctttaaaaagcagtcctc

SEQ ID NO: 6479998 - DNA, 17 bp, Homo sapiens
tctttaaaagaatgact

SEQ ID NO: 6479999 - DNA, 16 bp, Homo sapiens
tctttaaaagagagag

SEQ ID NO: 6480000 - DNA, 23 bp, Homo sapiens
tctttaaaagagagagagagaaa

SEQ ID NO: 6480001 - DNA, 17 bp, Homo sapiens
tctttaaaagtgcctta

SEQ ID NO: 6480002 - DNA, 17 bp, Homo sapiens
tctttaaaatacacact

SEQ ID NO: 6480003 - DNA, 23 bp, Homo sapiens
tctttaaaatgattcacttttat

SEQ ID NO: 6480004 - DNA, 15 bp, Homo sapiens
tctttaaaattacaa

SEQ ID NO: 6480005 - DNA, 22 bp, Homo sapiens
tctttaaacaaatatgaaaaat

SEQ ID NO: 6480006 - DNA, 23 bp, Homo sapiens
tctttaaacagcaactacagaag

SEQ ID NO: 6480007 - DNA, 16 bp, Homo sapiens
tctttaaacctttcat

SEQ ID NO: 6480008 - DNA, 13 bp, Homo sapiens
tctttaaagccag

SEQ ID NO: 6480009 - DNA, 17 bp, Homo sapiens
tctttaaaggcaaatat

SEQ ID NO: 6480010 - DNA, 18 bp, Homo sapiens
tctttaaaggcccagccc

SEQ ID NO: 6480011 - DNA, 21 bp, Homo sapiens
tctttaaagggatggcaagat

SEQ ID NO: 6480012 - DNA, 23 bp, Homo sapiens
tctttaaagtgactaatggcatg

SEQ ID NO: 6480013 - DNA, 14 bp, Homo sapiens
tctttaaagttctt

SEQ ID NO: 6480014 - DNA, 13 bp, Homo sapiens
tctttaaataaat

SEQ ID NO: 6480015 - DNA, 15 bp, Homo sapiens
tctttaaataaatgt

SEQ ID NO: 6480016 - DNA, 13 bp, Homo sapiens
tctttaaatactt

SEQ ID NO: 6480017 - DNA, 23 bp, Homo sapiens
tctttaaatacttcatgagcatt

SEQ ID NO: 6480018 - DNA, 14 bp, Homo sapiens
tctttaaatagata

SEQ ID NO: 6480019 - DNA, 14 bp, Homo sapiens
tctttaaatatata

SEQ ID NO: 6480020 - DNA, 15 bp, Homo sapiens
tctttaaatatatat

SEQ ID NO: 6480021 - DNA, 17 bp, Homo sapiens
tctttaaatatatatta

SEQ ID NO: 6480022 - DNA, 13 bp, Homo sapiens
tctttaaatcaaa

SEQ ID NO: 6480023 - DNA, 14 bp, Homo sapiens
tctttaaatcaaaa

SEQ ID NO: 6480024 - DNA, 21 bp, Homo sapiens
tctttaaatcaaaagctgctt

SEQ ID NO: 6480025 - DNA, 13 bp, Homo sapiens
tctttaaatcagt

SEQ ID NO: 6480026 - DNA, 14 bp, Homo sapiens
tctttaaatcagta

SEQ ID NO: 6480027 - DNA, 16 bp, Homo sapiens
tctttaaatgctgctt

SEQ ID NO: 6480028 - DNA, 16 bp, Homo sapiens
tctttaaatgttttat

SEQ ID NO: 6480029 - DNA, 20 bp, Homo sapiens
tctttaacaattgtcttaaa

SEQ ID NO: 6480030 - DNA, 14 bp, Homo sapiens
tctttaacatagtc

SEQ ID NO: 6480031 - DNA, 17 bp, Homo sapiens
tctttaaccaaacaata

SEQ ID NO: 6480032 - DNA, 14 bp, Homo sapiens
tctttaacctcatc

SEQ ID NO: 6480033 - DNA, 16 bp, Homo sapiens
tctttaactcaggact

SEQ ID NO: 6480034 - DNA, 20 bp, Homo sapiens
tctttaactcaggactccag

SEQ ID NO: 6480035 - DNA, 23 bp, Homo sapiens
tctttaactcaggactccagccc

SEQ ID NO: 6480036 - DNA, 23 bp, Homo sapiens
tctttaactcccattaccatgta

SEQ ID NO: 6480037 - DNA, 20 bp, Homo sapiens
tctttaactgccgtaattta

SEQ ID NO: 6480038 - DNA, 21 bp, Homo sapiens
tctttaactgccgtaatttaa

SEQ ID NO: 6480039 - DNA, 14 bp, Homo sapiens
tctttaagactttt

SEQ ID NO: 6480040 - DNA, 21 bp, Homo sapiens
tctttaaggaagaataaaaaa

SEQ ID NO: 6480041 - DNA, 18 bp, Homo sapiens
tctttaaggtattgtgca

SEQ ID NO: 6480042 - DNA, 15 bp, Homo sapiens
tctttaagtattgtt

SEQ ID NO: 6480043 - DNA, 21 bp, Homo sapiens
tctttaagttttatttaactt

SEQ ID NO: 6480044 - DNA, 24 bp, Homo sapiens
tctttaataacaaggagatttctt

SEQ ID NO: 6480045 - DNA, 17 bp, Homo sapiens
tctttaatataataaaa

SEQ ID NO: 6480046 - DNA, 18 bp, Homo sapiens
tctttaatataatattat

SEQ ID NO: 6480047 - DNA, 15 bp, Homo sapiens
tctttaatcaaaagt

SEQ ID NO: 6480048 - DNA, 18 bp, Homo sapiens
tctttaatcacttaacat

SEQ ID NO: 6480049 - DNA, 23 bp, Homo sapiens
tctttaatcacttaacattccta

SEQ ID NO: 6480050 - DNA, 17 bp, Homo sapiens
tctttaatgattcctat

SEQ ID NO: 6480051 - DNA, 18 bp, Homo sapiens
tctttaatgattcctata

SEQ ID NO: 6480052 - DNA, 20 bp, Homo sapiens
tctttaatgattcctataaa

SEQ ID NO: 6480053 - DNA, 22 bp, Homo sapiens
tctttaatgcctagagaatggg

SEQ ID NO: 6480054 - DNA, 15 bp, Homo sapiens
tctttaatgctgtct

SEQ ID NO: 6480055 - DNA, 16 bp, Homo sapiens
tctttaatgctgtctt

SEQ ID NO: 6480056 - DNA, 20 bp, Homo sapiens
tctttaatgtcacaggcagg

SEQ ID NO: 6480057 - DNA, 17 bp, Homo sapiens
tctttaatgttgtccag

SEQ ID NO: 6480058 - DNA, 13 bp, Homo sapiens
tctttaattgtat

SEQ ID NO: 6480059 - DNA, 20 bp, Homo sapiens
tctttaatttatatcaggtg

SEQ ID NO: 6480060 - DNA, 16 bp, Homo sapiens
tctttaattttaactg

SEQ ID NO: 6480061 - DNA, 13 bp, Homo sapiens
tctttaattttgg

SEQ ID NO: 6480062 - DNA, 16 bp, Homo sapiens
tctttaattttggaat

SEQ ID NO: 6480063 - DNA, 23 bp, Homo sapiens
tctttacaaaacaaactcattca

SEQ ID NO: 6480064 - DNA, 22 bp, Homo sapiens
tctttacaaaatgaatgcattg

SEQ ID NO: 6480065 - DNA, 14 bp, Homo sapiens
tctttacaagcagg

SEQ ID NO: 6480066 - DNA, 14 bp, Homo sapiens
tctttacaataaac

SEQ ID NO: 6480067 - DNA, 22 bp, Homo sapiens
tctttacagctttgtttctgca

SEQ ID NO: 6480068 - DNA, 18 bp, Homo sapiens
tctttacatttcttttaa

SEQ ID NO: 6480069 - DNA, 18 bp, Homo sapiens
tctttaccaaaaaccatg

SEQ ID NO: 6480070 - DNA, 18 bp, Homo sapiens
tctttaccttctaaaagc

SEQ ID NO: 6480071 - DNA, 15 bp, Homo sapiens
tctttactaacactg

SEQ ID NO: 6480072 - DNA, 18 bp, Homo sapiens
tctttactaacactggct

SEQ ID NO: 6480073 - DNA, 20 bp, Homo sapiens
tctttactactgcaagttca

SEQ ID NO: 6480074 - DNA, 16 bp, Homo sapiens
tctttactatgtttct

SEQ ID NO: 6480075 - DNA, 15 bp, Homo sapiens
tctttactattaaaa

SEQ ID NO: 6480076 - DNA, 14 bp, Homo sapiens
tggaaatctttaaa

SEQ ID NO: 6480077 - DNA, 15 bp, Homo sapiens
tggaaatgagaacaa

SEQ ID NO: 6480078 - DNA, 19 bp, Homo sapiens
tggaaatgatgttggtcca

SEQ ID NO: 6480079 - DNA, 20 bp, Homo sapiens
tggaaatgatgttggtccaa

SEQ ID NO: 6480080 - DNA, 15 bp, Homo sapiens
tggaaatgctgggct

SEQ ID NO: 6480081 - DNA, 23 bp, Homo sapiens
tggaaatgggcagagcagagacc

SEQ ID NO: 6480082 - DNA, 22 bp, Homo sapiens
tggaaatggggaactcccccag

SEQ ID NO: 6480083 - DNA, 18 bp, Homo sapiens
tggaaatggggagctggc

SEQ ID NO: 6480084 - DNA, 18 bp, Homo sapiens
tggaaatgtctgctggta

SEQ ID NO: 6480085 - DNA, 17 bp, Homo sapiens
tggaaatgtgagaaatg

SEQ ID NO: 6480086 - DNA, 21 bp, Homo sapiens
tggaaatgtgagaaatgtcta

SEQ ID NO: 6480087 - DNA, 15 bp, Homo sapiens
tggaaatgttaagaa

SEQ ID NO: 6480088 - DNA, 13 bp, Homo sapiens
tggaaatgttctt

SEQ ID NO: 6480089 - DNA, 18 bp, Homo sapiens
tggaaattaagaagaaac

SEQ ID NO: 6480090 - DNA, 20 bp, Homo sapiens
tggaaattaagaagaaacta

SEQ ID NO: 6480091 - DNA, 19 bp, Homo sapiens
tggaaattaggttgaaaca

SEQ ID NO: 6480092 - DNA, 20 bp, Homo sapiens
tggaaattaggttgaaacat

SEQ ID NO: 6480093 - DNA, 23 bp, Homo sapiens
tggaaattcccgtgttgcttcaa

SEQ ID NO: 6480094 - DNA, 17 bp, Homo sapiens
tggaaattcccttcatc

SEQ ID NO: 6480095 - DNA, 18 bp, Homo sapiens
tggaaattcccttcatct

SEQ ID NO: 6480096 - DNA, 22 bp, Homo sapiens
tggaaattcccttcatctggaa

SEQ ID NO: 6480097 - DNA, 14 bp, Homo sapiens
tggaaattcctgta

SEQ ID NO: 6480098 - DNA, 23 bp, Homo sapiens
tggaaattccttgccccacagtt

SEQ ID NO: 6480099 - DNA, 14 bp, Homo sapiens
tggaaattctgaaa

SEQ ID NO: 6480100 - DNA, 19 bp, Homo sapiens
tggaaattcttccctgggg

SEQ ID NO: 6480101 - DNA, 21 bp, Homo sapiens
tggaaattgggtgtgccctgg

SEQ ID NO: 6480102 - DNA, 13 bp, Homo sapiens
tggaaatttaaag

SEQ ID NO: 6480103 - DNA, 23 bp, Homo sapiens
tggaaatttataatataaatata

SEQ ID NO: 6480104 - DNA, 13 bp, Homo sapiens
tggaaatttcacg

SEQ ID NO: 6480105 - DNA, 14 bp, Homo sapiens
tggaaatttcacgt

SEQ ID NO: 6480106 - DNA, 13 bp, Homo sapiens
tggaaattttagt

SEQ ID NO: 6480107 - DNA, 21 bp, Homo sapiens
tggaaattttatatgtaaatg

SEQ ID NO: 6480108 - DNA, 16 bp, Homo sapiens
tggaaattttgtccat

SEQ ID NO: 6480109 - DNA, 14 bp, Homo sapiens
tggaaatttttacc

SEQ ID NO: 6480110 - DNA, 15 bp, Homo sapiens
tggaacaaagcatgt

SEQ ID NO: 6480111 - DNA, 16 bp, Homo sapiens
tggaacaaagtgaagg

SEQ ID NO: 6480112 - DNA, 20 bp, Homo sapiens
tggaacaaagtgaaggacat

SEQ ID NO: 6480113 - DNA, 20 bp, Homo sapiens
tggaacaatcacagggaatg

SEQ ID NO: 6480114 - DNA, 15 bp, Homo sapiens
tggaacaccagcagc

SEQ ID NO: 6480115 - DNA, 14 bp, Homo sapiens
tggaacaccctgga

SEQ ID NO: 6480116 - DNA, 14 bp, Homo sapiens
tggaacaccttggg

SEQ ID NO: 6480117 - DNA, 15 bp, Homo sapiens
tggaacacggccaca

SEQ ID NO: 6480118 - DNA, 20 bp, Homo sapiens
tggaacactactcttacatg

SEQ ID NO: 6480119 - DNA, 22 bp, Homo sapiens
tggaacactagacaagccagaa

SEQ ID NO: 6480120 - DNA, 12 bp, Homo sapiens
tggaacactctg

SEQ ID NO: 6480121 - DNA, 15 bp, Homo sapiens
tggaacactgtactg

SEQ ID NO: 6480122 - DNA, 21 bp, Homo sapiens
tggaacactttcctcttctat

SEQ ID NO: 6480123 - DNA, 20 bp, Homo sapiens
tggaacagatatttagctct

SEQ ID NO: 6480124 - DNA, 23 bp, Homo sapiens
tggaacagattcacactgtctgg

SEQ ID NO: 6480125 - DNA, 15 bp, Homo sapiens
tggaacagccctgca

SEQ ID NO: 6480126 - DNA, 18 bp, Homo sapiens
tggaacaggaggaactgg

SEQ ID NO: 6480127 - DNA, 21 bp, Homo sapiens
tggaacaggaggaactggtcc

SEQ ID NO: 6480128 - DNA, 22 bp, Homo sapiens
tggaacagtgaaagtcaattca

SEQ ID NO: 6480129 - DNA, 13 bp, Homo sapiens
tggaacagtgaca

SEQ ID NO: 6480130 - DNA, 12 bp, Homo sapiens
tggaacagtgct

SEQ ID NO: 6480131 - DNA, 17 bp, Homo sapiens
tggaacatatgcacagg

SEQ ID NO: 6480132 - DNA, 18 bp, Homo sapiens
tggaacatatgcacaggg

SEQ ID NO: 6480133 - DNA, 21 bp, Homo sapiens
tggaacatcatcaaggcactg

SEQ ID NO: 6480134 - DNA, 23 bp, Homo sapiens
tggaacatcctttgcagggcagc

SEQ ID NO: 6480135 - DNA, 17 bp, Homo sapiens
tggaacatgcttttact

SEQ ID NO: 6480136 - DNA, 21 bp, Homo sapiens
tggaacatggctagcctttct

SEQ ID NO: 6480137 - DNA, 20 bp, Homo sapiens
tggaacattggaatgttctc

SEQ ID NO: 6480138 - DNA, 13 bp, Homo sapiens
tggaacatttctt

SEQ ID NO: 6480139 - DNA, 16 bp, Homo sapiens
tggaacatttgatatt

SEQ ID NO: 6480140 - DNA, 19 bp, Homo sapiens
tggaaccacattgaagaat

SEQ ID NO: 6480141 - DNA, 13 bp, Homo sapiens
tggaaccagactc

SEQ ID NO: 6480142 - DNA, 14 bp, Homo sapiens
tggaaccagagggg

SEQ ID NO: 6480143 - DNA, 20 bp, Homo sapiens
tggaaccagcaagtcccaga

SEQ ID NO: 6480144 - DNA, 14 bp, Homo sapiens
tggaaccagcccca

SEQ ID NO: 6480145 - DNA, 13 bp, Homo sapiens
tggaaccaggctt

SEQ ID NO: 6480146 - DNA, 13 bp, Homo sapiens
tggaaccatcctc

SEQ ID NO: 6480147 - DNA, 14 bp, Homo sapiens
tggaaccatcctct

SEQ ID NO: 6480148 - DNA, 18 bp, Homo sapiens
tggaaccatggaggagga

SEQ ID NO: 6480149 - DNA, 15 bp, Homo sapiens
tggaacccagactca

SEQ ID NO: 6480150 - DNA, 17 bp, Homo sapiens
tggaacccagactcaga

SEQ ID NO: 6480151 - DNA, 17 bp, Homo sapiens
tggaacccccagcccag

SEQ ID NO: 6480152 - DNA, 21 bp, Homo sapiens
tggaacccttttggcccccga

SEQ ID NO: 6480153 - DNA, 20 bp, Homo sapiens
tggaaccgcaggaagctgct

SEQ ID NO: 6480154 - DNA, 21 bp, Homo sapiens
tggaaccgtgtccagcacaga

SEQ ID NO: 6480155 - DNA, 17 bp, Homo sapiens
tggaacctcagcctggc

SEQ ID NO: 6480156 - DNA, 18 bp, Homo sapiens
tggaacctcagcctggcc

SEQ ID NO: 6480157 - DNA, 19 bp, Homo sapiens
tggaacctcagcctggcca

SEQ ID NO: 6480158 - DNA, 23 bp, Homo sapiens
tggaacctcattgctaccacaga

SEQ ID NO: 6480159 - DNA, 14 bp, Homo sapiens
tggaacctccctgg

SEQ ID NO: 6480160 - DNA, 16 bp, Homo sapiens
tggaacctggcaggcc

SEQ ID NO: 6480161 - DNA, 18 bp, Homo sapiens
tggaacctggcaggccct

SEQ ID NO: 6480162 - DNA, 21 bp, Homo sapiens
tggaacctggcaggccctgcc

SEQ ID NO: 6480163 - DNA, 13 bp, Homo sapiens
tggaaccttccct

SEQ ID NO: 6480164 - DNA, 14 bp, Homo sapiens
tggaaccttctaga

SEQ ID NO: 6480165 - DNA, 21 bp, Homo sapiens
tggaacgggcatgggcctctc

SEQ ID NO: 6480166 - DNA, 22 bp, Homo sapiens
tggaacgggcatgggcctctct

SEQ ID NO: 6480167 - DNA, 15 bp, Homo sapiens
tggaacgttctctac

SEQ ID NO: 6480168 - DNA, 16 bp, Homo sapiens
tggaactaaaatgtta

SEQ ID NO: 6480169 - DNA, 17 bp, Homo sapiens
tggaactacattactgt

SEQ ID NO: 6480170 - DNA, 20 bp, Homo sapiens
tggaactatacccgggacca

SEQ ID NO: 6480171 - DNA, 20 bp, Homo sapiens
tggaactattccatcaatag

SEQ ID NO: 6480172 - DNA, 23 bp, Homo sapiens
tggaactcagctgtctgtggctt

SEQ ID NO: 6480173 - DNA, 16 bp, Homo sapiens
tggaactctaccctgg

SEQ ID NO: 6480174 - DNA, 21 bp, Homo sapiens
tggaactctatctgggcctgg

SEQ ID NO: 6480175 - DNA, 22 bp, Homo sapiens
tggaactctatctgggcctggg

SEQ ID NO: 6480176 - DNA, 21 bp, Homo sapiens
tggaactctcctgctcctcag

SEQ ID NO: 6480177 - DNA, 13 bp, Homo sapiens
tggaactctgctt

SEQ ID NO: 6480178 - DNA, 18 bp, Homo sapiens
tggaactctgtgcaggtg

SEQ ID NO: 6480179 - DNA, 20 bp, Homo sapiens
tggaactctgtgcaggtgct

SEQ ID NO: 6480180 - DNA, 13 bp, Homo sapiens
tggaactgacccc

SEQ ID NO: 6480181 - DNA, 16 bp, Homo sapiens
tggaactgcaatgaaa

SEQ ID NO: 6480182 - DNA, 17 bp, Homo sapiens
tggaactgcaatgaaag

SEQ ID NO: 6480183 - DNA, 20 bp, Homo sapiens
tggaactgcgataactgaga

SEQ ID NO: 6480184 - DNA, 21 bp, Homo sapiens
tggaactgcgttatgaagagc

SEQ ID NO: 6480185 - DNA, 13 bp, Homo sapiens
tggaactgctgcc

SEQ ID NO: 6480186 - DNA, 14 bp, Homo sapiens
tggaactgctgcca

SEQ ID NO: 6480187 - DNA, 23 bp, Homo sapiens
tggaactgctgccatgattttgg

SEQ ID NO: 6480188 - DNA, 20 bp, Homo sapiens
tggaactggaatcctttcag

SEQ ID NO: 6480189 - DNA, 16 bp, Homo sapiens
tggaactgtcccagct

SEQ ID NO: 6480190 - DNA, 17 bp, Homo sapiens
tggaactgtcccagcta

SEQ ID NO: 6480191 - DNA, 18 bp, Homo sapiens
tggaactgtgtttcaaat

SEQ ID NO: 6480192 - DNA, 13 bp, Homo sapiens
tggaactgtttcc

SEQ ID NO: 6480193 - DNA, 16 bp, Homo sapiens
tggaacttaaaacata

SEQ ID NO: 6480194 - DNA, 20 bp, Homo sapiens
tggaacttacaaagggtcta

SEQ ID NO: 6480195 - DNA, 21 bp, Homo sapiens
tggaacttagccatttttcaa

SEQ ID NO: 6480196 - DNA, 13 bp, Homo sapiens
tggaacttctaat

SEQ ID NO: 6480197 - DNA, 15 bp, Homo sapiens
tggaacttctaatat

SEQ ID NO: 6480198 - DNA, 21 bp, Homo sapiens
tggaacttgcctgcctttcca

SEQ ID NO: 6480199 - DNA, 23 bp, Homo sapiens
tggaactttagggggtgggaggg

SEQ ID NO: 6480200 - DNA, 17 bp, Homo sapiens
tggaactttctgttccc

SEQ ID NO: 6480201 - DNA, 16 bp, Homo sapiens
tggaacttttattaga

SEQ ID NO: 6480202 - DNA, 21 bp, Homo sapiens
tggaactttttagattattcc

SEQ ID NO: 6480203 - DNA, 18 bp, Homo sapiens
tggaagaaaaaaatcttc

SEQ ID NO: 6480204 - DNA, 22 bp, Homo sapiens
tggaagaaaaaaatcttctcca

SEQ ID NO: 6480205 - DNA, 15 bp, Homo sapiens
tggaagaaaatggtt

SEQ ID NO: 6480206 - DNA, 16 bp, Homo sapiens
tggaagaaagggagaa

SEQ ID NO: 6480207 - DNA, 20 bp, Homo sapiens
tggaagaaattcctgtagca

SEQ ID NO: 6480208 - DNA, 16 bp, Homo sapiens
tggaagaacaggcctc

SEQ ID NO: 6480209 - DNA, 18 bp, Homo sapiens
tggaagaacaggcctctc

SEQ ID NO: 6480210 - DNA, 17 bp, Homo sapiens
tggaagaacatcaagat

SEQ ID NO: 6480211 - DNA, 18 bp, Homo sapiens
tggaagaacatcaagata

SEQ ID NO: 6480212 - DNA, 15 bp, Homo sapiens
tggaagaaccactgt

SEQ ID NO: 6480213 - DNA, 18 bp, Homo sapiens
tggaagaactgtgataaa

SEQ ID NO: 6480214 - DNA, 15 bp, Homo sapiens
tggaagaagaaccag

SEQ ID NO: 6480215 - DNA, 21 bp, Homo sapiens
tggaagaagggagaagaaagg

SEQ ID NO: 6480216 - DNA, 18 bp, Homo sapiens
tggaagaagggccaccct

SEQ ID NO: 6480217 - DNA, 22 bp, Homo sapiens
tggaagaagggccaccctgagc

SEQ ID NO: 6480218 - DNA, 14 bp, Homo sapiens
tggaagaattcatg

SEQ ID NO: 6480219 - DNA, 14 bp, Homo sapiens
tggaagaattctag

SEQ ID NO: 6480220 - DNA, 17 bp, Homo sapiens
tggaagacaaatacaca

SEQ ID NO: 6480221 - DNA, 11 bp, Homo sapiens
tggaagacaca

SEQ ID NO: 6480222 - DNA, 21 bp, Homo sapiens
tggaagacacttgctgagtga

SEQ ID NO: 6480223 - DNA, 18 bp, Homo sapiens
tggaagacagagaaaact

SEQ ID NO: 6480224 - DNA, 23 bp, Homo sapiens
tggaagacagagacctcctgcct

SEQ ID NO: 6480225 - DNA, 16 bp, Homo sapiens
tggaagacagagatgg

SEQ ID NO: 6480226 - DNA, 21 bp, Homo sapiens
tggaagacagagatggcagag

SEQ ID NO: 6480227 - DNA, 22 bp, Homo sapiens
tggaagacagagatggcagagc

SEQ ID NO: 6480228 - DNA, 23 bp, Homo sapiens
tggaagacagagatggcagagcc

SEQ ID NO: 6480229 - DNA, 14 bp, Homo sapiens
tggaagacagctct

SEQ ID NO: 6480230 - DNA, 21 bp, Homo sapiens
tggaagacaggaaagttcaga

SEQ ID NO: 6480231 - DNA, 14 bp, Homo sapiens
tggaagacatatat

SEQ ID NO: 6480232 - DNA, 15 bp, Homo sapiens
tggaagaccccaccc

SEQ ID NO: 6480233 - DNA, 23 bp, Homo sapiens
tggaagacgcaagggcctgatgg

SEQ ID NO: 6480234 - DNA, 16 bp, Homo sapiens
tggaagagaaatctca

SEQ ID NO: 6480235 - DNA, 17 bp, Homo sapiens
tggaagagaagagaaag

SEQ ID NO: 6480236 - DNA, 23 bp, Homo sapiens
tggaagagagaaagcatattgac

SEQ ID NO: 6480237 - DNA, 12 bp, Homo sapiens
tggaagagaggc

SEQ ID NO: 6480238 - DNA, 13 bp, Homo sapiens
tggaagagaggca

SEQ ID NO: 6480239 - DNA, 13 bp, Homo sapiens
tggaagagattcc

SEQ ID NO: 6480240 - DNA, 22 bp, Homo sapiens
tggaagagcagcacctcctcag

SEQ ID NO: 6480241 - DNA, 13 bp, Homo sapiens
tggaagagcagcc

SEQ ID NO: 6480242 - DNA, 14 bp, Homo sapiens
tggaagagcagcct

SEQ ID NO: 6480243 - DNA, 18 bp, Homo sapiens
tggaagagcagcctgatg

SEQ ID NO: 6480244 - DNA, 12 bp, Homo sapiens
tggaagagcccg

SEQ ID NO: 6480245 - DNA, 23 bp, Homo sapiens
tggaagagcccgccgtctgcagg

SEQ ID NO: 6480246 - DNA, 19 bp, Homo sapiens
tggaagagctgctgtattt

SEQ ID NO: 6480247 - DNA, 22 bp, Homo sapiens
tggaagagctgggtaccaggcc

SEQ ID NO: 6480248 - DNA, 15 bp, Homo sapiens
tggaagaggaggagg

SEQ ID NO: 6480249 - DNA, 16 bp, Homo sapiens
tggaagaggaggagga

SEQ ID NO: 6480250 - DNA, 15 bp, Homo sapiens
tggaagaggggacag

SEQ ID NO: 6480251 - DNA, 21 bp, Homo sapiens
tggaagaggggacaggtccct

SEQ ID NO: 6480252 - DNA, 14 bp, Homo sapiens
tggaagaggttctc

SEQ ID NO: 6480253 - DNA, 14 bp, Homo sapiens
tggaagatagctgt

SEQ ID NO: 6480254 - DNA, 21 bp, Homo sapiens
tctttactattaaaatatttt

SEQ ID NO: 6480255 - DNA, 20 bp, Homo sapiens
tctttactcccttcctggcc

SEQ ID NO: 6480256 - DNA, 17 bp, Homo sapiens
tctttactctgacttcc

SEQ ID NO: 6480257 - DNA, 12 bp, Homo sapiens
tctttactctgg

SEQ ID NO: 6480258 - DNA, 14 bp, Homo sapiens
tctttactgcactc

SEQ ID NO: 6480259 - DNA, 15 bp, Homo sapiens
tctttactgcactca

SEQ ID NO: 6480260 - DNA, 21 bp, Homo sapiens
tctttactgcactcagattta

SEQ ID NO: 6480261 - DNA, 20 bp, Homo sapiens
tctttactggtgatttctga

SEQ ID NO: 6480262 - DNA, 14 bp, Homo sapiens
tctttacttaacat

SEQ ID NO: 6480263 - DNA, 17 bp, Homo sapiens
tctttacttatctctca

SEQ ID NO: 6480264 - DNA, 13 bp, Homo sapiens
tctttacttcctt

SEQ ID NO: 6480265 - DNA, 14 bp, Homo sapiens
tctttactttctcc

SEQ ID NO: 6480266 - DNA, 12 bp, Homo sapiens
tctttactttta

SEQ ID NO: 6480267 - DNA, 23 bp, Homo sapiens
tctttagaatcgctttccttcct

SEQ ID NO: 6480268 - DNA, 15 bp, Homo sapiens
tctttagaccctcgg

SEQ ID NO: 6480269 - DNA, 13 bp, Homo sapiens
tctttagagaact

SEQ ID NO: 6480270 - DNA, 17 bp, Homo sapiens
tctttagagaactgaaa

SEQ ID NO: 6480271 - DNA, 20 bp, Homo sapiens
tctttagagattataacaaa

SEQ ID NO: 6480272 - DNA, 19 bp, Homo sapiens
tctttagagcattgccatt

SEQ ID NO: 6480273 - DNA, 20 bp, Homo sapiens
tctttagaggctttcaaatg

SEQ ID NO: 6480274 - DNA, 22 bp, Homo sapiens
tctttagaggctttcaaatgta

SEQ ID NO: 6480275 - DNA, 16 bp, Homo sapiens
tctttagagttagact

SEQ ID NO: 6480276 - DNA, 17 bp, Homo sapiens
tctttagagttagactg

SEQ ID NO: 6480277 - DNA, 21 bp, Homo sapiens
tctttagatagccctgtcctg

SEQ ID NO: 6480278 - DNA, 16 bp, Homo sapiens
tctttagatatttgcc

SEQ ID NO: 6480279 - DNA, 22 bp, Homo sapiens
tctttagatggtggcacattcc

SEQ ID NO: 6480280 - DNA, 23 bp, Homo sapiens
tctttagatggtggcacattcct

SEQ ID NO: 6480281 - DNA, 20 bp, Homo sapiens
tctttagatttttaaattgg

SEQ ID NO: 6480282 - DNA, 22 bp, Homo sapiens
tctttagcagatattaaaaatt

SEQ ID NO: 6480283 - DNA, 11 bp, Homo sapiens
tctttagcagt

SEQ ID NO: 6480284 - DNA, 20 bp, Homo sapiens
tctttagcagtttcctcagt

SEQ ID NO: 6480285 - DNA, 22 bp, Homo sapiens
tctttagcagtttcctcagtga

SEQ ID NO: 6480286 - DNA, 18 bp, Homo sapiens
tctttagcattgaagtgt

SEQ ID NO: 6480287 - DNA, 20 bp, Homo sapiens
tctttagcatttttatgcag

SEQ ID NO: 6480288 - DNA, 21 bp, Homo sapiens
tctttagcatttttatgcaga

SEQ ID NO: 6480289 - DNA, 22 bp, Homo sapiens
tctttagcatttttatgcagac

SEQ ID NO: 6480290 - DNA, 20 bp, Homo sapiens
tctttagccagaatctcatt

SEQ ID NO: 6480291 - DNA, 20 bp, Homo sapiens
tctttagccccactgcttgc

SEQ ID NO: 6480292 - DNA, 15 bp, Homo sapiens
tctttagcgctggct

SEQ ID NO: 6480293 - DNA, 17 bp, Homo sapiens
tctttagcttttaccaa

SEQ ID NO: 6480294 - DNA, 14 bp, Homo sapiens
tctttaggacataa

SEQ ID NO: 6480295 - DNA, 21 bp, Homo sapiens
tctttaggagaaattatagtt

SEQ ID NO: 6480296 - DNA, 21 bp, Homo sapiens
tctttagggagacccaataaa

SEQ ID NO: 6480297 - DNA, 23 bp, Homo sapiens
tctttaggggaagtaaaacagtc

SEQ ID NO: 6480298 - DNA, 17 bp, Homo sapiens
tctttaggtctttgcct

SEQ ID NO: 6480299 - DNA, 17 bp, Homo sapiens
tctttaggtgcctcctg

SEQ ID NO: 6480300 - DNA, 19 bp, Homo sapiens
tctttaggtgcctcctgtc

SEQ ID NO: 6480301 - DNA, 21 bp, Homo sapiens
tctttaggtgcctcctgtctt

SEQ ID NO: 6480302 - DNA, 12 bp, Homo sapiens
tctttagtatag

SEQ ID NO: 6480303 - DNA, 21 bp, Homo sapiens
tctttagtcatttaagaattt

SEQ ID NO: 6480304 - DNA, 14 bp, Homo sapiens
tctttagtggagaa

SEQ ID NO: 6480305 - DNA, 19 bp, Homo sapiens
tctttagtgttcaaatact

SEQ ID NO: 6480306 - DNA, 12 bp, Homo sapiens
tctttagttttt

SEQ ID NO: 6480307 - DNA, 22 bp, Homo sapiens
tctttataaaatgtataaatta

SEQ ID NO: 6480308 - DNA, 22 bp, Homo sapiens
tctttataaagctgttcttgaa

SEQ ID NO: 6480309 - DNA, 13 bp, Homo sapiens
tctttataagaaa

SEQ ID NO: 6480310 - DNA, 14 bp, Homo sapiens
tctttataagaaag

SEQ ID NO: 6480311 - DNA, 19 bp, Homo sapiens
tctttataattgaattggt

SEQ ID NO: 6480312 - DNA, 13 bp, Homo sapiens
tctttatacaaca

SEQ ID NO: 6480313 - DNA, 14 bp, Homo sapiens
tctttatacagctg

SEQ ID NO: 6480314 - DNA, 15 bp, Homo sapiens
tctttatacagctgt

SEQ ID NO: 6480315 - DNA, 18 bp, Homo sapiens
tctttatactctcttccc

SEQ ID NO: 6480316 - DNA, 20 bp, Homo sapiens
tctttatactctcttccctt

SEQ ID NO: 6480317 - DNA, 11 bp, Homo sapiens
tctttatactt

SEQ ID NO: 6480318 - DNA, 22 bp, Homo sapiens
tctttatagaaggaatttgtac

SEQ ID NO: 6480319 - DNA, 23 bp, Homo sapiens
tctttatagaaggaatttgtact

SEQ ID NO: 6480320 - DNA, 18 bp, Homo sapiens
tctttatagtgaagtgtt

SEQ ID NO: 6480321 - DNA, 21 bp, Homo sapiens
tctttatagtgcacaaaatga

SEQ ID NO: 6480322 - DNA, 14 bp, Homo sapiens
tctttatagttgta

SEQ ID NO: 6480323 - DNA, 18 bp, Homo sapiens
tctttatatacaataatg

SEQ ID NO: 6480324 - DNA, 13 bp, Homo sapiens
tctttatatatgg

SEQ ID NO: 6480325 - DNA, 15 bp, Homo sapiens
tctttatatgaacat

SEQ ID NO: 6480326 - DNA, 15 bp, Homo sapiens
tctttatatgaagaa

SEQ ID NO: 6480327 - DNA, 15 bp, Homo sapiens
tctttatatttcaat

SEQ ID NO: 6480328 - DNA, 13 bp, Homo sapiens
tctttatattttg

SEQ ID NO: 6480329 - DNA, 14 bp, Homo sapiens
tctttatattttgg

SEQ ID NO: 6480330 - DNA, 19 bp, Homo sapiens
tctttatcaaggagatata

SEQ ID NO: 6480331 - DNA, 17 bp, Homo sapiens
tctttatcattaaacat

SEQ ID NO: 6480332 - DNA, 19 bp, Homo sapiens
tctttatcctaaagattat

SEQ ID NO: 6480333 - DNA, 20 bp, Homo sapiens
tctttatcgccctgagaaga

SEQ ID NO: 6480334 - DNA, 23 bp, Homo sapiens
tctttatgaaaaaaaaagaaatc

SEQ ID NO: 6480335 - DNA, 12 bp, Homo sapiens
tctttatgattt

SEQ ID NO: 6480336 - DNA, 14 bp, Homo sapiens
tctttatgatttca

SEQ ID NO: 6480337 - DNA, 19 bp, Homo sapiens
tctttatgcaaaaacatat

SEQ ID NO: 6480338 - DNA, 14 bp, Homo sapiens
tctttatgcttgca

SEQ ID NO: 6480339 - DNA, 16 bp, Homo sapiens
tctttatgtagcacta

SEQ ID NO: 6480340 - DNA, 12 bp, Homo sapiens
tctttattaaaa

SEQ ID NO: 6480341 - DNA, 14 bp, Homo sapiens
tctttattaaaaca

SEQ ID NO: 6480342 - DNA, 19 bp, Homo sapiens
tctttattacacaaactat

SEQ ID NO: 6480343 - DNA, 16 bp, Homo sapiens
tctttattagtaacat

SEQ ID NO: 6480344 - DNA, 14 bp, Homo sapiens
tctttattagtgaa

SEQ ID NO: 6480345 - DNA, 12 bp, Homo sapiens
tctttattataa

SEQ ID NO: 6480346 - DNA, 15 bp, Homo sapiens
tctttattcctagtt

SEQ ID NO: 6480347 - DNA, 22 bp, Homo sapiens
tctttattctcagtaactttta

SEQ ID NO: 6480348 - DNA, 14 bp, Homo sapiens
tctttattctgtgt

SEQ ID NO: 6480349 - DNA, 15 bp, Homo sapiens
tctttattcttatta

SEQ ID NO: 6480350 - DNA, 16 bp, Homo sapiens
tctttattctttacta

SEQ ID NO: 6480351 - DNA, 16 bp, Homo sapiens
tctttattgagaaaga

SEQ ID NO: 6480352 - DNA, 14 bp, Homo sapiens
tctttattgcacta

SEQ ID NO: 6480353 - DNA, 15 bp, Homo sapiens
tctttattgcactag

SEQ ID NO: 6480354 - DNA, 22 bp, Homo sapiens
tctttattgcactaggaattct

SEQ ID NO: 6480355 - DNA, 14 bp, Homo sapiens
tctttattgtccac

SEQ ID NO: 6480356 - DNA, 13 bp, Homo sapiens
tctttatttctgt

SEQ ID NO: 6480357 - DNA, 19 bp, Homo sapiens
tctttatttctgtctcata

SEQ ID NO: 6480358 - DNA, 16 bp, Homo sapiens
tctttattttgtgtaa

SEQ ID NO: 6480359 - DNA, 17 bp, Homo sapiens
tctttattttgtgtaaa

SEQ ID NO: 6480360 - DNA, 21 bp, Homo sapiens
tctttatttttatcccaggaa

SEQ ID NO: 6480361 - DNA, 16 bp, Homo sapiens
tctttatttttttccc

SEQ ID NO: 6480362 - DNA, 21 bp, Homo sapiens
tctttcaaaaccttttgaaat

SEQ ID NO: 6480363 - DNA, 23 bp, Homo sapiens
tctttcaaaggaacattgtgtct

SEQ ID NO: 6480364 - DNA, 22 bp, Homo sapiens
tctttcaaattgagagaatgga

SEQ ID NO: 6480365 - DNA, 17 bp, Homo sapiens
tctttcaactcattgca

SEQ ID NO: 6480366 - DNA, 18 bp, Homo sapiens
tctttcaacttgcatcca

SEQ ID NO: 6480367 - DNA, 17 bp, Homo sapiens
tctttcaagatcttcaa

SEQ ID NO: 6480368 - DNA, 18 bp, Homo sapiens
tctttcaagggctttcct

SEQ ID NO: 6480369 - DNA, 21 bp, Homo sapiens
tctttcaagggctttcctgtg

SEQ ID NO: 6480370 - DNA, 21 bp, Homo sapiens
tctttcaagtgaatctaaaag

SEQ ID NO: 6480371 - DNA, 15 bp, Homo sapiens
tctttcaagttgcat

SEQ ID NO: 6480372 - DNA, 20 bp, Homo sapiens
tctttcaatacagatatatt

SEQ ID NO: 6480373 - DNA, 15 bp, Homo sapiens
tctttcaatatcatt

SEQ ID NO: 6480374 - DNA, 16 bp, Homo sapiens
tctttcaatatcatta

SEQ ID NO: 6480375 - DNA, 19 bp, Homo sapiens
tctttcaatatcattacta

SEQ ID NO: 6480376 - DNA, 22 bp, Homo sapiens
tctttcaatgtgtttaattttg

SEQ ID NO: 6480377 - DNA, 23 bp, Homo sapiens
tctttcaattgcagatgccaaaa

SEQ ID NO: 6480378 - DNA, 19 bp, Homo sapiens
tctttcacagctcctccca

SEQ ID NO: 6480379 - DNA, 20 bp, Homo sapiens
tctttcacagctcctcccac

SEQ ID NO: 6480380 - DNA, 19 bp, Homo sapiens
tctttcacaggcatcagga

SEQ ID NO: 6480381 - DNA, 20 bp, Homo sapiens
tctttcaccaagatgggtgg

SEQ ID NO: 6480382 - DNA, 19 bp, Homo sapiens
tctttcacccatcctagga

SEQ ID NO: 6480383 - DNA, 16 bp, Homo sapiens
tctttcaccctgccac

SEQ ID NO: 6480384 - DNA, 13 bp, Homo sapiens
tctttcacttgaa

SEQ ID NO: 6480385 - DNA, 11 bp, Homo sapiens
tctttcagaaa

SEQ ID NO: 6480386 - DNA, 13 bp, Homo sapiens
tctttcagaaata

SEQ ID NO: 6480387 - DNA, 18 bp, Homo sapiens
tctttcagaaatataaca

SEQ ID NO: 6480388 - DNA, 16 bp, Homo sapiens
tctttcagaatacaat

SEQ ID NO: 6480389 - DNA, 18 bp, Homo sapiens
tctttcagacttgccatg

SEQ ID NO: 6480390 - DNA, 10 bp, Homo sapiens
tctttcagat

SEQ ID NO: 6480391 - DNA, 22 bp, Homo sapiens
tctttcagatgatttgaaagca

SEQ ID NO: 6480392 - DNA, 22 bp, Homo sapiens
tctttcagattttttgaaccat

SEQ ID NO: 6480393 - DNA, 15 bp, Homo sapiens
tctttcagcaagata

SEQ ID NO: 6480394 - DNA, 16 bp, Homo sapiens
tctttcagccaagaat

SEQ ID NO: 6480395 - DNA, 11 bp, Homo sapiens
tctttcagctc

SEQ ID NO: 6480396 - DNA, 14 bp, Homo sapiens
tctttcagctcctg

SEQ ID NO: 6480397 - DNA, 15 bp, Homo sapiens
tctttcaggaaattt

SEQ ID NO: 6480398 - DNA, 20 bp, Homo sapiens
tctttcaggaaatttttgca

SEQ ID NO: 6480399 - DNA, 20 bp, Homo sapiens
tctttcaggggggttgtgag

SEQ ID NO: 6480400 - DNA, 16 bp, Homo sapiens
tctttcagtacttttt

SEQ ID NO: 6480401 - DNA, 14 bp, Homo sapiens
tctttcatacatat

SEQ ID NO: 6480402 - DNA, 16 bp, Homo sapiens
tctttcatacatatat

SEQ ID NO: 6480403 - DNA, 16 bp, Homo sapiens
tctttcatacattata

SEQ ID NO: 6480404 - DNA, 17 bp, Homo sapiens
tctttcatagtataact

SEQ ID NO: 6480405 - DNA, 22 bp, Homo sapiens
tctttcatagtataactttaaa

SEQ ID NO: 6480406 - DNA, 20 bp, Homo sapiens
tctttcatagttctgttaaa

SEQ ID NO: 6480407 - DNA, 23 bp, Homo sapiens
tctttcatcaatcattgtacagt

SEQ ID NO: 6480408 - DNA, 13 bp, Homo sapiens
tctttcatctagc

SEQ ID NO: 6480409 - DNA, 15 bp, Homo sapiens
tctttcatctcccag

SEQ ID NO: 6480410 - DNA, 12 bp, Homo sapiens
tctttcatgagt

SEQ ID NO: 6480411 - DNA, 17 bp, Homo sapiens
tctttcatgccatttta

SEQ ID NO: 6480412 - DNA, 10 bp, Homo sapiens
tctttcatgg

SEQ ID NO: 6480413 - DNA, 21 bp, Homo sapiens
tctttcattaaaaagaataga

SEQ ID NO: 6480414 - DNA, 15 bp, Homo sapiens
tctttcattcttctc

SEQ ID NO: 6480415 - DNA, 19 bp, Homo sapiens
tctttcatttcgtatttct

SEQ ID NO: 6480416 - DNA, 19 bp, Homo sapiens
tctttccaaaggttgtaca

SEQ ID NO: 6480417 - DNA, 20 bp, Homo sapiens
tctttccaaaggttgtacat

SEQ ID NO: 6480418 - DNA, 14 bp, Homo sapiens
tctttccaaagtac

SEQ ID NO: 6480419 - DNA, 14 bp, Homo sapiens
tctttccaaattat

SEQ ID NO: 6480420 - DNA, 17 bp, Homo sapiens
tctttccacagaagctc

SEQ ID NO: 6480421 - DNA, 19 bp, Homo sapiens
tctttccacagaagctcca

SEQ ID NO: 6480422 - DNA, 22 bp, Homo sapiens
tctttccacggagccactcctc

SEQ ID NO: 6480423 - DNA, 22 bp, Homo sapiens
tctttccactcctcctagccac

SEQ ID NO: 6480424 - DNA, 14 bp, Homo sapiens
tctttccactctgg

SEQ ID NO: 6480425 - DNA, 20 bp, Homo sapiens
tctttccacttgccctgtgt

SEQ ID NO: 6480426 - DNA, 23 bp, Homo sapiens
tctttccaggctatgtataaaat

SEQ ID NO: 6480427 - DNA, 13 bp, Homo sapiens
tctttccaggctt

SEQ ID NO: 6480428 - DNA, 15 bp, Homo sapiens
tctttccagtcaaca

SEQ ID NO: 6480429 - DNA, 15 bp, Homo sapiens
tctttccatatccat

SEQ ID NO: 6480430 - DNA, 20 bp, Homo sapiens
tctttccatcaactcccaac

SEQ ID NO: 6480431 - DNA, 21 bp, Homo sapiens
tctttccatctatcactgcat

SEQ ID NO: 6480432 - DNA, 18 bp, Homo sapiens
tctttccatgcagttatt

SEQ ID NO: 6480433 - DNA, 16 bp, Homo sapiens
tggaagatagctgtga

SEQ ID NO: 6480434 - DNA, 18 bp, Homo sapiens
tggaagatagctgtgact

SEQ ID NO: 6480435 - DNA, 19 bp, Homo sapiens
tggaagatctgcaaacatt

SEQ ID NO: 6480436 - DNA, 13 bp, Homo sapiens
tggaagattctta

SEQ ID NO: 6480437 - DNA, 22 bp, Homo sapiens
tggaagatttatgaacagaaat

SEQ ID NO: 6480438 - DNA, 14 bp, Homo sapiens
tggaagattttcat

SEQ ID NO: 6480439 - DNA, 12 bp, Homo sapiens
tggaagcaaaga

SEQ ID NO: 6480440 - DNA, 14 bp, Homo sapiens
tggaagcaaagaca

SEQ ID NO: 6480441 - DNA, 18 bp, Homo sapiens
tggaagcaacaggaatca

SEQ ID NO: 6480442 - DNA, 17 bp, Homo sapiens
tggaagcaacgtgttaa

SEQ ID NO: 6480443 - DNA, 12 bp, Homo sapiens
tggaagcacaca

SEQ ID NO: 6480444 - DNA, 21 bp, Homo sapiens
tggaagcacaccaatcttact

SEQ ID NO: 6480445 - DNA, 23 bp, Homo sapiens
tggaagcacaccaatcttacttt

SEQ ID NO: 6480446 - DNA, 16 bp, Homo sapiens
tggaagcacagcttca

SEQ ID NO: 6480447 - DNA, 23 bp, Homo sapiens
tggaagcactgccattagactga

SEQ ID NO: 6480448 - DNA, 16 bp, Homo sapiens
tggaagcactgctgtg

SEQ ID NO: 6480449 - DNA, 16 bp, Homo sapiens
tggaagcagaaacaaa

SEQ ID NO: 6480450 - DNA, 17 bp, Homo sapiens
tggaagcagaaacaaaa

SEQ ID NO: 6480451 - DNA, 15 bp, Homo sapiens
tggaagcagaggccc

SEQ ID NO: 6480452 - DNA, 19 bp, Homo sapiens
tggaagcagaggccctgcc

SEQ ID NO: 6480453 - DNA, 20 bp, Homo sapiens
tggaagcagaggccctgccc

SEQ ID NO: 6480454 - DNA, 18 bp, Homo sapiens
tggaagcagcaaggtggg

SEQ ID NO: 6480455 - DNA, 22 bp, Homo sapiens
tggaagcagcaaggtgggggtc

SEQ ID NO: 6480456 - DNA, 17 bp, Homo sapiens
tggaagcaggttaaatg

SEQ ID NO: 6480457 - DNA, 17 bp, Homo sapiens
tggaagcagtgcccagg

SEQ ID NO: 6480458 - DNA, 19 bp, Homo sapiens
tggaagcatattgttatta

SEQ ID NO: 6480459 - DNA, 23 bp, Homo sapiens
tggaagcatgtagactgtgccag

SEQ ID NO: 6480460 - DNA, 22 bp, Homo sapiens
tggaagcatgtaggagaatcca

SEQ ID NO: 6480461 - DNA, 12 bp, Homo sapiens
tggaagccacat

SEQ ID NO: 6480462 - DNA, 15 bp, Homo sapiens
tggaagccagctttc

SEQ ID NO: 6480463 - DNA, 18 bp, Homo sapiens
tggaagccagctttccct

SEQ ID NO: 6480464 - DNA, 16 bp, Homo sapiens
tggaagcccctgggcc

SEQ ID NO: 6480465 - DNA, 13 bp, Homo sapiens
tggaagccctcct

SEQ ID NO: 6480466 - DNA, 22 bp, Homo sapiens
tggaagccggccggctgggatc

SEQ ID NO: 6480467 - DNA, 12 bp, Homo sapiens
tggaagcctcag

SEQ ID NO: 6480468 - DNA, 20 bp, Homo sapiens
tggaagcctccacctgcagc

SEQ ID NO: 6480469 - DNA, 14 bp, Homo sapiens
tggaagcctgagca

SEQ ID NO: 6480470 - DNA, 15 bp, Homo sapiens
tggaagcctggactc

SEQ ID NO: 6480471 - DNA, 16 bp, Homo sapiens
tggaagcggtttgcat

SEQ ID NO: 6480472 - DNA, 12 bp, Homo sapiens
tggaagctagct

SEQ ID NO: 6480473 - DNA, 22 bp, Homo sapiens
tggaagctagctcccctcctct

SEQ ID NO: 6480474 - DNA, 20 bp, Homo sapiens
tggaagctctccgagctctg

SEQ ID NO: 6480475 - DNA, 23 bp, Homo sapiens
tggaagctctgttgcaggtgtcc

SEQ ID NO: 6480476 - DNA, 11 bp, Homo sapiens
tggaagctgag

SEQ ID NO: 6480477 - DNA, 20 bp, Homo sapiens
tggaagctgattaaaacaca

SEQ ID NO: 6480478 - DNA, 20 bp, Homo sapiens
tggaagctgattcccagagc

SEQ ID NO: 6480479 - DNA, 14 bp, Homo sapiens
tggaagctggaaga

SEQ ID NO: 6480480 - DNA, 15 bp, Homo sapiens
tggaagctggcagga

SEQ ID NO: 6480481 - DNA, 14 bp, Homo sapiens
tggaagctgggtga

SEQ ID NO: 6480482 - DNA, 16 bp, Homo sapiens
tggaagctgtgtcctt

SEQ ID NO: 6480483 - DNA, 23 bp, Homo sapiens
tggaagctgtttggaaaagacag

SEQ ID NO: 6480484 - DNA, 21 bp, Homo sapiens
tggaagcttactctctgcttc

SEQ ID NO: 6480485 - DNA, 16 bp, Homo sapiens
tggaagcttggggaag

SEQ ID NO: 6480486 - DNA, 21 bp, Homo sapiens
tggaagctttggttatgaaac

SEQ ID NO: 6480487 - DNA, 18 bp, Homo sapiens
tggaagctttgtcccctg

SEQ ID NO: 6480488 - DNA, 14 bp, Homo sapiens
tggaaggaaagatg

SEQ ID NO: 6480489 - DNA, 23 bp, Homo sapiens
tggaaggaacatggagctgtcat

SEQ ID NO: 6480490 - DNA, 15 bp, Homo sapiens
tggaaggaaggaggc

SEQ ID NO: 6480491 - DNA, 16 bp, Homo sapiens
tggaaggacacagtga

SEQ ID NO: 6480492 - DNA, 20 bp, Homo sapiens
tggaaggacacagtgatgaa

SEQ ID NO: 6480493 - DNA, 19 bp, Homo sapiens
tggaaggaccacattttat

SEQ ID NO: 6480494 - DNA, 20 bp, Homo sapiens
tggaaggacctgctcccaca

SEQ ID NO: 6480495 - DNA, 16 bp, Homo sapiens
tggaaggactgtggct

SEQ ID NO: 6480496 - DNA, 20 bp, Homo sapiens
tggaaggagacacagatgtt

SEQ ID NO: 6480497 - DNA, 12 bp, Homo sapiens
tggaaggagaga

SEQ ID NO: 6480498 - DNA, 21 bp, Homo sapiens
tggaaggagagaggttgagga

SEQ ID NO: 6480499 - DNA, 14 bp, Homo sapiens
tggaaggagagggg

SEQ ID NO: 6480500 - DNA, 12 bp, Homo sapiens
tggaaggagcac

SEQ ID NO: 6480501 - DNA, 13 bp, Homo sapiens
tggaaggagcctg

SEQ ID NO: 6480502 - DNA, 14 bp, Homo sapiens
tggaaggaggcgca

SEQ ID NO: 6480503 - DNA, 14 bp, Homo sapiens
tggaaggagggatg

SEQ ID NO: 6480504 - DNA, 15 bp, Homo sapiens
tggaaggatctgctg

SEQ ID NO: 6480505 - DNA, 19 bp, Homo sapiens
tggaaggatctgctgaggc

SEQ ID NO: 6480506 - DNA, 20 bp, Homo sapiens
tggaaggatctgctgaggcc

SEQ ID NO: 6480507 - DNA, 23 bp, Homo sapiens
tggaaggatgggatgggttccag

SEQ ID NO: 6480508 - DNA, 15 bp, Homo sapiens
tggaaggcagcaggc

SEQ ID NO: 6480509 - DNA, 21 bp, Homo sapiens
tggaaggcattgaagcttgca

SEQ ID NO: 6480510 - DNA, 15 bp, Homo sapiens
tggaaggcccagcac

SEQ ID NO: 6480511 - DNA, 18 bp, Homo sapiens
tggaaggccccttccctg

SEQ ID NO: 6480512 - DNA, 16 bp, Homo sapiens
tggaaggcctccctct

SEQ ID NO: 6480513 - DNA, 15 bp, Homo sapiens
tggaagggactagga

SEQ ID NO: 6480514 - DNA, 23 bp, Homo sapiens
tggaagggaggaaggcctttctt

SEQ ID NO: 6480515 - DNA, 18 bp, Homo sapiens
tggaagggcaggagctca

SEQ ID NO: 6480516 - DNA, 22 bp, Homo sapiens
tggaagggccaatggagaaaat

SEQ ID NO: 6480517 - DNA, 23 bp, Homo sapiens
tggaagggccaatggagaaaatg

SEQ ID NO: 6480518 - DNA, 21 bp, Homo sapiens
tggaagggcgttctaggtagg

SEQ ID NO: 6480519 - DNA, 16 bp, Homo sapiens
tggaagggctgggtgt

SEQ ID NO: 6480520 - DNA, 17 bp, Homo sapiens
tggaaggggcagcagga

SEQ ID NO: 6480521 - DNA, 14 bp, Homo sapiens
tggaaggggcagcc

SEQ ID NO: 6480522 - DNA, 14 bp, Homo sapiens
tggaagggggagga

SEQ ID NO: 6480523 - DNA, 21 bp, Homo sapiens
tggaagggggctcttttactg

SEQ ID NO: 6480524 - DNA, 23 bp, Homo sapiens
tggaagggggtgtgcgtgcgtgt

SEQ ID NO: 6480525 - DNA, 18 bp, Homo sapiens
tggaagggttctggctgc

SEQ ID NO: 6480526 - DNA, 19 bp, Homo sapiens
tggaagggttctggctgcc

SEQ ID NO: 6480527 - DNA, 20 bp, Homo sapiens
tggaaggtcacgctgaatga

SEQ ID NO: 6480528 - DNA, 20 bp, Homo sapiens
tggaaggtgccagaaggaag

SEQ ID NO: 6480529 - DNA, 22 bp, Homo sapiens
tggaaggtgccagaaggaaggt

SEQ ID NO: 6480530 - DNA, 21 bp, Homo sapiens
tggaaggtgctgttatccatg

SEQ ID NO: 6480531 - DNA, 22 bp, Homo sapiens
tggaaggttaggtttgtcaaca

SEQ ID NO: 6480532 - DNA, 20 bp, Homo sapiens
tggaagtaaccatttgcact

SEQ ID NO: 6480533 - DNA, 18 bp, Homo sapiens
tggaagtactataattta

SEQ ID NO: 6480534 - DNA, 23 bp, Homo sapiens
tggaagtacttggcccccttcag

SEQ ID NO: 6480535 - DNA, 17 bp, Homo sapiens
tggaagtagtggagccc

SEQ ID NO: 6480536 - DNA, 18 bp, Homo sapiens
tggaagtatacctggctt

SEQ ID NO: 6480537 - DNA, 14 bp, Homo sapiens
tggaagtatttgag

SEQ ID NO: 6480538 - DNA, 17 bp, Homo sapiens
tggaagtatttgagaga

SEQ ID NO: 6480539 - DNA, 22 bp, Homo sapiens
tggaagtattttcctccaaagt

SEQ ID NO: 6480540 - DNA, 22 bp, Homo sapiens
tggaagtcacctttctgggctt

SEQ ID NO: 6480541 - DNA, 23 bp, Homo sapiens
tggaagtcacctttctgggcttt

SEQ ID NO: 6480542 - DNA, 17 bp, Homo sapiens
tggaagtccaatgtggc

SEQ ID NO: 6480543 - DNA, 23 bp, Homo sapiens
tggaagtctacctgctggacagc

SEQ ID NO: 6480544 - DNA, 21 bp, Homo sapiens
tggaagtctccatgaagagct

SEQ ID NO: 6480545 - DNA, 23 bp, Homo sapiens
tggaagtgactttggctgcatgc

SEQ ID NO: 6480546 - DNA, 14 bp, Homo sapiens
tggaagtgaggcat

SEQ ID NO: 6480547 - DNA, 18 bp, Homo sapiens
tggaagtgagggtcagag

SEQ ID NO: 6480548 - DNA, 19 bp, Homo sapiens
tggaagtggggcgggcttc

SEQ ID NO: 6480549 - DNA, 20 bp, Homo sapiens
tggaagtgtctgccagctgg

SEQ ID NO: 6480550 - DNA, 19 bp, Homo sapiens
tggaagtgtgtgccaagag

SEQ ID NO: 6480551 - DNA, 19 bp, Homo sapiens
tggaagtgtgtggaaggca

SEQ ID NO: 6480552 - DNA, 20 bp, Homo sapiens
tggaagtgtgtgtggcagca

SEQ ID NO: 6480553 - DNA, 14 bp, Homo sapiens
tggaagtgttcaga

SEQ ID NO: 6480554 - DNA, 13 bp, Homo sapiens
tggaagtgttcct

SEQ ID NO: 6480555 - DNA, 14 bp, Homo sapiens
tggaagtgttcctg

SEQ ID NO: 6480556 - DNA, 11 bp, Homo sapiens
tggaagttatt

SEQ ID NO: 6480557 - DNA, 12 bp, Homo sapiens
tggaagttattt

SEQ ID NO: 6480558 - DNA, 15 bp, Homo sapiens
tggaagttcttcaag

SEQ ID NO: 6480559 - DNA, 18 bp, Homo sapiens
tggaagtttagctctgag

SEQ ID NO: 6480560 - DNA, 13 bp, Homo sapiens
tggaagttttcag

SEQ ID NO: 6480561 - DNA, 19 bp, Homo sapiens
tggaagttttcctacactt

SEQ ID NO: 6480562 - DNA, 14 bp, Homo sapiens
tggaagttttgcat

SEQ ID NO: 6480563 - DNA, 17 bp, Homo sapiens
tggaagtttttttttcc

SEQ ID NO: 6480564 - DNA, 23 bp, Homo sapiens
tggaataaaaattccagaatgaa

SEQ ID NO: 6480565 - DNA, 19 bp, Homo sapiens
tggaataaaatactatttt

SEQ ID NO: 6480566 - DNA, 22 bp, Homo sapiens
tggaataaaatataaaactgaa

SEQ ID NO: 6480567 - DNA, 18 bp, Homo sapiens
tggaataaacagtgagca

SEQ ID NO: 6480568 - DNA, 19 bp, Homo sapiens
tggaataaacatctgtgtc

SEQ ID NO: 6480569 - DNA, 18 bp, Homo sapiens
tggaataaagttgcagat

SEQ ID NO: 6480570 - DNA, 14 bp, Homo sapiens
tggaataaatcctt

SEQ ID NO: 6480571 - DNA, 20 bp, Homo sapiens
tggaataacaactttcagtg

SEQ ID NO: 6480572 - DNA, 12 bp, Homo sapiens
tggaataactct

SEQ ID NO: 6480573 - DNA, 18 bp, Homo sapiens
tggaataagacagagacc

SEQ ID NO: 6480574 - DNA, 14 bp, Homo sapiens
tggaataagccttc

SEQ ID NO: 6480575 - DNA, 17 bp, Homo sapiens
tggaataaggagctggg

SEQ ID NO: 6480576 - DNA, 15 bp, Homo sapiens
tggaataagttcaaa

SEQ ID NO: 6480577 - DNA, 21 bp, Homo sapiens
tggaataataattttcctcct

SEQ ID NO: 6480578 - DNA, 23 bp, Homo sapiens
tggaataataattttcctcctaa

SEQ ID NO: 6480579 - DNA, 13 bp, Homo sapiens
tggaataatacat

SEQ ID NO: 6480580 - DNA, 18 bp, Homo sapiens
tggaataatacatactaa

SEQ ID NO: 6480581 - DNA, 19 bp, Homo sapiens
tggaataatacatactaat

SEQ ID NO: 6480582 - DNA, 14 bp, Homo sapiens
tggaataatttcta

SEQ ID NO: 6480583 - DNA, 15 bp, Homo sapiens
tggaataatttgtaa

SEQ ID NO: 6480584 - DNA, 17 bp, Homo sapiens
tggaataatttgtaaat

SEQ ID NO: 6480585 - DNA, 18 bp, Homo sapiens
tggaataatttgtaaatg

SEQ ID NO: 6480586 - DNA, 18 bp, Homo sapiens
tggaatacacatgcagga

SEQ ID NO: 6480587 - DNA, 14 bp, Homo sapiens
tggaatacagtgtt

SEQ ID NO: 6480588 - DNA, 14 bp, Homo sapiens
tggaatacatttct

SEQ ID NO: 6480589 - DNA, 22 bp, Homo sapiens
tggaatactaaaaatcatgaga

SEQ ID NO: 6480590 - DNA, 13 bp, Homo sapiens
tggaatactgaaa

SEQ ID NO: 6480591 - DNA, 18 bp, Homo sapiens
tggaatagatgtctcaaa

SEQ ID NO: 6480592 - DNA, 15 bp, Homo sapiens
tggaatagcagcctc

SEQ ID NO: 6480593 - DNA, 18 bp, Homo sapiens
tggaatagggaactgtaa

SEQ ID NO: 6480594 - DNA, 18 bp, Homo sapiens
tggaatagtatcctccag

SEQ ID NO: 6480595 - DNA, 22 bp, Homo sapiens
tggaatagtatcctccaggttt

SEQ ID NO: 6480596 - DNA, 14 bp, Homo sapiens
tggaatagttctgt

SEQ ID NO: 6480597 - DNA, 20 bp, Homo sapiens
tggaatataaatagctgaaa

SEQ ID NO: 6480598 - DNA, 18 bp, Homo sapiens
tggaatataaatatcaca

SEQ ID NO: 6480599 - DNA, 14 bp, Homo sapiens
tggaatataaggaa

SEQ ID NO: 6480600 - DNA, 22 bp, Homo sapiens
tggaatataattgttttatctg

SEQ ID NO: 6480601 - DNA, 15 bp, Homo sapiens
tggaatatataacca

SEQ ID NO: 6480602 - DNA, 14 bp, Homo sapiens
tggaatatcatctg

SEQ ID NO: 6480603 - DNA, 14 bp, Homo sapiens
tggaatatctactt

SEQ ID NO: 6480604 - DNA, 18 bp, Homo sapiens
tggaatatctgagaattg

SEQ ID NO: 6480605 - DNA, 19 bp, Homo sapiens
tggaatatggcaatagcat

SEQ ID NO: 6480606 - DNA, 21 bp, Homo sapiens
tggaatatggcaatagcattg

SEQ ID NO: 6480607 - DNA, 12 bp, Homo sapiens
tggaatattcat

SEQ ID NO: 6480608 - DNA, 14 bp, Homo sapiens
tggaatattcattt

SEQ ID NO: 6480609 - DNA, 17 bp, Homo sapiens
tggaatattcattttac

SEQ ID NO: 6480610 - DNA, 15 bp, Homo sapiens
tggaatattgtccat

SEQ ID NO: 6480611 - DNA, 20 bp, Homo sapiens
tctttccattcttcttgcta

SEQ ID NO: 6480612 - DNA, 15 bp, Homo sapiens
tctttccatttctct

SEQ ID NO: 6480613 - DNA, 13 bp, Homo sapiens
tctttccatttgc

SEQ ID NO: 6480614 - DNA, 14 bp, Homo sapiens
tctttccatttgca

SEQ ID NO: 6480615 - DNA, 22 bp, Homo sapiens
tctttccatttgcatttgttta

SEQ ID NO: 6480616 - DNA, 20 bp, Homo sapiens
tctttcccacactgaaattc

SEQ ID NO: 6480617 - DNA, 21 bp, Homo sapiens
tctttcccacactgaaattct

SEQ ID NO: 6480618 - DNA, 15 bp, Homo sapiens
tctttcccaccctcc

SEQ ID NO: 6480619 - DNA, 22 bp, Homo sapiens
tctttcccaccctgttcccagt

SEQ ID NO: 6480620 - DNA, 14 bp, Homo sapiens
tctttcccaggacg

SEQ ID NO: 6480621 - DNA, 15 bp, Homo sapiens
tctttcccatgtatt

SEQ ID NO: 6480622 - DNA, 17 bp, Homo sapiens
tctttcccatgtatttg

SEQ ID NO: 6480623 - DNA, 13 bp, Homo sapiens
tctttccccagag

SEQ ID NO: 6480624 - DNA, 23 bp, Homo sapiens
tctttcccccaccctactccctc

SEQ ID NO: 6480625 - DNA, 18 bp, Homo sapiens
tctttcccctcagagctc

SEQ ID NO: 6480626 - DNA, 23 bp, Homo sapiens
tctttcccctcaggagtttctat

SEQ ID NO: 6480627 - DNA, 12 bp, Homo sapiens
tctttcccctcc

SEQ ID NO: 6480628 - DNA, 12 bp, Homo sapiens
tctttccctccc

SEQ ID NO: 6480629 - DNA, 12 bp, Homo sapiens
tctttccctcct

SEQ ID NO: 6480630 - DNA, 13 bp, Homo sapiens
tctttccctcctt

SEQ ID NO: 6480631 - DNA, 15 bp, Homo sapiens
tctttccctggacag

SEQ ID NO: 6480632 - DNA, 16 bp, Homo sapiens
tctttcccttccagtt

SEQ ID NO: 6480633 - DNA, 19 bp, Homo sapiens
tctttcccttttctgttta

SEQ ID NO: 6480634 - DNA, 14 bp, Homo sapiens
tctttccgacacat

SEQ ID NO: 6480635 - DNA, 14 bp, Homo sapiens
tctttccgactgcc

SEQ ID NO: 6480636 - DNA, 15 bp, Homo sapiens
tctttccgactgccc

SEQ ID NO: 6480637 - DNA, 13 bp, Homo sapiens
tctttccggccaa

SEQ ID NO: 6480638 - DNA, 15 bp, Homo sapiens
tctttcctaaagcca

SEQ ID NO: 6480639 - DNA, 20 bp, Homo sapiens
tctttcctaaatataaatga

SEQ ID NO: 6480640 - DNA, 16 bp, Homo sapiens
tctttcctacaagtta

SEQ ID NO: 6480641 - DNA, 18 bp, Homo sapiens
tctttcctacacactctg

SEQ ID NO: 6480642 - DNA, 21 bp, Homo sapiens
tctttcctactctgggaagaa

SEQ ID NO: 6480643 - DNA, 17 bp, Homo sapiens
tctttcctactttctat

SEQ ID NO: 6480644 - DNA, 22 bp, Homo sapiens
tctttcctagatggcagtcact

SEQ ID NO: 6480645 - DNA, 24 bp, Homo sapiens
tctttcctatttcagtgttacctg

SEQ ID NO: 6480646 - DNA, 21 bp, Homo sapiens
tctttcctcaagtatcttcta

SEQ ID NO: 6480647 - DNA, 13 bp, Homo sapiens
tctttcctccctt

SEQ ID NO: 6480648 - DNA, 12 bp, Homo sapiens
tctttcctcctt

SEQ ID NO: 6480649 - DNA, 12 bp, Homo sapiens
tctttcctctta

SEQ ID NO: 6480650 - DNA, 23 bp, Homo sapiens
tctttcctcttccccttgccctt

SEQ ID NO: 6480651 - DNA, 23 bp, Homo sapiens
tctttcctctttctgctctgcca

SEQ ID NO: 6480652 - DNA, 14 bp, Homo sapiens
tctttcctgaggct

SEQ ID NO: 6480653 - DNA, 15 bp, Homo sapiens
tctttcctgaggctg

SEQ ID NO: 6480654 - DNA, 16 bp, Homo sapiens
tctttcctgaggctgg

SEQ ID NO: 6480655 - DNA, 13 bp, Homo sapiens
tctttcctgccct

SEQ ID NO: 6480656 - DNA, 21 bp, Homo sapiens
tctttcctgcccttttcctgg

SEQ ID NO: 6480657 - DNA, 11 bp, Homo sapiens
tctttcctgtc

SEQ ID NO: 6480658 - DNA, 14 bp, Homo sapiens
tctttcctgtgcca

SEQ ID NO: 6480659 - DNA, 11 bp, Homo sapiens
tctttccttcc

SEQ ID NO: 6480660 - DNA, 15 bp, Homo sapiens
tctttccttccatca

SEQ ID NO: 6480661 - DNA, 17 bp, Homo sapiens
tctttccttccatcaaa

SEQ ID NO: 6480662 - DNA, 15 bp, Homo sapiens
tctttccttcccaat

SEQ ID NO: 6480663 - DNA, 14 bp, Homo sapiens
tctttccttcctct

SEQ ID NO: 6480664 - DNA, 14 bp, Homo sapiens
tctttccttgtctc

SEQ ID NO: 6480665 - DNA, 16 bp, Homo sapiens
tctttccttgtctctc

SEQ ID NO: 6480666 - DNA, 15 bp, Homo sapiens
tctttccttgttcag

SEQ ID NO: 6480667 - DNA, 14 bp, Homo sapiens
tctttcctttaaaa

SEQ ID NO: 6480668 - DNA, 20 bp, Homo sapiens
tctttcctttactcctggct

SEQ ID NO: 6480669 - DNA, 11 bp, Homo sapiens
tctttcctttc

SEQ ID NO: 6480670 - DNA, 21 bp, Homo sapiens
tctttcctttcatcctcagca

SEQ ID NO: 6480671 - DNA, 11 bp, Homo sapiens
tctttcctttt

SEQ ID NO: 6480672 - DNA, 14 bp, Homo sapiens
tctttcggaatttt

SEQ ID NO: 6480673 - DNA, 23 bp, Homo sapiens
tctttcggactgaggccttctca

SEQ ID NO: 6480674 - DNA, 15 bp, Homo sapiens
tctttcggtctcctt

SEQ ID NO: 6480675 - DNA, 14 bp, Homo sapiens
tctttcgtcaccct

SEQ ID NO: 6480676 - DNA, 15 bp, Homo sapiens
tctttcgtcaccctt

SEQ ID NO: 6480677 - DNA, 20 bp, Homo sapiens
tctttcgttggttgtttctc

SEQ ID NO: 6480678 - DNA, 23 bp, Homo sapiens
tctttcgttggttgtttctctga

SEQ ID NO: 6480679 - DNA, 18 bp, Homo sapiens
tctttctaactttcttta

SEQ ID NO: 6480680 - DNA, 18 bp, Homo sapiens
tctttctaagagacctga

SEQ ID NO: 6480681 - DNA, 10 bp, Homo sapiens
tctttctaat

SEQ ID NO: 6480682 - DNA, 18 bp, Homo sapiens
tctttctaatacaagcat

SEQ ID NO: 6480683 - DNA, 14 bp, Homo sapiens
tctttctaatgctg

SEQ ID NO: 6480684 - DNA, 16 bp, Homo sapiens
tctttctaatgtagct

SEQ ID NO: 6480685 - DNA, 18 bp, Homo sapiens
tctttctaatgtgtgaat

SEQ ID NO: 6480686 - DNA, 23 bp, Homo sapiens
tctttctacaaagcactagagaa

SEQ ID NO: 6480687 - DNA, 16 bp, Homo sapiens
tctttctactctgaac

SEQ ID NO: 6480688 - DNA, 11 bp, Homo sapiens
tctttctagag

SEQ ID NO: 6480689 - DNA, 16 bp, Homo sapiens
tctttctagtggtctt

SEQ ID NO: 6480690 - DNA, 17 bp, Homo sapiens
tctttctagtggtcttt

SEQ ID NO: 6480691 - DNA, 19 bp, Homo sapiens
tctttctagttcagctgcc

SEQ ID NO: 6480692 - DNA, 22 bp, Homo sapiens
tctttctagttcagctgcccca

SEQ ID NO: 6480693 - DNA, 15 bp, Homo sapiens
tctttctagtttgtt

SEQ ID NO: 6480694 - DNA, 15 bp, Homo sapiens
tctttctatgctgct

SEQ ID NO: 6480695 - DNA, 18 bp, Homo sapiens
tctttctattcagcaaaa

SEQ ID NO: 6480696 - DNA, 21 bp, Homo sapiens
tctttctattcataataaact

SEQ ID NO: 6480697 - DNA, 15 bp, Homo sapiens
tctttctcacacgga

SEQ ID NO: 6480698 - DNA, 16 bp, Homo sapiens
tctttctcactgcctt

SEQ ID NO: 6480699 - DNA, 14 bp, Homo sapiens
tctttctcataaaa

SEQ ID NO: 6480700 - DNA, 16 bp, Homo sapiens
tctttctcataaaact

SEQ ID NO: 6480701 - DNA, 21 bp, Homo sapiens
tctttctccaaagttatccag

SEQ ID NO: 6480702 - DNA, 18 bp, Homo sapiens
tctttctcccttctgctc

SEQ ID NO: 6480703 - DNA, 13 bp, Homo sapiens
tctttctcctcag

SEQ ID NO: 6480704 - DNA, 13 bp, Homo sapiens
tctttctcctggt

SEQ ID NO: 6480705 - DNA, 16 bp, Homo sapiens
tctttctcctgtggtt

SEQ ID NO: 6480706 - DNA, 24 bp, Homo sapiens
tctttctccttgaatatctttcga

SEQ ID NO: 6480707 - DNA, 11 bp, Homo sapiens
tctttctctca

SEQ ID NO: 6480708 - DNA, 21 bp, Homo sapiens
tctttctctccttcttccctg

SEQ ID NO: 6480709 - DNA, 22 bp, Homo sapiens
tctttctctccttcttccctgt

SEQ ID NO: 6480710 - DNA, 16 bp, Homo sapiens
tctttctctctcactc

SEQ ID NO: 6480711 - DNA, 15 bp, Homo sapiens
tctttctctctctct

SEQ ID NO: 6480712 - DNA, 20 bp, Homo sapiens
tctttctctctctctcttcc

SEQ ID NO: 6480713 - DNA, 15 bp, Homo sapiens
tctttctctctgtgt

SEQ ID NO: 6480714 - DNA, 14 bp, Homo sapiens
tctttctctcttcc

SEQ ID NO: 6480715 - DNA, 20 bp, Homo sapiens
tctttctctctttccatctc

SEQ ID NO: 6480716 - DNA, 21 bp, Homo sapiens
tctttctctgagaaccaaaag

SEQ ID NO: 6480717 - DNA, 13 bp, Homo sapiens
tctttctctgcca

SEQ ID NO: 6480718 - DNA, 12 bp, Homo sapiens
tctttctcttcc

SEQ ID NO: 6480719 - DNA, 13 bp, Homo sapiens
tctttctctttta

SEQ ID NO: 6480720 - DNA, 19 bp, Homo sapiens
tctttctgaaggctttgtg

SEQ ID NO: 6480721 - DNA, 19 bp, Homo sapiens
tctttctgagcacacttta

SEQ ID NO: 6480722 - DNA, 21 bp, Homo sapiens
tctttctgagcacactttagt

SEQ ID NO: 6480723 - DNA, 20 bp, Homo sapiens
tctttctgcacacaaatatt

SEQ ID NO: 6480724 - DNA, 14 bp, Homo sapiens
tctttctgcagaaa

SEQ ID NO: 6480725 - DNA, 16 bp, Homo sapiens
tctttctgcagaaaat

SEQ ID NO: 6480726 - DNA, 23 bp, Homo sapiens
tctttctgcccggctacatcagc

SEQ ID NO: 6480727 - DNA, 12 bp, Homo sapiens
tctttctgcctt

SEQ ID NO: 6480728 - DNA, 22 bp, Homo sapiens
tctttctgctatgtgtggtact

SEQ ID NO: 6480729 - DNA, 14 bp, Homo sapiens
tctttctgctctgc

SEQ ID NO: 6480730 - DNA, 13 bp, Homo sapiens
tctttctgctttg

SEQ ID NO: 6480731 - DNA, 13 bp, Homo sapiens
tctttctggactg

SEQ ID NO: 6480732 - DNA, 13 bp, Homo sapiens
tctttctggagtc

SEQ ID NO: 6480733 - DNA, 16 bp, Homo sapiens
tctttctggcctgcct

SEQ ID NO: 6480734 - DNA, 13 bp, Homo sapiens
tctttctgggagc

SEQ ID NO: 6480735 - DNA, 17 bp, Homo sapiens
tctttctggtgttttat

SEQ ID NO: 6480736 - DNA, 23 bp, Homo sapiens
tctttctggtgttttatttccta

SEQ ID NO: 6480737 - DNA, 16 bp, Homo sapiens
tctttctgtcccctct

SEQ ID NO: 6480738 - DNA, 18 bp, Homo sapiens
tctttctgtctcccttct

SEQ ID NO: 6480739 - DNA, 14 bp, Homo sapiens
tctttctgtttcct

SEQ ID NO: 6480740 - DNA, 16 bp, Homo sapiens
tctttcttaagccctt

SEQ ID NO: 6480741 - DNA, 13 bp, Homo sapiens
tctttcttagaaa

SEQ ID NO: 6480742 - DNA, 18 bp, Homo sapiens
tctttcttattttgtaat

SEQ ID NO: 6480743 - DNA, 19 bp, Homo sapiens
tctttcttattttgtaata

SEQ ID NO: 6480744 - DNA, 21 bp, Homo sapiens
tctttcttattttgtaataaa

SEQ ID NO: 6480745 - DNA, 19 bp, Homo sapiens
tctttcttcaattaatgga

SEQ ID NO: 6480746 - DNA, 20 bp, Homo sapiens
tctttcttcaattaatggaa

SEQ ID NO: 6480747 - DNA, 21 bp, Homo sapiens
tctttcttcaattaatggaaa

SEQ ID NO: 6480748 - DNA, 14 bp, Homo sapiens
tctttcttcactct

SEQ ID NO: 6480749 - DNA, 21 bp, Homo sapiens
tctttcttcccgtgtgtattt

SEQ ID NO: 6480750 - DNA, 22 bp, Homo sapiens
tctttcttcccgtgtgtatttc

SEQ ID NO: 6480751 - DNA, 14 bp, Homo sapiens
tctttcttcctctg

SEQ ID NO: 6480752 - DNA, 16 bp, Homo sapiens
tctttcttcctctgct

SEQ ID NO: 6480753 - DNA, 17 bp, Homo sapiens
tctttcttcctctgctg

SEQ ID NO: 6480754 - DNA, 22 bp, Homo sapiens
tctttcttctcgcctaggattt

SEQ ID NO: 6480755 - DNA, 15 bp, Homo sapiens
tctttcttctcttta

SEQ ID NO: 6480756 - DNA, 22 bp, Homo sapiens
tctttcttcttcaaacctttgt

SEQ ID NO: 6480757 - DNA, 18 bp, Homo sapiens
tctttcttgctccctgac

SEQ ID NO: 6480758 - DNA, 20 bp, Homo sapiens
tctttcttgctccctgactg

SEQ ID NO: 6480759 - DNA, 22 bp, Homo sapiens
tctttcttggagtgccaagttt

SEQ ID NO: 6480760 - DNA, 23 bp, Homo sapiens
tctttcttgtttgtcagcatctg

SEQ ID NO: 6480761 - DNA, 12 bp, Homo sapiens
tctttctttaaa

SEQ ID NO: 6480762 - DNA, 13 bp, Homo sapiens
tctttctttaaat

SEQ ID NO: 6480763 - DNA, 18 bp, Homo sapiens
tctttctttaaatgtttt

SEQ ID NO: 6480764 - DNA, 17 bp, Homo sapiens
tctttctttacctgaga

SEQ ID NO: 6480765 - DNA, 18 bp, Homo sapiens
tctttctttccaaaacat

SEQ ID NO: 6480766 - DNA, 22 bp, Homo sapiens
tctttctttccaaaacatttct

SEQ ID NO: 6480767 - DNA, 13 bp, Homo sapiens
tctttctttctcc

SEQ ID NO: 6480768 - DNA, 13 bp, Homo sapiens
tctttctttctct

SEQ ID NO: 6480769 - DNA, 12 bp, Homo sapiens
tctttctttctt

SEQ ID NO: 6480770 - DNA, 15 bp, Homo sapiens
tctttctttcttaga

SEQ ID NO: 6480771 - DNA, 13 bp, Homo sapiens
tctttctttgctg

SEQ ID NO: 6480772 - DNA, 16 bp, Homo sapiens
tctttctttgctgctg

SEQ ID NO: 6480773 - DNA, 19 bp, Homo sapiens
tctttctttgctgctgtgg

SEQ ID NO: 6480774 - DNA, 18 bp, Homo sapiens
tctttctttggtgccttt

SEQ ID NO: 6480775 - DNA, 19 bp, Homo sapiens
tctttctttgtcattcagt

SEQ ID NO: 6480776 - DNA, 22 bp, Homo sapiens
tctttctttgtcattcagttct

SEQ ID NO: 6480777 - DNA, 23 bp, Homo sapiens
tctttctttgtttctttcttcct

SEQ ID NO: 6480778 - DNA, 14 bp, Homo sapiens
tctttcttttctct

SEQ ID NO: 6480779 - DNA, 15 bp, Homo sapiens
tctttcttttgtgca

SEQ ID NO: 6480780 - DNA, 17 bp, Homo sapiens
tctttcttttgtgcata

SEQ ID NO: 6480781 - DNA, 18 bp, Homo sapiens
tctttctttttctggaaa

SEQ ID NO: 6480782 - DNA, 23 bp, Homo sapiens
tctttctttttctggaaattttg

SEQ ID NO: 6480783 - DNA, 20 bp, Homo sapiens
tctttctttttctgtctctc

SEQ ID NO: 6480784 - DNA, 22 bp, Homo sapiens
tctttctttttctgtctctctt

SEQ ID NO: 6480785 - DNA, 21 bp, Homo sapiens
tctttgaaaacagatgaccat

SEQ ID NO: 6480786 - DNA, 15 bp, Homo sapiens
tctttgaaaagaaaa

SEQ ID NO: 6480787 - DNA, 14 bp, Homo sapiens
tctttgaaacaact

SEQ ID NO: 6480788 - DNA, 22 bp, Homo sapiens
tctttgaaagacttccaaagaa

SEQ ID NO: 6480789 - DNA, 16 bp, Homo sapiens
tctttgaaataaaaaa

SEQ ID NO: 6480790 - DNA, 22 bp, Homo sapiens
tctttgaaatagtctgtgtgaa

SEQ ID NO: 6480791 - DNA, 19 bp, Homo sapiens
tctttgaaatatgcatgta

SEQ ID NO: 6480792 - DNA, 23 bp, Homo sapiens
aagacctttattcacccctgccc

SEQ ID NO: 6480793 - DNA, 15 bp, Homo sapiens
aagacctttttctgc

SEQ ID NO: 6480794 - DNA, 16 bp, Homo sapiens
aagacctttttctgca

SEQ ID NO: 6480795 - DNA, 22 bp, Homo sapiens
aagacgaagaagcaagggagga

SEQ ID NO: 6480796 - DNA, 21 bp, Homo sapiens
aagacgacggcttcaggcccg

SEQ ID NO: 6480797 - DNA, 19 bp, Homo sapiens
aagacgagcatccccctcc

SEQ ID NO: 6480798 - DNA, 17 bp, Homo sapiens
aagacgcaaggtgtgct

SEQ ID NO: 6480799 - DNA, 13 bp, Homo sapiens
aagacgccttcat

SEQ ID NO: 6480800 - DNA, 22 bp, Homo sapiens
aagacgccttcatctgggacaa

SEQ ID NO: 6480801 - DNA, 20 bp, Homo sapiens
aagacgctgtgctgccctgc

SEQ ID NO: 6480802 - DNA, 21 bp, Homo sapiens
aagacgctgtgctgccctgcc

SEQ ID NO: 6480803 - DNA, 23 bp, Homo sapiens
aagacggaagtaaattatgatgt

SEQ ID NO: 6480804 - DNA, 19 bp, Homo sapiens
aagacggaggaggggaagg

SEQ ID NO: 6480805 - DNA, 16 bp, Homo sapiens
aagacggatggcagga

SEQ ID NO: 6480806 - DNA, 16 bp, Homo sapiens
aagacgggaggggagg

SEQ ID NO: 6480807 - DNA, 15 bp, Homo sapiens
aagacgggtattgtt

SEQ ID NO: 6480808 - DNA, 21 bp, Homo sapiens
aagacgggtattgttgggaaa

SEQ ID NO: 6480809 - DNA, 22 bp, Homo sapiens
aagacgggtattgttgggaaag

SEQ ID NO: 6480810 - DNA, 23 bp, Homo sapiens
aagacgggtattgttgggaaagg

SEQ ID NO: 6480811 - DNA, 23 bp, Homo sapiens
aagacggtattaaaatggagcga

SEQ ID NO: 6480812 - DNA, 18 bp, Homo sapiens
aagacgtaataaaattaa

SEQ ID NO: 6480813 - DNA, 22 bp, Homo sapiens
aagacgtgattttgctgtagaa

SEQ ID NO: 6480814 - DNA, 23 bp, Homo sapiens
aagacgtgattttgctgtagaag

SEQ ID NO: 6480815 - DNA, 19 bp, Homo sapiens
aagacgtggctctgggtga

SEQ ID NO: 6480816 - DNA, 16 bp, Homo sapiens
aagacgtgtttgtgtt

SEQ ID NO: 6480817 - DNA, 18 bp, Homo sapiens
aagacgtttaactgcagt

SEQ ID NO: 6480818 - DNA, 16 bp, Homo sapiens
aagactaatgctttct

SEQ ID NO: 6480819 - DNA, 18 bp, Homo sapiens
aagactactggcctctgt

SEQ ID NO: 6480820 - DNA, 22 bp, Homo sapiens
aagactagagcaaaataatgca

SEQ ID NO: 6480821 - DNA, 20 bp, Homo sapiens
aagactagaggcttgcataa

SEQ ID NO: 6480822 - DNA, 19 bp, Homo sapiens
aagactaggatattgaatg

SEQ ID NO: 6480823 - DNA, 23 bp, Homo sapiens
aagactaggatattgaatgtgaa

SEQ ID NO: 6480824 - DNA, 18 bp, Homo sapiens
aagactatctaaatgttg

SEQ ID NO: 6480825 - DNA, 15 bp, Homo sapiens
aagactatgaaaatg

SEQ ID NO: 6480826 - DNA, 17 bp, Homo sapiens
aagactatgaaaatgct

SEQ ID NO: 6480827 - DNA, 20 bp, Homo sapiens
aagactatttcaaaatgtcc

SEQ ID NO: 6480828 - DNA, 14 bp, Homo sapiens
aagactatttttct

SEQ ID NO: 6480829 - DNA, 14 bp, Homo sapiens
aagactcaaatgtt

SEQ ID NO: 6480830 - DNA, 17 bp, Homo sapiens
aagactcaaatgttcta

SEQ ID NO: 6480831 - DNA, 21 bp, Homo sapiens
aagactcaagtgggaacgact

SEQ ID NO: 6480832 - DNA, 23 bp, Homo sapiens
aagactcaagtgggaacgactgg

SEQ ID NO: 6480833 - DNA, 23 bp, Homo sapiens
aagactcactgtgtggcctcaga

SEQ ID NO: 6480834 - DNA, 10 bp, Homo sapiens
aagactcatc

SEQ ID NO: 6480835 - DNA, 11 bp, Homo sapiens
aagactcatcc

SEQ ID NO: 6480836 - DNA, 17 bp, Homo sapiens
aagactcattccctaga

SEQ ID NO: 6480837 - DNA, 18 bp, Homo sapiens
aagactcattgctggagg

SEQ ID NO: 6480838 - DNA, 12 bp, Homo sapiens
aagactccagaa

SEQ ID NO: 6480839 - DNA, 17 bp, Homo sapiens
aagactccagtactatt

SEQ ID NO: 6480840 - DNA, 19 bp, Homo sapiens
aagactccagtactatttt

SEQ ID NO: 6480841 - DNA, 22 bp, Homo sapiens
aagactcccatgagggagatgc

SEQ ID NO: 6480842 - DNA, 12 bp, Homo sapiens
aagactccctga

SEQ ID NO: 6480843 - DNA, 21 bp, Homo sapiens
aagactcctcctgggggctgg

SEQ ID NO: 6480844 - DNA, 22 bp, Homo sapiens
aagactcctcctgggggctggc

SEQ ID NO: 6480845 - DNA, 20 bp, Homo sapiens
aagactcgcggcaggttctc

SEQ ID NO: 6480846 - DNA, 12 bp, Homo sapiens
aagactctagag

SEQ ID NO: 6480847 - DNA, 15 bp, Homo sapiens
aagactctatgctct

SEQ ID NO: 6480848 - DNA, 14 bp, Homo sapiens
aagactctgcctta

SEQ ID NO: 6480849 - DNA, 14 bp, Homo sapiens
aagactctgctctc

SEQ ID NO: 6480850 - DNA, 13 bp, Homo sapiens
aagactctggagg

SEQ ID NO: 6480851 - DNA, 14 bp, Homo sapiens
aagactctggaggt

SEQ ID NO: 6480852 - DNA, 19 bp, Homo sapiens
aagactctgtgtggctgtg

SEQ ID NO: 6480853 - DNA, 22 bp, Homo sapiens
aagactcttgggagggagttac

SEQ ID NO: 6480854 - DNA, 13 bp, Homo sapiens
aagactgaacatg

SEQ ID NO: 6480855 - DNA, 14 bp, Homo sapiens
aagactgaacatgt

SEQ ID NO: 6480856 - DNA, 14 bp, Homo sapiens
aagactgagaactt

SEQ ID NO: 6480857 - DNA, 15 bp, Homo sapiens
aagactgagaacttt

SEQ ID NO: 6480858 - DNA, 15 bp, Homo sapiens
aagactgagcacctg

SEQ ID NO: 6480859 - DNA, 19 bp, Homo sapiens
aagactgagcacctgcttc

SEQ ID NO: 6480860 - DNA, 15 bp, Homo sapiens
aagactgagcagaac

SEQ ID NO: 6480861 - DNA, 14 bp, Homo sapiens
aagactgagccaga

SEQ ID NO: 6480862 - DNA, 14 bp, Homo sapiens
aagactgataacaa

SEQ ID NO: 6480863 - DNA, 15 bp, Homo sapiens
aagactgataatttt

SEQ ID NO: 6480864 - DNA, 16 bp, Homo sapiens
aagactgcaagagatg

SEQ ID NO: 6480865 - DNA, 13 bp, Homo sapiens
aagactgcagaac

SEQ ID NO: 6480866 - DNA, 17 bp, Homo sapiens
aagactgcattatattt

SEQ ID NO: 6480867 - DNA, 14 bp, Homo sapiens
aagactgccaggtg

SEQ ID NO: 6480868 - DNA, 15 bp, Homo sapiens
aagactgcctccctc

SEQ ID NO: 6480869 - DNA, 21 bp, Homo sapiens
aagactgctgtggccaggagg

SEQ ID NO: 6480870 - DNA, 20 bp, Homo sapiens
aagactggaagctaatttgc

SEQ ID NO: 6480871 - DNA, 22 bp, Homo sapiens
aagactggcatggacatcagca

SEQ ID NO: 6480872 - DNA, 16 bp, Homo sapiens
aagactggcccagtgc

SEQ ID NO: 6480873 - DNA, 18 bp, Homo sapiens
aagactggcccagtgcca

SEQ ID NO: 6480874 - DNA, 18 bp, Homo sapiens
aagactgggccccacatg

SEQ ID NO: 6480875 - DNA, 12 bp, Homo sapiens
aagactggtttg

SEQ ID NO: 6480876 - DNA, 20 bp, Homo sapiens
aagactggtttgtttgctta

SEQ ID NO: 6480877 - DNA, 13 bp, Homo sapiens
aagactgtaaatt

SEQ ID NO: 6480878 - DNA, 16 bp, Homo sapiens
aagactgtaatgaatc

SEQ ID NO: 6480879 - DNA, 20 bp, Homo sapiens
aagactgtattttcaggaag

SEQ ID NO: 6480880 - DNA, 18 bp, Homo sapiens
aagactgtcaaatgaact

SEQ ID NO: 6480881 - DNA, 16 bp, Homo sapiens
aagactgtcattagaa

SEQ ID NO: 6480882 - DNA, 16 bp, Homo sapiens
aagactgtcattgccc

SEQ ID NO: 6480883 - DNA, 19 bp, Homo sapiens
aagactgtcttacctggca

SEQ ID NO: 6480884 - DNA, 20 bp, Homo sapiens
aagactgtgaacagcttgct

SEQ ID NO: 6480885 - DNA, 13 bp, Homo sapiens
aagactgtgcaga

SEQ ID NO: 6480886 - DNA, 15 bp, Homo sapiens
aagactgtgcagaag

SEQ ID NO: 6480887 - DNA, 20 bp, Homo sapiens
aagactgtgctgtcctttaa

SEQ ID NO: 6480888 - DNA, 15 bp, Homo sapiens
aagactgtggctgct

SEQ ID NO: 6480889 - DNA, 24 bp, Homo sapiens
aagactgttgctcaaatctattca

SEQ ID NO: 6480890 - DNA, 17 bp, Homo sapiens
aagactgttttcagacc

SEQ ID NO: 6480891 - DNA, 16 bp, Homo sapiens
aagactgtttttaagt

SEQ ID NO: 6480892 - DNA, 21 bp, Homo sapiens
aagactgtttttaagtaactt

SEQ ID NO: 6480893 - DNA, 17 bp, Homo sapiens
aagacttaaatagttca

SEQ ID NO: 6480894 - DNA, 14 bp, Homo sapiens
aagacttaagatta

SEQ ID NO: 6480895 - DNA, 17 bp, Homo sapiens
aagacttaatctttgct

SEQ ID NO: 6480896 - DNA, 15 bp, Homo sapiens
aagacttacctgaat

SEQ ID NO: 6480897 - DNA, 21 bp, Homo sapiens
aagacttacctgaataattac

SEQ ID NO: 6480898 - DNA, 15 bp, Homo sapiens
aagacttactctaag

SEQ ID NO: 6480899 - DNA, 17 bp, Homo sapiens
aagacttactctaagat

SEQ ID NO: 6480900 - DNA, 20 bp, Homo sapiens
aagacttactctaagatctt

SEQ ID NO: 6480901 - DNA, 19 bp, Homo sapiens
aagacttagatctgagccc

SEQ ID NO: 6480902 - DNA, 21 bp, Homo sapiens
aagacttagatctgagccctc

SEQ ID NO: 6480903 - DNA, 20 bp, Homo sapiens
aagacttcagtatgttgtca

SEQ ID NO: 6480904 - DNA, 20 bp, Homo sapiens
aagacttcatttaacactga

SEQ ID NO: 6480905 - DNA, 16 bp, Homo sapiens
aagacttccagagcct

SEQ ID NO: 6480906 - DNA, 18 bp, Homo sapiens
aagacttccagagcctca

SEQ ID NO: 6480907 - DNA, 14 bp, Homo sapiens
aagacttcccagct

SEQ ID NO: 6480908 - DNA, 15 bp, Homo sapiens
aagacttcctctcta

SEQ ID NO: 6480909 - DNA, 20 bp, Homo sapiens
aagacttcctctctaccccc

SEQ ID NO: 6480910 - DNA, 13 bp, Homo sapiens
aagacttctctgt

SEQ ID NO: 6480911 - DNA, 19 bp, Homo sapiens
aagacttctctttgcctca

SEQ ID NO: 6480912 - DNA, 15 bp, Homo sapiens
aagacttgagacaat

SEQ ID NO: 6480913 - DNA, 21 bp, Homo sapiens
aagacttgatactgcaataaa

SEQ ID NO: 6480914 - DNA, 18 bp, Homo sapiens
aagacttggcaacagaag

SEQ ID NO: 6480915 - DNA, 19 bp, Homo sapiens
aagacttggcaacagaagc

SEQ ID NO: 6480916 - DNA, 20 bp, Homo sapiens
aagacttggcaacagaagca

SEQ ID NO: 6480917 - DNA, 18 bp, Homo sapiens
aagacttggcccaggaaa

SEQ ID NO: 6480918 - DNA, 20 bp, Homo sapiens
aagacttggcccaggaaaaa

SEQ ID NO: 6480919 - DNA, 18 bp, Homo sapiens
aagacttgtgcatccctc

SEQ ID NO: 6480920 - DNA, 14 bp, Homo sapiens
aagactttaattat

SEQ ID NO: 6480921 - DNA, 18 bp, Homo sapiens
aagactttgatccttgga

SEQ ID NO: 6480922 - DNA, 20 bp, Homo sapiens
aagactttgatccttggaaa

SEQ ID NO: 6480923 - DNA, 14 bp, Homo sapiens
aagactttgtgact

SEQ ID NO: 6480924 - DNA, 18 bp, Homo sapiens
aagacttttagcggtttg

SEQ ID NO: 6480925 - DNA, 15 bp, Homo sapiens
aagacttttatgata

SEQ ID NO: 6480926 - DNA, 22 bp, Homo sapiens
aagacttttatgtgagatttcc

SEQ ID NO: 6480927 - DNA, 18 bp, Homo sapiens
aagacttttattaataaa

SEQ ID NO: 6480928 - DNA, 12 bp, Homo sapiens
aagacttttctt

SEQ ID NO: 6480929 - DNA, 21 bp, Homo sapiens
aagacttttggtagagaagga

SEQ ID NO: 6480930 - DNA, 14 bp, Homo sapiens
aagacttttttccc

SEQ ID NO: 6480931 - DNA, 23 bp, Homo sapiens
aagagaaaaaaaaacacacaaaa

SEQ ID NO: 6480932 - DNA, 19 bp, Homo sapiens
aagagaaaaaagtcaccat

SEQ ID NO: 6480933 - DNA, 11 bp, Homo sapiens
aagagaaaaac

SEQ ID NO: 6480934 - DNA, 17 bp, Homo sapiens
aagagaaaaagaaatgc

SEQ ID NO: 6480935 - DNA, 18 bp, Homo sapiens
aagagaaaaagccctctt

SEQ ID NO: 6480936 - DNA, 23 bp, Homo sapiens
aagagaaaaaggctgaaaagaag

SEQ ID NO: 6480937 - DNA, 12 bp, Homo sapiens
aagagaaaagaa

SEQ ID NO: 6480938 - DNA, 13 bp, Homo sapiens
aagagaaaatatt

SEQ ID NO: 6480939 - DNA, 14 bp, Homo sapiens
aagagaaaatatta

SEQ ID NO: 6480940 - DNA, 13 bp, Homo sapiens
aagagaaaatgat

SEQ ID NO: 6480941 - DNA, 21 bp, Homo sapiens
aagagaaaatgtaaaggaggg

SEQ ID NO: 6480942 - DNA, 17 bp, Homo sapiens
aagagaaaatgtaaata

SEQ ID NO: 6480943 - DNA, 14 bp, Homo sapiens
aagagaaaatgtgt

SEQ ID NO: 6480944 - DNA, 17 bp, Homo sapiens
aagagaaaattcctaga

SEQ ID NO: 6480945 - DNA, 13 bp, Homo sapiens
aagagaaaattga

SEQ ID NO: 6480946 - DNA, 15 bp, Homo sapiens
aagagaaaattgaat

SEQ ID NO: 6480947 - DNA, 17 bp, Homo sapiens
aagagaaaattgaattt

SEQ ID NO: 6480948 - DNA, 21 bp, Homo sapiens
aagagaaaattgaatttaaca

SEQ ID NO: 6480949 - DNA, 18 bp, Homo sapiens
aagagaaaattgcactaa

SEQ ID NO: 6480950 - DNA, 21 bp, Homo sapiens
aagagaaacactaatggccaa

SEQ ID NO: 6480951 - DNA, 12 bp, Homo sapiens
aagagaaacagg

SEQ ID NO: 6480952 - DNA, 20 bp, Homo sapiens
aagagaaacagttggtaact

SEQ ID NO: 6480953 - DNA, 20 bp, Homo sapiens
aagagaaacctgccaaggag

SEQ ID NO: 6480954 - DNA, 20 bp, Homo sapiens
aagagaaactatctatttgc

SEQ ID NO: 6480955 - DNA, 18 bp, Homo sapiens
aagagaaactttatacat

SEQ ID NO: 6480956 - DNA, 19 bp, Homo sapiens
aagagaaactttatacatt

SEQ ID NO: 6480957 - DNA, 22 bp, Homo sapiens
aagagaaactttatacattagt

SEQ ID NO: 6480958 - DNA, 14 bp, Homo sapiens
aagagaaactttgt

SEQ ID NO: 6480959 - DNA, 11 bp, Homo sapiens
aagagaaagag

SEQ ID NO: 6480960 - DNA, 13 bp, Homo sapiens
aagagaaagagac

SEQ ID NO: 6480961 - DNA, 16 bp, Homo sapiens
aagagaaagaggccag

SEQ ID NO: 6480962 - DNA, 14 bp, Homo sapiens
aagagaaaggactc

SEQ ID NO: 6480963 - DNA, 19 bp, Homo sapiens
aagagaaaggactcagtgt

SEQ ID NO: 6480964 - DNA, 19 bp, Homo sapiens
aagagaaaggggcaagaaa

SEQ ID NO: 6480965 - DNA, 20 bp, Homo sapiens
aagagaaagtactcagaggc

SEQ ID NO: 6480966 - DNA, 18 bp, Homo sapiens
aagagaaatacagctggc

SEQ ID NO: 6480967 - DNA, 11 bp, Homo sapiens
aagagaaatga

SEQ ID NO: 6480968 - DNA, 21 bp, Homo sapiens
aagagaacaaagagtgaaata

SEQ ID NO: 6480969 - DNA, 18 bp, Homo sapiens
aagagaacaagaggtgct

SEQ ID NO: 6480970 - DNA, 13 bp, Homo sapiens
aagagaaccatgt

SEQ ID NO: 6480971 - DNA, 18 bp, Homo sapiens
tctttgaaatgacatgtt

SEQ ID NO: 6480972 - DNA, 22 bp, Homo sapiens
tctttgaaatgacatgttcctt

SEQ ID NO: 6480973 - DNA, 16 bp, Homo sapiens
tctttgaaatgctaaa

SEQ ID NO: 6480974 - DNA, 20 bp, Homo sapiens
tctttgaagaaggaatcttt

SEQ ID NO: 6480975 - DNA, 22 bp, Homo sapiens
tctttgaagaaggtggaccttt

SEQ ID NO: 6480976 - DNA, 23 bp, Homo sapiens
tctttgaagaaggtggacctttt

SEQ ID NO: 6480977 - DNA, 20 bp, Homo sapiens
tctttgaagagatgacaaca

SEQ ID NO: 6480978 - DNA, 12 bp, Homo sapiens
tctttgaagtta

SEQ ID NO: 6480979 - DNA, 17 bp, Homo sapiens
tctttgaagttatttag

SEQ ID NO: 6480980 - DNA, 21 bp, Homo sapiens
tctttgaagttatttagaaat

SEQ ID NO: 6480981 - DNA, 10 bp, Homo sapiens
tctttgaata

SEQ ID NO: 6480982 - DNA, 12 bp, Homo sapiens
tctttgaataaa

SEQ ID NO: 6480983 - DNA, 18 bp, Homo sapiens
tctttgaataaagtctga

SEQ ID NO: 6480984 - DNA, 13 bp, Homo sapiens
tctttgaataaat

SEQ ID NO: 6480985 - DNA, 16 bp, Homo sapiens
tctttgaataaatgtc

SEQ ID NO: 6480986 - DNA, 17 bp, Homo sapiens
tctttgaataaatgtca

SEQ ID NO: 6480987 - DNA, 20 bp, Homo sapiens
tctttgaataaatgtcactt

SEQ ID NO: 6480988 - DNA, 13 bp, Homo sapiens
tctttgaattttc

SEQ ID NO: 6480989 - DNA, 14 bp, Homo sapiens
tctttgaattttca

SEQ ID NO: 6480990 - DNA, 16 bp, Homo sapiens
tctttgaattttctgt

SEQ ID NO: 6480991 - DNA, 22 bp, Homo sapiens
tctttgacatttttgccaaaat

SEQ ID NO: 6480992 - DNA, 17 bp, Homo sapiens
tctttgaccaaactgtg

SEQ ID NO: 6480993 - DNA, 18 bp, Homo sapiens
tctttgactataacaaaa

SEQ ID NO: 6480994 - DNA, 19 bp, Homo sapiens
tctttgactgtcagcaaga

SEQ ID NO: 6480995 - DNA, 22 bp, Homo sapiens
tctttgagaaaggattaagata

SEQ ID NO: 6480996 - DNA, 21 bp, Homo sapiens
tctttgagaccatccattctc

SEQ ID NO: 6480997 - DNA, 18 bp, Homo sapiens
tctttgagataatacatt

SEQ ID NO: 6480998 - DNA, 22 bp, Homo sapiens
tctttgagataatacattccga

SEQ ID NO: 6480999 - DNA, 17 bp, Homo sapiens
tctttgagatagaagaa

SEQ ID NO: 6481000 - DNA, 12 bp, Homo sapiens
tctttgagccca

SEQ ID NO: 6481001 - DNA, 15 bp, Homo sapiens
tctttgagcccattc

SEQ ID NO: 6481002 - DNA, 21 bp, Homo sapiens
tctttgagcccattcttctgg

SEQ ID NO: 6481003 - DNA, 19 bp, Homo sapiens
tctttgagggactgcctct

SEQ ID NO: 6481004 - DNA, 14 bp, Homo sapiens
tctttgataatgtt

SEQ ID NO: 6481005 - DNA, 17 bp, Homo sapiens
tctttgataatgttaaa

SEQ ID NO: 6481006 - DNA, 21 bp, Homo sapiens
tctttgataatgttaaatttg

SEQ ID NO: 6481007 - DNA, 22 bp, Homo sapiens
tctttgatatgttgatgaaatt

SEQ ID NO: 6481008 - DNA, 13 bp, Homo sapiens
tctttgatccttc

SEQ ID NO: 6481009 - DNA, 15 bp, Homo sapiens
tctttgatccttctc

SEQ ID NO: 6481010 - DNA, 16 bp, Homo sapiens
tctttgatccttctga

SEQ ID NO: 6481011 - DNA, 12 bp, Homo sapiens
tctttgatggac

SEQ ID NO: 6481012 - DNA, 19 bp, Homo sapiens
tctttgatgttaacacatt

SEQ ID NO: 6481013 - DNA, 17 bp, Homo sapiens
tctttgattatttgcat

SEQ ID NO: 6481014 - DNA, 13 bp, Homo sapiens
tctttgattcaga

SEQ ID NO: 6481015 - DNA, 15 bp, Homo sapiens
tctttgattctcctt

SEQ ID NO: 6481016 - DNA, 15 bp, Homo sapiens
tctttgattgtgaaa

SEQ ID NO: 6481017 - DNA, 14 bp, Homo sapiens
tctttgatttgtac

SEQ ID NO: 6481018 - DNA, 22 bp, Homo sapiens
tctttgcaaaaatccaaatatt

SEQ ID NO: 6481019 - DNA, 18 bp, Homo sapiens
tctttgcaaaccctggtg

SEQ ID NO: 6481020 - DNA, 12 bp, Homo sapiens
tctttgcaaagt

SEQ ID NO: 6481021 - DNA, 15 bp, Homo sapiens
tctttgcaaagtatt

SEQ ID NO: 6481022 - DNA, 12 bp, Homo sapiens
tctttgcaaata

SEQ ID NO: 6481023 - DNA, 22 bp, Homo sapiens
tctttgcaacaataataaatgt

SEQ ID NO: 6481024 - DNA, 15 bp, Homo sapiens
tctttgcaatactgc

SEQ ID NO: 6481025 - DNA, 18 bp, Homo sapiens
tctttgcaccaaagatgt

SEQ ID NO: 6481026 - DNA, 17 bp, Homo sapiens
tctttgcacttaaaaat

SEQ ID NO: 6481027 - DNA, 18 bp, Homo sapiens
tctttgcacttttgaaat

SEQ ID NO: 6481028 - DNA, 18 bp, Homo sapiens
tctttgcactttttctta

SEQ ID NO: 6481029 - DNA, 15 bp, Homo sapiens
tctttgcagagcctt

SEQ ID NO: 6481030 - DNA, 21 bp, Homo sapiens
tctttgcagtgaagatgtgta

SEQ ID NO: 6481031 - DNA, 18 bp, Homo sapiens
tctttgccaacatggtga

SEQ ID NO: 6481032 - DNA, 21 bp, Homo sapiens
tctttgccaagacctttcaaa

SEQ ID NO: 6481033 - DNA, 17 bp, Homo sapiens
tctttgccaccctcatg

SEQ ID NO: 6481034 - DNA, 20 bp, Homo sapiens
tctttgccagagacctattt

SEQ ID NO: 6481035 - DNA, 18 bp, Homo sapiens
tctttgccataactttat

SEQ ID NO: 6481036 - DNA, 13 bp, Homo sapiens
tctttgccatctc

SEQ ID NO: 6481037 - DNA, 19 bp, Homo sapiens
tctttgccatctctgctcc

SEQ ID NO: 6481038 - DNA, 20 bp, Homo sapiens
tctttgccatctctgctcca

SEQ ID NO: 6481039 - DNA, 20 bp, Homo sapiens
tctttgcccagttcatccca

SEQ ID NO: 6481040 - DNA, 22 bp, Homo sapiens
tctttgccctttacttgtcttt

SEQ ID NO: 6481041 - DNA, 12 bp, Homo sapiens
tctttgcctcaa

SEQ ID NO: 6481042 - DNA, 18 bp, Homo sapiens
tctttgcctgtgtgagca

SEQ ID NO: 6481043 - DNA, 21 bp, Homo sapiens
tctttgcctgtgtgagcatct

SEQ ID NO: 6481044 - DNA, 17 bp, Homo sapiens
tctttgccttgatgttg

SEQ ID NO: 6481045 - DNA, 20 bp, Homo sapiens
tctttgccttgggctgctcc

SEQ ID NO: 6481046 - DNA, 21 bp, Homo sapiens
tctttgcggggcctgtctcag

SEQ ID NO: 6481047 - DNA, 23 bp, Homo sapiens
tctttgcggggcctgtctcagtg

SEQ ID NO: 6481048 - DNA, 14 bp, Homo sapiens
tctttgctacaata

SEQ ID NO: 6481049 - DNA, 23 bp, Homo sapiens
tctttgctacaataaatgctgaa

SEQ ID NO: 6481050 - DNA, 12 bp, Homo sapiens
tctttgctcagt

SEQ ID NO: 6481051 - DNA, 22 bp, Homo sapiens
tctttgctccagataactctct

SEQ ID NO: 6481052 - DNA, 14 bp, Homo sapiens
tctttgctgacact

SEQ ID NO: 6481053 - DNA, 12 bp, Homo sapiens
tctttgctgcag

SEQ ID NO: 6481054 - DNA, 13 bp, Homo sapiens
tctttgctgcccc

SEQ ID NO: 6481055 - DNA, 19 bp, Homo sapiens
tctttgctgcccctgtctg

SEQ ID NO: 6481056 - DNA, 18 bp, Homo sapiens
tctttgctgctgctctca

SEQ ID NO: 6481057 - DNA, 14 bp, Homo sapiens
tctttgctgctttg

SEQ ID NO: 6481058 - DNA, 15 bp, Homo sapiens
tctttgctgtactct

SEQ ID NO: 6481059 - DNA, 15 bp, Homo sapiens
tctttgctgtgccaa

SEQ ID NO: 6481060 - DNA, 19 bp, Homo sapiens
tctttgctgtgccaaagca

SEQ ID NO: 6481061 - DNA, 17 bp, Homo sapiens
tctttgcttctttttct

SEQ ID NO: 6481062 - DNA, 15 bp, Homo sapiens
tctttgcttgaacac

SEQ ID NO: 6481063 - DNA, 17 bp, Homo sapiens
tctttgcttgaacacag

SEQ ID NO: 6481064 - DNA, 12 bp, Homo sapiens
tctttgcttggg

SEQ ID NO: 6481065 - DNA, 21 bp, Homo sapiens
tctttgctttgtagtttgctt

SEQ ID NO: 6481066 - DNA, 19 bp, Homo sapiens
tctttggaaaattcagata

SEQ ID NO: 6481067 - DNA, 17 bp, Homo sapiens
tctttggaaatagcatg

SEQ ID NO: 6481068 - DNA, 18 bp, Homo sapiens
tctttggaacagatattt

SEQ ID NO: 6481069 - DNA, 23 bp, Homo sapiens
tctttggaagcagccccctgtgg

SEQ ID NO: 6481070 - DNA, 18 bp, Homo sapiens
tctttggaaggagtgaga

SEQ ID NO: 6481071 - DNA, 21 bp, Homo sapiens
tctttggaatgaaattcctcc

SEQ ID NO: 6481072 - DNA, 17 bp, Homo sapiens
tctttggacactcacac

SEQ ID NO: 6481073 - DNA, 14 bp, Homo sapiens
tctttggaccctga

SEQ ID NO: 6481074 - DNA, 17 bp, Homo sapiens
tctttggaccctgaggc

SEQ ID NO: 6481075 - DNA, 21 bp, Homo sapiens
tctttggaccctgaggcccag

SEQ ID NO: 6481076 - DNA, 22 bp, Homo sapiens
tctttggagagctcagtacagg

SEQ ID NO: 6481077 - DNA, 20 bp, Homo sapiens
tctttggagttaaaatgcac

SEQ ID NO: 6481078 - DNA, 19 bp, Homo sapiens
tctttggataataggaatt

SEQ ID NO: 6481079 - DNA, 15 bp, Homo sapiens
tctttggcatgattt

SEQ ID NO: 6481080 - DNA, 17 bp, Homo sapiens
tctttggcctacattct

SEQ ID NO: 6481081 - DNA, 19 bp, Homo sapiens
tctttggcctacattcttt

SEQ ID NO: 6481082 - DNA, 23 bp, Homo sapiens
tctttggctattgtccttgtgta

SEQ ID NO: 6481083 - DNA, 14 bp, Homo sapiens
tctttggctcccct

SEQ ID NO: 6481084 - DNA, 14 bp, Homo sapiens
tctttggctctatt

SEQ ID NO: 6481085 - DNA, 14 bp, Homo sapiens
tctttgggaatgtt

SEQ ID NO: 6481086 - DNA, 21 bp, Homo sapiens
tctttgggacacctcagaaaa

SEQ ID NO: 6481087 - DNA, 17 bp, Homo sapiens
tctttgggatcttgaag

SEQ ID NO: 6481088 - DNA, 16 bp, Homo sapiens
tctttggggaaaaatt

SEQ ID NO: 6481089 - DNA, 17 bp, Homo sapiens
tctttggggaaaaattc

SEQ ID NO: 6481090 - DNA, 22 bp, Homo sapiens
tctttggggcaagatccaggtg

SEQ ID NO: 6481091 - DNA, 22 bp, Homo sapiens
tctttggggctcctttcccctc

SEQ ID NO: 6481092 - DNA, 17 bp, Homo sapiens
tctttgggggattcaaa

SEQ ID NO: 6481093 - DNA, 10 bp, Homo sapiens
tctttggggt

SEQ ID NO: 6481094 - DNA, 21 bp, Homo sapiens
tctttgggtgggggggagaag

SEQ ID NO: 6481095 - DNA, 15 bp, Homo sapiens
tctttggtaggtaaa

SEQ ID NO: 6481096 - DNA, 22 bp, Homo sapiens
tctttggtattgtcttaaataa

SEQ ID NO: 6481097 - DNA, 13 bp, Homo sapiens
tctttggtgcctt

SEQ ID NO: 6481098 - DNA, 20 bp, Homo sapiens
tctttggtgcctttcctgtt

SEQ ID NO: 6481099 - DNA, 18 bp, Homo sapiens
tctttggtgttctggcct

SEQ ID NO: 6481100 - DNA, 14 bp, Homo sapiens
tctttggttcctca

SEQ ID NO: 6481101 - DNA, 12 bp, Homo sapiens
tctttggttcta

SEQ ID NO: 6481102 - DNA, 21 bp, Homo sapiens
tctttggttctaaggacctga

SEQ ID NO: 6481103 - DNA, 19 bp, Homo sapiens
tctttggtttaatttaaag

SEQ ID NO: 6481104 - DNA, 17 bp, Homo sapiens
tctttgtaaaatcttgc

SEQ ID NO: 6481105 - DNA, 17 bp, Homo sapiens
tctttgtaaaggtcaga

SEQ ID NO: 6481106 - DNA, 21 bp, Homo sapiens
tctttgtaaattattttatgt

SEQ ID NO: 6481107 - DNA, 21 bp, Homo sapiens
tctttgtaagaactaaagaag

SEQ ID NO: 6481108 - DNA, 13 bp, Homo sapiens
tctttgtaagagt

SEQ ID NO: 6481109 - DNA, 18 bp, Homo sapiens
tctttgtaagagtgtaga

SEQ ID NO: 6481110 - DNA, 21 bp, Homo sapiens
tctttgtaagagtgtagaagc

SEQ ID NO: 6481111 - DNA, 16 bp, Homo sapiens
tctttgtaaggacttg

SEQ ID NO: 6481112 - DNA, 18 bp, Homo sapiens
tctttgtaaggacttgtg

SEQ ID NO: 6481113 - DNA, 22 bp, Homo sapiens
tctttgtaagtcagtgttgaga

SEQ ID NO: 6481114 - DNA, 15 bp, Homo sapiens
tctttgtaatgaaaa

SEQ ID NO: 6481115 - DNA, 17 bp, Homo sapiens
tctttgtaccaaaattt

SEQ ID NO: 6481116 - DNA, 23 bp, Homo sapiens
tctttgtaccacagtttcttctg

SEQ ID NO: 6481117 - DNA, 17 bp, Homo sapiens
tctttgtaccatctgtc

SEQ ID NO: 6481118 - DNA, 19 bp, Homo sapiens
tctttgtagaataaatggt

SEQ ID NO: 6481119 - DNA, 20 bp, Homo sapiens
tctttgtagaataaatggtt

SEQ ID NO: 6481120 - DNA, 20 bp, Homo sapiens
tctttgtagctaacagtgaa

SEQ ID NO: 6481121 - DNA, 14 bp, Homo sapiens
tctttgtataaata

SEQ ID NO: 6481122 - DNA, 19 bp, Homo sapiens
tctttgtataaataaatat

SEQ ID NO: 6481123 - DNA, 12 bp, Homo sapiens
tctttgtatctt

SEQ ID NO: 6481124 - DNA, 15 bp, Homo sapiens
tctttgtatcttaaa

SEQ ID NO: 6481125 - DNA, 16 bp, Homo sapiens
tctttgtatcttaaat

SEQ ID NO: 6481126 - DNA, 17 bp, Homo sapiens
tctttgtattaccaaag

SEQ ID NO: 6481127 - DNA, 18 bp, Homo sapiens
tctttgtattaccaaagc

SEQ ID NO: 6481128 - DNA, 15 bp, Homo sapiens
tctttgtattcttca

SEQ ID NO: 6481129 - DNA, 19 bp, Homo sapiens
tctttgtattcttcatgaa

SEQ ID NO: 6481130 - DNA, 21 bp, Homo sapiens
tctttgtattcttcatgaaat

SEQ ID NO: 6481131 - DNA, 23 bp, Homo sapiens
tctttgtattcttcatgaaatgt

SEQ ID NO: 6481132 - DNA, 22 bp, Homo sapiens
tctttgtcaatgctctaacaaa

SEQ ID NO: 6481133 - DNA, 17 bp, Homo sapiens
tctttgtcccctgggtc

SEQ ID NO: 6481134 - DNA, 22 bp, Homo sapiens
tctttgtcccggataggctaat

SEQ ID NO: 6481135 - DNA, 24 bp, Homo sapiens
tctttgtcccggataggctaatca

SEQ ID NO: 6481136 - DNA, 13 bp, Homo sapiens
tctttgtctaaaa

SEQ ID NO: 6481137 - DNA, 20 bp, Homo sapiens
tctttgtctaaaacaataaa

SEQ ID NO: 6481138 - DNA, 19 bp, Homo sapiens
tctttgtctcaccagctca

SEQ ID NO: 6481139 - DNA, 18 bp, Homo sapiens
tctttgtctgccttccca

SEQ ID NO: 6481140 - DNA, 16 bp, Homo sapiens
tctttgtctttttcct

SEQ ID NO: 6481141 - DNA, 13 bp, Homo sapiens
tctttgtgaaatc

SEQ ID NO: 6481142 - DNA, 13 bp, Homo sapiens
tctttgtgaacat

SEQ ID NO: 6481143 - DNA, 16 bp, Homo sapiens
tctttgtgaaggcctc

SEQ ID NO: 6481144 - DNA, 14 bp, Homo sapiens
tctttgtgacagga

SEQ ID NO: 6481145 - DNA, 20 bp, Homo sapiens
tctttgtgacaggaaagccc

SEQ ID NO: 6481146 - DNA, 21 bp, Homo sapiens
tctttgtgataattctcagta

SEQ ID NO: 6481147 - DNA, 15 bp, Homo sapiens
tctttgtgcagtgtt

SEQ ID NO: 6481148 - DNA, 16 bp, Homo sapiens
tctttgtgcctttggc

SEQ ID NO: 6481149 - DNA, 13 bp, Homo sapiens
tggaatattgttt

SEQ ID NO: 6481150 - DNA, 16 bp, Homo sapiens
tggaatattttatcct

SEQ ID NO: 6481151 - DNA, 17 bp, Homo sapiens
tggaatattttatcctg

SEQ ID NO: 6481152 - DNA, 12 bp, Homo sapiens
tggaatcaacac

SEQ ID NO: 6481153 - DNA, 21 bp, Homo sapiens
tggaatcaaggaatcctgagt

SEQ ID NO: 6481154 - DNA, 20 bp, Homo sapiens
tggaatcaaggtaagctcag

SEQ ID NO: 6481155 - DNA, 18 bp, Homo sapiens
tggaatcaatttcccaga

SEQ ID NO: 6481156 - DNA, 19 bp, Homo sapiens
tggaatcaatttcccagaa

SEQ ID NO: 6481157 - DNA, 15 bp, Homo sapiens
tggaatcacagccaa

SEQ ID NO: 6481158 - DNA, 18 bp, Homo sapiens
tggaatcacctggagggc

SEQ ID NO: 6481159 - DNA, 21 bp, Homo sapiens
tggaatcagtatttccttcca

SEQ ID NO: 6481160 - DNA, 23 bp, Homo sapiens
tggaatcagtatttccttccact

SEQ ID NO: 6481161 - DNA, 19 bp, Homo sapiens
tggaatcatactgcctact

SEQ ID NO: 6481162 - DNA, 20 bp, Homo sapiens
tggaatcattgtccagagct

SEQ ID NO: 6481163 - DNA, 16 bp, Homo sapiens
tggaatccagaaggaa

SEQ ID NO: 6481164 - DNA, 14 bp, Homo sapiens
tggaatccagtgtg

SEQ ID NO: 6481165 - DNA, 21 bp, Homo sapiens
tggaatccagtgtggctccca

SEQ ID NO: 6481166 - DNA, 23 bp, Homo sapiens
tggaatcccactaatgcaaactg

SEQ ID NO: 6481167 - DNA, 18 bp, Homo sapiens
tggaatcccactgtatga

SEQ ID NO: 6481168 - DNA, 15 bp, Homo sapiens
tggaatcccagctcc

SEQ ID NO: 6481169 - DNA, 22 bp, Homo sapiens
tggaatcctccttaatttaatt

SEQ ID NO: 6481170 - DNA, 13 bp, Homo sapiens
tggaatcctttca

SEQ ID NO: 6481171 - DNA, 18 bp, Homo sapiens
tggaatcgatctgtactg

SEQ ID NO: 6481172 - DNA, 15 bp, Homo sapiens
tggaatctgaggcat

SEQ ID NO: 6481173 - DNA, 13 bp, Homo sapiens
tggaatctgctcc

SEQ ID NO: 6481174 - DNA, 12 bp, Homo sapiens
tggaatctggag

SEQ ID NO: 6481175 - DNA, 18 bp, Homo sapiens
tggaatcttcacctcaga

SEQ ID NO: 6481176 - DNA, 20 bp, Homo sapiens
tggaatcttcacctcagagt

SEQ ID NO: 6481177 - DNA, 21 bp, Homo sapiens
tggaatcttcacctcagagtg

SEQ ID NO: 6481178 - DNA, 15 bp, Homo sapiens
tggaatcttccccaa

SEQ ID NO: 6481179 - DNA, 16 bp, Homo sapiens
tggaatgaagcatgta

SEQ ID NO: 6481180 - DNA, 18 bp, Homo sapiens
tggaatgacatgtgtcaa

SEQ ID NO: 6481181 - DNA, 15 bp, Homo sapiens
tggaatgagaattta

SEQ ID NO: 6481182 - DNA, 19 bp, Homo sapiens
tggaatgagtgtgcatgga

SEQ ID NO: 6481183 - DNA, 20 bp, Homo sapiens
tggaatgatgggtcagttgt

SEQ ID NO: 6481184 - DNA, 18 bp, Homo sapiens
tggaatgatgtatataaa

SEQ ID NO: 6481185 - DNA, 13 bp, Homo sapiens
tggaatgcaattt

SEQ ID NO: 6481186 - DNA, 15 bp, Homo sapiens
tggaatgcatggggc

SEQ ID NO: 6481187 - DNA, 21 bp, Homo sapiens
tggaatgcattcactcagcat

SEQ ID NO: 6481188 - DNA, 23 bp, Homo sapiens
tggaatgccaatgtcagcatcaa

SEQ ID NO: 6481189 - DNA, 17 bp, Homo sapiens
tggaatgcccttcactg

SEQ ID NO: 6481190 - DNA, 19 bp, Homo sapiens
tggaatgccgctgtctctg

SEQ ID NO: 6481191 - DNA, 20 bp, Homo sapiens
tggaatgcgggggagcaggc

SEQ ID NO: 6481192 - DNA, 22 bp, Homo sapiens
tggaatgcgggggagcaggcag

SEQ ID NO: 6481193 - DNA, 16 bp, Homo sapiens
tggaatgctgggtatg

SEQ ID NO: 6481194 - DNA, 13 bp, Homo sapiens
tggaatgcttctt

SEQ ID NO: 6481195 - DNA, 22 bp, Homo sapiens
tggaatgcttgaaaaatgtgca

SEQ ID NO: 6481196 - DNA, 21 bp, Homo sapiens
tggaatggaaaagcaacttca

SEQ ID NO: 6481197 - DNA, 22 bp, Homo sapiens
tggaatggaactactgtacttt

SEQ ID NO: 6481198 - DNA, 15 bp, Homo sapiens
tggaatggacatcct

SEQ ID NO: 6481199 - DNA, 14 bp, Homo sapiens
tggaatggactggg

SEQ ID NO: 6481200 - DNA, 13 bp, Homo sapiens
tggaatggagctg

SEQ ID NO: 6481201 - DNA, 19 bp, Homo sapiens
tggaatggattttcctgaa

SEQ ID NO: 6481202 - DNA, 15 bp, Homo sapiens
tggaatggatttttc

SEQ ID NO: 6481203 - DNA, 21 bp, Homo sapiens
tggaatggctgagcaaatatt

SEQ ID NO: 6481204 - DNA, 21 bp, Homo sapiens
tggaatgggagtctgaaatgg

SEQ ID NO: 6481205 - DNA, 20 bp, Homo sapiens
tggaatggtgttttgtcaga

SEQ ID NO: 6481206 - DNA, 17 bp, Homo sapiens
tggaatggttataaaag

SEQ ID NO: 6481207 - DNA, 16 bp, Homo sapiens
tggaatggtttgggaa

SEQ ID NO: 6481208 - DNA, 15 bp, Homo sapiens
tggaatgtgccacag

SEQ ID NO: 6481209 - DNA, 19 bp, Homo sapiens
tggaatgtgccacagaggc

SEQ ID NO: 6481210 - DNA, 16 bp, Homo sapiens
tggaatgtgccacctg

SEQ ID NO: 6481211 - DNA, 18 bp, Homo sapiens
tggaatgtgcccctggcc

SEQ ID NO: 6481212 - DNA, 22 bp, Homo sapiens
tggaatgtggtacaaattgttc

SEQ ID NO: 6481213 - DNA, 15 bp, Homo sapiens
tggaatgtgttgtaa

SEQ ID NO: 6481214 - DNA, 15 bp, Homo sapiens
tggaatgttggctgt

SEQ ID NO: 6481215 - DNA, 14 bp, Homo sapiens
tggaattaaaacaa

SEQ ID NO: 6481216 - DNA, 16 bp, Homo sapiens
tggaattaaaacaaaa

SEQ ID NO: 6481217 - DNA, 17 bp, Homo sapiens
tggaattaaaaggatag

SEQ ID NO: 6481218 - DNA, 16 bp, Homo sapiens
tggaattaacctggtg

SEQ ID NO: 6481219 - DNA, 18 bp, Homo sapiens
tggaattaacctggtgct

SEQ ID NO: 6481220 - DNA, 19 bp, Homo sapiens
tggaattaacctggtgctg

SEQ ID NO: 6481221 - DNA, 16 bp, Homo sapiens
tggaattacagactca

SEQ ID NO: 6481222 - DNA, 13 bp, Homo sapiens
tggaattactcca

SEQ ID NO: 6481223 - DNA, 15 bp, Homo sapiens
tggaattactgaaag

SEQ ID NO: 6481224 - DNA, 22 bp, Homo sapiens
tggaattagaacccttgcacag

SEQ ID NO: 6481225 - DNA, 23 bp, Homo sapiens
tggaattagaacccttgcacagc

SEQ ID NO: 6481226 - DNA, 15 bp, Homo sapiens
tggaattagagggcc

SEQ ID NO: 6481227 - DNA, 15 bp, Homo sapiens
tggaattatgtataa

SEQ ID NO: 6481228 - DNA, 21 bp, Homo sapiens
tggaattatgttggtgtgaat

SEQ ID NO: 6481229 - DNA, 22 bp, Homo sapiens
tggaattatgttggtgtgaatt

SEQ ID NO: 6481230 - DNA, 20 bp, Homo sapiens
tggaattattagcaccagct

SEQ ID NO: 6481231 - DNA, 23 bp, Homo sapiens
tggaattattgtaccattttcta

SEQ ID NO: 6481232 - DNA, 17 bp, Homo sapiens
tggaattattttaaaag

SEQ ID NO: 6481233 - DNA, 19 bp, Homo sapiens
tggaattattttaaaagat

SEQ ID NO: 6481234 - DNA, 22 bp, Homo sapiens
tggaattattttgaatgtcaca

SEQ ID NO: 6481235 - DNA, 14 bp, Homo sapiens
tggaattcacaaag

SEQ ID NO: 6481236 - DNA, 21 bp, Homo sapiens
tggaattccaacttgaaggat

SEQ ID NO: 6481237 - DNA, 23 bp, Homo sapiens
tggaattccaacttgaaggattg

SEQ ID NO: 6481238 - DNA, 19 bp, Homo sapiens
tggaattccttggagccac

SEQ ID NO: 6481239 - DNA, 21 bp, Homo sapiens
tggaattctaaatgctggtct

SEQ ID NO: 6481240 - DNA, 20 bp, Homo sapiens
tggaattctactggaaaaaa

SEQ ID NO: 6481241 - DNA, 18 bp, Homo sapiens
tggaattctgcttctctt

SEQ ID NO: 6481242 - DNA, 18 bp, Homo sapiens
tggaattgaactctctgc

SEQ ID NO: 6481243 - DNA, 13 bp, Homo sapiens
tggaattgacatt

SEQ ID NO: 6481244 - DNA, 15 bp, Homo sapiens
tggaattgatgttta

SEQ ID NO: 6481245 - DNA, 15 bp, Homo sapiens
tggaattgatttgca

SEQ ID NO: 6481246 - DNA, 17 bp, Homo sapiens
tggaattgatttgcatt

SEQ ID NO: 6481247 - DNA, 22 bp, Homo sapiens
tggaattgatttgcattgaaca

SEQ ID NO: 6481248 - DNA, 23 bp, Homo sapiens
tggaattgatttgcattgaacac

SEQ ID NO: 6481249 - DNA, 22 bp, Homo sapiens
tggaattgccacataattcatt

SEQ ID NO: 6481250 - DNA, 16 bp, Homo sapiens
tggaattgctgctctc

SEQ ID NO: 6481251 - DNA, 16 bp, Homo sapiens
tggaattgcttaccaa

SEQ ID NO: 6481252 - DNA, 14 bp, Homo sapiens
tggaattggacata

SEQ ID NO: 6481253 - DNA, 17 bp, Homo sapiens
tggaattgggagcttgg

SEQ ID NO: 6481254 - DNA, 18 bp, Homo sapiens
tggaattggtgtatatca

SEQ ID NO: 6481255 - DNA, 19 bp, Homo sapiens
tggaattggtgtatatcat

SEQ ID NO: 6481256 - DNA, 13 bp, Homo sapiens
tggaattggttta

SEQ ID NO: 6481257 - DNA, 19 bp, Homo sapiens
tggaattggtttaaacttt

SEQ ID NO: 6481258 - DNA, 18 bp, Homo sapiens
tggaattgtgctccaaat

SEQ ID NO: 6481259 - DNA, 12 bp, Homo sapiens
tggaatttaaga

SEQ ID NO: 6481260 - DNA, 17 bp, Homo sapiens
tggaatttaatttatgt

SEQ ID NO: 6481261 - DNA, 20 bp, Homo sapiens
tggaatttaatttatgtgaa

SEQ ID NO: 6481262 - DNA, 18 bp, Homo sapiens
tggaatttataattcagt

SEQ ID NO: 6481263 - DNA, 20 bp, Homo sapiens
tggaatttataattcagtat

SEQ ID NO: 6481264 - DNA, 23 bp, Homo sapiens
tggaatttattggcagccaagga

SEQ ID NO: 6481265 - DNA, 22 bp, Homo sapiens
tggaatttctcccagtcattta

SEQ ID NO: 6481266 - DNA, 17 bp, Homo sapiens
tggaatttcttgtttct

SEQ ID NO: 6481267 - DNA, 22 bp, Homo sapiens
tggaatttgcaagtcatggctg

SEQ ID NO: 6481268 - DNA, 14 bp, Homo sapiens
tggaatttgcacca

SEQ ID NO: 6481269 - DNA, 15 bp, Homo sapiens
tggaatttgggcaga

SEQ ID NO: 6481270 - DNA, 16 bp, Homo sapiens
tggaatttgggcagat

SEQ ID NO: 6481271 - DNA, 16 bp, Homo sapiens
tggaatttgtaacctc

SEQ ID NO: 6481272 - DNA, 14 bp, Homo sapiens
tggaatttgtaagt

SEQ ID NO: 6481273 - DNA, 16 bp, Homo sapiens
tggaattttaagtctt

SEQ ID NO: 6481274 - DNA, 20 bp, Homo sapiens
tggaattttaagtctttcct

SEQ ID NO: 6481275 - DNA, 17 bp, Homo sapiens
tggaattttcctccttt

SEQ ID NO: 6481276 - DNA, 22 bp, Homo sapiens
tggaattttctaatataatgac

SEQ ID NO: 6481277 - DNA, 17 bp, Homo sapiens
tggaattttctgttcat

SEQ ID NO: 6481278 - DNA, 17 bp, Homo sapiens
tggaattttgagaaaaa

SEQ ID NO: 6481279 - DNA, 18 bp, Homo sapiens
tggaattttgagaaaaat

SEQ ID NO: 6481280 - DNA, 23 bp, Homo sapiens
tggaattttgcaaagatttaatc

SEQ ID NO: 6481281 - DNA, 20 bp, Homo sapiens
tggaattttgtaaaaagaaa

SEQ ID NO: 6481282 - DNA, 18 bp, Homo sapiens
tggaatttttattatgca

SEQ ID NO: 6481283 - DNA, 19 bp, Homo sapiens
tggaatttttattatgcat

SEQ ID NO: 6481284 - DNA, 13 bp, Homo sapiens
tggaatttttctg

SEQ ID NO: 6481285 - DNA, 20 bp, Homo sapiens
tggaattttttattcttgtg

SEQ ID NO: 6481286 - DNA, 21 bp, Homo sapiens
tggaattttttattcttgtga

SEQ ID NO: 6481287 - DNA, 15 bp, Homo sapiens
tggaattttttcctg

SEQ ID NO: 6481288 - DNA, 17 bp, Homo sapiens
tggaatttttttttcct

SEQ ID NO: 6481289 - DNA, 20 bp, Homo sapiens
tggacaaagaattccaaagc

SEQ ID NO: 6481290 - DNA, 14 bp, Homo sapiens
tggacaaaggcctg

SEQ ID NO: 6481291 - DNA, 15 bp, Homo sapiens
tggacaaatcacata

SEQ ID NO: 6481292 - DNA, 21 bp, Homo sapiens
tggacaaatcacatattttaa

SEQ ID NO: 6481293 - DNA, 22 bp, Homo sapiens
tggacaaatcacatattttaaa

SEQ ID NO: 6481294 - DNA, 13 bp, Homo sapiens
tggacaaatggac

SEQ ID NO: 6481295 - DNA, 13 bp, Homo sapiens
tggacaaatgtga

SEQ ID NO: 6481296 - DNA, 20 bp, Homo sapiens
tggacaaatgtgaagatgca

SEQ ID NO: 6481297 - DNA, 21 bp, Homo sapiens
tggacaaatgtgaagatgcat

SEQ ID NO: 6481298 - DNA, 14 bp, Homo sapiens
tggacaaatgttgt

SEQ ID NO: 6481299 - DNA, 23 bp, Homo sapiens
tggacaacactaattgtccacag

SEQ ID NO: 6481300 - DNA, 13 bp, Homo sapiens
tggacaacaggaa

SEQ ID NO: 6481301 - DNA, 11 bp, Homo sapiens
tggacaaccca

SEQ ID NO: 6481302 - DNA, 16 bp, Homo sapiens
tggacaacttatttaa

SEQ ID NO: 6481303 - DNA, 21 bp, Homo sapiens
tggacaacttatttaaaaata

SEQ ID NO: 6481304 - DNA, 22 bp, Homo sapiens
tggacaacttatttaaaaatat

SEQ ID NO: 6481305 - DNA, 13 bp, Homo sapiens
tggacaagaaagt

SEQ ID NO: 6481306 - DNA, 16 bp, Homo sapiens
tggacaagaagctgct

SEQ ID NO: 6481307 - DNA, 19 bp, Homo sapiens
tggacaagacatgcttggg

SEQ ID NO: 6481308 - DNA, 14 bp, Homo sapiens
tggacaagcagtgt

SEQ ID NO: 6481309 - DNA, 13 bp, Homo sapiens
tggacaaggaagg

SEQ ID NO: 6481310 - DNA, 14 bp, Homo sapiens
tggacaagtcatgg

SEQ ID NO: 6481311 - DNA, 16 bp, Homo sapiens
tggacaagtttcccaa

SEQ ID NO: 6481312 - DNA, 18 bp, Homo sapiens
tggacaatctcacacctt

SEQ ID NO: 6481313 - DNA, 21 bp, Homo sapiens
tggacaatcttatgtttccaa

SEQ ID NO: 6481314 - DNA, 20 bp, Homo sapiens
tggacaatttccaagaatga

SEQ ID NO: 6481315 - DNA, 17 bp, Homo sapiens
tggacacaaaaaaatgg

SEQ ID NO: 6481316 - DNA, 16 bp, Homo sapiens
tggacacaaacaggaa

SEQ ID NO: 6481317 - DNA, 21 bp, Homo sapiens
tggacacaaattttcaagttt

SEQ ID NO: 6481318 - DNA, 14 bp, Homo sapiens
tggacacacacagc

SEQ ID NO: 6481319 - DNA, 22 bp, Homo sapiens
tggacacacactcaccagtggc

SEQ ID NO: 6481320 - DNA, 21 bp, Homo sapiens
tggacacactgtaaacccctg

SEQ ID NO: 6481321 - DNA, 14 bp, Homo sapiens
tggacacagcccac

SEQ ID NO: 6481322 - DNA, 17 bp, Homo sapiens
tggacacagcccaccct

SEQ ID NO: 6481323 - DNA, 12 bp, Homo sapiens
tggacacagctc

SEQ ID NO: 6481324 - DNA, 13 bp, Homo sapiens
tggacacagctct

SEQ ID NO: 6481325 - DNA, 21 bp, Homo sapiens
tggacacagctcttctccagg

SEQ ID NO: 6481326 - DNA, 19 bp, Homo sapiens
tctttgtgcctttggcctg

SEQ ID NO: 6481327 - DNA, 15 bp, Homo sapiens
tctttgtggcagtgg

SEQ ID NO: 6481328 - DNA, 14 bp, Homo sapiens
tctttgtggcttcc

SEQ ID NO: 6481329 - DNA, 23 bp, Homo sapiens
tctttgtgggttggccaggaggt

SEQ ID NO: 6481330 - DNA, 19 bp, Homo sapiens
tctttgtggtctgtgtcac

SEQ ID NO: 6481331 - DNA, 20 bp, Homo sapiens
tctttgtggtttcaaatcag

SEQ ID NO: 6481332 - DNA, 15 bp, Homo sapiens
tctttgtgtaatcta

SEQ ID NO: 6481333 - DNA, 14 bp, Homo sapiens
tctttgtgtgctgt

SEQ ID NO: 6481334 - DNA, 23 bp, Homo sapiens
tctttgtgtttgcttggtgctgg

SEQ ID NO: 6481335 - DNA, 15 bp, Homo sapiens
tctttgttacaggca

SEQ ID NO: 6481336 - DNA, 17 bp, Homo sapiens
tctttgttacttcctta

SEQ ID NO: 6481337 - DNA, 16 bp, Homo sapiens
tctttgttcatagccc

SEQ ID NO: 6481338 - DNA, 12 bp, Homo sapiens
tctttgttctca

SEQ ID NO: 6481339 - DNA, 16 bp, Homo sapiens
tctttgttctcagctc

SEQ ID NO: 6481340 - DNA, 19 bp, Homo sapiens
tctttgttctcagctcccc

SEQ ID NO: 6481341 - DNA, 14 bp, Homo sapiens
tctttgttctccta

SEQ ID NO: 6481342 - DNA, 20 bp, Homo sapiens
tctttgttcttcaatgtgaa

SEQ ID NO: 6481343 - DNA, 21 bp, Homo sapiens
tctttgttcttcaatgtgaaa

SEQ ID NO: 6481344 - DNA, 12 bp, Homo sapiens
tctttgttgctt

SEQ ID NO: 6481345 - DNA, 15 bp, Homo sapiens
tctttgttgcttaat

SEQ ID NO: 6481346 - DNA, 18 bp, Homo sapiens
tctttgttggaaaagaat

SEQ ID NO: 6481347 - DNA, 13 bp, Homo sapiens
tctttgtttaaaa

SEQ ID NO: 6481348 - DNA, 16 bp, Homo sapiens
tctttgtttaaatgcc

SEQ ID NO: 6481349 - DNA, 19 bp, Homo sapiens
tctttgtttaacaaaagat

SEQ ID NO: 6481350 - DNA, 17 bp, Homo sapiens
tctttgtttacatgagt

SEQ ID NO: 6481351 - DNA, 19 bp, Homo sapiens
tctttgtttcctggcaata

SEQ ID NO: 6481352 - DNA, 18 bp, Homo sapiens
tctttgtttctttttaca

SEQ ID NO: 6481353 - DNA, 20 bp, Homo sapiens
tctttgtttctttttacagc

SEQ ID NO: 6481354 - DNA, 19 bp, Homo sapiens
tctttgttttattttaata

SEQ ID NO: 6481355 - DNA, 12 bp, Homo sapiens
tctttgttttgt

SEQ ID NO: 6481356 - DNA, 18 bp, Homo sapiens
tctttgttttgtgtctct

SEQ ID NO: 6481357 - DNA, 19 bp, Homo sapiens
tctttgttttgtgtctctt

SEQ ID NO: 6481358 - DNA, 20 bp, Homo sapiens
tctttgttttttgttttcat

SEQ ID NO: 6481359 - DNA, 14 bp, Homo sapiens
tcttttaaaaagta

SEQ ID NO: 6481360 - DNA, 16 bp, Homo sapiens
tcttttaaaaagtatt

SEQ ID NO: 6481361 - DNA, 17 bp, Homo sapiens
tcttttaaaagccccag

SEQ ID NO: 6481362 - DNA, 13 bp, Homo sapiens
tcttttaaaatat

SEQ ID NO: 6481363 - DNA, 12 bp, Homo sapiens
tcttttaaacat

SEQ ID NO: 6481364 - DNA, 12 bp, Homo sapiens
tcttttaaactc

SEQ ID NO: 6481365 - DNA, 22 bp, Homo sapiens
tcttttaaagaagtaaatttgt

SEQ ID NO: 6481366 - DNA, 23 bp, Homo sapiens
tcttttaaagaagtaaatttgtc

SEQ ID NO: 6481367 - DNA, 19 bp, Homo sapiens
tcttttaaagactacctgg

SEQ ID NO: 6481368 - DNA, 20 bp, Homo sapiens
tcttttaaagtatttataaa

SEQ ID NO: 6481369 - DNA, 22 bp, Homo sapiens
tcttttaaagttttatatgcat

SEQ ID NO: 6481370 - DNA, 17 bp, Homo sapiens
tcttttaaattagaaaa

SEQ ID NO: 6481371 - DNA, 14 bp, Homo sapiens
tcttttaaattgca

SEQ ID NO: 6481372 - DNA, 22 bp, Homo sapiens
tcttttaagatcttgttaaaga

SEQ ID NO: 6481373 - DNA, 12 bp, Homo sapiens
tcttttaagcag

SEQ ID NO: 6481374 - DNA, 19 bp, Homo sapiens
tcttttaagccctgctctt

SEQ ID NO: 6481375 - DNA, 21 bp, Homo sapiens
tcttttaaggtagaatcttgt

SEQ ID NO: 6481376 - DNA, 22 bp, Homo sapiens
tcttttaatccatttcaggact

SEQ ID NO: 6481377 - DNA, 16 bp, Homo sapiens
tcttttaattacagaa

SEQ ID NO: 6481378 - DNA, 20 bp, Homo sapiens
tcttttacatacagtgatat

SEQ ID NO: 6481379 - DNA, 14 bp, Homo sapiens
tcttttacattttt

SEQ ID NO: 6481380 - DNA, 18 bp, Homo sapiens
tcttttaccctgtgtcag

SEQ ID NO: 6481381 - DNA, 15 bp, Homo sapiens
tcttttacctgctgc

SEQ ID NO: 6481382 - DNA, 19 bp, Homo sapiens
tcttttactaagacatagt

SEQ ID NO: 6481383 - DNA, 17 bp, Homo sapiens
tcttttactatcttttc

SEQ ID NO: 6481384 - DNA, 14 bp, Homo sapiens
tcttttactgggtt

SEQ ID NO: 6481385 - DNA, 20 bp, Homo sapiens
tcttttactgtggaggtggc

SEQ ID NO: 6481386 - DNA, 18 bp, Homo sapiens
tcttttactgttatagaa

SEQ ID NO: 6481387 - DNA, 18 bp, Homo sapiens
tcttttagacaactagat

SEQ ID NO: 6481388 - DNA, 20 bp, Homo sapiens
tcttttagacaactagattt

SEQ ID NO: 6481389 - DNA, 16 bp, Homo sapiens
tcttttagagtaaact

SEQ ID NO: 6481390 - DNA, 17 bp, Homo sapiens
tcttttagctgatgaac

SEQ ID NO: 6481391 - DNA, 20 bp, Homo sapiens
tcttttagtcagaaatgatt

SEQ ID NO: 6481392 - DNA, 16 bp, Homo sapiens
tcttttagttccaaca

SEQ ID NO: 6481393 - DNA, 22 bp, Homo sapiens
tcttttataactagtcctttac

SEQ ID NO: 6481394 - DNA, 13 bp, Homo sapiens
tcttttataataa

SEQ ID NO: 6481395 - DNA, 13 bp, Homo sapiens
tcttttataattc

SEQ ID NO: 6481396 - DNA, 22 bp, Homo sapiens
tcttttataattctcattaaaa

SEQ ID NO: 6481397 - DNA, 14 bp, Homo sapiens
tcttttatagagca

SEQ ID NO: 6481398 - DNA, 15 bp, Homo sapiens
tcttttataggaaaa

SEQ ID NO: 6481399 - DNA, 14 bp, Homo sapiens
tcttttataggatt

SEQ ID NO: 6481400 - DNA, 21 bp, Homo sapiens
tcttttatagtggaaaaacac

SEQ ID NO: 6481401 - DNA, 12 bp, Homo sapiens
tcttttatataa

SEQ ID NO: 6481402 - DNA, 13 bp, Homo sapiens
tcttttatataac

SEQ ID NO: 6481403 - DNA, 19 bp, Homo sapiens
tcttttatataactacatt

SEQ ID NO: 6481404 - DNA, 14 bp, Homo sapiens
tcttttatatataa

SEQ ID NO: 6481405 - DNA, 16 bp, Homo sapiens
tcttttatatataaaa

SEQ ID NO: 6481406 - DNA, 22 bp, Homo sapiens
tcttttatatataaaataaata

SEQ ID NO: 6481407 - DNA, 23 bp, Homo sapiens
tcttttatatataaaataaatat

SEQ ID NO: 6481408 - DNA, 14 bp, Homo sapiens
tcttttatatctgt

SEQ ID NO: 6481409 - DNA, 17 bp, Homo sapiens
tcttttatatctgtaaa

SEQ ID NO: 6481410 - DNA, 17 bp, Homo sapiens
tcttttatcaactgtat

SEQ ID NO: 6481411 - DNA, 21 bp, Homo sapiens
tcttttatcattgcaggccag

SEQ ID NO: 6481412 - DNA, 14 bp, Homo sapiens
tcttttatctgttt

SEQ ID NO: 6481413 - DNA, 15 bp, Homo sapiens
tcttttatctgttta

SEQ ID NO: 6481414 - DNA, 15 bp, Homo sapiens
tcttttatgttcagc

SEQ ID NO: 6481415 - DNA, 13 bp, Homo sapiens
tcttttatgtttg

SEQ ID NO: 6481416 - DNA, 15 bp, Homo sapiens
tcttttatgtttgaa

SEQ ID NO: 6481417 - DNA, 16 bp, Homo sapiens
tcttttatgtttgaat

SEQ ID NO: 6481418 - DNA, 13 bp, Homo sapiens
tcttttattaata

SEQ ID NO: 6481419 - DNA, 13 bp, Homo sapiens
tcttttattctgt

SEQ ID NO: 6481420 - DNA, 13 bp, Homo sapiens
tcttttatttcat

SEQ ID NO: 6481421 - DNA, 12 bp, Homo sapiens
tcttttcaaaat

SEQ ID NO: 6481422 - DNA, 22 bp, Homo sapiens
tcttttcaaaattgttgcatcc

SEQ ID NO: 6481423 - DNA, 18 bp, Homo sapiens
tcttttcaattatttcaa

SEQ ID NO: 6481424 - DNA, 12 bp, Homo sapiens
tcttttcacaaa

SEQ ID NO: 6481425 - DNA, 13 bp, Homo sapiens
tcttttcacaaat

SEQ ID NO: 6481426 - DNA, 15 bp, Homo sapiens
tcttttcacaaataa

SEQ ID NO: 6481427 - DNA, 16 bp, Homo sapiens
tcttttcacagcaaca

SEQ ID NO: 6481428 - DNA, 18 bp, Homo sapiens
tcttttcacattcttata

SEQ ID NO: 6481429 - DNA, 21 bp, Homo sapiens
tcttttcagaagcaagccaga

SEQ ID NO: 6481430 - DNA, 13 bp, Homo sapiens
tcttttcatctca

SEQ ID NO: 6481431 - DNA, 16 bp, Homo sapiens
tcttttcattgaacag

SEQ ID NO: 6481432 - DNA, 12 bp, Homo sapiens
tcttttccaagc

SEQ ID NO: 6481433 - DNA, 23 bp, Homo sapiens
tcttttccacatggcagatgatt

SEQ ID NO: 6481434 - DNA, 16 bp, Homo sapiens
tcttttcccacattca

SEQ ID NO: 6481435 - DNA, 21 bp, Homo sapiens
tcttttcccatttacaaatga

SEQ ID NO: 6481436 - DNA, 19 bp, Homo sapiens
tcttttcccatttatctaa

SEQ ID NO: 6481437 - DNA, 18 bp, Homo sapiens
tcttttcccccaaagtgg

SEQ ID NO: 6481438 - DNA, 20 bp, Homo sapiens
tcttttccccgcctgcagtc

SEQ ID NO: 6481439 - DNA, 18 bp, Homo sapiens
tcttttcccctttcctgt

SEQ ID NO: 6481440 - DNA, 19 bp, Homo sapiens
tcttttccctcctttcctt

SEQ ID NO: 6481441 - DNA, 14 bp, Homo sapiens
tcttttcccttaaa

SEQ ID NO: 6481442 - DNA, 18 bp, Homo sapiens
tcttttcctaacatgcac

SEQ ID NO: 6481443 - DNA, 17 bp, Homo sapiens
tcttttcctagttttat

SEQ ID NO: 6481444 - DNA, 12 bp, Homo sapiens
tcttttcctcct

SEQ ID NO: 6481445 - DNA, 14 bp, Homo sapiens
tcttttcctcctcc

SEQ ID NO: 6481446 - DNA, 13 bp, Homo sapiens
tcttttcctcgct

SEQ ID NO: 6481447 - DNA, 15 bp, Homo sapiens
tcttttcctctagga

SEQ ID NO: 6481448 - DNA, 19 bp, Homo sapiens
tcttttcctgcttagaatt

SEQ ID NO: 6481449 - DNA, 15 bp, Homo sapiens
tcttttcctgttgta

SEQ ID NO: 6481450 - DNA, 22 bp, Homo sapiens
tcttttctaagtggcgtgtgca

SEQ ID NO: 6481451 - DNA, 17 bp, Homo sapiens
tcttttctaccctagcc

SEQ ID NO: 6481452 - DNA, 18 bp, Homo sapiens
tcttttctattttccctc

SEQ ID NO: 6481453 - DNA, 21 bp, Homo sapiens
tcttttctcccttttaatcct

SEQ ID NO: 6481454 - DNA, 13 bp, Homo sapiens
tcttttctctgtg

SEQ ID NO: 6481455 - DNA, 18 bp, Homo sapiens
tcttttctgaatcttctg

SEQ ID NO: 6481456 - DNA, 14 bp, Homo sapiens
tcttttctgaggtt

SEQ ID NO: 6481457 - DNA, 15 bp, Homo sapiens
tcttttctgaggttt

SEQ ID NO: 6481458 - DNA, 16 bp, Homo sapiens
tcttttctgtacttcc

SEQ ID NO: 6481459 - DNA, 21 bp, Homo sapiens
tcttttctgtttctgtttata

SEQ ID NO: 6481460 - DNA, 17 bp, Homo sapiens
tcttttcttcaacttga

SEQ ID NO: 6481461 - DNA, 15 bp, Homo sapiens
tcttttcttgatttt

SEQ ID NO: 6481462 - DNA, 16 bp, Homo sapiens
tcttttcttgcctctg

SEQ ID NO: 6481463 - DNA, 20 bp, Homo sapiens
tcttttcttgcctctgtccc

SEQ ID NO: 6481464 - DNA, 12 bp, Homo sapiens
tcttttctttaa

SEQ ID NO: 6481465 - DNA, 23 bp, Homo sapiens
tcttttctttagagcattgccat

SEQ ID NO: 6481466 - DNA, 13 bp, Homo sapiens
tcttttctttata

SEQ ID NO: 6481467 - DNA, 13 bp, Homo sapiens
tcttttctttctg

SEQ ID NO: 6481468 - DNA, 20 bp, Homo sapiens
tcttttctttgccatctctg

SEQ ID NO: 6481469 - DNA, 13 bp, Homo sapiens
tcttttcttttta

SEQ ID NO: 6481470 - DNA, 16 bp, Homo sapiens
tcttttctttttacat

SEQ ID NO: 6481471 - DNA, 15 bp, Homo sapiens
tcttttgaaacaata

SEQ ID NO: 6481472 - DNA, 23 bp, Homo sapiens
tcttttgaatattcccaagccca

SEQ ID NO: 6481473 - DNA, 23 bp, Homo sapiens
tcttttgaatcaatctggcttct

SEQ ID NO: 6481474 - DNA, 19 bp, Homo sapiens
tcttttgaatccatgcttg

SEQ ID NO: 6481475 - DNA, 20 bp, Homo sapiens
tcttttgaatccatgcttgg

SEQ ID NO: 6481476 - DNA, 16 bp, Homo sapiens
tcttttgaattcttga

SEQ ID NO: 6481477 - DNA, 17 bp, Homo sapiens
tcttttgaattgttaca

SEQ ID NO: 6481478 - DNA, 16 bp, Homo sapiens
tcttttgacaccttag

SEQ ID NO: 6481479 - DNA, 11 bp, Homo sapiens
tcttttgacct

SEQ ID NO: 6481480 - DNA, 21 bp, Homo sapiens
tcttttgaggctctctcataa

SEQ ID NO: 6481481 - DNA, 13 bp, Homo sapiens
tcttttgagggct

SEQ ID NO: 6481482 - DNA, 19 bp, Homo sapiens
tcttttgatagtatttata

SEQ ID NO: 6481483 - DNA, 17 bp, Homo sapiens
tcttttgatcacattgt

SEQ ID NO: 6481484 - DNA, 14 bp, Homo sapiens
tcttttgattttgt

SEQ ID NO: 6481485 - DNA, 13 bp, Homo sapiens
tcttttgcaattg

SEQ ID NO: 6481486 - DNA, 13 bp, Homo sapiens
tcttttgccatga

SEQ ID NO: 6481487 - DNA, 13 bp, Homo sapiens
tcttttgctgtgc

SEQ ID NO: 6481488 - DNA, 11 bp, Homo sapiens
tcttttggaaa

SEQ ID NO: 6481489 - DNA, 16 bp, Homo sapiens
tcttttggaaataatt

SEQ ID NO: 6481490 - DNA, 21 bp, Homo sapiens
tcttttggaggacgtacgtaa

SEQ ID NO: 6481491 - DNA, 14 bp, Homo sapiens
tcttttggccttgt

SEQ ID NO: 6481492 - DNA, 18 bp, Homo sapiens
tcttttggctttgaaact

SEQ ID NO: 6481493 - DNA, 17 bp, Homo sapiens
tcttttgggggaaactt

SEQ ID NO: 6481494 - DNA, 23 bp, Homo sapiens
tcttttgtaaagagaccatcttc

SEQ ID NO: 6481495 - DNA, 14 bp, Homo sapiens
tcttttgtaaatga

SEQ ID NO: 6481496 - DNA, 17 bp, Homo sapiens
tcttttgtaaatgagac

SEQ ID NO: 6481497 - DNA, 13 bp, Homo sapiens
tcttttgtaagtg

SEQ ID NO: 6481498 - DNA, 19 bp, Homo sapiens
tcttttgtaataaactatt

SEQ ID NO: 6481499 - DNA, 15 bp, Homo sapiens
tcttttgtatgtaaa

SEQ ID NO: 6481500 - DNA, 17 bp, Homo sapiens
tcttttgtatgtaaatg

SEQ ID NO: 6481501 - DNA, 22 bp, Homo sapiens
tcttttgtatgtaaatgtgcat

SEQ ID NO: 6481502 - DNA, 12 bp, Homo sapiens
tcttttgtatta

SEQ ID NO: 6481503 - DNA, 17 bp, Homo sapiens
tcttttgtattgtttct

SEQ ID NO: 6481504 - DNA, 21 bp, Homo sapiens
tcttttgtcctgcatcatctt

SEQ ID NO: 6481505 - DNA, 14 bp, Homo sapiens
tcttttgtctccca

SEQ ID NO: 6481506 - DNA, 14 bp, Homo sapiens
tcttttgtgatgaa

SEQ ID NO: 6481507 - DNA, 17 bp, Homo sapiens
tggacacagtgttccag

SEQ ID NO: 6481508 - DNA, 16 bp, Homo sapiens
tggacacattggaatg

SEQ ID NO: 6481509 - DNA, 20 bp, Homo sapiens
tggacacattggaatgcctt

SEQ ID NO: 6481510 - DNA, 20 bp, Homo sapiens
tggacaccactgagctctgc

SEQ ID NO: 6481511 - DNA, 20 bp, Homo sapiens
tggacaccaggagtccctgg

SEQ ID NO: 6481512 - DNA, 17 bp, Homo sapiens
tggacaccccagacctg

SEQ ID NO: 6481513 - DNA, 12 bp, Homo sapiens
tggacaccccca

SEQ ID NO: 6481514 - DNA, 16 bp, Homo sapiens
tggacacccccagctg

SEQ ID NO: 6481515 - DNA, 13 bp, Homo sapiens
tggacacccctgc

SEQ ID NO: 6481516 - DNA, 15 bp, Homo sapiens
tggacaccggaaaca

SEQ ID NO: 6481517 - DNA, 14 bp, Homo sapiens
tggacacctacagc

SEQ ID NO: 6481518 - DNA, 16 bp, Homo sapiens
tggacacctacagcag

SEQ ID NO: 6481519 - DNA, 20 bp, Homo sapiens
tggacacctacagcagcacg

SEQ ID NO: 6481520 - DNA, 16 bp, Homo sapiens
tggacacctcccaggg

SEQ ID NO: 6481521 - DNA, 18 bp, Homo sapiens
tggacacctcccagggga

SEQ ID NO: 6481522 - DNA, 19 bp, Homo sapiens
tggacacctcccaggggac

SEQ ID NO: 6481523 - DNA, 11 bp, Homo sapiens
tggacacctgc

SEQ ID NO: 6481524 - DNA, 18 bp, Homo sapiens
tggacacctgccctgccc

SEQ ID NO: 6481525 - DNA, 22 bp, Homo sapiens
tggacacgcgtgattgaccctt

SEQ ID NO: 6481526 - DNA, 17 bp, Homo sapiens
tggacactcagaccagc

SEQ ID NO: 6481527 - DNA, 14 bp, Homo sapiens
tggacactccaggg

SEQ ID NO: 6481528 - DNA, 16 bp, Homo sapiens
tggacactccagggac

SEQ ID NO: 6481529 - DNA, 19 bp, Homo sapiens
tggacactccagggacaca

SEQ ID NO: 6481530 - DNA, 22 bp, Homo sapiens
tggacactccagggacacacag

SEQ ID NO: 6481531 - DNA, 23 bp, Homo sapiens
tggacactccagggacacacagc

SEQ ID NO: 6481532 - DNA, 14 bp, Homo sapiens
tggacactgtacaa

SEQ ID NO: 6481533 - DNA, 13 bp, Homo sapiens
tggacacttaatt

SEQ ID NO: 6481534 - DNA, 17 bp, Homo sapiens
tggacacttaattctgt

SEQ ID NO: 6481535 - DNA, 18 bp, Homo sapiens
tggacacttaattctgtt

SEQ ID NO: 6481536 - DNA, 13 bp, Homo sapiens
tggacacttcttt

SEQ ID NO: 6481537 - DNA, 20 bp, Homo sapiens
tggacactttgaaatgtgtt

SEQ ID NO: 6481538 - DNA, 23 bp, Homo sapiens
tggacactttgaaatgtgtttct

SEQ ID NO: 6481539 - DNA, 12 bp, Homo sapiens
tggacagaagaa

SEQ ID NO: 6481540 - DNA, 17 bp, Homo sapiens
tggacagaagcagctct

SEQ ID NO: 6481541 - DNA, 19 bp, Homo sapiens
tggacagaatgtgtctcag

SEQ ID NO: 6481542 - DNA, 15 bp, Homo sapiens
tggacagacacagag

SEQ ID NO: 6481543 - DNA, 12 bp, Homo sapiens
tggacagacacc

SEQ ID NO: 6481544 - DNA, 20 bp, Homo sapiens
tggacagacactgttgcaaa

SEQ ID NO: 6481545 - DNA, 17 bp, Homo sapiens
tggacagacccaggtct

SEQ ID NO: 6481546 - DNA, 22 bp, Homo sapiens
tggacagacccaggtcttccag

SEQ ID NO: 6481547 - DNA, 23 bp, Homo sapiens
tggacagacccaggtcttccaga

SEQ ID NO: 6481548 - DNA, 15 bp, Homo sapiens
tggacagagaagggc

SEQ ID NO: 6481549 - DNA, 14 bp, Homo sapiens
tggacagagactca

SEQ ID NO: 6481550 - DNA, 17 bp, Homo sapiens
tggacagagactcagcg

SEQ ID NO: 6481551 - DNA, 19 bp, Homo sapiens
tggacagagcgcccctccc

SEQ ID NO: 6481552 - DNA, 18 bp, Homo sapiens
tggacagaggcggggcta

SEQ ID NO: 6481553 - DNA, 15 bp, Homo sapiens
tggacagagggagaa

SEQ ID NO: 6481554 - DNA, 13 bp, Homo sapiens
tggacagagggga

SEQ ID NO: 6481555 - DNA, 14 bp, Homo sapiens
tggacagaggggac

SEQ ID NO: 6481556 - DNA, 18 bp, Homo sapiens
tggacagatagacagtgc

SEQ ID NO: 6481557 - DNA, 16 bp, Homo sapiens
tggacagatggacgca

SEQ ID NO: 6481558 - DNA, 22 bp, Homo sapiens
tggacagatggacgcaggccct

SEQ ID NO: 6481559 - DNA, 14 bp, Homo sapiens
tggacagatggccc

SEQ ID NO: 6481560 - DNA, 21 bp, Homo sapiens
tggacagatggcccaagggat

SEQ ID NO: 6481561 - DNA, 24 bp, Homo sapiens
tggacagatggcccaagggatggc

SEQ ID NO: 6481562 - DNA, 18 bp, Homo sapiens
tggacagatgggtgtccc

SEQ ID NO: 6481563 - DNA, 22 bp, Homo sapiens
tggacagatgggtgtcccctgg

SEQ ID NO: 6481564 - DNA, 21 bp, Homo sapiens
tggacagattgcctgtttctg

SEQ ID NO: 6481565 - DNA, 22 bp, Homo sapiens
tggacagattgcctgtttctga

SEQ ID NO: 6481566 - DNA, 22 bp, Homo sapiens
tggacagatttcagtaatgtct

SEQ ID NO: 6481567 - DNA, 20 bp, Homo sapiens
tggacagcaaaaccattgct

SEQ ID NO: 6481568 - DNA, 14 bp, Homo sapiens
tggacagcagaagc

SEQ ID NO: 6481569 - DNA, 16 bp, Homo sapiens
tggacagcagctggac

SEQ ID NO: 6481570 - DNA, 14 bp, Homo sapiens
tggacagccagggc

SEQ ID NO: 6481571 - DNA, 14 bp, Homo sapiens
tggacagccccacc

SEQ ID NO: 6481572 - DNA, 13 bp, Homo sapiens
tggacagcccggg

SEQ ID NO: 6481573 - DNA, 14 bp, Homo sapiens
tggacagcccggga

SEQ ID NO: 6481574 - DNA, 13 bp, Homo sapiens
tggacagccggag

SEQ ID NO: 6481575 - DNA, 21 bp, Homo sapiens
tggacagcctcttctgtccca

SEQ ID NO: 6481576 - DNA, 19 bp, Homo sapiens
tggacagcgatgaggggac

SEQ ID NO: 6481577 - DNA, 21 bp, Homo sapiens
tggacagcggcagtgggcctg

SEQ ID NO: 6481578 - DNA, 13 bp, Homo sapiens
tggacagctgagc

SEQ ID NO: 6481579 - DNA, 13 bp, Homo sapiens
tggacagctgtgc

SEQ ID NO: 6481580 - DNA, 15 bp, Homo sapiens
tggacagctttattt

SEQ ID NO: 6481581 - DNA, 23 bp, Homo sapiens
tggacagctttattttaaatgtg

SEQ ID NO: 6481582 - DNA, 23 bp, Homo sapiens
tggacaggactaacactcagaag

SEQ ID NO: 6481583 - DNA, 19 bp, Homo sapiens
tggacaggatgaggacaga

SEQ ID NO: 6481584 - DNA, 21 bp, Homo sapiens
tggacaggatgaggacagagg

SEQ ID NO: 6481585 - DNA, 13 bp, Homo sapiens
tggacaggatgtg

SEQ ID NO: 6481586 - DNA, 12 bp, Homo sapiens
tggacaggcagc

SEQ ID NO: 6481587 - DNA, 16 bp, Homo sapiens
tggacaggcagcctcc

SEQ ID NO: 6481588 - DNA, 13 bp, Homo sapiens
tggacaggcccag

SEQ ID NO: 6481589 - DNA, 14 bp, Homo sapiens
tggacaggcccagc

SEQ ID NO: 6481590 - DNA, 15 bp, Homo sapiens
tggacaggcccagcg

SEQ ID NO: 6481591 - DNA, 14 bp, Homo sapiens
tggacaggctggct

SEQ ID NO: 6481592 - DNA, 13 bp, Homo sapiens
tggacaggtctgg

SEQ ID NO: 6481593 - DNA, 14 bp, Homo sapiens
tggacaggtctggg

SEQ ID NO: 6481594 - DNA, 16 bp, Homo sapiens
tggacaggtctgggag

SEQ ID NO: 6481595 - DNA, 15 bp, Homo sapiens
tggacagtaagattt

SEQ ID NO: 6481596 - DNA, 12 bp, Homo sapiens
tggacagtcctg

SEQ ID NO: 6481597 - DNA, 16 bp, Homo sapiens
tggacagtcctgggag

SEQ ID NO: 6481598 - DNA, 14 bp, Homo sapiens
tggacagtctccct

SEQ ID NO: 6481599 - DNA, 21 bp, Homo sapiens
tggacagtctttgatcatcat

SEQ ID NO: 6481600 - DNA, 22 bp, Homo sapiens
tggacagtctttgatcatcatg

SEQ ID NO: 6481601 - DNA, 16 bp, Homo sapiens
tggacagtgcctaact

SEQ ID NO: 6481602 - DNA, 13 bp, Homo sapiens
tggacagtggcct

SEQ ID NO: 6481603 - DNA, 22 bp, Homo sapiens
tggacagtgggcatcagcagca

SEQ ID NO: 6481604 - DNA, 18 bp, Homo sapiens
tggacagttcacaccctg

SEQ ID NO: 6481605 - DNA, 20 bp, Homo sapiens
tggacagttcacaccctgca

SEQ ID NO: 6481606 - DNA, 16 bp, Homo sapiens
tggacagtttgtttcc

SEQ ID NO: 6481607 - DNA, 15 bp, Homo sapiens
tggacatactgctgg

SEQ ID NO: 6481608 - DNA, 16 bp, Homo sapiens
tggacatatgtatact

SEQ ID NO: 6481609 - DNA, 21 bp, Homo sapiens
tggacatcacagcagaatgaa

SEQ ID NO: 6481610 - DNA, 22 bp, Homo sapiens
tggacatcacagcagaatgaag

SEQ ID NO: 6481611 - DNA, 15 bp, Homo sapiens
tggacatcagtgttt

SEQ ID NO: 6481612 - DNA, 21 bp, Homo sapiens
tggacatcagtgtttgttgga

SEQ ID NO: 6481613 - DNA, 18 bp, Homo sapiens
tggacatcctcctcccac

SEQ ID NO: 6481614 - DNA, 18 bp, Homo sapiens
tggacatcctcttctgct

SEQ ID NO: 6481615 - DNA, 15 bp, Homo sapiens
tggacatcgatatga

SEQ ID NO: 6481616 - DNA, 21 bp, Homo sapiens
tggacatcgtaggcagccacg

SEQ ID NO: 6481617 - DNA, 15 bp, Homo sapiens
tggacatctctctgg

SEQ ID NO: 6481618 - DNA, 17 bp, Homo sapiens
tggacatctctctggct

SEQ ID NO: 6481619 - DNA, 18 bp, Homo sapiens
tggacatctctctggctt

SEQ ID NO: 6481620 - DNA, 20 bp, Homo sapiens
tggacatctctctggcttct

SEQ ID NO: 6481621 - DNA, 21 bp, Homo sapiens
tggacatctctctggcttctg

SEQ ID NO: 6481622 - DNA, 18 bp, Homo sapiens
tggacatgaagattcttt

SEQ ID NO: 6481623 - DNA, 21 bp, Homo sapiens
tggacatgaagattctttccc

SEQ ID NO: 6481624 - DNA, 18 bp, Homo sapiens
tggacatgagagtagggc

SEQ ID NO: 6481625 - DNA, 16 bp, Homo sapiens
tggacatgagataatg

SEQ ID NO: 6481626 - DNA, 14 bp, Homo sapiens
tggacatgcacccg

SEQ ID NO: 6481627 - DNA, 22 bp, Homo sapiens
tggacatgcacccgcatgtaca

SEQ ID NO: 6481628 - DNA, 17 bp, Homo sapiens
tggacatgcataaaaat

SEQ ID NO: 6481629 - DNA, 20 bp, Homo sapiens
tggacatgcataaaaattaa

SEQ ID NO: 6481630 - DNA, 21 bp, Homo sapiens
tggacatgcataaaaattaaa

SEQ ID NO: 6481631 - DNA, 15 bp, Homo sapiens
tggacatgcctgtcc

SEQ ID NO: 6481632 - DNA, 15 bp, Homo sapiens
tggacatgggcagca

SEQ ID NO: 6481633 - DNA, 16 bp, Homo sapiens
tggacatgggcagcaa

SEQ ID NO: 6481634 - DNA, 15 bp, Homo sapiens
tggacatggtcacag

SEQ ID NO: 6481635 - DNA, 18 bp, Homo sapiens
tggacatgtaaaaagaca

SEQ ID NO: 6481636 - DNA, 13 bp, Homo sapiens
tggacatgtgggt

SEQ ID NO: 6481637 - DNA, 23 bp, Homo sapiens
tggacatgtgggtggagaaggga

SEQ ID NO: 6481638 - DNA, 15 bp, Homo sapiens
tggacattcagaaca

SEQ ID NO: 6481639 - DNA, 16 bp, Homo sapiens
tggacattctctttga

SEQ ID NO: 6481640 - DNA, 19 bp, Homo sapiens
tggacattctctttgataa

SEQ ID NO: 6481641 - DNA, 15 bp, Homo sapiens
tggacattgtctgcg

SEQ ID NO: 6481642 - DNA, 15 bp, Homo sapiens
tggacatttatgtac

SEQ ID NO: 6481643 - DNA, 22 bp, Homo sapiens
tggacatttgccttgctggacg

SEQ ID NO: 6481644 - DNA, 21 bp, Homo sapiens
tggacatttgggttggttcca

SEQ ID NO: 6481645 - DNA, 17 bp, Homo sapiens
tggacattttatgtctt

SEQ ID NO: 6481646 - DNA, 24 bp, Homo sapiens
tggacattttcttttattatcagt

SEQ ID NO: 6481647 - DNA, 17 bp, Homo sapiens
tggacattttttcagtc

SEQ ID NO: 6481648 - DNA, 22 bp, Homo sapiens
tggaccaaaaaaataaagcatt

SEQ ID NO: 6481649 - DNA, 17 bp, Homo sapiens
tggaccaaaaaccagta

SEQ ID NO: 6481650 - DNA, 12 bp, Homo sapiens
tggaccaaagcc

SEQ ID NO: 6481651 - DNA, 15 bp, Homo sapiens
tggaccaaagccacc

SEQ ID NO: 6481652 - DNA, 18 bp, Homo sapiens
tggaccaaagccacctgc

SEQ ID NO: 6481653 - DNA, 22 bp, Homo sapiens
tggaccaaagccacctgctgcg

SEQ ID NO: 6481654 - DNA, 13 bp, Homo sapiens
tggaccaaagctg

SEQ ID NO: 6481655 - DNA, 13 bp, Homo sapiens
tggaccaaatgtg

SEQ ID NO: 6481656 - DNA, 21 bp, Homo sapiens
tggaccaacctgctctgtccc

SEQ ID NO: 6481657 - DNA, 17 bp, Homo sapiens
tggaccaagcacaaaaa

SEQ ID NO: 6481658 - DNA, 18 bp, Homo sapiens
tggaccaaggtgaagcaa

SEQ ID NO: 6481659 - DNA, 20 bp, Homo sapiens
tggaccaatagggctgagct

SEQ ID NO: 6481660 - DNA, 20 bp, Homo sapiens
tggaccacagcatgaacctt

SEQ ID NO: 6481661 - DNA, 13 bp, Homo sapiens
tggaccacaggca

SEQ ID NO: 6481662 - DNA, 14 bp, Homo sapiens
tggaccacagtgac

SEQ ID NO: 6481663 - DNA, 17 bp, Homo sapiens
tggaccaccagccccag

SEQ ID NO: 6481664 - DNA, 21 bp, Homo sapiens
tggaccaccagccccagcaag

SEQ ID NO: 6481665 - DNA, 23 bp, Homo sapiens
tggaccacccgccctggcagttg

SEQ ID NO: 6481666 - DNA, 23 bp, Homo sapiens
tggaccacgccgccctccatccg

SEQ ID NO: 6481667 - DNA, 18 bp, Homo sapiens
tggaccactcctcatagc

SEQ ID NO: 6481668 - DNA, 15 bp, Homo sapiens
tggaccactgggcaa

SEQ ID NO: 6481669 - DNA, 12 bp, Homo sapiens
tggaccagagga

SEQ ID NO: 6481670 - DNA, 13 bp, Homo sapiens
tggaccagcctcc

SEQ ID NO: 6481671 - DNA, 19 bp, Homo sapiens
tggaccaggacaggaccag

SEQ ID NO: 6481672 - DNA, 21 bp, Homo sapiens
tggaccaggaggattgccttt

SEQ ID NO: 6481673 - DNA, 16 bp, Homo sapiens
tggaccaggcctggag

SEQ ID NO: 6481674 - DNA, 18 bp, Homo sapiens
tggaccaggcctggaggg

SEQ ID NO: 6481675 - DNA, 12 bp, Homo sapiens
tggaccaggtcc

SEQ ID NO: 6481676 - DNA, 17 bp, Homo sapiens
tggaccaggtcctgctc

SEQ ID NO: 6481677 - DNA, 13 bp, Homo sapiens
tggaccagtggtc

SEQ ID NO: 6481678 - DNA, 24 bp, Homo sapiens
tggaccagttccctcagccctcat

SEQ ID NO: 6481679 - DNA, 17 bp, Homo sapiens
tggaccatccaaattta

SEQ ID NO: 6481680 - DNA, 14 bp, Homo sapiens
tggaccatctctgt

SEQ ID NO: 6481681 - DNA, 15 bp, Homo sapiens
tggaccatgccagat

SEQ ID NO: 6481682 - DNA, 16 bp, Homo sapiens
tggaccatgccagatt

SEQ ID NO: 6481683 - DNA, 13 bp, Homo sapiens
tggaccatgctga

SEQ ID NO: 6481684 - DNA, 14 bp, Homo sapiens
tggaccatgctgag

SEQ ID NO: 6481685 - DNA, 23 bp, Homo sapiens
tggaccatgctgagacatccctc

SEQ ID NO: 6481686 - DNA, 18 bp, Homo sapiens
tcttttgtggacttgtct

SEQ ID NO: 6481687 - DNA, 22 bp, Homo sapiens
tcttttgtgtcctgctctgttt

SEQ ID NO: 6481688 - DNA, 22 bp, Homo sapiens
tcttttgttaaataatatggct

SEQ ID NO: 6481689 - DNA, 14 bp, Homo sapiens
tcttttgttactgt

SEQ ID NO: 6481690 - DNA, 15 bp, Homo sapiens
tcttttgttactgtt

SEQ ID NO: 6481691 - DNA, 18 bp, Homo sapiens
tcttttgttactgttctt

SEQ ID NO: 6481692 - DNA, 19 bp, Homo sapiens
tcttttgttactgttcttg

SEQ ID NO: 6481693 - DNA, 23 bp, Homo sapiens
tcttttgttactgttcttgctgc

SEQ ID NO: 6481694 - DNA, 15 bp, Homo sapiens
tcttttgttctctga

SEQ ID NO: 6481695 - DNA, 23 bp, Homo sapiens
tcttttgttctctgaattttcag

SEQ ID NO: 6481696 - DNA, 13 bp, Homo sapiens
tcttttgtttcca

SEQ ID NO: 6481697 - DNA, 16 bp, Homo sapiens
tcttttgtttggtaaa

SEQ ID NO: 6481698 - DNA, 23 bp, Homo sapiens
tcttttgttttggtttggttttg

SEQ ID NO: 6481699 - DNA, 16 bp, Homo sapiens
tctttttaaaaactct

SEQ ID NO: 6481700 - DNA, 18 bp, Homo sapiens
tctttttaaaaagttgca

SEQ ID NO: 6481701 - DNA, 15 bp, Homo sapiens
tctttttaaaaatga

SEQ ID NO: 6481702 - DNA, 23 bp, Homo sapiens
tctttttaaagtgtttctgttat

SEQ ID NO: 6481703 - DNA, 14 bp, Homo sapiens
tctttttaaatgtg

SEQ ID NO: 6481704 - DNA, 14 bp, Homo sapiens
tctttttaaatttt

SEQ ID NO: 6481705 - DNA, 14 bp, Homo sapiens
tctttttaagctta

SEQ ID NO: 6481706 - DNA, 15 bp, Homo sapiens
tctttttaaggacac

SEQ ID NO: 6481707 - DNA, 15 bp, Homo sapiens
tctttttaagtaatg

SEQ ID NO: 6481708 - DNA, 15 bp, Homo sapiens
tctttttaagttaat

SEQ ID NO: 6481709 - DNA, 16 bp, Homo sapiens
tctttttactgttgaa

SEQ ID NO: 6481710 - DNA, 18 bp, Homo sapiens
tctttttacttggaaata

SEQ ID NO: 6481711 - DNA, 13 bp, Homo sapiens
tctttttagattg

SEQ ID NO: 6481712 - DNA, 12 bp, Homo sapiens
tctttttagttt

SEQ ID NO: 6481713 - DNA, 14 bp, Homo sapiens
tctttttatacaca

SEQ ID NO: 6481714 - DNA, 16 bp, Homo sapiens
tctttttatactatta

SEQ ID NO: 6481715 - DNA, 14 bp, Homo sapiens
tctttttatcgcca

SEQ ID NO: 6481716 - DNA, 21 bp, Homo sapiens
tctttttattaggttaagtct

SEQ ID NO: 6481717 - DNA, 12 bp, Homo sapiens
tctttttattca

SEQ ID NO: 6481718 - DNA, 13 bp, Homo sapiens
tctttttattgaa

SEQ ID NO: 6481719 - DNA, 20 bp, Homo sapiens
tctttttatttctgatagtt

SEQ ID NO: 6481720 - DNA, 14 bp, Homo sapiens
tctttttcaaaaat

SEQ ID NO: 6481721 - DNA, 17 bp, Homo sapiens
tctttttcaaaactagt

SEQ ID NO: 6481722 - DNA, 12 bp, Homo sapiens
tctttttccaaa

SEQ ID NO: 6481723 - DNA, 17 bp, Homo sapiens
tctttttccagcttgag

SEQ ID NO: 6481724 - DNA, 12 bp, Homo sapiens
tctttttccagt

SEQ ID NO: 6481725 - DNA, 13 bp, Homo sapiens
tctttttcctact

SEQ ID NO: 6481726 - DNA, 14 bp, Homo sapiens
tctttttcctatga

SEQ ID NO: 6481727 - DNA, 14 bp, Homo sapiens
tctttttcctgaaa

SEQ ID NO: 6481728 - DNA, 13 bp, Homo sapiens
tctttttccttct

SEQ ID NO: 6481729 - DNA, 16 bp, Homo sapiens
tctttttcctttataa

SEQ ID NO: 6481730 - DNA, 20 bp, Homo sapiens
tctttttctacatgtgagat

SEQ ID NO: 6481731 - DNA, 15 bp, Homo sapiens
tctttttctagactt

SEQ ID NO: 6481732 - DNA, 18 bp, Homo sapiens
tctttttctctgtatatt

SEQ ID NO: 6481733 - DNA, 16 bp, Homo sapiens
tctttttctcttctgt

SEQ ID NO: 6481734 - DNA, 11 bp, Homo sapiens
tctttttctga

SEQ ID NO: 6481735 - DNA, 20 bp, Homo sapiens
tctttttctgaactccattt

SEQ ID NO: 6481736 - DNA, 15 bp, Homo sapiens
tctttttctggaaat

SEQ ID NO: 6481737 - DNA, 17 bp, Homo sapiens
tctttttctgttgtaac

SEQ ID NO: 6481738 - DNA, 23 bp, Homo sapiens
tctttttcttaccagtctcctcc

SEQ ID NO: 6481739 - DNA, 15 bp, Homo sapiens
tctttttcttcttcc

SEQ ID NO: 6481740 - DNA, 12 bp, Homo sapiens
tctttttcttgg

SEQ ID NO: 6481741 - DNA, 15 bp, Homo sapiens
tctttttcttttcta

SEQ ID NO: 6481742 - DNA, 14 bp, Homo sapiens
tctttttgaagtgt

SEQ ID NO: 6481743 - DNA, 21 bp, Homo sapiens
tctttttgaccctcattcttt

SEQ ID NO: 6481744 - DNA, 14 bp, Homo sapiens
tctttttgactgat

SEQ ID NO: 6481745 - DNA, 14 bp, Homo sapiens
tctttttgattttt

SEQ ID NO: 6481746 - DNA, 15 bp, Homo sapiens
tctttttgattttta

SEQ ID NO: 6481747 - DNA, 17 bp, Homo sapiens
tctttttgctctaaaat

SEQ ID NO: 6481748 - DNA, 14 bp, Homo sapiens
tctttttgcttcta

SEQ ID NO: 6481749 - DNA, 18 bp, Homo sapiens
tctttttgtgtgtgccaa

SEQ ID NO: 6481750 - DNA, 17 bp, Homo sapiens
tctttttgtttcactgg

SEQ ID NO: 6481751 - DNA, 20 bp, Homo sapiens
tcttttttaaatgtttcttg

SEQ ID NO: 6481752 - DNA, 14 bp, Homo sapiens
tcttttttactcat

SEQ ID NO: 6481753 - DNA, 16 bp, Homo sapiens
tcttttttagcataaa

SEQ ID NO: 6481754 - DNA, 17 bp, Homo sapiens
tcttttttagctctctt

SEQ ID NO: 6481755 - DNA, 17 bp, Homo sapiens
tcttttttagtgttaaa

SEQ ID NO: 6481756 - DNA, 22 bp, Homo sapiens
tcttttttatgttaaaaagaaa

SEQ ID NO: 6481757 - DNA, 16 bp, Homo sapiens
tcttttttattaccag

SEQ ID NO: 6481758 - DNA, 16 bp, Homo sapiens
tcttttttcaaaagaa

SEQ ID NO: 6481759 - DNA, 13 bp, Homo sapiens
tcttttttcaatg

SEQ ID NO: 6481760 - DNA, 12 bp, Homo sapiens
tcttttttcagt

SEQ ID NO: 6481761 - DNA, 23 bp, Homo sapiens
tcttttttcatggacactttgaa

SEQ ID NO: 6481762 - DNA, 23 bp, Homo sapiens
tcttttttcatttcttcctcagc

SEQ ID NO: 6481763 - DNA, 18 bp, Homo sapiens
tcttttttcggctaaaaa

SEQ ID NO: 6481764 - DNA, 20 bp, Homo sapiens
tcttttttcggctaaaaaga

SEQ ID NO: 6481765 - DNA, 21 bp, Homo sapiens
tcttttttctaaagtaaaaac

SEQ ID NO: 6481766 - DNA, 22 bp, Homo sapiens
tcttttttctaaagtaaaaaca

SEQ ID NO: 6481767 - DNA, 12 bp, Homo sapiens
tcttttttctct

SEQ ID NO: 6481768 - DNA, 16 bp, Homo sapiens
tcttttttctgggtct

SEQ ID NO: 6481769 - DNA, 15 bp, Homo sapiens
tcttttttcttttgg

SEQ ID NO: 6481770 - DNA, 16 bp, Homo sapiens
tcttttttgagacagg

SEQ ID NO: 6481771 - DNA, 20 bp, Homo sapiens
tcttttttgatatgataata

SEQ ID NO: 6481772 - DNA, 21 bp, Homo sapiens
tcttttttggccatctgctcc

SEQ ID NO: 6481773 - DNA, 22 bp, Homo sapiens
tcttttttggccatctgctcct

SEQ ID NO: 6481774 - DNA, 15 bp, Homo sapiens
tcttttttgtacagt

SEQ ID NO: 6481775 - DNA, 21 bp, Homo sapiens
tctttttttaaaaataaatct

SEQ ID NO: 6481776 - DNA, 15 bp, Homo sapiens
tctttttttaaattg

SEQ ID NO: 6481777 - DNA, 16 bp, Homo sapiens
tctttttttagggaga

SEQ ID NO: 6481778 - DNA, 19 bp, Homo sapiens
tctttttttagggagaagg

SEQ ID NO: 6481779 - DNA, 17 bp, Homo sapiens
tctttttttattaaaca

SEQ ID NO: 6481780 - DNA, 17 bp, Homo sapiens
tctttttttccttcctt

SEQ ID NO: 6481781 - DNA, 20 bp, Homo sapiens
tctttttttctgtcagtaaa

SEQ ID NO: 6481782 - DNA, 16 bp, Homo sapiens
tctttttttcttttct

SEQ ID NO: 6481783 - DNA, 19 bp, Homo sapiens
tctttttttgagtgacagc

SEQ ID NO: 6481784 - DNA, 20 bp, Homo sapiens
tctttttttgagtgacagct

SEQ ID NO: 6481785 - DNA, 14 bp, Homo sapiens
tctttttttgcata

SEQ ID NO: 6481786 - DNA, 16 bp, Homo sapiens
tctttttttgctgttc

SEQ ID NO: 6481787 - DNA, 21 bp, Homo sapiens
tctttttttgctgttccacca

SEQ ID NO: 6481788 - DNA, 17 bp, Homo sapiens
tctttttttggtaaatt

SEQ ID NO: 6481789 - DNA, 17 bp, Homo sapiens
tctttttttgtatagtt

SEQ ID NO: 6481790 - DNA, 18 bp, Homo sapiens
tctttttttgtatagtta

SEQ ID NO: 6481791 - DNA, 15 bp, Homo sapiens
tcttttttttaatgt

SEQ ID NO: 6481792 - DNA, 20 bp, Homo sapiens
tcttttttttaatgtgctgt

SEQ ID NO: 6481793 - DNA, 20 bp, Homo sapiens
tcttttttttaatgtttctg

SEQ ID NO: 6481794 - DNA, 19 bp, Homo sapiens
tcttttttttattccacat

SEQ ID NO: 6481795 - DNA, 16 bp, Homo sapiens
tcttttttttcctttg

SEQ ID NO: 6481796 - DNA, 15 bp, Homo sapiens
tctttttttttaagt

SEQ ID NO: 6481797 - DNA, 13 bp, Homo sapiens
tctttttttttcc

SEQ ID NO: 6481798 - DNA, 17 bp, Homo sapiens
tctttttttttcttcat

SEQ ID NO: 6481799 - DNA, 21 bp, Homo sapiens
tctttttttttctttttccag

SEQ ID NO: 6481800 - DNA, 17 bp, Homo sapiens
tcttttttttttccaaa

SEQ ID NO: 6481801 - DNA, 20 bp, Homo sapiens
tcttttttttttctgttgaa

SEQ ID NO: 6481802 - DNA, 23 bp, Homo sapiens
tctttttttttttttaaagacag

SEQ ID NO: 6481803 - DNA, 22 bp, Homo sapiens
tctttttttttttttttgaaag

SEQ ID NO: 6481804 - DNA, 21 bp, Homo sapiens
tcttttttttttttttttaga

SEQ ID NO: 6481805 - DNA, 20 bp, Homo sapiens
tgaaaaaaaaaaaaatccca

SEQ ID NO: 6481806 - DNA, 17 bp, Homo sapiens
tgaaaaaaaaaaaagaa

SEQ ID NO: 6481807 - DNA, 16 bp, Homo sapiens
tgaaaaaaaaaaacaa

SEQ ID NO: 6481808 - DNA, 22 bp, Homo sapiens
tgaaaaaaaaaaacaatatctg

SEQ ID NO: 6481809 - DNA, 20 bp, Homo sapiens
tgaaaaaaaaaaacacaaaa

SEQ ID NO: 6481810 - DNA, 23 bp, Homo sapiens
tgaaaaaaaaaaacacaaaaaaa

SEQ ID NO: 6481811 - DNA, 20 bp, Homo sapiens
tgaaaaaaaaaaagaagaag

SEQ ID NO: 6481812 - DNA, 21 bp, Homo sapiens
tgaaaaaaaaaaagaagaaga

SEQ ID NO: 6481813 - DNA, 17 bp, Homo sapiens
tgaaaaaaaaaatgttg

SEQ ID NO: 6481814 - DNA, 22 bp, Homo sapiens
tgaaaaaaaaaggggggtggga

SEQ ID NO: 6481815 - DNA, 19 bp, Homo sapiens
tgaaaaaaaatagatgttt

SEQ ID NO: 6481816 - DNA, 23 bp, Homo sapiens
tgaaaaaaaatttgttttcaaca

SEQ ID NO: 6481817 - DNA, 15 bp, Homo sapiens
tgaaaaaaacttcat

SEQ ID NO: 6481818 - DNA, 12 bp, Homo sapiens
tgaaaaaaagaa

SEQ ID NO: 6481819 - DNA, 14 bp, Homo sapiens
tgaaaaaaagaaac

SEQ ID NO: 6481820 - DNA, 18 bp, Homo sapiens
tgaaaaaaagcatggtat

SEQ ID NO: 6481821 - DNA, 18 bp, Homo sapiens
tgaaaaaaagggaaaaca

SEQ ID NO: 6481822 - DNA, 23 bp, Homo sapiens
tgaaaaaaagggaaaacaaatat

SEQ ID NO: 6481823 - DNA, 14 bp, Homo sapiens
tgaaaaaaagtgct

SEQ ID NO: 6481824 - DNA, 23 bp, Homo sapiens
tgaaaaaaagtttctatttagtt

SEQ ID NO: 6481825 - DNA, 14 bp, Homo sapiens
tgaaaaaaatgaaa

SEQ ID NO: 6481826 - DNA, 14 bp, Homo sapiens
tgaaaaaaatggag

SEQ ID NO: 6481827 - DNA, 12 bp, Homo sapiens
tgaaaaaaattg

SEQ ID NO: 6481828 - DNA, 15 bp, Homo sapiens
tgaaaaaaattgaaa

SEQ ID NO: 6481829 - DNA, 21 bp, Homo sapiens
tgaaaaaactttctctttgcc

SEQ ID NO: 6481830 - DNA, 14 bp, Homo sapiens
tgaaaaaagagaaa

SEQ ID NO: 6481831 - DNA, 19 bp, Homo sapiens
tgaaaaaagcttttatgag

SEQ ID NO: 6481832 - DNA, 21 bp, Homo sapiens
tgaaaaaaggacaatttcaaa

SEQ ID NO: 6481833 - DNA, 22 bp, Homo sapiens
tgaaaaaagtataggataaatt

SEQ ID NO: 6481834 - DNA, 13 bp, Homo sapiens
tgaaaaaatatat

SEQ ID NO: 6481835 - DNA, 16 bp, Homo sapiens
tgaaaaaatgctgagc

SEQ ID NO: 6481836 - DNA, 21 bp, Homo sapiens
tgaaaaaatgttctatatgca

SEQ ID NO: 6481837 - DNA, 14 bp, Homo sapiens
tgaaaaaattaaaa

SEQ ID NO: 6481838 - DNA, 20 bp, Homo sapiens
tgaaaaaatttaaaagtaaa

SEQ ID NO: 6481839 - DNA, 11 bp, Homo sapiens
tgaaaaacaaa

SEQ ID NO: 6481840 - DNA, 17 bp, Homo sapiens
tgaaaaacaaaaagcta

SEQ ID NO: 6481841 - DNA, 19 bp, Homo sapiens
tgaaaaacacggcagctgt

SEQ ID NO: 6481842 - DNA, 15 bp, Homo sapiens
tgaaaaactaatgtg

SEQ ID NO: 6481843 - DNA, 23 bp, Homo sapiens
tgaaaaactagtaatactgtctt

SEQ ID NO: 6481844 - DNA, 12 bp, Homo sapiens
tgaaaaactgat

SEQ ID NO: 6481845 - DNA, 21 bp, Homo sapiens
tgaaaaactgatcaaaaataa

SEQ ID NO: 6481846 - DNA, 22 bp, Homo sapiens
tgaaaaactgatcaaaaataaa

SEQ ID NO: 6481847 - DNA, 12 bp, Homo sapiens
tgaaaaactgct

SEQ ID NO: 6481848 - DNA, 12 bp, Homo sapiens
tgaaaaacttcc

SEQ ID NO: 6481849 - DNA, 12 bp, Homo sapiens
tgaaaaactttt

SEQ ID NO: 6481850 - DNA, 18 bp, Homo sapiens
tgaaaaagaaaaaaatga

SEQ ID NO: 6481851 - DNA, 18 bp, Homo sapiens
tgaaaaagaaactgaata

SEQ ID NO: 6481852 - DNA, 23 bp, Homo sapiens
tgaaaaagaataaaaacttttga

SEQ ID NO: 6481853 - DNA, 15 bp, Homo sapiens
tgaaaaagaatgaaa

SEQ ID NO: 6481854 - DNA, 12 bp, Homo sapiens
tgaaaaagacat

SEQ ID NO: 6481855 - DNA, 15 bp, Homo sapiens
tgaaaaagagaaaaa

SEQ ID NO: 6481856 - DNA, 21 bp, Homo sapiens
tgaaaaagagaacagaaaaca

SEQ ID NO: 6481857 - DNA, 23 bp, Homo sapiens
tgaaaaagagaacagaaaacaac

SEQ ID NO: 6481858 - DNA, 14 bp, Homo sapiens
tgaaaaagatggct

SEQ ID NO: 6481859 - DNA, 15 bp, Homo sapiens
tgaaaaagcatgtac

SEQ ID NO: 6481860 - DNA, 16 bp, Homo sapiens
tgaaaaagcatgtaca

SEQ ID NO: 6481861 - DNA, 20 bp, Homo sapiens
tgaaaaagcctaagaaaaag

SEQ ID NO: 6481862 - DNA, 20 bp, Homo sapiens
tgaaaaagctggattttctt

SEQ ID NO: 6481863 - DNA, 18 bp, Homo sapiens
tgaaaaaggaaaaatatt

SEQ ID NO: 6481864 - DNA, 19 bp, Homo sapiens
tgaaaaaggaaatattctt

SEQ ID NO: 6481865 - DNA, 20 bp, Homo sapiens
tgaaaaaggaataaattgtt

SEQ ID NO: 6481866 - DNA, 22 bp, Homo sapiens
tggacccacctgtggggcctgg

SEQ ID NO: 6481867 - DNA, 21 bp, Homo sapiens
tggacccactacccttctcct

SEQ ID NO: 6481868 - DNA, 14 bp, Homo sapiens
tggacccagcaggg

SEQ ID NO: 6481869 - DNA, 17 bp, Homo sapiens
tggacccagccaggccc

SEQ ID NO: 6481870 - DNA, 21 bp, Homo sapiens
tggacccagccaggcccagcc

SEQ ID NO: 6481871 - DNA, 13 bp, Homo sapiens
tggacccagggcc

SEQ ID NO: 6481872 - DNA, 15 bp, Homo sapiens
tggacccagggcctg

SEQ ID NO: 6481873 - DNA, 14 bp, Homo sapiens
tggaccccactggc

SEQ ID NO: 6481874 - DNA, 15 bp, Homo sapiens
tggaccccactggct

SEQ ID NO: 6481875 - DNA, 15 bp, Homo sapiens
tggaccccagccttg

SEQ ID NO: 6481876 - DNA, 15 bp, Homo sapiens
tggaccccagctggg

SEQ ID NO: 6481877 - DNA, 16 bp, Homo sapiens
tggaccccatctgtga

SEQ ID NO: 6481878 - DNA, 20 bp, Homo sapiens
tggaccccatctgtgaataa

SEQ ID NO: 6481879 - DNA, 15 bp, Homo sapiens
tggacccccaccctg

SEQ ID NO: 6481880 - DNA, 23 bp, Homo sapiens
tggacccccagcccccagggccc

SEQ ID NO: 6481881 - DNA, 16 bp, Homo sapiens
tggaccccgcctccca

SEQ ID NO: 6481882 - DNA, 19 bp, Homo sapiens
tggaccccgcctcccagcc

SEQ ID NO: 6481883 - DNA, 12 bp, Homo sapiens
tggacccctgca

SEQ ID NO: 6481884 - DNA, 13 bp, Homo sapiens
tggacccctgggg

SEQ ID NO: 6481885 - DNA, 23 bp, Homo sapiens
tggacccctggggtggccagggc

SEQ ID NO: 6481886 - DNA, 17 bp, Homo sapiens
tggaccctcgcagcagg

SEQ ID NO: 6481887 - DNA, 17 bp, Homo sapiens
tggaccctgaaatgtgt

SEQ ID NO: 6481888 - DNA, 20 bp, Homo sapiens
tggaccctgaccagctcccc

SEQ ID NO: 6481889 - DNA, 23 bp, Homo sapiens
tggaccctgaccagctccccctc

SEQ ID NO: 6481890 - DNA, 12 bp, Homo sapiens
tggaccctgagg

SEQ ID NO: 6481891 - DNA, 15 bp, Homo sapiens
tggaccctgaggccc

SEQ ID NO: 6481892 - DNA, 19 bp, Homo sapiens
tggaccctgtggccaggtg

SEQ ID NO: 6481893 - DNA, 13 bp, Homo sapiens
tggaccctgttgc

SEQ ID NO: 6481894 - DNA, 16 bp, Homo sapiens
tggacccttataaaat

SEQ ID NO: 6481895 - DNA, 18 bp, Homo sapiens
tggaccgaaatctgtatt

SEQ ID NO: 6481896 - DNA, 16 bp, Homo sapiens
tggaccgagatgtgag

SEQ ID NO: 6481897 - DNA, 13 bp, Homo sapiens
tggaccgagtaga

SEQ ID NO: 6481898 - DNA, 18 bp, Homo sapiens
tggaccgcaggagggcag

SEQ ID NO: 6481899 - DNA, 19 bp, Homo sapiens
tggaccgcccttttcccct

SEQ ID NO: 6481900 - DNA, 17 bp, Homo sapiens
tggaccgcttcccagag

SEQ ID NO: 6481901 - DNA, 16 bp, Homo sapiens
tggaccggccgcagcc

SEQ ID NO: 6481902 - DNA, 19 bp, Homo sapiens
tggaccggccgcagccccc

SEQ ID NO: 6481903 - DNA, 20 bp, Homo sapiens
tggaccggggccttggtccc

SEQ ID NO: 6481904 - DNA, 22 bp, Homo sapiens
tggaccgggtgggcctggcctg

SEQ ID NO: 6481905 - DNA, 16 bp, Homo sapiens
tggaccgtggacaggc

SEQ ID NO: 6481906 - DNA, 19 bp, Homo sapiens
tggaccgtggacaggccca

SEQ ID NO: 6481907 - DNA, 17 bp, Homo sapiens
tggacctaaatggcctc

SEQ ID NO: 6481908 - DNA, 18 bp, Homo sapiens
tggacctaaatggcctca

SEQ ID NO: 6481909 - DNA, 13 bp, Homo sapiens
tggacctaacatt

SEQ ID NO: 6481910 - DNA, 14 bp, Homo sapiens
tggacctaatccaa

SEQ ID NO: 6481911 - DNA, 16 bp, Homo sapiens
tggacctagcctggat

SEQ ID NO: 6481912 - DNA, 12 bp, Homo sapiens
tggacctagctt

SEQ ID NO: 6481913 - DNA, 20 bp, Homo sapiens
tggacctatgacaggctgaa

SEQ ID NO: 6481914 - DNA, 20 bp, Homo sapiens
tggacctatgcagggaggcc

SEQ ID NO: 6481915 - DNA, 22 bp, Homo sapiens
tggacctatgcagggaggccac

SEQ ID NO: 6481916 - DNA, 19 bp, Homo sapiens
tggacctatgtcctaagga

SEQ ID NO: 6481917 - DNA, 19 bp, Homo sapiens
tggacctcagcaagctgcc

SEQ ID NO: 6481918 - DNA, 19 bp, Homo sapiens
tggacctcaggagggcagg

SEQ ID NO: 6481919 - DNA, 20 bp, Homo sapiens
tggacctcaggagggcaggc

SEQ ID NO: 6481920 - DNA, 21 bp, Homo sapiens
tggacctcaggagggcaggct

SEQ ID NO: 6481921 - DNA, 22 bp, Homo sapiens
tggacctcaggttcctaagact

SEQ ID NO: 6481922 - DNA, 18 bp, Homo sapiens
tggacctccaggctccag

SEQ ID NO: 6481923 - DNA, 17 bp, Homo sapiens
tggacctccaggggctc

SEQ ID NO: 6481924 - DNA, 20 bp, Homo sapiens
tggacctccaggggctcctg

SEQ ID NO: 6481925 - DNA, 19 bp, Homo sapiens
tggacctctcagcagaaac

SEQ ID NO: 6481926 - DNA, 13 bp, Homo sapiens
tggacctctgaca

SEQ ID NO: 6481927 - DNA, 17 bp, Homo sapiens
tggacctctgacagcag

SEQ ID NO: 6481928 - DNA, 18 bp, Homo sapiens
tggacctctgacagcagc

SEQ ID NO: 6481929 - DNA, 22 bp, Homo sapiens
tggacctctgacagcagcatct

SEQ ID NO: 6481930 - DNA, 15 bp, Homo sapiens
tggacctctgctctg

SEQ ID NO: 6481931 - DNA, 16 bp, Homo sapiens
tggacctctgctctga

SEQ ID NO: 6481932 - DNA, 18 bp, Homo sapiens
tggacctctgcttcccca

SEQ ID NO: 6481933 - DNA, 13 bp, Homo sapiens
tggacctgaagga

SEQ ID NO: 6481934 - DNA, 14 bp, Homo sapiens
tggacctgaccaga

SEQ ID NO: 6481935 - DNA, 14 bp, Homo sapiens
tggacctgcagttg

SEQ ID NO: 6481936 - DNA, 19 bp, Homo sapiens
tggacctgcagttggcctc

SEQ ID NO: 6481937 - DNA, 22 bp, Homo sapiens
tggacctgcagttggcctcagc

SEQ ID NO: 6481938 - DNA, 18 bp, Homo sapiens
tggacctgccccggacct

SEQ ID NO: 6481939 - DNA, 14 bp, Homo sapiens
tggacctgcctgca

SEQ ID NO: 6481940 - DNA, 15 bp, Homo sapiens
tggacctgcctgcat

SEQ ID NO: 6481941 - DNA, 19 bp, Homo sapiens
tggacctgctgacatagtg

SEQ ID NO: 6481942 - DNA, 12 bp, Homo sapiens
tggacctggcag

SEQ ID NO: 6481943 - DNA, 15 bp, Homo sapiens
tggacctggcccagt

SEQ ID NO: 6481944 - DNA, 13 bp, Homo sapiens
tggacctgggaca

SEQ ID NO: 6481945 - DNA, 19 bp, Homo sapiens
tggacctggggtcccccct

SEQ ID NO: 6481946 - DNA, 21 bp, Homo sapiens
tggacctggggtcccccctcc

SEQ ID NO: 6481947 - DNA, 17 bp, Homo sapiens
tggacctgggttattta

SEQ ID NO: 6481948 - DNA, 20 bp, Homo sapiens
tggacctgggttatttattg

SEQ ID NO: 6481949 - DNA, 16 bp, Homo sapiens
tggacctggtgcccct

SEQ ID NO: 6481950 - DNA, 19 bp, Homo sapiens
tggaccttaggccttcctc

SEQ ID NO: 6481951 - DNA, 17 bp, Homo sapiens
tggaccttctctccaga

SEQ ID NO: 6481952 - DNA, 21 bp, Homo sapiens
tggacctttgggttctttctg

SEQ ID NO: 6481953 - DNA, 15 bp, Homo sapiens
tggaccttttaaagt

SEQ ID NO: 6481954 - DNA, 16 bp, Homo sapiens
tggaccttttgtctca

SEQ ID NO: 6481955 - DNA, 24 bp, Homo sapiens
tggacgacacggtcggggcatctg

SEQ ID NO: 6481956 - DNA, 23 bp, Homo sapiens
tggacgagtgagctaccaggaag

SEQ ID NO: 6481957 - DNA, 16 bp, Homo sapiens
tggacgcaccggcctg

SEQ ID NO: 6481958 - DNA, 18 bp, Homo sapiens
tggacgcaggccctgtcc

SEQ ID NO: 6481959 - DNA, 23 bp, Homo sapiens
tggacgcattttggtttttcctc

SEQ ID NO: 6481960 - DNA, 12 bp, Homo sapiens
tggacgcctggc

SEQ ID NO: 6481961 - DNA, 17 bp, Homo sapiens
tggacgcctggctccag

SEQ ID NO: 6481962 - DNA, 19 bp, Homo sapiens
tggacgctgcagaccccag

SEQ ID NO: 6481963 - DNA, 16 bp, Homo sapiens
tggacgctgccgggag

SEQ ID NO: 6481964 - DNA, 19 bp, Homo sapiens
tggacgctgtccattgcca

SEQ ID NO: 6481965 - DNA, 14 bp, Homo sapiens
tggacggagagcct

SEQ ID NO: 6481966 - DNA, 17 bp, Homo sapiens
tggacggagagccttgg

SEQ ID NO: 6481967 - DNA, 18 bp, Homo sapiens
tggacggcaggctcactg

SEQ ID NO: 6481968 - DNA, 19 bp, Homo sapiens
tggacggcgctgcctcagg

SEQ ID NO: 6481969 - DNA, 22 bp, Homo sapiens
tggacgggatgacctccagaag

SEQ ID NO: 6481970 - DNA, 18 bp, Homo sapiens
tggacggggacacggcct

SEQ ID NO: 6481971 - DNA, 21 bp, Homo sapiens
tggacggggtcggacggggca

SEQ ID NO: 6481972 - DNA, 17 bp, Homo sapiens
tggacggtgctccaggc

SEQ ID NO: 6481973 - DNA, 22 bp, Homo sapiens
tggacggtgctccaggcaggct

SEQ ID NO: 6481974 - DNA, 17 bp, Homo sapiens
tggacggtttctagcct

SEQ ID NO: 6481975 - DNA, 20 bp, Homo sapiens
tggacggtttctagcctctg

SEQ ID NO: 6481976 - DNA, 14 bp, Homo sapiens
tggacgtagagttg

SEQ ID NO: 6481977 - DNA, 19 bp, Homo sapiens
tggacgtcacgctccctga

SEQ ID NO: 6481978 - DNA, 20 bp, Homo sapiens
tggacgtgcactgacagcct

SEQ ID NO: 6481979 - DNA, 16 bp, Homo sapiens
tggacgttaggccagg

SEQ ID NO: 6481980 - DNA, 17 bp, Homo sapiens
tggacgttaggccaggc

SEQ ID NO: 6481981 - DNA, 23 bp, Homo sapiens
tggactaaaggcatccttgtctt

SEQ ID NO: 6481982 - DNA, 14 bp, Homo sapiens
tggactaaatgcct

SEQ ID NO: 6481983 - DNA, 16 bp, Homo sapiens
tggactaaatgcctag

SEQ ID NO: 6481984 - DNA, 16 bp, Homo sapiens
tggactaagatgaaat

SEQ ID NO: 6481985 - DNA, 19 bp, Homo sapiens
tggactaattgacttgcaa

SEQ ID NO: 6481986 - DNA, 14 bp, Homo sapiens
tggactacaaaata

SEQ ID NO: 6481987 - DNA, 17 bp, Homo sapiens
tggactacaaaatacaa

SEQ ID NO: 6481988 - DNA, 15 bp, Homo sapiens
tggactacacaatac

SEQ ID NO: 6481989 - DNA, 20 bp, Homo sapiens
tggactacacaatacagtat

SEQ ID NO: 6481990 - DNA, 14 bp, Homo sapiens
tggactacaggaca

SEQ ID NO: 6481991 - DNA, 16 bp, Homo sapiens
tggactacctataaat

SEQ ID NO: 6481992 - DNA, 17 bp, Homo sapiens
tggactagggcctcgga

SEQ ID NO: 6481993 - DNA, 18 bp, Homo sapiens
tggactatattgggactg

SEQ ID NO: 6481994 - DNA, 15 bp, Homo sapiens
tggactattgtgcca

SEQ ID NO: 6481995 - DNA, 18 bp, Homo sapiens
tggactcacctcccccat

SEQ ID NO: 6481996 - DNA, 18 bp, Homo sapiens
tggactcagaaactccat

SEQ ID NO: 6481997 - DNA, 12 bp, Homo sapiens
tggactcagaga

SEQ ID NO: 6481998 - DNA, 13 bp, Homo sapiens
tggactcagccca

SEQ ID NO: 6481999 - DNA, 15 bp, Homo sapiens
tggactcagcccacc

SEQ ID NO: 6482000 - DNA, 16 bp, Homo sapiens
tggactcagctctgtc

SEQ ID NO: 6482001 - DNA, 18 bp, Homo sapiens
tggactcagctctgtctg

SEQ ID NO: 6482002 - DNA, 14 bp, Homo sapiens
tggactcaggatcc

SEQ ID NO: 6482003 - DNA, 14 bp, Homo sapiens
tggactcagggcag

SEQ ID NO: 6482004 - DNA, 14 bp, Homo sapiens
tggactccagcctg

SEQ ID NO: 6482005 - DNA, 22 bp, Homo sapiens
tggactccagcctgcctggcag

SEQ ID NO: 6482006 - DNA, 22 bp, Homo sapiens
tggactccaggatcctcctgga

SEQ ID NO: 6482007 - DNA, 20 bp, Homo sapiens
tggactccaggcctgaccag

SEQ ID NO: 6482008 - DNA, 21 bp, Homo sapiens
tggactccaggcctgaccagg

SEQ ID NO: 6482009 - DNA, 20 bp, Homo sapiens
tggactcccactctttgaat

SEQ ID NO: 6482010 - DNA, 19 bp, Homo sapiens
tggactccctccccacccc

SEQ ID NO: 6482011 - DNA, 18 bp, Homo sapiens
tggactccggaggactga

SEQ ID NO: 6482012 - DNA, 19 bp, Homo sapiens
tggactccggaggactgag

SEQ ID NO: 6482013 - DNA, 23 bp, Homo sapiens
tggactccggaggactgagcccc

SEQ ID NO: 6482014 - DNA, 16 bp, Homo sapiens
tggactcctcccacaa

SEQ ID NO: 6482015 - DNA, 14 bp, Homo sapiens
tggactcctgacca

SEQ ID NO: 6482016 - DNA, 19 bp, Homo sapiens
tggactcgcgttcccaaag

SEQ ID NO: 6482017 - DNA, 20 bp, Homo sapiens
tggactcgtaaagctgctag

SEQ ID NO: 6482018 - DNA, 17 bp, Homo sapiens
tggactctaaagaccaa

SEQ ID NO: 6482019 - DNA, 22 bp, Homo sapiens
tggactctcagtctctgagcag

SEQ ID NO: 6482020 - DNA, 15 bp, Homo sapiens
tggactctcccctct

SEQ ID NO: 6482021 - DNA, 16 bp, Homo sapiens
tggactctcccctctt

SEQ ID NO: 6482022 - DNA, 21 bp, Homo sapiens
tggactctcctagtgactggg

SEQ ID NO: 6482023 - DNA, 14 bp, Homo sapiens
tggactctctgaca

SEQ ID NO: 6482024 - DNA, 15 bp, Homo sapiens
tggactctctgacaa

SEQ ID NO: 6482025 - DNA, 14 bp, Homo sapiens
tggactctctgtgg

SEQ ID NO: 6482026 - DNA, 15 bp, Homo sapiens
tggactctctgtggt

SEQ ID NO: 6482027 - DNA, 17 bp, Homo sapiens
tggactctctgtggtcc

SEQ ID NO: 6482028 - DNA, 13 bp, Homo sapiens
tggactctgcaca

SEQ ID NO: 6482029 - DNA, 14 bp, Homo sapiens
tggactctgcatcc

SEQ ID NO: 6482030 - DNA, 18 bp, Homo sapiens
tggactctggactgggaa

SEQ ID NO: 6482031 - DNA, 12 bp, Homo sapiens
tggactctggga

SEQ ID NO: 6482032 - DNA, 21 bp, Homo sapiens
tggactctggtgcctccagag

SEQ ID NO: 6482033 - DNA, 17 bp, Homo sapiens
tggactctgtcctgaag

SEQ ID NO: 6482034 - DNA, 16 bp, Homo sapiens
tggactctgtgctcac

SEQ ID NO: 6482035 - DNA, 15 bp, Homo sapiens
tggactcttctcggc

SEQ ID NO: 6482036 - DNA, 21 bp, Homo sapiens
tggactcttctcggctcaggc

SEQ ID NO: 6482037 - DNA, 19 bp, Homo sapiens
tggactctttggtggcttt

SEQ ID NO: 6482038 - DNA, 15 bp, Homo sapiens
tggactgaagcctgc

SEQ ID NO: 6482039 - DNA, 18 bp, Homo sapiens
tggactgaagcctgcagg

SEQ ID NO: 6482040 - DNA, 22 bp, Homo sapiens
tggactgacagcatgtgccctc

SEQ ID NO: 6482041 - DNA, 13 bp, Homo sapiens
tggactgaccaaa

SEQ ID NO: 6482042 - DNA, 18 bp, Homo sapiens
tggactgaccaaagactg

SEQ ID NO: 6482043 - DNA, 19 bp, Homo sapiens
tggactgaccaaagactgc

SEQ ID NO: 6482044 - DNA, 19 bp, Homo sapiens
tggactgaccacaccaacc

SEQ ID NO: 6482045 - DNA, 15 bp, Homo sapiens
tgaaaaaggtgatta

SEQ ID NO: 6482046 - DNA, 19 bp, Homo sapiens
tgaaaaagtgtttttacat

SEQ ID NO: 6482047 - DNA, 20 bp, Homo sapiens
tgaaaaagttccatagaaaa

SEQ ID NO: 6482048 - DNA, 15 bp, Homo sapiens
tgaaaaataaaaacc

SEQ ID NO: 6482049 - DNA, 18 bp, Homo sapiens
tgaaaaataacggtgctt

SEQ ID NO: 6482050 - DNA, 12 bp, Homo sapiens
tgaaaaatacag

SEQ ID NO: 6482051 - DNA, 23 bp, Homo sapiens
tgaaaaatacgttttgtgtatat

SEQ ID NO: 6482052 - DNA, 23 bp, Homo sapiens
tgaaaaatactttaattcatgaa

SEQ ID NO: 6482053 - DNA, 13 bp, Homo sapiens
tgaaaaatataaa

SEQ ID NO: 6482054 - DNA, 20 bp, Homo sapiens
tgaaaaatatgtgcttgaaa

SEQ ID NO: 6482055 - DNA, 20 bp, Homo sapiens
tgaaaaatattcatgtagat

SEQ ID NO: 6482056 - DNA, 20 bp, Homo sapiens
tgaaaaatattccaagcttc

SEQ ID NO: 6482057 - DNA, 17 bp, Homo sapiens
tgaaaaatattgctaaa

SEQ ID NO: 6482058 - DNA, 23 bp, Homo sapiens
tgaaaaatattgctaaaagtgca

SEQ ID NO: 6482059 - DNA, 21 bp, Homo sapiens
tgaaaaatcacttgattcata

SEQ ID NO: 6482060 - DNA, 11 bp, Homo sapiens
tgaaaaatcag

SEQ ID NO: 6482061 - DNA, 22 bp, Homo sapiens
tgaaaaatctcattatttctgg

SEQ ID NO: 6482062 - DNA, 14 bp, Homo sapiens
tgaaaaatctgaat

SEQ ID NO: 6482063 - DNA, 15 bp, Homo sapiens
tgaaaaatctgaatt

SEQ ID NO: 6482064 - DNA, 20 bp, Homo sapiens
tgaaaaatctgctgttaact

SEQ ID NO: 6482065 - DNA, 11 bp, Homo sapiens
tgaaaaatctt

SEQ ID NO: 6482066 - DNA, 16 bp, Homo sapiens
tgaaaaatgaaagatg

SEQ ID NO: 6482067 - DNA, 17 bp, Homo sapiens
tgaaaaatgaaagatga

SEQ ID NO: 6482068 - DNA, 14 bp, Homo sapiens
tgaaaaatgaatgt

SEQ ID NO: 6482069 - DNA, 19 bp, Homo sapiens
tgaaaaatgcctgctgctg

SEQ ID NO: 6482070 - DNA, 19 bp, Homo sapiens
tgaaaaatgggcacttaaa

SEQ ID NO: 6482071 - DNA, 14 bp, Homo sapiens
tgaaaaatggtccc

SEQ ID NO: 6482072 - DNA, 14 bp, Homo sapiens
tgaaaaatgtaaat

SEQ ID NO: 6482073 - DNA, 21 bp, Homo sapiens
tgaaaaatgtcactatatctt

SEQ ID NO: 6482074 - DNA, 20 bp, Homo sapiens
tgaaaaatgtgcaaaacagc

SEQ ID NO: 6482075 - DNA, 23 bp, Homo sapiens
tgaaaaattacctgtataatgga

SEQ ID NO: 6482076 - DNA, 17 bp, Homo sapiens
tgaaaaattatcagtta

SEQ ID NO: 6482077 - DNA, 22 bp, Homo sapiens
tgaaaaattcctattgtgattt

SEQ ID NO: 6482078 - DNA, 13 bp, Homo sapiens
tgaaaaattctca

SEQ ID NO: 6482079 - DNA, 16 bp, Homo sapiens
tgaaaaattgctgact

SEQ ID NO: 6482080 - DNA, 22 bp, Homo sapiens
tgaaaaattgctgactgtagct

SEQ ID NO: 6482081 - DNA, 20 bp, Homo sapiens
tgaaaaatttaagcattgtt

SEQ ID NO: 6482082 - DNA, 13 bp, Homo sapiens
tgaaaacaaacaa

SEQ ID NO: 6482083 - DNA, 20 bp, Homo sapiens
tgaaaacaaacaaatcaaac

SEQ ID NO: 6482084 - DNA, 14 bp, Homo sapiens
tgaaaacaaatcta

SEQ ID NO: 6482085 - DNA, 23 bp, Homo sapiens
tgaaaacaagaaagaaatggctt

SEQ ID NO: 6482086 - DNA, 21 bp, Homo sapiens
tgaaaacaagagactgcttga

SEQ ID NO: 6482087 - DNA, 16 bp, Homo sapiens
tgaaaacaagcctcca

SEQ ID NO: 6482088 - DNA, 13 bp, Homo sapiens
tgaaaacaagtgc

SEQ ID NO: 6482089 - DNA, 16 bp, Homo sapiens
tgaaaacaagtgctgg

SEQ ID NO: 6482090 - DNA, 21 bp, Homo sapiens
tgaaaacaagtgctggcacca

SEQ ID NO: 6482091 - DNA, 17 bp, Homo sapiens
tgaaaacacatttgctt

SEQ ID NO: 6482092 - DNA, 15 bp, Homo sapiens
tgaaaacacattttt

SEQ ID NO: 6482093 - DNA, 17 bp, Homo sapiens
tgaaaacacatttttct

SEQ ID NO: 6482094 - DNA, 19 bp, Homo sapiens
tgaaaacactaacaaaatt

SEQ ID NO: 6482095 - DNA, 23 bp, Homo sapiens
tgaaaacactaacaaaatttgaa

SEQ ID NO: 6482096 - DNA, 18 bp, Homo sapiens
tgaaaacactgtgcacat

SEQ ID NO: 6482097 - DNA, 17 bp, Homo sapiens
tgaaaacactgttctct

SEQ ID NO: 6482098 - DNA, 21 bp, Homo sapiens
tgaaaacactgttctctgccc

SEQ ID NO: 6482099 - DNA, 22 bp, Homo sapiens
tgaaaacactgttctctgccct

SEQ ID NO: 6482100 - DNA, 22 bp, Homo sapiens
tgaaaacacttattttacacag

SEQ ID NO: 6482101 - DNA, 18 bp, Homo sapiens
tgaaaacagaaaacggtt

SEQ ID NO: 6482102 - DNA, 15 bp, Homo sapiens
tgaaaacagtgtctt

SEQ ID NO: 6482103 - DNA, 19 bp, Homo sapiens
tgaaaacatggtagaattg

SEQ ID NO: 6482104 - DNA, 14 bp, Homo sapiens
tgaaaacatgtaat

SEQ ID NO: 6482105 - DNA, 21 bp, Homo sapiens
tgaaaacatgtactacagcta

SEQ ID NO: 6482106 - DNA, 15 bp, Homo sapiens
tgaaaacattgatga

SEQ ID NO: 6482107 - DNA, 16 bp, Homo sapiens
tgaaaacattgatgaa

SEQ ID NO: 6482108 - DNA, 17 bp, Homo sapiens
tgaaaacattgatgaat

SEQ ID NO: 6482109 - DNA, 15 bp, Homo sapiens
tgaaaaccaaaatga

SEQ ID NO: 6482110 - DNA, 20 bp, Homo sapiens
tgaaaaccaaccctgtgggc

SEQ ID NO: 6482111 - DNA, 15 bp, Homo sapiens
tgaaaaccacagtca

SEQ ID NO: 6482112 - DNA, 18 bp, Homo sapiens
tgaaaaccacattggaga

SEQ ID NO: 6482113 - DNA, 20 bp, Homo sapiens
tgaaaaccagtcttctccct

SEQ ID NO: 6482114 - DNA, 22 bp, Homo sapiens
tgaaaaccagtcttctccctgt

SEQ ID NO: 6482115 - DNA, 22 bp, Homo sapiens
tgaaaaccatccatctgtggaa

SEQ ID NO: 6482116 - DNA, 20 bp, Homo sapiens
tgaaaaccatctggcctggc

SEQ ID NO: 6482117 - DNA, 15 bp, Homo sapiens
tgaaaacccagagag

SEQ ID NO: 6482118 - DNA, 21 bp, Homo sapiens
tgaaaaccctcgatgttcatg

SEQ ID NO: 6482119 - DNA, 13 bp, Homo sapiens
tgaaaacctcaca

SEQ ID NO: 6482120 - DNA, 20 bp, Homo sapiens
tgaaaacggagctgaacaat

SEQ ID NO: 6482121 - DNA, 16 bp, Homo sapiens
tgaaaactaaggattt

SEQ ID NO: 6482122 - DNA, 19 bp, Homo sapiens
tgaaaactaatgtactgta

SEQ ID NO: 6482123 - DNA, 15 bp, Homo sapiens
tgaaaactcatacag

SEQ ID NO: 6482124 - DNA, 16 bp, Homo sapiens
tgaaaactcatcggga

SEQ ID NO: 6482125 - DNA, 13 bp, Homo sapiens
tgaaaactctttg

SEQ ID NO: 6482126 - DNA, 17 bp, Homo sapiens
tgaaaactctttgctgc

SEQ ID NO: 6482127 - DNA, 12 bp, Homo sapiens
tgaaaactgaat

SEQ ID NO: 6482128 - DNA, 16 bp, Homo sapiens
tgaaaactgaatgtca

SEQ ID NO: 6482129 - DNA, 12 bp, Homo sapiens
tgaaaactgaca

SEQ ID NO: 6482130 - DNA, 15 bp, Homo sapiens
tgaaaactgacatca

SEQ ID NO: 6482131 - DNA, 20 bp, Homo sapiens
tgaaaactgacatcagattt

SEQ ID NO: 6482132 - DNA, 21 bp, Homo sapiens
tgaaaactgacatcagatttc

SEQ ID NO: 6482133 - DNA, 23 bp, Homo sapiens
tgaaaactgacatcagatttctt

SEQ ID NO: 6482134 - DNA, 17 bp, Homo sapiens
tgaaaactgatttccca

SEQ ID NO: 6482135 - DNA, 12 bp, Homo sapiens
tgaaaactggaa

SEQ ID NO: 6482136 - DNA, 14 bp, Homo sapiens
tgaaaactggaata

SEQ ID NO: 6482137 - DNA, 21 bp, Homo sapiens
tgaaaactggattatctacta

SEQ ID NO: 6482138 - DNA, 17 bp, Homo sapiens
tgaaaactgtttatggt

SEQ ID NO: 6482139 - DNA, 14 bp, Homo sapiens
tgaaaacttcaaag

SEQ ID NO: 6482140 - DNA, 20 bp, Homo sapiens
tgaaaacttcaaagctgaat

SEQ ID NO: 6482141 - DNA, 22 bp, Homo sapiens
tgaaaacttcaaagctgaatat

SEQ ID NO: 6482142 - DNA, 23 bp, Homo sapiens
tgaaaacttcaaagctgaatatt

SEQ ID NO: 6482143 - DNA, 19 bp, Homo sapiens
tgaaaacttgctgaaaaac

SEQ ID NO: 6482144 - DNA, 23 bp, Homo sapiens
tgaaaacttttacatttttctga

SEQ ID NO: 6482145 - DNA, 14 bp, Homo sapiens
tgaaaactttttca

SEQ ID NO: 6482146 - DNA, 19 bp, Homo sapiens
tgaaaagaaaaatgagcct

SEQ ID NO: 6482147 - DNA, 12 bp, Homo sapiens
tgaaaagaaaga

SEQ ID NO: 6482148 - DNA, 13 bp, Homo sapiens
tgaaaagaaagaa

SEQ ID NO: 6482149 - DNA, 14 bp, Homo sapiens
tgaaaagaaataat

SEQ ID NO: 6482150 - DNA, 16 bp, Homo sapiens
tgaaaagaaatgctaa

SEQ ID NO: 6482151 - DNA, 19 bp, Homo sapiens
tgaaaagaactagtttcta

SEQ ID NO: 6482152 - DNA, 12 bp, Homo sapiens
tgaaaagaagaa

SEQ ID NO: 6482153 - DNA, 21 bp, Homo sapiens
tgaaaagaagaaagtctatgc

SEQ ID NO: 6482154 - DNA, 16 bp, Homo sapiens
tgaaaagaaggaaaga

SEQ ID NO: 6482155 - DNA, 13 bp, Homo sapiens
tgaaaagaatttg

SEQ ID NO: 6482156 - DNA, 17 bp, Homo sapiens
tgaaaagactccaaaga

SEQ ID NO: 6482157 - DNA, 19 bp, Homo sapiens
tgaaaagactccaaagaaa

SEQ ID NO: 6482158 - DNA, 15 bp, Homo sapiens
tgaaaagagaagcaa

SEQ ID NO: 6482159 - DNA, 18 bp, Homo sapiens
tgaaaagagaattactta

SEQ ID NO: 6482160 - DNA, 18 bp, Homo sapiens
tgaaaagagagcagagaa

SEQ ID NO: 6482161 - DNA, 19 bp, Homo sapiens
tgaaaagagagcagagaat

SEQ ID NO: 6482162 - DNA, 23 bp, Homo sapiens
tgaaaagaggggaccagaagcca

SEQ ID NO: 6482163 - DNA, 21 bp, Homo sapiens
tgaaaagaggtgaccataaag

SEQ ID NO: 6482164 - DNA, 20 bp, Homo sapiens
tgaaaagatcccaagatgga

SEQ ID NO: 6482165 - DNA, 18 bp, Homo sapiens
tgaaaagatggtatcata

SEQ ID NO: 6482166 - DNA, 16 bp, Homo sapiens
tgaaaagatgtacctg

SEQ ID NO: 6482167 - DNA, 16 bp, Homo sapiens
tgaaaagattgcaaag

SEQ ID NO: 6482168 - DNA, 20 bp, Homo sapiens
tgaaaagcaatacaacttta

SEQ ID NO: 6482169 - DNA, 14 bp, Homo sapiens
tgaaaagcaatatt

SEQ ID NO: 6482170 - DNA, 19 bp, Homo sapiens
tgaaaagcaatattgtata

SEQ ID NO: 6482171 - DNA, 18 bp, Homo sapiens
tgaaaagcaattgccctg

SEQ ID NO: 6482172 - DNA, 23 bp, Homo sapiens
tgaaaagcagttcatgtctgaaa

SEQ ID NO: 6482173 - DNA, 13 bp, Homo sapiens
tgaaaagccaaag

SEQ ID NO: 6482174 - DNA, 11 bp, Homo sapiens
tgaaaagccat

SEQ ID NO: 6482175 - DNA, 15 bp, Homo sapiens
tgaaaagccatgttt

SEQ ID NO: 6482176 - DNA, 20 bp, Homo sapiens
tgaaaagcctctgttttgat

SEQ ID NO: 6482177 - DNA, 22 bp, Homo sapiens
tgaaaagcctctgttttgatat

SEQ ID NO: 6482178 - DNA, 18 bp, Homo sapiens
tgaaaaggaacttgccct

SEQ ID NO: 6482179 - DNA, 12 bp, Homo sapiens
tgaaaaggaaga

SEQ ID NO: 6482180 - DNA, 18 bp, Homo sapiens
tgaaaaggaaggaccagg

SEQ ID NO: 6482181 - DNA, 19 bp, Homo sapiens
tgaaaaggactcttgagcc

SEQ ID NO: 6482182 - DNA, 11 bp, Homo sapiens
tgaaaaggcag

SEQ ID NO: 6482183 - DNA, 16 bp, Homo sapiens
tgaaaagggcagaggc

SEQ ID NO: 6482184 - DNA, 19 bp, Homo sapiens
tgaaaagggcggaagagtt

SEQ ID NO: 6482185 - DNA, 21 bp, Homo sapiens
tgaaaagggcggaagagttac

SEQ ID NO: 6482186 - DNA, 19 bp, Homo sapiens
tgaaaagggggtgggatgg

SEQ ID NO: 6482187 - DNA, 21 bp, Homo sapiens
tgaaaaggttcttcatccctt

SEQ ID NO: 6482188 - DNA, 12 bp, Homo sapiens
tgaaaagtaaaa

SEQ ID NO: 6482189 - DNA, 14 bp, Homo sapiens
tgaaaagtaattga

SEQ ID NO: 6482190 - DNA, 24 bp, Homo sapiens
tgaaaagtaattgaaaaaggtgat

SEQ ID NO: 6482191 - DNA, 21 bp, Homo sapiens
tgaaaagtatcactctaaaaa

SEQ ID NO: 6482192 - DNA, 22 bp, Homo sapiens
tgaaaagtatcactctaaaaaa

SEQ ID NO: 6482193 - DNA, 14 bp, Homo sapiens
tgaaaagtcaaact

SEQ ID NO: 6482194 - DNA, 14 bp, Homo sapiens
tgaaaagtgtgtat

SEQ ID NO: 6482195 - DNA, 19 bp, Homo sapiens
tgaaaagtgtgtatatatt

SEQ ID NO: 6482196 - DNA, 15 bp, Homo sapiens
tgaaaagtgttctgt

SEQ ID NO: 6482197 - DNA, 19 bp, Homo sapiens
tgaaaagtgttctgtgcgt

SEQ ID NO: 6482198 - DNA, 12 bp, Homo sapiens
tgaaaagttatt

SEQ ID NO: 6482199 - DNA, 13 bp, Homo sapiens
tgaaaagttattt

SEQ ID NO: 6482200 - DNA, 18 bp, Homo sapiens
tgaaaagttatttatgct

SEQ ID NO: 6482201 - DNA, 20 bp, Homo sapiens
tgaaaagttatttatgctat

SEQ ID NO: 6482202 - DNA, 21 bp, Homo sapiens
tgaaaagttatttatgctata

SEQ ID NO: 6482203 - DNA, 12 bp, Homo sapiens
tgaaaagttgaa

SEQ ID NO: 6482204 - DNA, 16 bp, Homo sapiens
tgaaaagttgaaatgt

SEQ ID NO: 6482205 - DNA, 16 bp, Homo sapiens
tgaaaagttggaagga

SEQ ID NO: 6482206 - DNA, 22 bp, Homo sapiens
tgaaaagttggaaggatctgct

SEQ ID NO: 6482207 - DNA, 14 bp, Homo sapiens
tgaaaagttttcaa

SEQ ID NO: 6482208 - DNA, 22 bp, Homo sapiens
tgaaaagttttcaagcattgct

SEQ ID NO: 6482209 - DNA, 15 bp, Homo sapiens
tgaaaagtttttgtt

SEQ ID NO: 6482210 - DNA, 20 bp, Homo sapiens
tgaaaataaaaagatcactt

SEQ ID NO: 6482211 - DNA, 17 bp, Homo sapiens
tgaaaataaagaatgga

SEQ ID NO: 6482212 - DNA, 14 bp, Homo sapiens
tgaaaataagaaag

SEQ ID NO: 6482213 - DNA, 16 bp, Homo sapiens
tgaaaataagaataga

SEQ ID NO: 6482214 - DNA, 16 bp, Homo sapiens
tgaaaataattttcca

SEQ ID NO: 6482215 - DNA, 12 bp, Homo sapiens
tgaaaatacaac

SEQ ID NO: 6482216 - DNA, 13 bp, Homo sapiens
tgaaaataccatt

SEQ ID NO: 6482217 - DNA, 15 bp, Homo sapiens
tgaaaatactcctga

SEQ ID NO: 6482218 - DNA, 18 bp, Homo sapiens
tgaaaatacttaggaagg

SEQ ID NO: 6482219 - DNA, 22 bp, Homo sapiens
tgaaaatactttggataataaa

SEQ ID NO: 6482220 - DNA, 18 bp, Homo sapiens
tgaaaataggtatacagt

SEQ ID NO: 6482221 - DNA, 13 bp, Homo sapiens
tgaaaatagtgta

SEQ ID NO: 6482222 - DNA, 16 bp, Homo sapiens
tgaaaatagtgtaaga

SEQ ID NO: 6482223 - DNA, 18 bp, Homo sapiens
tgaaaatagtttatttta

SEQ ID NO: 6482224 - DNA, 11 bp, Homo sapiens
tggactgacta

SEQ ID NO: 6482225 - DNA, 18 bp, Homo sapiens
tggactgactgcagcccc

SEQ ID NO: 6482226 - DNA, 12 bp, Homo sapiens
tggactgactgt

SEQ ID NO: 6482227 - DNA, 15 bp, Homo sapiens
tggactgactgtgtt

SEQ ID NO: 6482228 - DNA, 18 bp, Homo sapiens
tggactgactgtgttggg

SEQ ID NO: 6482229 - DNA, 23 bp, Homo sapiens
tggactgagccaaggaggcctgg

SEQ ID NO: 6482230 - DNA, 17 bp, Homo sapiens
tggactgagcgaggaaa

SEQ ID NO: 6482231 - DNA, 20 bp, Homo sapiens
tggactgagcgaggaaaaac

SEQ ID NO: 6482232 - DNA, 21 bp, Homo sapiens
tggactgagcgaggaaaaaca

SEQ ID NO: 6482233 - DNA, 22 bp, Homo sapiens
tggactgagcgaggaaaaacaa

SEQ ID NO: 6482234 - DNA, 20 bp, Homo sapiens
tggactgagggggcctggat

SEQ ID NO: 6482235 - DNA, 22 bp, Homo sapiens
tggactgagggggcctggatgc

SEQ ID NO: 6482236 - DNA, 17 bp, Homo sapiens
tggactgagtgggaagc

SEQ ID NO: 6482237 - DNA, 15 bp, Homo sapiens
tggactgatggttgc

SEQ ID NO: 6482238 - DNA, 19 bp, Homo sapiens
tggactgatggttgctttg

SEQ ID NO: 6482239 - DNA, 12 bp, Homo sapiens
tggactgatttg

SEQ ID NO: 6482240 - DNA, 15 bp, Homo sapiens
tggactgatttgtgg

SEQ ID NO: 6482241 - DNA, 19 bp, Homo sapiens
tggactgcaatatcaacaa

SEQ ID NO: 6482242 - DNA, 14 bp, Homo sapiens
tggactgcacaaaa

SEQ ID NO: 6482243 - DNA, 20 bp, Homo sapiens
tggactgcacaaaagtctca

SEQ ID NO: 6482244 - DNA, 21 bp, Homo sapiens
tggactgcattgaaggcgagg

SEQ ID NO: 6482245 - DNA, 12 bp, Homo sapiens
tggactgcattt

SEQ ID NO: 6482246 - DNA, 20 bp, Homo sapiens
tggactgcatttaaatttga

SEQ ID NO: 6482247 - DNA, 17 bp, Homo sapiens
tggactggaaagcacaa

SEQ ID NO: 6482248 - DNA, 21 bp, Homo sapiens
tggactggaggcccctggagc

SEQ ID NO: 6482249 - DNA, 23 bp, Homo sapiens
tggactggaggtacaaataattt

SEQ ID NO: 6482250 - DNA, 22 bp, Homo sapiens
tggactggccatttttctgggg

SEQ ID NO: 6482251 - DNA, 16 bp, Homo sapiens
tggactggcccctggg

SEQ ID NO: 6482252 - DNA, 20 bp, Homo sapiens
tggactggcccctgggtcag

SEQ ID NO: 6482253 - DNA, 14 bp, Homo sapiens
tggactggcccttg

SEQ ID NO: 6482254 - DNA, 17 bp, Homo sapiens
tggactggcccttgccc

SEQ ID NO: 6482255 - DNA, 18 bp, Homo sapiens
tggactggctgtgcccct

SEQ ID NO: 6482256 - DNA, 17 bp, Homo sapiens
tggactgggaagcatta

SEQ ID NO: 6482257 - DNA, 16 bp, Homo sapiens
tggactggttatcttg

SEQ ID NO: 6482258 - DNA, 18 bp, Homo sapiens
tggactggttatcttgtt

SEQ ID NO: 6482259 - DNA, 15 bp, Homo sapiens
tggactgtcatagaa

SEQ ID NO: 6482260 - DNA, 15 bp, Homo sapiens
tggactgtcctaggt

SEQ ID NO: 6482261 - DNA, 13 bp, Homo sapiens
tggactgtctttt

SEQ ID NO: 6482262 - DNA, 20 bp, Homo sapiens
tggactgtgaatttcaaaaa

SEQ ID NO: 6482263 - DNA, 23 bp, Homo sapiens
tggactgtgcctcaggccagggc

SEQ ID NO: 6482264 - DNA, 18 bp, Homo sapiens
tggactgtggcacttgcc

SEQ ID NO: 6482265 - DNA, 18 bp, Homo sapiens
tggactgtggcctcagga

SEQ ID NO: 6482266 - DNA, 19 bp, Homo sapiens
tggactgtggtgactttgg

SEQ ID NO: 6482267 - DNA, 21 bp, Homo sapiens
tggactgtggtgactttggat

SEQ ID NO: 6482268 - DNA, 16 bp, Homo sapiens
tggactgttgccacca

SEQ ID NO: 6482269 - DNA, 19 bp, Homo sapiens
tggactgtttcatagtttt

SEQ ID NO: 6482270 - DNA, 14 bp, Homo sapiens
tggactgttttcaa

SEQ ID NO: 6482271 - DNA, 15 bp, Homo sapiens
tggactgttttcaat

SEQ ID NO: 6482272 - DNA, 17 bp, Homo sapiens
tggactgttttccttca

SEQ ID NO: 6482273 - DNA, 16 bp, Homo sapiens
tggacttaaagaaaaa

SEQ ID NO: 6482274 - DNA, 17 bp, Homo sapiens
tggacttaaccggagtt

SEQ ID NO: 6482275 - DNA, 17 bp, Homo sapiens
tggacttagctctgagg

SEQ ID NO: 6482276 - DNA, 17 bp, Homo sapiens
tggacttattcattcct

SEQ ID NO: 6482277 - DNA, 14 bp, Homo sapiens
tggacttcaaagca

SEQ ID NO: 6482278 - DNA, 19 bp, Homo sapiens
tggacttcaaagcaagctg

SEQ ID NO: 6482279 - DNA, 22 bp, Homo sapiens
tggacttcacataagctcagaa

SEQ ID NO: 6482280 - DNA, 14 bp, Homo sapiens
tggacttcctgtca

SEQ ID NO: 6482281 - DNA, 16 bp, Homo sapiens
tggacttccttggttt

SEQ ID NO: 6482282 - DNA, 17 bp, Homo sapiens
tggacttctacctgccc

SEQ ID NO: 6482283 - DNA, 18 bp, Homo sapiens
tggacttctacctgccct

SEQ ID NO: 6482284 - DNA, 15 bp, Homo sapiens
tggacttctgaagag

SEQ ID NO: 6482285 - DNA, 14 bp, Homo sapiens
tggacttctgtggg

SEQ ID NO: 6482286 - DNA, 18 bp, Homo sapiens
tggacttgaactttcctg

SEQ ID NO: 6482287 - DNA, 13 bp, Homo sapiens
tggacttgagaaa

SEQ ID NO: 6482288 - DNA, 14 bp, Homo sapiens
tggacttgcctctg

SEQ ID NO: 6482289 - DNA, 23 bp, Homo sapiens
tggacttgcttcttgtgtttgaa

SEQ ID NO: 6482290 - DNA, 18 bp, Homo sapiens
tggacttggagctgcaca

SEQ ID NO: 6482291 - DNA, 15 bp, Homo sapiens
tggacttggggcctc

SEQ ID NO: 6482292 - DNA, 14 bp, Homo sapiens
tggacttgtatatt

SEQ ID NO: 6482293 - DNA, 17 bp, Homo sapiens
tggacttgtatatttgt

SEQ ID NO: 6482294 - DNA, 21 bp, Homo sapiens
tggacttgtatatttgtacaa

SEQ ID NO: 6482295 - DNA, 15 bp, Homo sapiens
tggacttgtcctcag

SEQ ID NO: 6482296 - DNA, 17 bp, Homo sapiens
tggacttgtctcccagt

SEQ ID NO: 6482297 - DNA, 16 bp, Homo sapiens
tggacttgtgattggc

SEQ ID NO: 6482298 - DNA, 20 bp, Homo sapiens
tggacttgtgattggctgca

SEQ ID NO: 6482299 - DNA, 12 bp, Homo sapiens
tggactttattt

SEQ ID NO: 6482300 - DNA, 20 bp, Homo sapiens
tggactttatttaatttcat

SEQ ID NO: 6482301 - DNA, 16 bp, Homo sapiens
tggactttccaccccc

SEQ ID NO: 6482302 - DNA, 20 bp, Homo sapiens
tggactttctctaataataa

SEQ ID NO: 6482303 - DNA, 21 bp, Homo sapiens
tggactttctctaataataaa

SEQ ID NO: 6482304 - DNA, 22 bp, Homo sapiens
tggactttggttctctccagga

SEQ ID NO: 6482305 - DNA, 22 bp, Homo sapiens
tggactttgttacactgttatt

SEQ ID NO: 6482306 - DNA, 18 bp, Homo sapiens
tggacttttcgttaacat

SEQ ID NO: 6482307 - DNA, 19 bp, Homo sapiens
tggacttttcgttaacatt

SEQ ID NO: 6482308 - DNA, 20 bp, Homo sapiens
tggacttttgttcatgggag

SEQ ID NO: 6482309 - DNA, 22 bp, Homo sapiens
tggagaaaaaaatcaaccctgc

SEQ ID NO: 6482310 - DNA, 15 bp, Homo sapiens
tggagaaaaaaattg

SEQ ID NO: 6482311 - DNA, 23 bp, Homo sapiens
tggagaaaaatatctgtaagagt

SEQ ID NO: 6482312 - DNA, 17 bp, Homo sapiens
tggagaaaaattacaga

SEQ ID NO: 6482313 - DNA, 17 bp, Homo sapiens
tggagaaaataacaaga

SEQ ID NO: 6482314 - DNA, 17 bp, Homo sapiens
tggagaaaatgaatgga

SEQ ID NO: 6482315 - DNA, 17 bp, Homo sapiens
tggagaaacaggcccag

SEQ ID NO: 6482316 - DNA, 19 bp, Homo sapiens
tggagaaaccctgtctcta

SEQ ID NO: 6482317 - DNA, 17 bp, Homo sapiens
tggagaaacccttgaaa

SEQ ID NO: 6482318 - DNA, 22 bp, Homo sapiens
tggagaaactgtagtctcagga

SEQ ID NO: 6482319 - DNA, 14 bp, Homo sapiens
tggagaaagaagtg

SEQ ID NO: 6482320 - DNA, 15 bp, Homo sapiens
tggagaaagaagtgg

SEQ ID NO: 6482321 - DNA, 21 bp, Homo sapiens
tggagaaagagctgcctggat

SEQ ID NO: 6482322 - DNA, 23 bp, Homo sapiens
tggagaaagagctgcctggatga

SEQ ID NO: 6482323 - DNA, 18 bp, Homo sapiens
tggagaaagcactgacct

SEQ ID NO: 6482324 - DNA, 22 bp, Homo sapiens
tggagaaagggccctgggcctg

SEQ ID NO: 6482325 - DNA, 23 bp, Homo sapiens
tggagaaataaaaatacctcttt

SEQ ID NO: 6482326 - DNA, 16 bp, Homo sapiens
tggagaaatgcttact

SEQ ID NO: 6482327 - DNA, 11 bp, Homo sapiens
tggagaaatgg

SEQ ID NO: 6482328 - DNA, 18 bp, Homo sapiens
tggagaaatgtcataaat

SEQ ID NO: 6482329 - DNA, 19 bp, Homo sapiens
tggagaaattatttaataa

SEQ ID NO: 6482330 - DNA, 20 bp, Homo sapiens
tggagaacagtggttgcctg

SEQ ID NO: 6482331 - DNA, 23 bp, Homo sapiens
tggagaacagtggttgcctgggg

SEQ ID NO: 6482332 - DNA, 14 bp, Homo sapiens
tggagaaccaccta

SEQ ID NO: 6482333 - DNA, 18 bp, Homo sapiens
tggagaacgccagtctcc

SEQ ID NO: 6482334 - DNA, 21 bp, Homo sapiens
tggagaactagaacctggagg

SEQ ID NO: 6482335 - DNA, 14 bp, Homo sapiens
tggagaactagaga

SEQ ID NO: 6482336 - DNA, 17 bp, Homo sapiens
tggagaactcagtgcca

SEQ ID NO: 6482337 - DNA, 17 bp, Homo sapiens
tggagaactttccatct

SEQ ID NO: 6482338 - DNA, 16 bp, Homo sapiens
tggagaagaactgaaa

SEQ ID NO: 6482339 - DNA, 19 bp, Homo sapiens
tggagaagaatggctttca

SEQ ID NO: 6482340 - DNA, 16 bp, Homo sapiens
tggagaagagaggaga

SEQ ID NO: 6482341 - DNA, 16 bp, Homo sapiens
tggagaagatcgcatg

SEQ ID NO: 6482342 - DNA, 14 bp, Homo sapiens
tggagaagatttat

SEQ ID NO: 6482343 - DNA, 13 bp, Homo sapiens
tggagaagcagtg

SEQ ID NO: 6482344 - DNA, 18 bp, Homo sapiens
tggagaagccacaggcct

SEQ ID NO: 6482345 - DNA, 19 bp, Homo sapiens
tggagaagccacaggcctg

SEQ ID NO: 6482346 - DNA, 20 bp, Homo sapiens
tggagaagccacaggcctga

SEQ ID NO: 6482347 - DNA, 13 bp, Homo sapiens
tggagaagccatt

SEQ ID NO: 6482348 - DNA, 14 bp, Homo sapiens
tggagaagccattg

SEQ ID NO: 6482349 - DNA, 14 bp, Homo sapiens
tggagaagctctgt

SEQ ID NO: 6482350 - DNA, 19 bp, Homo sapiens
tggagaaggaaaaggctgg

SEQ ID NO: 6482351 - DNA, 12 bp, Homo sapiens
tggagaaggaag

SEQ ID NO: 6482352 - DNA, 18 bp, Homo sapiens
tggagaaggatagcctca

SEQ ID NO: 6482353 - DNA, 14 bp, Homo sapiens
tggagaaggcatat

SEQ ID NO: 6482354 - DNA, 12 bp, Homo sapiens
tggagaagggag

SEQ ID NO: 6482355 - DNA, 20 bp, Homo sapiens
tggagaagggttctgccctg

SEQ ID NO: 6482356 - DNA, 16 bp, Homo sapiens
tggagaagtctcagct

SEQ ID NO: 6482357 - DNA, 22 bp, Homo sapiens
tggagaagtgtcgttttcataa

SEQ ID NO: 6482358 - DNA, 16 bp, Homo sapiens
tggagaagtgtgttct

SEQ ID NO: 6482359 - DNA, 12 bp, Homo sapiens
tggagaatactg

SEQ ID NO: 6482360 - DNA, 19 bp, Homo sapiens
tggagaatactttgcttca

SEQ ID NO: 6482361 - DNA, 20 bp, Homo sapiens
tggagaatactttgcttcat

SEQ ID NO: 6482362 - DNA, 16 bp, Homo sapiens
tggagaatcacaggct

SEQ ID NO: 6482363 - DNA, 18 bp, Homo sapiens
tggagaatcacaggctgg

SEQ ID NO: 6482364 - DNA, 15 bp, Homo sapiens
tggagaatgccagcc

SEQ ID NO: 6482365 - DNA, 16 bp, Homo sapiens
tggagaatgccagccc

SEQ ID NO: 6482366 - DNA, 15 bp, Homo sapiens
tggagaatgtggaga

SEQ ID NO: 6482367 - DNA, 18 bp, Homo sapiens
tggagaattgctgaaggg

SEQ ID NO: 6482368 - DNA, 19 bp, Homo sapiens
tggagaattgctgaagggc

SEQ ID NO: 6482369 - DNA, 16 bp, Homo sapiens
tggagaattggccaga

SEQ ID NO: 6482370 - DNA, 23 bp, Homo sapiens
tggagacaaaatattttcctgcc

SEQ ID NO: 6482371 - DNA, 15 bp, Homo sapiens
tggagacaaggataa

SEQ ID NO: 6482372 - DNA, 18 bp, Homo sapiens
tggagacaaggtgctaac

SEQ ID NO: 6482373 - DNA, 16 bp, Homo sapiens
tggagacaataaacag

SEQ ID NO: 6482374 - DNA, 18 bp, Homo sapiens
tggagacaatgcagatgc

SEQ ID NO: 6482375 - DNA, 22 bp, Homo sapiens
tggagacaatgtctgcagccct

SEQ ID NO: 6482376 - DNA, 17 bp, Homo sapiens
tggagacaccctctggg

SEQ ID NO: 6482377 - DNA, 23 bp, Homo sapiens
tggagacactcctataaggagag

SEQ ID NO: 6482378 - DNA, 12 bp, Homo sapiens
tggagacagcag

SEQ ID NO: 6482379 - DNA, 12 bp, Homo sapiens
tggagacagccc

SEQ ID NO: 6482380 - DNA, 17 bp, Homo sapiens
tggagacagccctgcct

SEQ ID NO: 6482381 - DNA, 19 bp, Homo sapiens
tggagacagccctgcctat

SEQ ID NO: 6482382 - DNA, 14 bp, Homo sapiens
tggagacagggtct

SEQ ID NO: 6482383 - DNA, 21 bp, Homo sapiens
tggagacattcctgggcacag

SEQ ID NO: 6482384 - DNA, 17 bp, Homo sapiens
tggagaccaccagggca

SEQ ID NO: 6482385 - DNA, 14 bp, Homo sapiens
tggagaccaggact

SEQ ID NO: 6482386 - DNA, 21 bp, Homo sapiens
tggagaccaggcctcagctct

SEQ ID NO: 6482387 - DNA, 22 bp, Homo sapiens
tggagacccaccccacctgcag

SEQ ID NO: 6482388 - DNA, 19 bp, Homo sapiens
tggagaccctgcaaacaga

SEQ ID NO: 6482389 - DNA, 16 bp, Homo sapiens
tggagaccctgccaca

SEQ ID NO: 6482390 - DNA, 18 bp, Homo sapiens
tggagaccctgccacagc

SEQ ID NO: 6482391 - DNA, 21 bp, Homo sapiens
tggagaccctgccacagccag

SEQ ID NO: 6482392 - DNA, 21 bp, Homo sapiens
tggagaccgcttcacccctgc

SEQ ID NO: 6482393 - DNA, 22 bp, Homo sapiens
tggagaccggaattgagaggtg

SEQ ID NO: 6482394 - DNA, 19 bp, Homo sapiens
tggagacctctccttccta

SEQ ID NO: 6482395 - DNA, 14 bp, Homo sapiens
tggagaccttaccc

SEQ ID NO: 6482396 - DNA, 19 bp, Homo sapiens
tggagacggaatctgccgc

SEQ ID NO: 6482397 - DNA, 19 bp, Homo sapiens
tggagactaacttattttg

SEQ ID NO: 6482398 - DNA, 21 bp, Homo sapiens
tggagactaacttattttgat

SEQ ID NO: 6482399 - DNA, 18 bp, Homo sapiens
tggagactcctgccctgt

SEQ ID NO: 6482400 - DNA, 19 bp, Homo sapiens
tggagactctgtggggcct

SEQ ID NO: 6482401 - DNA, 19 bp, Homo sapiens
tggagactgcttcccatcc

SEQ ID NO: 6482402 - DNA, 20 bp, Homo sapiens
tgaaaatagtttattttaaa

SEQ ID NO: 6482403 - DNA, 21 bp, Homo sapiens
tgaaaatatacttgactctaa

SEQ ID NO: 6482404 - DNA, 15 bp, Homo sapiens
tgaaaatatagacat

SEQ ID NO: 6482405 - DNA, 22 bp, Homo sapiens
tgaaaatatagacattctcaca

SEQ ID NO: 6482406 - DNA, 17 bp, Homo sapiens
tgaaaatatatttaata

SEQ ID NO: 6482407 - DNA, 12 bp, Homo sapiens
tgaaaatatcag

SEQ ID NO: 6482408 - DNA, 16 bp, Homo sapiens
tgaaaatatcggggag

SEQ ID NO: 6482409 - DNA, 15 bp, Homo sapiens
tgaaaatatctcttg

SEQ ID NO: 6482410 - DNA, 20 bp, Homo sapiens
tgaaaatatctcttgtgctt

SEQ ID NO: 6482411 - DNA, 20 bp, Homo sapiens
tgaaaatatgatgtttcaca

SEQ ID NO: 6482412 - DNA, 20 bp, Homo sapiens
tgaaaatatgtctgcaggtt

SEQ ID NO: 6482413 - DNA, 23 bp, Homo sapiens
tgaaaatattgttttacaatagt

SEQ ID NO: 6482414 - DNA, 11 bp, Homo sapiens
tgaaaatattt

SEQ ID NO: 6482415 - DNA, 12 bp, Homo sapiens
tgaaaatattta

SEQ ID NO: 6482416 - DNA, 13 bp, Homo sapiens
tgaaaatatttaa

SEQ ID NO: 6482417 - DNA, 16 bp, Homo sapiens
tgaaaatatttctatg

SEQ ID NO: 6482418 - DNA, 15 bp, Homo sapiens
tgaaaatatttctct

SEQ ID NO: 6482419 - DNA, 16 bp, Homo sapiens
tgaaaatatttctcta

SEQ ID NO: 6482420 - DNA, 16 bp, Homo sapiens
tgaaaatatttgtcca

SEQ ID NO: 6482421 - DNA, 19 bp, Homo sapiens
tgaaaatatttttttctag

SEQ ID NO: 6482422 - DNA, 12 bp, Homo sapiens
tgaaaatcacta

SEQ ID NO: 6482423 - DNA, 20 bp, Homo sapiens
tgaaaatcatcactcaagat

SEQ ID NO: 6482424 - DNA, 23 bp, Homo sapiens
tgaaaatcctatatctgtttgta

SEQ ID NO: 6482425 - DNA, 21 bp, Homo sapiens
tgaaaatctaatattaaaaat

SEQ ID NO: 6482426 - DNA, 11 bp, Homo sapiens
tgaaaatgaag

SEQ ID NO: 6482427 - DNA, 20 bp, Homo sapiens
tgaaaatgaagaaggaagct

SEQ ID NO: 6482428 - DNA, 16 bp, Homo sapiens
tgaaaatgaatagctt

SEQ ID NO: 6482429 - DNA, 19 bp, Homo sapiens
tgaaaatgaatatctatta

SEQ ID NO: 6482430 - DNA, 13 bp, Homo sapiens
tgaaaatgaatgc

SEQ ID NO: 6482431 - DNA, 13 bp, Homo sapiens
tgaaaatgagccc

SEQ ID NO: 6482432 - DNA, 16 bp, Homo sapiens
tgaaaatgagcctgta

SEQ ID NO: 6482433 - DNA, 15 bp, Homo sapiens
tgaaaatgaggagga

SEQ ID NO: 6482434 - DNA, 17 bp, Homo sapiens
tgaaaatgagttgtgaa

SEQ ID NO: 6482435 - DNA, 18 bp, Homo sapiens
tgaaaatgagttgtgaaa

SEQ ID NO: 6482436 - DNA, 19 bp, Homo sapiens
tgaaaatgatgtagacatt

SEQ ID NO: 6482437 - DNA, 19 bp, Homo sapiens
tgaaaatgattcctggaca

SEQ ID NO: 6482438 - DNA, 17 bp, Homo sapiens
tgaaaatgcaaagctga

SEQ ID NO: 6482439 - DNA, 23 bp, Homo sapiens
tgaaaatgcaacaacatgtataa

SEQ ID NO: 6482440 - DNA, 16 bp, Homo sapiens
tgaaaatgcaagtgtt

SEQ ID NO: 6482441 - DNA, 21 bp, Homo sapiens
tgaaaatgcatttttatcatg

SEQ ID NO: 6482442 - DNA, 20 bp, Homo sapiens
tgaaaatgctcttaaaatat

SEQ ID NO: 6482443 - DNA, 12 bp, Homo sapiens
tgaaaatgctgg

SEQ ID NO: 6482444 - DNA, 20 bp, Homo sapiens
tgaaaatggaagtggcaata

SEQ ID NO: 6482445 - DNA, 16 bp, Homo sapiens
tgaaaatggctgaaga

SEQ ID NO: 6482446 - DNA, 21 bp, Homo sapiens
tgaaaatgggttggtgcttct

SEQ ID NO: 6482447 - DNA, 16 bp, Homo sapiens
tgaaaatggtattttc

SEQ ID NO: 6482448 - DNA, 18 bp, Homo sapiens
tgaaaatggtgaagaatg

SEQ ID NO: 6482449 - DNA, 22 bp, Homo sapiens
tgaaaatgtaacttttcttaca

SEQ ID NO: 6482450 - DNA, 18 bp, Homo sapiens
tgaaaatgtaagctgttt

SEQ ID NO: 6482451 - DNA, 17 bp, Homo sapiens
tgaaaatgtacatgttc

SEQ ID NO: 6482452 - DNA, 13 bp, Homo sapiens
tgaaaatgtactg

SEQ ID NO: 6482453 - DNA, 21 bp, Homo sapiens
tgaaaatgtatttcctgaaat

SEQ ID NO: 6482454 - DNA, 22 bp, Homo sapiens
tgaaaatgtcactgttataaat

SEQ ID NO: 6482455 - DNA, 14 bp, Homo sapiens
tgaaaatgtcagaa

SEQ ID NO: 6482456 - DNA, 18 bp, Homo sapiens
tgaaaatgtccttgtgat

SEQ ID NO: 6482457 - DNA, 19 bp, Homo sapiens
tgaaaatgtccttgtgatg

SEQ ID NO: 6482458 - DNA, 21 bp, Homo sapiens
tgaaaatgtctcagtatttta

SEQ ID NO: 6482459 - DNA, 21 bp, Homo sapiens
tgaaaatgtgctatactgcat

SEQ ID NO: 6482460 - DNA, 14 bp, Homo sapiens
tgaaaatgtgtgtt

SEQ ID NO: 6482461 - DNA, 17 bp, Homo sapiens
tgaaaatgtgtttgctg

SEQ ID NO: 6482462 - DNA, 11 bp, Homo sapiens
tgaaaatgtta

SEQ ID NO: 6482463 - DNA, 13 bp, Homo sapiens
tgaaaatgttacc

SEQ ID NO: 6482464 - DNA, 17 bp, Homo sapiens
tgaaaatgttaccagtg

SEQ ID NO: 6482465 - DNA, 12 bp, Homo sapiens
tgaaaatgttta

SEQ ID NO: 6482466 - DNA, 13 bp, Homo sapiens
tgaaaatgtttta

SEQ ID NO: 6482467 - DNA, 14 bp, Homo sapiens
tgaaaatgttttat

SEQ ID NO: 6482468 - DNA, 15 bp, Homo sapiens
tgaaaatgttttatt

SEQ ID NO: 6482469 - DNA, 13 bp, Homo sapiens
tgaaaatgttttt

SEQ ID NO: 6482470 - DNA, 15 bp, Homo sapiens
tgaaaattaacactg

SEQ ID NO: 6482471 - DNA, 23 bp, Homo sapiens
tgaaaattaagattattgtctga

SEQ ID NO: 6482472 - DNA, 14 bp, Homo sapiens
tgaaaattacatgt

SEQ ID NO: 6482473 - DNA, 23 bp, Homo sapiens
tgaaaattacatgttttttcatt

SEQ ID NO: 6482474 - DNA, 19 bp, Homo sapiens
tgaaaattacgttcttaca

SEQ ID NO: 6482475 - DNA, 20 bp, Homo sapiens
tgaaaattaggatttcatga

SEQ ID NO: 6482476 - DNA, 19 bp, Homo sapiens
tgaaaattatgcaaaagca

SEQ ID NO: 6482477 - DNA, 17 bp, Homo sapiens
tgaaaattatttaaacc

SEQ ID NO: 6482478 - DNA, 18 bp, Homo sapiens
tgaaaattattttaaaca

SEQ ID NO: 6482479 - DNA, 19 bp, Homo sapiens
tgaaaattattttaaacaa

SEQ ID NO: 6482480 - DNA, 21 bp, Homo sapiens
tgaaaattattttaaacaaaa

SEQ ID NO: 6482481 - DNA, 19 bp, Homo sapiens
tgaaaattattttgttcat

SEQ ID NO: 6482482 - DNA, 18 bp, Homo sapiens
tgaaaattcaaaaagtgt

SEQ ID NO: 6482483 - DNA, 13 bp, Homo sapiens
tgaaaattcaaca

SEQ ID NO: 6482484 - DNA, 22 bp, Homo sapiens
tgaaaattcgcccgagctgttt

SEQ ID NO: 6482485 - DNA, 17 bp, Homo sapiens
tgaaaattgaaaagtac

SEQ ID NO: 6482486 - DNA, 18 bp, Homo sapiens
tgaaaattgcctttctgt

SEQ ID NO: 6482487 - DNA, 22 bp, Homo sapiens
tgaaaattgcctttctgtgttt

SEQ ID NO: 6482488 - DNA, 23 bp, Homo sapiens
tgaaaattggacagattgcctgt

SEQ ID NO: 6482489 - DNA, 13 bp, Homo sapiens
tgaaaattgtata

SEQ ID NO: 6482490 - DNA, 17 bp, Homo sapiens
tgaaaattgtatgttaa

SEQ ID NO: 6482491 - DNA, 13 bp, Homo sapiens
tgaaaatttatat

SEQ ID NO: 6482492 - DNA, 13 bp, Homo sapiens
tgaaaatttgaga

SEQ ID NO: 6482493 - DNA, 14 bp, Homo sapiens
tgaaaattttaaga

SEQ ID NO: 6482494 - DNA, 18 bp, Homo sapiens
tgaaaattttacttccat

SEQ ID NO: 6482495 - DNA, 21 bp, Homo sapiens
tgaaaattttgatgttttaag

SEQ ID NO: 6482496 - DNA, 17 bp, Homo sapiens
tgaaacaaaaattgtct

SEQ ID NO: 6482497 - DNA, 19 bp, Homo sapiens
tgaaacaaagtactcttta

SEQ ID NO: 6482498 - DNA, 22 bp, Homo sapiens
tgaaacaaagtactctttaaca

SEQ ID NO: 6482499 - DNA, 19 bp, Homo sapiens
tgaaacaaataatcacatt

SEQ ID NO: 6482500 - DNA, 15 bp, Homo sapiens
tgaaacaaattaatg

SEQ ID NO: 6482501 - DNA, 16 bp, Homo sapiens
tgaaacaaattaatga

SEQ ID NO: 6482502 - DNA, 19 bp, Homo sapiens
tgaaacaaatttacatcag

SEQ ID NO: 6482503 - DNA, 14 bp, Homo sapiens
tgaaacaacaaaac

SEQ ID NO: 6482504 - DNA, 17 bp, Homo sapiens
tgaaacaacattatttt

SEQ ID NO: 6482505 - DNA, 19 bp, Homo sapiens
tgaaacaactccttttact

SEQ ID NO: 6482506 - DNA, 20 bp, Homo sapiens
tgaaacaactccttttactg

SEQ ID NO: 6482507 - DNA, 17 bp, Homo sapiens
tgaaacaagaagccaca

SEQ ID NO: 6482508 - DNA, 21 bp, Homo sapiens
tgaaacaagtctagtcttctg

SEQ ID NO: 6482509 - DNA, 22 bp, Homo sapiens
tgaaacaatgcctacagctgtc

SEQ ID NO: 6482510 - DNA, 11 bp, Homo sapiens
tgaaacaatgt

SEQ ID NO: 6482511 - DNA, 21 bp, Homo sapiens
tgaaacaatgttgtccaacaa

SEQ ID NO: 6482512 - DNA, 23 bp, Homo sapiens
tgaaacaattattgtacactaac

SEQ ID NO: 6482513 - DNA, 20 bp, Homo sapiens
tgaaacacaaacaatagtaa

SEQ ID NO: 6482514 - DNA, 11 bp, Homo sapiens
tgaaacacaca

SEQ ID NO: 6482515 - DNA, 15 bp, Homo sapiens
tgaaacacacacaca

SEQ ID NO: 6482516 - DNA, 21 bp, Homo sapiens
tgaaacacacaggccatttca

SEQ ID NO: 6482517 - DNA, 21 bp, Homo sapiens
tgaaacacacagtgaccaagg

SEQ ID NO: 6482518 - DNA, 16 bp, Homo sapiens
tgaaacacaccaggct

SEQ ID NO: 6482519 - DNA, 17 bp, Homo sapiens
tgaaacacaccaggctg

SEQ ID NO: 6482520 - DNA, 21 bp, Homo sapiens
tgaaacacacgagcaaaccca

SEQ ID NO: 6482521 - DNA, 18 bp, Homo sapiens
tgaaacacagctgttctt

SEQ ID NO: 6482522 - DNA, 21 bp, Homo sapiens
tgaaacacagctgttcttctg

SEQ ID NO: 6482523 - DNA, 15 bp, Homo sapiens
tgaaacacctcccag

SEQ ID NO: 6482524 - DNA, 16 bp, Homo sapiens
tgaaacacctcccagg

SEQ ID NO: 6482525 - DNA, 17 bp, Homo sapiens
tgaaacacctcccaggg

SEQ ID NO: 6482526 - DNA, 17 bp, Homo sapiens
tgaaacacgaaacttgt

SEQ ID NO: 6482527 - DNA, 19 bp, Homo sapiens
tgaaacactcgtgtgcatg

SEQ ID NO: 6482528 - DNA, 20 bp, Homo sapiens
tgaaacactcgtgtgcatga

SEQ ID NO: 6482529 - DNA, 22 bp, Homo sapiens
tgaaacactcgtgtgcatgaga

SEQ ID NO: 6482530 - DNA, 11 bp, Homo sapiens
tgaaacactgg

SEQ ID NO: 6482531 - DNA, 15 bp, Homo sapiens
tgaaacactggacct

SEQ ID NO: 6482532 - DNA, 20 bp, Homo sapiens
tgaaacactggacctggggg

SEQ ID NO: 6482533 - DNA, 21 bp, Homo sapiens
tgaaacactggttttaaatat

SEQ ID NO: 6482534 - DNA, 11 bp, Homo sapiens
tgaaacacttt

SEQ ID NO: 6482535 - DNA, 15 bp, Homo sapiens
tgaaacactttgcat

SEQ ID NO: 6482536 - DNA, 15 bp, Homo sapiens
tgaaacactttgcct

SEQ ID NO: 6482537 - DNA, 23 bp, Homo sapiens
tgaaacactttgcctcctgtgta

SEQ ID NO: 6482538 - DNA, 15 bp, Homo sapiens
tgaaacagaaaaata

SEQ ID NO: 6482539 - DNA, 13 bp, Homo sapiens
tgaaacagaaaca

SEQ ID NO: 6482540 - DNA, 14 bp, Homo sapiens
tgaaacagaaagtt

SEQ ID NO: 6482541 - DNA, 20 bp, Homo sapiens
tgaaacagatgataaatatt

SEQ ID NO: 6482542 - DNA, 11 bp, Homo sapiens
tgaaacagcag

SEQ ID NO: 6482543 - DNA, 13 bp, Homo sapiens
tgaaacagcagct

SEQ ID NO: 6482544 - DNA, 11 bp, Homo sapiens
tgaaacagctg

SEQ ID NO: 6482545 - DNA, 13 bp, Homo sapiens
tgaaacagctgcc

SEQ ID NO: 6482546 - DNA, 20 bp, Homo sapiens
tgaaacaggagagaaagggg

SEQ ID NO: 6482547 - DNA, 22 bp, Homo sapiens
tgaaacagggaaaatgaagctg

SEQ ID NO: 6482548 - DNA, 18 bp, Homo sapiens
tgaaacagttccatttat

SEQ ID NO: 6482549 - DNA, 22 bp, Homo sapiens
tgaaacagttgctgtgaacttt

SEQ ID NO: 6482550 - DNA, 20 bp, Homo sapiens
tgaaacataataataatggg

SEQ ID NO: 6482551 - DNA, 22 bp, Homo sapiens
tgaaacataataataatgggtt

SEQ ID NO: 6482552 - DNA, 22 bp, Homo sapiens
tgaaacatatctcttatcttac

SEQ ID NO: 6482553 - DNA, 14 bp, Homo sapiens
tgaaacatgcacat

SEQ ID NO: 6482554 - DNA, 20 bp, Homo sapiens
tgaaacatgcacattttgta

SEQ ID NO: 6482555 - DNA, 15 bp, Homo sapiens
tgaaacatggttgta

SEQ ID NO: 6482556 - DNA, 18 bp, Homo sapiens
tgaaacatgtgcccctgc

SEQ ID NO: 6482557 - DNA, 22 bp, Homo sapiens
tgaaacatgtgcccctgccaag

SEQ ID NO: 6482558 - DNA, 24 bp, Homo sapiens
tgaaacatgttgccaaaatggtgg

SEQ ID NO: 6482559 - DNA, 15 bp, Homo sapiens
tgaaacattaactct

SEQ ID NO: 6482560 - DNA, 19 bp, Homo sapiens
tgaaacattaactctaact

SEQ ID NO: 6482561 - DNA, 14 bp, Homo sapiens
tgaaacattatttt

SEQ ID NO: 6482562 - DNA, 11 bp, Homo sapiens
tgaaacattca

SEQ ID NO: 6482563 - DNA, 18 bp, Homo sapiens
tgaaacattccgaagagg

SEQ ID NO: 6482564 - DNA, 23 bp, Homo sapiens
tgaaacattgagggaacacaaat

SEQ ID NO: 6482565 - DNA, 17 bp, Homo sapiens
tgaaacattgcttttaa

SEQ ID NO: 6482566 - DNA, 15 bp, Homo sapiens
tgaaacatttataaa

SEQ ID NO: 6482567 - DNA, 19 bp, Homo sapiens
tgaaacatttcagaaggta

SEQ ID NO: 6482568 - DNA, 19 bp, Homo sapiens
tgaaacatttgacacataa

SEQ ID NO: 6482569 - DNA, 20 bp, Homo sapiens
tgaaacatttgacacataaa

SEQ ID NO: 6482570 - DNA, 23 bp, Homo sapiens
tgaaacatttgacacataaaagt

SEQ ID NO: 6482571 - DNA, 19 bp, Homo sapiens
tgaaacattttctccctgg

SEQ ID NO: 6482572 - DNA, 15 bp, Homo sapiens
tgaaacattttttct

SEQ ID NO: 6482573 - DNA, 11 bp, Homo sapiens
tgaaaccaaaa

SEQ ID NO: 6482574 - DNA, 13 bp, Homo sapiens
tgaaaccaaaatt

SEQ ID NO: 6482575 - DNA, 12 bp, Homo sapiens
tgaaaccaactg

SEQ ID NO: 6482576 - DNA, 20 bp, Homo sapiens
tgaaaccacaggcccttggg

SEQ ID NO: 6482577 - DNA, 15 bp, Homo sapiens
tgaaaccagtattta

SEQ ID NO: 6482578 - DNA, 16 bp, Homo sapiens
tgaaaccatcacagct

SEQ ID NO: 6482579 - DNA, 19 bp, Homo sapiens
tgaaacccaaagccctggt

SEQ ID NO: 6482580 - DNA, 12 bp, Homo sapiens
tgaaacccacag

SEQ ID NO: 6482581 - DNA, 15 bp, Homo sapiens
tggagactggcaggc

SEQ ID NO: 6482582 - DNA, 16 bp, Homo sapiens
tggagactggcaggcg

SEQ ID NO: 6482583 - DNA, 20 bp, Homo sapiens
tggagactggggggcttgaa

SEQ ID NO: 6482584 - DNA, 20 bp, Homo sapiens
tggagacttaatagacattt

SEQ ID NO: 6482585 - DNA, 22 bp, Homo sapiens
tggagacttcaggttgttctgt

SEQ ID NO: 6482586 - DNA, 15 bp, Homo sapiens
tggagacttcctctg

SEQ ID NO: 6482587 - DNA, 17 bp, Homo sapiens
tggagactttctgttac

SEQ ID NO: 6482588 - DNA, 16 bp, Homo sapiens
tggagactttgctgtt

SEQ ID NO: 6482589 - DNA, 17 bp, Homo sapiens
tggagagaaaaaattaa

SEQ ID NO: 6482590 - DNA, 12 bp, Homo sapiens
tggagagaaaac

SEQ ID NO: 6482591 - DNA, 19 bp, Homo sapiens
tggagagaagcaagccagc

SEQ ID NO: 6482592 - DNA, 12 bp, Homo sapiens
tggagagaaggc

SEQ ID NO: 6482593 - DNA, 21 bp, Homo sapiens
tggagagaaggcctccctagc

SEQ ID NO: 6482594 - DNA, 22 bp, Homo sapiens
tggagagactggttttttccag

SEQ ID NO: 6482595 - DNA, 23 bp, Homo sapiens
tggagagagaggctgcctcagcc

SEQ ID NO: 6482596 - DNA, 14 bp, Homo sapiens
tggagagaggattt

SEQ ID NO: 6482597 - DNA, 20 bp, Homo sapiens
tggagagatgtttggaaacc

SEQ ID NO: 6482598 - DNA, 14 bp, Homo sapiens
tggagagcaaaggc

SEQ ID NO: 6482599 - DNA, 19 bp, Homo sapiens
tggagagcaaaggcccatg

SEQ ID NO: 6482600 - DNA, 14 bp, Homo sapiens
tggagagcaacaca

SEQ ID NO: 6482601 - DNA, 21 bp, Homo sapiens
tggagagcacagcatgcctta

SEQ ID NO: 6482602 - DNA, 17 bp, Homo sapiens
tggagagcactgccagg

SEQ ID NO: 6482603 - DNA, 14 bp, Homo sapiens
tggagagcagcagg

SEQ ID NO: 6482604 - DNA, 19 bp, Homo sapiens
tggagagcagcaggtgctg

SEQ ID NO: 6482605 - DNA, 16 bp, Homo sapiens
tggagagcagccagca

SEQ ID NO: 6482606 - DNA, 14 bp, Homo sapiens
tggagagcagctgg

SEQ ID NO: 6482607 - DNA, 16 bp, Homo sapiens
tggagagcagctggct

SEQ ID NO: 6482608 - DNA, 13 bp, Homo sapiens
tggagagccctgg

SEQ ID NO: 6482609 - DNA, 16 bp, Homo sapiens
tggagagccctgggac

SEQ ID NO: 6482610 - DNA, 17 bp, Homo sapiens
tggagagcgggtgggtg

SEQ ID NO: 6482611 - DNA, 21 bp, Homo sapiens
tggagagctagaacctggaga

SEQ ID NO: 6482612 - DNA, 14 bp, Homo sapiens
tggagagctaggag

SEQ ID NO: 6482613 - DNA, 21 bp, Homo sapiens
tggagagctcagtacagggca

SEQ ID NO: 6482614 - DNA, 22 bp, Homo sapiens
tggagagctcagtacagggcag

SEQ ID NO: 6482615 - DNA, 14 bp, Homo sapiens
tggagagctggtgc

SEQ ID NO: 6482616 - DNA, 19 bp, Homo sapiens
tggagagctgttcgctcct

SEQ ID NO: 6482617 - DNA, 12 bp, Homo sapiens
tggagaggaaca

SEQ ID NO: 6482618 - DNA, 11 bp, Homo sapiens
tggagaggaag

SEQ ID NO: 6482619 - DNA, 21 bp, Homo sapiens
tggagaggacggccctgcctg

SEQ ID NO: 6482620 - DNA, 23 bp, Homo sapiens
tggagaggacggccctgcctgcc

SEQ ID NO: 6482621 - DNA, 12 bp, Homo sapiens
tggagaggagaa

SEQ ID NO: 6482622 - DNA, 13 bp, Homo sapiens
tggagaggagaac

SEQ ID NO: 6482623 - DNA, 21 bp, Homo sapiens
tggagaggagggatgctgcct

SEQ ID NO: 6482624 - DNA, 21 bp, Homo sapiens
tggagaggaggtgtggagtgg

SEQ ID NO: 6482625 - DNA, 18 bp, Homo sapiens
tggagaggatttgatttc

SEQ ID NO: 6482626 - DNA, 14 bp, Homo sapiens
tggagaggcatggg

SEQ ID NO: 6482627 - DNA, 20 bp, Homo sapiens
tggagaggcccggcctctca

SEQ ID NO: 6482628 - DNA, 18 bp, Homo sapiens
tggagaggccctctggag

SEQ ID NO: 6482629 - DNA, 12 bp, Homo sapiens
tggagaggcctg

SEQ ID NO: 6482630 - DNA, 15 bp, Homo sapiens
tggagaggcctgggg

SEQ ID NO: 6482631 - DNA, 14 bp, Homo sapiens
tggagaggcggcct

SEQ ID NO: 6482632 - DNA, 15 bp, Homo sapiens
tggagaggcggcctc

SEQ ID NO: 6482633 - DNA, 18 bp, Homo sapiens
tggagagggaatgtgaaa

SEQ ID NO: 6482634 - DNA, 19 bp, Homo sapiens
tggagagggaatgtgaaat

SEQ ID NO: 6482635 - DNA, 13 bp, Homo sapiens
tggagagggatgg

SEQ ID NO: 6482636 - DNA, 14 bp, Homo sapiens
tggagagggatgga

SEQ ID NO: 6482637 - DNA, 14 bp, Homo sapiens
tggagagggcccag

SEQ ID NO: 6482638 - DNA, 15 bp, Homo sapiens
tggagaggggcctgg

SEQ ID NO: 6482639 - DNA, 16 bp, Homo sapiens
tggagagggggccgga

SEQ ID NO: 6482640 - DNA, 17 bp, Homo sapiens
tggagagggggccggac

SEQ ID NO: 6482641 - DNA, 13 bp, Homo sapiens
tggagagggtctc

SEQ ID NO: 6482642 - DNA, 18 bp, Homo sapiens
tggagaggtttgtcaaca

SEQ ID NO: 6482643 - DNA, 20 bp, Homo sapiens
tggagaggtttgtcaacaca

SEQ ID NO: 6482644 - DNA, 13 bp, Homo sapiens
tggagagtagaca

SEQ ID NO: 6482645 - DNA, 17 bp, Homo sapiens
tggagagtagatgcttg

SEQ ID NO: 6482646 - DNA, 16 bp, Homo sapiens
tggagagtcagatctt

SEQ ID NO: 6482647 - DNA, 16 bp, Homo sapiens
tggagagtgagctaca

SEQ ID NO: 6482648 - DNA, 17 bp, Homo sapiens
tggagagtgcaacagta

SEQ ID NO: 6482649 - DNA, 17 bp, Homo sapiens
tggagagtgcacatgcc

SEQ ID NO: 6482650 - DNA, 23 bp, Homo sapiens
tggagagtgggctgacatcaagt

SEQ ID NO: 6482651 - DNA, 17 bp, Homo sapiens
tggagagtgttcctgtt

SEQ ID NO: 6482652 - DNA, 18 bp, Homo sapiens
tggagagttgggggccag

SEQ ID NO: 6482653 - DNA, 21 bp, Homo sapiens
tggagataaaagcaattctga

SEQ ID NO: 6482654 - DNA, 18 bp, Homo sapiens
tggagatagctggggctt

SEQ ID NO: 6482655 - DNA, 17 bp, Homo sapiens
tggagatagtgccaggt

SEQ ID NO: 6482656 - DNA, 17 bp, Homo sapiens
tggagatatgcattcaa

SEQ ID NO: 6482657 - DNA, 19 bp, Homo sapiens
tggagatatttatgggggg

SEQ ID NO: 6482658 - DNA, 17 bp, Homo sapiens
tggagatcacagcccca

SEQ ID NO: 6482659 - DNA, 21 bp, Homo sapiens
tggagatcacagccccaccct

SEQ ID NO: 6482660 - DNA, 20 bp, Homo sapiens
tggagatcagaaagtgacat

SEQ ID NO: 6482661 - DNA, 22 bp, Homo sapiens
tggagatcaggtaccaaggaaa

SEQ ID NO: 6482662 - DNA, 16 bp, Homo sapiens
tggagatcccacatat

SEQ ID NO: 6482663 - DNA, 21 bp, Homo sapiens
tggagatcccacatatttcaa

SEQ ID NO: 6482664 - DNA, 19 bp, Homo sapiens
tggagatcctaactgagaa

SEQ ID NO: 6482665 - DNA, 20 bp, Homo sapiens
tggagatcctcctgcagacc

SEQ ID NO: 6482666 - DNA, 16 bp, Homo sapiens
tggagatgaggccaga

SEQ ID NO: 6482667 - DNA, 18 bp, Homo sapiens
tggagatgaggccagacc

SEQ ID NO: 6482668 - DNA, 24 bp, Homo sapiens
tggagatgaggccagaccatggac

SEQ ID NO: 6482669 - DNA, 15 bp, Homo sapiens
tggagatgcaaggtg

SEQ ID NO: 6482670 - DNA, 18 bp, Homo sapiens
tggagatggaagcttgtt

SEQ ID NO: 6482671 - DNA, 18 bp, Homo sapiens
tggagatggactcaggat

SEQ ID NO: 6482672 - DNA, 20 bp, Homo sapiens
tggagatggcaggagagctt

SEQ ID NO: 6482673 - DNA, 18 bp, Homo sapiens
tggagatgtctctgtgtg

SEQ ID NO: 6482674 - DNA, 13 bp, Homo sapiens
tggagatgtcttc

SEQ ID NO: 6482675 - DNA, 11 bp, Homo sapiens
tggagatgttt

SEQ ID NO: 6482676 - DNA, 19 bp, Homo sapiens
tggagatgttttagagtta

SEQ ID NO: 6482677 - DNA, 16 bp, Homo sapiens
tggagattaagatgcc

SEQ ID NO: 6482678 - DNA, 18 bp, Homo sapiens
tggagattactaactgtg

SEQ ID NO: 6482679 - DNA, 16 bp, Homo sapiens
tggagattataataaa

SEQ ID NO: 6482680 - DNA, 22 bp, Homo sapiens
tggagatttgaaggtctgcaag

SEQ ID NO: 6482681 - DNA, 19 bp, Homo sapiens
tggagatttggaattgaac

SEQ ID NO: 6482682 - DNA, 22 bp, Homo sapiens
tggagatttttcatacttttct

SEQ ID NO: 6482683 - DNA, 23 bp, Homo sapiens
tggagatttttcatacttttctt

SEQ ID NO: 6482684 - DNA, 13 bp, Homo sapiens
tggagcaaaacaa

SEQ ID NO: 6482685 - DNA, 23 bp, Homo sapiens
tggagcaaaacaaagctgatttc

SEQ ID NO: 6482686 - DNA, 21 bp, Homo sapiens
tggagcaaaaggcagctcacc

SEQ ID NO: 6482687 - DNA, 23 bp, Homo sapiens
tggagcaaaaggcagctcacccc

SEQ ID NO: 6482688 - DNA, 14 bp, Homo sapiens
tggagcaaaccatt

SEQ ID NO: 6482689 - DNA, 17 bp, Homo sapiens
tggagcaaacctagccc

SEQ ID NO: 6482690 - DNA, 19 bp, Homo sapiens
tggagcaaagaaggagctg

SEQ ID NO: 6482691 - DNA, 21 bp, Homo sapiens
tggagcaaagaaggagctgag

SEQ ID NO: 6482692 - DNA, 18 bp, Homo sapiens
tggagcaacctactgtct

SEQ ID NO: 6482693 - DNA, 14 bp, Homo sapiens
tggagcaagccctg

SEQ ID NO: 6482694 - DNA, 12 bp, Homo sapiens
tggagcaagctc

SEQ ID NO: 6482695 - DNA, 13 bp, Homo sapiens
tggagcaagctct

SEQ ID NO: 6482696 - DNA, 14 bp, Homo sapiens
tggagcaagctctg

SEQ ID NO: 6482697 - DNA, 18 bp, Homo sapiens
tggagcaagctctgccct

SEQ ID NO: 6482698 - DNA, 20 bp, Homo sapiens
tggagcaagctcttcccttg

SEQ ID NO: 6482699 - DNA, 18 bp, Homo sapiens
tggagcacaaaagcctct

SEQ ID NO: 6482700 - DNA, 17 bp, Homo sapiens
tggagcacaaaattcaa

SEQ ID NO: 6482701 - DNA, 19 bp, Homo sapiens
tggagcacaaagaccctgg

SEQ ID NO: 6482702 - DNA, 20 bp, Homo sapiens
tggagcacatgttactgctt

SEQ ID NO: 6482703 - DNA, 13 bp, Homo sapiens
tggagcacctggg

SEQ ID NO: 6482704 - DNA, 21 bp, Homo sapiens
tggagcacctgggccccactg

SEQ ID NO: 6482705 - DNA, 19 bp, Homo sapiens
tggagcacgtggagatagt

SEQ ID NO: 6482706 - DNA, 15 bp, Homo sapiens
tggagcactggactc

SEQ ID NO: 6482707 - DNA, 21 bp, Homo sapiens
tggagcactggactccggggc

SEQ ID NO: 6482708 - DNA, 18 bp, Homo sapiens
tggagcagaaagccaggg

SEQ ID NO: 6482709 - DNA, 13 bp, Homo sapiens
tggagcagagacg

SEQ ID NO: 6482710 - DNA, 12 bp, Homo sapiens
tggagcagagca

SEQ ID NO: 6482711 - DNA, 20 bp, Homo sapiens
tggagcagagcaagtctgca

SEQ ID NO: 6482712 - DNA, 21 bp, Homo sapiens
tggagcagagcaagtctgcag

SEQ ID NO: 6482713 - DNA, 15 bp, Homo sapiens
tggagcagagctctc

SEQ ID NO: 6482714 - DNA, 12 bp, Homo sapiens
tggagcagaggg

SEQ ID NO: 6482715 - DNA, 13 bp, Homo sapiens
tggagcagagggg

SEQ ID NO: 6482716 - DNA, 16 bp, Homo sapiens
tggagcagaggggctg

SEQ ID NO: 6482717 - DNA, 17 bp, Homo sapiens
tggagcagcagctgagg

SEQ ID NO: 6482718 - DNA, 18 bp, Homo sapiens
tggagcagcagctgaggc

SEQ ID NO: 6482719 - DNA, 14 bp, Homo sapiens
tggagcagcaggcc

SEQ ID NO: 6482720 - DNA, 17 bp, Homo sapiens
tggagcagcaggcctct

SEQ ID NO: 6482721 - DNA, 18 bp, Homo sapiens
tggagcagcaggcctctg

SEQ ID NO: 6482722 - DNA, 20 bp, Homo sapiens
tggagcagcaggcctctggg

SEQ ID NO: 6482723 - DNA, 15 bp, Homo sapiens
tggagcagccaaggc

SEQ ID NO: 6482724 - DNA, 13 bp, Homo sapiens
tggagcagccaga

SEQ ID NO: 6482725 - DNA, 17 bp, Homo sapiens
tggagcagctattttaa

SEQ ID NO: 6482726 - DNA, 22 bp, Homo sapiens
tggagcagctattttaagccat

SEQ ID NO: 6482727 - DNA, 14 bp, Homo sapiens
tggagcagctgcag

SEQ ID NO: 6482728 - DNA, 19 bp, Homo sapiens
tggagcaggagccccgcca

SEQ ID NO: 6482729 - DNA, 12 bp, Homo sapiens
tggagcaggcaa

SEQ ID NO: 6482730 - DNA, 21 bp, Homo sapiens
tggagcaggcccaatgctgct

SEQ ID NO: 6482731 - DNA, 15 bp, Homo sapiens
tggagcatcaagcca

SEQ ID NO: 6482732 - DNA, 17 bp, Homo sapiens
tggagcatcaagccact

SEQ ID NO: 6482733 - DNA, 15 bp, Homo sapiens
tggagcatcccaggc

SEQ ID NO: 6482734 - DNA, 11 bp, Homo sapiens
tggagcatctg

SEQ ID NO: 6482735 - DNA, 14 bp, Homo sapiens
tggagcatgcagag

SEQ ID NO: 6482736 - DNA, 17 bp, Homo sapiens
tggagcatgggcctggc

SEQ ID NO: 6482737 - DNA, 18 bp, Homo sapiens
tggagcatgggcctggcc

SEQ ID NO: 6482738 - DNA, 15 bp, Homo sapiens
tggagcatttatgta

SEQ ID NO: 6482739 - DNA, 22 bp, Homo sapiens
tggagcatttatgtagacattg

SEQ ID NO: 6482740 - DNA, 16 bp, Homo sapiens
tggagcatttttcaga

SEQ ID NO: 6482741 - DNA, 20 bp, Homo sapiens
tggagccaaaaaattgattc

SEQ ID NO: 6482742 - DNA, 17 bp, Homo sapiens
tggagccaactgctgct

SEQ ID NO: 6482743 - DNA, 13 bp, Homo sapiens
tggagccaagtgg

SEQ ID NO: 6482744 - DNA, 21 bp, Homo sapiens
tggagccaagtggtccagcgt

SEQ ID NO: 6482745 - DNA, 17 bp, Homo sapiens
tggagccaatggcccgg

SEQ ID NO: 6482746 - DNA, 11 bp, Homo sapiens
tggagccacag

SEQ ID NO: 6482747 - DNA, 12 bp, Homo sapiens
tggagccacagg

SEQ ID NO: 6482748 - DNA, 14 bp, Homo sapiens
tggagccacaggca

SEQ ID NO: 6482749 - DNA, 16 bp, Homo sapiens
tggagccactaactag

SEQ ID NO: 6482750 - DNA, 11 bp, Homo sapiens
tggagccactc

SEQ ID NO: 6482751 - DNA, 14 bp, Homo sapiens
tggagccactcctg

SEQ ID NO: 6482752 - DNA, 15 bp, Homo sapiens
tggagccactctgtt

SEQ ID NO: 6482753 - DNA, 15 bp, Homo sapiens
tggagccagagagaa

SEQ ID NO: 6482754 - DNA, 21 bp, Homo sapiens
tggagccagagagaacaacag

SEQ ID NO: 6482755 - DNA, 17 bp, Homo sapiens
tggagccagcagggctg

SEQ ID NO: 6482756 - DNA, 22 bp, Homo sapiens
tggagccagccgagcaggaggc

SEQ ID NO: 6482757 - DNA, 12 bp, Homo sapiens
tggagccaggcg

SEQ ID NO: 6482758 - DNA, 11 bp, Homo sapiens
tggagccaggg

SEQ ID NO: 6482759 - DNA, 14 bp, Homo sapiens
tggagccagggagc

SEQ ID NO: 6482760 - DNA, 23 bp, Homo sapiens
tggagccagggagcggccgcctg

SEQ ID NO: 6482761 - DNA, 15 bp, Homo sapiens
tgaaacccacagttt

SEQ ID NO: 6482762 - DNA, 19 bp, Homo sapiens
tgaaacccacagtttgaga

SEQ ID NO: 6482763 - DNA, 11 bp, Homo sapiens
tgaaacccagt

SEQ ID NO: 6482764 - DNA, 20 bp, Homo sapiens
tgaaacccagtcactgtgag

SEQ ID NO: 6482765 - DNA, 20 bp, Homo sapiens
tgaaacccattaggcatgcc

SEQ ID NO: 6482766 - DNA, 21 bp, Homo sapiens
tgaaacccattaggcatgcct

SEQ ID NO: 6482767 - DNA, 17 bp, Homo sapiens
tgaaacccgccctcagg

SEQ ID NO: 6482768 - DNA, 15 bp, Homo sapiens
tgaaaccctggacca

SEQ ID NO: 6482769 - DNA, 21 bp, Homo sapiens
tgaaaccctggaccagtggtc

SEQ ID NO: 6482770 - DNA, 14 bp, Homo sapiens
tgaaaccctgtctc

SEQ ID NO: 6482771 - DNA, 16 bp, Homo sapiens
tgaaacctaaggcaac

SEQ ID NO: 6482772 - DNA, 16 bp, Homo sapiens
tgaaacctacacactg

SEQ ID NO: 6482773 - DNA, 15 bp, Homo sapiens
tgaaacctctgcctt

SEQ ID NO: 6482774 - DNA, 13 bp, Homo sapiens
tgaaacctctgtt

SEQ ID NO: 6482775 - DNA, 17 bp, Homo sapiens
tgaaacctcttcctagg

SEQ ID NO: 6482776 - DNA, 15 bp, Homo sapiens
tgaaacctgatgtca

SEQ ID NO: 6482777 - DNA, 22 bp, Homo sapiens
tgaaacctgatgtcagctgctg

SEQ ID NO: 6482778 - DNA, 17 bp, Homo sapiens
tgaaaccttattttttc

SEQ ID NO: 6482779 - DNA, 18 bp, Homo sapiens
tgaaaccttattttttcc

SEQ ID NO: 6482780 - DNA, 18 bp, Homo sapiens
tgaaacctttagggcagc

SEQ ID NO: 6482781 - DNA, 20 bp, Homo sapiens
tgaaacctttagggcagctt

SEQ ID NO: 6482782 - DNA, 22 bp, Homo sapiens
tgaaacctttagggcagcttgc

SEQ ID NO: 6482783 - DNA, 21 bp, Homo sapiens
tgaaaccttttttaagatttt

SEQ ID NO: 6482784 - DNA, 21 bp, Homo sapiens
tgaaacgaatataagcttaaa

SEQ ID NO: 6482785 - DNA, 20 bp, Homo sapiens
tgaaacgagaagtgccctta

SEQ ID NO: 6482786 - DNA, 20 bp, Homo sapiens
tgaaacgcaattttacctag

SEQ ID NO: 6482787 - DNA, 17 bp, Homo sapiens
tgaaacggaagctcata

SEQ ID NO: 6482788 - DNA, 19 bp, Homo sapiens
tgaaacggaggcagatgga

SEQ ID NO: 6482789 - DNA, 20 bp, Homo sapiens
tgaaacgtcccacactttga

SEQ ID NO: 6482790 - DNA, 19 bp, Homo sapiens
tgaaactaaagcaatagaa

SEQ ID NO: 6482791 - DNA, 20 bp, Homo sapiens
tgaaactaaagcaatagaaa

SEQ ID NO: 6482792 - DNA, 15 bp, Homo sapiens
tgaaactaatcttaa

SEQ ID NO: 6482793 - DNA, 22 bp, Homo sapiens
tgaaactagaaagcagagattt

SEQ ID NO: 6482794 - DNA, 20 bp, Homo sapiens
tgaaactagaaatctgtcct

SEQ ID NO: 6482795 - DNA, 19 bp, Homo sapiens
tgaaactagaagtcaaaaa

SEQ ID NO: 6482796 - DNA, 15 bp, Homo sapiens
tgaaactagacttga

SEQ ID NO: 6482797 - DNA, 20 bp, Homo sapiens
tgaaactaggcttctgtaat

SEQ ID NO: 6482798 - DNA, 21 bp, Homo sapiens
tgaaactatggctttaaacta

SEQ ID NO: 6482799 - DNA, 18 bp, Homo sapiens
tgaaactatttacaatgt

SEQ ID NO: 6482800 - DNA, 20 bp, Homo sapiens
tgaaactcaaaaccatctct

SEQ ID NO: 6482801 - DNA, 21 bp, Homo sapiens
tgaaactccaccttgcgggga

SEQ ID NO: 6482802 - DNA, 19 bp, Homo sapiens
tgaaactccagatgccaca

SEQ ID NO: 6482803 - DNA, 14 bp, Homo sapiens
tgaaactcccaccc

SEQ ID NO: 6482804 - DNA, 15 bp, Homo sapiens
tgaaactcccaccct

SEQ ID NO: 6482805 - DNA, 17 bp, Homo sapiens
tgaaactcccttgtgtt

SEQ ID NO: 6482806 - DNA, 20 bp, Homo sapiens
tgaaactcccttgtgttcct

SEQ ID NO: 6482807 - DNA, 21 bp, Homo sapiens
tgaaactcccttgtgttcctt

SEQ ID NO: 6482808 - DNA, 19 bp, Homo sapiens
tgaaactcctgattttgta

SEQ ID NO: 6482809 - DNA, 17 bp, Homo sapiens
tgaaactctacatttaa

SEQ ID NO: 6482810 - DNA, 16 bp, Homo sapiens
tgaaactgaaggtcaa

SEQ ID NO: 6482811 - DNA, 20 bp, Homo sapiens
tgaaactgaaggtcaataaa

SEQ ID NO: 6482812 - DNA, 14 bp, Homo sapiens
tgaaactgagacca

SEQ ID NO: 6482813 - DNA, 15 bp, Homo sapiens
tgaaactgcatttgt

SEQ ID NO: 6482814 - DNA, 21 bp, Homo sapiens
tgaaactgcttgagcatcagg

SEQ ID NO: 6482815 - DNA, 22 bp, Homo sapiens
tgaaactgcttgtttcctagca

SEQ ID NO: 6482816 - DNA, 18 bp, Homo sapiens
tgaaactggattaaactt

SEQ ID NO: 6482817 - DNA, 19 bp, Homo sapiens
tgaaactggtttataataa

SEQ ID NO: 6482818 - DNA, 12 bp, Homo sapiens
tgaaactgtatt

SEQ ID NO: 6482819 - DNA, 13 bp, Homo sapiens
tgaaactgtattt

SEQ ID NO: 6482820 - DNA, 21 bp, Homo sapiens
tgaaactgtatttacttgtta

SEQ ID NO: 6482821 - DNA, 19 bp, Homo sapiens
tgaaacttacactgtttca

SEQ ID NO: 6482822 - DNA, 23 bp, Homo sapiens
tgaaacttatttttttctgattg

SEQ ID NO: 6482823 - DNA, 15 bp, Homo sapiens
tgaaacttcataaat

SEQ ID NO: 6482824 - DNA, 14 bp, Homo sapiens
tgaaacttctcagt

SEQ ID NO: 6482825 - DNA, 12 bp, Homo sapiens
tgaaacttgaac

SEQ ID NO: 6482826 - DNA, 23 bp, Homo sapiens
tgaaacttgagcattcaaatgaa

SEQ ID NO: 6482827 - DNA, 17 bp, Homo sapiens
tgaaacttggttcccag

SEQ ID NO: 6482828 - DNA, 18 bp, Homo sapiens
tgaaacttggttcccaga

SEQ ID NO: 6482829 - DNA, 17 bp, Homo sapiens
tgaaacttgtgtaaata

SEQ ID NO: 6482830 - DNA, 23 bp, Homo sapiens
tgaaacttgtgtaaatacaattt

SEQ ID NO: 6482831 - DNA, 14 bp, Homo sapiens
tgaaactttcattc

SEQ ID NO: 6482832 - DNA, 13 bp, Homo sapiens
tgaaactttgaaa

SEQ ID NO: 6482833 - DNA, 14 bp, Homo sapiens
tgaaactttgagat

SEQ ID NO: 6482834 - DNA, 16 bp, Homo sapiens
tgaaactttgggaaaa

SEQ ID NO: 6482835 - DNA, 16 bp, Homo sapiens
tgaaacttttctaaag

SEQ ID NO: 6482836 - DNA, 19 bp, Homo sapiens
tgaaacttttttcattttg

SEQ ID NO: 6482837 - DNA, 21 bp, Homo sapiens
tgaaacttttttcattttgaa

SEQ ID NO: 6482838 - DNA, 19 bp, Homo sapiens
tgaaagaaaaaaaaatact

SEQ ID NO: 6482839 - DNA, 20 bp, Homo sapiens
tgaaagaaaatatgcatcta

SEQ ID NO: 6482840 - DNA, 13 bp, Homo sapiens
tgaaagaaaattg

SEQ ID NO: 6482841 - DNA, 14 bp, Homo sapiens
tgaaagaaacagtt

SEQ ID NO: 6482842 - DNA, 11 bp, Homo sapiens
tgaaagaaacc

SEQ ID NO: 6482843 - DNA, 16 bp, Homo sapiens
tgaaagaaactagggt

SEQ ID NO: 6482844 - DNA, 19 bp, Homo sapiens
tgaaagaaagctgagaaga

SEQ ID NO: 6482845 - DNA, 22 bp, Homo sapiens
tgaaagaaagggacccacctgc

SEQ ID NO: 6482846 - DNA, 21 bp, Homo sapiens
tgaaagaaaggggcaggagct

SEQ ID NO: 6482847 - DNA, 20 bp, Homo sapiens
tgaaagaaataaacaggagt

SEQ ID NO: 6482848 - DNA, 12 bp, Homo sapiens
tgaaagaaatca

SEQ ID NO: 6482849 - DNA, 14 bp, Homo sapiens
tgaaagaacataca

SEQ ID NO: 6482850 - DNA, 11 bp, Homo sapiens
tgaaagaactt

SEQ ID NO: 6482851 - DNA, 13 bp, Homo sapiens
tgaaagaagaaca

SEQ ID NO: 6482852 - DNA, 11 bp, Homo sapiens
tgaaagaagca

SEQ ID NO: 6482853 - DNA, 14 bp, Homo sapiens
tgaaagaagcaaga

SEQ ID NO: 6482854 - DNA, 15 bp, Homo sapiens
tgaaagaagcaagac

SEQ ID NO: 6482855 - DNA, 23 bp, Homo sapiens
tgaaagaagcaagacacgtggcc

SEQ ID NO: 6482856 - DNA, 20 bp, Homo sapiens
tgaaagaatagaacacagtt

SEQ ID NO: 6482857 - DNA, 17 bp, Homo sapiens
tgaaagaatatctaatt

SEQ ID NO: 6482858 - DNA, 21 bp, Homo sapiens
tgaaagaatcagtaggaccag

SEQ ID NO: 6482859 - DNA, 16 bp, Homo sapiens
tgaaagaattattttt

SEQ ID NO: 6482860 - DNA, 16 bp, Homo sapiens
tgaaagaattctattt

SEQ ID NO: 6482861 - DNA, 11 bp, Homo sapiens
tgaaagacaaa

SEQ ID NO: 6482862 - DNA, 21 bp, Homo sapiens
tgaaagacaaagaaggaaaag

SEQ ID NO: 6482863 - DNA, 13 bp, Homo sapiens
tgaaagacaccat

SEQ ID NO: 6482864 - DNA, 13 bp, Homo sapiens
tgaaagacatcaa

SEQ ID NO: 6482865 - DNA, 19 bp, Homo sapiens
tgaaagacatcaatgaaac

SEQ ID NO: 6482866 - DNA, 16 bp, Homo sapiens
tgaaagaccagatcct

SEQ ID NO: 6482867 - DNA, 14 bp, Homo sapiens
tgaaagacctgaat

SEQ ID NO: 6482868 - DNA, 17 bp, Homo sapiens
tgaaagaccttctccaa

SEQ ID NO: 6482869 - DNA, 19 bp, Homo sapiens
tgaaagactcgagaaccaa

SEQ ID NO: 6482870 - DNA, 13 bp, Homo sapiens
tgaaagactgtac

SEQ ID NO: 6482871 - DNA, 19 bp, Homo sapiens
tgaaagactgtacaaagta

SEQ ID NO: 6482872 - DNA, 22 bp, Homo sapiens
tgaaagactgtacaaagtagaa

SEQ ID NO: 6482873 - DNA, 15 bp, Homo sapiens
tgaaagacttccaaa

SEQ ID NO: 6482874 - DNA, 21 bp, Homo sapiens
tgaaagacttccaaagaatgt

SEQ ID NO: 6482875 - DNA, 19 bp, Homo sapiens
tgaaagacttgaatttagt

SEQ ID NO: 6482876 - DNA, 18 bp, Homo sapiens
tgaaagagaaaatgcttt

SEQ ID NO: 6482877 - DNA, 18 bp, Homo sapiens
tgaaagagaaagactgat

SEQ ID NO: 6482878 - DNA, 18 bp, Homo sapiens
tgaaagagaagatggcca

SEQ ID NO: 6482879 - DNA, 21 bp, Homo sapiens
tgaaagagagtaccatgctgg

SEQ ID NO: 6482880 - DNA, 18 bp, Homo sapiens
tgaaagagcattattcct

SEQ ID NO: 6482881 - DNA, 22 bp, Homo sapiens
tgaaagagccagactctgtctc

SEQ ID NO: 6482882 - DNA, 18 bp, Homo sapiens
tgaaagaggaatgaagta

SEQ ID NO: 6482883 - DNA, 22 bp, Homo sapiens
tgaaagaggaggacccctgcct

SEQ ID NO: 6482884 - DNA, 23 bp, Homo sapiens
tgaaagaggaggacccctgcctt

SEQ ID NO: 6482885 - DNA, 18 bp, Homo sapiens
tgaaagaggcagcttgaa

SEQ ID NO: 6482886 - DNA, 19 bp, Homo sapiens
tgaaagaggctgaggcctg

SEQ ID NO: 6482887 - DNA, 17 bp, Homo sapiens
tgaaagagtaaaaccaa

SEQ ID NO: 6482888 - DNA, 13 bp, Homo sapiens
tgaaagagtatgt

SEQ ID NO: 6482889 - DNA, 17 bp, Homo sapiens
tgaaagagtctgggacc

SEQ ID NO: 6482890 - DNA, 21 bp, Homo sapiens
tgaaagataaatgatgattcg

SEQ ID NO: 6482891 - DNA, 21 bp, Homo sapiens
tgaaagatctctgtcacatcc

SEQ ID NO: 6482892 - DNA, 16 bp, Homo sapiens
tgaaagatgatcattt

SEQ ID NO: 6482893 - DNA, 19 bp, Homo sapiens
tgaaagatggctgtgcctc

SEQ ID NO: 6482894 - DNA, 20 bp, Homo sapiens
tgaaagatggtaatcttttc

SEQ ID NO: 6482895 - DNA, 21 bp, Homo sapiens
tgaaagatggtaatcttttct

SEQ ID NO: 6482896 - DNA, 12 bp, Homo sapiens
tgaaagatgtat

SEQ ID NO: 6482897 - DNA, 12 bp, Homo sapiens
tgaaagattaaa

SEQ ID NO: 6482898 - DNA, 15 bp, Homo sapiens
tgaaagattaaacag

SEQ ID NO: 6482899 - DNA, 23 bp, Homo sapiens
tgaaagattatgatgcatacagt

SEQ ID NO: 6482900 - DNA, 15 bp, Homo sapiens
tgaaagattatttaa

SEQ ID NO: 6482901 - DNA, 14 bp, Homo sapiens
tgaaagattttatt

SEQ ID NO: 6482902 - DNA, 20 bp, Homo sapiens
tgaaagatttttactaatat

SEQ ID NO: 6482903 - DNA, 16 bp, Homo sapiens
tgaaagcaaaaatgct

SEQ ID NO: 6482904 - DNA, 19 bp, Homo sapiens
tgaaagcacatgaataatt

SEQ ID NO: 6482905 - DNA, 16 bp, Homo sapiens
tgaaagcagcagctag

SEQ ID NO: 6482906 - DNA, 22 bp, Homo sapiens
tgaaagcagcagctaggactga

SEQ ID NO: 6482907 - DNA, 20 bp, Homo sapiens
tgaaagcagggaatttctat

SEQ ID NO: 6482908 - DNA, 22 bp, Homo sapiens
tgaaagcagggaatttctatct

SEQ ID NO: 6482909 - DNA, 19 bp, Homo sapiens
tgaaagcagggacttgaac

SEQ ID NO: 6482910 - DNA, 23 bp, Homo sapiens
tgaaagcagggacttgaacccat

SEQ ID NO: 6482911 - DNA, 18 bp, Homo sapiens
tgaaagcagtaaccaaga

SEQ ID NO: 6482912 - DNA, 12 bp, Homo sapiens
tgaaagccaagg

SEQ ID NO: 6482913 - DNA, 23 bp, Homo sapiens
tgaaagccaaggagtcactgaga

SEQ ID NO: 6482914 - DNA, 14 bp, Homo sapiens
tgaaagccaaggca

SEQ ID NO: 6482915 - DNA, 16 bp, Homo sapiens
tgaaagccaagtgttt

SEQ ID NO: 6482916 - DNA, 13 bp, Homo sapiens
tgaaagccatgga

SEQ ID NO: 6482917 - DNA, 15 bp, Homo sapiens
tgaaagccccagaaa

SEQ ID NO: 6482918 - DNA, 17 bp, Homo sapiens
tgaaagccccagaaatc

SEQ ID NO: 6482919 - DNA, 18 bp, Homo sapiens
tgaaagccctgagctttc

SEQ ID NO: 6482920 - DNA, 15 bp, Homo sapiens
tgaaagcggctgcct

SEQ ID NO: 6482921 - DNA, 16 bp, Homo sapiens
tgaaagcggctgcctc

SEQ ID NO: 6482922 - DNA, 13 bp, Homo sapiens
tgaaagctagaga

SEQ ID NO: 6482923 - DNA, 20 bp, Homo sapiens
tgaaagctatgaatgttact

SEQ ID NO: 6482924 - DNA, 22 bp, Homo sapiens
tgaaagctccatgtttagaaat

SEQ ID NO: 6482925 - DNA, 16 bp, Homo sapiens
tgaaagctgaaaagca

SEQ ID NO: 6482926 - DNA, 17 bp, Homo sapiens
tgaaagctgacattaag

SEQ ID NO: 6482927 - DNA, 19 bp, Homo sapiens
tgaaagctgagaactcctg

SEQ ID NO: 6482928 - DNA, 22 bp, Homo sapiens
tgaaagctgctctgctcagagt

SEQ ID NO: 6482929 - DNA, 20 bp, Homo sapiens
tgaaagctgcttctggggga

SEQ ID NO: 6482930 - DNA, 17 bp, Homo sapiens
tgaaagctggtggcaga

SEQ ID NO: 6482931 - DNA, 19 bp, Homo sapiens
tgaaagctgtttcatttgt

SEQ ID NO: 6482932 - DNA, 15 bp, Homo sapiens
tgaaagctttaatgt

SEQ ID NO: 6482933 - DNA, 10 bp, Homo sapiens
tgaaaggaaa

SEQ ID NO: 6482934 - DNA, 11 bp, Homo sapiens
tgaaaggaaaa

SEQ ID NO: 6482935 - DNA, 14 bp, Homo sapiens
tgaaaggaaagtgc

SEQ ID NO: 6482936 - DNA, 16 bp, Homo sapiens
tgaaaggaaattaagg

SEQ ID NO: 6482937 - DNA, 20 bp, Homo sapiens
tgaaaggaaattaaggcaac

SEQ ID NO: 6482938 - DNA, 16 bp, Homo sapiens
tgaaaggaacactggc

SEQ ID NO: 6482939 - DNA, 18 bp, Homo sapiens
tggagccattgaacagct

SEQ ID NO: 6482940 - DNA, 21 bp, Homo sapiens
tggagccattgaacagctgtg

SEQ ID NO: 6482941 - DNA, 18 bp, Homo sapiens
tggagcccacagagtctg

SEQ ID NO: 6482942 - DNA, 19 bp, Homo sapiens
tggagcccagaggagggca

SEQ ID NO: 6482943 - DNA, 16 bp, Homo sapiens
tggagcccaggcggga

SEQ ID NO: 6482944 - DNA, 12 bp, Homo sapiens
tggagcccaggg

SEQ ID NO: 6482945 - DNA, 19 bp, Homo sapiens
tggagcccagggtgctggg

SEQ ID NO: 6482946 - DNA, 20 bp, Homo sapiens
tggagcccagggtgctggga

SEQ ID NO: 6482947 - DNA, 17 bp, Homo sapiens
tggagcccagttggaaa

SEQ ID NO: 6482948 - DNA, 13 bp, Homo sapiens
tggagccccagcc

SEQ ID NO: 6482949 - DNA, 13 bp, Homo sapiens
tggagccccaggg

SEQ ID NO: 6482950 - DNA, 19 bp, Homo sapiens
tggagccccatcgcctggg

SEQ ID NO: 6482951 - DNA, 17 bp, Homo sapiens
tggagccccatcggcca

SEQ ID NO: 6482952 - DNA, 17 bp, Homo sapiens
tggagcccccagcagag

SEQ ID NO: 6482953 - DNA, 20 bp, Homo sapiens
tggagccccctggcggcagg

SEQ ID NO: 6482954 - DNA, 13 bp, Homo sapiens
tggagcccctcca

SEQ ID NO: 6482955 - DNA, 15 bp, Homo sapiens
tggagcccctgggtg

SEQ ID NO: 6482956 - DNA, 21 bp, Homo sapiens
tggagcccctgtgtgggaggg

SEQ ID NO: 6482957 - DNA, 22 bp, Homo sapiens
tggagcccctgtgtgggagggc

SEQ ID NO: 6482958 - DNA, 18 bp, Homo sapiens
tggagcccgaggcaccag

SEQ ID NO: 6482959 - DNA, 19 bp, Homo sapiens
tggagcccgaggcaccagt

SEQ ID NO: 6482960 - DNA, 19 bp, Homo sapiens
tggagcccgcactgtccca

SEQ ID NO: 6482961 - DNA, 19 bp, Homo sapiens
tggagcccgcttcaagctc

SEQ ID NO: 6482962 - DNA, 20 bp, Homo sapiens
tggagcccgcttcaagctct

SEQ ID NO: 6482963 - DNA, 12 bp, Homo sapiens
tggagccctcag

SEQ ID NO: 6482964 - DNA, 17 bp, Homo sapiens
tggagccctccgccttc

SEQ ID NO: 6482965 - DNA, 14 bp, Homo sapiens
tggagccctggaga

SEQ ID NO: 6482966 - DNA, 13 bp, Homo sapiens
tggagccctgggc

SEQ ID NO: 6482967 - DNA, 15 bp, Homo sapiens
tggagccctgttcct

SEQ ID NO: 6482968 - DNA, 15 bp, Homo sapiens
tggagcccttgggtt

SEQ ID NO: 6482969 - DNA, 17 bp, Homo sapiens
tggagccgaggcctacc

SEQ ID NO: 6482970 - DNA, 20 bp, Homo sapiens
tggagccgccattctgcaga

SEQ ID NO: 6482971 - DNA, 15 bp, Homo sapiens
tggagccgcttcccc

SEQ ID NO: 6482972 - DNA, 17 bp, Homo sapiens
tggagccgcttccccag

SEQ ID NO: 6482973 - DNA, 23 bp, Homo sapiens
tggagccgcttccccagctcaga

SEQ ID NO: 6482974 - DNA, 23 bp, Homo sapiens
tggagccggactttcggagttgg

SEQ ID NO: 6482975 - DNA, 18 bp, Homo sapiens
tggagcctacctctgtct

SEQ ID NO: 6482976 - DNA, 20 bp, Homo sapiens
tggagcctacctctgtctga

SEQ ID NO: 6482977 - DNA, 22 bp, Homo sapiens
tggagcctacctctgtctgaga

SEQ ID NO: 6482978 - DNA, 14 bp, Homo sapiens
tggagcctcagcag

SEQ ID NO: 6482979 - DNA, 19 bp, Homo sapiens
tggagcctcggtggccatg

SEQ ID NO: 6482980 - DNA, 20 bp, Homo sapiens
tggagcctcggtggccatgc

SEQ ID NO: 6482981 - DNA, 13 bp, Homo sapiens
tggagcctgacag

SEQ ID NO: 6482982 - DNA, 22 bp, Homo sapiens
tggagcctgagtcagggcccag

SEQ ID NO: 6482983 - DNA, 16 bp, Homo sapiens
tggagcctgcagagct

SEQ ID NO: 6482984 - DNA, 22 bp, Homo sapiens
tggagcctgcggggcagcaggg

SEQ ID NO: 6482985 - DNA, 13 bp, Homo sapiens
tggagcctggggt

SEQ ID NO: 6482986 - DNA, 21 bp, Homo sapiens
tggagcctgtgtaacagctcc

SEQ ID NO: 6482987 - DNA, 11 bp, Homo sapiens
tggagccttcc

SEQ ID NO: 6482988 - DNA, 12 bp, Homo sapiens
tggagccttcca

SEQ ID NO: 6482989 - DNA, 13 bp, Homo sapiens
tggagccttccac

SEQ ID NO: 6482990 - DNA, 14 bp, Homo sapiens
tggagccttccacc

SEQ ID NO: 6482991 - DNA, 15 bp, Homo sapiens
tggagccttccaccg

SEQ ID NO: 6482992 - DNA, 19 bp, Homo sapiens
tggagcctttgaataaaaa

SEQ ID NO: 6482993 - DNA, 20 bp, Homo sapiens
tggagccttttaactgtgca

SEQ ID NO: 6482994 - DNA, 20 bp, Homo sapiens
tggagcgaagccttctgcag

SEQ ID NO: 6482995 - DNA, 23 bp, Homo sapiens
tggagcgaagccttctgcagcag

SEQ ID NO: 6482996 - DNA, 23 bp, Homo sapiens
tggagcggagaggaagccagctg

SEQ ID NO: 6482997 - DNA, 12 bp, Homo sapiens
tggagcggctca

SEQ ID NO: 6482998 - DNA, 23 bp, Homo sapiens
tggagcgggcatggccgggccct

SEQ ID NO: 6482999 - DNA, 16 bp, Homo sapiens
tggagcgtccttgtcc

SEQ ID NO: 6483000 - DNA, 16 bp, Homo sapiens
tggagcgtggactggt

SEQ ID NO: 6483001 - DNA, 16 bp, Homo sapiens
tggagcgtttgctgtg

SEQ ID NO: 6483002 - DNA, 17 bp, Homo sapiens
tggagctaaggccagct

SEQ ID NO: 6483003 - DNA, 22 bp, Homo sapiens
tggagctaattaaggtttgccc

SEQ ID NO: 6483004 - DNA, 23 bp, Homo sapiens
tggagctaattaaggtttgccct

SEQ ID NO: 6483005 - DNA, 22 bp, Homo sapiens
tggagctagtgtctcctctctg

SEQ ID NO: 6483006 - DNA, 17 bp, Homo sapiens
tggagctcacccaaggt

SEQ ID NO: 6483007 - DNA, 18 bp, Homo sapiens
tggagctcacccaaggtc

SEQ ID NO: 6483008 - DNA, 22 bp, Homo sapiens
tggagctcagccccgagctgtc

SEQ ID NO: 6483009 - DNA, 17 bp, Homo sapiens
tggagctccagcctgac

SEQ ID NO: 6483010 - DNA, 23 bp, Homo sapiens
tggagctcctccctccagctgcg

SEQ ID NO: 6483011 - DNA, 12 bp, Homo sapiens
tggagctcctgg

SEQ ID NO: 6483012 - DNA, 16 bp, Homo sapiens
tggagctcgcccctcc

SEQ ID NO: 6483013 - DNA, 19 bp, Homo sapiens
tggagctcgcccctcccct

SEQ ID NO: 6483014 - DNA, 17 bp, Homo sapiens
tggagctcgtggaacag

SEQ ID NO: 6483015 - DNA, 22 bp, Homo sapiens
tggagctctaactgattcaggg

SEQ ID NO: 6483016 - DNA, 14 bp, Homo sapiens
tggagctcttggaa

SEQ ID NO: 6483017 - DNA, 15 bp, Homo sapiens
tggagctcttgggtc

SEQ ID NO: 6483018 - DNA, 20 bp, Homo sapiens
tggagctgaagacctaaagt

SEQ ID NO: 6483019 - DNA, 16 bp, Homo sapiens
tggagctgaatttgat

SEQ ID NO: 6483020 - DNA, 17 bp, Homo sapiens
tggagctgaattttctg

SEQ ID NO: 6483021 - DNA, 21 bp, Homo sapiens
tggagctgaattttctggaaa

SEQ ID NO: 6483022 - DNA, 22 bp, Homo sapiens
tggagctgactacggaactgca

SEQ ID NO: 6483023 - DNA, 13 bp, Homo sapiens
tggagctgactgt

SEQ ID NO: 6483024 - DNA, 16 bp, Homo sapiens
tggagctgactgttct

SEQ ID NO: 6483025 - DNA, 19 bp, Homo sapiens
tggagctgccacagagaag

SEQ ID NO: 6483026 - DNA, 12 bp, Homo sapiens
tggagctgccag

SEQ ID NO: 6483027 - DNA, 16 bp, Homo sapiens
tggagctgggagacaa

SEQ ID NO: 6483028 - DNA, 14 bp, Homo sapiens
tggagctggtctgc

SEQ ID NO: 6483029 - DNA, 23 bp, Homo sapiens
tggagctgtcacctctcagctgc

SEQ ID NO: 6483030 - DNA, 16 bp, Homo sapiens
tggagctgtcctccag

SEQ ID NO: 6483031 - DNA, 17 bp, Homo sapiens
tggagctgtcctccaga

SEQ ID NO: 6483032 - DNA, 13 bp, Homo sapiens
tggagctgtctgt

SEQ ID NO: 6483033 - DNA, 21 bp, Homo sapiens
tggagctgtgcttactggctt

SEQ ID NO: 6483034 - DNA, 19 bp, Homo sapiens
tggagcttaagccactgcc

SEQ ID NO: 6483035 - DNA, 16 bp, Homo sapiens
tggagcttcagccagg

SEQ ID NO: 6483036 - DNA, 23 bp, Homo sapiens
tggagcttctctttaactcagga

SEQ ID NO: 6483037 - DNA, 16 bp, Homo sapiens
tggagcttgaaatagt

SEQ ID NO: 6483038 - DNA, 22 bp, Homo sapiens
tggagcttgcaatgagccaaga

SEQ ID NO: 6483039 - DNA, 14 bp, Homo sapiens
tggagcttggagcc

SEQ ID NO: 6483040 - DNA, 19 bp, Homo sapiens
tggagcttggagccccctg

SEQ ID NO: 6483041 - DNA, 14 bp, Homo sapiens
tggagctttctgta

SEQ ID NO: 6483042 - DNA, 21 bp, Homo sapiens
tggagctttgcagccaaggtg

SEQ ID NO: 6483043 - DNA, 21 bp, Homo sapiens
tggagctttgtaatgggaata

SEQ ID NO: 6483044 - DNA, 19 bp, Homo sapiens
tggagcttttaaaaatgtt

SEQ ID NO: 6483045 - DNA, 16 bp, Homo sapiens
tggagctttttcaaaa

SEQ ID NO: 6483046 - DNA, 16 bp, Homo sapiens
tggaggaaagggagga

SEQ ID NO: 6483047 - DNA, 21 bp, Homo sapiens
tggaggaacaatcggctgcat

SEQ ID NO: 6483048 - DNA, 17 bp, Homo sapiens
tggaggaacacagagaa

SEQ ID NO: 6483049 - DNA, 15 bp, Homo sapiens
tggaggaacagctcc

SEQ ID NO: 6483050 - DNA, 16 bp, Homo sapiens
tggaggaacattggga

SEQ ID NO: 6483051 - DNA, 17 bp, Homo sapiens
tggaggaaccacatata

SEQ ID NO: 6483052 - DNA, 15 bp, Homo sapiens
tggaggaagaacaac

SEQ ID NO: 6483053 - DNA, 22 bp, Homo sapiens
tggaggaagaacaacaaagaca

SEQ ID NO: 6483054 - DNA, 15 bp, Homo sapiens
tggaggaagagccac

SEQ ID NO: 6483055 - DNA, 20 bp, Homo sapiens
tggaggaagagccacctgca

SEQ ID NO: 6483056 - DNA, 22 bp, Homo sapiens
tggaggaagagccacctgcaag

SEQ ID NO: 6483057 - DNA, 23 bp, Homo sapiens
tggaggaagagccacctgcaaga

SEQ ID NO: 6483058 - DNA, 16 bp, Homo sapiens
tggaggaagcccacca

SEQ ID NO: 6483059 - DNA, 12 bp, Homo sapiens
tggaggaaggaa

SEQ ID NO: 6483060 - DNA, 13 bp, Homo sapiens
tggaggaaggaaa

SEQ ID NO: 6483061 - DNA, 18 bp, Homo sapiens
tggaggaaggaaacccag

SEQ ID NO: 6483062 - DNA, 21 bp, Homo sapiens
tggaggaaggaaacccagctc

SEQ ID NO: 6483063 - DNA, 19 bp, Homo sapiens
tggaggaaggattgtaaaa

SEQ ID NO: 6483064 - DNA, 15 bp, Homo sapiens
tggaggaagggctgg

SEQ ID NO: 6483065 - DNA, 18 bp, Homo sapiens
tggaggaagggctgggcc

SEQ ID NO: 6483066 - DNA, 19 bp, Homo sapiens
tggaggaagggctgggcca

SEQ ID NO: 6483067 - DNA, 22 bp, Homo sapiens
tggaggaagggctgggccacca

SEQ ID NO: 6483068 - DNA, 14 bp, Homo sapiens
tggaggaaggtgct

SEQ ID NO: 6483069 - DNA, 18 bp, Homo sapiens
tggaggaaggtgctgagc

SEQ ID NO: 6483070 - DNA, 20 bp, Homo sapiens
tggaggaaggtgctgagctt

SEQ ID NO: 6483071 - DNA, 23 bp, Homo sapiens
tggaggaagtggggtctggcctg

SEQ ID NO: 6483072 - DNA, 15 bp, Homo sapiens
tggaggaatgctccc

SEQ ID NO: 6483073 - DNA, 15 bp, Homo sapiens
tggaggaccgaggct

SEQ ID NO: 6483074 - DNA, 15 bp, Homo sapiens
tggaggaccgttctc

SEQ ID NO: 6483075 - DNA, 17 bp, Homo sapiens
tggaggaccgttctctg

SEQ ID NO: 6483076 - DNA, 16 bp, Homo sapiens
tggaggacctgagcct

SEQ ID NO: 6483077 - DNA, 15 bp, Homo sapiens
tggaggacctgcccg

SEQ ID NO: 6483078 - DNA, 18 bp, Homo sapiens
tggaggactctagaagct

SEQ ID NO: 6483079 - DNA, 17 bp, Homo sapiens
tggaggactctcctctt

SEQ ID NO: 6483080 - DNA, 17 bp, Homo sapiens
tggaggagaaataaact

SEQ ID NO: 6483081 - DNA, 21 bp, Homo sapiens
tggaggagaagaattttcaga

SEQ ID NO: 6483082 - DNA, 14 bp, Homo sapiens
tggaggagaaggac

SEQ ID NO: 6483083 - DNA, 15 bp, Homo sapiens
tggaggagacaggaa

SEQ ID NO: 6483084 - DNA, 14 bp, Homo sapiens
tggaggagactggg

SEQ ID NO: 6483085 - DNA, 15 bp, Homo sapiens
tggaggagagaagaa

SEQ ID NO: 6483086 - DNA, 13 bp, Homo sapiens
tggaggagagaga

SEQ ID NO: 6483087 - DNA, 23 bp, Homo sapiens
tggaggagagagccttgggagcc

SEQ ID NO: 6483088 - DNA, 15 bp, Homo sapiens
tggaggagaggagac

SEQ ID NO: 6483089 - DNA, 11 bp, Homo sapiens
tggaggagcaa

SEQ ID NO: 6483090 - DNA, 14 bp, Homo sapiens
tggaggagcaaagg

SEQ ID NO: 6483091 - DNA, 16 bp, Homo sapiens
tggaggagcagcttcc

SEQ ID NO: 6483092 - DNA, 21 bp, Homo sapiens
tggaggagcagcttccttctg

SEQ ID NO: 6483093 - DNA, 14 bp, Homo sapiens
tggaggagcccagg

SEQ ID NO: 6483094 - DNA, 19 bp, Homo sapiens
tggaggagctcaggacact

SEQ ID NO: 6483095 - DNA, 20 bp, Homo sapiens
tggaggagctcaggacacta

SEQ ID NO: 6483096 - DNA, 19 bp, Homo sapiens
tggaggagctgagggaggg

SEQ ID NO: 6483097 - DNA, 13 bp, Homo sapiens
tggaggagctggc

SEQ ID NO: 6483098 - DNA, 20 bp, Homo sapiens
tggaggagctggcctgtggc

SEQ ID NO: 6483099 - DNA, 22 bp, Homo sapiens
tggaggagctggcctgtggcac

SEQ ID NO: 6483100 - DNA, 16 bp, Homo sapiens
tggaggaggaaggcaa

SEQ ID NO: 6483101 - DNA, 17 bp, Homo sapiens
tggaggaggaaggcaag

SEQ ID NO: 6483102 - DNA, 13 bp, Homo sapiens
tggaggaggaggc

SEQ ID NO: 6483103 - DNA, 16 bp, Homo sapiens
tggaggaggaggcaat

SEQ ID NO: 6483104 - DNA, 21 bp, Homo sapiens
tggaggaggagggaggcgctg

SEQ ID NO: 6483105 - DNA, 22 bp, Homo sapiens
tggaggaggggaagctgggccc

SEQ ID NO: 6483106 - DNA, 22 bp, Homo sapiens
tggaggagggggtacagtcctg

SEQ ID NO: 6483107 - DNA, 12 bp, Homo sapiens
tggaggagggtt

SEQ ID NO: 6483108 - DNA, 21 bp, Homo sapiens
tggaggagggtttgggcagag

SEQ ID NO: 6483109 - DNA, 22 bp, Homo sapiens
tggaggagggtttgggcagagc

SEQ ID NO: 6483110 - DNA, 17 bp, Homo sapiens
tggaggaggttgggagg

SEQ ID NO: 6483111 - DNA, 17 bp, Homo sapiens
tggaggatcagtttttt

SEQ ID NO: 6483112 - DNA, 15 bp, Homo sapiens
tggaggatggagaga

SEQ ID NO: 6483113 - DNA, 20 bp, Homo sapiens
tggaggatggagagagggga

SEQ ID NO: 6483114 - DNA, 18 bp, Homo sapiens
tggaggattctttcccca

SEQ ID NO: 6483115 - DNA, 16 bp, Homo sapiens
tggaggattgctgcca

SEQ ID NO: 6483116 - DNA, 17 bp, Homo sapiens
tggaggattgctgccag

SEQ ID NO: 6483117 - DNA, 15 bp, Homo sapiens
tgaaaggaacatttt

SEQ ID NO: 6483118 - DNA, 16 bp, Homo sapiens
tgaaaggaacattttt

SEQ ID NO: 6483119 - DNA, 22 bp, Homo sapiens
tgaaaggaagagctaataaatc

SEQ ID NO: 6483120 - DNA, 19 bp, Homo sapiens
tgaaaggaagataaacgtg

SEQ ID NO: 6483121 - DNA, 17 bp, Homo sapiens
tgaaaggaattttgcta

SEQ ID NO: 6483122 - DNA, 19 bp, Homo sapiens
tgaaaggaccagtttcttg

SEQ ID NO: 6483123 - DNA, 21 bp, Homo sapiens
tgaaaggatgtagaaacaata

SEQ ID NO: 6483124 - DNA, 18 bp, Homo sapiens
tgaaaggatgtggaagag

SEQ ID NO: 6483125 - DNA, 20 bp, Homo sapiens
tgaaaggcaggaagggaagc

SEQ ID NO: 6483126 - DNA, 17 bp, Homo sapiens
tgaaaggcattctctga

SEQ ID NO: 6483127 - DNA, 19 bp, Homo sapiens
tgaaaggcattctctgaag

SEQ ID NO: 6483128 - DNA, 19 bp, Homo sapiens
tgaaaggcctcaagaacaa

SEQ ID NO: 6483129 - DNA, 11 bp, Homo sapiens
tgaaaggcttt

SEQ ID NO: 6483130 - DNA, 14 bp, Homo sapiens
tgaaagggaaactg

SEQ ID NO: 6483131 - DNA, 20 bp, Homo sapiens
tgaaagggaaactgggaaac

SEQ ID NO: 6483132 - DNA, 20 bp, Homo sapiens
tgaaagggaaggacagctgt

SEQ ID NO: 6483133 - DNA, 22 bp, Homo sapiens
tgaaagggaaggacagctgtgc

SEQ ID NO: 6483134 - DNA, 15 bp, Homo sapiens
tgaaagggacaagta

SEQ ID NO: 6483135 - DNA, 14 bp, Homo sapiens
tgaaagggagcccc

SEQ ID NO: 6483136 - DNA, 20 bp, Homo sapiens
tgaaagggagctatcaggaa

SEQ ID NO: 6483137 - DNA, 13 bp, Homo sapiens
tgaaagggcactt

SEQ ID NO: 6483138 - DNA, 22 bp, Homo sapiens
tgaaagggcacttaatttgtaa

SEQ ID NO: 6483139 - DNA, 20 bp, Homo sapiens
tgaaagggcccttcccctcc

SEQ ID NO: 6483140 - DNA, 15 bp, Homo sapiens
tgaaagggctatggc

SEQ ID NO: 6483141 - DNA, 16 bp, Homo sapiens
tgaaagggctatggca

SEQ ID NO: 6483142 - DNA, 19 bp, Homo sapiens
tgaaagggctatggcaagg

SEQ ID NO: 6483143 - DNA, 21 bp, Homo sapiens
tgaaaggggacacctgtacat

SEQ ID NO: 6483144 - DNA, 12 bp, Homo sapiens
tgaaaggggtgt

SEQ ID NO: 6483145 - DNA, 18 bp, Homo sapiens
tgaaaggtactatatttg

SEQ ID NO: 6483146 - DNA, 15 bp, Homo sapiens
tgaaaggtagacttt

SEQ ID NO: 6483147 - DNA, 16 bp, Homo sapiens
tgaaaggtatatgact

SEQ ID NO: 6483148 - DNA, 16 bp, Homo sapiens
tgaaaggtcagaattt

SEQ ID NO: 6483149 - DNA, 19 bp, Homo sapiens
tgaaaggttaccctgtaac

SEQ ID NO: 6483150 - DNA, 17 bp, Homo sapiens
tgaaaggttttttttca

SEQ ID NO: 6483151 - DNA, 19 bp, Homo sapiens
tgaaagtaaaacaatttat

SEQ ID NO: 6483152 - DNA, 16 bp, Homo sapiens
tgaaagtaaaagttat

SEQ ID NO: 6483153 - DNA, 12 bp, Homo sapiens
tgaaagtaattt

SEQ ID NO: 6483154 - DNA, 19 bp, Homo sapiens
tgaaagtaatttcaagaat

SEQ ID NO: 6483155 - DNA, 21 bp, Homo sapiens
tgaaagtagagctagctgcca

SEQ ID NO: 6483156 - DNA, 18 bp, Homo sapiens
tgaaagtatgttgtatat

SEQ ID NO: 6483157 - DNA, 17 bp, Homo sapiens
tgaaagtatgttttact

SEQ ID NO: 6483158 - DNA, 13 bp, Homo sapiens
tgaaagtattcag

SEQ ID NO: 6483159 - DNA, 16 bp, Homo sapiens
tgaaagtattcagaaa

SEQ ID NO: 6483160 - DNA, 17 bp, Homo sapiens
tgaaagtattcagaaat

SEQ ID NO: 6483161 - DNA, 19 bp, Homo sapiens
tgaaagtattcagaaatta

SEQ ID NO: 6483162 - DNA, 22 bp, Homo sapiens
tgaaagtattcagaaattaaaa

SEQ ID NO: 6483163 - DNA, 15 bp, Homo sapiens
tgaaagtcaaattta

SEQ ID NO: 6483164 - DNA, 17 bp, Homo sapiens
tgaaagtcaaatttact

SEQ ID NO: 6483165 - DNA, 15 bp, Homo sapiens
tgaaagtcaagtcta

SEQ ID NO: 6483166 - DNA, 16 bp, Homo sapiens
tgaaagtcaattcagt

SEQ ID NO: 6483167 - DNA, 17 bp, Homo sapiens
tgaaagtcaattcagtg

SEQ ID NO: 6483168 - DNA, 19 bp, Homo sapiens
tgaaagtcacggctgcgca

SEQ ID NO: 6483169 - DNA, 21 bp, Homo sapiens
tgaaagtcagtttaagaggct

SEQ ID NO: 6483170 - DNA, 17 bp, Homo sapiens
tgaaagtcctgctttcc

SEQ ID NO: 6483171 - DNA, 21 bp, Homo sapiens
tgaaagtcttgtgactagtgc

SEQ ID NO: 6483172 - DNA, 15 bp, Homo sapiens
tgaaagtgaaataat

SEQ ID NO: 6483173 - DNA, 21 bp, Homo sapiens
tgaaagtgaataaacttcagc

SEQ ID NO: 6483174 - DNA, 15 bp, Homo sapiens
tgaaagtgatgacat

SEQ ID NO: 6483175 - DNA, 21 bp, Homo sapiens
tgaaagtgcatttttgtaaat

SEQ ID NO: 6483176 - DNA, 17 bp, Homo sapiens
tgaaagtgcctttgcag

SEQ ID NO: 6483177 - DNA, 12 bp, Homo sapiens
tgaaagtgctgc

SEQ ID NO: 6483178 - DNA, 20 bp, Homo sapiens
tgaaagtgggtttcaattta

SEQ ID NO: 6483179 - DNA, 18 bp, Homo sapiens
tgaaagtgtaaaatagaa

SEQ ID NO: 6483180 - DNA, 14 bp, Homo sapiens
tgaaagtgtcgtct

SEQ ID NO: 6483181 - DNA, 20 bp, Homo sapiens
tgaaagtgtcgtctccgctt

SEQ ID NO: 6483182 - DNA, 14 bp, Homo sapiens
tgaaagtgttaatt

SEQ ID NO: 6483183 - DNA, 13 bp, Homo sapiens
tgaaagtgttttt

SEQ ID NO: 6483184 - DNA, 20 bp, Homo sapiens
tgaaagttaactcttcaaat

SEQ ID NO: 6483185 - DNA, 19 bp, Homo sapiens
tgaaagttcatatctggag

SEQ ID NO: 6483186 - DNA, 23 bp, Homo sapiens
tgaaagttccttctgtagcctga

SEQ ID NO: 6483187 - DNA, 13 bp, Homo sapiens
tgaaagttgccat

SEQ ID NO: 6483188 - DNA, 22 bp, Homo sapiens
tgaaagttgccattattctatg

SEQ ID NO: 6483189 - DNA, 19 bp, Homo sapiens
tgaaagttgcttttattgc

SEQ ID NO: 6483190 - DNA, 20 bp, Homo sapiens
tgaaagttgcttttattgca

SEQ ID NO: 6483191 - DNA, 20 bp, Homo sapiens
tgaaagttggggcccagtcc

SEQ ID NO: 6483192 - DNA, 19 bp, Homo sapiens
tgaaagttgtacatgaaat

SEQ ID NO: 6483193 - DNA, 13 bp, Homo sapiens
tgaaagttgtgat

SEQ ID NO: 6483194 - DNA, 15 bp, Homo sapiens
tgaaagtttccttat

SEQ ID NO: 6483195 - DNA, 13 bp, Homo sapiens
tgaaagttttcca

SEQ ID NO: 6483196 - DNA, 15 bp, Homo sapiens
tgaaagttttccagt

SEQ ID NO: 6483197 - DNA, 18 bp, Homo sapiens
tgaaagttttccagtatt

SEQ ID NO: 6483198 - DNA, 21 bp, Homo sapiens
tgaaagttttccagtattgaa

SEQ ID NO: 6483199 - DNA, 18 bp, Homo sapiens
tgaaagttttgatacttg

SEQ ID NO: 6483200 - DNA, 20 bp, Homo sapiens
tgaaagttttgtaaaagaaa

SEQ ID NO: 6483201 - DNA, 22 bp, Homo sapiens
tgaaagttttgtaaaagaaatc

SEQ ID NO: 6483202 - DNA, 17 bp, Homo sapiens
tgaaataaaaaaagatt

SEQ ID NO: 6483203 - DNA, 11 bp, Homo sapiens
tgaaataaaac

SEQ ID NO: 6483204 - DNA, 16 bp, Homo sapiens
tgaaataaaacaggac

SEQ ID NO: 6483205 - DNA, 12 bp, Homo sapiens
tgaaataaaact

SEQ ID NO: 6483206 - DNA, 12 bp, Homo sapiens
tgaaataaaata

SEQ ID NO: 6483207 - DNA, 13 bp, Homo sapiens
tgaaataaaatgc

SEQ ID NO: 6483208 - DNA, 17 bp, Homo sapiens
tgaaataaaatttgaaa

SEQ ID NO: 6483209 - DNA, 13 bp, Homo sapiens
tgaaataaacact

SEQ ID NO: 6483210 - DNA, 15 bp, Homo sapiens
tgaaataaacactgg

SEQ ID NO: 6483211 - DNA, 19 bp, Homo sapiens
tgaaataaacctgcactga

SEQ ID NO: 6483212 - DNA, 22 bp, Homo sapiens
tgaaataaacgtcttaaatatt

SEQ ID NO: 6483213 - DNA, 14 bp, Homo sapiens
tgaaataaacgtgc

SEQ ID NO: 6483214 - DNA, 21 bp, Homo sapiens
tgaaataaagaaattgcaata

SEQ ID NO: 6483215 - DNA, 22 bp, Homo sapiens
tgaaataaagaatttaaagaat

SEQ ID NO: 6483216 - DNA, 21 bp, Homo sapiens
tgaaataaagacccaggggga

SEQ ID NO: 6483217 - DNA, 19 bp, Homo sapiens
tgaaataaagactcttgga

SEQ ID NO: 6483218 - DNA, 18 bp, Homo sapiens
tgaaataaagagttctcc

SEQ ID NO: 6483219 - DNA, 21 bp, Homo sapiens
tgaaataaagagttctccttg

SEQ ID NO: 6483220 - DNA, 14 bp, Homo sapiens
tgaaataaagttga

SEQ ID NO: 6483221 - DNA, 15 bp, Homo sapiens
tgaaataaagttgaa

SEQ ID NO: 6483222 - DNA, 13 bp, Homo sapiens
tgaaataaatgtt

SEQ ID NO: 6483223 - DNA, 19 bp, Homo sapiens
tgaaataaatgtttcaaat

SEQ ID NO: 6483224 - DNA, 23 bp, Homo sapiens
tgaaataaattctgacttatgaa

SEQ ID NO: 6483225 - DNA, 19 bp, Homo sapiens
tgaaataaattctgattct

SEQ ID NO: 6483226 - DNA, 22 bp, Homo sapiens
tgaaataaattctgattcttct

SEQ ID NO: 6483227 - DNA, 18 bp, Homo sapiens
tgaaataacaaaatggac

SEQ ID NO: 6483228 - DNA, 17 bp, Homo sapiens
tgaaataacacagcagt

SEQ ID NO: 6483229 - DNA, 23 bp, Homo sapiens
tgaaataaccgtaaaggtttatt

SEQ ID NO: 6483230 - DNA, 14 bp, Homo sapiens
tgaaataactggaa

SEQ ID NO: 6483231 - DNA, 14 bp, Homo sapiens
tgaaataagccaga

SEQ ID NO: 6483232 - DNA, 17 bp, Homo sapiens
tgaaataagccagacat

SEQ ID NO: 6483233 - DNA, 18 bp, Homo sapiens
tgaaataagccagacatc

SEQ ID NO: 6483234 - DNA, 20 bp, Homo sapiens
tgaaataagccagacatcaa

SEQ ID NO: 6483235 - DNA, 22 bp, Homo sapiens
tgaaataagctatttgatgtaa

SEQ ID NO: 6483236 - DNA, 17 bp, Homo sapiens
tgaaataagtaaatgta

SEQ ID NO: 6483237 - DNA, 14 bp, Homo sapiens
tgaaataagttgtt

SEQ ID NO: 6483238 - DNA, 12 bp, Homo sapiens
tgaaataataaa

SEQ ID NO: 6483239 - DNA, 12 bp, Homo sapiens
tgaaataataga

SEQ ID NO: 6483240 - DNA, 14 bp, Homo sapiens
tgaaataatatatt

SEQ ID NO: 6483241 - DNA, 15 bp, Homo sapiens
tgaaataatcagtga

SEQ ID NO: 6483242 - DNA, 15 bp, Homo sapiens
tgaaataatgatctt

SEQ ID NO: 6483243 - DNA, 16 bp, Homo sapiens
tgaaataatgtgtagt

SEQ ID NO: 6483244 - DNA, 13 bp, Homo sapiens
tgaaataattaca

SEQ ID NO: 6483245 - DNA, 18 bp, Homo sapiens
tgaaataattacagaata

SEQ ID NO: 6483246 - DNA, 11 bp, Homo sapiens
tgaaataattt

SEQ ID NO: 6483247 - DNA, 22 bp, Homo sapiens
tgaaataatttgtgtctgtgtt

SEQ ID NO: 6483248 - DNA, 15 bp, Homo sapiens
tgaaataattttcaa

SEQ ID NO: 6483249 - DNA, 17 bp, Homo sapiens
tgaaataatttttaact

SEQ ID NO: 6483250 - DNA, 20 bp, Homo sapiens
tgaaatacaaccagaaacaa

SEQ ID NO: 6483251 - DNA, 14 bp, Homo sapiens
tgaaataccagtgt

SEQ ID NO: 6483252 - DNA, 16 bp, Homo sapiens
tgaaataccagtgtgg

SEQ ID NO: 6483253 - DNA, 16 bp, Homo sapiens
tgaaataccattatta

SEQ ID NO: 6483254 - DNA, 19 bp, Homo sapiens
tgaaatacctcatgtttat

SEQ ID NO: 6483255 - DNA, 21 bp, Homo sapiens
tgaaatacctcatgtttatga

SEQ ID NO: 6483256 - DNA, 15 bp, Homo sapiens
tgaaatacctgtttc

SEQ ID NO: 6483257 - DNA, 11 bp, Homo sapiens
tgaaatacctt

SEQ ID NO: 6483258 - DNA, 15 bp, Homo sapiens
tgaaatacctttgta

SEQ ID NO: 6483259 - DNA, 17 bp, Homo sapiens
tgaaatacctttgtagt

SEQ ID NO: 6483260 - DNA, 17 bp, Homo sapiens
tgaaatactaaaagcaa

SEQ ID NO: 6483261 - DNA, 21 bp, Homo sapiens
tgaaatactgccttggctaga

SEQ ID NO: 6483262 - DNA, 14 bp, Homo sapiens
tgaaatactgtttg

SEQ ID NO: 6483263 - DNA, 18 bp, Homo sapiens
tgaaatacttattatttt

SEQ ID NO: 6483264 - DNA, 19 bp, Homo sapiens
tgaaatacttcgatgatga

SEQ ID NO: 6483265 - DNA, 17 bp, Homo sapiens
tgaaatacttgaaaact

SEQ ID NO: 6483266 - DNA, 22 bp, Homo sapiens
tgaaatacttgaaaacttctca

SEQ ID NO: 6483267 - DNA, 18 bp, Homo sapiens
tgaaatacttttgagtat

SEQ ID NO: 6483268 - DNA, 18 bp, Homo sapiens
tgaaatactttttaacaa

SEQ ID NO: 6483269 - DNA, 17 bp, Homo sapiens
tgaaataggaaacaagt

SEQ ID NO: 6483270 - DNA, 18 bp, Homo sapiens
tgaaataggaaacaagtg

SEQ ID NO: 6483271 - DNA, 21 bp, Homo sapiens
tgaaataggagggaaaccttt

SEQ ID NO: 6483272 - DNA, 21 bp, Homo sapiens
tgaaatagtcctgaagttctt

SEQ ID NO: 6483273 - DNA, 13 bp, Homo sapiens
tgaaatagtctgt

SEQ ID NO: 6483274 - DNA, 21 bp, Homo sapiens
tgaaatagtggttcttggaaa

SEQ ID NO: 6483275 - DNA, 14 bp, Homo sapiens
tgaaatagtgtctg

SEQ ID NO: 6483276 - DNA, 23 bp, Homo sapiens
tgaaatagttattttaatacctt

SEQ ID NO: 6483277 - DNA, 16 bp, Homo sapiens
tgaaatagttcaaact

SEQ ID NO: 6483278 - DNA, 19 bp, Homo sapiens
tgaaatagttcaaagccaa

SEQ ID NO: 6483279 - DNA, 15 bp, Homo sapiens
tgaaatagttctgcc

SEQ ID NO: 6483280 - DNA, 21 bp, Homo sapiens
tgaaatagtttccaagaaatt

SEQ ID NO: 6483281 - DNA, 17 bp, Homo sapiens
tgaaatataaactgtag

SEQ ID NO: 6483282 - DNA, 20 bp, Homo sapiens
tgaaatataaactgtagcga

SEQ ID NO: 6483283 - DNA, 21 bp, Homo sapiens
tgaaatataaactgtgagata

SEQ ID NO: 6483284 - DNA, 17 bp, Homo sapiens
tgaaatataaattatct

SEQ ID NO: 6483285 - DNA, 18 bp, Homo sapiens
tgaaatataaattatctg

SEQ ID NO: 6483286 - DNA, 17 bp, Homo sapiens
tgaaatatacacacagc

SEQ ID NO: 6483287 - DNA, 15 bp, Homo sapiens
tgaaatatagttgaa

SEQ ID NO: 6483288 - DNA, 16 bp, Homo sapiens
tgaaatatagttgaaa

SEQ ID NO: 6483289 - DNA, 17 bp, Homo sapiens
tgaaatatagttgaaag

SEQ ID NO: 6483290 - DNA, 20 bp, Homo sapiens
tgaaatatagttgaaagtaa

SEQ ID NO: 6483291 - DNA, 21 bp, Homo sapiens
tgaaatatagttgaaagtaaa

SEQ ID NO: 6483292 - DNA, 18 bp, Homo sapiens
tgaaatatatattgtaaa

SEQ ID NO: 6483293 - DNA, 19 bp, Homo sapiens
tgaaatatatattgtaaag

SEQ ID NO: 6483294 - DNA, 22 bp, Homo sapiens
tgaaatatatggtctaatgttt

SEQ ID NO: 6483295 - DNA, 17 bp, Homo sapiens
tgaaatatatgtgaaag

SEQ ID NO: 6483296 - DNA, 23 bp, Homo sapiens
tggaggattgctgccagagaagt

SEQ ID NO: 6483297 - DNA, 23 bp, Homo sapiens
tggaggatttgccattgtccagg

SEQ ID NO: 6483298 - DNA, 16 bp, Homo sapiens
tggaggcaaaggcctg

SEQ ID NO: 6483299 - DNA, 18 bp, Homo sapiens
tggaggcacgcaccactg

SEQ ID NO: 6483300 - DNA, 13 bp, Homo sapiens
tggaggcacttta

SEQ ID NO: 6483301 - DNA, 15 bp, Homo sapiens
tggaggcagagacct

SEQ ID NO: 6483302 - DNA, 16 bp, Homo sapiens
tggaggcagagacctc

SEQ ID NO: 6483303 - DNA, 13 bp, Homo sapiens
tggaggcagatgc

SEQ ID NO: 6483304 - DNA, 16 bp, Homo sapiens
tggaggcagatgtggg

SEQ ID NO: 6483305 - DNA, 20 bp, Homo sapiens
tggaggcagatgtggggctg

SEQ ID NO: 6483306 - DNA, 23 bp, Homo sapiens
tggaggcaggggctgctgccttg

SEQ ID NO: 6483307 - DNA, 20 bp, Homo sapiens
tggaggcaggggcttcctgg

SEQ ID NO: 6483308 - DNA, 15 bp, Homo sapiens
tggaggcagtgtcat

SEQ ID NO: 6483309 - DNA, 16 bp, Homo sapiens
tggaggcagtgtcatt

SEQ ID NO: 6483310 - DNA, 17 bp, Homo sapiens
tggaggcattcccagag

SEQ ID NO: 6483311 - DNA, 20 bp, Homo sapiens
tggaggcattgatgcatgct

SEQ ID NO: 6483312 - DNA, 13 bp, Homo sapiens
tggaggcattgtt

SEQ ID NO: 6483313 - DNA, 15 bp, Homo sapiens
tggaggccaagcctg

SEQ ID NO: 6483314 - DNA, 23 bp, Homo sapiens
tggaggccaccaagctgctctcc

SEQ ID NO: 6483315 - DNA, 22 bp, Homo sapiens
tggaggccaccgggacagacct

SEQ ID NO: 6483316 - DNA, 12 bp, Homo sapiens
tggaggccagag

SEQ ID NO: 6483317 - DNA, 13 bp, Homo sapiens
tggaggccagagt

SEQ ID NO: 6483318 - DNA, 16 bp, Homo sapiens
tggaggccagagtctc

SEQ ID NO: 6483319 - DNA, 21 bp, Homo sapiens
tggaggccatcgggctcccag

SEQ ID NO: 6483320 - DNA, 18 bp, Homo sapiens
tggaggcccaggctggga

SEQ ID NO: 6483321 - DNA, 12 bp, Homo sapiens
tggaggcccagt

SEQ ID NO: 6483322 - DNA, 16 bp, Homo sapiens
tggaggcccctggagc

SEQ ID NO: 6483323 - DNA, 15 bp, Homo sapiens
tggaggcccctgggc

SEQ ID NO: 6483324 - DNA, 16 bp, Homo sapiens
tggaggccctcctgtg

SEQ ID NO: 6483325 - DNA, 21 bp, Homo sapiens
tggaggccctcctgtgctggg

SEQ ID NO: 6483326 - DNA, 21 bp, Homo sapiens
tggaggcccttttctggctcc

SEQ ID NO: 6483327 - DNA, 19 bp, Homo sapiens
tggaggccgagtctgtcct

SEQ ID NO: 6483328 - DNA, 20 bp, Homo sapiens
tggaggccgagtctgtcctg

SEQ ID NO: 6483329 - DNA, 21 bp, Homo sapiens
tggaggccgggtgctcagggc

SEQ ID NO: 6483330 - DNA, 13 bp, Homo sapiens
tggaggcctacct

SEQ ID NO: 6483331 - DNA, 16 bp, Homo sapiens
tggaggcctacctctc

SEQ ID NO: 6483332 - DNA, 18 bp, Homo sapiens
tggaggcctcacacccag

SEQ ID NO: 6483333 - DNA, 17 bp, Homo sapiens
tggaggcctcaccctgc

SEQ ID NO: 6483334 - DNA, 19 bp, Homo sapiens
tggaggcctcaccctgctt

SEQ ID NO: 6483335 - DNA, 16 bp, Homo sapiens
tggaggcctctgcaag

SEQ ID NO: 6483336 - DNA, 18 bp, Homo sapiens
tggaggcctggtctggag

SEQ ID NO: 6483337 - DNA, 19 bp, Homo sapiens
tggaggcctggtctggagc

SEQ ID NO: 6483338 - DNA, 17 bp, Homo sapiens
tggaggccttccagctg

SEQ ID NO: 6483339 - DNA, 20 bp, Homo sapiens
tggaggccttccagctgctg

SEQ ID NO: 6483340 - DNA, 19 bp, Homo sapiens
tggaggcgccttcctgggt

SEQ ID NO: 6483341 - DNA, 21 bp, Homo sapiens
tggaggcgccttcctgggttg

SEQ ID NO: 6483342 - DNA, 17 bp, Homo sapiens
tggaggcgggcttggaa

SEQ ID NO: 6483343 - DNA, 18 bp, Homo sapiens
tggaggcggtgcggcagg

SEQ ID NO: 6483344 - DNA, 22 bp, Homo sapiens
tggaggcggtgcggcagggaag

SEQ ID NO: 6483345 - DNA, 19 bp, Homo sapiens
tggaggctaagcctggaca

SEQ ID NO: 6483346 - DNA, 14 bp, Homo sapiens
tggaggctcaaatt

SEQ ID NO: 6483347 - DNA, 20 bp, Homo sapiens
tggaggctcagcccaccctc

SEQ ID NO: 6483348 - DNA, 17 bp, Homo sapiens
tggaggctccaggactc

SEQ ID NO: 6483349 - DNA, 15 bp, Homo sapiens
tggaggctcctctag

SEQ ID NO: 6483350 - DNA, 17 bp, Homo sapiens
tggaggctcctctaggc

SEQ ID NO: 6483351 - DNA, 20 bp, Homo sapiens
tggaggctcctctaggccct

SEQ ID NO: 6483352 - DNA, 13 bp, Homo sapiens
tggaggctcctgt

SEQ ID NO: 6483353 - DNA, 17 bp, Homo sapiens
tggaggctcctgtggta

SEQ ID NO: 6483354 - DNA, 14 bp, Homo sapiens
tggaggctgagttc

SEQ ID NO: 6483355 - DNA, 14 bp, Homo sapiens
tggaggctgcagcg

SEQ ID NO: 6483356 - DNA, 16 bp, Homo sapiens
tggaggctgcagcgcc

SEQ ID NO: 6483357 - DNA, 16 bp, Homo sapiens
tggaggctgcctccca

SEQ ID NO: 6483358 - DNA, 14 bp, Homo sapiens
tggaggctgctgtg

SEQ ID NO: 6483359 - DNA, 15 bp, Homo sapiens
tggaggctgctgtga

SEQ ID NO: 6483360 - DNA, 16 bp, Homo sapiens
tggaggctgctgtgaa

SEQ ID NO: 6483361 - DNA, 11 bp, Homo sapiens
tggaggctgga

SEQ ID NO: 6483362 - DNA, 23 bp, Homo sapiens
tggaggctggaccaactgctttg

SEQ ID NO: 6483363 - DNA, 22 bp, Homo sapiens
tggaggctgtcttctcaggctc

SEQ ID NO: 6483364 - DNA, 13 bp, Homo sapiens
tggaggcttagct

SEQ ID NO: 6483365 - DNA, 13 bp, Homo sapiens
tggaggcttcctg

SEQ ID NO: 6483366 - DNA, 22 bp, Homo sapiens
tggaggcttcctgcgtcctcct

SEQ ID NO: 6483367 - DNA, 18 bp, Homo sapiens
tggaggcttcttgcccag

SEQ ID NO: 6483368 - DNA, 20 bp, Homo sapiens
tggagggaaacaccaaactc

SEQ ID NO: 6483369 - DNA, 17 bp, Homo sapiens
tggagggaaagccagcc

SEQ ID NO: 6483370 - DNA, 18 bp, Homo sapiens
tggagggaaagccagcct

SEQ ID NO: 6483371 - DNA, 20 bp, Homo sapiens
tggagggaaagccagcctgg

SEQ ID NO: 6483372 - DNA, 23 bp, Homo sapiens
tggagggaaatcttggtgtaact

SEQ ID NO: 6483373 - DNA, 12 bp, Homo sapiens
tggagggaacca

SEQ ID NO: 6483374 - DNA, 17 bp, Homo sapiens
tggagggaaccaccagc

SEQ ID NO: 6483375 - DNA, 15 bp, Homo sapiens
tggagggaagacctg

SEQ ID NO: 6483376 - DNA, 20 bp, Homo sapiens
tggagggaagggagaaagta

SEQ ID NO: 6483377 - DNA, 20 bp, Homo sapiens
tggagggaatgaacctggag

SEQ ID NO: 6483378 - DNA, 22 bp, Homo sapiens
tggagggacaagtggactcagg

SEQ ID NO: 6483379 - DNA, 13 bp, Homo sapiens
tggagggaggccc

SEQ ID NO: 6483380 - DNA, 14 bp, Homo sapiens
tggagggaggcccc

SEQ ID NO: 6483381 - DNA, 13 bp, Homo sapiens
tggagggaggctg

SEQ ID NO: 6483382 - DNA, 19 bp, Homo sapiens
tggagggaggggatttaat

SEQ ID NO: 6483383 - DNA, 19 bp, Homo sapiens
tggagggatcagttgcccc

SEQ ID NO: 6483384 - DNA, 20 bp, Homo sapiens
tggagggattgaacacaggc

SEQ ID NO: 6483385 - DNA, 19 bp, Homo sapiens
tggagggcaagccctgccc

SEQ ID NO: 6483386 - DNA, 13 bp, Homo sapiens
tggagggcacagc

SEQ ID NO: 6483387 - DNA, 20 bp, Homo sapiens
tggagggcacttcaggtccg

SEQ ID NO: 6483388 - DNA, 22 bp, Homo sapiens
tggagggcacttcctccacagt

SEQ ID NO: 6483389 - DNA, 13 bp, Homo sapiens
tggagggcagaga

SEQ ID NO: 6483390 - DNA, 15 bp, Homo sapiens
tggagggcagagaca

SEQ ID NO: 6483391 - DNA, 13 bp, Homo sapiens
tggagggcagagt

SEQ ID NO: 6483392 - DNA, 22 bp, Homo sapiens
tggagggcagagtgggctgcct

SEQ ID NO: 6483393 - DNA, 15 bp, Homo sapiens
tggagggcctgggcc

SEQ ID NO: 6483394 - DNA, 17 bp, Homo sapiens
tggagggcctgggcctg

SEQ ID NO: 6483395 - DNA, 20 bp, Homo sapiens
tggagggcgcccagcagcct

SEQ ID NO: 6483396 - DNA, 22 bp, Homo sapiens
tggagggctagaacctggagag

SEQ ID NO: 6483397 - DNA, 21 bp, Homo sapiens
tggagggctagaacctggagg

SEQ ID NO: 6483398 - DNA, 17 bp, Homo sapiens
tggagggctgcagagcc

SEQ ID NO: 6483399 - DNA, 18 bp, Homo sapiens
tggagggctgcagagcct

SEQ ID NO: 6483400 - DNA, 12 bp, Homo sapiens
tggagggctgga

SEQ ID NO: 6483401 - DNA, 22 bp, Homo sapiens
tggagggctggaatctggagag

SEQ ID NO: 6483402 - DNA, 20 bp, Homo sapiens
tggagggctgggcagggccc

SEQ ID NO: 6483403 - DNA, 13 bp, Homo sapiens
tggagggcttggc

SEQ ID NO: 6483404 - DNA, 15 bp, Homo sapiens
tggagggcttggccc

SEQ ID NO: 6483405 - DNA, 20 bp, Homo sapiens
tggaggggaaatggggaaag

SEQ ID NO: 6483406 - DNA, 22 bp, Homo sapiens
tggaggggagaggtcagccttg

SEQ ID NO: 6483407 - DNA, 13 bp, Homo sapiens
tggaggggagctg

SEQ ID NO: 6483408 - DNA, 16 bp, Homo sapiens
tggaggggagtgttgg

SEQ ID NO: 6483409 - DNA, 13 bp, Homo sapiens
tggaggggcagag

SEQ ID NO: 6483410 - DNA, 16 bp, Homo sapiens
tggaggggcagagcca

SEQ ID NO: 6483411 - DNA, 21 bp, Homo sapiens
tggaggggcagagccaggaag

SEQ ID NO: 6483412 - DNA, 22 bp, Homo sapiens
tggaggggcagcctgtgcctgc

SEQ ID NO: 6483413 - DNA, 20 bp, Homo sapiens
tggaggggcatggccagcag

SEQ ID NO: 6483414 - DNA, 16 bp, Homo sapiens
tggaggggccctccga

SEQ ID NO: 6483415 - DNA, 21 bp, Homo sapiens
tggaggggccctccgagggtg

SEQ ID NO: 6483416 - DNA, 19 bp, Homo sapiens
tggaggggcgcccagggtc

SEQ ID NO: 6483417 - DNA, 18 bp, Homo sapiens
tggaggggctgtcctcct

SEQ ID NO: 6483418 - DNA, 22 bp, Homo sapiens
tggaggggctgtcctccttcct

SEQ ID NO: 6483419 - DNA, 21 bp, Homo sapiens
tggaggggcttgggcctgcac

SEQ ID NO: 6483420 - DNA, 23 bp, Homo sapiens
tggaggggggaggtgggatcctc

SEQ ID NO: 6483421 - DNA, 17 bp, Homo sapiens
tggaggggtaggggctg

SEQ ID NO: 6483422 - DNA, 22 bp, Homo sapiens
tggaggggtaggggctgggaac

SEQ ID NO: 6483423 - DNA, 14 bp, Homo sapiens
tggaggggtggccc

SEQ ID NO: 6483424 - DNA, 16 bp, Homo sapiens
tggaggggtggcccag

SEQ ID NO: 6483425 - DNA, 19 bp, Homo sapiens
tggaggggtggtcctgact

SEQ ID NO: 6483426 - DNA, 14 bp, Homo sapiens
tggagggtagggga

SEQ ID NO: 6483427 - DNA, 19 bp, Homo sapiens
tggagggtatactgagggg

SEQ ID NO: 6483428 - DNA, 15 bp, Homo sapiens
tggagggtcccaagc

SEQ ID NO: 6483429 - DNA, 17 bp, Homo sapiens
tggagggtcccaagctg

SEQ ID NO: 6483430 - DNA, 21 bp, Homo sapiens
tggagggtcccaagctgggcc

SEQ ID NO: 6483431 - DNA, 16 bp, Homo sapiens
tggagggtctgggggc

SEQ ID NO: 6483432 - DNA, 20 bp, Homo sapiens
tggagggtgctaggcccctg

SEQ ID NO: 6483433 - DNA, 22 bp, Homo sapiens
tggagggtgctaggcccctgtg

SEQ ID NO: 6483434 - DNA, 20 bp, Homo sapiens
tggagggtggcgccctgcgt

SEQ ID NO: 6483435 - DNA, 15 bp, Homo sapiens
tggaggtagggctgg

SEQ ID NO: 6483436 - DNA, 21 bp, Homo sapiens
tggaggtagttgggtagaaaa

SEQ ID NO: 6483437 - DNA, 22 bp, Homo sapiens
tggaggtagttgggtagaaaaa

SEQ ID NO: 6483438 - DNA, 19 bp, Homo sapiens
tggaggtcacagctggatc

SEQ ID NO: 6483439 - DNA, 18 bp, Homo sapiens
tggaggtcacattcagga

SEQ ID NO: 6483440 - DNA, 22 bp, Homo sapiens
tggaggtcacattcaggaagat

SEQ ID NO: 6483441 - DNA, 14 bp, Homo sapiens
tggaggtcccagac

SEQ ID NO: 6483442 - DNA, 23 bp, Homo sapiens
tggaggtcccagacatgctgccc

SEQ ID NO: 6483443 - DNA, 23 bp, Homo sapiens
tggaggtccctggtcggagaggg

SEQ ID NO: 6483444 - DNA, 21 bp, Homo sapiens
tggaggtctcccctgatccag

SEQ ID NO: 6483445 - DNA, 18 bp, Homo sapiens
tggaggtctggctgagcc

SEQ ID NO: 6483446 - DNA, 19 bp, Homo sapiens
tggaggtctggctgagccc

SEQ ID NO: 6483447 - DNA, 18 bp, Homo sapiens
tggaggtgaagtccctgt

SEQ ID NO: 6483448 - DNA, 15 bp, Homo sapiens
tggaggtgagaaaag

SEQ ID NO: 6483449 - DNA, 18 bp, Homo sapiens
tggaggtgctggtagctg

SEQ ID NO: 6483450 - DNA, 21 bp, Homo sapiens
tggaggtggcgccccctggtg

SEQ ID NO: 6483451 - DNA, 23 bp, Homo sapiens
tggaggtggcgccccctggtggg

SEQ ID NO: 6483452 - DNA, 21 bp, Homo sapiens
tggaggtgggacgatgagact

SEQ ID NO: 6483453 - DNA, 22 bp, Homo sapiens
tggaggtggggagggcctctgg

SEQ ID NO: 6483454 - DNA, 16 bp, Homo sapiens
tggaggtggggcatgg

SEQ ID NO: 6483455 - DNA, 22 bp, Homo sapiens
tggaggtggggcgaggcaggcc

SEQ ID NO: 6483456 - DNA, 15 bp, Homo sapiens
tggaggtggggttgg

SEQ ID NO: 6483457 - DNA, 16 bp, Homo sapiens
tggaggtgtcaggctg

SEQ ID NO: 6483458 - DNA, 20 bp, Homo sapiens
tggaggtgtcaggctgctgg

SEQ ID NO: 6483459 - DNA, 21 bp, Homo sapiens
tggaggtgtcaggctgctggc

SEQ ID NO: 6483460 - DNA, 19 bp, Homo sapiens
tggaggtgttgtggggatg

SEQ ID NO: 6483461 - DNA, 19 bp, Homo sapiens
tggaggttaaggctgagga

SEQ ID NO: 6483462 - DNA, 20 bp, Homo sapiens
tggaggttaaggctgaggaa

SEQ ID NO: 6483463 - DNA, 22 bp, Homo sapiens
tggaggttaaggctgaggaaag

SEQ ID NO: 6483464 - DNA, 24 bp, Homo sapiens
tggaggttaaggctgaggaaaggc

SEQ ID NO: 6483465 - DNA, 13 bp, Homo sapiens
tggaggttctaag

SEQ ID NO: 6483466 - DNA, 16 bp, Homo sapiens
tggaggttctaaggcc

SEQ ID NO: 6483467 - DNA, 21 bp, Homo sapiens
tggaggttctcagagccaagt

SEQ ID NO: 6483468 - DNA, 14 bp, Homo sapiens
tggaggttgcagtg

SEQ ID NO: 6483469 - DNA, 15 bp, Homo sapiens
tggaggttgcagtga

SEQ ID NO: 6483470 - DNA, 21 bp, Homo sapiens
tggaggttgcagtgagccaag

SEQ ID NO: 6483471 - DNA, 20 bp, Homo sapiens
tggaggttgcagtgagctga

SEQ ID NO: 6483472 - DNA, 18 bp, Homo sapiens
tgaaatatattatttcct

SEQ ID NO: 6483473 - DNA, 13 bp, Homo sapiens
tgaaatatcatgt

SEQ ID NO: 6483474 - DNA, 18 bp, Homo sapiens
tgaaatatccacccagca

SEQ ID NO: 6483475 - DNA, 16 bp, Homo sapiens
tgaaatatgagaagat

SEQ ID NO: 6483476 - DNA, 23 bp, Homo sapiens
tgaaatatgagaagatcctgtca

SEQ ID NO: 6483477 - DNA, 15 bp, Homo sapiens
tgaaatatgcatact

SEQ ID NO: 6483478 - DNA, 19 bp, Homo sapiens
tgaaatatgcatgtacttt

SEQ ID NO: 6483479 - DNA, 21 bp, Homo sapiens
tgaaatatgctcttttgtttg

SEQ ID NO: 6483480 - DNA, 18 bp, Homo sapiens
tgaaatatgctggctgga

SEQ ID NO: 6483481 - DNA, 19 bp, Homo sapiens
tgaaatatggaactgtaat

SEQ ID NO: 6483482 - DNA, 15 bp, Homo sapiens
tgaaatatgtgaagt

SEQ ID NO: 6483483 - DNA, 14 bp, Homo sapiens
tgaaatattaaaat

SEQ ID NO: 6483484 - DNA, 19 bp, Homo sapiens
tgaaatattaaaatcactg

SEQ ID NO: 6483485 - DNA, 11 bp, Homo sapiens
tgaaatattag

SEQ ID NO: 6483486 - DNA, 13 bp, Homo sapiens
tgaaatattgctg

SEQ ID NO: 6483487 - DNA, 14 bp, Homo sapiens
tgaaatattgtaaa

SEQ ID NO: 6483488 - DNA, 16 bp, Homo sapiens
tgaaatattgtaaatg

SEQ ID NO: 6483489 - DNA, 18 bp, Homo sapiens
tgaaatattgtaaatgct

SEQ ID NO: 6483490 - DNA, 19 bp, Homo sapiens
tgaaatattgtaaatgcta

SEQ ID NO: 6483491 - DNA, 21 bp, Homo sapiens
tgaaatatttgtgtgtttgtg

SEQ ID NO: 6483492 - DNA, 11 bp, Homo sapiens
tgaaatatttt

SEQ ID NO: 6483493 - DNA, 17 bp, Homo sapiens
tgaaatattttctactt

SEQ ID NO: 6483494 - DNA, 12 bp, Homo sapiens
tgaaatattttg

SEQ ID NO: 6483495 - DNA, 21 bp, Homo sapiens
tgaaatattttttaatttaaa

SEQ ID NO: 6483496 - DNA, 13 bp, Homo sapiens
tgaaatcaaatgt

SEQ ID NO: 6483497 - DNA, 19 bp, Homo sapiens
tgaaatcaaatgtatgtat

SEQ ID NO: 6483498 - DNA, 20 bp, Homo sapiens
tgaaatcagtaaacactgtg

SEQ ID NO: 6483499 - DNA, 22 bp, Homo sapiens
tgaaatcagtaaacactgtgta

SEQ ID NO: 6483500 - DNA, 16 bp, Homo sapiens
tgaaatcagtatcaga

SEQ ID NO: 6483501 - DNA, 17 bp, Homo sapiens
tgaaatcagtatcagaa

SEQ ID NO: 6483502 - DNA, 15 bp, Homo sapiens
tgaaatcagtgaggt

SEQ ID NO: 6483503 - DNA, 19 bp, Homo sapiens
tgaaatcatatagaaaggc

SEQ ID NO: 6483504 - DNA, 18 bp, Homo sapiens
tgaaatcatcaaaaagaa

SEQ ID NO: 6483505 - DNA, 21 bp, Homo sapiens
tgaaatccaaaatagtcatgt

SEQ ID NO: 6483506 - DNA, 22 bp, Homo sapiens
tgaaatccaaaatagtcatgtt

SEQ ID NO: 6483507 - DNA, 17 bp, Homo sapiens
tgaaatccaaactactt

SEQ ID NO: 6483508 - DNA, 23 bp, Homo sapiens
tgaaatccataaactaagagaaa

SEQ ID NO: 6483509 - DNA, 21 bp, Homo sapiens
tgaaatccatactgtagacac

SEQ ID NO: 6483510 - DNA, 20 bp, Homo sapiens
tgaaatccatatatatgaaa

SEQ ID NO: 6483511 - DNA, 18 bp, Homo sapiens
tgaaatcccatcaggtca

SEQ ID NO: 6483512 - DNA, 20 bp, Homo sapiens
tgaaatccctgcctcaggcc

SEQ ID NO: 6483513 - DNA, 23 bp, Homo sapiens
tgaaatccgaacagttggggctg

SEQ ID NO: 6483514 - DNA, 13 bp, Homo sapiens
tgaaatcctggaa

SEQ ID NO: 6483515 - DNA, 20 bp, Homo sapiens
tgaaatccttgactggacct

SEQ ID NO: 6483516 - DNA, 19 bp, Homo sapiens
tgaaatctcagaattcctt

SEQ ID NO: 6483517 - DNA, 23 bp, Homo sapiens
tgaaatctcagatacttatgaaa

SEQ ID NO: 6483518 - DNA, 15 bp, Homo sapiens
tgaaatctgctagaa

SEQ ID NO: 6483519 - DNA, 20 bp, Homo sapiens
tgaaatctgctagaaagtta

SEQ ID NO: 6483520 - DNA, 14 bp, Homo sapiens
tgaaatctgctctg

SEQ ID NO: 6483521 - DNA, 20 bp, Homo sapiens
tgaaatctgctctgtacatc

SEQ ID NO: 6483522 - DNA, 13 bp, Homo sapiens
tgaaatctgtctt

SEQ ID NO: 6483523 - DNA, 13 bp, Homo sapiens
tgaaatctgtgca

SEQ ID NO: 6483524 - DNA, 18 bp, Homo sapiens
tgaaatctgtgcaataaa

SEQ ID NO: 6483525 - DNA, 15 bp, Homo sapiens
tgaaatcttcccagt

SEQ ID NO: 6483526 - DNA, 20 bp, Homo sapiens
tgaaatcttgtaagtattta

SEQ ID NO: 6483527 - DNA, 21 bp, Homo sapiens
tgaaatcttgtttgttactgt

SEQ ID NO: 6483528 - DNA, 22 bp, Homo sapiens
tgaaatcttgtttgttactgtc

SEQ ID NO: 6483529 - DNA, 12 bp, Homo sapiens
tgaaatctttct

SEQ ID NO: 6483530 - DNA, 13 bp, Homo sapiens
tgaaatgaaagaa

SEQ ID NO: 6483531 - DNA, 15 bp, Homo sapiens
tgaaatgaaagaact

SEQ ID NO: 6483532 - DNA, 14 bp, Homo sapiens
tgaaatgaaaggga

SEQ ID NO: 6483533 - DNA, 16 bp, Homo sapiens
tgaaatgaaatcttcc

SEQ ID NO: 6483534 - DNA, 17 bp, Homo sapiens
tgaaatgaaatttaaac

SEQ ID NO: 6483535 - DNA, 18 bp, Homo sapiens
tgaaatgaacacaaatta

SEQ ID NO: 6483536 - DNA, 13 bp, Homo sapiens
tgaaatgaacttt

SEQ ID NO: 6483537 - DNA, 17 bp, Homo sapiens
tgaaatgaactttgtca

SEQ ID NO: 6483538 - DNA, 17 bp, Homo sapiens
tgaaatgacagaatgct

SEQ ID NO: 6483539 - DNA, 16 bp, Homo sapiens
tgaaatgaccaagaca

SEQ ID NO: 6483540 - DNA, 17 bp, Homo sapiens
tgaaatgacctctgtcc

SEQ ID NO: 6483541 - DNA, 17 bp, Homo sapiens
tgaaatgaggtctgttt

SEQ ID NO: 6483542 - DNA, 19 bp, Homo sapiens
tgaaatgaggtctgtttaa

SEQ ID NO: 6483543 - DNA, 18 bp, Homo sapiens
tgaaatgagtaaaaacta

SEQ ID NO: 6483544 - DNA, 17 bp, Homo sapiens
tgaaatgagttggccag

SEQ ID NO: 6483545 - DNA, 21 bp, Homo sapiens
tgaaatgatagatttgacctc

SEQ ID NO: 6483546 - DNA, 14 bp, Homo sapiens
tgaaatgcactgta

SEQ ID NO: 6483547 - DNA, 22 bp, Homo sapiens
tgaaatgcactgtattgctcct

SEQ ID NO: 6483548 - DNA, 13 bp, Homo sapiens
tgaaatgcatatt

SEQ ID NO: 6483549 - DNA, 20 bp, Homo sapiens
tgaaatgcatcaggtccttt

SEQ ID NO: 6483550 - DNA, 14 bp, Homo sapiens
tgaaatgcattttg

SEQ ID NO: 6483551 - DNA, 21 bp, Homo sapiens
tgaaatgcattttgctagaca

SEQ ID NO: 6483552 - DNA, 14 bp, Homo sapiens
tgaaatgccaaagg

SEQ ID NO: 6483553 - DNA, 15 bp, Homo sapiens
tgaaatgccaaagga

SEQ ID NO: 6483554 - DNA, 14 bp, Homo sapiens
tgaaatgccaagtg

SEQ ID NO: 6483555 - DNA, 17 bp, Homo sapiens
tgaaatgccctcctaaa

SEQ ID NO: 6483556 - DNA, 17 bp, Homo sapiens
tgaaatgcctgctttga

SEQ ID NO: 6483557 - DNA, 14 bp, Homo sapiens
tgaaatgccttact

SEQ ID NO: 6483558 - DNA, 15 bp, Homo sapiens
tgaaatgccttactt

SEQ ID NO: 6483559 - DNA, 19 bp, Homo sapiens
tgaaatgccttactttgta

SEQ ID NO: 6483560 - DNA, 24 bp, Homo sapiens
tgaaatgccttactttgtatgata

SEQ ID NO: 6483561 - DNA, 15 bp, Homo sapiens
tgaaatgctaaactt

SEQ ID NO: 6483562 - DNA, 20 bp, Homo sapiens
tgaaatgctcttttgcacaa

SEQ ID NO: 6483563 - DNA, 21 bp, Homo sapiens
tgaaatgctcttttgcacaag

SEQ ID NO: 6483564 - DNA, 15 bp, Homo sapiens
tgaaatgctgaaaat

SEQ ID NO: 6483565 - DNA, 16 bp, Homo sapiens
tgaaatgctgaaaatt

SEQ ID NO: 6483566 - DNA, 12 bp, Homo sapiens
tgaaatgctgta

SEQ ID NO: 6483567 - DNA, 23 bp, Homo sapiens
tgaaatgctgtatttttacagct

SEQ ID NO: 6483568 - DNA, 22 bp, Homo sapiens
tgaaatgcttatgcttgtgtat

SEQ ID NO: 6483569 - DNA, 21 bp, Homo sapiens
tgaaatggatagattgtttta

SEQ ID NO: 6483570 - DNA, 19 bp, Homo sapiens
tgaaatgggaacaatatca

SEQ ID NO: 6483571 - DNA, 15 bp, Homo sapiens
tgaaatgggctttaa

SEQ ID NO: 6483572 - DNA, 20 bp, Homo sapiens
tgaaatgtaaggctgtgtaa

SEQ ID NO: 6483573 - DNA, 17 bp, Homo sapiens
tgaaatgtaatttcagt

SEQ ID NO: 6483574 - DNA, 19 bp, Homo sapiens
tgaaatgtaatttcagttc

SEQ ID NO: 6483575 - DNA, 22 bp, Homo sapiens
tgaaatgtaccatcaaatgtta

SEQ ID NO: 6483576 - DNA, 20 bp, Homo sapiens
tgaaatgtagaattgaaaat

SEQ ID NO: 6483577 - DNA, 22 bp, Homo sapiens
tgaaatgtcacgtactgtctga

SEQ ID NO: 6483578 - DNA, 17 bp, Homo sapiens
tgaaatgtcagttctga

SEQ ID NO: 6483579 - DNA, 22 bp, Homo sapiens
tgaaatgtcccctcaaactcat

SEQ ID NO: 6483580 - DNA, 23 bp, Homo sapiens
tgaaatgtcccctcaaactcatt

SEQ ID NO: 6483581 - DNA, 10 bp, Homo sapiens
tgaaatgtct

SEQ ID NO: 6483582 - DNA, 18 bp, Homo sapiens
tgaaatgtggatgtgatt

SEQ ID NO: 6483583 - DNA, 19 bp, Homo sapiens
tgaaatgtggttttcctga

SEQ ID NO: 6483584 - DNA, 22 bp, Homo sapiens
tgaaatgtgtgtgatgtgacat

SEQ ID NO: 6483585 - DNA, 16 bp, Homo sapiens
tgaaatgtgtttcctt

SEQ ID NO: 6483586 - DNA, 23 bp, Homo sapiens
tgaaatgtgtttccttttcagga

SEQ ID NO: 6483587 - DNA, 21 bp, Homo sapiens
tgaaatgttagtcattgttat

SEQ ID NO: 6483588 - DNA, 16 bp, Homo sapiens
tgaaatgttctgttca

SEQ ID NO: 6483589 - DNA, 19 bp, Homo sapiens
tgaaatgttctgttcaccc

SEQ ID NO: 6483590 - DNA, 19 bp, Homo sapiens
tgaaatgtttaataaagct

SEQ ID NO: 6483591 - DNA, 21 bp, Homo sapiens
tgaaatgtttaataaagcttt

SEQ ID NO: 6483592 - DNA, 13 bp, Homo sapiens
tgaaatgtttcac

SEQ ID NO: 6483593 - DNA, 13 bp, Homo sapiens
tgaaatgtttcct

SEQ ID NO: 6483594 - DNA, 21 bp, Homo sapiens
tgaaatgtttggattctctta

SEQ ID NO: 6483595 - DNA, 17 bp, Homo sapiens
tgaaatgtttttaatgt

SEQ ID NO: 6483596 - DNA, 18 bp, Homo sapiens
tgaaattaaatgccactt

SEQ ID NO: 6483597 - DNA, 20 bp, Homo sapiens
tgaaattaacaagaactcat

SEQ ID NO: 6483598 - DNA, 23 bp, Homo sapiens
tgaaattaacaagaactcattat

SEQ ID NO: 6483599 - DNA, 19 bp, Homo sapiens
tgaaattaacacaaaggaa

SEQ ID NO: 6483600 - DNA, 18 bp, Homo sapiens
tgaaattaaccatagatg

SEQ ID NO: 6483601 - DNA, 22 bp, Homo sapiens
tgaaattaaccatagatgtaga

SEQ ID NO: 6483602 - DNA, 17 bp, Homo sapiens
tgaaattaacctctcac

SEQ ID NO: 6483603 - DNA, 19 bp, Homo sapiens
tgaaattaagcattttgaa

SEQ ID NO: 6483604 - DNA, 14 bp, Homo sapiens
tgaaattaatttgt

SEQ ID NO: 6483605 - DNA, 17 bp, Homo sapiens
tgaaattaatttgtgaa

SEQ ID NO: 6483606 - DNA, 18 bp, Homo sapiens
tgaaattaatttgtgaat

SEQ ID NO: 6483607 - DNA, 14 bp, Homo sapiens
tgaaattactgaaa

SEQ ID NO: 6483608 - DNA, 19 bp, Homo sapiens
tgaaattactgtgtaaata

SEQ ID NO: 6483609 - DNA, 19 bp, Homo sapiens
tgaaattacttatcatcca

SEQ ID NO: 6483610 - DNA, 22 bp, Homo sapiens
tgaaattacttatcatccacat

SEQ ID NO: 6483611 - DNA, 13 bp, Homo sapiens
tgaaattacttta

SEQ ID NO: 6483612 - DNA, 20 bp, Homo sapiens
tgaaattactttaacatttt

SEQ ID NO: 6483613 - DNA, 22 bp, Homo sapiens
tgaaattactttaacattttgg

SEQ ID NO: 6483614 - DNA, 18 bp, Homo sapiens
tgaaattagccagggtgg

SEQ ID NO: 6483615 - DNA, 22 bp, Homo sapiens
tgaaattaggaaagtactgcat

SEQ ID NO: 6483616 - DNA, 19 bp, Homo sapiens
tgaaattaggccttatgta

SEQ ID NO: 6483617 - DNA, 17 bp, Homo sapiens
tgaaattagtattttga

SEQ ID NO: 6483618 - DNA, 17 bp, Homo sapiens
tgaaattagtgttttca

SEQ ID NO: 6483619 - DNA, 23 bp, Homo sapiens
tgaaattataactattacagtgt

SEQ ID NO: 6483620 - DNA, 18 bp, Homo sapiens
tgaaattatagtttcaag

SEQ ID NO: 6483621 - DNA, 21 bp, Homo sapiens
tgaaattatagtttcaagcca

SEQ ID NO: 6483622 - DNA, 14 bp, Homo sapiens
tgaaattatatctg

SEQ ID NO: 6483623 - DNA, 17 bp, Homo sapiens
tgaaattatgtatgttt

SEQ ID NO: 6483624 - DNA, 21 bp, Homo sapiens
tgaaattatgtatgtttacat

SEQ ID NO: 6483625 - DNA, 20 bp, Homo sapiens
tgaaattatgtgacatttta

SEQ ID NO: 6483626 - DNA, 22 bp, Homo sapiens
tgaaattatgtgacattttaca

SEQ ID NO: 6483627 - DNA, 18 bp, Homo sapiens
tgaaattattttctccaa

SEQ ID NO: 6483628 - DNA, 16 bp, Homo sapiens
tgaaattcaaaatgct

SEQ ID NO: 6483629 - DNA, 22 bp, Homo sapiens
tgaaattcaggatgctgtgata

SEQ ID NO: 6483630 - DNA, 19 bp, Homo sapiens
tgaaattccaaagtctcta

SEQ ID NO: 6483631 - DNA, 15 bp, Homo sapiens
tgaaattccagatga

SEQ ID NO: 6483632 - DNA, 15 bp, Homo sapiens
tgaaattccagcaat

SEQ ID NO: 6483633 - DNA, 21 bp, Homo sapiens
tgaaattccagcaataagaaa

SEQ ID NO: 6483634 - DNA, 13 bp, Homo sapiens
tgaaattccagtt

SEQ ID NO: 6483635 - DNA, 15 bp, Homo sapiens
tgaaattccatttgt

SEQ ID NO: 6483636 - DNA, 23 bp, Homo sapiens
tgaaattctaaagagcacttact

SEQ ID NO: 6483637 - DNA, 14 bp, Homo sapiens
tgaaattctcagag

SEQ ID NO: 6483638 - DNA, 14 bp, Homo sapiens
tgaaattctgaatt

SEQ ID NO: 6483639 - DNA, 21 bp, Homo sapiens
tgaaattctgaatttgcaaag

SEQ ID NO: 6483640 - DNA, 16 bp, Homo sapiens
tgaaattcttgaagtt

SEQ ID NO: 6483641 - DNA, 16 bp, Homo sapiens
tgaaattgaaaagtta

SEQ ID NO: 6483642 - DNA, 18 bp, Homo sapiens
tgaaattgaaaagttatt

SEQ ID NO: 6483643 - DNA, 13 bp, Homo sapiens
tgaaattgaacct

SEQ ID NO: 6483644 - DNA, 17 bp, Homo sapiens
tgaaattgcatactttg

SEQ ID NO: 6483645 - DNA, 12 bp, Homo sapiens
tgaaattgcctg

SEQ ID NO: 6483646 - DNA, 12 bp, Homo sapiens
tgaaattggtgg

SEQ ID NO: 6483647 - DNA, 12 bp, Homo sapiens
tgaaattgtaaa

SEQ ID NO: 6483648 - DNA, 15 bp, Homo sapiens
tgaaattgtaattat

SEQ ID NO: 6483649 - DNA, 22 bp, Homo sapiens
tggaggttgctgtacaggaaaa

SEQ ID NO: 6483650 - DNA, 23 bp, Homo sapiens
tggaggttgggaggtccaaggtc

SEQ ID NO: 6483651 - DNA, 16 bp, Homo sapiens
tggagtaattgcacat

SEQ ID NO: 6483652 - DNA, 18 bp, Homo sapiens
tggagtagacccctggct

SEQ ID NO: 6483653 - DNA, 22 bp, Homo sapiens
tggagtagcctggactgtttca

SEQ ID NO: 6483654 - DNA, 17 bp, Homo sapiens
tggagtaggcctggggc

SEQ ID NO: 6483655 - DNA, 16 bp, Homo sapiens
tggagtataatattca

SEQ ID NO: 6483656 - DNA, 18 bp, Homo sapiens
tggagtatgtctgatgga

SEQ ID NO: 6483657 - DNA, 19 bp, Homo sapiens
tggagtattattattttaa

SEQ ID NO: 6483658 - DNA, 22 bp, Homo sapiens
tggagtcacatcagtgaggagg

SEQ ID NO: 6483659 - DNA, 19 bp, Homo sapiens
tggagtcagacagatgtgg

SEQ ID NO: 6483660 - DNA, 23 bp, Homo sapiens
tggagtcagatgagcaaggacat

SEQ ID NO: 6483661 - DNA, 14 bp, Homo sapiens
tggagtcagcctcg

SEQ ID NO: 6483662 - DNA, 15 bp, Homo sapiens
tggagtcagggctgt

SEQ ID NO: 6483663 - DNA, 17 bp, Homo sapiens
tggagtcatttctgatt

SEQ ID NO: 6483664 - DNA, 22 bp, Homo sapiens
tggagtccagacctgggccctg

SEQ ID NO: 6483665 - DNA, 23 bp, Homo sapiens
tggagtccagacctgggccctgg

SEQ ID NO: 6483666 - DNA, 13 bp, Homo sapiens
tggagtccagctc

SEQ ID NO: 6483667 - DNA, 14 bp, Homo sapiens
tggagtccagctct

SEQ ID NO: 6483668 - DNA, 13 bp, Homo sapiens
tggagtccagtgc

SEQ ID NO: 6483669 - DNA, 13 bp, Homo sapiens
tggagtcccaccc

SEQ ID NO: 6483670 - DNA, 14 bp, Homo sapiens
tggagtcccacccg

SEQ ID NO: 6483671 - DNA, 15 bp, Homo sapiens
tggagtcccacccgg

SEQ ID NO: 6483672 - DNA, 21 bp, Homo sapiens
tggagtcccaggggcagccac

SEQ ID NO: 6483673 - DNA, 23 bp, Homo sapiens
tggagtcccaggggcagccacac

SEQ ID NO: 6483674 - DNA, 14 bp, Homo sapiens
tggagtcccctcac

SEQ ID NO: 6483675 - DNA, 16 bp, Homo sapiens
tggagtcccttttcat

SEQ ID NO: 6483676 - DNA, 13 bp, Homo sapiens
tggagtcctctcc

SEQ ID NO: 6483677 - DNA, 23 bp, Homo sapiens
tggagtcctctccagagaggctc

SEQ ID NO: 6483678 - DNA, 22 bp, Homo sapiens
tggagtcctgttctcagagctc

SEQ ID NO: 6483679 - DNA, 23 bp, Homo sapiens
tggagtcctgttctcagagctcc

SEQ ID NO: 6483680 - DNA, 16 bp, Homo sapiens
tggagtcggagtggac

SEQ ID NO: 6483681 - DNA, 20 bp, Homo sapiens
tggagtcgtgggaaggaggg

SEQ ID NO: 6483682 - DNA, 17 bp, Homo sapiens
tggagtctcaaaatcaa

SEQ ID NO: 6483683 - DNA, 16 bp, Homo sapiens
tggagtctcactcttg

SEQ ID NO: 6483684 - DNA, 15 bp, Homo sapiens
tggagtctcagagca

SEQ ID NO: 6483685 - DNA, 17 bp, Homo sapiens
tggagtctccagtggtt

SEQ ID NO: 6483686 - DNA, 15 bp, Homo sapiens
tggagtctccctctg

SEQ ID NO: 6483687 - DNA, 13 bp, Homo sapiens
tggagtctcgctc

SEQ ID NO: 6483688 - DNA, 19 bp, Homo sapiens
tggagtctcgctctgctgc

SEQ ID NO: 6483689 - DNA, 20 bp, Homo sapiens
tggagtctgaaggagaggag

SEQ ID NO: 6483690 - DNA, 23 bp, Homo sapiens
tggagtctgaaggagaggagtgc

SEQ ID NO: 6483691 - DNA, 16 bp, Homo sapiens
tggagtctgagtctga

SEQ ID NO: 6483692 - DNA, 17 bp, Homo sapiens
tggagtctgccacccag

SEQ ID NO: 6483693 - DNA, 15 bp, Homo sapiens
tggagtctgggctcc

SEQ ID NO: 6483694 - DNA, 14 bp, Homo sapiens
tggagtcttcctgt

SEQ ID NO: 6483695 - DNA, 18 bp, Homo sapiens
tggagtcttcctgtagtg

SEQ ID NO: 6483696 - DNA, 16 bp, Homo sapiens
tggagtcttgtgaaag

SEQ ID NO: 6483697 - DNA, 16 bp, Homo sapiens
tggagtcttttctgtt

SEQ ID NO: 6483698 - DNA, 16 bp, Homo sapiens
tggagtgaaattattt

SEQ ID NO: 6483699 - DNA, 18 bp, Homo sapiens
tggagtgaagcatttaaa

SEQ ID NO: 6483700 - DNA, 16 bp, Homo sapiens
tggagtgaatgaagtt

SEQ ID NO: 6483701 - DNA, 13 bp, Homo sapiens
tggagtgagactg

SEQ ID NO: 6483702 - DNA, 18 bp, Homo sapiens
tggagtgagagcctttgc

SEQ ID NO: 6483703 - DNA, 19 bp, Homo sapiens
tggagtgagagcctttgcc

SEQ ID NO: 6483704 - DNA, 21 bp, Homo sapiens
tggagtgagagcctttgcctt

SEQ ID NO: 6483705 - DNA, 15 bp, Homo sapiens
tggagtgagaggccc

SEQ ID NO: 6483706 - DNA, 16 bp, Homo sapiens
tggagtgagaggcccc

SEQ ID NO: 6483707 - DNA, 17 bp, Homo sapiens
tggagtgagaggccccc

SEQ ID NO: 6483708 - DNA, 12 bp, Homo sapiens
tggagtgagatc

SEQ ID NO: 6483709 - DNA, 20 bp, Homo sapiens
tggagtgaggcttccaggct

SEQ ID NO: 6483710 - DNA, 22 bp, Homo sapiens
tggagtgaggcttccaggctct

SEQ ID NO: 6483711 - DNA, 19 bp, Homo sapiens
tggagtgagggcctcagag

SEQ ID NO: 6483712 - DNA, 18 bp, Homo sapiens
tggagtgagtcacctgct

SEQ ID NO: 6483713 - DNA, 23 bp, Homo sapiens
tggagtgagtcacctgctccaga

SEQ ID NO: 6483714 - DNA, 14 bp, Homo sapiens
tggagtgatagcta

SEQ ID NO: 6483715 - DNA, 18 bp, Homo sapiens
tggagtgatctcagctca

SEQ ID NO: 6483716 - DNA, 15 bp, Homo sapiens
tggagtgattctaga

SEQ ID NO: 6483717 - DNA, 16 bp, Homo sapiens
tggagtgcaaaaggct

SEQ ID NO: 6483718 - DNA, 17 bp, Homo sapiens
tggagtgcaatgacaca

SEQ ID NO: 6483719 - DNA, 16 bp, Homo sapiens
tggagtgcaccaaaga

SEQ ID NO: 6483720 - DNA, 15 bp, Homo sapiens
tggagtgcagggagg

SEQ ID NO: 6483721 - DNA, 17 bp, Homo sapiens
tggagtgcagggaggag

SEQ ID NO: 6483722 - DNA, 13 bp, Homo sapiens
tggagtgcagtgg

SEQ ID NO: 6483723 - DNA, 16 bp, Homo sapiens
tggagtgcagtggcac

SEQ ID NO: 6483724 - DNA, 19 bp, Homo sapiens
tggagtgccatggctgggg

SEQ ID NO: 6483725 - DNA, 22 bp, Homo sapiens
tggagtgccccaaggaggtggc

SEQ ID NO: 6483726 - DNA, 20 bp, Homo sapiens
tggagtgccctgcaggcaca

SEQ ID NO: 6483727 - DNA, 15 bp, Homo sapiens
tggagtgcgctcttg

SEQ ID NO: 6483728 - DNA, 22 bp, Homo sapiens
tggagtgcgctcttggtccctg

SEQ ID NO: 6483729 - DNA, 23 bp, Homo sapiens
tggagtgctcttcccactccagc

SEQ ID NO: 6483730 - DNA, 13 bp, Homo sapiens
tggagtgctgcag

SEQ ID NO: 6483731 - DNA, 14 bp, Homo sapiens
tggagtgctgcagc

SEQ ID NO: 6483732 - DNA, 15 bp, Homo sapiens
tggagtgctgcagct

SEQ ID NO: 6483733 - DNA, 17 bp, Homo sapiens
tggagtgctgttttgtt

SEQ ID NO: 6483734 - DNA, 15 bp, Homo sapiens
tggagtgcttaaaaa

SEQ ID NO: 6483735 - DNA, 16 bp, Homo sapiens
tggagtgcttgtttac

SEQ ID NO: 6483736 - DNA, 19 bp, Homo sapiens
tggagtggcagcccagcca

SEQ ID NO: 6483737 - DNA, 22 bp, Homo sapiens
tggagtggccaaataggaggga

SEQ ID NO: 6483738 - DNA, 14 bp, Homo sapiens
tggagtggccactg

SEQ ID NO: 6483739 - DNA, 19 bp, Homo sapiens
tggagtggccactggcact

SEQ ID NO: 6483740 - DNA, 13 bp, Homo sapiens
tggagtggggcag

SEQ ID NO: 6483741 - DNA, 16 bp, Homo sapiens
tggagtggggcagtag

SEQ ID NO: 6483742 - DNA, 17 bp, Homo sapiens
tggagtggggcagtaga

SEQ ID NO: 6483743 - DNA, 13 bp, Homo sapiens
tggagtgtaaacc

SEQ ID NO: 6483744 - DNA, 17 bp, Homo sapiens
tggagtgtatgactgca

SEQ ID NO: 6483745 - DNA, 19 bp, Homo sapiens
tggagtgtatgactgcaca

SEQ ID NO: 6483746 - DNA, 12 bp, Homo sapiens
tggagtgtcacc

SEQ ID NO: 6483747 - DNA, 20 bp, Homo sapiens
tggagtgtcggatcctgtga

SEQ ID NO: 6483748 - DNA, 21 bp, Homo sapiens
tggagtgtgagggtcctgcag

SEQ ID NO: 6483749 - DNA, 16 bp, Homo sapiens
tggagtgtgcagacag

SEQ ID NO: 6483750 - DNA, 18 bp, Homo sapiens
tggagtgtgcagacagcc

SEQ ID NO: 6483751 - DNA, 18 bp, Homo sapiens
tggagtgtgcgtgtgtgc

SEQ ID NO: 6483752 - DNA, 15 bp, Homo sapiens
tggagtgtgtattgt

SEQ ID NO: 6483753 - DNA, 17 bp, Homo sapiens
tggagtgtgtcagagcc

SEQ ID NO: 6483754 - DNA, 20 bp, Homo sapiens
tggagtgtgtgggggtctgg

SEQ ID NO: 6483755 - DNA, 24 bp, Homo sapiens
tggagtgtttctaataaacttgga

SEQ ID NO: 6483756 - DNA, 14 bp, Homo sapiens
tggagtgtttgaaa

SEQ ID NO: 6483757 - DNA, 18 bp, Homo sapiens
tggagtgtttgaaaactg

SEQ ID NO: 6483758 - DNA, 22 bp, Homo sapiens
tggagtgtttgacgaagaaaca

SEQ ID NO: 6483759 - DNA, 20 bp, Homo sapiens
tggagtgttttagttcttgg

SEQ ID NO: 6483760 - DNA, 20 bp, Homo sapiens
tggagttacattaatgttaa

SEQ ID NO: 6483761 - DNA, 13 bp, Homo sapiens
tggagttatgagg

SEQ ID NO: 6483762 - DNA, 23 bp, Homo sapiens
tggagttattcactctcccagag

SEQ ID NO: 6483763 - DNA, 14 bp, Homo sapiens
tggagttcaccttg

SEQ ID NO: 6483764 - DNA, 17 bp, Homo sapiens
tggagttcaccttggaa

SEQ ID NO: 6483765 - DNA, 18 bp, Homo sapiens
tggagttcattcatatta

SEQ ID NO: 6483766 - DNA, 23 bp, Homo sapiens
tggagttccggcctgggcaccag

SEQ ID NO: 6483767 - DNA, 19 bp, Homo sapiens
tggagttcctcatcagtgt

SEQ ID NO: 6483768 - DNA, 14 bp, Homo sapiens
tggagttccttatc

SEQ ID NO: 6483769 - DNA, 15 bp, Homo sapiens
tggagttcttgtgcc

SEQ ID NO: 6483770 - DNA, 14 bp, Homo sapiens
tggagttgaaaatc

SEQ ID NO: 6483771 - DNA, 22 bp, Homo sapiens
tggagttgaaagagttaagaat

SEQ ID NO: 6483772 - DNA, 16 bp, Homo sapiens
tggagttggcagacag

SEQ ID NO: 6483773 - DNA, 20 bp, Homo sapiens
tggagttgttttaacagatg

SEQ ID NO: 6483774 - DNA, 17 bp, Homo sapiens
tggagtttacaaagata

SEQ ID NO: 6483775 - DNA, 13 bp, Homo sapiens
tggagtttctaag

SEQ ID NO: 6483776 - DNA, 16 bp, Homo sapiens
tggagtttctaaggtc

SEQ ID NO: 6483777 - DNA, 14 bp, Homo sapiens
tggagtttctctaa

SEQ ID NO: 6483778 - DNA, 12 bp, Homo sapiens
tggagttttata

SEQ ID NO: 6483779 - DNA, 16 bp, Homo sapiens
tggagttttataaatt

SEQ ID NO: 6483780 - DNA, 17 bp, Homo sapiens
tggagttttataaatta

SEQ ID NO: 6483781 - DNA, 19 bp, Homo sapiens
tggagttttatttttaaga

SEQ ID NO: 6483782 - DNA, 20 bp, Homo sapiens
tggagttttatttttaagaa

SEQ ID NO: 6483783 - DNA, 21 bp, Homo sapiens
tggagttttcaggctatcata

SEQ ID NO: 6483784 - DNA, 14 bp, Homo sapiens
tggagttttcatga

SEQ ID NO: 6483785 - DNA, 20 bp, Homo sapiens
tggagttttgtttcctctgt

SEQ ID NO: 6483786 - DNA, 22 bp, Homo sapiens
tggagtttttgtttggagagca

SEQ ID NO: 6483787 - DNA, 23 bp, Homo sapiens
tggagtttttgtttggagagcac

SEQ ID NO: 6483788 - DNA, 17 bp, Homo sapiens
tggataaaactgtgtaa

SEQ ID NO: 6483789 - DNA, 20 bp, Homo sapiens
tggataaaactgtgtaaacc

SEQ ID NO: 6483790 - DNA, 21 bp, Homo sapiens
tggataaaccaccctctgggg

SEQ ID NO: 6483791 - DNA, 14 bp, Homo sapiens
tggataaactgagc

SEQ ID NO: 6483792 - DNA, 14 bp, Homo sapiens
tggataaatcattt

SEQ ID NO: 6483793 - DNA, 18 bp, Homo sapiens
tggataaatcatttcagt

SEQ ID NO: 6483794 - DNA, 17 bp, Homo sapiens
tggataaattgtttagt

SEQ ID NO: 6483795 - DNA, 15 bp, Homo sapiens
tggataaatttgaac

SEQ ID NO: 6483796 - DNA, 14 bp, Homo sapiens
tggataaccaggct

SEQ ID NO: 6483797 - DNA, 15 bp, Homo sapiens
tggataactagccag

SEQ ID NO: 6483798 - DNA, 16 bp, Homo sapiens
tggataacttccacag

SEQ ID NO: 6483799 - DNA, 21 bp, Homo sapiens
tggataacttccacagggtcc

SEQ ID NO: 6483800 - DNA, 12 bp, Homo sapiens
tggataagaaaa

SEQ ID NO: 6483801 - DNA, 19 bp, Homo sapiens
tggataagatgatgttaaa

SEQ ID NO: 6483802 - DNA, 14 bp, Homo sapiens
tggataagcgtggg

SEQ ID NO: 6483803 - DNA, 15 bp, Homo sapiens
tggataagtggctgt

SEQ ID NO: 6483804 - DNA, 19 bp, Homo sapiens
tggataagtggctgtttca

SEQ ID NO: 6483805 - DNA, 20 bp, Homo sapiens
tggataagtggctgtttcat

SEQ ID NO: 6483806 - DNA, 23 bp, Homo sapiens
tggataataaagatactagagaa

SEQ ID NO: 6483807 - DNA, 14 bp, Homo sapiens
tggataataggaat

SEQ ID NO: 6483808 - DNA, 16 bp, Homo sapiens
tggataataggaattc

SEQ ID NO: 6483809 - DNA, 19 bp, Homo sapiens
tggataatattcattggtt

SEQ ID NO: 6483810 - DNA, 16 bp, Homo sapiens
tggataatcaggaaaa

SEQ ID NO: 6483811 - DNA, 14 bp, Homo sapiens
tggataatctgagc

SEQ ID NO: 6483812 - DNA, 16 bp, Homo sapiens
tggataatgtgtataa

SEQ ID NO: 6483813 - DNA, 22 bp, Homo sapiens
tggatacaccgaatgaccaggt

SEQ ID NO: 6483814 - DNA, 14 bp, Homo sapiens
tggatacagctgct

SEQ ID NO: 6483815 - DNA, 15 bp, Homo sapiens
tggatacagtgccca

SEQ ID NO: 6483816 - DNA, 15 bp, Homo sapiens
tggatacctgtgtgt

SEQ ID NO: 6483817 - DNA, 19 bp, Homo sapiens
tggatacgacaacttgcac

SEQ ID NO: 6483818 - DNA, 22 bp, Homo sapiens
tggatacgggggttccctttcc

SEQ ID NO: 6483819 - DNA, 16 bp, Homo sapiens
tggatactatatgata

SEQ ID NO: 6483820 - DNA, 19 bp, Homo sapiens
tggatactccatggggtgg

SEQ ID NO: 6483821 - DNA, 12 bp, Homo sapiens
tggatactgtac

SEQ ID NO: 6483822 - DNA, 15 bp, Homo sapiens
tggatacttggattt

SEQ ID NO: 6483823 - DNA, 13 bp, Homo sapiens
tggatagaaaaaa

SEQ ID NO: 6483824 - DNA, 19 bp, Homo sapiens
tggatagaaaaaaactaaa

SEQ ID NO: 6483825 - DNA, 16 bp, Homo sapiens
tggatagaaaaatgct

SEQ ID NO: 6483826 - DNA, 15 bp, Homo sapiens
tggatagacttggga

SEQ ID NO: 6483827 - DNA, 12 bp, Homo sapiens
tggatagccttg

SEQ ID NO: 6483828 - DNA, 19 bp, Homo sapiens
tgaaattgtaattatatct

SEQ ID NO: 6483829 - DNA, 20 bp, Homo sapiens
tgaaattgtaattatatctg

SEQ ID NO: 6483830 - DNA, 17 bp, Homo sapiens
tgaaattgtacatattt

SEQ ID NO: 6483831 - DNA, 18 bp, Homo sapiens
tgaaattgtagtgcaaaa

SEQ ID NO: 6483832 - DNA, 19 bp, Homo sapiens
tgaaattgtatctcagtct

SEQ ID NO: 6483833 - DNA, 23 bp, Homo sapiens
tgaaattgtttaagtgttgtaaa

SEQ ID NO: 6483834 - DNA, 18 bp, Homo sapiens
tgaaatttaaaaataaag

SEQ ID NO: 6483835 - DNA, 21 bp, Homo sapiens
tgaaatttaaaaataaagcta

SEQ ID NO: 6483836 - DNA, 23 bp, Homo sapiens
tgaaatttaaaaataaagctact

SEQ ID NO: 6483837 - DNA, 22 bp, Homo sapiens
tgaaatttaaaaatctttcaga

SEQ ID NO: 6483838 - DNA, 16 bp, Homo sapiens
tgaaatttaaataata

SEQ ID NO: 6483839 - DNA, 21 bp, Homo sapiens
tgaaatttaaataatagacat

SEQ ID NO: 6483840 - DNA, 17 bp, Homo sapiens
tgaaatttaactgccta

SEQ ID NO: 6483841 - DNA, 12 bp, Homo sapiens
tgaaatttaagc

SEQ ID NO: 6483842 - DNA, 14 bp, Homo sapiens
tgaaatttaagcac

SEQ ID NO: 6483843 - DNA, 16 bp, Homo sapiens
tgaaatttaagcacaa

SEQ ID NO: 6483844 - DNA, 22 bp, Homo sapiens
tgaaatttaatatagctatttt

SEQ ID NO: 6483845 - DNA, 17 bp, Homo sapiens
tgaaatttaattacaaa

SEQ ID NO: 6483846 - DNA, 13 bp, Homo sapiens
tgaaatttacaca

SEQ ID NO: 6483847 - DNA, 16 bp, Homo sapiens
tgaaatttacacagtg

SEQ ID NO: 6483848 - DNA, 12 bp, Homo sapiens
tgaaatttacag

SEQ ID NO: 6483849 - DNA, 22 bp, Homo sapiens
tgaaatttacagtgatagaaca

SEQ ID NO: 6483850 - DNA, 23 bp, Homo sapiens
tgaaatttagtacactatgttct

SEQ ID NO: 6483851 - DNA, 23 bp, Homo sapiens
tgaaatttatacaccaattgatt

SEQ ID NO: 6483852 - DNA, 20 bp, Homo sapiens
tgaaatttattagttaatat

SEQ ID NO: 6483853 - DNA, 21 bp, Homo sapiens
tgaaatttattagttaatata

SEQ ID NO: 6483854 - DNA, 15 bp, Homo sapiens
tgaaatttattgagg

SEQ ID NO: 6483855 - DNA, 23 bp, Homo sapiens
tgaaatttattgaggaaaaatat

SEQ ID NO: 6483856 - DNA, 17 bp, Homo sapiens
tgaaatttatttaatgt

SEQ ID NO: 6483857 - DNA, 20 bp, Homo sapiens
tgaaatttcacttcaggaga

SEQ ID NO: 6483858 - DNA, 22 bp, Homo sapiens
tgaaatttcagattcccagagc

SEQ ID NO: 6483859 - DNA, 12 bp, Homo sapiens
tgaaatttcatg

SEQ ID NO: 6483860 - DNA, 19 bp, Homo sapiens
tgaaatttcctaatttatt

SEQ ID NO: 6483861 - DNA, 15 bp, Homo sapiens
tgaaatttcctggga

SEQ ID NO: 6483862 - DNA, 23 bp, Homo sapiens
tgaaatttcctgggagcttttgt

SEQ ID NO: 6483863 - DNA, 15 bp, Homo sapiens
tgaaatttctagcct

SEQ ID NO: 6483864 - DNA, 13 bp, Homo sapiens
tgaaatttctcag

SEQ ID NO: 6483865 - DNA, 14 bp, Homo sapiens
tgaaatttctcagc

SEQ ID NO: 6483866 - DNA, 16 bp, Homo sapiens
tgaaatttgaattttg

SEQ ID NO: 6483867 - DNA, 17 bp, Homo sapiens
tgaaatttgaattttgt

SEQ ID NO: 6483868 - DNA, 14 bp, Homo sapiens
tgaaatttgcaaaa

SEQ ID NO: 6483869 - DNA, 19 bp, Homo sapiens
tgaaatttgcaaaatcact

SEQ ID NO: 6483870 - DNA, 15 bp, Homo sapiens
tgaaatttgcctctg

SEQ ID NO: 6483871 - DNA, 15 bp, Homo sapiens
tgaaatttgctatat

SEQ ID NO: 6483872 - DNA, 19 bp, Homo sapiens
tgaaatttgtgatggccaa

SEQ ID NO: 6483873 - DNA, 14 bp, Homo sapiens
tgaaatttgttaat

SEQ ID NO: 6483874 - DNA, 18 bp, Homo sapiens
tgaaatttgttaatatat

SEQ ID NO: 6483875 - DNA, 20 bp, Homo sapiens
tgaaatttgttatacttcaa

SEQ ID NO: 6483876 - DNA, 18 bp, Homo sapiens
tgaaatttgtttctgttt

SEQ ID NO: 6483877 - DNA, 15 bp, Homo sapiens
tgaaattttaaaagt

SEQ ID NO: 6483878 - DNA, 17 bp, Homo sapiens
tgaaattttaaactata

SEQ ID NO: 6483879 - DNA, 15 bp, Homo sapiens
tgaaattttaaatgc

SEQ ID NO: 6483880 - DNA, 14 bp, Homo sapiens
tgaaattttaacct

SEQ ID NO: 6483881 - DNA, 18 bp, Homo sapiens
tgaaattttagaaatatt

SEQ ID NO: 6483882 - DNA, 18 bp, Homo sapiens
tgaaattttatatgctta

SEQ ID NO: 6483883 - DNA, 22 bp, Homo sapiens
tgaaattttatatgcttactga

SEQ ID NO: 6483884 - DNA, 12 bp, Homo sapiens
tgaaattttcag

SEQ ID NO: 6483885 - DNA, 20 bp, Homo sapiens
tgaaattttccaatgtctgc

SEQ ID NO: 6483886 - DNA, 22 bp, Homo sapiens
tgaaattttctagaatactaat

SEQ ID NO: 6483887 - DNA, 19 bp, Homo sapiens
tgaaattttctagactttc

SEQ ID NO: 6483888 - DNA, 20 bp, Homo sapiens
tgaaattttcttgatttgag

SEQ ID NO: 6483889 - DNA, 20 bp, Homo sapiens
tgaaattttgcaaatataaa

SEQ ID NO: 6483890 - DNA, 15 bp, Homo sapiens
tgaaatttttaaatc

SEQ ID NO: 6483891 - DNA, 18 bp, Homo sapiens
tgaaatttttaaatcatt

SEQ ID NO: 6483892 - DNA, 12 bp, Homo sapiens
tgaaatttttca

SEQ ID NO: 6483893 - DNA, 20 bp, Homo sapiens
tgaaatttttcatattttaa

SEQ ID NO: 6483894 - DNA, 21 bp, Homo sapiens
tgaaatttttccacactatgt

SEQ ID NO: 6483895 - DNA, 15 bp, Homo sapiens
tgaacaaaaactgta

SEQ ID NO: 6483896 - DNA, 16 bp, Homo sapiens
tgaacaaaaactgtat

SEQ ID NO: 6483897 - DNA, 19 bp, Homo sapiens
tgaacaaaaactgtatgga

SEQ ID NO: 6483898 - DNA, 20 bp, Homo sapiens
tgaacaaaaatgtttccact

SEQ ID NO: 6483899 - DNA, 21 bp, Homo sapiens
tgaacaaaagcaggtttttat

SEQ ID NO: 6483900 - DNA, 13 bp, Homo sapiens
tgaacaaaagggt

SEQ ID NO: 6483901 - DNA, 18 bp, Homo sapiens
tgaacaaaccctttaaat

SEQ ID NO: 6483902 - DNA, 13 bp, Homo sapiens
tgaacaaacctgt

SEQ ID NO: 6483903 - DNA, 13 bp, Homo sapiens
tgaacaaactaaa

SEQ ID NO: 6483904 - DNA, 14 bp, Homo sapiens
tgaacaaagacatt

SEQ ID NO: 6483905 - DNA, 15 bp, Homo sapiens
tgaacaaagaccaat

SEQ ID NO: 6483906 - DNA, 15 bp, Homo sapiens
tgaacaaagcagcca

SEQ ID NO: 6483907 - DNA, 21 bp, Homo sapiens
tgaacaaagggattctccagg

SEQ ID NO: 6483908 - DNA, 17 bp, Homo sapiens
tgaacaaagtgagaaat

SEQ ID NO: 6483909 - DNA, 18 bp, Homo sapiens
tgaacaaagtgagaaatg

SEQ ID NO: 6483910 - DNA, 12 bp, Homo sapiens
tgaacaaagtgc

SEQ ID NO: 6483911 - DNA, 20 bp, Homo sapiens
tgaacaaatcaaattgctta

SEQ ID NO: 6483912 - DNA, 22 bp, Homo sapiens
tgaacaaattctttagtactca

SEQ ID NO: 6483913 - DNA, 21 bp, Homo sapiens
tgaacaaattgaactctttga

SEQ ID NO: 6483914 - DNA, 18 bp, Homo sapiens
tgaacaaatttacagaga

SEQ ID NO: 6483915 - DNA, 14 bp, Homo sapiens
tgaacaaatttcaa

SEQ ID NO: 6483916 - DNA, 16 bp, Homo sapiens
tgaacaaattttctgg

SEQ ID NO: 6483917 - DNA, 12 bp, Homo sapiens
tgaacaacagta

SEQ ID NO: 6483918 - DNA, 18 bp, Homo sapiens
tgaacaacgagccttttc

SEQ ID NO: 6483919 - DNA, 19 bp, Homo sapiens
tgaacaacgagccttttca

SEQ ID NO: 6483920 - DNA, 15 bp, Homo sapiens
tgaacaactggaaat

SEQ ID NO: 6483921 - DNA, 24 bp, Homo sapiens
tgaacaagaaattggtattatcaa

SEQ ID NO: 6483922 - DNA, 23 bp, Homo sapiens
tgaacaagagaagcattctcatt

SEQ ID NO: 6483923 - DNA, 23 bp, Homo sapiens
tgaacaagatgtgggccttgcaa

SEQ ID NO: 6483924 - DNA, 15 bp, Homo sapiens
tgaacaagatttccc

SEQ ID NO: 6483925 - DNA, 18 bp, Homo sapiens
tgaacaagatttccctaa

SEQ ID NO: 6483926 - DNA, 20 bp, Homo sapiens
tgaacaagccacgttgcaga

SEQ ID NO: 6483927 - DNA, 21 bp, Homo sapiens
tgaacaaggggcctccaacct

SEQ ID NO: 6483928 - DNA, 15 bp, Homo sapiens
tgaacaagtccctgt

SEQ ID NO: 6483929 - DNA, 23 bp, Homo sapiens
tgaacaagtgggccattagccag

SEQ ID NO: 6483930 - DNA, 19 bp, Homo sapiens
tgaacaagttgtttcattg

SEQ ID NO: 6483931 - DNA, 18 bp, Homo sapiens
tgaacaagttttaatgta

SEQ ID NO: 6483932 - DNA, 21 bp, Homo sapiens
tgaacaataaagtttgctttc

SEQ ID NO: 6483933 - DNA, 19 bp, Homo sapiens
tgaacaataagtaaatcca

SEQ ID NO: 6483934 - DNA, 16 bp, Homo sapiens
tgaacaatcaaagcac

SEQ ID NO: 6483935 - DNA, 17 bp, Homo sapiens
tgaacaatcagattaga

SEQ ID NO: 6483936 - DNA, 23 bp, Homo sapiens
tgaacaatggggactttgttggt

SEQ ID NO: 6483937 - DNA, 14 bp, Homo sapiens
tgaacaatgtatac

SEQ ID NO: 6483938 - DNA, 18 bp, Homo sapiens
tgaacaatgtatacaatg

SEQ ID NO: 6483939 - DNA, 22 bp, Homo sapiens
tgaacaatgtatacaatgcact

SEQ ID NO: 6483940 - DNA, 18 bp, Homo sapiens
tgaacaattgctatttaa

SEQ ID NO: 6483941 - DNA, 20 bp, Homo sapiens
tgaacaattgctatttaaat

SEQ ID NO: 6483942 - DNA, 15 bp, Homo sapiens
tgaacaattgtgttt

SEQ ID NO: 6483943 - DNA, 18 bp, Homo sapiens
tgaacacaaactgtaaat

SEQ ID NO: 6483944 - DNA, 19 bp, Homo sapiens
tgaacacaaatgtgtattt

SEQ ID NO: 6483945 - DNA, 12 bp, Homo sapiens
tgaacacaaatt

SEQ ID NO: 6483946 - DNA, 18 bp, Homo sapiens
tgaacacaattgatactt

SEQ ID NO: 6483947 - DNA, 15 bp, Homo sapiens
tgaacacacaccagt

SEQ ID NO: 6483948 - DNA, 16 bp, Homo sapiens
tgaacacactcagcag

SEQ ID NO: 6483949 - DNA, 14 bp, Homo sapiens
tgaacacagcagac

SEQ ID NO: 6483950 - DNA, 23 bp, Homo sapiens
tgaacacagctgctgaagaggca

SEQ ID NO: 6483951 - DNA, 14 bp, Homo sapiens
tgaacacaggcaaa

SEQ ID NO: 6483952 - DNA, 23 bp, Homo sapiens
tgaacacaggcaaagaggtgctg

SEQ ID NO: 6483953 - DNA, 14 bp, Homo sapiens
tgaacacaggcagc

SEQ ID NO: 6483954 - DNA, 15 bp, Homo sapiens
tgaacacaggcagct

SEQ ID NO: 6483955 - DNA, 17 bp, Homo sapiens
tgaacacaggcagcttt

SEQ ID NO: 6483956 - DNA, 20 bp, Homo sapiens
tgaacacaggcagctttcta

SEQ ID NO: 6483957 - DNA, 12 bp, Homo sapiens
tgaacacagtat

SEQ ID NO: 6483958 - DNA, 17 bp, Homo sapiens
tgaacacagtgtctgtt

SEQ ID NO: 6483959 - DNA, 19 bp, Homo sapiens
tgaacacagtgtctgttca

SEQ ID NO: 6483960 - DNA, 18 bp, Homo sapiens
tgaacacatcagctagca

SEQ ID NO: 6483961 - DNA, 19 bp, Homo sapiens
tgaacacatcagctagcaa

SEQ ID NO: 6483962 - DNA, 13 bp, Homo sapiens
tgaacacatgtgt

SEQ ID NO: 6483963 - DNA, 19 bp, Homo sapiens
tgaacacatgtgtatgata

SEQ ID NO: 6483964 - DNA, 17 bp, Homo sapiens
tgaacaccaacttttat

SEQ ID NO: 6483965 - DNA, 20 bp, Homo sapiens
tgaacaccattgaaggctta

SEQ ID NO: 6483966 - DNA, 15 bp, Homo sapiens
tgaacactagtctgt

SEQ ID NO: 6483967 - DNA, 22 bp, Homo sapiens
tgaacactagtctgtgtaactt

SEQ ID NO: 6483968 - DNA, 18 bp, Homo sapiens
tgaacactccaattaagg

SEQ ID NO: 6483969 - DNA, 16 bp, Homo sapiens
tgaacactgcaccctc

SEQ ID NO: 6483970 - DNA, 23 bp, Homo sapiens
tgaacactgcaccctccacagga

SEQ ID NO: 6483971 - DNA, 22 bp, Homo sapiens
tgaacactgggggaggggacat

SEQ ID NO: 6483972 - DNA, 13 bp, Homo sapiens
tgaacacttataa

SEQ ID NO: 6483973 - DNA, 16 bp, Homo sapiens
tgaacacttggtgctg

SEQ ID NO: 6483974 - DNA, 20 bp, Homo sapiens
tgaacacttttgaaaatgta

SEQ ID NO: 6483975 - DNA, 14 bp, Homo sapiens
tgaacagaatttat

SEQ ID NO: 6483976 - DNA, 22 bp, Homo sapiens
tgaacagactagaagtatttgt

SEQ ID NO: 6483977 - DNA, 15 bp, Homo sapiens
tgaacagagagaacc

SEQ ID NO: 6483978 - DNA, 21 bp, Homo sapiens
tgaacagatgacccctgccca

SEQ ID NO: 6483979 - DNA, 16 bp, Homo sapiens
tgaacagatgtaaatc

SEQ ID NO: 6483980 - DNA, 20 bp, Homo sapiens
tgaacagattgctacacaca

SEQ ID NO: 6483981 - DNA, 23 bp, Homo sapiens
tgaacagattttattaatcacgg

SEQ ID NO: 6483982 - DNA, 16 bp, Homo sapiens
tgaacagcaggatgcc

SEQ ID NO: 6483983 - DNA, 23 bp, Homo sapiens
tgaacagcatggcactccctcca

SEQ ID NO: 6483984 - DNA, 22 bp, Homo sapiens
tgaacagcggctggacttggag

SEQ ID NO: 6483985 - DNA, 19 bp, Homo sapiens
tgaacagctggtgtagcta

SEQ ID NO: 6483986 - DNA, 13 bp, Homo sapiens
tgaacagctgtga

SEQ ID NO: 6483987 - DNA, 17 bp, Homo sapiens
tgaacagctgtgagcca

SEQ ID NO: 6483988 - DNA, 15 bp, Homo sapiens
tgaacagctttgtat

SEQ ID NO: 6483989 - DNA, 15 bp, Homo sapiens
tgaacaggctggggc

SEQ ID NO: 6483990 - DNA, 20 bp, Homo sapiens
tgaacagggcaaaatgaact

SEQ ID NO: 6483991 - DNA, 19 bp, Homo sapiens
tgaacagggcccaggcctg

SEQ ID NO: 6483992 - DNA, 22 bp, Homo sapiens
tgaacagggcccaggcctggag

SEQ ID NO: 6483993 - DNA, 23 bp, Homo sapiens
tgaacagggcccaggcctggagc

SEQ ID NO: 6483994 - DNA, 19 bp, Homo sapiens
tgaacaggggctggtatta

SEQ ID NO: 6483995 - DNA, 18 bp, Homo sapiens
tgaacagggtccctggat

SEQ ID NO: 6483996 - DNA, 18 bp, Homo sapiens
tgaacaggtcaaagatgt

SEQ ID NO: 6483997 - DNA, 17 bp, Homo sapiens
tgaacaggttctccagg

SEQ ID NO: 6483998 - DNA, 20 bp, Homo sapiens
tgaacagtacagtatttaca

SEQ ID NO: 6483999 - DNA, 20 bp, Homo sapiens
tgaacagtactggttacttt

SEQ ID NO: 6484000 - DNA, 20 bp, Homo sapiens
tgaacagtcacgcctgaaac

SEQ ID NO: 6484001 - DNA, 22 bp, Homo sapiens
tgaacagtcacgcctgaaactt

SEQ ID NO: 6484002 - DNA, 15 bp, Homo sapiens
tgaacagtgctctgc

SEQ ID NO: 6484003 - DNA, 16 bp, Homo sapiens
tgaacagtgctctgcc

SEQ ID NO: 6484004 - DNA, 16 bp, Homo sapiens
tggatagtagatctgt

SEQ ID NO: 6484005 - DNA, 23 bp, Homo sapiens
tggatatagctaggtgacatata

SEQ ID NO: 6484006 - DNA, 15 bp, Homo sapiens
tggatatgacccaca

SEQ ID NO: 6484007 - DNA, 19 bp, Homo sapiens
tggatatgtgtaaatgtta

SEQ ID NO: 6484008 - DNA, 20 bp, Homo sapiens
tggatatgttgttaaacacg

SEQ ID NO: 6484009 - DNA, 16 bp, Homo sapiens
tggatattattagaaa

SEQ ID NO: 6484010 - DNA, 19 bp, Homo sapiens
tggatatttatttaaacaa

SEQ ID NO: 6484011 - DNA, 14 bp, Homo sapiens
tggatatttcaatc

SEQ ID NO: 6484012 - DNA, 21 bp, Homo sapiens
tggatatttgcacttatgtac

SEQ ID NO: 6484013 - DNA, 23 bp, Homo sapiens
tggatatttgcacttatgtactt

SEQ ID NO: 6484014 - DNA, 17 bp, Homo sapiens
tggatattttcttaaaa

SEQ ID NO: 6484015 - DNA, 22 bp, Homo sapiens
tggatatttttgtacttgattt

SEQ ID NO: 6484016 - DNA, 24 bp, Homo sapiens
tggatattttttggtgtgccctgt

SEQ ID NO: 6484017 - DNA, 16 bp, Homo sapiens
tggatcaaaaggagaa

SEQ ID NO: 6484018 - DNA, 18 bp, Homo sapiens
tggatcaaccaagttaca

SEQ ID NO: 6484019 - DNA, 19 bp, Homo sapiens
tggatcaagcttgtgtact

SEQ ID NO: 6484020 - DNA, 21 bp, Homo sapiens
tggatcacacctcagtgggaa

SEQ ID NO: 6484021 - DNA, 16 bp, Homo sapiens
tggatcaccattatat

SEQ ID NO: 6484022 - DNA, 17 bp, Homo sapiens
tggatcaccattatatt

SEQ ID NO: 6484023 - DNA, 23 bp, Homo sapiens
tggatcacctgaggtcaggagtt

SEQ ID NO: 6484024 - DNA, 20 bp, Homo sapiens
tggatcagaggtcatccctt

SEQ ID NO: 6484025 - DNA, 14 bp, Homo sapiens
tggatcagccaagg

SEQ ID NO: 6484026 - DNA, 20 bp, Homo sapiens
tggatcaggaacccttacag

SEQ ID NO: 6484027 - DNA, 16 bp, Homo sapiens
tggatcagtcctttga

SEQ ID NO: 6484028 - DNA, 13 bp, Homo sapiens
tggatcatgaggt

SEQ ID NO: 6484029 - DNA, 17 bp, Homo sapiens
tggatcatgaggtcagg

SEQ ID NO: 6484030 - DNA, 18 bp, Homo sapiens
tggatcatgtccccctta

SEQ ID NO: 6484031 - DNA, 22 bp, Homo sapiens
tggatccaatgttagagacttt

SEQ ID NO: 6484032 - DNA, 23 bp, Homo sapiens
tggatccaatgttagagactttt

SEQ ID NO: 6484033 - DNA, 15 bp, Homo sapiens
tggatccagaagcta

SEQ ID NO: 6484034 - DNA, 19 bp, Homo sapiens
tggatccagctctgggagc

SEQ ID NO: 6484035 - DNA, 18 bp, Homo sapiens
tggatccatacaaaacta

SEQ ID NO: 6484036 - DNA, 20 bp, Homo sapiens
tggatccatacaaaactatc

SEQ ID NO: 6484037 - DNA, 21 bp, Homo sapiens
tggatccatcttgagccacag

SEQ ID NO: 6484038 - DNA, 19 bp, Homo sapiens
tggatccccagtgaaaact

SEQ ID NO: 6484039 - DNA, 20 bp, Homo sapiens
tggatccccagtgaaaacta

SEQ ID NO: 6484040 - DNA, 17 bp, Homo sapiens
tggatcccctctgtcta

SEQ ID NO: 6484041 - DNA, 20 bp, Homo sapiens
tggatcccctctgtctacaa

SEQ ID NO: 6484042 - DNA, 18 bp, Homo sapiens
tggatcccctgcggtcag

SEQ ID NO: 6484043 - DNA, 20 bp, Homo sapiens
tggatcccctgcggtcaggc

SEQ ID NO: 6484044 - DNA, 18 bp, Homo sapiens
tggatcccgaagaatgga

SEQ ID NO: 6484045 - DNA, 20 bp, Homo sapiens
tggatcccgttcagaaaacc

SEQ ID NO: 6484046 - DNA, 14 bp, Homo sapiens
tggatccctgccct

SEQ ID NO: 6484047 - DNA, 23 bp, Homo sapiens
tggatccgtttgaccaatttgca

SEQ ID NO: 6484048 - DNA, 19 bp, Homo sapiens
tggatcctcagttctcaaa

SEQ ID NO: 6484049 - DNA, 20 bp, Homo sapiens
tggatcctgaaatagaggct

SEQ ID NO: 6484050 - DNA, 15 bp, Homo sapiens
tggatcctgctgctt

SEQ ID NO: 6484051 - DNA, 20 bp, Homo sapiens
tggatcctgctgtggcctca

SEQ ID NO: 6484052 - DNA, 21 bp, Homo sapiens
tggatcctgctgtggcctcac

SEQ ID NO: 6484053 - DNA, 14 bp, Homo sapiens
tggatcctgggctg

SEQ ID NO: 6484054 - DNA, 16 bp, Homo sapiens
tggatcctgtgtggag

SEQ ID NO: 6484055 - DNA, 14 bp, Homo sapiens
tggatccttccatc

SEQ ID NO: 6484056 - DNA, 18 bp, Homo sapiens
tggatccttgtcagttgt

SEQ ID NO: 6484057 - DNA, 18 bp, Homo sapiens
tggatcgagtgtagctgt

SEQ ID NO: 6484058 - DNA, 22 bp, Homo sapiens
tggatcgctgcacatggcctga

SEQ ID NO: 6484059 - DNA, 18 bp, Homo sapiens
tggatcgtggaagaaggg

SEQ ID NO: 6484060 - DNA, 16 bp, Homo sapiens
tggatctatattttca

SEQ ID NO: 6484061 - DNA, 15 bp, Homo sapiens
tggatctatcacctg

SEQ ID NO: 6484062 - DNA, 18 bp, Homo sapiens
tggatctatcacctgtca

SEQ ID NO: 6484063 - DNA, 21 bp, Homo sapiens
tggatctatcacctgtcatca

SEQ ID NO: 6484064 - DNA, 16 bp, Homo sapiens
tggatctatccctgcg

SEQ ID NO: 6484065 - DNA, 18 bp, Homo sapiens
tggatctatttcatgttt

SEQ ID NO: 6484066 - DNA, 15 bp, Homo sapiens
tggatctccaaggac

SEQ ID NO: 6484067 - DNA, 16 bp, Homo sapiens
tggatctcccagggct

SEQ ID NO: 6484068 - DNA, 15 bp, Homo sapiens
tggatctccccactc

SEQ ID NO: 6484069 - DNA, 22 bp, Homo sapiens
tggatctccttcccttctcttg

SEQ ID NO: 6484070 - DNA, 17 bp, Homo sapiens
tggatctctggttgtct

SEQ ID NO: 6484071 - DNA, 14 bp, Homo sapiens
tggatctcttaaga

SEQ ID NO: 6484072 - DNA, 17 bp, Homo sapiens
tggatctgaccctccca

SEQ ID NO: 6484073 - DNA, 19 bp, Homo sapiens
tggatctgctccatgcaga

SEQ ID NO: 6484074 - DNA, 20 bp, Homo sapiens
tggatctgctccatgcagat

SEQ ID NO: 6484075 - DNA, 15 bp, Homo sapiens
tggatctgcttgttg

SEQ ID NO: 6484076 - DNA, 20 bp, Homo sapiens
tggatctgggaccctttcct

SEQ ID NO: 6484077 - DNA, 11 bp, Homo sapiens
tggatctgggc

SEQ ID NO: 6484078 - DNA, 20 bp, Homo sapiens
tggatcttcagaactgccct

SEQ ID NO: 6484079 - DNA, 22 bp, Homo sapiens
tggatcttcagaactgcccttg

SEQ ID NO: 6484080 - DNA, 23 bp, Homo sapiens
tggatcttcagaactgcccttgc

SEQ ID NO: 6484081 - DNA, 14 bp, Homo sapiens
tggatcttgccaca

SEQ ID NO: 6484082 - DNA, 18 bp, Homo sapiens
tggatcttgccacatttc

SEQ ID NO: 6484083 - DNA, 21 bp, Homo sapiens
tggatcttttactttaaagta

SEQ ID NO: 6484084 - DNA, 21 bp, Homo sapiens
tggatgaaaaatatttctgag

SEQ ID NO: 6484085 - DNA, 22 bp, Homo sapiens
tggatgaagttatctggcttca

SEQ ID NO: 6484086 - DNA, 16 bp, Homo sapiens
tggatgacaaagaaaa

SEQ ID NO: 6484087 - DNA, 19 bp, Homo sapiens
tggatgacagggcagagca

SEQ ID NO: 6484088 - DNA, 13 bp, Homo sapiens
tggatgaccagaa

SEQ ID NO: 6484089 - DNA, 15 bp, Homo sapiens
tggatgacttgctca

SEQ ID NO: 6484090 - DNA, 18 bp, Homo sapiens
tggatgagaaacagctca

SEQ ID NO: 6484091 - DNA, 21 bp, Homo sapiens
tggatgagaaacagctcagcc

SEQ ID NO: 6484092 - DNA, 20 bp, Homo sapiens
tggatgagacttccaaacct

SEQ ID NO: 6484093 - DNA, 15 bp, Homo sapiens
tggatgagccctcag

SEQ ID NO: 6484094 - DNA, 21 bp, Homo sapiens
tggatgaggcttcttcctgga

SEQ ID NO: 6484095 - DNA, 17 bp, Homo sapiens
tggatgatacagtgttt

SEQ ID NO: 6484096 - DNA, 15 bp, Homo sapiens
tggatgatatacaca

SEQ ID NO: 6484097 - DNA, 19 bp, Homo sapiens
tggatgatattttttatca

SEQ ID NO: 6484098 - DNA, 15 bp, Homo sapiens
tggatgatcaatcct

SEQ ID NO: 6484099 - DNA, 12 bp, Homo sapiens
tggatgatgttt

SEQ ID NO: 6484100 - DNA, 18 bp, Homo sapiens
tggatgattaaattttag

SEQ ID NO: 6484101 - DNA, 13 bp, Homo sapiens
tggatgattcttt

SEQ ID NO: 6484102 - DNA, 19 bp, Homo sapiens
tggatgattgttcataata

SEQ ID NO: 6484103 - DNA, 18 bp, Homo sapiens
tggatgattttttaagca

SEQ ID NO: 6484104 - DNA, 22 bp, Homo sapiens
tggatgattttttaagcagact

SEQ ID NO: 6484105 - DNA, 13 bp, Homo sapiens
tggatgcaaagta

SEQ ID NO: 6484106 - DNA, 19 bp, Homo sapiens
tggatgcacagatgccatg

SEQ ID NO: 6484107 - DNA, 16 bp, Homo sapiens
tggatgcacagtgcct

SEQ ID NO: 6484108 - DNA, 17 bp, Homo sapiens
tggatgcacagtgcctg

SEQ ID NO: 6484109 - DNA, 22 bp, Homo sapiens
tggatgcagcctcacagtcctt

SEQ ID NO: 6484110 - DNA, 15 bp, Homo sapiens
tggatgcagtgctcg

SEQ ID NO: 6484111 - DNA, 20 bp, Homo sapiens
tggatgcagtggctcatgcc

SEQ ID NO: 6484112 - DNA, 16 bp, Homo sapiens
tggatgcatcaagaac

SEQ ID NO: 6484113 - DNA, 12 bp, Homo sapiens
tggatgcatttc

SEQ ID NO: 6484114 - DNA, 18 bp, Homo sapiens
tggatgccaaggagcccc

SEQ ID NO: 6484115 - DNA, 19 bp, Homo sapiens
tggatgccaaggagcccct

SEQ ID NO: 6484116 - DNA, 13 bp, Homo sapiens
tggatgccagctg

SEQ ID NO: 6484117 - DNA, 19 bp, Homo sapiens
tggatgccagctgtgtcct

SEQ ID NO: 6484118 - DNA, 13 bp, Homo sapiens
tggatgcctgatt

SEQ ID NO: 6484119 - DNA, 20 bp, Homo sapiens
tggatgcctggtggcagctg

SEQ ID NO: 6484120 - DNA, 21 bp, Homo sapiens
tggatgcctggtggcagctgc

SEQ ID NO: 6484121 - DNA, 12 bp, Homo sapiens
tggatgccttga

SEQ ID NO: 6484122 - DNA, 19 bp, Homo sapiens
tggatgcgaggaccacttt

SEQ ID NO: 6484123 - DNA, 18 bp, Homo sapiens
tggatgctccagggcagc

SEQ ID NO: 6484124 - DNA, 17 bp, Homo sapiens
tggatgctgagctgtga

SEQ ID NO: 6484125 - DNA, 23 bp, Homo sapiens
tggatgctgggttctggggctga

SEQ ID NO: 6484126 - DNA, 13 bp, Homo sapiens
tggatgctgtgct

SEQ ID NO: 6484127 - DNA, 15 bp, Homo sapiens
tggatgctgtgctac

SEQ ID NO: 6484128 - DNA, 18 bp, Homo sapiens
tggatggaacgggcatgg

SEQ ID NO: 6484129 - DNA, 13 bp, Homo sapiens
tggatggaagggg

SEQ ID NO: 6484130 - DNA, 11 bp, Homo sapiens
tggatggacag

SEQ ID NO: 6484131 - DNA, 16 bp, Homo sapiens
tggatggacagaatga

SEQ ID NO: 6484132 - DNA, 13 bp, Homo sapiens
tggatggacagac

SEQ ID NO: 6484133 - DNA, 17 bp, Homo sapiens
tggatggacagacacct

SEQ ID NO: 6484134 - DNA, 16 bp, Homo sapiens
tggatggacagacaga

SEQ ID NO: 6484135 - DNA, 14 bp, Homo sapiens
tggatggacttgta

SEQ ID NO: 6484136 - DNA, 15 bp, Homo sapiens
tggatggaggagaaa

SEQ ID NO: 6484137 - DNA, 16 bp, Homo sapiens
tggatggaggagaaat

SEQ ID NO: 6484138 - DNA, 17 bp, Homo sapiens
tggatggaggagaaata

SEQ ID NO: 6484139 - DNA, 19 bp, Homo sapiens
tggatggaggagaaataaa

SEQ ID NO: 6484140 - DNA, 16 bp, Homo sapiens
tggatggcacctcagg

SEQ ID NO: 6484141 - DNA, 21 bp, Homo sapiens
tggatggcacctcaggctgag

SEQ ID NO: 6484142 - DNA, 14 bp, Homo sapiens
tggatggcagactc

SEQ ID NO: 6484143 - DNA, 15 bp, Homo sapiens
tggatggcagactct

SEQ ID NO: 6484144 - DNA, 22 bp, Homo sapiens
tggatggcatctagccagaggc

SEQ ID NO: 6484145 - DNA, 15 bp, Homo sapiens
tggatggccccagca

SEQ ID NO: 6484146 - DNA, 23 bp, Homo sapiens
tggatggccgggctgctgctgat

SEQ ID NO: 6484147 - DNA, 13 bp, Homo sapiens
tggatggcctctg

SEQ ID NO: 6484148 - DNA, 18 bp, Homo sapiens
tggatggctcaagtctgc

SEQ ID NO: 6484149 - DNA, 17 bp, Homo sapiens
tggatggctcccctgag

SEQ ID NO: 6484150 - DNA, 23 bp, Homo sapiens
tggatggcttgtctatactcctt

SEQ ID NO: 6484151 - DNA, 16 bp, Homo sapiens
tggatgggacattttt

SEQ ID NO: 6484152 - DNA, 12 bp, Homo sapiens
tggatgggactc

SEQ ID NO: 6484153 - DNA, 22 bp, Homo sapiens
tggatgggactccatagctcct

SEQ ID NO: 6484154 - DNA, 21 bp, Homo sapiens
tggatgggaggagagccactg

SEQ ID NO: 6484155 - DNA, 14 bp, Homo sapiens
tggatgggaggctc

SEQ ID NO: 6484156 - DNA, 22 bp, Homo sapiens
tggatgggcattgggctgacac

SEQ ID NO: 6484157 - DNA, 23 bp, Homo sapiens
tggatgggcattgggctgacacc

SEQ ID NO: 6484158 - DNA, 16 bp, Homo sapiens
tggatgggcctttgag

SEQ ID NO: 6484159 - DNA, 17 bp, Homo sapiens
tggatggggcagagctt

SEQ ID NO: 6484160 - DNA, 19 bp, Homo sapiens
tggatggggcggcctgcag

SEQ ID NO: 6484161 - DNA, 21 bp, Homo sapiens
tggatggggctggcatgtttt

SEQ ID NO: 6484162 - DNA, 21 bp, Homo sapiens
tggatgggggaaatggtgcct

SEQ ID NO: 6484163 - DNA, 16 bp, Homo sapiens
tggatgggggctctgc

SEQ ID NO: 6484164 - DNA, 20 bp, Homo sapiens
tggatggtctccacctgtgc

SEQ ID NO: 6484165 - DNA, 22 bp, Homo sapiens
tggatggtctccacctgtgctt

SEQ ID NO: 6484166 - DNA, 12 bp, Homo sapiens
tggatggtgact

SEQ ID NO: 6484167 - DNA, 14 bp, Homo sapiens
tggatggtgacttt

SEQ ID NO: 6484168 - DNA, 18 bp, Homo sapiens
tggatggtgacttttgaa

SEQ ID NO: 6484169 - DNA, 13 bp, Homo sapiens
tggatggtggcca

SEQ ID NO: 6484170 - DNA, 12 bp, Homo sapiens
tggatggtttgt

SEQ ID NO: 6484171 - DNA, 14 bp, Homo sapiens
tggatgtaaatcct

SEQ ID NO: 6484172 - DNA, 20 bp, Homo sapiens
tggatgtaattagctctggg

SEQ ID NO: 6484173 - DNA, 22 bp, Homo sapiens
tggatgtaattagctctggggg

SEQ ID NO: 6484174 - DNA, 18 bp, Homo sapiens
tggatgtcccctgtccca

SEQ ID NO: 6484175 - DNA, 16 bp, Homo sapiens
tggatgtctgaacttt

SEQ ID NO: 6484176 - DNA, 20 bp, Homo sapiens
tggatgtctgccaatttttg

SEQ ID NO: 6484177 - DNA, 11 bp, Homo sapiens
tggatgtctgg

SEQ ID NO: 6484178 - DNA, 15 bp, Homo sapiens
tggatgtcttccttg

SEQ ID NO: 6484179 - DNA, 13 bp, Homo sapiens
tggatgtgagcag

SEQ ID NO: 6484180 - DNA, 15 bp, Homo sapiens
tggatgtgagtttaa

SEQ ID NO: 6484181 - DNA, 21 bp, Homo sapiens
tggatgtgattgcctcaataa

SEQ ID NO: 6484182 - DNA, 17 bp, Homo sapiens
tgaacagtgctctgcct

SEQ ID NO: 6484183 - DNA, 18 bp, Homo sapiens
tgaacagtgctctgcctc

SEQ ID NO: 6484184 - DNA, 12 bp, Homo sapiens
tgaacagtggag

SEQ ID NO: 6484185 - DNA, 18 bp, Homo sapiens
tgaacagttctcccttca

SEQ ID NO: 6484186 - DNA, 22 bp, Homo sapiens
tgaacagtttatgcagtgctgc

SEQ ID NO: 6484187 - DNA, 20 bp, Homo sapiens
tgaacagtttggggactcag

SEQ ID NO: 6484188 - DNA, 21 bp, Homo sapiens
tgaacagtttggggactcagg

SEQ ID NO: 6484189 - DNA, 23 bp, Homo sapiens
tgaacagtttggggactcaggac

SEQ ID NO: 6484190 - DNA, 15 bp, Homo sapiens
tgaacataacttctc

SEQ ID NO: 6484191 - DNA, 16 bp, Homo sapiens
tgaacatacttcaaaa

SEQ ID NO: 6484192 - DNA, 22 bp, Homo sapiens
tgaacatacttcaaaaataatg

SEQ ID NO: 6484193 - DNA, 23 bp, Homo sapiens
tgaacatacttcaaaaataatgt

SEQ ID NO: 6484194 - DNA, 17 bp, Homo sapiens
tgaacataggtgtgctt

SEQ ID NO: 6484195 - DNA, 17 bp, Homo sapiens
tgaacatagttttcacc

SEQ ID NO: 6484196 - DNA, 21 bp, Homo sapiens
tgaacatcagaaggtattttt

SEQ ID NO: 6484197 - DNA, 17 bp, Homo sapiens
tgaacatcccctcccat

SEQ ID NO: 6484198 - DNA, 20 bp, Homo sapiens
tgaacatctggcccaagtga

SEQ ID NO: 6484199 - DNA, 14 bp, Homo sapiens
tgaacatgatagtt

SEQ ID NO: 6484200 - DNA, 18 bp, Homo sapiens
tgaacatgatagttaaac

SEQ ID NO: 6484201 - DNA, 14 bp, Homo sapiens
tgaacatgcctcct

SEQ ID NO: 6484202 - DNA, 15 bp, Homo sapiens
tgaacatgcctcctc

SEQ ID NO: 6484203 - DNA, 20 bp, Homo sapiens
tgaacatgccttatatttgt

SEQ ID NO: 6484204 - DNA, 13 bp, Homo sapiens
tgaacatgtttta

SEQ ID NO: 6484205 - DNA, 17 bp, Homo sapiens
tgaacattagttgcact

SEQ ID NO: 6484206 - DNA, 12 bp, Homo sapiens
tgaacattccaa

SEQ ID NO: 6484207 - DNA, 14 bp, Homo sapiens
tgaacattccagag

SEQ ID NO: 6484208 - DNA, 13 bp, Homo sapiens
tgaacattcccag

SEQ ID NO: 6484209 - DNA, 12 bp, Homo sapiens
tgaacattccta

SEQ ID NO: 6484210 - DNA, 14 bp, Homo sapiens
tgaacattcttgct

SEQ ID NO: 6484211 - DNA, 17 bp, Homo sapiens
tgaacattgcaatagaa

SEQ ID NO: 6484212 - DNA, 12 bp, Homo sapiens
tgaacattgcat

SEQ ID NO: 6484213 - DNA, 22 bp, Homo sapiens
tgaacattgcatataacttata

SEQ ID NO: 6484214 - DNA, 20 bp, Homo sapiens
tgaacattgtactgttgctt

SEQ ID NO: 6484215 - DNA, 23 bp, Homo sapiens
tgaacattgtactgttgctttaa

SEQ ID NO: 6484216 - DNA, 21 bp, Homo sapiens
tgaacatttagtaccctgcag

SEQ ID NO: 6484217 - DNA, 22 bp, Homo sapiens
tgaacatttagtaccctgcagg

SEQ ID NO: 6484218 - DNA, 22 bp, Homo sapiens
tgaacatttatcaatcagtata

SEQ ID NO: 6484219 - DNA, 21 bp, Homo sapiens
tgaacatttcaaattgaattt

SEQ ID NO: 6484220 - DNA, 23 bp, Homo sapiens
tgaacattttatcattaattttt

SEQ ID NO: 6484221 - DNA, 17 bp, Homo sapiens
tgaaccaaaaatagaaa

SEQ ID NO: 6484222 - DNA, 18 bp, Homo sapiens
tgaaccaaaaatagaaat

SEQ ID NO: 6484223 - DNA, 20 bp, Homo sapiens
tgaaccaaaaatagaaatta

SEQ ID NO: 6484224 - DNA, 14 bp, Homo sapiens
tgaaccaaagcctc

SEQ ID NO: 6484225 - DNA, 18 bp, Homo sapiens
tgaaccaaattgcactga

SEQ ID NO: 6484226 - DNA, 21 bp, Homo sapiens
tgaaccaaattgcactgaagt

SEQ ID NO: 6484227 - DNA, 23 bp, Homo sapiens
tgaaccaaattgcactgaagttt

SEQ ID NO: 6484228 - DNA, 17 bp, Homo sapiens
tgaaccaacagaagcag

SEQ ID NO: 6484229 - DNA, 15 bp, Homo sapiens
tgaaccaacatcttt

SEQ ID NO: 6484230 - DNA, 16 bp, Homo sapiens
tgaaccaacccccatc

SEQ ID NO: 6484231 - DNA, 15 bp, Homo sapiens
tgaaccaatctggat

SEQ ID NO: 6484232 - DNA, 15 bp, Homo sapiens
tgaaccacaactttg

SEQ ID NO: 6484233 - DNA, 13 bp, Homo sapiens
tgaaccacagaaa

SEQ ID NO: 6484234 - DNA, 17 bp, Homo sapiens
tgaaccaccacacccag

SEQ ID NO: 6484235 - DNA, 21 bp, Homo sapiens
tgaaccaccacacccagccca

SEQ ID NO: 6484236 - DNA, 16 bp, Homo sapiens
tgaaccacgaggctgc

SEQ ID NO: 6484237 - DNA, 20 bp, Homo sapiens
tgaaccacgaggctgccccc

SEQ ID NO: 6484238 - DNA, 21 bp, Homo sapiens
tgaaccacgaggctgccccca

SEQ ID NO: 6484239 - DNA, 23 bp, Homo sapiens
tgaaccactgcttctcttttgaa

SEQ ID NO: 6484240 - DNA, 15 bp, Homo sapiens
tgaaccactgtgccc

SEQ ID NO: 6484241 - DNA, 15 bp, Homo sapiens
tgaaccacttccctc

SEQ ID NO: 6484242 - DNA, 14 bp, Homo sapiens
tgaaccacttgtag

SEQ ID NO: 6484243 - DNA, 12 bp, Homo sapiens
tgaaccagccac

SEQ ID NO: 6484244 - DNA, 15 bp, Homo sapiens
tgaaccagctcatct

SEQ ID NO: 6484245 - DNA, 17 bp, Homo sapiens
tgaaccaggccttctga

SEQ ID NO: 6484246 - DNA, 17 bp, Homo sapiens
tgaaccagtcctgctgc

SEQ ID NO: 6484247 - DNA, 19 bp, Homo sapiens
tgaaccagtcctgctgcct

SEQ ID NO: 6484248 - DNA, 16 bp, Homo sapiens
tgaaccataaaatgtc

SEQ ID NO: 6484249 - DNA, 16 bp, Homo sapiens
tgaaccataaattcaa

SEQ ID NO: 6484250 - DNA, 21 bp, Homo sapiens
tgaaccataaattcaactttg

SEQ ID NO: 6484251 - DNA, 18 bp, Homo sapiens
tgaaccatagttactgta

SEQ ID NO: 6484252 - DNA, 21 bp, Homo sapiens
tgaaccatcattataaacgtg

SEQ ID NO: 6484253 - DNA, 19 bp, Homo sapiens
tgaaccatccttcccatga

SEQ ID NO: 6484254 - DNA, 21 bp, Homo sapiens
tgaaccatgcttacaaagaaa

SEQ ID NO: 6484255 - DNA, 20 bp, Homo sapiens
tgaaccattccctagtcatt

SEQ ID NO: 6484256 - DNA, 14 bp, Homo sapiens
tgaacccaagagca

SEQ ID NO: 6484257 - DNA, 22 bp, Homo sapiens
tgaacccagaaacaacacaatc

SEQ ID NO: 6484258 - DNA, 21 bp, Homo sapiens
tgaacccagagtcaggaagag

SEQ ID NO: 6484259 - DNA, 12 bp, Homo sapiens
tgaacccaggac

SEQ ID NO: 6484260 - DNA, 21 bp, Homo sapiens
tgaacccaggacgcttctgaa

SEQ ID NO: 6484261 - DNA, 22 bp, Homo sapiens
tgaacccaggacgcttctgaat

SEQ ID NO: 6484262 - DNA, 14 bp, Homo sapiens
tgaacccaggcagc

SEQ ID NO: 6484263 - DNA, 17 bp, Homo sapiens
tgaacccaggcagctgg

SEQ ID NO: 6484264 - DNA, 19 bp, Homo sapiens
tgaacccaggcagctggca

SEQ ID NO: 6484265 - DNA, 22 bp, Homo sapiens
tgaacccaggcagctggcagga

SEQ ID NO: 6484266 - DNA, 19 bp, Homo sapiens
tgaacccattttgagtgac

SEQ ID NO: 6484267 - DNA, 14 bp, Homo sapiens
tgaaccccaaatgc

SEQ ID NO: 6484268 - DNA, 13 bp, Homo sapiens
tgaaccccatggg

SEQ ID NO: 6484269 - DNA, 14 bp, Homo sapiens
tgaacccccatgat

SEQ ID NO: 6484270 - DNA, 17 bp, Homo sapiens
tgaacccctggctcctt

SEQ ID NO: 6484271 - DNA, 22 bp, Homo sapiens
tgaacccgggacgcaggggttg

SEQ ID NO: 6484272 - DNA, 17 bp, Homo sapiens
tgaacccgggaggcaga

SEQ ID NO: 6484273 - DNA, 18 bp, Homo sapiens
tgaaccctagctgtgtca

SEQ ID NO: 6484274 - DNA, 13 bp, Homo sapiens
tgaaccctcagcc

SEQ ID NO: 6484275 - DNA, 13 bp, Homo sapiens
tgaaccctccagg

SEQ ID NO: 6484276 - DNA, 13 bp, Homo sapiens
tgaaccctcctcc

SEQ ID NO: 6484277 - DNA, 15 bp, Homo sapiens
tgaaccctcctcctt

SEQ ID NO: 6484278 - DNA, 20 bp, Homo sapiens
tgaaccctcctcctttttaa

SEQ ID NO: 6484279 - DNA, 18 bp, Homo sapiens
tgaaccctcttgccatcc

SEQ ID NO: 6484280 - DNA, 20 bp, Homo sapiens
tgaaccctcttgccatcctg

SEQ ID NO: 6484281 - DNA, 22 bp, Homo sapiens
tgaaccctcttgccatcctgat

SEQ ID NO: 6484282 - DNA, 12 bp, Homo sapiens
tgaaccctgccc

SEQ ID NO: 6484283 - DNA, 22 bp, Homo sapiens
tgaaccctggcatttggcctct

SEQ ID NO: 6484284 - DNA, 15 bp, Homo sapiens
tgaaccctggggcct

SEQ ID NO: 6484285 - DNA, 14 bp, Homo sapiens
tgaaccctgtgctg

SEQ ID NO: 6484286 - DNA, 17 bp, Homo sapiens
tgaacccttgtgcttgg

SEQ ID NO: 6484287 - DNA, 17 bp, Homo sapiens
tgaaccctttgtttctt

SEQ ID NO: 6484288 - DNA, 19 bp, Homo sapiens
tgaaccgactgaccctgag

SEQ ID NO: 6484289 - DNA, 20 bp, Homo sapiens
tgaaccgactgaccctgagg

SEQ ID NO: 6484290 - DNA, 14 bp, Homo sapiens
tgaaccgacttttc

SEQ ID NO: 6484291 - DNA, 15 bp, Homo sapiens
tgaaccgacttttct

SEQ ID NO: 6484292 - DNA, 22 bp, Homo sapiens
tgaaccgaggggctcaggaaaa

SEQ ID NO: 6484293 - DNA, 22 bp, Homo sapiens
tgaaccgcaccccatcccacca

SEQ ID NO: 6484294 - DNA, 18 bp, Homo sapiens
tgaaccgctacaagaggg

SEQ ID NO: 6484295 - DNA, 15 bp, Homo sapiens
tgaaccgtcaatgtg

SEQ ID NO: 6484296 - DNA, 17 bp, Homo sapiens
tgaaccgtcaatgtgaa

SEQ ID NO: 6484297 - DNA, 18 bp, Homo sapiens
tgaaccgtcaatgtgaaa

SEQ ID NO: 6484298 - DNA, 19 bp, Homo sapiens
tgaaccgtcaatgtgaaat

SEQ ID NO: 6484299 - DNA, 20 bp, Homo sapiens
tgaaccgtgtgctcctcggc

SEQ ID NO: 6484300 - DNA, 21 bp, Homo sapiens
tgaaccgtgtgctcctcggca

SEQ ID NO: 6484301 - DNA, 17 bp, Homo sapiens
tgaaccgtttacagtgt

SEQ ID NO: 6484302 - DNA, 23 bp, Homo sapiens
tgaacctactgaggagcaaagca

SEQ ID NO: 6484303 - DNA, 21 bp, Homo sapiens
tgaacctaggagtgccccatt

SEQ ID NO: 6484304 - DNA, 17 bp, Homo sapiens
tgaacctattttcattt

SEQ ID NO: 6484305 - DNA, 18 bp, Homo sapiens
tgaacctattttcatttg

SEQ ID NO: 6484306 - DNA, 20 bp, Homo sapiens
tgaacctattttcatttgta

SEQ ID NO: 6484307 - DNA, 22 bp, Homo sapiens
tgaacctcaccccgaggccctg

SEQ ID NO: 6484308 - DNA, 23 bp, Homo sapiens
tgaacctcaccccgaggccctgc

SEQ ID NO: 6484309 - DNA, 12 bp, Homo sapiens
tgaacctcagtt

SEQ ID NO: 6484310 - DNA, 17 bp, Homo sapiens
tgaacctcattctggtt

SEQ ID NO: 6484311 - DNA, 15 bp, Homo sapiens
tgaacctccaaatgg

SEQ ID NO: 6484312 - DNA, 22 bp, Homo sapiens
tgaacctcgaggaactccagga

SEQ ID NO: 6484313 - DNA, 21 bp, Homo sapiens
tgaacctgaaaagggtcagaa

SEQ ID NO: 6484314 - DNA, 16 bp, Homo sapiens
tgaacctgcttcctgg

SEQ ID NO: 6484315 - DNA, 15 bp, Homo sapiens
tgaacctggaaatga

SEQ ID NO: 6484316 - DNA, 13 bp, Homo sapiens
tgaacctggatcc

SEQ ID NO: 6484317 - DNA, 12 bp, Homo sapiens
tgaacctgggaa

SEQ ID NO: 6484318 - DNA, 21 bp, Homo sapiens
tgaacctgggaaccatgaagc

SEQ ID NO: 6484319 - DNA, 14 bp, Homo sapiens
tgaacctgggaggt

SEQ ID NO: 6484320 - DNA, 15 bp, Homo sapiens
tgaacctgtcacctg

SEQ ID NO: 6484321 - DNA, 15 bp, Homo sapiens
tgaacctgtctcctc

SEQ ID NO: 6484322 - DNA, 12 bp, Homo sapiens
tgaacctgtgag

SEQ ID NO: 6484323 - DNA, 17 bp, Homo sapiens
tgaacctgtgaggaaga

SEQ ID NO: 6484324 - DNA, 18 bp, Homo sapiens
tgaacctgtgaggaagag

SEQ ID NO: 6484325 - DNA, 19 bp, Homo sapiens
tgaacctgtgagtaaatat

SEQ ID NO: 6484326 - DNA, 15 bp, Homo sapiens
tgaaccttaatgtgg

SEQ ID NO: 6484327 - DNA, 15 bp, Homo sapiens
tgaaccttcaaagct

SEQ ID NO: 6484328 - DNA, 21 bp, Homo sapiens
tgaaccttgttgatgccagct

SEQ ID NO: 6484329 - DNA, 19 bp, Homo sapiens
tgaacctttaaagtaaagg

SEQ ID NO: 6484330 - DNA, 18 bp, Homo sapiens
tgaacctttgtgccctat

SEQ ID NO: 6484331 - DNA, 16 bp, Homo sapiens
tgaacgaccttacaaa

SEQ ID NO: 6484332 - DNA, 16 bp, Homo sapiens
tgaacgactgtatatt

SEQ ID NO: 6484333 - DNA, 15 bp, Homo sapiens
tgaacgagcagccca

SEQ ID NO: 6484334 - DNA, 20 bp, Homo sapiens
tgaacgatatgtagcagaaa

SEQ ID NO: 6484335 - DNA, 21 bp, Homo sapiens
tgaacgatatgtagcagaaag

SEQ ID NO: 6484336 - DNA, 19 bp, Homo sapiens
tgaacgcacaacatgcaca

SEQ ID NO: 6484337 - DNA, 14 bp, Homo sapiens
tgaacgccaaggaa

SEQ ID NO: 6484338 - DNA, 17 bp, Homo sapiens
tgaacgccctggtaagg

SEQ ID NO: 6484339 - DNA, 14 bp, Homo sapiens
tgaacggataagaa

SEQ ID NO: 6484340 - DNA, 15 bp, Homo sapiens
tgaacggggagaaaa

SEQ ID NO: 6484341 - DNA, 16 bp, Homo sapiens
tgaacggggagaaaag

SEQ ID NO: 6484342 - DNA, 15 bp, Homo sapiens
tgaacgtccttcctt

SEQ ID NO: 6484343 - DNA, 19 bp, Homo sapiens
tgaacgtgcttctttgtaa

SEQ ID NO: 6484344 - DNA, 16 bp, Homo sapiens
tgaacgtggattgtat

SEQ ID NO: 6484345 - DNA, 19 bp, Homo sapiens
tgaacgtttggttcaaatg

SEQ ID NO: 6484346 - DNA, 20 bp, Homo sapiens
tgaacgtttggttcaaatgt

SEQ ID NO: 6484347 - DNA, 16 bp, Homo sapiens
tgaacgttttaataat

SEQ ID NO: 6484348 - DNA, 13 bp, Homo sapiens
tgaacgttttctt

SEQ ID NO: 6484349 - DNA, 17 bp, Homo sapiens
tgaacgttttcttcttt

SEQ ID NO: 6484350 - DNA, 18 bp, Homo sapiens
tgaacgttttcttctttc

SEQ ID NO: 6484351 - DNA, 19 bp, Homo sapiens
tgaactaaagtgctgcact

SEQ ID NO: 6484352 - DNA, 16 bp, Homo sapiens
tgaactaactgccatg

SEQ ID NO: 6484353 - DNA, 17 bp, Homo sapiens
tgaactaactgccatgt

SEQ ID NO: 6484354 - DNA, 14 bp, Homo sapiens
tgaactaagttatt

SEQ ID NO: 6484355 - DNA, 16 bp, Homo sapiens
tgaactaagttattgc

SEQ ID NO: 6484356 - DNA, 16 bp, Homo sapiens
tgaactaataaaagca

SEQ ID NO: 6484357 - DNA, 15 bp, Homo sapiens
tgaactaattcattt

SEQ ID NO: 6484358 - DNA, 16 bp, Homo sapiens
tgaactaattcattta

SEQ ID NO: 6484359 - DNA, 17 bp, Homo sapiens
tgaactaattcatttat

SEQ ID NO: 6484360 - DNA, 16 bp, Homo sapiens
tggatgtgcccacagg

SEQ ID NO: 6484361 - DNA, 18 bp, Homo sapiens
tggatgtgcccacaggga

SEQ ID NO: 6484362 - DNA, 16 bp, Homo sapiens
tggatgtgctggaggg

SEQ ID NO: 6484363 - DNA, 13 bp, Homo sapiens
tggatgtgctttc

SEQ ID NO: 6484364 - DNA, 14 bp, Homo sapiens
tggatgtgtggggc

SEQ ID NO: 6484365 - DNA, 16 bp, Homo sapiens
tggatgtgttgcccct

SEQ ID NO: 6484366 - DNA, 15 bp, Homo sapiens
tggatgttactctct

SEQ ID NO: 6484367 - DNA, 21 bp, Homo sapiens
tggatgttatgaacagctgtg

SEQ ID NO: 6484368 - DNA, 16 bp, Homo sapiens
tggatgttcagaattt

SEQ ID NO: 6484369 - DNA, 14 bp, Homo sapiens
tggatgttgctata

SEQ ID NO: 6484370 - DNA, 19 bp, Homo sapiens
tggatgttgctatagtgac

SEQ ID NO: 6484371 - DNA, 17 bp, Homo sapiens
tggatgttgtaaataaa

SEQ ID NO: 6484372 - DNA, 18 bp, Homo sapiens
tggatgttttaattccat

SEQ ID NO: 6484373 - DNA, 17 bp, Homo sapiens
tggatgtttttagttct

SEQ ID NO: 6484374 - DNA, 19 bp, Homo sapiens
tggatgtttttagttctga

SEQ ID NO: 6484375 - DNA, 18 bp, Homo sapiens
tggattaaaaaaaaatgt

SEQ ID NO: 6484376 - DNA, 15 bp, Homo sapiens
tggattaaacctttt

SEQ ID NO: 6484377 - DNA, 18 bp, Homo sapiens
tggattaaacctttttat

SEQ ID NO: 6484378 - DNA, 20 bp, Homo sapiens
tggattaaacctttttataa

SEQ ID NO: 6484379 - DNA, 14 bp, Homo sapiens
tggattaaactcag

SEQ ID NO: 6484380 - DNA, 13 bp, Homo sapiens
tggattaaagact

SEQ ID NO: 6484381 - DNA, 14 bp, Homo sapiens
tggattaaatacat

SEQ ID NO: 6484382 - DNA, 15 bp, Homo sapiens
tggattaaatacata

SEQ ID NO: 6484383 - DNA, 21 bp, Homo sapiens
tggattaaatacatatggatg

SEQ ID NO: 6484384 - DNA, 21 bp, Homo sapiens
tggattaaatggcacctgtat

SEQ ID NO: 6484385 - DNA, 14 bp, Homo sapiens
tggattaaattagt

SEQ ID NO: 6484386 - DNA, 18 bp, Homo sapiens
tggattactattgcaaaa

SEQ ID NO: 6484387 - DNA, 20 bp, Homo sapiens
tggattactgccattcactt

SEQ ID NO: 6484388 - DNA, 20 bp, Homo sapiens
tggattacttctctataaaa

SEQ ID NO: 6484389 - DNA, 17 bp, Homo sapiens
tggattagcctttgaca

SEQ ID NO: 6484390 - DNA, 16 bp, Homo sapiens
tggattagcttttcct

SEQ ID NO: 6484391 - DNA, 22 bp, Homo sapiens
tggattagtgaactaagttatt

SEQ ID NO: 6484392 - DNA, 19 bp, Homo sapiens
tggattataaaaaatgtaa

SEQ ID NO: 6484393 - DNA, 21 bp, Homo sapiens
tggattataaaaaatgtaaca

SEQ ID NO: 6484394 - DNA, 22 bp, Homo sapiens
tggattataaaaaatgtaacat

SEQ ID NO: 6484395 - DNA, 20 bp, Homo sapiens
tggattataagttctatttt

SEQ ID NO: 6484396 - DNA, 14 bp, Homo sapiens
tggattatacaaaa

SEQ ID NO: 6484397 - DNA, 22 bp, Homo sapiens
tggattatgttatacaaggcaa

SEQ ID NO: 6484398 - DNA, 18 bp, Homo sapiens
tggattattcatttaaaa

SEQ ID NO: 6484399 - DNA, 19 bp, Homo sapiens
tggattattcatttaaaat

SEQ ID NO: 6484400 - DNA, 16 bp, Homo sapiens
tggattattctttctc

SEQ ID NO: 6484401 - DNA, 22 bp, Homo sapiens
tggattattctttctccttttt

SEQ ID NO: 6484402 - DNA, 14 bp, Homo sapiens
tggattatttaata

SEQ ID NO: 6484403 - DNA, 17 bp, Homo sapiens
tggattatttaataaca

SEQ ID NO: 6484404 - DNA, 20 bp, Homo sapiens
tggattatttaataacatta

SEQ ID NO: 6484405 - DNA, 13 bp, Homo sapiens
tggattcaattac

SEQ ID NO: 6484406 - DNA, 19 bp, Homo sapiens
tggattcaattcctgtcct

SEQ ID NO: 6484407 - DNA, 15 bp, Homo sapiens
tggattcacagacca

SEQ ID NO: 6484408 - DNA, 22 bp, Homo sapiens
tggattcacccccctctgctgc

SEQ ID NO: 6484409 - DNA, 23 bp, Homo sapiens
tggattcacccccctctgctgcc

SEQ ID NO: 6484410 - DNA, 13 bp, Homo sapiens
tggattcacttct

SEQ ID NO: 6484411 - DNA, 14 bp, Homo sapiens
tggattcagccttc

SEQ ID NO: 6484412 - DNA, 17 bp, Homo sapiens
tggattcatatttaatt

SEQ ID NO: 6484413 - DNA, 16 bp, Homo sapiens
tggattcattgtctct

SEQ ID NO: 6484414 - DNA, 17 bp, Homo sapiens
tggattcatttataaga

SEQ ID NO: 6484415 - DNA, 17 bp, Homo sapiens
tggattcatttcctgcc

SEQ ID NO: 6484416 - DNA, 22 bp, Homo sapiens
tggattccccatctcaggccag

SEQ ID NO: 6484417 - DNA, 21 bp, Homo sapiens
tggattcccccccctttccta

SEQ ID NO: 6484418 - DNA, 14 bp, Homo sapiens
tggattcccctgga

SEQ ID NO: 6484419 - DNA, 18 bp, Homo sapiens
tggattcccttaaacaaa

SEQ ID NO: 6484420 - DNA, 17 bp, Homo sapiens
tggattcctcacagcct

SEQ ID NO: 6484421 - DNA, 20 bp, Homo sapiens
tggattcctcacagccttgg

SEQ ID NO: 6484422 - DNA, 17 bp, Homo sapiens
tggattcctctaagatc

SEQ ID NO: 6484423 - DNA, 14 bp, Homo sapiens
tggattcctgtttc

SEQ ID NO: 6484424 - DNA, 16 bp, Homo sapiens
tggattctaaattatg

SEQ ID NO: 6484425 - DNA, 12 bp, Homo sapiens
tggattctcaga

SEQ ID NO: 6484426 - DNA, 13 bp, Homo sapiens
tggattctcagat

SEQ ID NO: 6484427 - DNA, 19 bp, Homo sapiens
tggattctccctgggcctc

SEQ ID NO: 6484428 - DNA, 17 bp, Homo sapiens
tggattctctaaccttt

SEQ ID NO: 6484429 - DNA, 21 bp, Homo sapiens
tggattctcttagctactgta

SEQ ID NO: 6484430 - DNA, 22 bp, Homo sapiens
tggattctcttagctactgtat

SEQ ID NO: 6484431 - DNA, 20 bp, Homo sapiens
tggattctgaggccctgccc

SEQ ID NO: 6484432 - DNA, 18 bp, Homo sapiens
tggattctgcctaataaa

SEQ ID NO: 6484433 - DNA, 13 bp, Homo sapiens
tggattctggatg

SEQ ID NO: 6484434 - DNA, 17 bp, Homo sapiens
tggattcttatgtagca

SEQ ID NO: 6484435 - DNA, 10 bp, Homo sapiens
tggattcttt

SEQ ID NO: 6484436 - DNA, 20 bp, Homo sapiens
tggattgacagtaacttggt

SEQ ID NO: 6484437 - DNA, 16 bp, Homo sapiens
tggattgattcagtct

SEQ ID NO: 6484438 - DNA, 17 bp, Homo sapiens
tggattgcacgtggcct

SEQ ID NO: 6484439 - DNA, 21 bp, Homo sapiens
tggattgcacgtggcctcttg

SEQ ID NO: 6484440 - DNA, 15 bp, Homo sapiens
tggattgccacagct

SEQ ID NO: 6484441 - DNA, 17 bp, Homo sapiens
tggattgccacagctca

SEQ ID NO: 6484442 - DNA, 18 bp, Homo sapiens
tggattgcgcctaatgtg

SEQ ID NO: 6484443 - DNA, 20 bp, Homo sapiens
tggattgcgcctaatgtgtt

SEQ ID NO: 6484444 - DNA, 20 bp, Homo sapiens
tggattgcgcctttgtatta

SEQ ID NO: 6484445 - DNA, 13 bp, Homo sapiens
tggattggacaaa

SEQ ID NO: 6484446 - DNA, 19 bp, Homo sapiens
tggattggacaaaatgact

SEQ ID NO: 6484447 - DNA, 23 bp, Homo sapiens
tggattggagaagtaatcctagg

SEQ ID NO: 6484448 - DNA, 22 bp, Homo sapiens
tggattggcaggtgtgggctcc

SEQ ID NO: 6484449 - DNA, 15 bp, Homo sapiens
tggattggccaaaca

SEQ ID NO: 6484450 - DNA, 16 bp, Homo sapiens
tggattggcctccagg

SEQ ID NO: 6484451 - DNA, 21 bp, Homo sapiens
tggattgggacgcacagtgca

SEQ ID NO: 6484452 - DNA, 22 bp, Homo sapiens
tggattgggcagaatcctgggc

SEQ ID NO: 6484453 - DNA, 14 bp, Homo sapiens
tggattggggtccc

SEQ ID NO: 6484454 - DNA, 21 bp, Homo sapiens
tggattgtagaacttgttgct

SEQ ID NO: 6484455 - DNA, 19 bp, Homo sapiens
tggattgtatttaagacat

SEQ ID NO: 6484456 - DNA, 13 bp, Homo sapiens
tggattgtccccg

SEQ ID NO: 6484457 - DNA, 21 bp, Homo sapiens
tggattgtccccgacccttgc

SEQ ID NO: 6484458 - DNA, 12 bp, Homo sapiens
tggattgtggat

SEQ ID NO: 6484459 - DNA, 11 bp, Homo sapiens
tggattgtttt

SEQ ID NO: 6484460 - DNA, 15 bp, Homo sapiens
tggatttaacagaaa

SEQ ID NO: 6484461 - DNA, 20 bp, Homo sapiens
tggatttaacagcatgacaa

SEQ ID NO: 6484462 - DNA, 21 bp, Homo sapiens
tggatttaacagcatgacaaa

SEQ ID NO: 6484463 - DNA, 18 bp, Homo sapiens
tggatttaatccattttt

SEQ ID NO: 6484464 - DNA, 19 bp, Homo sapiens
tggatttagagactgtaaa

SEQ ID NO: 6484465 - DNA, 12 bp, Homo sapiens
tggatttagagc

SEQ ID NO: 6484466 - DNA, 19 bp, Homo sapiens
tggatttattttttgtaac

SEQ ID NO: 6484467 - DNA, 23 bp, Homo sapiens
tggatttattttttgtaactctt

SEQ ID NO: 6484468 - DNA, 16 bp, Homo sapiens
tggatttcatttgtaa

SEQ ID NO: 6484469 - DNA, 15 bp, Homo sapiens
tggatttccactgct

SEQ ID NO: 6484470 - DNA, 23 bp, Homo sapiens
tggatttcccatcccctgtggga

SEQ ID NO: 6484471 - DNA, 15 bp, Homo sapiens
tggatttcctaatac

SEQ ID NO: 6484472 - DNA, 21 bp, Homo sapiens
tggatttcctattttaaaacc

SEQ ID NO: 6484473 - DNA, 23 bp, Homo sapiens
tggatttcctattttaaaaccat

SEQ ID NO: 6484474 - DNA, 22 bp, Homo sapiens
tggatttcctttatactgtgaa

SEQ ID NO: 6484475 - DNA, 20 bp, Homo sapiens
tggatttcgtgtgccgctgc

SEQ ID NO: 6484476 - DNA, 17 bp, Homo sapiens
tggatttctgaatggct

SEQ ID NO: 6484477 - DNA, 13 bp, Homo sapiens
tggatttctgtga

SEQ ID NO: 6484478 - DNA, 21 bp, Homo sapiens
tggatttctgtgaagttgaat

SEQ ID NO: 6484479 - DNA, 19 bp, Homo sapiens
tggatttctttgaaaaaaa

SEQ ID NO: 6484480 - DNA, 16 bp, Homo sapiens
tggatttcttttgtaa

SEQ ID NO: 6484481 - DNA, 15 bp, Homo sapiens
tggatttgacacact

SEQ ID NO: 6484482 - DNA, 17 bp, Homo sapiens
tggatttgagctgtggc

SEQ ID NO: 6484483 - DNA, 21 bp, Homo sapiens
tggatttgatgagttaactgt

SEQ ID NO: 6484484 - DNA, 17 bp, Homo sapiens
tggatttgattcatttt

SEQ ID NO: 6484485 - DNA, 21 bp, Homo sapiens
tggatttgattcattttcctg

SEQ ID NO: 6484486 - DNA, 21 bp, Homo sapiens
tggatttgcatttttgtattt

SEQ ID NO: 6484487 - DNA, 19 bp, Homo sapiens
tggatttggagagaaatat

SEQ ID NO: 6484488 - DNA, 22 bp, Homo sapiens
tggatttggagagaaatatttt

SEQ ID NO: 6484489 - DNA, 18 bp, Homo sapiens
tggatttgggatgaaata

SEQ ID NO: 6484490 - DNA, 22 bp, Homo sapiens
tggatttggggtgttacagtag

SEQ ID NO: 6484491 - DNA, 21 bp, Homo sapiens
tggatttgtaattaaattgta

SEQ ID NO: 6484492 - DNA, 14 bp, Homo sapiens
tggatttgtacttg

SEQ ID NO: 6484493 - DNA, 16 bp, Homo sapiens
tggatttgtccaaaca

SEQ ID NO: 6484494 - DNA, 16 bp, Homo sapiens
tggattttaaaaaatc

SEQ ID NO: 6484495 - DNA, 19 bp, Homo sapiens
tggattttaaacaaaattt

SEQ ID NO: 6484496 - DNA, 13 bp, Homo sapiens
tggattttatgtt

SEQ ID NO: 6484497 - DNA, 15 bp, Homo sapiens
tggattttatgttga

SEQ ID NO: 6484498 - DNA, 22 bp, Homo sapiens
tggattttatgttgacatttgt

SEQ ID NO: 6484499 - DNA, 22 bp, Homo sapiens
tggattttccaggactgtttca

SEQ ID NO: 6484500 - DNA, 18 bp, Homo sapiens
tggattttcccctgaaga

SEQ ID NO: 6484501 - DNA, 19 bp, Homo sapiens
tggattttcctgaaagtgt

SEQ ID NO: 6484502 - DNA, 16 bp, Homo sapiens
tggattttctactgta

SEQ ID NO: 6484503 - DNA, 23 bp, Homo sapiens
tggattttctttctatgtagaac

SEQ ID NO: 6484504 - DNA, 16 bp, Homo sapiens
tggattttggcagggc

SEQ ID NO: 6484505 - DNA, 22 bp, Homo sapiens
tggattttggttttgttcccct

SEQ ID NO: 6484506 - DNA, 23 bp, Homo sapiens
tggatttttaaaatgtcaagaca

SEQ ID NO: 6484507 - DNA, 15 bp, Homo sapiens
tggatttttaaatta

SEQ ID NO: 6484508 - DNA, 16 bp, Homo sapiens
tggatttttaattaaa

SEQ ID NO: 6484509 - DNA, 19 bp, Homo sapiens
tggatttttaattaaaaac

SEQ ID NO: 6484510 - DNA, 22 bp, Homo sapiens
tggatttttacaaataaagatg

SEQ ID NO: 6484511 - DNA, 14 bp, Homo sapiens
tggatttttaccag

SEQ ID NO: 6484512 - DNA, 22 bp, Homo sapiens
tggatttttaccagtctcacat

SEQ ID NO: 6484513 - DNA, 18 bp, Homo sapiens
tggatttttctttaactg

SEQ ID NO: 6484514 - DNA, 20 bp, Homo sapiens
tggatttttgactctggcaa

SEQ ID NO: 6484515 - DNA, 22 bp, Homo sapiens
tggatttttttgtcattaaaat

SEQ ID NO: 6484516 - DNA, 15 bp, Homo sapiens
tggatttttttttct

SEQ ID NO: 6484517 - DNA, 17 bp, Homo sapiens
tggcaaaaaaaaaaaag

SEQ ID NO: 6484518 - DNA, 14 bp, Homo sapiens
tggcaaaaaagaac

SEQ ID NO: 6484519 - DNA, 17 bp, Homo sapiens
tggcaaaaagagtcaga

SEQ ID NO: 6484520 - DNA, 16 bp, Homo sapiens
tggcaaaaaggcagga

SEQ ID NO: 6484521 - DNA, 21 bp, Homo sapiens
tggcaaaaatgcaacaaatga

SEQ ID NO: 6484522 - DNA, 17 bp, Homo sapiens
tggcaaaaatggctaga

SEQ ID NO: 6484523 - DNA, 17 bp, Homo sapiens
tggcaaaacagacatca

SEQ ID NO: 6484524 - DNA, 16 bp, Homo sapiens
tggcaaaacagccctc

SEQ ID NO: 6484525 - DNA, 18 bp, Homo sapiens
tggcaaaactcaggcaga

SEQ ID NO: 6484526 - DNA, 14 bp, Homo sapiens
tggcaaaagacatc

SEQ ID NO: 6484527 - DNA, 20 bp, Homo sapiens
tggcaaaagacatcctcaaa

SEQ ID NO: 6484528 - DNA, 21 bp, Homo sapiens
tggcaaaagccttgtgtatat

SEQ ID NO: 6484529 - DNA, 20 bp, Homo sapiens
tggcaaaaggatctttgtgg

SEQ ID NO: 6484530 - DNA, 15 bp, Homo sapiens
tggcaaaataaagaa

SEQ ID NO: 6484531 - DNA, 21 bp, Homo sapiens
tggcaaaatagttctgcaggt

SEQ ID NO: 6484532 - DNA, 21 bp, Homo sapiens
tggcaaaatatggtttggttt

SEQ ID NO: 6484533 - DNA, 13 bp, Homo sapiens
tggcaaaatatta

SEQ ID NO: 6484534 - DNA, 16 bp, Homo sapiens
tggcaaacaaaaccaa

SEQ ID NO: 6484535 - DNA, 17 bp, Homo sapiens
tggcaaacaccattatt

SEQ ID NO: 6484536 - DNA, 15 bp, Homo sapiens
tggcaaacagggcct

SEQ ID NO: 6484537 - DNA, 24 bp, Homo sapiens
tgaactaattcatttattaagtat

SEQ ID NO: 6484538 - DNA, 14 bp, Homo sapiens
tgaactaatttctt

SEQ ID NO: 6484539 - DNA, 13 bp, Homo sapiens
tgaactactgcta

SEQ ID NO: 6484540 - DNA, 16 bp, Homo sapiens
tgaactactgctattt

SEQ ID NO: 6484541 - DNA, 18 bp, Homo sapiens
tgaactagagactctgtg

SEQ ID NO: 6484542 - DNA, 20 bp, Homo sapiens
tgaactagctaccatataag

SEQ ID NO: 6484543 - DNA, 18 bp, Homo sapiens
tgaactaggctgagcaat

SEQ ID NO: 6484544 - DNA, 23 bp, Homo sapiens
tgaactagggtggtgcatttttg

SEQ ID NO: 6484545 - DNA, 16 bp, Homo sapiens
tgaactaggtgctggc

SEQ ID NO: 6484546 - DNA, 22 bp, Homo sapiens
tgaactatatcagtagtgtaca

SEQ ID NO: 6484547 - DNA, 20 bp, Homo sapiens
tgaactatcagggcaagctc

SEQ ID NO: 6484548 - DNA, 18 bp, Homo sapiens
tgaactatgactggagta

SEQ ID NO: 6484549 - DNA, 12 bp, Homo sapiens
tgaactattgag

SEQ ID NO: 6484550 - DNA, 21 bp, Homo sapiens
tgaactattgagaagatcgga

SEQ ID NO: 6484551 - DNA, 16 bp, Homo sapiens
tgaactattttgaaga

SEQ ID NO: 6484552 - DNA, 18 bp, Homo sapiens
tgaactattttgaagaaa

SEQ ID NO: 6484553 - DNA, 14 bp, Homo sapiens
tgaactcaaacgat

SEQ ID NO: 6484554 - DNA, 20 bp, Homo sapiens
tgaactcaatctaaattaaa

SEQ ID NO: 6484555 - DNA, 21 bp, Homo sapiens
tgaactcaatctaaattaaaa

SEQ ID NO: 6484556 - DNA, 14 bp, Homo sapiens
tgaactcaatgcat

SEQ ID NO: 6484557 - DNA, 18 bp, Homo sapiens
tgaactcaatgcatgatg

SEQ ID NO: 6484558 - DNA, 14 bp, Homo sapiens
tgaactcaatgtgc

SEQ ID NO: 6484559 - DNA, 16 bp, Homo sapiens
tgaactcaatgtgcaa

SEQ ID NO: 6484560 - DNA, 16 bp, Homo sapiens
tgaactcagccaagca

SEQ ID NO: 6484561 - DNA, 19 bp, Homo sapiens
tgaactcagccaagcacag

SEQ ID NO: 6484562 - DNA, 16 bp, Homo sapiens
tgaactcatcattttt

SEQ ID NO: 6484563 - DNA, 14 bp, Homo sapiens
tgaactcattctct

SEQ ID NO: 6484564 - DNA, 20 bp, Homo sapiens
tgaactcattctcttcttgc

SEQ ID NO: 6484565 - DNA, 21 bp, Homo sapiens
tgaactccaccgaccaactgc

SEQ ID NO: 6484566 - DNA, 23 bp, Homo sapiens
tgaactccaccgaccaactgccc

SEQ ID NO: 6484567 - DNA, 12 bp, Homo sapiens
tgaactccagag

SEQ ID NO: 6484568 - DNA, 13 bp, Homo sapiens
tgaactccagagg

SEQ ID NO: 6484569 - DNA, 12 bp, Homo sapiens
tgaactccaggc

SEQ ID NO: 6484570 - DNA, 14 bp, Homo sapiens
tgaactccaggcat

SEQ ID NO: 6484571 - DNA, 15 bp, Homo sapiens
tgaactccaggcatg

SEQ ID NO: 6484572 - DNA, 18 bp, Homo sapiens
tgaactccatacagcctc

SEQ ID NO: 6484573 - DNA, 19 bp, Homo sapiens
tgaactccatacagcctct

SEQ ID NO: 6484574 - DNA, 20 bp, Homo sapiens
tgaactccatacagcctcta

SEQ ID NO: 6484575 - DNA, 21 bp, Homo sapiens
tgaactcctagactcaagtga

SEQ ID NO: 6484576 - DNA, 19 bp, Homo sapiens
tgaactcctcaagggcaga

SEQ ID NO: 6484577 - DNA, 23 bp, Homo sapiens
tgaactcctcaagggcagagaac

SEQ ID NO: 6484578 - DNA, 18 bp, Homo sapiens
tgaactcctgacctcagg

SEQ ID NO: 6484579 - DNA, 15 bp, Homo sapiens
tgaactcctgccagg

SEQ ID NO: 6484580 - DNA, 12 bp, Homo sapiens
tgaactcctggc

SEQ ID NO: 6484581 - DNA, 17 bp, Homo sapiens
tgaactccttccccact

SEQ ID NO: 6484582 - DNA, 18 bp, Homo sapiens
tgaactccttccccactt

SEQ ID NO: 6484583 - DNA, 22 bp, Homo sapiens
tgaactctaagcagaagactct

SEQ ID NO: 6484584 - DNA, 21 bp, Homo sapiens
tgaactctattttgattattg

SEQ ID NO: 6484585 - DNA, 11 bp, Homo sapiens
tgaactctcaa

SEQ ID NO: 6484586 - DNA, 22 bp, Homo sapiens
tgaactctcaaaagtctatttt

SEQ ID NO: 6484587 - DNA, 18 bp, Homo sapiens
tgaactctcaaatccaaa

SEQ ID NO: 6484588 - DNA, 16 bp, Homo sapiens
tgaactctcccctccc

SEQ ID NO: 6484589 - DNA, 21 bp, Homo sapiens
tgaactctcccctccccatct

SEQ ID NO: 6484590 - DNA, 18 bp, Homo sapiens
tgaactctgaactttgga

SEQ ID NO: 6484591 - DNA, 16 bp, Homo sapiens
tgaactctgacaacag

SEQ ID NO: 6484592 - DNA, 16 bp, Homo sapiens
tgaactctgttccccc

SEQ ID NO: 6484593 - DNA, 19 bp, Homo sapiens
tgaactctgttcccccacc

SEQ ID NO: 6484594 - DNA, 21 bp, Homo sapiens
tgaactctgttcccccaccct

SEQ ID NO: 6484595 - DNA, 15 bp, Homo sapiens
tgaactcttaatcaa

SEQ ID NO: 6484596 - DNA, 21 bp, Homo sapiens
tgaactcttaatcaaatagca

SEQ ID NO: 6484597 - DNA, 12 bp, Homo sapiens
tgaactcttaga

SEQ ID NO: 6484598 - DNA, 17 bp, Homo sapiens
tgaactcttaggcacat

SEQ ID NO: 6484599 - DNA, 15 bp, Homo sapiens
tgaactcttcaatct

SEQ ID NO: 6484600 - DNA, 18 bp, Homo sapiens
tgaactcttctcattact

SEQ ID NO: 6484601 - DNA, 21 bp, Homo sapiens
tgaactcttctcattacttgt

SEQ ID NO: 6484602 - DNA, 15 bp, Homo sapiens
tgaactcttggcctc

SEQ ID NO: 6484603 - DNA, 19 bp, Homo sapiens
tgaactctttaagttgaaa

SEQ ID NO: 6484604 - DNA, 22 bp, Homo sapiens
tgaactgaaacttttctaaagt

SEQ ID NO: 6484605 - DNA, 19 bp, Homo sapiens
tgaactgaactctgacaac

SEQ ID NO: 6484606 - DNA, 17 bp, Homo sapiens
tgaactgaagcagagtc

SEQ ID NO: 6484607 - DNA, 20 bp, Homo sapiens
tgaactgaaggcagcatgta

SEQ ID NO: 6484608 - DNA, 13 bp, Homo sapiens
tgaactgaagttt

SEQ ID NO: 6484609 - DNA, 17 bp, Homo sapiens
tgaactgacaatgaagg

SEQ ID NO: 6484610 - DNA, 13 bp, Homo sapiens
tgaactgagaagg

SEQ ID NO: 6484611 - DNA, 16 bp, Homo sapiens
tgaactgagaaggcag

SEQ ID NO: 6484612 - DNA, 22 bp, Homo sapiens
tgaactgagccaaacacactgt

SEQ ID NO: 6484613 - DNA, 17 bp, Homo sapiens
tgaactgagccccagcg

SEQ ID NO: 6484614 - DNA, 20 bp, Homo sapiens
tgaactgagcctagctacct

SEQ ID NO: 6484615 - DNA, 23 bp, Homo sapiens
tgaactgaggagatgaccaggga

SEQ ID NO: 6484616 - DNA, 14 bp, Homo sapiens
tgaactgaggccct

SEQ ID NO: 6484617 - DNA, 19 bp, Homo sapiens
tgaactgaggccctgtgat

SEQ ID NO: 6484618 - DNA, 21 bp, Homo sapiens
tgaactgataatttttgtttt

SEQ ID NO: 6484619 - DNA, 12 bp, Homo sapiens
tgaactgattca

SEQ ID NO: 6484620 - DNA, 14 bp, Homo sapiens
tgaactgcaacact

SEQ ID NO: 6484621 - DNA, 17 bp, Homo sapiens
tgaactgcaggaagaga

SEQ ID NO: 6484622 - DNA, 13 bp, Homo sapiens
tgaactgcccact

SEQ ID NO: 6484623 - DNA, 14 bp, Homo sapiens
tgaactgcccactg

SEQ ID NO: 6484624 - DNA, 16 bp, Homo sapiens
tgaactgcgtgccagt

SEQ ID NO: 6484625 - DNA, 14 bp, Homo sapiens
tgaactgctgctgg

SEQ ID NO: 6484626 - DNA, 23 bp, Homo sapiens
tgaactgctggagtctggcttta

SEQ ID NO: 6484627 - DNA, 19 bp, Homo sapiens
tgaactgcttgctaccaat

SEQ ID NO: 6484628 - DNA, 16 bp, Homo sapiens
tgaactgctttcaagt

SEQ ID NO: 6484629 - DNA, 15 bp, Homo sapiens
tgaactgcttttcct

SEQ ID NO: 6484630 - DNA, 16 bp, Homo sapiens
tgaactgcttttcctc

SEQ ID NO: 6484631 - DNA, 14 bp, Homo sapiens
tgaactggaataat

SEQ ID NO: 6484632 - DNA, 21 bp, Homo sapiens
tgaactggaccctgttgctaa

SEQ ID NO: 6484633 - DNA, 22 bp, Homo sapiens
tgaactggaccctgttgctaag

SEQ ID NO: 6484634 - DNA, 14 bp, Homo sapiens
tgaactggccccag

SEQ ID NO: 6484635 - DNA, 16 bp, Homo sapiens
tgaactggccccagct

SEQ ID NO: 6484636 - DNA, 17 bp, Homo sapiens
tgaactggcctctgcct

SEQ ID NO: 6484637 - DNA, 20 bp, Homo sapiens
tgaactgggcacagattgaa

SEQ ID NO: 6484638 - DNA, 17 bp, Homo sapiens
tgaactgggcatttcac

SEQ ID NO: 6484639 - DNA, 15 bp, Homo sapiens
tgaactggtcttcct

SEQ ID NO: 6484640 - DNA, 15 bp, Homo sapiens
tgaactgtatattat

SEQ ID NO: 6484641 - DNA, 16 bp, Homo sapiens
tgaactgtatattatt

SEQ ID NO: 6484642 - DNA, 18 bp, Homo sapiens
tgaactgtattattgcaa

SEQ ID NO: 6484643 - DNA, 12 bp, Homo sapiens
tgaactgtgaca

SEQ ID NO: 6484644 - DNA, 15 bp, Homo sapiens
tgaactgtgacagga

SEQ ID NO: 6484645 - DNA, 16 bp, Homo sapiens
tgaactgtgacaggaa

SEQ ID NO: 6484646 - DNA, 19 bp, Homo sapiens
tgaactgtgatggggtggg

SEQ ID NO: 6484647 - DNA, 17 bp, Homo sapiens
tgaactgtggccaccta

SEQ ID NO: 6484648 - DNA, 12 bp, Homo sapiens
tgaactgtgtgt

SEQ ID NO: 6484649 - DNA, 14 bp, Homo sapiens
tgaactgttagaat

SEQ ID NO: 6484650 - DNA, 17 bp, Homo sapiens
tgaactgttagaatgta

SEQ ID NO: 6484651 - DNA, 23 bp, Homo sapiens
tgaactgtttggtcgagtctttg

SEQ ID NO: 6484652 - DNA, 14 bp, Homo sapiens
tgaacttaacatgc

SEQ ID NO: 6484653 - DNA, 17 bp, Homo sapiens
tgaacttaacatgctgt

SEQ ID NO: 6484654 - DNA, 23 bp, Homo sapiens
tgaacttacacttggagcccgtg

SEQ ID NO: 6484655 - DNA, 19 bp, Homo sapiens
tgaacttacaggtgattaa

SEQ ID NO: 6484656 - DNA, 21 bp, Homo sapiens
tgaacttagaactatgctaat

SEQ ID NO: 6484657 - DNA, 16 bp, Homo sapiens
tgaacttataatgatt

SEQ ID NO: 6484658 - DNA, 19 bp, Homo sapiens
tgaacttattacctaatta

SEQ ID NO: 6484659 - DNA, 16 bp, Homo sapiens
tgaacttcatatacta

SEQ ID NO: 6484660 - DNA, 12 bp, Homo sapiens
tgaacttccagg

SEQ ID NO: 6484661 - DNA, 15 bp, Homo sapiens
tgaacttccaggaaa

SEQ ID NO: 6484662 - DNA, 23 bp, Homo sapiens
tgaacttccatttgtattcaaat

SEQ ID NO: 6484663 - DNA, 22 bp, Homo sapiens
tgaacttctctcagacttactt

SEQ ID NO: 6484664 - DNA, 17 bp, Homo sapiens
tgaacttctttgaattt

SEQ ID NO: 6484665 - DNA, 15 bp, Homo sapiens
tgaacttgagatctg

SEQ ID NO: 6484666 - DNA, 19 bp, Homo sapiens
tgaacttgagatctgtata

SEQ ID NO: 6484667 - DNA, 17 bp, Homo sapiens
tgaacttgatgttcctg

SEQ ID NO: 6484668 - DNA, 20 bp, Homo sapiens
tgaacttgatgttcctggga

SEQ ID NO: 6484669 - DNA, 16 bp, Homo sapiens
tgaacttgcctctttt

SEQ ID NO: 6484670 - DNA, 15 bp, Homo sapiens
tgaacttggagaggg

SEQ ID NO: 6484671 - DNA, 21 bp, Homo sapiens
tgaacttggagagggggccgg

SEQ ID NO: 6484672 - DNA, 14 bp, Homo sapiens
tgaacttgtagctg

SEQ ID NO: 6484673 - DNA, 16 bp, Homo sapiens
tgaacttgtagctgta

SEQ ID NO: 6484674 - DNA, 11 bp, Homo sapiens
tgaacttgtca

SEQ ID NO: 6484675 - DNA, 12 bp, Homo sapiens
tgaactttaaaa

SEQ ID NO: 6484676 - DNA, 14 bp, Homo sapiens
tgaactttcattgg

SEQ ID NO: 6484677 - DNA, 13 bp, Homo sapiens
tgaactttctcag

SEQ ID NO: 6484678 - DNA, 16 bp, Homo sapiens
tgaactttctccctca

SEQ ID NO: 6484679 - DNA, 22 bp, Homo sapiens
tgaactttctcttcatactttt

SEQ ID NO: 6484680 - DNA, 13 bp, Homo sapiens
tgaactttgaaga

SEQ ID NO: 6484681 - DNA, 18 bp, Homo sapiens
tgaactttgaatgaaatt

SEQ ID NO: 6484682 - DNA, 23 bp, Homo sapiens
tgaactttgccaaaaaaaaaaga

SEQ ID NO: 6484683 - DNA, 15 bp, Homo sapiens
tgaactttgctgagc

SEQ ID NO: 6484684 - DNA, 17 bp, Homo sapiens
tgaactttgggaagcct

SEQ ID NO: 6484685 - DNA, 15 bp, Homo sapiens
tgaactttgtttcca

SEQ ID NO: 6484686 - DNA, 21 bp, Homo sapiens
tgaacttttaatgaactttga

SEQ ID NO: 6484687 - DNA, 19 bp, Homo sapiens
tgaacttttacagaatgca

SEQ ID NO: 6484688 - DNA, 22 bp, Homo sapiens
tgaacttttcaaaataaagctt

SEQ ID NO: 6484689 - DNA, 23 bp, Homo sapiens
tgaacttttcaaaataaagcttt

SEQ ID NO: 6484690 - DNA, 14 bp, Homo sapiens
tgaacttttcagga

SEQ ID NO: 6484691 - DNA, 12 bp, Homo sapiens
tgaacttttcat

SEQ ID NO: 6484692 - DNA, 12 bp, Homo sapiens
tgaacttttgta

SEQ ID NO: 6484693 - DNA, 15 bp, Homo sapiens
tgaacttttgtaatt

SEQ ID NO: 6484694 - DNA, 18 bp, Homo sapiens
tgaacttttgtactgaat

SEQ ID NO: 6484695 - DNA, 17 bp, Homo sapiens
tgaactttttaacaaat

SEQ ID NO: 6484696 - DNA, 14 bp, Homo sapiens
tgaactttttattt

SEQ ID NO: 6484697 - DNA, 21 bp, Homo sapiens
tgaactttttatttgaggaga

SEQ ID NO: 6484698 - DNA, 23 bp, Homo sapiens
tgaactttttatttgaggagacg

SEQ ID NO: 6484699 - DNA, 13 bp, Homo sapiens
tgaactttttgta

SEQ ID NO: 6484700 - DNA, 19 bp, Homo sapiens
tgaagaaaaaattttaaaa

SEQ ID NO: 6484701 - DNA, 20 bp, Homo sapiens
tgaagaaaaaattttaaaaa

SEQ ID NO: 6484702 - DNA, 12 bp, Homo sapiens
tgaagaaaacaa

SEQ ID NO: 6484703 - DNA, 12 bp, Homo sapiens
tgaagaaaacac

SEQ ID NO: 6484704 - DNA, 14 bp, Homo sapiens
tgaagaaaacacaa

SEQ ID NO: 6484705 - DNA, 15 bp, Homo sapiens
tgaagaaaagtgggc

SEQ ID NO: 6484706 - DNA, 12 bp, Homo sapiens
tgaagaaaatac

SEQ ID NO: 6484707 - DNA, 20 bp, Homo sapiens
tgaagaaaatacttaaatgt

SEQ ID NO: 6484708 - DNA, 22 bp, Homo sapiens
tgaagaaaatacttaaatgtta

SEQ ID NO: 6484709 - DNA, 24 bp, Homo sapiens
tgaagaaaatacttaaatgttatg

SEQ ID NO: 6484710 - DNA, 15 bp, Homo sapiens
tgaagaaaatcactt

SEQ ID NO: 6484711 - DNA, 17 bp, Homo sapiens
tgaagaaaatccttcag

SEQ ID NO: 6484712 - DNA, 13 bp, Homo sapiens
tgaagaaaatgag

SEQ ID NO: 6484713 - DNA, 20 bp, Homo sapiens
tgaagaaacacagcatgcat

SEQ ID NO: 6484714 - DNA, 22 bp, Homo sapiens
tgaagaaacacagcatgcattt

SEQ ID NO: 6484715 - DNA, 16 bp, Homo sapiens
tgaagaaacagctatg

SEQ ID NO: 6484716 - DNA, 18 bp, Homo sapiens
tgaagaaacatttatctt

SEQ ID NO: 6484717 - DNA, 18 bp, Homo sapiens
tggcaaacagggcctctg

SEQ ID NO: 6484718 - DNA, 17 bp, Homo sapiens
tggcaaacatgtgcaac

SEQ ID NO: 6484719 - DNA, 12 bp, Homo sapiens
tggcaaacattt

SEQ ID NO: 6484720 - DNA, 16 bp, Homo sapiens
tggcaaaccccaaaga

SEQ ID NO: 6484721 - DNA, 16 bp, Homo sapiens
tggcaaacgggcttga

SEQ ID NO: 6484722 - DNA, 23 bp, Homo sapiens
tggcaaagcagcaacacacatgc

SEQ ID NO: 6484723 - DNA, 12 bp, Homo sapiens
tggcaaagccag

SEQ ID NO: 6484724 - DNA, 13 bp, Homo sapiens
tggcaaagccaga

SEQ ID NO: 6484725 - DNA, 17 bp, Homo sapiens
tggcaaagctgttcttc

SEQ ID NO: 6484726 - DNA, 19 bp, Homo sapiens
tggcaaagctgttcttcct

SEQ ID NO: 6484727 - DNA, 17 bp, Homo sapiens
tggcaaagcttttagaa

SEQ ID NO: 6484728 - DNA, 17 bp, Homo sapiens
tggcaaaggaaggtgga

SEQ ID NO: 6484729 - DNA, 22 bp, Homo sapiens
tggcaaaggacccttgagtaag

SEQ ID NO: 6484730 - DNA, 16 bp, Homo sapiens
tggcaaaggatccaga

SEQ ID NO: 6484731 - DNA, 21 bp, Homo sapiens
tggcaaagggagcagaactga

SEQ ID NO: 6484732 - DNA, 20 bp, Homo sapiens
tggcaaataatactaattta

SEQ ID NO: 6484733 - DNA, 23 bp, Homo sapiens
tggcaaataatactaatttataa

SEQ ID NO: 6484734 - DNA, 14 bp, Homo sapiens
tggcaaatataaaa

SEQ ID NO: 6484735 - DNA, 18 bp, Homo sapiens
tggcaaatattttgtcac

SEQ ID NO: 6484736 - DNA, 19 bp, Homo sapiens
tggcaaatattttgtcact

SEQ ID NO: 6484737 - DNA, 17 bp, Homo sapiens
tggcaaatcacttcaat

SEQ ID NO: 6484738 - DNA, 18 bp, Homo sapiens
tggcaaatcaggggccag

SEQ ID NO: 6484739 - DNA, 16 bp, Homo sapiens
tggcaaatgagtgaca

SEQ ID NO: 6484740 - DNA, 21 bp, Homo sapiens
tggcaaatggaggcttttcac

SEQ ID NO: 6484741 - DNA, 22 bp, Homo sapiens
tggcaaatggaggcttttcact

SEQ ID NO: 6484742 - DNA, 14 bp, Homo sapiens
tggcaaatttgtga

SEQ ID NO: 6484743 - DNA, 19 bp, Homo sapiens
tggcaaatttgtgaactgt

SEQ ID NO: 6484744 - DNA, 18 bp, Homo sapiens
tggcaaattttaaaacat

SEQ ID NO: 6484745 - DNA, 14 bp, Homo sapiens
tggcaacaaaatgt

SEQ ID NO: 6484746 - DNA, 15 bp, Homo sapiens
tggcaacaaactgca

SEQ ID NO: 6484747 - DNA, 17 bp, Homo sapiens
tggcaacaaactgcaca

SEQ ID NO: 6484748 - DNA, 18 bp, Homo sapiens
tggcaacaaactgcacat

SEQ ID NO: 6484749 - DNA, 20 bp, Homo sapiens
tggcaacagaaaacaattgt

SEQ ID NO: 6484750 - DNA, 15 bp, Homo sapiens
tggcaacagaaacca

SEQ ID NO: 6484751 - DNA, 12 bp, Homo sapiens
tggcaacagaag

SEQ ID NO: 6484752 - DNA, 17 bp, Homo sapiens
tggcaacagagcaagac

SEQ ID NO: 6484753 - DNA, 18 bp, Homo sapiens
tggcaacagatctggaac

SEQ ID NO: 6484754 - DNA, 20 bp, Homo sapiens
tggcaacaggacagagttca

SEQ ID NO: 6484755 - DNA, 17 bp, Homo sapiens
tggcaacattggacaga

SEQ ID NO: 6484756 - DNA, 23 bp, Homo sapiens
tggcaacattggacagaaaatgc

SEQ ID NO: 6484757 - DNA, 15 bp, Homo sapiens
tggcaacatttgggg

SEQ ID NO: 6484758 - DNA, 20 bp, Homo sapiens
tggcaacatttggggagaga

SEQ ID NO: 6484759 - DNA, 16 bp, Homo sapiens
tggcaaccagccagcg

SEQ ID NO: 6484760 - DNA, 14 bp, Homo sapiens
tggcaacctgcttc

SEQ ID NO: 6484761 - DNA, 20 bp, Homo sapiens
tggcaacgttcatgttcatc

SEQ ID NO: 6484762 - DNA, 19 bp, Homo sapiens
tggcaactgtattaaagaa

SEQ ID NO: 6484763 - DNA, 20 bp, Homo sapiens
tggcaactgtattaaagaaa

SEQ ID NO: 6484764 - DNA, 21 bp, Homo sapiens
tggcaactgtattaaagaaaa

SEQ ID NO: 6484765 - DNA, 22 bp, Homo sapiens
tggcaactgtattaaagaaaaa

SEQ ID NO: 6484766 - DNA, 15 bp, Homo sapiens
tggcaagaaccagtt

SEQ ID NO: 6484767 - DNA, 17 bp, Homo sapiens
tggcaagaacttgttta

SEQ ID NO: 6484768 - DNA, 20 bp, Homo sapiens
tggcaagaacttgtttacaa

SEQ ID NO: 6484769 - DNA, 15 bp, Homo sapiens
tggcaagactactgg

SEQ ID NO: 6484770 - DNA, 17 bp, Homo sapiens
tggcaagagatcatatc

SEQ ID NO: 6484771 - DNA, 21 bp, Homo sapiens
tggcaagagcgttactgtaga

SEQ ID NO: 6484772 - DNA, 13 bp, Homo sapiens
tggcaagaggcct

SEQ ID NO: 6484773 - DNA, 17 bp, Homo sapiens
tggcaagaggcctcatg

SEQ ID NO: 6484774 - DNA, 18 bp, Homo sapiens
tggcaagagggtgacagc

SEQ ID NO: 6484775 - DNA, 19 bp, Homo sapiens
tggcaagagtgtggaggct

SEQ ID NO: 6484776 - DNA, 18 bp, Homo sapiens
tggcaagatgaaataatt

SEQ ID NO: 6484777 - DNA, 19 bp, Homo sapiens
tggcaagattgaagtctga

SEQ ID NO: 6484778 - DNA, 15 bp, Homo sapiens
tggcaagcagggaaa

SEQ ID NO: 6484779 - DNA, 22 bp, Homo sapiens
tggcaagcagggaaagctccac

SEQ ID NO: 6484780 - DNA, 15 bp, Homo sapiens
tggcaagcatagtcg

SEQ ID NO: 6484781 - DNA, 15 bp, Homo sapiens
tggcaagcccctgcc

SEQ ID NO: 6484782 - DNA, 21 bp, Homo sapiens
tggcaagcccctgcccatctg

SEQ ID NO: 6484783 - DNA, 21 bp, Homo sapiens
tggcaagctagaacctggagg

SEQ ID NO: 6484784 - DNA, 16 bp, Homo sapiens
tggcaagctgcaaaag

SEQ ID NO: 6484785 - DNA, 21 bp, Homo sapiens
tggcaagctgcaaaaggcctg

SEQ ID NO: 6484786 - DNA, 12 bp, Homo sapiens
tggcaaggaaag

SEQ ID NO: 6484787 - DNA, 20 bp, Homo sapiens
tggcaaggcagccctgtctg

SEQ ID NO: 6484788 - DNA, 12 bp, Homo sapiens
tggcaaggctgt

SEQ ID NO: 6484789 - DNA, 20 bp, Homo sapiens
tggcaaggctgtgctccctg

SEQ ID NO: 6484790 - DNA, 16 bp, Homo sapiens
tggcaagggggcgggg

SEQ ID NO: 6484791 - DNA, 22 bp, Homo sapiens
tggcaaggtgggttccagggac

SEQ ID NO: 6484792 - DNA, 19 bp, Homo sapiens
tggcaagtcggggcctggg

SEQ ID NO: 6484793 - DNA, 20 bp, Homo sapiens
tggcaagtcggggcctggga

SEQ ID NO: 6484794 - DNA, 14 bp, Homo sapiens
tggcaagtgaattt

SEQ ID NO: 6484795 - DNA, 23 bp, Homo sapiens
tggcaagttttgatatgagtata

SEQ ID NO: 6484796 - DNA, 12 bp, Homo sapiens
tggcaataaact

SEQ ID NO: 6484797 - DNA, 12 bp, Homo sapiens
tggcaatagacc

SEQ ID NO: 6484798 - DNA, 20 bp, Homo sapiens
tggcaatagtcattaaaaac

SEQ ID NO: 6484799 - DNA, 17 bp, Homo sapiens
tggcaatagtgtgttct

SEQ ID NO: 6484800 - DNA, 19 bp, Homo sapiens
tggcaatattctgtaacta

SEQ ID NO: 6484801 - DNA, 15 bp, Homo sapiens
tggcaatatttgttc

SEQ ID NO: 6484802 - DNA, 19 bp, Homo sapiens
tggcaatctcagatgcagt

SEQ ID NO: 6484803 - DNA, 22 bp, Homo sapiens
tggcaatgaaaattttaagaag

SEQ ID NO: 6484804 - DNA, 13 bp, Homo sapiens
tggcaatgccaca

SEQ ID NO: 6484805 - DNA, 19 bp, Homo sapiens
tggcaatgctaattcaatg

SEQ ID NO: 6484806 - DNA, 21 bp, Homo sapiens
tggcaatgcttaaactaaata

SEQ ID NO: 6484807 - DNA, 23 bp, Homo sapiens
tggcaatgggccgtcccctctcc

SEQ ID NO: 6484808 - DNA, 19 bp, Homo sapiens
tggcaatggtagtttctgt

SEQ ID NO: 6484809 - DNA, 14 bp, Homo sapiens
tggcaattaaaaat

SEQ ID NO: 6484810 - DNA, 17 bp, Homo sapiens
tggcaattctggaagct

SEQ ID NO: 6484811 - DNA, 19 bp, Homo sapiens
tggcaattctggaagctga

SEQ ID NO: 6484812 - DNA, 23 bp, Homo sapiens
tggcaattctttgacctcaacct

SEQ ID NO: 6484813 - DNA, 16 bp, Homo sapiens
tggcaattgtccccag

SEQ ID NO: 6484814 - DNA, 13 bp, Homo sapiens
tggcaattgtcta

SEQ ID NO: 6484815 - DNA, 19 bp, Homo sapiens
tggcaattttgtaaattga

SEQ ID NO: 6484816 - DNA, 14 bp, Homo sapiens
tggcaattttgtgg

SEQ ID NO: 6484817 - DNA, 17 bp, Homo sapiens
tggcacaaaagacagct

SEQ ID NO: 6484818 - DNA, 22 bp, Homo sapiens
tggcacaaaagacagctggcgg

SEQ ID NO: 6484819 - DNA, 21 bp, Homo sapiens
tggcacaacgctctaccctgc

SEQ ID NO: 6484820 - DNA, 20 bp, Homo sapiens
tggcacaatctcacacagct

SEQ ID NO: 6484821 - DNA, 17 bp, Homo sapiens
tggcacaatgtatactt

SEQ ID NO: 6484822 - DNA, 14 bp, Homo sapiens
tggcacacactgac

SEQ ID NO: 6484823 - DNA, 13 bp, Homo sapiens
tggcacacagcag

SEQ ID NO: 6484824 - DNA, 15 bp, Homo sapiens
tggcacagaagagga

SEQ ID NO: 6484825 - DNA, 18 bp, Homo sapiens
tggcacagaagaggagtc

SEQ ID NO: 6484826 - DNA, 21 bp, Homo sapiens
tggcacagacttctggaaggc

SEQ ID NO: 6484827 - DNA, 18 bp, Homo sapiens
tggcacagcccaaagaag

SEQ ID NO: 6484828 - DNA, 17 bp, Homo sapiens
tggcacagcccctggag

SEQ ID NO: 6484829 - DNA, 24 bp, Homo sapiens
tggcacagcccctggagcctcaga

SEQ ID NO: 6484830 - DNA, 13 bp, Homo sapiens
tggcacagccctg

SEQ ID NO: 6484831 - DNA, 23 bp, Homo sapiens
tggcacagccgcgggccaggagg

SEQ ID NO: 6484832 - DNA, 14 bp, Homo sapiens
tggcacagcctgca

SEQ ID NO: 6484833 - DNA, 13 bp, Homo sapiens
tggcacagctggg

SEQ ID NO: 6484834 - DNA, 16 bp, Homo sapiens
tggcacagctgggagc

SEQ ID NO: 6484835 - DNA, 15 bp, Homo sapiens
tggcacaggactgat

SEQ ID NO: 6484836 - DNA, 20 bp, Homo sapiens
tggcacagggcatgaaatga

SEQ ID NO: 6484837 - DNA, 18 bp, Homo sapiens
tggcacagtgtctgggct

SEQ ID NO: 6484838 - DNA, 20 bp, Homo sapiens
tggcacagtgtctgggctga

SEQ ID NO: 6484839 - DNA, 20 bp, Homo sapiens
tggcacagttttctgagaaa

SEQ ID NO: 6484840 - DNA, 20 bp, Homo sapiens
tggcacatagtgggccttca

SEQ ID NO: 6484841 - DNA, 18 bp, Homo sapiens
tggcacatcagaaaggaa

SEQ ID NO: 6484842 - DNA, 21 bp, Homo sapiens
tggcacatcagcacgatttct

SEQ ID NO: 6484843 - DNA, 23 bp, Homo sapiens
tggcacatcagcacgatttctgt

SEQ ID NO: 6484844 - DNA, 15 bp, Homo sapiens
tggcacatgccacct

SEQ ID NO: 6484845 - DNA, 14 bp, Homo sapiens
tggcacattccttt

SEQ ID NO: 6484846 - DNA, 15 bp, Homo sapiens
tggcacattcctttg

SEQ ID NO: 6484847 - DNA, 22 bp, Homo sapiens
tggcacattgcccctctgcctt

SEQ ID NO: 6484848 - DNA, 17 bp, Homo sapiens
tggcacatttcagggag

SEQ ID NO: 6484849 - DNA, 19 bp, Homo sapiens
tggcacatttcagggagaa

SEQ ID NO: 6484850 - DNA, 21 bp, Homo sapiens
tggcacatttccccagacctg

SEQ ID NO: 6484851 - DNA, 17 bp, Homo sapiens
tggcaccaaagatgcag

SEQ ID NO: 6484852 - DNA, 13 bp, Homo sapiens
tggcaccaataaa

SEQ ID NO: 6484853 - DNA, 17 bp, Homo sapiens
tggcaccaataaaggag

SEQ ID NO: 6484854 - DNA, 20 bp, Homo sapiens
tggcaccaataaaggaggaa

SEQ ID NO: 6484855 - DNA, 22 bp, Homo sapiens
tggcaccaccagggtggaccag

SEQ ID NO: 6484856 - DNA, 18 bp, Homo sapiens
tggcaccactgcactcca

SEQ ID NO: 6484857 - DNA, 19 bp, Homo sapiens
tggcaccactgcactccag

SEQ ID NO: 6484858 - DNA, 21 bp, Homo sapiens
tggcaccagacacccaggact

SEQ ID NO: 6484859 - DNA, 14 bp, Homo sapiens
tggcaccagaggct

SEQ ID NO: 6484860 - DNA, 12 bp, Homo sapiens
tggcaccagatg

SEQ ID NO: 6484861 - DNA, 16 bp, Homo sapiens
tggcaccagcagcctg

SEQ ID NO: 6484862 - DNA, 19 bp, Homo sapiens
tggcaccagccccctggat

SEQ ID NO: 6484863 - DNA, 20 bp, Homo sapiens
tggcaccagccccctggatg

SEQ ID NO: 6484864 - DNA, 18 bp, Homo sapiens
tggcaccagcgaagggag

SEQ ID NO: 6484865 - DNA, 12 bp, Homo sapiens
tggcaccatcca

SEQ ID NO: 6484866 - DNA, 16 bp, Homo sapiens
tggcaccatggtgact

SEQ ID NO: 6484867 - DNA, 13 bp, Homo sapiens
tggcaccatgtgc

SEQ ID NO: 6484868 - DNA, 21 bp, Homo sapiens
tggcacccaaatcacatctca

SEQ ID NO: 6484869 - DNA, 13 bp, Homo sapiens
tggcacccaccac

SEQ ID NO: 6484870 - DNA, 22 bp, Homo sapiens
tggcacccaccgtggaggagga

SEQ ID NO: 6484871 - DNA, 20 bp, Homo sapiens
tggcacccactggaggtggg

SEQ ID NO: 6484872 - DNA, 18 bp, Homo sapiens
tggcacccggcccctgct

SEQ ID NO: 6484873 - DNA, 16 bp, Homo sapiens
tggcaccgcctcccca

SEQ ID NO: 6484874 - DNA, 13 bp, Homo sapiens
tggcacctcaggc

SEQ ID NO: 6484875 - DNA, 22 bp, Homo sapiens
tggcacctcaggctgagggccc

SEQ ID NO: 6484876 - DNA, 15 bp, Homo sapiens
tggcacctcctgaga

SEQ ID NO: 6484877 - DNA, 19 bp, Homo sapiens
tggcacctcctgagaaggc

SEQ ID NO: 6484878 - DNA, 13 bp, Homo sapiens
tggcacctgcaca

SEQ ID NO: 6484879 - DNA, 14 bp, Homo sapiens
tggcacctgcacac

SEQ ID NO: 6484880 - DNA, 17 bp, Homo sapiens
tggcacctgcacactcc

SEQ ID NO: 6484881 - DNA, 14 bp, Homo sapiens
tggcacctgcctag

SEQ ID NO: 6484882 - DNA, 14 bp, Homo sapiens
tggcacctgggttg

SEQ ID NO: 6484883 - DNA, 11 bp, Homo sapiens
tggcacctgta

SEQ ID NO: 6484884 - DNA, 13 bp, Homo sapiens
tggcacctgtctg

SEQ ID NO: 6484885 - DNA, 19 bp, Homo sapiens
tggcacctgtctgctccag

SEQ ID NO: 6484886 - DNA, 21 bp, Homo sapiens
tggcacctgtctgctccagct

SEQ ID NO: 6484887 - DNA, 15 bp, Homo sapiens
tggcacctgtggcca

SEQ ID NO: 6484888 - DNA, 21 bp, Homo sapiens
tggcacctgtggccagagcac

SEQ ID NO: 6484889 - DNA, 22 bp, Homo sapiens
tggcaccttcagactttgcttc

SEQ ID NO: 6484890 - DNA, 21 bp, Homo sapiens
tggcacctttgagagaggggg

SEQ ID NO: 6484891 - DNA, 14 bp, Homo sapiens
tggcacgaaggccc

SEQ ID NO: 6484892 - DNA, 16 bp, Homo sapiens
tggcacgatctcagct

SEQ ID NO: 6484893 - DNA, 17 bp, Homo sapiens
tggcacgatctcagctc

SEQ ID NO: 6484894 - DNA, 17 bp, Homo sapiens
tggcacgatctcggctc

SEQ ID NO: 6484895 - DNA, 14 bp, Homo sapiens
tgaagaaaccacag

SEQ ID NO: 6484896 - DNA, 21 bp, Homo sapiens
tgaagaaaccttcagatttgt

SEQ ID NO: 6484897 - DNA, 19 bp, Homo sapiens
tgaagaaagagactgtggg

SEQ ID NO: 6484898 - DNA, 21 bp, Homo sapiens
tgaagaaagccagacaacttc

SEQ ID NO: 6484899 - DNA, 13 bp, Homo sapiens
tgaagaaagttat

SEQ ID NO: 6484900 - DNA, 14 bp, Homo sapiens
tgaagaaataaatg

SEQ ID NO: 6484901 - DNA, 21 bp, Homo sapiens
tgaagaaatccaatcctagcc

SEQ ID NO: 6484902 - DNA, 14 bp, Homo sapiens
tgaagaaatgatgg

SEQ ID NO: 6484903 - DNA, 13 bp, Homo sapiens
tgaagaaatggaa

SEQ ID NO: 6484904 - DNA, 17 bp, Homo sapiens
tgaagaaattgtggggg

SEQ ID NO: 6484905 - DNA, 17 bp, Homo sapiens
tgaagaaatttatgaag

SEQ ID NO: 6484906 - DNA, 18 bp, Homo sapiens
tgaagaacacagcatgtg

SEQ ID NO: 6484907 - DNA, 22 bp, Homo sapiens
tgaagaacacagcatgtgccaa

SEQ ID NO: 6484908 - DNA, 13 bp, Homo sapiens
tgaagaacagtaa

SEQ ID NO: 6484909 - DNA, 16 bp, Homo sapiens
tgaagaacatctggag

SEQ ID NO: 6484910 - DNA, 19 bp, Homo sapiens
tgaagaaccagtcccccca

SEQ ID NO: 6484911 - DNA, 18 bp, Homo sapiens
tgaagaaccgcattttga

SEQ ID NO: 6484912 - DNA, 21 bp, Homo sapiens
tgaagaactctttttcctcta

SEQ ID NO: 6484913 - DNA, 17 bp, Homo sapiens
tgaagaactgcactttt

SEQ ID NO: 6484914 - DNA, 15 bp, Homo sapiens
tgaagaactgcaggc

SEQ ID NO: 6484915 - DNA, 20 bp, Homo sapiens
tgaagaagaaccagcccagc

SEQ ID NO: 6484916 - DNA, 22 bp, Homo sapiens
tgaagaagaaccagcccagcct

SEQ ID NO: 6484917 - DNA, 13 bp, Homo sapiens
tgaagaagacaaa

SEQ ID NO: 6484918 - DNA, 15 bp, Homo sapiens
tgaagaagatgagcc

SEQ ID NO: 6484919 - DNA, 22 bp, Homo sapiens
tgaagaagcaccaatcatgaat

SEQ ID NO: 6484920 - DNA, 23 bp, Homo sapiens
tgaagaagcacttctgctgcatc

SEQ ID NO: 6484921 - DNA, 14 bp, Homo sapiens
tgaagaagccctgt

SEQ ID NO: 6484922 - DNA, 15 bp, Homo sapiens
tgaagaagccctgtt

SEQ ID NO: 6484923 - DNA, 16 bp, Homo sapiens
tgaagaagccctgttc

SEQ ID NO: 6484924 - DNA, 17 bp, Homo sapiens
tgaagaagccctgttct

SEQ ID NO: 6484925 - DNA, 15 bp, Homo sapiens
tgaagaagcctcaca

SEQ ID NO: 6484926 - DNA, 19 bp, Homo sapiens
tgaagaaggaaagaaccga

SEQ ID NO: 6484927 - DNA, 13 bp, Homo sapiens
tgaagaaggaagc

SEQ ID NO: 6484928 - DNA, 17 bp, Homo sapiens
tgaagaaggagcagaat

SEQ ID NO: 6484929 - DNA, 22 bp, Homo sapiens
tgaagaaggagcagaataaatg

SEQ ID NO: 6484930 - DNA, 15 bp, Homo sapiens
tgaagaaggcaaggc

SEQ ID NO: 6484931 - DNA, 16 bp, Homo sapiens
tgaagaagggggtggg

SEQ ID NO: 6484932 - DNA, 21 bp, Homo sapiens
tgaagaagggggtggggggag

SEQ ID NO: 6484933 - DNA, 23 bp, Homo sapiens
tgaagaaggtggaccttttaaag

SEQ ID NO: 6484934 - DNA, 17 bp, Homo sapiens
tgaagaagttaattctt

SEQ ID NO: 6484935 - DNA, 22 bp, Homo sapiens
tgaagaagttcagaaatttaaa

SEQ ID NO: 6484936 - DNA, 14 bp, Homo sapiens
tgaagaatacagtt

SEQ ID NO: 6484937 - DNA, 15 bp, Homo sapiens
tgaagaatacagtta

SEQ ID NO: 6484938 - DNA, 11 bp, Homo sapiens
tgaagaatatt

SEQ ID NO: 6484939 - DNA, 17 bp, Homo sapiens
tgaagaatatttaagaa

SEQ ID NO: 6484940 - DNA, 18 bp, Homo sapiens
tgaagaatatttaagaaa

SEQ ID NO: 6484941 - DNA, 16 bp, Homo sapiens
tgaagaatcaagaggg

SEQ ID NO: 6484942 - DNA, 16 bp, Homo sapiens
tgaagaatccttttgt

SEQ ID NO: 6484943 - DNA, 19 bp, Homo sapiens
tgaagaatgtctgtacctt

SEQ ID NO: 6484944 - DNA, 23 bp, Homo sapiens
tgaagaatgttagagtaatgaaa

SEQ ID NO: 6484945 - DNA, 20 bp, Homo sapiens
tgaagaattaatgacaacaa

SEQ ID NO: 6484946 - DNA, 12 bp, Homo sapiens
tgaagaattatt

SEQ ID NO: 6484947 - DNA, 20 bp, Homo sapiens
tgaagaattattttttttct

SEQ ID NO: 6484948 - DNA, 11 bp, Homo sapiens
tgaagaattgt

SEQ ID NO: 6484949 - DNA, 11 bp, Homo sapiens
tgaagaattta

SEQ ID NO: 6484950 - DNA, 13 bp, Homo sapiens
tgaagaatttaaa

SEQ ID NO: 6484951 - DNA, 16 bp, Homo sapiens
tgaagaatttgttctt

SEQ ID NO: 6484952 - DNA, 21 bp, Homo sapiens
tgaagacaaaaatactctaat

SEQ ID NO: 6484953 - DNA, 12 bp, Homo sapiens
tgaagacaatga

SEQ ID NO: 6484954 - DNA, 13 bp, Homo sapiens
tgaagacaatttg

SEQ ID NO: 6484955 - DNA, 21 bp, Homo sapiens
tgaagacaatttgatacataa

SEQ ID NO: 6484956 - DNA, 22 bp, Homo sapiens
tgaagacaatttgatacataat

SEQ ID NO: 6484957 - DNA, 17 bp, Homo sapiens
tgaagacaccagagtgt

SEQ ID NO: 6484958 - DNA, 21 bp, Homo sapiens
tgaagacaccagagtgtatgc

SEQ ID NO: 6484959 - DNA, 19 bp, Homo sapiens
tgaagacacgcccgactct

SEQ ID NO: 6484960 - DNA, 23 bp, Homo sapiens
tgaagacacgcccgactctctcc

SEQ ID NO: 6484961 - DNA, 22 bp, Homo sapiens
tgaagacactacagaggattct

SEQ ID NO: 6484962 - DNA, 22 bp, Homo sapiens
tgaagacactgtgcaggcccag

SEQ ID NO: 6484963 - DNA, 23 bp, Homo sapiens
tgaagacactgtgcaggcccagg

SEQ ID NO: 6484964 - DNA, 13 bp, Homo sapiens
tgaagacagaagt

SEQ ID NO: 6484965 - DNA, 14 bp, Homo sapiens
tgaagacagagcaa

SEQ ID NO: 6484966 - DNA, 21 bp, Homo sapiens
tgaagacagagcaaagcgccc

SEQ ID NO: 6484967 - DNA, 15 bp, Homo sapiens
tgaagacagcccgat

SEQ ID NO: 6484968 - DNA, 23 bp, Homo sapiens
tgaagacagcccgatcctcccct

SEQ ID NO: 6484969 - DNA, 15 bp, Homo sapiens
tgaagacaggcacaa

SEQ ID NO: 6484970 - DNA, 18 bp, Homo sapiens
tgaagacaggcacaaaat

SEQ ID NO: 6484971 - DNA, 12 bp, Homo sapiens
tgaagacataaa

SEQ ID NO: 6484972 - DNA, 19 bp, Homo sapiens
tgaagacattttttgctat

SEQ ID NO: 6484973 - DNA, 13 bp, Homo sapiens
tgaagaccaaaga

SEQ ID NO: 6484974 - DNA, 16 bp, Homo sapiens
tgaagaccaaatgata

SEQ ID NO: 6484975 - DNA, 20 bp, Homo sapiens
tgaagaccaatcaaatatat

SEQ ID NO: 6484976 - DNA, 16 bp, Homo sapiens
tgaagacccaaaacag

SEQ ID NO: 6484977 - DNA, 13 bp, Homo sapiens
tgaagacccagga

SEQ ID NO: 6484978 - DNA, 21 bp, Homo sapiens
tgaagacccagtgtaaagaat

SEQ ID NO: 6484979 - DNA, 18 bp, Homo sapiens
tgaagacctaaagtgctt

SEQ ID NO: 6484980 - DNA, 20 bp, Homo sapiens
tgaagacctaaatgacctca

SEQ ID NO: 6484981 - DNA, 23 bp, Homo sapiens
tgaagacctaaatgacctcagca

SEQ ID NO: 6484982 - DNA, 17 bp, Homo sapiens
tgaagacctaaccaggg

SEQ ID NO: 6484983 - DNA, 19 bp, Homo sapiens
tgaagacctaaccagggcc

SEQ ID NO: 6484984 - DNA, 24 bp, Homo sapiens
tgaagacctccacattaagtggct

SEQ ID NO: 6484985 - DNA, 18 bp, Homo sapiens
tgaagacctttttctgca

SEQ ID NO: 6484986 - DNA, 12 bp, Homo sapiens
tgaagacgtgga

SEQ ID NO: 6484987 - DNA, 13 bp, Homo sapiens
tgaagacgtggac

SEQ ID NO: 6484988 - DNA, 17 bp, Homo sapiens
tgaagacgtggactcct

SEQ ID NO: 6484989 - DNA, 18 bp, Homo sapiens
tgaagacgtggactcctc

SEQ ID NO: 6484990 - DNA, 20 bp, Homo sapiens
tgaagacgtggactcctctt

SEQ ID NO: 6484991 - DNA, 20 bp, Homo sapiens
tgaagactagttatatattc

SEQ ID NO: 6484992 - DNA, 19 bp, Homo sapiens
tgaagactcattcttctgt

SEQ ID NO: 6484993 - DNA, 14 bp, Homo sapiens
tgaagactccagaa

SEQ ID NO: 6484994 - DNA, 14 bp, Homo sapiens
tgaagactccctga

SEQ ID NO: 6484995 - DNA, 15 bp, Homo sapiens
tgaagactgagaact

SEQ ID NO: 6484996 - DNA, 14 bp, Homo sapiens
tgaagactgaggac

SEQ ID NO: 6484997 - DNA, 17 bp, Homo sapiens
tgaagactggaagctaa

SEQ ID NO: 6484998 - DNA, 21 bp, Homo sapiens
tgaagacttaactggcccaga

SEQ ID NO: 6484999 - DNA, 22 bp, Homo sapiens
tgaagacttaactggcccagaa

SEQ ID NO: 6485000 - DNA, 23 bp, Homo sapiens
tgaagacttacagcaaatccttt

SEQ ID NO: 6485001 - DNA, 14 bp, Homo sapiens
tgaagacttttctt

SEQ ID NO: 6485002 - DNA, 22 bp, Homo sapiens
tgaagacttttctttcagccaa

SEQ ID NO: 6485003 - DNA, 15 bp, Homo sapiens
tgaagagaaaaaaag

SEQ ID NO: 6485004 - DNA, 21 bp, Homo sapiens
tgaagagaaaaaaaggaaaag

SEQ ID NO: 6485005 - DNA, 22 bp, Homo sapiens
tgaagagaaaaaggctgaaaag

SEQ ID NO: 6485006 - DNA, 23 bp, Homo sapiens
tgaagagaaccgagcaaagatca

SEQ ID NO: 6485007 - DNA, 19 bp, Homo sapiens
tgaagagaagctgagaaga

SEQ ID NO: 6485008 - DNA, 22 bp, Homo sapiens
tgaagagaagctgagaagaagc

SEQ ID NO: 6485009 - DNA, 22 bp, Homo sapiens
tgaagagaagggcagggctgag

SEQ ID NO: 6485010 - DNA, 15 bp, Homo sapiens
tgaagagaatgtatt

SEQ ID NO: 6485011 - DNA, 12 bp, Homo sapiens
tgaagagacaga

SEQ ID NO: 6485012 - DNA, 15 bp, Homo sapiens
tgaagagagatatat

SEQ ID NO: 6485013 - DNA, 21 bp, Homo sapiens
tgaagagagatatatctgaaa

SEQ ID NO: 6485014 - DNA, 22 bp, Homo sapiens
tgaagagagggacaggcactcc

SEQ ID NO: 6485015 - DNA, 17 bp, Homo sapiens
tgaagagatccttccat

SEQ ID NO: 6485016 - DNA, 19 bp, Homo sapiens
tgaagagatccttccattc

SEQ ID NO: 6485017 - DNA, 23 bp, Homo sapiens
tgaagagatgacaacaaattttg

SEQ ID NO: 6485018 - DNA, 15 bp, Homo sapiens
tgaagagattgctga

SEQ ID NO: 6485019 - DNA, 15 bp, Homo sapiens
tgaagagatttttca

SEQ ID NO: 6485020 - DNA, 17 bp, Homo sapiens
tgaagagccagcccaag

SEQ ID NO: 6485021 - DNA, 22 bp, Homo sapiens
tgaagagcctgaagctggcctg

SEQ ID NO: 6485022 - DNA, 13 bp, Homo sapiens
tgaagagcgctcc

SEQ ID NO: 6485023 - DNA, 22 bp, Homo sapiens
tgaagagcgctcctctgccttg

SEQ ID NO: 6485024 - DNA, 15 bp, Homo sapiens
tgaagagctagagaa

SEQ ID NO: 6485025 - DNA, 13 bp, Homo sapiens
tgaagagctcttg

SEQ ID NO: 6485026 - DNA, 15 bp, Homo sapiens
tgaagagctcttggc

SEQ ID NO: 6485027 - DNA, 17 bp, Homo sapiens
tgaagagctcttggccc

SEQ ID NO: 6485028 - DNA, 21 bp, Homo sapiens
tgaagagctgtcttcccctga

SEQ ID NO: 6485029 - DNA, 17 bp, Homo sapiens
tgaagagcttgctttga

SEQ ID NO: 6485030 - DNA, 17 bp, Homo sapiens
tgaagagcttgtgtcct

SEQ ID NO: 6485031 - DNA, 12 bp, Homo sapiens
tgaagaggaaaa

SEQ ID NO: 6485032 - DNA, 15 bp, Homo sapiens
tgaagaggaccagag

SEQ ID NO: 6485033 - DNA, 17 bp, Homo sapiens
tgaagaggaccagagga

SEQ ID NO: 6485034 - DNA, 19 bp, Homo sapiens
tgaagaggaccagaggagc

SEQ ID NO: 6485035 - DNA, 18 bp, Homo sapiens
tgaagaggagattggcca

SEQ ID NO: 6485036 - DNA, 18 bp, Homo sapiens
tgaagaggaggaggaggg

SEQ ID NO: 6485037 - DNA, 20 bp, Homo sapiens
tgaagaggcaagagacagaa

SEQ ID NO: 6485038 - DNA, 19 bp, Homo sapiens
tgaagaggcgggccagcca

SEQ ID NO: 6485039 - DNA, 21 bp, Homo sapiens
tgaagaggcgggccagccagg

SEQ ID NO: 6485040 - DNA, 23 bp, Homo sapiens
tgaagaggcgggccagccaggcg

SEQ ID NO: 6485041 - DNA, 21 bp, Homo sapiens
tgaagagggagaagcatgaaa

SEQ ID NO: 6485042 - DNA, 12 bp, Homo sapiens
tgaagaggggca

SEQ ID NO: 6485043 - DNA, 22 bp, Homo sapiens
tgaagaggttctgattttcttg

SEQ ID NO: 6485044 - DNA, 19 bp, Homo sapiens
tgaagaggttttaaagctt

SEQ ID NO: 6485045 - DNA, 23 bp, Homo sapiens
tgaagagtaagtcaacctgcctg

SEQ ID NO: 6485046 - DNA, 21 bp, Homo sapiens
tgaagagtagaacccaggtct

SEQ ID NO: 6485047 - DNA, 15 bp, Homo sapiens
tgaagagtatccttc

SEQ ID NO: 6485048 - DNA, 20 bp, Homo sapiens
tgaagagtatccttccttca

SEQ ID NO: 6485049 - DNA, 16 bp, Homo sapiens
tgaagagtattaatgt

SEQ ID NO: 6485050 - DNA, 18 bp, Homo sapiens
tgaagagtcgattatttc

SEQ ID NO: 6485051 - DNA, 17 bp, Homo sapiens
tgaagagtgaagagcat

SEQ ID NO: 6485052 - DNA, 18 bp, Homo sapiens
tgaagagtgagagggcat

SEQ ID NO: 6485053 - DNA, 11 bp, Homo sapiens
tgaagagtgga

SEQ ID NO: 6485054 - DNA, 13 bp, Homo sapiens
tgaagagttccaa

SEQ ID NO: 6485055 - DNA, 15 bp, Homo sapiens
tgaagagtttcacaa

SEQ ID NO: 6485056 - DNA, 16 bp, Homo sapiens
tgaagagtttgtaaat

SEQ ID NO: 6485057 - DNA, 23 bp, Homo sapiens
tgaagataaatccaactctgact

SEQ ID NO: 6485058 - DNA, 15 bp, Homo sapiens
tgaagataaatgctt

SEQ ID NO: 6485059 - DNA, 20 bp, Homo sapiens
tgaagataaatgctttaaat

SEQ ID NO: 6485060 - DNA, 23 bp, Homo sapiens
tgaagataaatgctttaaatagt

SEQ ID NO: 6485061 - DNA, 19 bp, Homo sapiens
tgaagataacgccttccct

SEQ ID NO: 6485062 - DNA, 13 bp, Homo sapiens
tgaagatacacat

SEQ ID NO: 6485063 - DNA, 15 bp, Homo sapiens
tgaagatacatgtct

SEQ ID NO: 6485064 - DNA, 15 bp, Homo sapiens
tgaagatactttgta

SEQ ID NO: 6485065 - DNA, 16 bp, Homo sapiens
tgaagatactttgtat

SEQ ID NO: 6485066 - DNA, 15 bp, Homo sapiens
tgaagatagaagaaa

SEQ ID NO: 6485067 - DNA, 17 bp, Homo sapiens
tgaagatagaagaaaaa

SEQ ID NO: 6485068 - DNA, 23 bp, Homo sapiens
tgaagatataactattgcccagg

SEQ ID NO: 6485069 - DNA, 22 bp, Homo sapiens
tgaagatatcttgaaatgaaag

SEQ ID NO: 6485070 - DNA, 16 bp, Homo sapiens
tgaagatcaatttctc

SEQ ID NO: 6485071 - DNA, 15 bp, Homo sapiens
tgaagatcagaacat

SEQ ID NO: 6485072 - DNA, 22 bp, Homo sapiens
tgaagatcatatacgtgaaaat

SEQ ID NO: 6485073 - DNA, 19 bp, Homo sapiens
tggcacgcacctgtagtcc

SEQ ID NO: 6485074 - DNA, 23 bp, Homo sapiens
tggcacgcacctgtagtcccagc

SEQ ID NO: 6485075 - DNA, 14 bp, Homo sapiens
tggcacgccctact

SEQ ID NO: 6485076 - DNA, 14 bp, Homo sapiens
tggcacgggccctc

SEQ ID NO: 6485077 - DNA, 14 bp, Homo sapiens
tggcacggtggtac

SEQ ID NO: 6485078 - DNA, 14 bp, Homo sapiens
tggcacgtattgct

SEQ ID NO: 6485079 - DNA, 17 bp, Homo sapiens
tggcacgtattgctgtg

SEQ ID NO: 6485080 - DNA, 15 bp, Homo sapiens
tggcacgtgcctgta

SEQ ID NO: 6485081 - DNA, 18 bp, Homo sapiens
tggcacgtggccaggagc

SEQ ID NO: 6485082 - DNA, 19 bp, Homo sapiens
tggcacgtggccaggagcc

SEQ ID NO: 6485083 - DNA, 21 bp, Homo sapiens
tggcactaaaccacttctctg

SEQ ID NO: 6485084 - DNA, 23 bp, Homo sapiens
tggcactaaaccacttctctgct

SEQ ID NO: 6485085 - DNA, 15 bp, Homo sapiens
tggcactagtatttc

SEQ ID NO: 6485086 - DNA, 15 bp, Homo sapiens
tggcactataatgta

SEQ ID NO: 6485087 - DNA, 21 bp, Homo sapiens
tggcactataatgtaagctct

SEQ ID NO: 6485088 - DNA, 14 bp, Homo sapiens
tggcactattttta

SEQ ID NO: 6485089 - DNA, 16 bp, Homo sapiens
tggcactatttttatt

SEQ ID NO: 6485090 - DNA, 15 bp, Homo sapiens
tggcactcaacatga

SEQ ID NO: 6485091 - DNA, 17 bp, Homo sapiens
tggcactcacagacctg

SEQ ID NO: 6485092 - DNA, 18 bp, Homo sapiens
tggcactcacagacctgg

SEQ ID NO: 6485093 - DNA, 14 bp, Homo sapiens
tggcactctgtgtg

SEQ ID NO: 6485094 - DNA, 12 bp, Homo sapiens
tggcactgacag

SEQ ID NO: 6485095 - DNA, 16 bp, Homo sapiens
tggcactgacagcctg

SEQ ID NO: 6485096 - DNA, 12 bp, Homo sapiens
tggcactgaccg

SEQ ID NO: 6485097 - DNA, 13 bp, Homo sapiens
tggcactgactga

SEQ ID NO: 6485098 - DNA, 13 bp, Homo sapiens
tggcactgagccc

SEQ ID NO: 6485099 - DNA, 17 bp, Homo sapiens
tggcactgagccccccc

SEQ ID NO: 6485100 - DNA, 18 bp, Homo sapiens
tggcactgagccccccca

SEQ ID NO: 6485101 - DNA, 18 bp, Homo sapiens
tggcactgatgggcactg

SEQ ID NO: 6485102 - DNA, 19 bp, Homo sapiens
tggcactgatgggcactgg

SEQ ID NO: 6485103 - DNA, 19 bp, Homo sapiens
tggcactgcatacaatctg

SEQ ID NO: 6485104 - DNA, 19 bp, Homo sapiens
tggcactgctaaaatagaa

SEQ ID NO: 6485105 - DNA, 12 bp, Homo sapiens
tggcactgctgt

SEQ ID NO: 6485106 - DNA, 16 bp, Homo sapiens
tggcactgcttccagt

SEQ ID NO: 6485107 - DNA, 16 bp, Homo sapiens
tggcactggaccccag

SEQ ID NO: 6485108 - DNA, 18 bp, Homo sapiens
tggcactggatgcagaaa

SEQ ID NO: 6485109 - DNA, 19 bp, Homo sapiens
tggcactggatggacttgg

SEQ ID NO: 6485110 - DNA, 20 bp, Homo sapiens
tggcactggcattgtccctg

SEQ ID NO: 6485111 - DNA, 13 bp, Homo sapiens
tggcactgggagg

SEQ ID NO: 6485112 - DNA, 14 bp, Homo sapiens
tggcactgtaaggt

SEQ ID NO: 6485113 - DNA, 20 bp, Homo sapiens
tggcactgtaaggtgcttgc

SEQ ID NO: 6485114 - DNA, 22 bp, Homo sapiens
tggcactgtaaggtgcttgctc

SEQ ID NO: 6485115 - DNA, 23 bp, Homo sapiens
tggcactgtaaggtgcttgctcc

SEQ ID NO: 6485116 - DNA, 18 bp, Homo sapiens
tggcactgtccagggccc

SEQ ID NO: 6485117 - DNA, 20 bp, Homo sapiens
tggcactgtccagggcccat

SEQ ID NO: 6485118 - DNA, 21 bp, Homo sapiens
tggcactgtggaactgccacc

SEQ ID NO: 6485119 - DNA, 19 bp, Homo sapiens
tggcactgtggcactgcca

SEQ ID NO: 6485120 - DNA, 22 bp, Homo sapiens
tggcactgtggcactgccacca

SEQ ID NO: 6485121 - DNA, 20 bp, Homo sapiens
tggcactgttaatacacagt

SEQ ID NO: 6485122 - DNA, 15 bp, Homo sapiens
tggcacttatcatta

SEQ ID NO: 6485123 - DNA, 22 bp, Homo sapiens
tggcacttccacctccagcctc

SEQ ID NO: 6485124 - DNA, 16 bp, Homo sapiens
tggcacttgcatctgt

SEQ ID NO: 6485125 - DNA, 22 bp, Homo sapiens
tggcacttgccattccaaaata

SEQ ID NO: 6485126 - DNA, 15 bp, Homo sapiens
tggcacttgcctgct

SEQ ID NO: 6485127 - DNA, 18 bp, Homo sapiens
tggcacttgcctgctgct

SEQ ID NO: 6485128 - DNA, 23 bp, Homo sapiens
tggcacttgcctgctgcttggag

SEQ ID NO: 6485129 - DNA, 14 bp, Homo sapiens
tggcacttgtattt

SEQ ID NO: 6485130 - DNA, 15 bp, Homo sapiens
tggcacttgtattta

SEQ ID NO: 6485131 - DNA, 18 bp, Homo sapiens
tggcacttgtatttaatt

SEQ ID NO: 6485132 - DNA, 16 bp, Homo sapiens
tggcactttaatgata

SEQ ID NO: 6485133 - DNA, 14 bp, Homo sapiens
tggcactttagtga

SEQ ID NO: 6485134 - DNA, 22 bp, Homo sapiens
tggcactttagtgattgctttt

SEQ ID NO: 6485135 - DNA, 15 bp, Homo sapiens
tggcactttttcaca

SEQ ID NO: 6485136 - DNA, 20 bp, Homo sapiens
tggcactttttcacataagc

SEQ ID NO: 6485137 - DNA, 20 bp, Homo sapiens
tggcagaaaaaatgtctgta

SEQ ID NO: 6485138 - DNA, 21 bp, Homo sapiens
tggcagaaaaaatgtctgtaa

SEQ ID NO: 6485139 - DNA, 21 bp, Homo sapiens
tggcagaaacaggaggctccg

SEQ ID NO: 6485140 - DNA, 18 bp, Homo sapiens
tggcagaaagatggagag

SEQ ID NO: 6485141 - DNA, 23 bp, Homo sapiens
tggcagaaatacagtcttccaca

SEQ ID NO: 6485142 - DNA, 18 bp, Homo sapiens
tggcagaacgatgcctgc

SEQ ID NO: 6485143 - DNA, 22 bp, Homo sapiens
tggcagaacgatgcctgcaggc

SEQ ID NO: 6485144 - DNA, 14 bp, Homo sapiens
tggcagaactgagc

SEQ ID NO: 6485145 - DNA, 16 bp, Homo sapiens
tggcagaactgctggg

SEQ ID NO: 6485146 - DNA, 19 bp, Homo sapiens
tggcagaactgctggggct

SEQ ID NO: 6485147 - DNA, 22 bp, Homo sapiens
tggcagaactgctggggctggt

SEQ ID NO: 6485148 - DNA, 18 bp, Homo sapiens
tggcagaagacaccagag

SEQ ID NO: 6485149 - DNA, 23 bp, Homo sapiens
tggcagaagacaccagagcagat

SEQ ID NO: 6485150 - DNA, 23 bp, Homo sapiens
tggcagaagcgtctcccttggcc

SEQ ID NO: 6485151 - DNA, 15 bp, Homo sapiens
tggcagaagggaatt

SEQ ID NO: 6485152 - DNA, 21 bp, Homo sapiens
tggcagaagggagcagcacac

SEQ ID NO: 6485153 - DNA, 16 bp, Homo sapiens
tggcagaatgaaaatc

SEQ ID NO: 6485154 - DNA, 17 bp, Homo sapiens
tggcagaatgaaaatca

SEQ ID NO: 6485155 - DNA, 14 bp, Homo sapiens
tggcagaccatctc

SEQ ID NO: 6485156 - DNA, 18 bp, Homo sapiens
tggcagaccgggggccag

SEQ ID NO: 6485157 - DNA, 19 bp, Homo sapiens
tggcagactcaaggggctg

SEQ ID NO: 6485158 - DNA, 12 bp, Homo sapiens
tggcagactctt

SEQ ID NO: 6485159 - DNA, 15 bp, Homo sapiens
tggcagagaagagac

SEQ ID NO: 6485160 - DNA, 17 bp, Homo sapiens
tggcagagaaggcctct

SEQ ID NO: 6485161 - DNA, 23 bp, Homo sapiens
tggcagagaaggcctcttgtgct

SEQ ID NO: 6485162 - DNA, 16 bp, Homo sapiens
tggcagagaaggcttc

SEQ ID NO: 6485163 - DNA, 19 bp, Homo sapiens
tggcagagaaggcttcctc

SEQ ID NO: 6485164 - DNA, 21 bp, Homo sapiens
tggcagagacagtgggcacta

SEQ ID NO: 6485165 - DNA, 20 bp, Homo sapiens
tggcagagaccataagagaa

SEQ ID NO: 6485166 - DNA, 14 bp, Homo sapiens
tggcagagcacagc

SEQ ID NO: 6485167 - DNA, 15 bp, Homo sapiens
tggcagagcacagcc

SEQ ID NO: 6485168 - DNA, 18 bp, Homo sapiens
tggcagagcacagcccac

SEQ ID NO: 6485169 - DNA, 21 bp, Homo sapiens
tggcagagcccccaaggactc

SEQ ID NO: 6485170 - DNA, 17 bp, Homo sapiens
tggcagagcctctgaga

SEQ ID NO: 6485171 - DNA, 12 bp, Homo sapiens
tggcagaggagg

SEQ ID NO: 6485172 - DNA, 19 bp, Homo sapiens
tggcagagttacagttctg

SEQ ID NO: 6485173 - DNA, 17 bp, Homo sapiens
tggcagagttgaagaca

SEQ ID NO: 6485174 - DNA, 22 bp, Homo sapiens
tggcagagttgaagacagagct

SEQ ID NO: 6485175 - DNA, 20 bp, Homo sapiens
tggcagataatcagcctctt

SEQ ID NO: 6485176 - DNA, 21 bp, Homo sapiens
tggcagatcgctcactgttgt

SEQ ID NO: 6485177 - DNA, 19 bp, Homo sapiens
tggcagatgatttgggcag

SEQ ID NO: 6485178 - DNA, 21 bp, Homo sapiens
tggcagatgcagctcttcctg

SEQ ID NO: 6485179 - DNA, 18 bp, Homo sapiens
tggcagatgggggcctct

SEQ ID NO: 6485180 - DNA, 22 bp, Homo sapiens
tggcagatgtaaagttattctt

SEQ ID NO: 6485181 - DNA, 20 bp, Homo sapiens
tggcagatgtaggagggact

SEQ ID NO: 6485182 - DNA, 18 bp, Homo sapiens
tggcagatgtcttccctg

SEQ ID NO: 6485183 - DNA, 19 bp, Homo sapiens
tggcagatgtcttccctgg

SEQ ID NO: 6485184 - DNA, 22 bp, Homo sapiens
tggcagatgtcttccctgggct

SEQ ID NO: 6485185 - DNA, 18 bp, Homo sapiens
tggcagattcccactgcc

SEQ ID NO: 6485186 - DNA, 13 bp, Homo sapiens
tggcagattttac

SEQ ID NO: 6485187 - DNA, 15 bp, Homo sapiens
tggcagcaaaggaag

SEQ ID NO: 6485188 - DNA, 13 bp, Homo sapiens
tggcagcaacaat

SEQ ID NO: 6485189 - DNA, 14 bp, Homo sapiens
tggcagcacagccc

SEQ ID NO: 6485190 - DNA, 22 bp, Homo sapiens
tggcagcacagcccagggcctg

SEQ ID NO: 6485191 - DNA, 18 bp, Homo sapiens
tggcagcacccactcagc

SEQ ID NO: 6485192 - DNA, 23 bp, Homo sapiens
tggcagcaccgcctcttcccgcc

SEQ ID NO: 6485193 - DNA, 16 bp, Homo sapiens
tggcagcacgcaggcg

SEQ ID NO: 6485194 - DNA, 22 bp, Homo sapiens
tggcagcacgcaggcggggcag

SEQ ID NO: 6485195 - DNA, 17 bp, Homo sapiens
tggcagcacggcccggc

SEQ ID NO: 6485196 - DNA, 11 bp, Homo sapiens
tggcagcagat

SEQ ID NO: 6485197 - DNA, 13 bp, Homo sapiens
tggcagcagcccc

SEQ ID NO: 6485198 - DNA, 17 bp, Homo sapiens
tggcagcaggagggact

SEQ ID NO: 6485199 - DNA, 20 bp, Homo sapiens
tggcagcaggagggactctg

SEQ ID NO: 6485200 - DNA, 14 bp, Homo sapiens
tggcagcaggcagc

SEQ ID NO: 6485201 - DNA, 19 bp, Homo sapiens
tggcagcaggcctgttgct

SEQ ID NO: 6485202 - DNA, 20 bp, Homo sapiens
tggcagcaggcctgttgctt

SEQ ID NO: 6485203 - DNA, 13 bp, Homo sapiens
tggcagcaggtgc

SEQ ID NO: 6485204 - DNA, 21 bp, Homo sapiens
tggcagcaggtgctgctaccc

SEQ ID NO: 6485205 - DNA, 22 bp, Homo sapiens
tggcagcatgaattccaactca

SEQ ID NO: 6485206 - DNA, 22 bp, Homo sapiens
tggcagccaaggaatgtgtcca

SEQ ID NO: 6485207 - DNA, 11 bp, Homo sapiens
tggcagccaca

SEQ ID NO: 6485208 - DNA, 21 bp, Homo sapiens
tggcagccagacttctggagg

SEQ ID NO: 6485209 - DNA, 14 bp, Homo sapiens
tggcagccagggag

SEQ ID NO: 6485210 - DNA, 17 bp, Homo sapiens
tggcagccatgataata

SEQ ID NO: 6485211 - DNA, 13 bp, Homo sapiens
tggcagcccagcc

SEQ ID NO: 6485212 - DNA, 15 bp, Homo sapiens
tggcagccccagcac

SEQ ID NO: 6485213 - DNA, 13 bp, Homo sapiens
tggcagcccggct

SEQ ID NO: 6485214 - DNA, 14 bp, Homo sapiens
tggcagcccggctg

SEQ ID NO: 6485215 - DNA, 18 bp, Homo sapiens
tggcagcccggctgctgc

SEQ ID NO: 6485216 - DNA, 19 bp, Homo sapiens
tggcagcccggctgctgct

SEQ ID NO: 6485217 - DNA, 20 bp, Homo sapiens
tggcagcccggctgctgctt

SEQ ID NO: 6485218 - DNA, 21 bp, Homo sapiens
tggcagcccggctgctgcttg

SEQ ID NO: 6485219 - DNA, 18 bp, Homo sapiens
tggcagccgcctccctta

SEQ ID NO: 6485220 - DNA, 21 bp, Homo sapiens
tggcagccgggttagcatgtg

SEQ ID NO: 6485221 - DNA, 15 bp, Homo sapiens
tggcagccgtcccag

SEQ ID NO: 6485222 - DNA, 14 bp, Homo sapiens
tggcagcctcaggg

SEQ ID NO: 6485223 - DNA, 15 bp, Homo sapiens
tggcagcctcagggc

SEQ ID NO: 6485224 - DNA, 16 bp, Homo sapiens
tggcagcctcagggct

SEQ ID NO: 6485225 - DNA, 18 bp, Homo sapiens
tggcagcctcagggcttc

SEQ ID NO: 6485226 - DNA, 13 bp, Homo sapiens
tggcagcctccag

SEQ ID NO: 6485227 - DNA, 19 bp, Homo sapiens
tggcagcctcccatccagg

SEQ ID NO: 6485228 - DNA, 22 bp, Homo sapiens
tggcagcctcccatccagggcc

SEQ ID NO: 6485229 - DNA, 14 bp, Homo sapiens
tggcagcgcccagc

SEQ ID NO: 6485230 - DNA, 17 bp, Homo sapiens
tggcagcgcctcccgcc

SEQ ID NO: 6485231 - DNA, 24 bp, Homo sapiens
tggcagcgcctcccgccgcctcgg

SEQ ID NO: 6485232 - DNA, 16 bp, Homo sapiens
tggcagctagtgcctt

SEQ ID NO: 6485233 - DNA, 16 bp, Homo sapiens
tggcagctcagagagg

SEQ ID NO: 6485234 - DNA, 14 bp, Homo sapiens
tggcagctcctctc

SEQ ID NO: 6485235 - DNA, 17 bp, Homo sapiens
tggcagctcctctcctt

SEQ ID NO: 6485236 - DNA, 13 bp, Homo sapiens
tggcagctctcca

SEQ ID NO: 6485237 - DNA, 14 bp, Homo sapiens
tggcagctctccag

SEQ ID NO: 6485238 - DNA, 22 bp, Homo sapiens
tggcagctctggacagccccac

SEQ ID NO: 6485239 - DNA, 16 bp, Homo sapiens
tggcagctgagagccc

SEQ ID NO: 6485240 - DNA, 17 bp, Homo sapiens
tggcagctgagagccct

SEQ ID NO: 6485241 - DNA, 11 bp, Homo sapiens
tggcagctgcc

SEQ ID NO: 6485242 - DNA, 13 bp, Homo sapiens
tggcagctgcccc

SEQ ID NO: 6485243 - DNA, 15 bp, Homo sapiens
tggcagctgcccctg

SEQ ID NO: 6485244 - DNA, 22 bp, Homo sapiens
tggcagctgcccctggcacctg

SEQ ID NO: 6485245 - DNA, 15 bp, Homo sapiens
tggcagctgctgtgg

SEQ ID NO: 6485246 - DNA, 19 bp, Homo sapiens
tggcagctggggagcagct

SEQ ID NO: 6485247 - DNA, 18 bp, Homo sapiens
tggcagctgtcattcagg

SEQ ID NO: 6485248 - DNA, 23 bp, Homo sapiens
tggcagctgtcccctctccctgg

SEQ ID NO: 6485249 - DNA, 15 bp, Homo sapiens
tggcagctgtttctc

SEQ ID NO: 6485250 - DNA, 23 bp, Homo sapiens
tggcagctgtttctcatgaagct

SEQ ID NO: 6485251 - DNA, 22 bp, Homo sapiens
tgaagatcggctttcatgtaat

SEQ ID NO: 6485252 - DNA, 15 bp, Homo sapiens
tgaagatctaaataa

SEQ ID NO: 6485253 - DNA, 21 bp, Homo sapiens
tgaagatctcagataaagtga

SEQ ID NO: 6485254 - DNA, 21 bp, Homo sapiens
tgaagatctttatatttcaat

SEQ ID NO: 6485255 - DNA, 17 bp, Homo sapiens
tgaagatctttgacata

SEQ ID NO: 6485256 - DNA, 20 bp, Homo sapiens
tgaagatctttggcatgatt

SEQ ID NO: 6485257 - DNA, 22 bp, Homo sapiens
tgaagatgaaaggagtaagaaa

SEQ ID NO: 6485258 - DNA, 12 bp, Homo sapiens
tgaagatgaaat

SEQ ID NO: 6485259 - DNA, 12 bp, Homo sapiens
tgaagatgaaca

SEQ ID NO: 6485260 - DNA, 20 bp, Homo sapiens
tgaagatgaagaagcctttg

SEQ ID NO: 6485261 - DNA, 21 bp, Homo sapiens
tgaagatgcagcaaaatgtga

SEQ ID NO: 6485262 - DNA, 19 bp, Homo sapiens
tgaagatgcattttaaatg

SEQ ID NO: 6485263 - DNA, 20 bp, Homo sapiens
tgaagatgcattttaaatgt

SEQ ID NO: 6485264 - DNA, 18 bp, Homo sapiens
tgaagatgcccctgctcc

SEQ ID NO: 6485265 - DNA, 19 bp, Homo sapiens
tgaagatgcccctgctccc

SEQ ID NO: 6485266 - DNA, 17 bp, Homo sapiens
tgaagatgctgcctgta

SEQ ID NO: 6485267 - DNA, 20 bp, Homo sapiens
tgaagatgctgcctgtattt

SEQ ID NO: 6485268 - DNA, 18 bp, Homo sapiens
tgaagatgctttttgatc

SEQ ID NO: 6485269 - DNA, 17 bp, Homo sapiens
tgaagatggagggggct

SEQ ID NO: 6485270 - DNA, 23 bp, Homo sapiens
tgaagatggagggggctggggtc

SEQ ID NO: 6485271 - DNA, 17 bp, Homo sapiens
tgaagatggcatcctgt

SEQ ID NO: 6485272 - DNA, 19 bp, Homo sapiens
tgaagatggcatcctgtga

SEQ ID NO: 6485273 - DNA, 22 bp, Homo sapiens
tgaagatggcatcctgtgaagt

SEQ ID NO: 6485274 - DNA, 16 bp, Homo sapiens
tgaagatgggaacgca

SEQ ID NO: 6485275 - DNA, 15 bp, Homo sapiens
tgaagatgggagcct

SEQ ID NO: 6485276 - DNA, 18 bp, Homo sapiens
tgaagatggtttcaattc

SEQ ID NO: 6485277 - DNA, 13 bp, Homo sapiens
tgaagatgtaagg

SEQ ID NO: 6485278 - DNA, 12 bp, Homo sapiens
tgaagatgtagc

SEQ ID NO: 6485279 - DNA, 20 bp, Homo sapiens
tgaagatgtcatcccattgt

SEQ ID NO: 6485280 - DNA, 22 bp, Homo sapiens
tgaagatgtggatccctttaga

SEQ ID NO: 6485281 - DNA, 15 bp, Homo sapiens
tgaagatgttgagaa

SEQ ID NO: 6485282 - DNA, 15 bp, Homo sapiens
tgaagatgtttgcaa

SEQ ID NO: 6485283 - DNA, 17 bp, Homo sapiens
tgaagatgtttgcaata

SEQ ID NO: 6485284 - DNA, 19 bp, Homo sapiens
tgaagattaacactaatta

SEQ ID NO: 6485285 - DNA, 15 bp, Homo sapiens
tgaagattaacactg

SEQ ID NO: 6485286 - DNA, 17 bp, Homo sapiens
tgaagattaacactgag

SEQ ID NO: 6485287 - DNA, 21 bp, Homo sapiens
tgaagattaggagaaacacat

SEQ ID NO: 6485288 - DNA, 19 bp, Homo sapiens
tgaagattaggcacacaga

SEQ ID NO: 6485289 - DNA, 18 bp, Homo sapiens
tgaagattatatgaagtt

SEQ ID NO: 6485290 - DNA, 18 bp, Homo sapiens
tgaagattatttcattcg

SEQ ID NO: 6485291 - DNA, 17 bp, Homo sapiens
tgaagattcagcagtgt

SEQ ID NO: 6485292 - DNA, 19 bp, Homo sapiens
tgaagattcagcagtgtct

SEQ ID NO: 6485293 - DNA, 22 bp, Homo sapiens
tgaagattcagcagtgtctgtt

SEQ ID NO: 6485294 - DNA, 14 bp, Homo sapiens
tgaagattcaggct

SEQ ID NO: 6485295 - DNA, 19 bp, Homo sapiens
tgaagattcagtttaagag

SEQ ID NO: 6485296 - DNA, 11 bp, Homo sapiens
tgaagattctt

SEQ ID NO: 6485297 - DNA, 16 bp, Homo sapiens
tgaagattgtttatct

SEQ ID NO: 6485298 - DNA, 24 bp, Homo sapiens
tgaagattgtttatctagatgtaa

SEQ ID NO: 6485299 - DNA, 13 bp, Homo sapiens
tgaagatttaatt

SEQ ID NO: 6485300 - DNA, 17 bp, Homo sapiens
tgaagatttaccacttg

SEQ ID NO: 6485301 - DNA, 13 bp, Homo sapiens
tgaagatttcaga

SEQ ID NO: 6485302 - DNA, 17 bp, Homo sapiens
tgaagatttggtttttg

SEQ ID NO: 6485303 - DNA, 14 bp, Homo sapiens
tgaagcaaaaagat

SEQ ID NO: 6485304 - DNA, 13 bp, Homo sapiens
tgaagcaaacaca

SEQ ID NO: 6485305 - DNA, 14 bp, Homo sapiens
tgaagcaaacacac

SEQ ID NO: 6485306 - DNA, 22 bp, Homo sapiens
tgaagcaaacacacagactctg

SEQ ID NO: 6485307 - DNA, 15 bp, Homo sapiens
tgaagcaaacagttg

SEQ ID NO: 6485308 - DNA, 20 bp, Homo sapiens
tgaagcaaacagttgacaat

SEQ ID NO: 6485309 - DNA, 18 bp, Homo sapiens
tgaagcaaagcaccagct

SEQ ID NO: 6485310 - DNA, 20 bp, Homo sapiens
tgaagcaaatgtcatgctgc

SEQ ID NO: 6485311 - DNA, 21 bp, Homo sapiens
tgaagcaaatgtcatgctgcc

SEQ ID NO: 6485312 - DNA, 22 bp, Homo sapiens
tgaagcaacagctttgcagcaa

SEQ ID NO: 6485313 - DNA, 20 bp, Homo sapiens
tgaagcaacgataaaattac

SEQ ID NO: 6485314 - DNA, 16 bp, Homo sapiens
tgaagcaactgtgaat

SEQ ID NO: 6485315 - DNA, 16 bp, Homo sapiens
tgaagcaagctgtgtt

SEQ ID NO: 6485316 - DNA, 19 bp, Homo sapiens
tgaagcaagctgtgttact

SEQ ID NO: 6485317 - DNA, 20 bp, Homo sapiens
tgaagcaaggaagatataca

SEQ ID NO: 6485318 - DNA, 21 bp, Homo sapiens
tgaagcaaggaagatatacat

SEQ ID NO: 6485319 - DNA, 13 bp, Homo sapiens
tgaagcaataact

SEQ ID NO: 6485320 - DNA, 20 bp, Homo sapiens
tgaagcaataactccaagca

SEQ ID NO: 6485321 - DNA, 17 bp, Homo sapiens
tgaagcaattagtctga

SEQ ID NO: 6485322 - DNA, 22 bp, Homo sapiens
tgaagcaatttcagttttaaaa

SEQ ID NO: 6485323 - DNA, 16 bp, Homo sapiens
tgaagcaatttgaaat

SEQ ID NO: 6485324 - DNA, 17 bp, Homo sapiens
tgaagcaatttgaaata

SEQ ID NO: 6485325 - DNA, 19 bp, Homo sapiens
tgaagcaatttgaaataat

SEQ ID NO: 6485326 - DNA, 13 bp, Homo sapiens
tgaagcacaagtt

SEQ ID NO: 6485327 - DNA, 23 bp, Homo sapiens
tgaagcacagcaccgggggagag

SEQ ID NO: 6485328 - DNA, 17 bp, Homo sapiens
tgaagcaccaagctcaa

SEQ ID NO: 6485329 - DNA, 20 bp, Homo sapiens
tgaagcaccagggagaggcc

SEQ ID NO: 6485330 - DNA, 21 bp, Homo sapiens
tgaagcaccagggagaggcct

SEQ ID NO: 6485331 - DNA, 22 bp, Homo sapiens
tgaagcaccagggagaggcctc

SEQ ID NO: 6485332 - DNA, 18 bp, Homo sapiens
tgaagcaccatggtgtgt

SEQ ID NO: 6485333 - DNA, 17 bp, Homo sapiens
tgaagcacttaagtctt

SEQ ID NO: 6485334 - DNA, 15 bp, Homo sapiens
tgaagcagaaccttc

SEQ ID NO: 6485335 - DNA, 17 bp, Homo sapiens
tgaagcagaaccttctt

SEQ ID NO: 6485336 - DNA, 17 bp, Homo sapiens
tgaagcagaggaaggaa

SEQ ID NO: 6485337 - DNA, 12 bp, Homo sapiens
tgaagcagagtc

SEQ ID NO: 6485338 - DNA, 16 bp, Homo sapiens
tgaagcagagtcaagc

SEQ ID NO: 6485339 - DNA, 20 bp, Homo sapiens
tgaagcagagtcaagctgat

SEQ ID NO: 6485340 - DNA, 13 bp, Homo sapiens
tgaagcagagtgg

SEQ ID NO: 6485341 - DNA, 12 bp, Homo sapiens
tgaagcagcact

SEQ ID NO: 6485342 - DNA, 13 bp, Homo sapiens
tgaagcagcctct

SEQ ID NO: 6485343 - DNA, 14 bp, Homo sapiens
tgaagcagctctgc

SEQ ID NO: 6485344 - DNA, 17 bp, Homo sapiens
tgaagcagctctgcctt

SEQ ID NO: 6485345 - DNA, 13 bp, Homo sapiens
tgaagcaggaggc

SEQ ID NO: 6485346 - DNA, 17 bp, Homo sapiens
tgaagcagggtttcttt

SEQ ID NO: 6485347 - DNA, 20 bp, Homo sapiens
tgaagcaggttcccaagctc

SEQ ID NO: 6485348 - DNA, 15 bp, Homo sapiens
tgaagcagtattttg

SEQ ID NO: 6485349 - DNA, 20 bp, Homo sapiens
tgaagcagtcttgctctgtt

SEQ ID NO: 6485350 - DNA, 15 bp, Homo sapiens
tgaagcagtgcctcg

SEQ ID NO: 6485351 - DNA, 23 bp, Homo sapiens
tgaagcagtgcctcgaggcaccg

SEQ ID NO: 6485352 - DNA, 17 bp, Homo sapiens
tgaagcagttgtgtcag

SEQ ID NO: 6485353 - DNA, 14 bp, Homo sapiens
tgaagcataaacat

SEQ ID NO: 6485354 - DNA, 15 bp, Homo sapiens
tgaagcataaacatc

SEQ ID NO: 6485355 - DNA, 17 bp, Homo sapiens
tgaagcataatttgttt

SEQ ID NO: 6485356 - DNA, 20 bp, Homo sapiens
tgaagcatagctacaatttg

SEQ ID NO: 6485357 - DNA, 23 bp, Homo sapiens
tgaagcatagctacaatttgttt

SEQ ID NO: 6485358 - DNA, 19 bp, Homo sapiens
tgaagcatgctttgctgct

SEQ ID NO: 6485359 - DNA, 18 bp, Homo sapiens
tgaagcatttaaaagagt

SEQ ID NO: 6485360 - DNA, 18 bp, Homo sapiens
tgaagcatttcaaagccc

SEQ ID NO: 6485361 - DNA, 20 bp, Homo sapiens
tgaagcatttcaaagccctg

SEQ ID NO: 6485362 - DNA, 15 bp, Homo sapiens
tgaagcattttataa

SEQ ID NO: 6485363 - DNA, 17 bp, Homo sapiens
tgaagcattttataaat

SEQ ID NO: 6485364 - DNA, 11 bp, Homo sapiens
tgaagccaaag

SEQ ID NO: 6485365 - DNA, 21 bp, Homo sapiens
tgaagccaagtggggtgctgg

SEQ ID NO: 6485366 - DNA, 17 bp, Homo sapiens
tgaagccacacagccca

SEQ ID NO: 6485367 - DNA, 21 bp, Homo sapiens
tgaagccacacagcccagaag

SEQ ID NO: 6485368 - DNA, 19 bp, Homo sapiens
tgaagccacagcccaggcc

SEQ ID NO: 6485369 - DNA, 14 bp, Homo sapiens
tgaagccaccctgg

SEQ ID NO: 6485370 - DNA, 19 bp, Homo sapiens
tgaagccactgaagctggg

SEQ ID NO: 6485371 - DNA, 18 bp, Homo sapiens
tgaagccacttggcccag

SEQ ID NO: 6485372 - DNA, 19 bp, Homo sapiens
tgaagccacttggcccaga

SEQ ID NO: 6485373 - DNA, 19 bp, Homo sapiens
tgaagccagatccacccta

SEQ ID NO: 6485374 - DNA, 13 bp, Homo sapiens
tgaagccagcctt

SEQ ID NO: 6485375 - DNA, 16 bp, Homo sapiens
tgaagccagccttctt

SEQ ID NO: 6485376 - DNA, 21 bp, Homo sapiens
tgaagccatagcctccacgga

SEQ ID NO: 6485377 - DNA, 16 bp, Homo sapiens
tgaagccatgtagcca

SEQ ID NO: 6485378 - DNA, 17 bp, Homo sapiens
tgaagcccagcgacaca

SEQ ID NO: 6485379 - DNA, 14 bp, Homo sapiens
tgaagcccaggagg

SEQ ID NO: 6485380 - DNA, 16 bp, Homo sapiens
tgaagcccaggaggac

SEQ ID NO: 6485381 - DNA, 21 bp, Homo sapiens
tgaagcccaggctgatgcttg

SEQ ID NO: 6485382 - DNA, 22 bp, Homo sapiens
tgaagccccttgtcctctcccg

SEQ ID NO: 6485383 - DNA, 19 bp, Homo sapiens
tgaagcccgtgtcctgcct

SEQ ID NO: 6485384 - DNA, 15 bp, Homo sapiens
tgaagccctaagtaa

SEQ ID NO: 6485385 - DNA, 22 bp, Homo sapiens
tgaagccctagtagctggcgcc

SEQ ID NO: 6485386 - DNA, 15 bp, Homo sapiens
tgaagccctttgcct

SEQ ID NO: 6485387 - DNA, 15 bp, Homo sapiens
tgaagccgactctgg

SEQ ID NO: 6485388 - DNA, 16 bp, Homo sapiens
tgaagccgccagttca

SEQ ID NO: 6485389 - DNA, 14 bp, Homo sapiens
tgaagccggacagc

SEQ ID NO: 6485390 - DNA, 15 bp, Homo sapiens
tgaagccgtgcctgt

SEQ ID NO: 6485391 - DNA, 23 bp, Homo sapiens
tgaagccgtgcctgtagccttgg

SEQ ID NO: 6485392 - DNA, 13 bp, Homo sapiens
tgaagcctcccga

SEQ ID NO: 6485393 - DNA, 19 bp, Homo sapiens
tgaagcctctctccttggc

SEQ ID NO: 6485394 - DNA, 14 bp, Homo sapiens
tgaagcctctggga

SEQ ID NO: 6485395 - DNA, 23 bp, Homo sapiens
tgaagcctgctaaatgaagagac

SEQ ID NO: 6485396 - DNA, 11 bp, Homo sapiens
tgaagcctgga

SEQ ID NO: 6485397 - DNA, 19 bp, Homo sapiens
tgaagcctggacgcagcca

SEQ ID NO: 6485398 - DNA, 22 bp, Homo sapiens
tgaagcctggacgcagccacac

SEQ ID NO: 6485399 - DNA, 20 bp, Homo sapiens
tgaagcctggagctttcctg

SEQ ID NO: 6485400 - DNA, 22 bp, Homo sapiens
tgaagcctgtcgtgttctctcc

SEQ ID NO: 6485401 - DNA, 13 bp, Homo sapiens
tgaagcctgtgcc

SEQ ID NO: 6485402 - DNA, 16 bp, Homo sapiens
tgaagcctgtgccacc

SEQ ID NO: 6485403 - DNA, 16 bp, Homo sapiens
tgaagcctgtgcctcc

SEQ ID NO: 6485404 - DNA, 15 bp, Homo sapiens
tgaagccttagccag

SEQ ID NO: 6485405 - DNA, 16 bp, Homo sapiens
tgaagccttctgacct

SEQ ID NO: 6485406 - DNA, 19 bp, Homo sapiens
tgaagccttctgacctggg

SEQ ID NO: 6485407 - DNA, 15 bp, Homo sapiens
tgaagccttcttctg

SEQ ID NO: 6485408 - DNA, 19 bp, Homo sapiens
tgaagccttcttctgccac

SEQ ID NO: 6485409 - DNA, 13 bp, Homo sapiens
tgaagcctttctt

SEQ ID NO: 6485410 - DNA, 17 bp, Homo sapiens
tgaagcctttggtgaat

SEQ ID NO: 6485411 - DNA, 19 bp, Homo sapiens
tgaagcctttttttagtaa

SEQ ID NO: 6485412 - DNA, 16 bp, Homo sapiens
tgaagcgaacatcttc

SEQ ID NO: 6485413 - DNA, 19 bp, Homo sapiens
tgaagcgaacatcttcata

SEQ ID NO: 6485414 - DNA, 23 bp, Homo sapiens
tgaagcgaacatcttcatataaa

SEQ ID NO: 6485415 - DNA, 16 bp, Homo sapiens
tgaagcgactctcctg

SEQ ID NO: 6485416 - DNA, 15 bp, Homo sapiens
tgaagcggtcagact

SEQ ID NO: 6485417 - DNA, 19 bp, Homo sapiens
tgaagcggtcagactggag

SEQ ID NO: 6485418 - DNA, 13 bp, Homo sapiens
tgaagcgtgtttt

SEQ ID NO: 6485419 - DNA, 19 bp, Homo sapiens
tgaagcgtttttctttttc

SEQ ID NO: 6485420 - DNA, 17 bp, Homo sapiens
tgaagctaatgaccaac

SEQ ID NO: 6485421 - DNA, 13 bp, Homo sapiens
tgaagctaattat

SEQ ID NO: 6485422 - DNA, 14 bp, Homo sapiens
tgaagctaattatt

SEQ ID NO: 6485423 - DNA, 18 bp, Homo sapiens
tgaagctaattattttaa

SEQ ID NO: 6485424 - DNA, 23 bp, Homo sapiens
tgaagctaattattttaattagg

SEQ ID NO: 6485425 - DNA, 14 bp, Homo sapiens
tgaagctactgtgt

SEQ ID NO: 6485426 - DNA, 23 bp, Homo sapiens
tgaagctattgatgtttccagaa

SEQ ID NO: 6485427 - DNA, 17 bp, Homo sapiens
tgaagctcacactgatg

SEQ ID NO: 6485428 - DNA, 16 bp, Homo sapiens
tgaagctcacttctgg

SEQ ID NO: 6485429 - DNA, 14 bp, Homo sapiens
tggcagcttcaaaa

SEQ ID NO: 6485430 - DNA, 14 bp, Homo sapiens
tggcagcttccctg

SEQ ID NO: 6485431 - DNA, 15 bp, Homo sapiens
tggcagcttccctga

SEQ ID NO: 6485432 - DNA, 19 bp, Homo sapiens
tggcagcttccctgaacac

SEQ ID NO: 6485433 - DNA, 18 bp, Homo sapiens
tggcagcttgctgggctt

SEQ ID NO: 6485434 - DNA, 19 bp, Homo sapiens
tggcagcttgctgggcttt

SEQ ID NO: 6485435 - DNA, 20 bp, Homo sapiens
tggcagcttgctgggctttg

SEQ ID NO: 6485436 - DNA, 22 bp, Homo sapiens
tggcagcttgctgggctttggg

SEQ ID NO: 6485437 - DNA, 20 bp, Homo sapiens
tggcaggaaccatggacctg

SEQ ID NO: 6485438 - DNA, 17 bp, Homo sapiens
tggcaggacaaattgcg

SEQ ID NO: 6485439 - DNA, 20 bp, Homo sapiens
tggcaggacaaattgcgccc

SEQ ID NO: 6485440 - DNA, 21 bp, Homo sapiens
tggcaggacactgcagaacag

SEQ ID NO: 6485441 - DNA, 14 bp, Homo sapiens
tggcaggaccagga

SEQ ID NO: 6485442 - DNA, 16 bp, Homo sapiens
tggcaggaccaggact

SEQ ID NO: 6485443 - DNA, 14 bp, Homo sapiens
tggcaggactcctg

SEQ ID NO: 6485444 - DNA, 17 bp, Homo sapiens
tggcaggactcctggca

SEQ ID NO: 6485445 - DNA, 19 bp, Homo sapiens
tggcaggactcctggcagg

SEQ ID NO: 6485446 - DNA, 21 bp, Homo sapiens
tggcaggactcctggcagggc

SEQ ID NO: 6485447 - DNA, 11 bp, Homo sapiens
tggcaggactt

SEQ ID NO: 6485448 - DNA, 14 bp, Homo sapiens
tggcaggagaatca

SEQ ID NO: 6485449 - DNA, 20 bp, Homo sapiens
tggcaggagacactggtctc

SEQ ID NO: 6485450 - DNA, 21 bp, Homo sapiens
tggcaggagagagccttggcc

SEQ ID NO: 6485451 - DNA, 16 bp, Homo sapiens
tggcaggagcctcgtg

SEQ ID NO: 6485452 - DNA, 22 bp, Homo sapiens
tggcaggagcctcgtgtcctgc

SEQ ID NO: 6485453 - DNA, 23 bp, Homo sapiens
tggcaggagcctcgtgtcctgct

SEQ ID NO: 6485454 - DNA, 14 bp, Homo sapiens
tggcaggagctact

SEQ ID NO: 6485455 - DNA, 17 bp, Homo sapiens
tggcaggagctcctgga

SEQ ID NO: 6485456 - DNA, 18 bp, Homo sapiens
tggcaggaggacaggtgg

SEQ ID NO: 6485457 - DNA, 15 bp, Homo sapiens
tggcaggagggcagt

SEQ ID NO: 6485458 - DNA, 17 bp, Homo sapiens
tggcaggagggcagtgg

SEQ ID NO: 6485459 - DNA, 16 bp, Homo sapiens
tggcaggagtctctgc

SEQ ID NO: 6485460 - DNA, 17 bp, Homo sapiens
tggcaggagtgggctct

SEQ ID NO: 6485461 - DNA, 17 bp, Homo sapiens
tggcaggagtggggtgg

SEQ ID NO: 6485462 - DNA, 19 bp, Homo sapiens
tggcaggcacacagcagcc

SEQ ID NO: 6485463 - DNA, 22 bp, Homo sapiens
tggcaggcacacagcagccccc

SEQ ID NO: 6485464 - DNA, 12 bp, Homo sapiens
tggcaggcagag

SEQ ID NO: 6485465 - DNA, 17 bp, Homo sapiens
tggcaggcagaggccca

SEQ ID NO: 6485466 - DNA, 22 bp, Homo sapiens
tggcaggcagaggcccaggctg

SEQ ID NO: 6485467 - DNA, 20 bp, Homo sapiens
tggcaggcaggctcccaggg

SEQ ID NO: 6485468 - DNA, 12 bp, Homo sapiens
tggcaggcaggg

SEQ ID NO: 6485469 - DNA, 13 bp, Homo sapiens
tggcaggccagtg

SEQ ID NO: 6485470 - DNA, 12 bp, Homo sapiens
tggcaggcccac

SEQ ID NO: 6485471 - DNA, 16 bp, Homo sapiens
tggcaggccctgccca

SEQ ID NO: 6485472 - DNA, 18 bp, Homo sapiens
tggcaggccctgcccagc

SEQ ID NO: 6485473 - DNA, 19 bp, Homo sapiens
tggcaggccctgcccagcc

SEQ ID NO: 6485474 - DNA, 22 bp, Homo sapiens
tggcaggccctgcccagccagc

SEQ ID NO: 6485475 - DNA, 23 bp, Homo sapiens
tggcaggcctccctttggggaga

SEQ ID NO: 6485476 - DNA, 11 bp, Homo sapiens
tggcaggcctg

SEQ ID NO: 6485477 - DNA, 14 bp, Homo sapiens
tggcaggcctgacc

SEQ ID NO: 6485478 - DNA, 18 bp, Homo sapiens
tggcaggcggggggggcg

SEQ ID NO: 6485479 - DNA, 22 bp, Homo sapiens
tggcaggctactctgcccaccc

SEQ ID NO: 6485480 - DNA, 14 bp, Homo sapiens
tggcaggctgaggc

SEQ ID NO: 6485481 - DNA, 13 bp, Homo sapiens
tggcaggctggcc

SEQ ID NO: 6485482 - DNA, 19 bp, Homo sapiens
tggcagggaagggtgcctg

SEQ ID NO: 6485483 - DNA, 22 bp, Homo sapiens
tggcagggaccggcagagctct

SEQ ID NO: 6485484 - DNA, 13 bp, Homo sapiens
tggcagggacctg

SEQ ID NO: 6485485 - DNA, 19 bp, Homo sapiens
tggcagggaggtcaggccc

SEQ ID NO: 6485486 - DNA, 14 bp, Homo sapiens
tggcagggcacagg

SEQ ID NO: 6485487 - DNA, 18 bp, Homo sapiens
tggcagggcacagggcct

SEQ ID NO: 6485488 - DNA, 21 bp, Homo sapiens
tggcagggcacagggcctggc

SEQ ID NO: 6485489 - DNA, 13 bp, Homo sapiens
tggcagggcagca

SEQ ID NO: 6485490 - DNA, 19 bp, Homo sapiens
tggcagggcagcaggaggc

SEQ ID NO: 6485491 - DNA, 19 bp, Homo sapiens
tggcagggccacctgcagg

SEQ ID NO: 6485492 - DNA, 22 bp, Homo sapiens
tggcagggccagggcaatgcca

SEQ ID NO: 6485493 - DNA, 19 bp, Homo sapiens
tggcagggcctagctgcta

SEQ ID NO: 6485494 - DNA, 21 bp, Homo sapiens
tggcagggcctcatctcacct

SEQ ID NO: 6485495 - DNA, 18 bp, Homo sapiens
tggcagggcgtgaggaac

SEQ ID NO: 6485496 - DNA, 16 bp, Homo sapiens
tggcagggctcacact

SEQ ID NO: 6485497 - DNA, 18 bp, Homo sapiens
tggcagggctcacactcc

SEQ ID NO: 6485498 - DNA, 23 bp, Homo sapiens
tggcagggctgttccctccaggc

SEQ ID NO: 6485499 - DNA, 18 bp, Homo sapiens
tggcaggggaagccttgc

SEQ ID NO: 6485500 - DNA, 15 bp, Homo sapiens
tggcaggggacagga

SEQ ID NO: 6485501 - DNA, 18 bp, Homo sapiens
tggcaggggacaggagtc

SEQ ID NO: 6485502 - DNA, 22 bp, Homo sapiens
tggcaggggcagtggcctggat

SEQ ID NO: 6485503 - DNA, 13 bp, Homo sapiens
tggcagggggctg

SEQ ID NO: 6485504 - DNA, 18 bp, Homo sapiens
tggcagggggctgctgct

SEQ ID NO: 6485505 - DNA, 19 bp, Homo sapiens
tggcagggtccctccagca

SEQ ID NO: 6485506 - DNA, 15 bp, Homo sapiens
tggcaggtcactgtc

SEQ ID NO: 6485507 - DNA, 20 bp, Homo sapiens
tggcaggtcatggagcagcc

SEQ ID NO: 6485508 - DNA, 24 bp, Homo sapiens
tggcaggtcatggagcagccccca

SEQ ID NO: 6485509 - DNA, 15 bp, Homo sapiens
tggcaggtcctcccc

SEQ ID NO: 6485510 - DNA, 18 bp, Homo sapiens
tggcaggtgcagatgggc

SEQ ID NO: 6485511 - DNA, 15 bp, Homo sapiens
tggcaggtgcagccc

SEQ ID NO: 6485512 - DNA, 20 bp, Homo sapiens
tggcaggtgcctgtaatcct

SEQ ID NO: 6485513 - DNA, 15 bp, Homo sapiens
tggcaggtggccagg

SEQ ID NO: 6485514 - DNA, 18 bp, Homo sapiens
tggcaggtggccagggct

SEQ ID NO: 6485515 - DNA, 19 bp, Homo sapiens
tggcaggtggccagggctc

SEQ ID NO: 6485516 - DNA, 19 bp, Homo sapiens
tggcaggtgggctgcctgc

SEQ ID NO: 6485517 - DNA, 22 bp, Homo sapiens
tggcaggtgggggtgggctgct

SEQ ID NO: 6485518 - DNA, 16 bp, Homo sapiens
tggcaggtgtgggctc

SEQ ID NO: 6485519 - DNA, 20 bp, Homo sapiens
tggcaggtgtgggctcccac

SEQ ID NO: 6485520 - DNA, 14 bp, Homo sapiens
tggcagtaaagaga

SEQ ID NO: 6485521 - DNA, 22 bp, Homo sapiens
tggcagtaaagagaaactttgt

SEQ ID NO: 6485522 - DNA, 15 bp, Homo sapiens
tggcagtccagccag

SEQ ID NO: 6485523 - DNA, 16 bp, Homo sapiens
tggcagtccagccagc

SEQ ID NO: 6485524 - DNA, 20 bp, Homo sapiens
tggcagtccagccagctcct

SEQ ID NO: 6485525 - DNA, 13 bp, Homo sapiens
tggcagtcctgga

SEQ ID NO: 6485526 - DNA, 16 bp, Homo sapiens
tggcagtcctggaggc

SEQ ID NO: 6485527 - DNA, 16 bp, Homo sapiens
tggcagtctagggtga

SEQ ID NO: 6485528 - DNA, 15 bp, Homo sapiens
tggcagtctcagtcc

SEQ ID NO: 6485529 - DNA, 16 bp, Homo sapiens
tggcagtgactcccca

SEQ ID NO: 6485530 - DNA, 21 bp, Homo sapiens
tggcagtgactccccagccca

SEQ ID NO: 6485531 - DNA, 20 bp, Homo sapiens
tggcagtgactttgtataga

SEQ ID NO: 6485532 - DNA, 19 bp, Homo sapiens
tggcagtgagtgagcctgg

SEQ ID NO: 6485533 - DNA, 23 bp, Homo sapiens
tggcagtgagtgagcctggctct

SEQ ID NO: 6485534 - DNA, 15 bp, Homo sapiens
tggcagtgctgaagg

SEQ ID NO: 6485535 - DNA, 16 bp, Homo sapiens
tggcagtgctgaaggg

SEQ ID NO: 6485536 - DNA, 23 bp, Homo sapiens
tggcagtggactcagaaagccaa

SEQ ID NO: 6485537 - DNA, 14 bp, Homo sapiens
tggcagtggccagg

SEQ ID NO: 6485538 - DNA, 19 bp, Homo sapiens
tggcagtggccaggcaggg

SEQ ID NO: 6485539 - DNA, 17 bp, Homo sapiens
tggcagtggctctcaga

SEQ ID NO: 6485540 - DNA, 14 bp, Homo sapiens
tggcagtggctgtg

SEQ ID NO: 6485541 - DNA, 19 bp, Homo sapiens
tggcagtggctgtgaagga

SEQ ID NO: 6485542 - DNA, 23 bp, Homo sapiens
tggcagtgggaaaaatgtaggag

SEQ ID NO: 6485543 - DNA, 15 bp, Homo sapiens
tggcagtgggagctg

SEQ ID NO: 6485544 - DNA, 19 bp, Homo sapiens
tggcagtgggagctgcctg

SEQ ID NO: 6485545 - DNA, 17 bp, Homo sapiens
tggcagtgtggggaggg

SEQ ID NO: 6485546 - DNA, 14 bp, Homo sapiens
tggcagtgtttgta

SEQ ID NO: 6485547 - DNA, 17 bp, Homo sapiens
tggcagtgttttgagaa

SEQ ID NO: 6485548 - DNA, 17 bp, Homo sapiens
tggcagttgaacagagg

SEQ ID NO: 6485549 - DNA, 21 bp, Homo sapiens
tggcagttttgacatcagcca

SEQ ID NO: 6485550 - DNA, 15 bp, Homo sapiens
tggcataaattacag

SEQ ID NO: 6485551 - DNA, 16 bp, Homo sapiens
tggcataagacagaga

SEQ ID NO: 6485552 - DNA, 17 bp, Homo sapiens
tggcataatttgtctta

SEQ ID NO: 6485553 - DNA, 15 bp, Homo sapiens
tggcataatttttct

SEQ ID NO: 6485554 - DNA, 19 bp, Homo sapiens
tggcatacaaaatatttaa

SEQ ID NO: 6485555 - DNA, 14 bp, Homo sapiens
tggcatagacatgg

SEQ ID NO: 6485556 - DNA, 18 bp, Homo sapiens
tggcatagccattcattt

SEQ ID NO: 6485557 - DNA, 15 bp, Homo sapiens
tggcatagtggctta

SEQ ID NO: 6485558 - DNA, 16 bp, Homo sapiens
tggcatatagtgccct

SEQ ID NO: 6485559 - DNA, 16 bp, Homo sapiens
tggcatatctctgttc

SEQ ID NO: 6485560 - DNA, 16 bp, Homo sapiens
tggcatattgataata

SEQ ID NO: 6485561 - DNA, 17 bp, Homo sapiens
tggcatatttttcacat

SEQ ID NO: 6485562 - DNA, 18 bp, Homo sapiens
tggcatcaggagctgctc

SEQ ID NO: 6485563 - DNA, 22 bp, Homo sapiens
tggcatcagtttaggccttggc

SEQ ID NO: 6485564 - DNA, 21 bp, Homo sapiens
tggcatcatccattctctctg

SEQ ID NO: 6485565 - DNA, 18 bp, Homo sapiens
tggcatcatctcagctca

SEQ ID NO: 6485566 - DNA, 14 bp, Homo sapiens
tggcatcatggtgg

SEQ ID NO: 6485567 - DNA, 22 bp, Homo sapiens
tggcatccagggctgccaggag

SEQ ID NO: 6485568 - DNA, 18 bp, Homo sapiens
tggcatcccctttattaa

SEQ ID NO: 6485569 - DNA, 16 bp, Homo sapiens
tggcatccctgggcct

SEQ ID NO: 6485570 - DNA, 17 bp, Homo sapiens
tggcatcctccggagag

SEQ ID NO: 6485571 - DNA, 14 bp, Homo sapiens
tggcatcctggctg

SEQ ID NO: 6485572 - DNA, 15 bp, Homo sapiens
tggcatcctggctgg

SEQ ID NO: 6485573 - DNA, 16 bp, Homo sapiens
tggcatcctggctggc

SEQ ID NO: 6485574 - DNA, 20 bp, Homo sapiens
tggcatcctggcttgcctcc

SEQ ID NO: 6485575 - DNA, 21 bp, Homo sapiens
tggcatcgcaccattctgact

SEQ ID NO: 6485576 - DNA, 19 bp, Homo sapiens
tggcatcgcagcttcctgt

SEQ ID NO: 6485577 - DNA, 16 bp, Homo sapiens
tggcatcgtagaagag

SEQ ID NO: 6485578 - DNA, 20 bp, Homo sapiens
tggcatctcccccaccctgt

SEQ ID NO: 6485579 - DNA, 17 bp, Homo sapiens
tggcatctcctgtcctg

SEQ ID NO: 6485580 - DNA, 23 bp, Homo sapiens
tggcatctctccccatatataaa

SEQ ID NO: 6485581 - DNA, 18 bp, Homo sapiens
tggcatctctggagtgtg

SEQ ID NO: 6485582 - DNA, 19 bp, Homo sapiens
tggcatctctggagtgtgt

SEQ ID NO: 6485583 - DNA, 18 bp, Homo sapiens
tggcatctgacacaaaaa

SEQ ID NO: 6485584 - DNA, 14 bp, Homo sapiens
tggcatctgcaaag

SEQ ID NO: 6485585 - DNA, 14 bp, Homo sapiens
tggcatctgtgtgt

SEQ ID NO: 6485586 - DNA, 18 bp, Homo sapiens
tggcatcttaaaagctat

SEQ ID NO: 6485587 - DNA, 16 bp, Homo sapiens
tggcatctttgccttg

SEQ ID NO: 6485588 - DNA, 21 bp, Homo sapiens
tggcatctttgccttgggctg

SEQ ID NO: 6485589 - DNA, 17 bp, Homo sapiens
tggcatctttggaggaa

SEQ ID NO: 6485590 - DNA, 19 bp, Homo sapiens
tggcatcttttggaggaaa

SEQ ID NO: 6485591 - DNA, 19 bp, Homo sapiens
tggcatgaaccccaggctg

SEQ ID NO: 6485592 - DNA, 20 bp, Homo sapiens
tggcatgaatcgggctaagg

SEQ ID NO: 6485593 - DNA, 13 bp, Homo sapiens
tggcatgagaaat

SEQ ID NO: 6485594 - DNA, 21 bp, Homo sapiens
tggcatgagaaatacaaaaat

SEQ ID NO: 6485595 - DNA, 20 bp, Homo sapiens
tggcatgagccactgtgccc

SEQ ID NO: 6485596 - DNA, 15 bp, Homo sapiens
tggcatgaggaggtc

SEQ ID NO: 6485597 - DNA, 13 bp, Homo sapiens
tggcatgatttat

SEQ ID NO: 6485598 - DNA, 21 bp, Homo sapiens
tggcatgatttatatatggca

SEQ ID NO: 6485599 - DNA, 16 bp, Homo sapiens
tggcatgcaaaagaaa

SEQ ID NO: 6485600 - DNA, 13 bp, Homo sapiens
tggcatgcatccc

SEQ ID NO: 6485601 - DNA, 18 bp, Homo sapiens
tggcatgcatggaggact

SEQ ID NO: 6485602 - DNA, 15 bp, Homo sapiens
tggcatgccttccag

SEQ ID NO: 6485603 - DNA, 19 bp, Homo sapiens
tggcatgcgccaccatgcc

SEQ ID NO: 6485604 - DNA, 18 bp, Homo sapiens
tggcatgcttaaatattg

SEQ ID NO: 6485605 - DNA, 16 bp, Homo sapiens
tggcatggaaggggct

SEQ ID NO: 6485606 - DNA, 14 bp, Homo sapiens
tggcatggagactc

SEQ ID NO: 6485607 - DNA, 14 bp, Homo sapiens
tgaagctcagaaag

SEQ ID NO: 6485608 - DNA, 21 bp, Homo sapiens
tgaagctcagaaaggttgagg

SEQ ID NO: 6485609 - DNA, 17 bp, Homo sapiens
tgaagctcccttcaggc

SEQ ID NO: 6485610 - DNA, 21 bp, Homo sapiens
tgaagctcgcatccagacagt

SEQ ID NO: 6485611 - DNA, 15 bp, Homo sapiens
tgaagctgaaaatat

SEQ ID NO: 6485612 - DNA, 16 bp, Homo sapiens
tgaagctgaggctgct

SEQ ID NO: 6485613 - DNA, 17 bp, Homo sapiens
tgaagctgctgcagccc

SEQ ID NO: 6485614 - DNA, 13 bp, Homo sapiens
tgaagctgctgtg

SEQ ID NO: 6485615 - DNA, 16 bp, Homo sapiens
tgaagctgctgtgtcc

SEQ ID NO: 6485616 - DNA, 15 bp, Homo sapiens
tgaagctggaagcac

SEQ ID NO: 6485617 - DNA, 14 bp, Homo sapiens
tgaagctggccctc

SEQ ID NO: 6485618 - DNA, 19 bp, Homo sapiens
tgaagctggccctcagctc

SEQ ID NO: 6485619 - DNA, 14 bp, Homo sapiens
tgaagctggcctgg

SEQ ID NO: 6485620 - DNA, 15 bp, Homo sapiens
tgaagctggcctgga

SEQ ID NO: 6485621 - DNA, 12 bp, Homo sapiens
tgaagctgggct

SEQ ID NO: 6485622 - DNA, 15 bp, Homo sapiens
tgaagctgggctctt

SEQ ID NO: 6485623 - DNA, 14 bp, Homo sapiens
tgaagctgggctgt

SEQ ID NO: 6485624 - DNA, 20 bp, Homo sapiens
tgaagctggggacagctttc

SEQ ID NO: 6485625 - DNA, 23 bp, Homo sapiens
tgaagctgttgctatttgtattt

SEQ ID NO: 6485626 - DNA, 16 bp, Homo sapiens
tgaagctgttgtgtga

SEQ ID NO: 6485627 - DNA, 14 bp, Homo sapiens
tgaagcttatgttt

SEQ ID NO: 6485628 - DNA, 16 bp, Homo sapiens
tgaagcttatgtttct

SEQ ID NO: 6485629 - DNA, 20 bp, Homo sapiens
tgaagcttattaatgctaag

SEQ ID NO: 6485630 - DNA, 23 bp, Homo sapiens
tgaagcttattaatgctaagggc

SEQ ID NO: 6485631 - DNA, 22 bp, Homo sapiens
tgaagcttcactcactgtcaat

SEQ ID NO: 6485632 - DNA, 14 bp, Homo sapiens
tgaagcttcatgca

SEQ ID NO: 6485633 - DNA, 21 bp, Homo sapiens
tgaagcttcggccgcgccacc

SEQ ID NO: 6485634 - DNA, 23 bp, Homo sapiens
tgaagcttggaggtcacagctgg

SEQ ID NO: 6485635 - DNA, 16 bp, Homo sapiens
tgaagcttgtatctga

SEQ ID NO: 6485636 - DNA, 12 bp, Homo sapiens
tgaagctttata

SEQ ID NO: 6485637 - DNA, 23 bp, Homo sapiens
tgaagctttatttgcatatttat

SEQ ID NO: 6485638 - DNA, 15 bp, Homo sapiens
tgaagctttgcttat

SEQ ID NO: 6485639 - DNA, 13 bp, Homo sapiens
tgaagctttgtag

SEQ ID NO: 6485640 - DNA, 22 bp, Homo sapiens
tgaagctttttaaaaattgtaa

SEQ ID NO: 6485641 - DNA, 14 bp, Homo sapiens
tgaagctttttatt

SEQ ID NO: 6485642 - DNA, 23 bp, Homo sapiens
tgaaggaaaaacacaagcaaaaa

SEQ ID NO: 6485643 - DNA, 21 bp, Homo sapiens
tgaaggaaaagcaagaaacag

SEQ ID NO: 6485644 - DNA, 22 bp, Homo sapiens
tgaaggaaaagcaagaaacagt

SEQ ID NO: 6485645 - DNA, 12 bp, Homo sapiens
tgaaggaaaatt

SEQ ID NO: 6485646 - DNA, 16 bp, Homo sapiens
tgaaggaaacagttaa

SEQ ID NO: 6485647 - DNA, 18 bp, Homo sapiens
tgaaggaaagaatatgga

SEQ ID NO: 6485648 - DNA, 21 bp, Homo sapiens
tgaaggaaataaaaaagtctc

SEQ ID NO: 6485649 - DNA, 23 bp, Homo sapiens
tgaaggaaataaaaaagtctcta

SEQ ID NO: 6485650 - DNA, 15 bp, Homo sapiens
tgaaggaacttgtct

SEQ ID NO: 6485651 - DNA, 16 bp, Homo sapiens
tgaaggaagagaagac

SEQ ID NO: 6485652 - DNA, 20 bp, Homo sapiens
tgaaggaataggcaaaatgt

SEQ ID NO: 6485653 - DNA, 13 bp, Homo sapiens
tgaaggaatatat

SEQ ID NO: 6485654 - DNA, 21 bp, Homo sapiens
tgaaggaatatatggcagagt

SEQ ID NO: 6485655 - DNA, 10 bp, Homo sapiens
tgaaggaatt

SEQ ID NO: 6485656 - DNA, 19 bp, Homo sapiens
tgaaggacactctgcaggg

SEQ ID NO: 6485657 - DNA, 18 bp, Homo sapiens
tgaaggacacttcctgcc

SEQ ID NO: 6485658 - DNA, 23 bp, Homo sapiens
tgaaggacatgagactaagagaa

SEQ ID NO: 6485659 - DNA, 19 bp, Homo sapiens
tgaaggacattgcggacag

SEQ ID NO: 6485660 - DNA, 20 bp, Homo sapiens
tgaaggacattgcggacagc

SEQ ID NO: 6485661 - DNA, 21 bp, Homo sapiens
tgaaggaccctggctcttctc

SEQ ID NO: 6485662 - DNA, 12 bp, Homo sapiens
tgaaggaccctt

SEQ ID NO: 6485663 - DNA, 13 bp, Homo sapiens
tgaaggacctgag

SEQ ID NO: 6485664 - DNA, 15 bp, Homo sapiens
tgaaggacctgggct

SEQ ID NO: 6485665 - DNA, 21 bp, Homo sapiens
tgaaggaccttcactctaaga

SEQ ID NO: 6485666 - DNA, 23 bp, Homo sapiens
tgaaggagaaaatgcattatgtg

SEQ ID NO: 6485667 - DNA, 11 bp, Homo sapiens
tgaaggagccc

SEQ ID NO: 6485668 - DNA, 22 bp, Homo sapiens
tgaaggagccccattcctggga

SEQ ID NO: 6485669 - DNA, 23 bp, Homo sapiens
tgaaggagccccattcctgggaa

SEQ ID NO: 6485670 - DNA, 21 bp, Homo sapiens
tgaaggaggccacctcctaaa

SEQ ID NO: 6485671 - DNA, 19 bp, Homo sapiens
tgaaggaggcggggctcta

SEQ ID NO: 6485672 - DNA, 22 bp, Homo sapiens
tgaaggaggctccaggcagcac

SEQ ID NO: 6485673 - DNA, 16 bp, Homo sapiens
tgaaggataagagaaa

SEQ ID NO: 6485674 - DNA, 15 bp, Homo sapiens
tgaaggatccatctt

SEQ ID NO: 6485675 - DNA, 18 bp, Homo sapiens
tgaaggatgggggctcct

SEQ ID NO: 6485676 - DNA, 13 bp, Homo sapiens
tgaaggatggtta

SEQ ID NO: 6485677 - DNA, 16 bp, Homo sapiens
tgaaggattaatgaaa

SEQ ID NO: 6485678 - DNA, 18 bp, Homo sapiens
tgaaggattaatgaaaac

SEQ ID NO: 6485679 - DNA, 21 bp, Homo sapiens
tgaaggattatggaaaaataa

SEQ ID NO: 6485680 - DNA, 21 bp, Homo sapiens
tgaaggattctgggaatcatg

SEQ ID NO: 6485681 - DNA, 21 bp, Homo sapiens
tgaaggattgcatcctgctgg

SEQ ID NO: 6485682 - DNA, 17 bp, Homo sapiens
tgaaggcaaaattgcaa

SEQ ID NO: 6485683 - DNA, 18 bp, Homo sapiens
tgaaggcaaaattgcaaa

SEQ ID NO: 6485684 - DNA, 18 bp, Homo sapiens
tgaaggcacagctaacca

SEQ ID NO: 6485685 - DNA, 21 bp, Homo sapiens
tgaaggcacctgcccccacag

SEQ ID NO: 6485686 - DNA, 18 bp, Homo sapiens
tgaaggcagaaagcaaaa

SEQ ID NO: 6485687 - DNA, 21 bp, Homo sapiens
tgaaggcaggagttgggggca

SEQ ID NO: 6485688 - DNA, 17 bp, Homo sapiens
tgaaggcagggctcctc

SEQ ID NO: 6485689 - DNA, 19 bp, Homo sapiens
tgaaggcagggctcctccc

SEQ ID NO: 6485690 - DNA, 19 bp, Homo sapiens
tgaaggcagtctgaaccct

SEQ ID NO: 6485691 - DNA, 18 bp, Homo sapiens
tgaaggccccgcccaggc

SEQ ID NO: 6485692 - DNA, 20 bp, Homo sapiens
tgaaggccccgcccaggctt

SEQ ID NO: 6485693 - DNA, 15 bp, Homo sapiens
tgaaggccctgctga

SEQ ID NO: 6485694 - DNA, 18 bp, Homo sapiens
tgaaggcctcgcaggaag

SEQ ID NO: 6485695 - DNA, 11 bp, Homo sapiens
tgaaggcctgg

SEQ ID NO: 6485696 - DNA, 14 bp, Homo sapiens
tgaaggcctggctg

SEQ ID NO: 6485697 - DNA, 15 bp, Homo sapiens
tgaaggcctggctgg

SEQ ID NO: 6485698 - DNA, 16 bp, Homo sapiens
tgaaggcctggctgga

SEQ ID NO: 6485699 - DNA, 15 bp, Homo sapiens
tgaaggccttgttaa

SEQ ID NO: 6485700 - DNA, 15 bp, Homo sapiens
tgaaggcgtgcaagg

SEQ ID NO: 6485701 - DNA, 23 bp, Homo sapiens
tgaaggctggaaggcagcaggca

SEQ ID NO: 6485702 - DNA, 15 bp, Homo sapiens
tgaaggctggattct

SEQ ID NO: 6485703 - DNA, 16 bp, Homo sapiens
tgaaggctggcatgat

SEQ ID NO: 6485704 - DNA, 16 bp, Homo sapiens
tgaaggctgggttctg

SEQ ID NO: 6485705 - DNA, 17 bp, Homo sapiens
tgaaggcttaattgact

SEQ ID NO: 6485706 - DNA, 21 bp, Homo sapiens
tgaaggcttaattgactgaaa

SEQ ID NO: 6485707 - DNA, 18 bp, Homo sapiens
tgaaggcttctgcagctt

SEQ ID NO: 6485708 - DNA, 19 bp, Homo sapiens
tgaagggaaacaaagaagt

SEQ ID NO: 6485709 - DNA, 13 bp, Homo sapiens
tgaagggaaagat

SEQ ID NO: 6485710 - DNA, 21 bp, Homo sapiens
tgaagggaaaggatattttct

SEQ ID NO: 6485711 - DNA, 22 bp, Homo sapiens
tgaagggaaaggatattttctt

SEQ ID NO: 6485712 - DNA, 19 bp, Homo sapiens
tgaagggaagcccagcctg

SEQ ID NO: 6485713 - DNA, 23 bp, Homo sapiens
tgaagggaaggaagaggaagagt

SEQ ID NO: 6485714 - DNA, 18 bp, Homo sapiens
tgaagggaagtggggagt

SEQ ID NO: 6485715 - DNA, 16 bp, Homo sapiens
tgaagggacagctgct

SEQ ID NO: 6485716 - DNA, 20 bp, Homo sapiens
tgaagggacggctgtgggac

SEQ ID NO: 6485717 - DNA, 13 bp, Homo sapiens
tgaagggagaaag

SEQ ID NO: 6485718 - DNA, 18 bp, Homo sapiens
tgaagggagaagacactg

SEQ ID NO: 6485719 - DNA, 16 bp, Homo sapiens
tgaagggagagccagc

SEQ ID NO: 6485720 - DNA, 11 bp, Homo sapiens
tgaagggaggt

SEQ ID NO: 6485721 - DNA, 21 bp, Homo sapiens
tgaagggaggtgaagaggctg

SEQ ID NO: 6485722 - DNA, 21 bp, Homo sapiens
tgaagggaggtggggatgaga

SEQ ID NO: 6485723 - DNA, 16 bp, Homo sapiens
tgaagggatatgtgaa

SEQ ID NO: 6485724 - DNA, 19 bp, Homo sapiens
tgaagggcaggtgcttcag

SEQ ID NO: 6485725 - DNA, 12 bp, Homo sapiens
tgaagggccaga

SEQ ID NO: 6485726 - DNA, 17 bp, Homo sapiens
tgaagggccagagccag

SEQ ID NO: 6485727 - DNA, 13 bp, Homo sapiens
tgaagggcccagg

SEQ ID NO: 6485728 - DNA, 19 bp, Homo sapiens
tgaagggccttgagcatct

SEQ ID NO: 6485729 - DNA, 21 bp, Homo sapiens
tgaagggccttgagcatctgg

SEQ ID NO: 6485730 - DNA, 19 bp, Homo sapiens
tgaagggcttcttcttata

SEQ ID NO: 6485731 - DNA, 9 bp, Homo sapiens
tgaaggggc

SEQ ID NO: 6485732 - DNA, 17 bp, Homo sapiens
tgaaggggccagaccac

SEQ ID NO: 6485733 - DNA, 12 bp, Homo sapiens
tgaaggggcggg

SEQ ID NO: 6485734 - DNA, 16 bp, Homo sapiens
tgaagggggacactcc

SEQ ID NO: 6485735 - DNA, 19 bp, Homo sapiens
tgaagggggatatgaatgg

SEQ ID NO: 6485736 - DNA, 18 bp, Homo sapiens
tgaagggggcggcctatg

SEQ ID NO: 6485737 - DNA, 22 bp, Homo sapiens
tgaagggtaattatatagttac

SEQ ID NO: 6485738 - DNA, 18 bp, Homo sapiens
tgaagggtgacatcccag

SEQ ID NO: 6485739 - DNA, 14 bp, Homo sapiens
tgaagggtgctcag

SEQ ID NO: 6485740 - DNA, 21 bp, Homo sapiens
tgaaggtaaaattgaaaggca

SEQ ID NO: 6485741 - DNA, 16 bp, Homo sapiens
tgaaggtaaagggaca

SEQ ID NO: 6485742 - DNA, 18 bp, Homo sapiens
tgaaggtaaataaaaaga

SEQ ID NO: 6485743 - DNA, 21 bp, Homo sapiens
tgaaggtaataaatacacagc

SEQ ID NO: 6485744 - DNA, 15 bp, Homo sapiens
tgaaggtaattaaag

SEQ ID NO: 6485745 - DNA, 15 bp, Homo sapiens
tgaaggtatatctag

SEQ ID NO: 6485746 - DNA, 18 bp, Homo sapiens
tgaaggtattggcctgtt

SEQ ID NO: 6485747 - DNA, 22 bp, Homo sapiens
tgaaggtattttgtagatgtga

SEQ ID NO: 6485748 - DNA, 11 bp, Homo sapiens
tgaaggtcaca

SEQ ID NO: 6485749 - DNA, 16 bp, Homo sapiens
tgaaggtcataagttt

SEQ ID NO: 6485750 - DNA, 23 bp, Homo sapiens
tgaaggtctgtcataggactctg

SEQ ID NO: 6485751 - DNA, 19 bp, Homo sapiens
tgaaggtgataagggaaaa

SEQ ID NO: 6485752 - DNA, 20 bp, Homo sapiens
tgaaggtgctgacggccagg

SEQ ID NO: 6485753 - DNA, 18 bp, Homo sapiens
tgaaggtggaaataaact

SEQ ID NO: 6485754 - DNA, 23 bp, Homo sapiens
tgaaggtgtgtcctcaagaagaa

SEQ ID NO: 6485755 - DNA, 16 bp, Homo sapiens
tgaaggttaaaggaaa

SEQ ID NO: 6485756 - DNA, 20 bp, Homo sapiens
tgaaggttaggatttaacag

SEQ ID NO: 6485757 - DNA, 16 bp, Homo sapiens
tgaaggttcccaagga

SEQ ID NO: 6485758 - DNA, 14 bp, Homo sapiens
tgaaggttctggta

SEQ ID NO: 6485759 - DNA, 23 bp, Homo sapiens
tgaaggttggaactgctgccatg

SEQ ID NO: 6485760 - DNA, 18 bp, Homo sapiens
tgaaggttgtatgtaaat

SEQ ID NO: 6485761 - DNA, 15 bp, Homo sapiens
tgaaggttgtggcct

SEQ ID NO: 6485762 - DNA, 22 bp, Homo sapiens
tgaaggtttacaatttacaaag

SEQ ID NO: 6485763 - DNA, 16 bp, Homo sapiens
tgaaggtttctgaaaa

SEQ ID NO: 6485764 - DNA, 18 bp, Homo sapiens
tgaaggtttctgaaaatt

SEQ ID NO: 6485765 - DNA, 16 bp, Homo sapiens
tgaaggtttgagagca

SEQ ID NO: 6485766 - DNA, 18 bp, Homo sapiens
tgaaggttttaagtggtt

SEQ ID NO: 6485767 - DNA, 21 bp, Homo sapiens
tgaaggtttttgtaaagattt

SEQ ID NO: 6485768 - DNA, 21 bp, Homo sapiens
tgaaggttttttttttaagtg

SEQ ID NO: 6485769 - DNA, 15 bp, Homo sapiens
tgaagtaaaagcaag

SEQ ID NO: 6485770 - DNA, 18 bp, Homo sapiens
tgaagtaaaatgtggcag

SEQ ID NO: 6485771 - DNA, 16 bp, Homo sapiens
tgaagtaaattaaaca

SEQ ID NO: 6485772 - DNA, 18 bp, Homo sapiens
tgaagtaaattatgtaac

SEQ ID NO: 6485773 - DNA, 23 bp, Homo sapiens
tgaagtaacatgcatactttatt

SEQ ID NO: 6485774 - DNA, 18 bp, Homo sapiens
tgaagtaacccctcctgg

SEQ ID NO: 6485775 - DNA, 11 bp, Homo sapiens
tgaagtaacct

SEQ ID NO: 6485776 - DNA, 19 bp, Homo sapiens
tgaagtaactataacaaaa

SEQ ID NO: 6485777 - DNA, 20 bp, Homo sapiens
tgaagtaactataacaaaaa

SEQ ID NO: 6485778 - DNA, 19 bp, Homo sapiens
tgaagtaacttgtcttaaa

SEQ ID NO: 6485779 - DNA, 23 bp, Homo sapiens
tgaagtaagttcatcaaacatgt

SEQ ID NO: 6485780 - DNA, 13 bp, Homo sapiens
tgaagtaataact

SEQ ID NO: 6485781 - DNA, 22 bp, Homo sapiens
tgaagtaatatgcacacatttt

SEQ ID NO: 6485782 - DNA, 19 bp, Homo sapiens
tgaagtaattcttctgcct

SEQ ID NO: 6485783 - DNA, 14 bp, Homo sapiens
tgaagtacaaacat

SEQ ID NO: 6485784 - DNA, 16 bp, Homo sapiens
tggcatggagactctg

SEQ ID NO: 6485785 - DNA, 16 bp, Homo sapiens
tggcatggatttctgt

SEQ ID NO: 6485786 - DNA, 14 bp, Homo sapiens
tggcatggcaggag

SEQ ID NO: 6485787 - DNA, 20 bp, Homo sapiens
tggcatgggcgcaggcccag

SEQ ID NO: 6485788 - DNA, 12 bp, Homo sapiens
tggcatggggag

SEQ ID NO: 6485789 - DNA, 19 bp, Homo sapiens
tggcatgggggcctcaggg

SEQ ID NO: 6485790 - DNA, 18 bp, Homo sapiens
tggcatggtcctgtgccc

SEQ ID NO: 6485791 - DNA, 23 bp, Homo sapiens
tggcatggtgctttcaggtctgg

SEQ ID NO: 6485792 - DNA, 22 bp, Homo sapiens
tggcatggtggcacgtgcctgt

SEQ ID NO: 6485793 - DNA, 14 bp, Homo sapiens
tggcatgtaatatt

SEQ ID NO: 6485794 - DNA, 21 bp, Homo sapiens
tggcatgtcagagccaggctc

SEQ ID NO: 6485795 - DNA, 13 bp, Homo sapiens
tggcatgtcattt

SEQ ID NO: 6485796 - DNA, 17 bp, Homo sapiens
tggcatgtcatttgcac

SEQ ID NO: 6485797 - DNA, 18 bp, Homo sapiens
tggcatgtcatttgcaca

SEQ ID NO: 6485798 - DNA, 21 bp, Homo sapiens
tggcatgtcatttgcacacaa

SEQ ID NO: 6485799 - DNA, 21 bp, Homo sapiens
tggcatgtccacgtgtgtgtg

SEQ ID NO: 6485800 - DNA, 12 bp, Homo sapiens
tggcatgtcttt

SEQ ID NO: 6485801 - DNA, 12 bp, Homo sapiens
tggcatgtgaaa

SEQ ID NO: 6485802 - DNA, 19 bp, Homo sapiens
tggcatgtgcctataatcc

SEQ ID NO: 6485803 - DNA, 22 bp, Homo sapiens
tggcatgtgctgtgaccattta

SEQ ID NO: 6485804 - DNA, 20 bp, Homo sapiens
tggcatgttagcccttcctc

SEQ ID NO: 6485805 - DNA, 16 bp, Homo sapiens
tggcatgtttaattgt

SEQ ID NO: 6485806 - DNA, 20 bp, Homo sapiens
tggcatgtttcactcctgct

SEQ ID NO: 6485807 - DNA, 20 bp, Homo sapiens
tggcatgttttgtgcatttg

SEQ ID NO: 6485808 - DNA, 22 bp, Homo sapiens
tggcatgttttgtgcatttgta

SEQ ID NO: 6485809 - DNA, 12 bp, Homo sapiens
tggcattaacaa

SEQ ID NO: 6485810 - DNA, 15 bp, Homo sapiens
tggcattaattatta

SEQ ID NO: 6485811 - DNA, 21 bp, Homo sapiens
tggcattaccctctgcagaac

SEQ ID NO: 6485812 - DNA, 15 bp, Homo sapiens
tggcattactctgca

SEQ ID NO: 6485813 - DNA, 18 bp, Homo sapiens
tggcattactctgcacta

SEQ ID NO: 6485814 - DNA, 19 bp, Homo sapiens
tggcattatctctttctct

SEQ ID NO: 6485815 - DNA, 23 bp, Homo sapiens
tggcattatgtccactgtgtata

SEQ ID NO: 6485816 - DNA, 11 bp, Homo sapiens
tggcattcctc

SEQ ID NO: 6485817 - DNA, 21 bp, Homo sapiens
tggcattcctctaatgttgtg

SEQ ID NO: 6485818 - DNA, 15 bp, Homo sapiens
tggcattctacacct

SEQ ID NO: 6485819 - DNA, 18 bp, Homo sapiens
tggcattctcaaaactga

SEQ ID NO: 6485820 - DNA, 14 bp, Homo sapiens
tggcattctctctg

SEQ ID NO: 6485821 - DNA, 16 bp, Homo sapiens
tggcattctctctgct

SEQ ID NO: 6485822 - DNA, 15 bp, Homo sapiens
tggcattcttgtaca

SEQ ID NO: 6485823 - DNA, 16 bp, Homo sapiens
tggcattctttgcaat

SEQ ID NO: 6485824 - DNA, 21 bp, Homo sapiens
tggcattgctgcatatttgac

SEQ ID NO: 6485825 - DNA, 20 bp, Homo sapiens
tggcattggcagcaggtgct

SEQ ID NO: 6485826 - DNA, 20 bp, Homo sapiens
tggcattgggtggcaacatt

SEQ ID NO: 6485827 - DNA, 16 bp, Homo sapiens
tggcattgtccctgtg

SEQ ID NO: 6485828 - DNA, 16 bp, Homo sapiens
tggcatttagcacagt

SEQ ID NO: 6485829 - DNA, 22 bp, Homo sapiens
tggcatttagtaccttcaaata

SEQ ID NO: 6485830 - DNA, 21 bp, Homo sapiens
tggcatttcaattcctggccc

SEQ ID NO: 6485831 - DNA, 17 bp, Homo sapiens
tggcatttctctttaaa

SEQ ID NO: 6485832 - DNA, 20 bp, Homo sapiens
tggcatttctttatgaaaaa

SEQ ID NO: 6485833 - DNA, 17 bp, Homo sapiens
tggcatttgcaataaaa

SEQ ID NO: 6485834 - DNA, 12 bp, Homo sapiens
tggcatttgcag

SEQ ID NO: 6485835 - DNA, 19 bp, Homo sapiens
tggcatttgcagattttta

SEQ ID NO: 6485836 - DNA, 14 bp, Homo sapiens
tggcatttgctgaa

SEQ ID NO: 6485837 - DNA, 21 bp, Homo sapiens
tggcatttgctgaataacaac

SEQ ID NO: 6485838 - DNA, 18 bp, Homo sapiens
tggcatttgctgatttct

SEQ ID NO: 6485839 - DNA, 21 bp, Homo sapiens
tggcatttgctgatttctagt

SEQ ID NO: 6485840 - DNA, 18 bp, Homo sapiens
tggcatttgctggcctgg

SEQ ID NO: 6485841 - DNA, 20 bp, Homo sapiens
tggcatttgctggcctggca

SEQ ID NO: 6485842 - DNA, 15 bp, Homo sapiens
tggcatttggcctct

SEQ ID NO: 6485843 - DNA, 18 bp, Homo sapiens
tggcattttaagtgttta

SEQ ID NO: 6485844 - DNA, 14 bp, Homo sapiens
tggcattttctgtt

SEQ ID NO: 6485845 - DNA, 15 bp, Homo sapiens
tggcattttctgttc

SEQ ID NO: 6485846 - DNA, 17 bp, Homo sapiens
tggcattttctgttcca

SEQ ID NO: 6485847 - DNA, 16 bp, Homo sapiens
tggcattttggctcag

SEQ ID NO: 6485848 - DNA, 20 bp, Homo sapiens
tggcattttggctcagagtc

SEQ ID NO: 6485849 - DNA, 22 bp, Homo sapiens
tggcattttggctcagagtcca

SEQ ID NO: 6485850 - DNA, 19 bp, Homo sapiens
tggcatttttagctccttg

SEQ ID NO: 6485851 - DNA, 14 bp, Homo sapiens
tggcatttttgctt

SEQ ID NO: 6485852 - DNA, 18 bp, Homo sapiens
tggccaaaagcagtaaat

SEQ ID NO: 6485853 - DNA, 15 bp, Homo sapiens
tggccaaacaacagt

SEQ ID NO: 6485854 - DNA, 16 bp, Homo sapiens
tggccaaacaagtgtt

SEQ ID NO: 6485855 - DNA, 19 bp, Homo sapiens
tggccaaacatcagacctg

SEQ ID NO: 6485856 - DNA, 23 bp, Homo sapiens
tggccaaagccaaagctaggcct

SEQ ID NO: 6485857 - DNA, 14 bp, Homo sapiens
tggccaaagtcact

SEQ ID NO: 6485858 - DNA, 16 bp, Homo sapiens
tggccaaagtgtacaa

SEQ ID NO: 6485859 - DNA, 17 bp, Homo sapiens
tggccaaataggaggga

SEQ ID NO: 6485860 - DNA, 22 bp, Homo sapiens
tggccaaataggagggagactg

SEQ ID NO: 6485861 - DNA, 18 bp, Homo sapiens
tggccaaatatgcacttt

SEQ ID NO: 6485862 - DNA, 14 bp, Homo sapiens
tggccaacatggtg

SEQ ID NO: 6485863 - DNA, 15 bp, Homo sapiens
tggccaacatggtga

SEQ ID NO: 6485864 - DNA, 16 bp, Homo sapiens
tggccaaccaggaccc

SEQ ID NO: 6485865 - DNA, 19 bp, Homo sapiens
tggccaaccaggacccagg

SEQ ID NO: 6485866 - DNA, 19 bp, Homo sapiens
tggccaactcaactttcat

SEQ ID NO: 6485867 - DNA, 13 bp, Homo sapiens
tggccaactgcaa

SEQ ID NO: 6485868 - DNA, 21 bp, Homo sapiens
tggccaactgcaaaaaaagcc

SEQ ID NO: 6485869 - DNA, 22 bp, Homo sapiens
tggccaactgcaaaaaaagcct

SEQ ID NO: 6485870 - DNA, 20 bp, Homo sapiens
tggccaagagaaacttccta

SEQ ID NO: 6485871 - DNA, 14 bp, Homo sapiens
tggccaagagaagg

SEQ ID NO: 6485872 - DNA, 15 bp, Homo sapiens
tggccaagcaggctg

SEQ ID NO: 6485873 - DNA, 12 bp, Homo sapiens
tggccaagcctg

SEQ ID NO: 6485874 - DNA, 14 bp, Homo sapiens
tggccaagcctgct

SEQ ID NO: 6485875 - DNA, 13 bp, Homo sapiens
tggccaagcctgg

SEQ ID NO: 6485876 - DNA, 22 bp, Homo sapiens
tggccaagctgaggtgcccagg

SEQ ID NO: 6485877 - DNA, 23 bp, Homo sapiens
tggccaagctgaggtgcccagga

SEQ ID NO: 6485878 - DNA, 10 bp, Homo sapiens
tggccaaggg

SEQ ID NO: 6485879 - DNA, 12 bp, Homo sapiens
tggccaagggcc

SEQ ID NO: 6485880 - DNA, 15 bp, Homo sapiens
tggccaagggccaga

SEQ ID NO: 6485881 - DNA, 22 bp, Homo sapiens
tggccaaggtgtccagggtcct

SEQ ID NO: 6485882 - DNA, 23 bp, Homo sapiens
tggccaatgtgactaccgtgcca

SEQ ID NO: 6485883 - DNA, 14 bp, Homo sapiens
tggccaatttcacc

SEQ ID NO: 6485884 - DNA, 18 bp, Homo sapiens
tggccacaaacctgcccg

SEQ ID NO: 6485885 - DNA, 19 bp, Homo sapiens
tggccacaaattctttgac

SEQ ID NO: 6485886 - DNA, 21 bp, Homo sapiens
tggccacaacctgaaagacaa

SEQ ID NO: 6485887 - DNA, 22 bp, Homo sapiens
tggccacaactgctgtggcccc

SEQ ID NO: 6485888 - DNA, 20 bp, Homo sapiens
tggccacaaggaaaaggagg

SEQ ID NO: 6485889 - DNA, 23 bp, Homo sapiens
tggccacaaggaaaaggaggagg

SEQ ID NO: 6485890 - DNA, 23 bp, Homo sapiens
tggccacaaggacgctggctact

SEQ ID NO: 6485891 - DNA, 18 bp, Homo sapiens
tggccacaatcctcccca

SEQ ID NO: 6485892 - DNA, 23 bp, Homo sapiens
tggccacacactgagttgcacat

SEQ ID NO: 6485893 - DNA, 13 bp, Homo sapiens
tggccacacaggc

SEQ ID NO: 6485894 - DNA, 19 bp, Homo sapiens
tggccacacaggcagggcc

SEQ ID NO: 6485895 - DNA, 20 bp, Homo sapiens
tggccacacaggcagggcct

SEQ ID NO: 6485896 - DNA, 19 bp, Homo sapiens
tggccacactctgccttcc

SEQ ID NO: 6485897 - DNA, 18 bp, Homo sapiens
tggccacactggggctga

SEQ ID NO: 6485898 - DNA, 18 bp, Homo sapiens
tggccacactgtgacaca

SEQ ID NO: 6485899 - DNA, 15 bp, Homo sapiens
tggccacagaaaggc

SEQ ID NO: 6485900 - DNA, 13 bp, Homo sapiens
tggccacagactg

SEQ ID NO: 6485901 - DNA, 12 bp, Homo sapiens
tggccacagcac

SEQ ID NO: 6485902 - DNA, 12 bp, Homo sapiens
tggccacagcca

SEQ ID NO: 6485903 - DNA, 23 bp, Homo sapiens
tggccacagcccatccatagtaa

SEQ ID NO: 6485904 - DNA, 15 bp, Homo sapiens
tggccacagccttcc

SEQ ID NO: 6485905 - DNA, 17 bp, Homo sapiens
tggccacagccttccct

SEQ ID NO: 6485906 - DNA, 19 bp, Homo sapiens
tggccacagcgtgctggcg

SEQ ID NO: 6485907 - DNA, 17 bp, Homo sapiens
tggccacagtagtcttg

SEQ ID NO: 6485908 - DNA, 19 bp, Homo sapiens
tggccacagtgtcactggt

SEQ ID NO: 6485909 - DNA, 22 bp, Homo sapiens
tggccacatttaatatcttcag

SEQ ID NO: 6485910 - DNA, 20 bp, Homo sapiens
tggccaccacccaacctgtc

SEQ ID NO: 6485911 - DNA, 22 bp, Homo sapiens
tggccaccacccaacctgtcct

SEQ ID NO: 6485912 - DNA, 13 bp, Homo sapiens
tggccaccaggct

SEQ ID NO: 6485913 - DNA, 15 bp, Homo sapiens
tggccaccaggctgg

SEQ ID NO: 6485914 - DNA, 16 bp, Homo sapiens
tggccaccaggctggc

SEQ ID NO: 6485915 - DNA, 20 bp, Homo sapiens
tggccaccaggctggcgcag

SEQ ID NO: 6485916 - DNA, 22 bp, Homo sapiens
tggccaccaggctggcgcagcc

SEQ ID NO: 6485917 - DNA, 20 bp, Homo sapiens
tggccacccaacagcaccaa

SEQ ID NO: 6485918 - DNA, 22 bp, Homo sapiens
tggccaccccagagtgggagag

SEQ ID NO: 6485919 - DNA, 20 bp, Homo sapiens
tggccaccccagccagcagc

SEQ ID NO: 6485920 - DNA, 17 bp, Homo sapiens
tggccaccccgtgccac

SEQ ID NO: 6485921 - DNA, 18 bp, Homo sapiens
tggccaccccgtgccacc

SEQ ID NO: 6485922 - DNA, 20 bp, Homo sapiens
tggccaccccgtgccacccg

SEQ ID NO: 6485923 - DNA, 14 bp, Homo sapiens
tggccacccctccc

SEQ ID NO: 6485924 - DNA, 16 bp, Homo sapiens
tggccaccctggcccg

SEQ ID NO: 6485925 - DNA, 20 bp, Homo sapiens
tggccacccttggcctgtcc

SEQ ID NO: 6485926 - DNA, 23 bp, Homo sapiens
tggccaccgggggtggctctgtc

SEQ ID NO: 6485927 - DNA, 22 bp, Homo sapiens
tggccacctgaggtgggcccag

SEQ ID NO: 6485928 - DNA, 15 bp, Homo sapiens
tggccacctgccagg

SEQ ID NO: 6485929 - DNA, 21 bp, Homo sapiens
tggccacctgccaggcctccc

SEQ ID NO: 6485930 - DNA, 22 bp, Homo sapiens
tggccacctgccaggcctccct

SEQ ID NO: 6485931 - DNA, 22 bp, Homo sapiens
tggccacctgtagccatctgca

SEQ ID NO: 6485932 - DNA, 23 bp, Homo sapiens
tggccacctgtagccatctgcac

SEQ ID NO: 6485933 - DNA, 14 bp, Homo sapiens
tggccacgaggtta

SEQ ID NO: 6485934 - DNA, 14 bp, Homo sapiens
tggccacgcagcca

SEQ ID NO: 6485935 - DNA, 14 bp, Homo sapiens
tggccacggcccag

SEQ ID NO: 6485936 - DNA, 16 bp, Homo sapiens
tggccacggcccaggg

SEQ ID NO: 6485937 - DNA, 17 bp, Homo sapiens
tggccacggcccaggga

SEQ ID NO: 6485938 - DNA, 18 bp, Homo sapiens
tggccacggcccagggag

SEQ ID NO: 6485939 - DNA, 20 bp, Homo sapiens
tggccacggcccagggaggg

SEQ ID NO: 6485940 - DNA, 16 bp, Homo sapiens
tggccacggcctggga

SEQ ID NO: 6485941 - DNA, 18 bp, Homo sapiens
tggccacgttcagggagg

SEQ ID NO: 6485942 - DNA, 21 bp, Homo sapiens
tggccacgttcagggaggggc

SEQ ID NO: 6485943 - DNA, 15 bp, Homo sapiens
tggccactcagcttc

SEQ ID NO: 6485944 - DNA, 22 bp, Homo sapiens
tggccactcagcttcctaccca

SEQ ID NO: 6485945 - DNA, 20 bp, Homo sapiens
tggccactccagacccctgg

SEQ ID NO: 6485946 - DNA, 13 bp, Homo sapiens
tggccactgagct

SEQ ID NO: 6485947 - DNA, 18 bp, Homo sapiens
tggccactgagctggctg

SEQ ID NO: 6485948 - DNA, 17 bp, Homo sapiens
tggccactgcacagagc

SEQ ID NO: 6485949 - DNA, 18 bp, Homo sapiens
tggccactgcacagagct

SEQ ID NO: 6485950 - DNA, 22 bp, Homo sapiens
tggccactgccccactattttt

SEQ ID NO: 6485951 - DNA, 10 bp, Homo sapiens
tggccactgg

SEQ ID NO: 6485952 - DNA, 17 bp, Homo sapiens
tggccactggcacttgc

SEQ ID NO: 6485953 - DNA, 14 bp, Homo sapiens
tggccactggggtg

SEQ ID NO: 6485954 - DNA, 21 bp, Homo sapiens
tggccactgggtctcactcct

SEQ ID NO: 6485955 - DNA, 23 bp, Homo sapiens
tggccactgggtctcactcctga

SEQ ID NO: 6485956 - DNA, 23 bp, Homo sapiens
tggccactgtatttgttaatttc

SEQ ID NO: 6485957 - DNA, 19 bp, Homo sapiens
tggccactgtccctgtcct

SEQ ID NO: 6485958 - DNA, 22 bp, Homo sapiens
tggccacttcattccagcagct

SEQ ID NO: 6485959 - DNA, 16 bp, Homo sapiens
tggccactttaagaga

SEQ ID NO: 6485960 - DNA, 18 bp, Homo sapiens
tggccactttgcagacct

SEQ ID NO: 6485961 - DNA, 15 bp, Homo sapiens
tgaagtacacctgtg

SEQ ID NO: 6485962 - DNA, 22 bp, Homo sapiens
tgaagtacagcataagggaatc

SEQ ID NO: 6485963 - DNA, 17 bp, Homo sapiens
tgaagtacagtcccagc

SEQ ID NO: 6485964 - DNA, 18 bp, Homo sapiens
tgaagtacagtcccagca

SEQ ID NO: 6485965 - DNA, 13 bp, Homo sapiens
tgaagtagaacaa

SEQ ID NO: 6485966 - DNA, 22 bp, Homo sapiens
tgaagtagcaataggctgtaat

SEQ ID NO: 6485967 - DNA, 17 bp, Homo sapiens
tgaagtagtgtgagtgt

SEQ ID NO: 6485968 - DNA, 13 bp, Homo sapiens
tgaagtataaatc

SEQ ID NO: 6485969 - DNA, 15 bp, Homo sapiens
tgaagtatactgtat

SEQ ID NO: 6485970 - DNA, 14 bp, Homo sapiens
tgaagtatactttt

SEQ ID NO: 6485971 - DNA, 13 bp, Homo sapiens
tgaagtatattct

SEQ ID NO: 6485972 - DNA, 17 bp, Homo sapiens
tgaagtatgaagtctga

SEQ ID NO: 6485973 - DNA, 16 bp, Homo sapiens
tgaagtatgtcttcaa

SEQ ID NO: 6485974 - DNA, 20 bp, Homo sapiens
tgaagtatgtcttcaaaata

SEQ ID NO: 6485975 - DNA, 19 bp, Homo sapiens
tgaagtattacatgattta

SEQ ID NO: 6485976 - DNA, 12 bp, Homo sapiens
tgaagtattgct

SEQ ID NO: 6485977 - DNA, 15 bp, Homo sapiens
tgaagtatttcatgt

SEQ ID NO: 6485978 - DNA, 16 bp, Homo sapiens
tgaagtatttcatgta

SEQ ID NO: 6485979 - DNA, 20 bp, Homo sapiens
tgaagtatttcatgtaatat

SEQ ID NO: 6485980 - DNA, 17 bp, Homo sapiens
tgaagtattttatttgt

SEQ ID NO: 6485981 - DNA, 20 bp, Homo sapiens
tgaagtcaattactctataa

SEQ ID NO: 6485982 - DNA, 16 bp, Homo sapiens
tgaagtcacattagtg

SEQ ID NO: 6485983 - DNA, 19 bp, Homo sapiens
tgaagtcacccggccccca

SEQ ID NO: 6485984 - DNA, 16 bp, Homo sapiens
tgaagtcactattttg

SEQ ID NO: 6485985 - DNA, 14 bp, Homo sapiens
tgaagtcactgcac

SEQ ID NO: 6485986 - DNA, 16 bp, Homo sapiens
tgaagtcactgcacag

SEQ ID NO: 6485987 - DNA, 20 bp, Homo sapiens
tgaagtcagatctgcctaag

SEQ ID NO: 6485988 - DNA, 19 bp, Homo sapiens
tgaagtcagccacactggg

SEQ ID NO: 6485989 - DNA, 22 bp, Homo sapiens
tgaagtcagccacactgggcct

SEQ ID NO: 6485990 - DNA, 21 bp, Homo sapiens
tgaagtcattgtcgctcagca

SEQ ID NO: 6485991 - DNA, 20 bp, Homo sapiens
tgaagtccaaattgtttgta

SEQ ID NO: 6485992 - DNA, 21 bp, Homo sapiens
tgaagtccaagcatttagatg

SEQ ID NO: 6485993 - DNA, 15 bp, Homo sapiens
tgaagtccctgttct

SEQ ID NO: 6485994 - DNA, 18 bp, Homo sapiens
tgaagtccctgttctcag

SEQ ID NO: 6485995 - DNA, 21 bp, Homo sapiens
tgaagtccctgttctcagctc

SEQ ID NO: 6485996 - DNA, 18 bp, Homo sapiens
tgaagtcccttcctgtcc

SEQ ID NO: 6485997 - DNA, 19 bp, Homo sapiens
tgaagtcccttcctgtcct

SEQ ID NO: 6485998 - DNA, 20 bp, Homo sapiens
tgaagtcccttcctgtcctg

SEQ ID NO: 6485999 - DNA, 14 bp, Homo sapiens
tgaagtcctggctt

SEQ ID NO: 6486000 - DNA, 23 bp, Homo sapiens
tgaagtctcaagaactgccataa

SEQ ID NO: 6486001 - DNA, 20 bp, Homo sapiens
tgaagtctccttttgtctga

SEQ ID NO: 6486002 - DNA, 19 bp, Homo sapiens
tgaagtctctgaagtgaaa

SEQ ID NO: 6486003 - DNA, 12 bp, Homo sapiens
tgaagtctgaaa

SEQ ID NO: 6486004 - DNA, 13 bp, Homo sapiens
tgaagtctgaaat

SEQ ID NO: 6486005 - DNA, 21 bp, Homo sapiens
tgaagtctgagcccatttctg

SEQ ID NO: 6486006 - DNA, 13 bp, Homo sapiens
tgaagtctgctca

SEQ ID NO: 6486007 - DNA, 23 bp, Homo sapiens
tgaagtctgcttaccaaaacata

SEQ ID NO: 6486008 - DNA, 16 bp, Homo sapiens
tgaagtcttccctcag

SEQ ID NO: 6486009 - DNA, 18 bp, Homo sapiens
tgaagtcttcttatctaa

SEQ ID NO: 6486010 - DNA, 19 bp, Homo sapiens
tgaagtcttcttatctaaa

SEQ ID NO: 6486011 - DNA, 20 bp, Homo sapiens
tgaagtcttcttatctaaac

SEQ ID NO: 6486012 - DNA, 21 bp, Homo sapiens
tgaagtcttcttatctaaacc

SEQ ID NO: 6486013 - DNA, 12 bp, Homo sapiens
tgaagtcttgta

SEQ ID NO: 6486014 - DNA, 20 bp, Homo sapiens
tgaagtgaaaaagttttaca

SEQ ID NO: 6486015 - DNA, 13 bp, Homo sapiens
tgaagtgaaactg

SEQ ID NO: 6486016 - DNA, 14 bp, Homo sapiens
tgaagtgaaggaga

SEQ ID NO: 6486017 - DNA, 14 bp, Homo sapiens
tgaagtgaatacat

SEQ ID NO: 6486018 - DNA, 18 bp, Homo sapiens
tgaagtgaatacatggta

SEQ ID NO: 6486019 - DNA, 13 bp, Homo sapiens
tgaagtgacccca

SEQ ID NO: 6486020 - DNA, 15 bp, Homo sapiens
tgaagtgaccccagc

SEQ ID NO: 6486021 - DNA, 21 bp, Homo sapiens
tgaagtgaccccagctccagg

SEQ ID NO: 6486022 - DNA, 22 bp, Homo sapiens
tgaagtgaccccagctccaggc

SEQ ID NO: 6486023 - DNA, 20 bp, Homo sapiens
tgaagtgacctcactggcct

SEQ ID NO: 6486024 - DNA, 16 bp, Homo sapiens
tgaagtgactgttgta

SEQ ID NO: 6486025 - DNA, 18 bp, Homo sapiens
tgaagtgaggacaaaatc

SEQ ID NO: 6486026 - DNA, 20 bp, Homo sapiens
tgaagtgatatggtgagcag

SEQ ID NO: 6486027 - DNA, 18 bp, Homo sapiens
tgaagtgatgatggatga

SEQ ID NO: 6486028 - DNA, 14 bp, Homo sapiens
tgaagtgattgaaa

SEQ ID NO: 6486029 - DNA, 16 bp, Homo sapiens
tgaagtgattgacatt

SEQ ID NO: 6486030 - DNA, 20 bp, Homo sapiens
tgaagtgcagctcaggagac

SEQ ID NO: 6486031 - DNA, 16 bp, Homo sapiens
tgaagtgcatccaaag

SEQ ID NO: 6486032 - DNA, 18 bp, Homo sapiens
tgaagtgcatccaaaggt

SEQ ID NO: 6486033 - DNA, 17 bp, Homo sapiens
tgaagtgcatgggtcag

SEQ ID NO: 6486034 - DNA, 16 bp, Homo sapiens
tgaagtgcatgttaaa

SEQ ID NO: 6486035 - DNA, 23 bp, Homo sapiens
tgaagtgcctctgattctatgta

SEQ ID NO: 6486036 - DNA, 13 bp, Homo sapiens
tgaagtgccttaa

SEQ ID NO: 6486037 - DNA, 12 bp, Homo sapiens
tgaagtgctgtt

SEQ ID NO: 6486038 - DNA, 13 bp, Homo sapiens
tgaagtgcttgga

SEQ ID NO: 6486039 - DNA, 16 bp, Homo sapiens
tgaagtggccctccct

SEQ ID NO: 6486040 - DNA, 17 bp, Homo sapiens
tgaagtgggaaagcatt

SEQ ID NO: 6486041 - DNA, 18 bp, Homo sapiens
tgaagtggttgcattcta

SEQ ID NO: 6486042 - DNA, 18 bp, Homo sapiens
tgaagtgtataatataaa

SEQ ID NO: 6486043 - DNA, 17 bp, Homo sapiens
tgaagtgtcgagtccag

SEQ ID NO: 6486044 - DNA, 20 bp, Homo sapiens
tgaagtgtcgagtccagtcc

SEQ ID NO: 6486045 - DNA, 15 bp, Homo sapiens
tgaagtgtgggataa

SEQ ID NO: 6486046 - DNA, 16 bp, Homo sapiens
tgaagtgttaatacat

SEQ ID NO: 6486047 - DNA, 19 bp, Homo sapiens
tgaagtgttaatacatcac

SEQ ID NO: 6486048 - DNA, 22 bp, Homo sapiens
tgaagtgttccctttttcataa

SEQ ID NO: 6486049 - DNA, 21 bp, Homo sapiens
tgaagtgttctctagaatcca

SEQ ID NO: 6486050 - DNA, 10 bp, Homo sapiens
tgaagtgttg

SEQ ID NO: 6486051 - DNA, 14 bp, Homo sapiens
tgaagtgttttaca

SEQ ID NO: 6486052 - DNA, 18 bp, Homo sapiens
tgaagtgttttacaatga

SEQ ID NO: 6486053 - DNA, 21 bp, Homo sapiens
tgaagttaaaggtatttatca

SEQ ID NO: 6486054 - DNA, 17 bp, Homo sapiens
tgaagttacatgcataa

SEQ ID NO: 6486055 - DNA, 19 bp, Homo sapiens
tgaagttactttcttaatg

SEQ ID NO: 6486056 - DNA, 14 bp, Homo sapiens
tgaagttagaattc

SEQ ID NO: 6486057 - DNA, 19 bp, Homo sapiens
tgaagttagaattccttca

SEQ ID NO: 6486058 - DNA, 21 bp, Homo sapiens
tgaagttagaattccttcagg

SEQ ID NO: 6486059 - DNA, 23 bp, Homo sapiens
tgaagttagctttaacttaaata

SEQ ID NO: 6486060 - DNA, 16 bp, Homo sapiens
tgaagttagtggaaat

SEQ ID NO: 6486061 - DNA, 13 bp, Homo sapiens
tgaagttatctgt

SEQ ID NO: 6486062 - DNA, 20 bp, Homo sapiens
tgaagttatctgtgttattt

SEQ ID NO: 6486063 - DNA, 19 bp, Homo sapiens
tgaagttatgtgtatgtga

SEQ ID NO: 6486064 - DNA, 19 bp, Homo sapiens
tgaagttatttagaaatat

SEQ ID NO: 6486065 - DNA, 16 bp, Homo sapiens
tgaagttcaccattaa

SEQ ID NO: 6486066 - DNA, 15 bp, Homo sapiens
tgaagttctgaaatt

SEQ ID NO: 6486067 - DNA, 13 bp, Homo sapiens
tgaagttctgagc

SEQ ID NO: 6486068 - DNA, 22 bp, Homo sapiens
tgaagttctgcctctgatgtat

SEQ ID NO: 6486069 - DNA, 16 bp, Homo sapiens
tgaagttgattcatat

SEQ ID NO: 6486070 - DNA, 14 bp, Homo sapiens
tgaagttgctgctt

SEQ ID NO: 6486071 - DNA, 12 bp, Homo sapiens
tgaagttgctgt

SEQ ID NO: 6486072 - DNA, 17 bp, Homo sapiens
tgaagttgctgtttatt

SEQ ID NO: 6486073 - DNA, 19 bp, Homo sapiens
tgaagttgcttttttgact

SEQ ID NO: 6486074 - DNA, 14 bp, Homo sapiens
tgaagttggcacat

SEQ ID NO: 6486075 - DNA, 18 bp, Homo sapiens
tgaagttggcacatttca

SEQ ID NO: 6486076 - DNA, 14 bp, Homo sapiens
tgaagttgtgcaac

SEQ ID NO: 6486077 - DNA, 14 bp, Homo sapiens
tgaagtttaaattc

SEQ ID NO: 6486078 - DNA, 14 bp, Homo sapiens
tgaagtttacattg

SEQ ID NO: 6486079 - DNA, 16 bp, Homo sapiens
tgaagtttacattgta

SEQ ID NO: 6486080 - DNA, 20 bp, Homo sapiens
tgaagtttacattgtaaata

SEQ ID NO: 6486081 - DNA, 19 bp, Homo sapiens
tgaagtttacatttttatt

SEQ ID NO: 6486082 - DNA, 19 bp, Homo sapiens
tgaagtttatacagtacag

SEQ ID NO: 6486083 - DNA, 21 bp, Homo sapiens
tgaagtttattattttcaaag

SEQ ID NO: 6486084 - DNA, 21 bp, Homo sapiens
tgaagtttcaagttttaaagt

SEQ ID NO: 6486085 - DNA, 22 bp, Homo sapiens
tgaagtttcaagttttaaagtt

SEQ ID NO: 6486086 - DNA, 14 bp, Homo sapiens
tgaagtttcactcc

SEQ ID NO: 6486087 - DNA, 15 bp, Homo sapiens
tgaagtttcatttat

SEQ ID NO: 6486088 - DNA, 14 bp, Homo sapiens
tgaagtttctgtag

SEQ ID NO: 6486089 - DNA, 15 bp, Homo sapiens
tgaagtttgaatgct

SEQ ID NO: 6486090 - DNA, 15 bp, Homo sapiens
tgaagtttgaatgtt

SEQ ID NO: 6486091 - DNA, 16 bp, Homo sapiens
tgaagtttgaatgtta

SEQ ID NO: 6486092 - DNA, 17 bp, Homo sapiens
tgaagtttgaatgttaa

SEQ ID NO: 6486093 - DNA, 20 bp, Homo sapiens
tgaagtttgataaatagtgt

SEQ ID NO: 6486094 - DNA, 22 bp, Homo sapiens
tgaagtttgataaatagtgtta

SEQ ID NO: 6486095 - DNA, 18 bp, Homo sapiens
tgaagtttggagatagat

SEQ ID NO: 6486096 - DNA, 14 bp, Homo sapiens
tgaagttttacatt

SEQ ID NO: 6486097 - DNA, 23 bp, Homo sapiens
tgaagttttattttaaattatta

SEQ ID NO: 6486098 - DNA, 19 bp, Homo sapiens
tgaagttttccttgctatt

SEQ ID NO: 6486099 - DNA, 23 bp, Homo sapiens
tgaagttttccttgctatttcaa

SEQ ID NO: 6486100 - DNA, 17 bp, Homo sapiens
tgaagttttgatttatt

SEQ ID NO: 6486101 - DNA, 19 bp, Homo sapiens
tgaagtttttaaaaataaa

SEQ ID NO: 6486102 - DNA, 20 bp, Homo sapiens
tgaagtttttaaaaataaag

SEQ ID NO: 6486103 - DNA, 19 bp, Homo sapiens
tgaagtttttgaaatacct

SEQ ID NO: 6486104 - DNA, 22 bp, Homo sapiens
tgaataaaaaacatttgtacat

SEQ ID NO: 6486105 - DNA, 19 bp, Homo sapiens
tgaataaaaaagattctac

SEQ ID NO: 6486106 - DNA, 21 bp, Homo sapiens
tgaataaaaaagattctacta

SEQ ID NO: 6486107 - DNA, 22 bp, Homo sapiens
tgaataaaaaagattctactaa

SEQ ID NO: 6486108 - DNA, 23 bp, Homo sapiens
tgaataaaaaagattctactaac

SEQ ID NO: 6486109 - DNA, 22 bp, Homo sapiens
tgaataaaaaataaataaaatg

SEQ ID NO: 6486110 - DNA, 17 bp, Homo sapiens
tgaataaaaaatagaca

SEQ ID NO: 6486111 - DNA, 18 bp, Homo sapiens
tgaataaaaactcaagga

SEQ ID NO: 6486112 - DNA, 14 bp, Homo sapiens
tgaataaaaacttt

SEQ ID NO: 6486113 - DNA, 14 bp, Homo sapiens
tgaataaaaagaaa

SEQ ID NO: 6486114 - DNA, 16 bp, Homo sapiens
tgaataaaaaggaact

SEQ ID NO: 6486115 - DNA, 17 bp, Homo sapiens
tgaataaaaagtgaact

SEQ ID NO: 6486116 - DNA, 14 bp, Homo sapiens
tgaataaaaatgca

SEQ ID NO: 6486117 - DNA, 15 bp, Homo sapiens
tgaataaaaattaag

SEQ ID NO: 6486118 - DNA, 16 bp, Homo sapiens
tgaataaaacactcat

SEQ ID NO: 6486119 - DNA, 19 bp, Homo sapiens
tgaataaaacactcatccc

SEQ ID NO: 6486120 - DNA, 13 bp, Homo sapiens
tgaataaaagtga

SEQ ID NO: 6486121 - DNA, 14 bp, Homo sapiens
tgaataaaagtgca

SEQ ID NO: 6486122 - DNA, 16 bp, Homo sapiens
tgaataaaagtgcaca

SEQ ID NO: 6486123 - DNA, 16 bp, Homo sapiens
tgaataaaataaagct

SEQ ID NO: 6486124 - DNA, 13 bp, Homo sapiens
tgaataaaattag

SEQ ID NO: 6486125 - DNA, 13 bp, Homo sapiens
tgaataaaattat

SEQ ID NO: 6486126 - DNA, 12 bp, Homo sapiens
tgaataaaccaa

SEQ ID NO: 6486127 - DNA, 13 bp, Homo sapiens
tgaataaaccaag

SEQ ID NO: 6486128 - DNA, 22 bp, Homo sapiens
tgaataaaccagtatcgttact

SEQ ID NO: 6486129 - DNA, 14 bp, Homo sapiens
tgaataaactgaat

SEQ ID NO: 6486130 - DNA, 17 bp, Homo sapiens
tgaataaacttcagcac

SEQ ID NO: 6486131 - DNA, 17 bp, Homo sapiens
tgaataaagaatacttg

SEQ ID NO: 6486132 - DNA, 22 bp, Homo sapiens
tgaataaagaatacttgaactt

SEQ ID NO: 6486133 - DNA, 16 bp, Homo sapiens
tgaataaagaatgcca

SEQ ID NO: 6486134 - DNA, 14 bp, Homo sapiens
tgaataaagcaggg

SEQ ID NO: 6486135 - DNA, 15 bp, Homo sapiens
tgaataaagcaggga

SEQ ID NO: 6486136 - DNA, 20 bp, Homo sapiens
tgaataaagggaacatgcag

SEQ ID NO: 6486137 - DNA, 20 bp, Homo sapiens
tgaataaagtctgagtgggc

SEQ ID NO: 6486138 - DNA, 17 bp, Homo sapiens
tgaataaagtgtaacaa

SEQ ID NO: 6486139 - DNA, 16 bp, Homo sapiens
tgaataaataaatgta

SEQ ID NO: 6486140 - DNA, 19 bp, Homo sapiens
tggccactttgcagacctg

SEQ ID NO: 6486141 - DNA, 21 bp, Homo sapiens
tggccactttgcagacctggg

SEQ ID NO: 6486142 - DNA, 17 bp, Homo sapiens
tggccagaagtcaaggc

SEQ ID NO: 6486143 - DNA, 15 bp, Homo sapiens
tggccagacaagaag

SEQ ID NO: 6486144 - DNA, 12 bp, Homo sapiens
tggccagacaca

SEQ ID NO: 6486145 - DNA, 18 bp, Homo sapiens
tggccagacacaggccct

SEQ ID NO: 6486146 - DNA, 14 bp, Homo sapiens
tggccagaccagag

SEQ ID NO: 6486147 - DNA, 20 bp, Homo sapiens
tggccagaccagagctctgg

SEQ ID NO: 6486148 - DNA, 21 bp, Homo sapiens
tggccagaccagagctctgga

SEQ ID NO: 6486149 - DNA, 23 bp, Homo sapiens
tggccagaccagagctctggagc

SEQ ID NO: 6486150 - DNA, 15 bp, Homo sapiens
tggccagacgctgcc

SEQ ID NO: 6486151 - DNA, 19 bp, Homo sapiens
tggccagacgctgccgctg

SEQ ID NO: 6486152 - DNA, 23 bp, Homo sapiens
tggccagacggcccgccgtgcct

SEQ ID NO: 6486153 - DNA, 12 bp, Homo sapiens
tggccagactcg

SEQ ID NO: 6486154 - DNA, 23 bp, Homo sapiens
tggccagagagcctggtgctgct

SEQ ID NO: 6486155 - DNA, 18 bp, Homo sapiens
tggccagagagggcccag

SEQ ID NO: 6486156 - DNA, 22 bp, Homo sapiens
tggccagagagggcccagctgt

SEQ ID NO: 6486157 - DNA, 15 bp, Homo sapiens
tggccagagcacctc

SEQ ID NO: 6486158 - DNA, 19 bp, Homo sapiens
tggccagagcctctggccc

SEQ ID NO: 6486159 - DNA, 22 bp, Homo sapiens
tggccagagcctctggcccctc

SEQ ID NO: 6486160 - DNA, 22 bp, Homo sapiens
tggccagagctggaaggcaggg

SEQ ID NO: 6486161 - DNA, 14 bp, Homo sapiens
tggccagagctggg

SEQ ID NO: 6486162 - DNA, 20 bp, Homo sapiens
tggccagagctgggaggcat

SEQ ID NO: 6486163 - DNA, 24 bp, Homo sapiens
tggccagagctgggaggcatggcc

SEQ ID NO: 6486164 - DNA, 14 bp, Homo sapiens
tggccagaggcttg

SEQ ID NO: 6486165 - DNA, 17 bp, Homo sapiens
tggccagagggcccctc

SEQ ID NO: 6486166 - DNA, 18 bp, Homo sapiens
tggccagaggtgtcaccc

SEQ ID NO: 6486167 - DNA, 17 bp, Homo sapiens
tggccagagtcttggac

SEQ ID NO: 6486168 - DNA, 15 bp, Homo sapiens
tggccagatgcacca

SEQ ID NO: 6486169 - DNA, 17 bp, Homo sapiens
tggccagatgcggggac

SEQ ID NO: 6486170 - DNA, 19 bp, Homo sapiens
tggccagatgcggggacag

SEQ ID NO: 6486171 - DNA, 16 bp, Homo sapiens
tggccagcaaggcagg

SEQ ID NO: 6486172 - DNA, 23 bp, Homo sapiens
tggccagcacaccaagtggctgg

SEQ ID NO: 6486173 - DNA, 13 bp, Homo sapiens
tggccagcaccct

SEQ ID NO: 6486174 - DNA, 23 bp, Homo sapiens
tggccagcactagtaaaggagga

SEQ ID NO: 6486175 - DNA, 21 bp, Homo sapiens
tggccagcagcctctgatctg

SEQ ID NO: 6486176 - DNA, 14 bp, Homo sapiens
tggccagcagcttg

SEQ ID NO: 6486177 - DNA, 21 bp, Homo sapiens
tggccagccaacttttgcatg

SEQ ID NO: 6486178 - DNA, 14 bp, Homo sapiens
tggccagccaccac

SEQ ID NO: 6486179 - DNA, 12 bp, Homo sapiens
tggccagcccag

SEQ ID NO: 6486180 - DNA, 13 bp, Homo sapiens
tggccagcccaga

SEQ ID NO: 6486181 - DNA, 18 bp, Homo sapiens
tggccagcccagatggct

SEQ ID NO: 6486182 - DNA, 13 bp, Homo sapiens
tggccagccccac

SEQ ID NO: 6486183 - DNA, 19 bp, Homo sapiens
tggccagccccacagccca

SEQ ID NO: 6486184 - DNA, 20 bp, Homo sapiens
tggccagccccacagcccac

SEQ ID NO: 6486185 - DNA, 12 bp, Homo sapiens
tggccagcccct

SEQ ID NO: 6486186 - DNA, 15 bp, Homo sapiens
tggccagcccctggg

SEQ ID NO: 6486187 - DNA, 17 bp, Homo sapiens
tggccagcccctggggc

SEQ ID NO: 6486188 - DNA, 23 bp, Homo sapiens
tggccagcccctggggcccagcc

SEQ ID NO: 6486189 - DNA, 16 bp, Homo sapiens
tggccagccccttaga

SEQ ID NO: 6486190 - DNA, 11 bp, Homo sapiens
tggccagcccg

SEQ ID NO: 6486191 - DNA, 18 bp, Homo sapiens
tggccagcccgcagaggt

SEQ ID NO: 6486192 - DNA, 12 bp, Homo sapiens
tggccagcccgg

SEQ ID NO: 6486193 - DNA, 19 bp, Homo sapiens
tggccagcccggctggttt

SEQ ID NO: 6486194 - DNA, 20 bp, Homo sapiens
tggccagcccggctggtttt

SEQ ID NO: 6486195 - DNA, 22 bp, Homo sapiens
tggccagcccttcctctcactc

SEQ ID NO: 6486196 - DNA, 17 bp, Homo sapiens
tggccagccgctctcct

SEQ ID NO: 6486197 - DNA, 21 bp, Homo sapiens
tggccagccgggagcttggct

SEQ ID NO: 6486198 - DNA, 16 bp, Homo sapiens
tggccagcctggcatc

SEQ ID NO: 6486199 - DNA, 20 bp, Homo sapiens
tggccagcctggcatcagtt

SEQ ID NO: 6486200 - DNA, 18 bp, Homo sapiens
tggccagcctggggcctg

SEQ ID NO: 6486201 - DNA, 20 bp, Homo sapiens
tggccagcctggggcctggc

SEQ ID NO: 6486202 - DNA, 22 bp, Homo sapiens
tggccagcctggggcctggcag

SEQ ID NO: 6486203 - DNA, 20 bp, Homo sapiens
tggccagcgccagggcccag

SEQ ID NO: 6486204 - DNA, 21 bp, Homo sapiens
tggccagcgccagggcccagg

SEQ ID NO: 6486205 - DNA, 17 bp, Homo sapiens
tggccagcgtaaatgac

SEQ ID NO: 6486206 - DNA, 18 bp, Homo sapiens
tggccagctcataaaatg

SEQ ID NO: 6486207 - DNA, 14 bp, Homo sapiens
tggccagctctgag

SEQ ID NO: 6486208 - DNA, 18 bp, Homo sapiens
tggccagctctgagggga

SEQ ID NO: 6486209 - DNA, 15 bp, Homo sapiens
tggccagctctggct

SEQ ID NO: 6486210 - DNA, 12 bp, Homo sapiens
tggccagctgca

SEQ ID NO: 6486211 - DNA, 21 bp, Homo sapiens
tggccagctggaggcaggggc

SEQ ID NO: 6486212 - DNA, 19 bp, Homo sapiens
tggccaggaagtagcacag

SEQ ID NO: 6486213 - DNA, 13 bp, Homo sapiens
tggccaggacaca

SEQ ID NO: 6486214 - DNA, 11 bp, Homo sapiens
tggccaggagc

SEQ ID NO: 6486215 - DNA, 22 bp, Homo sapiens
tggccaggagcaggcacgggtg

SEQ ID NO: 6486216 - DNA, 16 bp, Homo sapiens
tggccaggagccatga

SEQ ID NO: 6486217 - DNA, 17 bp, Homo sapiens
tggccaggagccctggc

SEQ ID NO: 6486218 - DNA, 20 bp, Homo sapiens
tggccaggagctcttcaggc

SEQ ID NO: 6486219 - DNA, 23 bp, Homo sapiens
tggccaggagctcttcaggcctc

SEQ ID NO: 6486220 - DNA, 16 bp, Homo sapiens
tggccaggatggtctc

SEQ ID NO: 6486221 - DNA, 12 bp, Homo sapiens
tggccaggcaga

SEQ ID NO: 6486222 - DNA, 17 bp, Homo sapiens
tggccaggcagatctgt

SEQ ID NO: 6486223 - DNA, 14 bp, Homo sapiens
tggccaggccaggg

SEQ ID NO: 6486224 - DNA, 17 bp, Homo sapiens
tggccaggccaggggac

SEQ ID NO: 6486225 - DNA, 16 bp, Homo sapiens
tggccaggcctcaggg

SEQ ID NO: 6486226 - DNA, 20 bp, Homo sapiens
tggccaggctgatctcgaac

SEQ ID NO: 6486227 - DNA, 17 bp, Homo sapiens
tggccaggctgctctca

SEQ ID NO: 6486228 - DNA, 17 bp, Homo sapiens
tggccaggctgctcttg

SEQ ID NO: 6486229 - DNA, 20 bp, Homo sapiens
tggccaggctgctcttgaac

SEQ ID NO: 6486230 - DNA, 12 bp, Homo sapiens
tggccaggctgg

SEQ ID NO: 6486231 - DNA, 20 bp, Homo sapiens
tggccaggctggtcgtgaac

SEQ ID NO: 6486232 - DNA, 23 bp, Homo sapiens
tggccaggctggtcttgaactcc

SEQ ID NO: 6486233 - DNA, 20 bp, Homo sapiens
tggccaggctgttctcgaac

SEQ ID NO: 6486234 - DNA, 20 bp, Homo sapiens
tggccaggcttgtctcgaac

SEQ ID NO: 6486235 - DNA, 11 bp, Homo sapiens
tggccagggag

SEQ ID NO: 6486236 - DNA, 17 bp, Homo sapiens
tggccagggaggagccc

SEQ ID NO: 6486237 - DNA, 13 bp, Homo sapiens
tggccagggaggc

SEQ ID NO: 6486238 - DNA, 18 bp, Homo sapiens
tggccagggaggcgcagg

SEQ ID NO: 6486239 - DNA, 23 bp, Homo sapiens
tggccagggaggcgcagggacat

SEQ ID NO: 6486240 - DNA, 11 bp, Homo sapiens
tggccagggca

SEQ ID NO: 6486241 - DNA, 17 bp, Homo sapiens
tggccagggcagggcca

SEQ ID NO: 6486242 - DNA, 22 bp, Homo sapiens
tggccagggccacgctccagct

SEQ ID NO: 6486243 - DNA, 23 bp, Homo sapiens
tggccagggcctggaagacagag

SEQ ID NO: 6486244 - DNA, 11 bp, Homo sapiens
tggccagggct

SEQ ID NO: 6486245 - DNA, 21 bp, Homo sapiens
tggccagggcttccccatcag

SEQ ID NO: 6486246 - DNA, 18 bp, Homo sapiens
tggccaggggtgctcctg

SEQ ID NO: 6486247 - DNA, 22 bp, Homo sapiens
tggccagggtagacttggagct

SEQ ID NO: 6486248 - DNA, 12 bp, Homo sapiens
tggccagggtga

SEQ ID NO: 6486249 - DNA, 17 bp, Homo sapiens
tggccagggtgagagct

SEQ ID NO: 6486250 - DNA, 19 bp, Homo sapiens
tggccagggtgagagctgc

SEQ ID NO: 6486251 - DNA, 14 bp, Homo sapiens
tggccaggtacaac

SEQ ID NO: 6486252 - DNA, 13 bp, Homo sapiens
tggccaggtgccg

SEQ ID NO: 6486253 - DNA, 19 bp, Homo sapiens
tggccaggtggccactcca

SEQ ID NO: 6486254 - DNA, 16 bp, Homo sapiens
tggccagtagctgcca

SEQ ID NO: 6486255 - DNA, 17 bp, Homo sapiens
tggccagtatcctggat

SEQ ID NO: 6486256 - DNA, 19 bp, Homo sapiens
tggccagtatcctggattc

SEQ ID NO: 6486257 - DNA, 18 bp, Homo sapiens
tggccagtcatgtgctgg

SEQ ID NO: 6486258 - DNA, 15 bp, Homo sapiens
tggccagtccaggct

SEQ ID NO: 6486259 - DNA, 16 bp, Homo sapiens
tggccagtcctagagc

SEQ ID NO: 6486260 - DNA, 17 bp, Homo sapiens
tggccagtcctggtcct

SEQ ID NO: 6486261 - DNA, 20 bp, Homo sapiens
tggccagtcctggtcctggc

SEQ ID NO: 6486262 - DNA, 23 bp, Homo sapiens
tggccagtcctggtcctggctgc

SEQ ID NO: 6486263 - DNA, 21 bp, Homo sapiens
tggccagtcttcctcttagcc

SEQ ID NO: 6486264 - DNA, 16 bp, Homo sapiens
tggccagtgagaagct

SEQ ID NO: 6486265 - DNA, 19 bp, Homo sapiens
tggccagtgagaagctgag

SEQ ID NO: 6486266 - DNA, 18 bp, Homo sapiens
tggccagtgccctgatcc

SEQ ID NO: 6486267 - DNA, 11 bp, Homo sapiens
tggccagtgct

SEQ ID NO: 6486268 - DNA, 14 bp, Homo sapiens
tggccagtgctgct

SEQ ID NO: 6486269 - DNA, 16 bp, Homo sapiens
tggccagtgctgcttc

SEQ ID NO: 6486270 - DNA, 23 bp, Homo sapiens
tggccagtggctggatctgtgag

SEQ ID NO: 6486271 - DNA, 19 bp, Homo sapiens
tggccagtgtttaaaactt

SEQ ID NO: 6486272 - DNA, 16 bp, Homo sapiens
tggccagttatccctt

SEQ ID NO: 6486273 - DNA, 16 bp, Homo sapiens
tggccagttgaatata

SEQ ID NO: 6486274 - DNA, 20 bp, Homo sapiens
tggccagttgcccagagcac

SEQ ID NO: 6486275 - DNA, 22 bp, Homo sapiens
tggccagttttctgttcagctt

SEQ ID NO: 6486276 - DNA, 15 bp, Homo sapiens
tggccatagaggccc

SEQ ID NO: 6486277 - DNA, 18 bp, Homo sapiens
tggccatagaggcccagg

SEQ ID NO: 6486278 - DNA, 19 bp, Homo sapiens
tggccatagaggcccaggc

SEQ ID NO: 6486279 - DNA, 18 bp, Homo sapiens
tggccatatatgctgtat

SEQ ID NO: 6486280 - DNA, 20 bp, Homo sapiens
tggccatatatgctgtattt

SEQ ID NO: 6486281 - DNA, 22 bp, Homo sapiens
tggccatatttacctcagcctg

SEQ ID NO: 6486282 - DNA, 24 bp, Homo sapiens
tggccatatttacctcagcctggg

SEQ ID NO: 6486283 - DNA, 17 bp, Homo sapiens
tggccatcactcagccc

SEQ ID NO: 6486284 - DNA, 18 bp, Homo sapiens
tggccatcactcagcccc

SEQ ID NO: 6486285 - DNA, 13 bp, Homo sapiens
tggccatcatcct

SEQ ID NO: 6486286 - DNA, 14 bp, Homo sapiens
tggccatcatcctc

SEQ ID NO: 6486287 - DNA, 13 bp, Homo sapiens
tggccatccctgg

SEQ ID NO: 6486288 - DNA, 16 bp, Homo sapiens
tggccatccctgggcc

SEQ ID NO: 6486289 - DNA, 20 bp, Homo sapiens
tggccatccctgggcccctc

SEQ ID NO: 6486290 - DNA, 15 bp, Homo sapiens
tggccatccctgtga

SEQ ID NO: 6486291 - DNA, 16 bp, Homo sapiens
tggccatccctgtgag

SEQ ID NO: 6486292 - DNA, 21 bp, Homo sapiens
tggccatcctacccagcgtgg

SEQ ID NO: 6486293 - DNA, 19 bp, Homo sapiens
tggccatccttctgtgtac

SEQ ID NO: 6486294 - DNA, 16 bp, Homo sapiens
tggccatctccctccc

SEQ ID NO: 6486295 - DNA, 20 bp, Homo sapiens
tggccatctccctccccaga

SEQ ID NO: 6486296 - DNA, 14 bp, Homo sapiens
tggccatctctgga

SEQ ID NO: 6486297 - DNA, 16 bp, Homo sapiens
tggccatcttctttct

SEQ ID NO: 6486298 - DNA, 18 bp, Homo sapiens
tggccatcttctttcttc

SEQ ID NO: 6486299 - DNA, 23 bp, Homo sapiens
tggccatcttctttcttccaccc

SEQ ID NO: 6486300 - DNA, 22 bp, Homo sapiens
tggccatgaagaggatgctgtg

SEQ ID NO: 6486301 - DNA, 14 bp, Homo sapiens
tggccatgaccctg

SEQ ID NO: 6486302 - DNA, 16 bp, Homo sapiens
tggccatgaccctgcc

SEQ ID NO: 6486303 - DNA, 17 bp, Homo sapiens
tggccatgaccctgcct

SEQ ID NO: 6486304 - DNA, 17 bp, Homo sapiens
tggccatgatgacaact

SEQ ID NO: 6486305 - DNA, 16 bp, Homo sapiens
tggccatgcaggaggt

SEQ ID NO: 6486306 - DNA, 19 bp, Homo sapiens
tggccatgcaggaggtgga

SEQ ID NO: 6486307 - DNA, 21 bp, Homo sapiens
tggccatgcaggaggtggaga

SEQ ID NO: 6486308 - DNA, 14 bp, Homo sapiens
tggccatgccctag

SEQ ID NO: 6486309 - DNA, 22 bp, Homo sapiens
tggccatgccctagaccctccc

SEQ ID NO: 6486310 - DNA, 17 bp, Homo sapiens
tggccatgcctcagccc

SEQ ID NO: 6486311 - DNA, 24 bp, Homo sapiens
tggccatgctgtccctgcactgtg

SEQ ID NO: 6486312 - DNA, 14 bp, Homo sapiens
tggccatgcttctt

SEQ ID NO: 6486313 - DNA, 16 bp, Homo sapiens
tggccatgcttcttgc

SEQ ID NO: 6486314 - DNA, 17 bp, Homo sapiens
tggccatgcttcttgcc

SEQ ID NO: 6486315 - DNA, 21 bp, Homo sapiens
tggccatgcttcttgcccctt

SEQ ID NO: 6486316 - DNA, 23 bp, Homo sapiens
tggccatgcttcttgccccttgg

SEQ ID NO: 6486317 - DNA, 16 bp, Homo sapiens
tgaataaataagtaaa

SEQ ID NO: 6486318 - DNA, 23 bp, Homo sapiens
tgaataaatacctcttagctgag

SEQ ID NO: 6486319 - DNA, 19 bp, Homo sapiens
tgaataaatgtcacttttt

SEQ ID NO: 6486320 - DNA, 19 bp, Homo sapiens
tgaataaattctataggaa

SEQ ID NO: 6486321 - DNA, 15 bp, Homo sapiens
tgaataaattttcaa

SEQ ID NO: 6486322 - DNA, 21 bp, Homo sapiens
tgaataaattttcaaatcctt

SEQ ID NO: 6486323 - DNA, 15 bp, Homo sapiens
tgaataacaacaatt

SEQ ID NO: 6486324 - DNA, 21 bp, Homo sapiens
tgaataacaaggaaaacagta

SEQ ID NO: 6486325 - DNA, 13 bp, Homo sapiens
tgaataacatagg

SEQ ID NO: 6486326 - DNA, 14 bp, Homo sapiens
tgaataacataggt

SEQ ID NO: 6486327 - DNA, 18 bp, Homo sapiens
tgaataacatttaaattc

SEQ ID NO: 6486328 - DNA, 19 bp, Homo sapiens
tgaataacctgcacaggct

SEQ ID NO: 6486329 - DNA, 23 bp, Homo sapiens
tgaataactaagatatagaaact

SEQ ID NO: 6486330 - DNA, 13 bp, Homo sapiens
tgaataacttgaa

SEQ ID NO: 6486331 - DNA, 12 bp, Homo sapiens
tgaataagcact

SEQ ID NO: 6486332 - DNA, 17 bp, Homo sapiens
tgaataagcagaacata

SEQ ID NO: 6486333 - DNA, 19 bp, Homo sapiens
tgaataagttgattctgtc

SEQ ID NO: 6486334 - DNA, 23 bp, Homo sapiens
tgaataagttgttttgttttata

SEQ ID NO: 6486335 - DNA, 22 bp, Homo sapiens
tgaataataaccacgattccaa

SEQ ID NO: 6486336 - DNA, 16 bp, Homo sapiens
tgaataataagcagga

SEQ ID NO: 6486337 - DNA, 13 bp, Homo sapiens
tgaataatacagt

SEQ ID NO: 6486338 - DNA, 22 bp, Homo sapiens
tgaataatcatgtgaaatgttt

SEQ ID NO: 6486339 - DNA, 16 bp, Homo sapiens
tgaataatgctaccag

SEQ ID NO: 6486340 - DNA, 14 bp, Homo sapiens
tgaataatggaaaa

SEQ ID NO: 6486341 - DNA, 20 bp, Homo sapiens
tgaataatggtaccagataa

SEQ ID NO: 6486342 - DNA, 17 bp, Homo sapiens
tgaataatgtagtgcag

SEQ ID NO: 6486343 - DNA, 14 bp, Homo sapiens
tgaataatgtctag

SEQ ID NO: 6486344 - DNA, 18 bp, Homo sapiens
tgaataatgtctagattt

SEQ ID NO: 6486345 - DNA, 21 bp, Homo sapiens
tgaataatgtctagattttga

SEQ ID NO: 6486346 - DNA, 22 bp, Homo sapiens
tgaataatgtctagattttgaa

SEQ ID NO: 6486347 - DNA, 17 bp, Homo sapiens
tgaataattacagtgcc

SEQ ID NO: 6486348 - DNA, 18 bp, Homo sapiens
tgaataattacagtgcct

SEQ ID NO: 6486349 - DNA, 19 bp, Homo sapiens
tgaataattactacattag

SEQ ID NO: 6486350 - DNA, 22 bp, Homo sapiens
tgaataattatgtttacctcac

SEQ ID NO: 6486351 - DNA, 16 bp, Homo sapiens
tgaataatttattatt

SEQ ID NO: 6486352 - DNA, 22 bp, Homo sapiens
tgaatacaaacaatggaaactg

SEQ ID NO: 6486353 - DNA, 16 bp, Homo sapiens
tgaatacacaggactt

SEQ ID NO: 6486354 - DNA, 20 bp, Homo sapiens
tgaatacacatctctgtcag

SEQ ID NO: 6486355 - DNA, 14 bp, Homo sapiens
tgaatacagcagca

SEQ ID NO: 6486356 - DNA, 20 bp, Homo sapiens
tgaatacagttacttaatga

SEQ ID NO: 6486357 - DNA, 13 bp, Homo sapiens
tgaatacattaac

SEQ ID NO: 6486358 - DNA, 23 bp, Homo sapiens
tgaatacattaacggtgctaaaa

SEQ ID NO: 6486359 - DNA, 21 bp, Homo sapiens
tgaatacattctttgctagtt

SEQ ID NO: 6486360 - DNA, 19 bp, Homo sapiens
tgaatacatttgtatttat

SEQ ID NO: 6486361 - DNA, 16 bp, Homo sapiens
tgaataccactctgta

SEQ ID NO: 6486362 - DNA, 19 bp, Homo sapiens
tgaataccactctgtaatt

SEQ ID NO: 6486363 - DNA, 23 bp, Homo sapiens
tgaataccactctgtaattgcaa

SEQ ID NO: 6486364 - DNA, 19 bp, Homo sapiens
tgaataccacttacctcaa

SEQ ID NO: 6486365 - DNA, 19 bp, Homo sapiens
tgaatacccccagagacct

SEQ ID NO: 6486366 - DNA, 16 bp, Homo sapiens
tgaatacccttttctg

SEQ ID NO: 6486367 - DNA, 12 bp, Homo sapiens
tgaatacctaag

SEQ ID NO: 6486368 - DNA, 20 bp, Homo sapiens
tgaatacctaagatttctgt

SEQ ID NO: 6486369 - DNA, 14 bp, Homo sapiens
tgaatacctgctca

SEQ ID NO: 6486370 - DNA, 16 bp, Homo sapiens
tgaataccttagtgca

SEQ ID NO: 6486371 - DNA, 18 bp, Homo sapiens
tgaatactcctgttagta

SEQ ID NO: 6486372 - DNA, 13 bp, Homo sapiens
tgaatactctcac

SEQ ID NO: 6486373 - DNA, 15 bp, Homo sapiens
tgaatactgcttgaa

SEQ ID NO: 6486374 - DNA, 16 bp, Homo sapiens
tgaatactgtctgtat

SEQ ID NO: 6486375 - DNA, 17 bp, Homo sapiens
tgaatactgtctgtatc

SEQ ID NO: 6486376 - DNA, 19 bp, Homo sapiens
tgaatactgtctgtatctt

SEQ ID NO: 6486377 - DNA, 15 bp, Homo sapiens
tgaatactgtgaaaa

SEQ ID NO: 6486378 - DNA, 13 bp, Homo sapiens
tgaatacttattt

SEQ ID NO: 6486379 - DNA, 20 bp, Homo sapiens
tgaatacttattttcagtgc

SEQ ID NO: 6486380 - DNA, 15 bp, Homo sapiens
tgaatacttgaagta

SEQ ID NO: 6486381 - DNA, 13 bp, Homo sapiens
tgaatactttctt

SEQ ID NO: 6486382 - DNA, 20 bp, Homo sapiens
tgaatactttgaatgtgttt

SEQ ID NO: 6486383 - DNA, 12 bp, Homo sapiens
tgaatagaaatg

SEQ ID NO: 6486384 - DNA, 15 bp, Homo sapiens
tgaatagaaatggga

SEQ ID NO: 6486385 - DNA, 13 bp, Homo sapiens
tgaatagaagaaa

SEQ ID NO: 6486386 - DNA, 20 bp, Homo sapiens
tgaatagaagaaagaaaatg

SEQ ID NO: 6486387 - DNA, 17 bp, Homo sapiens
tgaatagaagttttcct

SEQ ID NO: 6486388 - DNA, 21 bp, Homo sapiens
tgaatagacagaggtttcatt

SEQ ID NO: 6486389 - DNA, 18 bp, Homo sapiens
tgaatagacataaattgt

SEQ ID NO: 6486390 - DNA, 18 bp, Homo sapiens
tgaatagactatctagaa

SEQ ID NO: 6486391 - DNA, 13 bp, Homo sapiens
tgaatagatgtga

SEQ ID NO: 6486392 - DNA, 21 bp, Homo sapiens
tgaatagcagtggcaaaatat

SEQ ID NO: 6486393 - DNA, 22 bp, Homo sapiens
tgaatagccatatttgtaaaat

SEQ ID NO: 6486394 - DNA, 20 bp, Homo sapiens
tgaatagctcccagatttca

SEQ ID NO: 6486395 - DNA, 11 bp, Homo sapiens
tgaatagcttg

SEQ ID NO: 6486396 - DNA, 18 bp, Homo sapiens
tgaataggcgatcacaac

SEQ ID NO: 6486397 - DNA, 19 bp, Homo sapiens
tgaataggcgatcacaacg

SEQ ID NO: 6486398 - DNA, 22 bp, Homo sapiens
tgaatagtcttttgcatgtcgc

SEQ ID NO: 6486399 - DNA, 19 bp, Homo sapiens
tgaatagtggaacattttc

SEQ ID NO: 6486400 - DNA, 14 bp, Homo sapiens
tgaatagttaaaaa

SEQ ID NO: 6486401 - DNA, 18 bp, Homo sapiens
tgaatagttaaaaattaa

SEQ ID NO: 6486402 - DNA, 19 bp, Homo sapiens
tgaatagtttatttctgtg

SEQ ID NO: 6486403 - DNA, 21 bp, Homo sapiens
tgaatataaaaacatttgtaa

SEQ ID NO: 6486404 - DNA, 15 bp, Homo sapiens
tgaatataaacacta

SEQ ID NO: 6486405 - DNA, 14 bp, Homo sapiens
tgaatataaatgta

SEQ ID NO: 6486406 - DNA, 18 bp, Homo sapiens
tgaatataaatgtgtgta

SEQ ID NO: 6486407 - DNA, 19 bp, Homo sapiens
tgaatataaatgtgtgtat

SEQ ID NO: 6486408 - DNA, 21 bp, Homo sapiens
tgaatataatatatttgtgta

SEQ ID NO: 6486409 - DNA, 22 bp, Homo sapiens
tgaatataatatatttgtgtat

SEQ ID NO: 6486410 - DNA, 12 bp, Homo sapiens
tgaatataatga

SEQ ID NO: 6486411 - DNA, 21 bp, Homo sapiens
tgaatatacagcaggtgctca

SEQ ID NO: 6486412 - DNA, 16 bp, Homo sapiens
tgaatatagcctgcct

SEQ ID NO: 6486413 - DNA, 14 bp, Homo sapiens
tgaatatataaaca

SEQ ID NO: 6486414 - DNA, 15 bp, Homo sapiens
tgaatatataaacac

SEQ ID NO: 6486415 - DNA, 16 bp, Homo sapiens
tgaatatataaacact

SEQ ID NO: 6486416 - DNA, 17 bp, Homo sapiens
tgaatatataaacactc

SEQ ID NO: 6486417 - DNA, 17 bp, Homo sapiens
tgaatatatatgatgaa

SEQ ID NO: 6486418 - DNA, 18 bp, Homo sapiens
tgaatatattataatctt

SEQ ID NO: 6486419 - DNA, 22 bp, Homo sapiens
tgaatatatttaagcaacatct

SEQ ID NO: 6486420 - DNA, 14 bp, Homo sapiens
tgaatatcattgat

SEQ ID NO: 6486421 - DNA, 14 bp, Homo sapiens
tgaatatctattaa

SEQ ID NO: 6486422 - DNA, 18 bp, Homo sapiens
tgaatatctattaatata

SEQ ID NO: 6486423 - DNA, 23 bp, Homo sapiens
tgaatatgagaaatacagaagaa

SEQ ID NO: 6486424 - DNA, 22 bp, Homo sapiens
tgaatatgaggcatttggcatt

SEQ ID NO: 6486425 - DNA, 13 bp, Homo sapiens
tgaatatgattaa

SEQ ID NO: 6486426 - DNA, 19 bp, Homo sapiens
tgaatatgattagtaaaga

SEQ ID NO: 6486427 - DNA, 14 bp, Homo sapiens
tgaatatgcctgta

SEQ ID NO: 6486428 - DNA, 16 bp, Homo sapiens
tgaatatgcctgtaat

SEQ ID NO: 6486429 - DNA, 23 bp, Homo sapiens
tgaatatgcctgtaattcagtgt

SEQ ID NO: 6486430 - DNA, 16 bp, Homo sapiens
tgaatatgccttaatt

SEQ ID NO: 6486431 - DNA, 19 bp, Homo sapiens
tgaatatggacagttagca

SEQ ID NO: 6486432 - DNA, 22 bp, Homo sapiens
tgaatatggacagttagcattt

SEQ ID NO: 6486433 - DNA, 22 bp, Homo sapiens
tgaatatgtcatcactctaggt

SEQ ID NO: 6486434 - DNA, 20 bp, Homo sapiens
tgaatatgtgccttctagaa

SEQ ID NO: 6486435 - DNA, 15 bp, Homo sapiens
tgaatatgtgtaact

SEQ ID NO: 6486436 - DNA, 21 bp, Homo sapiens
tgaatattaaagtctgagaaa

SEQ ID NO: 6486437 - DNA, 19 bp, Homo sapiens
tgaatattaagaaacaatt

SEQ ID NO: 6486438 - DNA, 22 bp, Homo sapiens
tgaatattacatgtaaagctgt

SEQ ID NO: 6486439 - DNA, 15 bp, Homo sapiens
tgaatattactccta

SEQ ID NO: 6486440 - DNA, 15 bp, Homo sapiens
tgaatattagatgct

SEQ ID NO: 6486441 - DNA, 17 bp, Homo sapiens
tgaatattatcatttct

SEQ ID NO: 6486442 - DNA, 18 bp, Homo sapiens
tgaatattcctggactta

SEQ ID NO: 6486443 - DNA, 17 bp, Homo sapiens
tgaatattgaagtttca

SEQ ID NO: 6486444 - DNA, 18 bp, Homo sapiens
tgaatattgccattatgc

SEQ ID NO: 6486445 - DNA, 21 bp, Homo sapiens
tgaatattggtaattaaaaga

SEQ ID NO: 6486446 - DNA, 13 bp, Homo sapiens
tgaatattgtaaa

SEQ ID NO: 6486447 - DNA, 20 bp, Homo sapiens
tgaatattgtggctccctgg

SEQ ID NO: 6486448 - DNA, 19 bp, Homo sapiens
tgaatatttaagcaataaa

SEQ ID NO: 6486449 - DNA, 17 bp, Homo sapiens
tgaatatttataacagc

SEQ ID NO: 6486450 - DNA, 22 bp, Homo sapiens
tgaatatttcaaaataaactgg

SEQ ID NO: 6486451 - DNA, 12 bp, Homo sapiens
tgaatatttcat

SEQ ID NO: 6486452 - DNA, 11 bp, Homo sapiens
tgaatatttct

SEQ ID NO: 6486453 - DNA, 13 bp, Homo sapiens
tgaatatttgtaa

SEQ ID NO: 6486454 - DNA, 15 bp, Homo sapiens
tgaatatttgtaaaa

SEQ ID NO: 6486455 - DNA, 21 bp, Homo sapiens
tgaatatttgttatgtagata

SEQ ID NO: 6486456 - DNA, 16 bp, Homo sapiens
tgaatattttatatta

SEQ ID NO: 6486457 - DNA, 12 bp, Homo sapiens
tgaatattttca

SEQ ID NO: 6486458 - DNA, 13 bp, Homo sapiens
tgaatattttcaa

SEQ ID NO: 6486459 - DNA, 19 bp, Homo sapiens
tgaatattttcaagttttt

SEQ ID NO: 6486460 - DNA, 22 bp, Homo sapiens
tgaatattttcaagtttttcat

SEQ ID NO: 6486461 - DNA, 20 bp, Homo sapiens
tgaatattttggaaactgct

SEQ ID NO: 6486462 - DNA, 16 bp, Homo sapiens
tgaatattttgtaata

SEQ ID NO: 6486463 - DNA, 17 bp, Homo sapiens
tgaatatttttgtattt

SEQ ID NO: 6486464 - DNA, 22 bp, Homo sapiens
tgaatatttttgtattttacat

SEQ ID NO: 6486465 - DNA, 13 bp, Homo sapiens
tgaatcaaaacaa

SEQ ID NO: 6486466 - DNA, 13 bp, Homo sapiens
tgaatcaaagaca

SEQ ID NO: 6486467 - DNA, 17 bp, Homo sapiens
tgaatcaaagacatttc

SEQ ID NO: 6486468 - DNA, 19 bp, Homo sapiens
tgaatcaaagacatttcat

SEQ ID NO: 6486469 - DNA, 20 bp, Homo sapiens
tgaatcaaagtgtctagaca

SEQ ID NO: 6486470 - DNA, 13 bp, Homo sapiens
tgaatcaataata

SEQ ID NO: 6486471 - DNA, 14 bp, Homo sapiens
tgaatcacatgaat

SEQ ID NO: 6486472 - DNA, 12 bp, Homo sapiens
tgaatcacctgg

SEQ ID NO: 6486473 - DNA, 19 bp, Homo sapiens
tgaatcacctggctgagca

SEQ ID NO: 6486474 - DNA, 21 bp, Homo sapiens
tgaatcactgcacctctttgt

SEQ ID NO: 6486475 - DNA, 11 bp, Homo sapiens
tgaatcactgt

SEQ ID NO: 6486476 - DNA, 21 bp, Homo sapiens
tgaatcactgtgctcagccac

SEQ ID NO: 6486477 - DNA, 13 bp, Homo sapiens
tgaatcactgttg

SEQ ID NO: 6486478 - DNA, 21 bp, Homo sapiens
tgaatcactgttgctttgaaa

SEQ ID NO: 6486479 - DNA, 17 bp, Homo sapiens
tgaatcagaaaagctat

SEQ ID NO: 6486480 - DNA, 21 bp, Homo sapiens
tgaatcagaacagatgctgag

SEQ ID NO: 6486481 - DNA, 22 bp, Homo sapiens
tgaatcagaacagatgctgagc

SEQ ID NO: 6486482 - DNA, 15 bp, Homo sapiens
tgaatcagaggcaga

SEQ ID NO: 6486483 - DNA, 18 bp, Homo sapiens
tgaatcagatgtgtgttc

SEQ ID NO: 6486484 - DNA, 14 bp, Homo sapiens
tgaatcagctggac

SEQ ID NO: 6486485 - DNA, 15 bp, Homo sapiens
tgaatcagctggaca

SEQ ID NO: 6486486 - DNA, 22 bp, Homo sapiens
tgaatcagttttggaatctaag

SEQ ID NO: 6486487 - DNA, 13 bp, Homo sapiens
tgaatcagttttt

SEQ ID NO: 6486488 - DNA, 14 bp, Homo sapiens
tgaatcatccagac

SEQ ID NO: 6486489 - DNA, 13 bp, Homo sapiens
tgaatcatgagcc

SEQ ID NO: 6486490 - DNA, 13 bp, Homo sapiens
tgaatcatttctt

SEQ ID NO: 6486491 - DNA, 23 bp, Homo sapiens
tgaatcatttcttataccttctg

SEQ ID NO: 6486492 - DNA, 23 bp, Homo sapiens
tgaatcattttacctttgacaaa

SEQ ID NO: 6486493 - DNA, 18 bp, Homo sapiens
tgaatccaaatctgtcct

SEQ ID NO: 6486494 - DNA, 23 bp, Homo sapiens
tgaatccaaatctgtcctctgta

SEQ ID NO: 6486495 - DNA, 23 bp, Homo sapiens
tggccatggacgaatatgaatgt

SEQ ID NO: 6486496 - DNA, 23 bp, Homo sapiens
tggccatggagaaagctgacttg

SEQ ID NO: 6486497 - DNA, 13 bp, Homo sapiens
tggccatggctgc

SEQ ID NO: 6486498 - DNA, 16 bp, Homo sapiens
tggccatgggaggcct

SEQ ID NO: 6486499 - DNA, 22 bp, Homo sapiens
tggccatgggaggcctttccct

SEQ ID NO: 6486500 - DNA, 20 bp, Homo sapiens
tggccatgggctgagcaggc

SEQ ID NO: 6486501 - DNA, 22 bp, Homo sapiens
tggccatggtacccccttctgg

SEQ ID NO: 6486502 - DNA, 14 bp, Homo sapiens
tggccatgtatgaa

SEQ ID NO: 6486503 - DNA, 13 bp, Homo sapiens
tggccatgtcctc

SEQ ID NO: 6486504 - DNA, 17 bp, Homo sapiens
tggccatgtcgcctgcc

SEQ ID NO: 6486505 - DNA, 15 bp, Homo sapiens
tggccatgttgtctt

SEQ ID NO: 6486506 - DNA, 23 bp, Homo sapiens
tggccattctttttttcttggcc

SEQ ID NO: 6486507 - DNA, 16 bp, Homo sapiens
tggccatttagccacc

SEQ ID NO: 6486508 - DNA, 13 bp, Homo sapiens
tggccatttctaa

SEQ ID NO: 6486509 - DNA, 19 bp, Homo sapiens
tggccatttgctagttctg

SEQ ID NO: 6486510 - DNA, 22 bp, Homo sapiens
tggccattttcttgcctgaggc

SEQ ID NO: 6486511 - DNA, 22 bp, Homo sapiens
tggcccaagactgggctgtagt

SEQ ID NO: 6486512 - DNA, 17 bp, Homo sapiens
tggcccaagccctccac

SEQ ID NO: 6486513 - DNA, 18 bp, Homo sapiens
tggcccaagccctccaca

SEQ ID NO: 6486514 - DNA, 17 bp, Homo sapiens
tggcccaagctgggctc

SEQ ID NO: 6486515 - DNA, 21 bp, Homo sapiens
tggcccaagctgggctccctt

SEQ ID NO: 6486516 - DNA, 12 bp, Homo sapiens
tggcccaaggct

SEQ ID NO: 6486517 - DNA, 18 bp, Homo sapiens
tggcccaagtcattccta

SEQ ID NO: 6486518 - DNA, 16 bp, Homo sapiens
tggcccacacagatct

SEQ ID NO: 6486519 - DNA, 21 bp, Homo sapiens
tggcccacacgtgcatagagg

SEQ ID NO: 6486520 - DNA, 19 bp, Homo sapiens
tggcccacagcaggtgctg

SEQ ID NO: 6486521 - DNA, 17 bp, Homo sapiens
tggcccacagctctgct

SEQ ID NO: 6486522 - DNA, 23 bp, Homo sapiens
tggcccacagctctgctggaaga

SEQ ID NO: 6486523 - DNA, 14 bp, Homo sapiens
tggcccaccaggcc

SEQ ID NO: 6486524 - DNA, 15 bp, Homo sapiens
tggcccaccccccag

SEQ ID NO: 6486525 - DNA, 20 bp, Homo sapiens
tggcccacccctcttccccc

SEQ ID NO: 6486526 - DNA, 23 bp, Homo sapiens
tggcccacccctcttcccccttc

SEQ ID NO: 6486527 - DNA, 22 bp, Homo sapiens
tggcccacgggccggccagctg

SEQ ID NO: 6486528 - DNA, 19 bp, Homo sapiens
tggcccactgctggctgca

SEQ ID NO: 6486529 - DNA, 15 bp, Homo sapiens
tggcccactgtgcag

SEQ ID NO: 6486530 - DNA, 14 bp, Homo sapiens
tggcccagaaagcc

SEQ ID NO: 6486531 - DNA, 22 bp, Homo sapiens
tggcccagaaagcctctctctc

SEQ ID NO: 6486532 - DNA, 12 bp, Homo sapiens
tggcccagagcc

SEQ ID NO: 6486533 - DNA, 13 bp, Homo sapiens
tggcccagagcca

SEQ ID NO: 6486534 - DNA, 15 bp, Homo sapiens
tggcccagcacgagc

SEQ ID NO: 6486535 - DNA, 17 bp, Homo sapiens
tggcccagcacgagcct

SEQ ID NO: 6486536 - DNA, 20 bp, Homo sapiens
tggcccagcactgcccatcc

SEQ ID NO: 6486537 - DNA, 18 bp, Homo sapiens
tggcccagcagcggccca

SEQ ID NO: 6486538 - DNA, 20 bp, Homo sapiens
tggcccagcagcggcccaga

SEQ ID NO: 6486539 - DNA, 23 bp, Homo sapiens
tggcccagcagcttggctgagcc

SEQ ID NO: 6486540 - DNA, 13 bp, Homo sapiens
tggcccagcaggc

SEQ ID NO: 6486541 - DNA, 14 bp, Homo sapiens
tggcccagcaggca

SEQ ID NO: 6486542 - DNA, 21 bp, Homo sapiens
tggcccagcaggcaggcactg

SEQ ID NO: 6486543 - DNA, 15 bp, Homo sapiens
tggcccagcatggaa

SEQ ID NO: 6486544 - DNA, 14 bp, Homo sapiens
tggcccagccactg

SEQ ID NO: 6486545 - DNA, 14 bp, Homo sapiens
tggcccagccagca

SEQ ID NO: 6486546 - DNA, 15 bp, Homo sapiens
tggcccagccagcag

SEQ ID NO: 6486547 - DNA, 17 bp, Homo sapiens
tggcccagccagcaggt

SEQ ID NO: 6486548 - DNA, 15 bp, Homo sapiens
tggcccagccatggc

SEQ ID NO: 6486549 - DNA, 19 bp, Homo sapiens
tggcccagccctgctggcc

SEQ ID NO: 6486550 - DNA, 20 bp, Homo sapiens
tggcccagccctgctggccg

SEQ ID NO: 6486551 - DNA, 13 bp, Homo sapiens
tggcccagccggc

SEQ ID NO: 6486552 - DNA, 15 bp, Homo sapiens
tggcccagccggcct

SEQ ID NO: 6486553 - DNA, 17 bp, Homo sapiens
tggcccagccggcctct

SEQ ID NO: 6486554 - DNA, 11 bp, Homo sapiens
tggcccagcct

SEQ ID NO: 6486555 - DNA, 17 bp, Homo sapiens
tggcccagcctcttaac

SEQ ID NO: 6486556 - DNA, 13 bp, Homo sapiens
tggcccagcctgg

SEQ ID NO: 6486557 - DNA, 15 bp, Homo sapiens
tggcccagcctgtgg

SEQ ID NO: 6486558 - DNA, 17 bp, Homo sapiens
tggcccagcctgtggcc

SEQ ID NO: 6486559 - DNA, 23 bp, Homo sapiens
tggcccagcctgtggcctcagca

SEQ ID NO: 6486560 - DNA, 17 bp, Homo sapiens
tggcccagcggcccctc

SEQ ID NO: 6486561 - DNA, 23 bp, Homo sapiens
tggcccaggaattagagaagctg

SEQ ID NO: 6486562 - DNA, 11 bp, Homo sapiens
tggcccaggag

SEQ ID NO: 6486563 - DNA, 13 bp, Homo sapiens
tggcccaggagct

SEQ ID NO: 6486564 - DNA, 15 bp, Homo sapiens
tggcccaggagctct

SEQ ID NO: 6486565 - DNA, 16 bp, Homo sapiens
tggcccaggagctctg

SEQ ID NO: 6486566 - DNA, 20 bp, Homo sapiens
tggcccaggagctctgcgcc

SEQ ID NO: 6486567 - DNA, 12 bp, Homo sapiens
tggcccaggagg

SEQ ID NO: 6486568 - DNA, 12 bp, Homo sapiens
tggcccaggagt

SEQ ID NO: 6486569 - DNA, 13 bp, Homo sapiens
tggcccaggagtt

SEQ ID NO: 6486570 - DNA, 19 bp, Homo sapiens
tggcccaggagtttggcca

SEQ ID NO: 6486571 - DNA, 22 bp, Homo sapiens
tggcccaggagtttggccagaa

SEQ ID NO: 6486572 - DNA, 12 bp, Homo sapiens
tggcccaggcag

SEQ ID NO: 6486573 - DNA, 11 bp, Homo sapiens
tggcccaggcc

SEQ ID NO: 6486574 - DNA, 13 bp, Homo sapiens
tggcccaggcccc

SEQ ID NO: 6486575 - DNA, 14 bp, Homo sapiens
tggcccaggccggg

SEQ ID NO: 6486576 - DNA, 22 bp, Homo sapiens
tggcccaggccgggaagagcca

SEQ ID NO: 6486577 - DNA, 12 bp, Homo sapiens
tggcccaggcct

SEQ ID NO: 6486578 - DNA, 21 bp, Homo sapiens
tggcccaggccttgctgactc

SEQ ID NO: 6486579 - DNA, 14 bp, Homo sapiens
tggcccaggctggc

SEQ ID NO: 6486580 - DNA, 22 bp, Homo sapiens
tggcccaggctggcccccaccc

SEQ ID NO: 6486581 - DNA, 14 bp, Homo sapiens
tggcccagggagga

SEQ ID NO: 6486582 - DNA, 14 bp, Homo sapiens
tggcccagggccca

SEQ ID NO: 6486583 - DNA, 21 bp, Homo sapiens
tggcccagggggcctggagca

SEQ ID NO: 6486584 - DNA, 19 bp, Homo sapiens
tggcccagggggcttcctg

SEQ ID NO: 6486585 - DNA, 20 bp, Homo sapiens
tggcccagggtaggggaggg

SEQ ID NO: 6486586 - DNA, 16 bp, Homo sapiens
tggcccagggtggcca

SEQ ID NO: 6486587 - DNA, 18 bp, Homo sapiens
tggcccagggtggccaca

SEQ ID NO: 6486588 - DNA, 18 bp, Homo sapiens
tggcccagtgagagtgag

SEQ ID NO: 6486589 - DNA, 19 bp, Homo sapiens
tggcccagtgagagtgagg

SEQ ID NO: 6486590 - DNA, 14 bp, Homo sapiens
tggcccagttctga

SEQ ID NO: 6486591 - DNA, 15 bp, Homo sapiens
tggcccagttgtcca

SEQ ID NO: 6486592 - DNA, 22 bp, Homo sapiens
tggcccatagaaacatgacact

SEQ ID NO: 6486593 - DNA, 15 bp, Homo sapiens
tggcccatcaactgt

SEQ ID NO: 6486594 - DNA, 22 bp, Homo sapiens
tggcccatcactcggctgtgga

SEQ ID NO: 6486595 - DNA, 22 bp, Homo sapiens
tggcccatcagggtaggctgga

SEQ ID NO: 6486596 - DNA, 12 bp, Homo sapiens
tggcccatcccc

SEQ ID NO: 6486597 - DNA, 20 bp, Homo sapiens
tggcccatcccccctcacca

SEQ ID NO: 6486598 - DNA, 20 bp, Homo sapiens
tggcccatcccgccttctcc

SEQ ID NO: 6486599 - DNA, 21 bp, Homo sapiens
tggcccatcccgccttctcca

SEQ ID NO: 6486600 - DNA, 20 bp, Homo sapiens
tggcccatctcagcctcctg

SEQ ID NO: 6486601 - DNA, 17 bp, Homo sapiens
tggcccatctgtatgct

SEQ ID NO: 6486602 - DNA, 19 bp, Homo sapiens
tggcccatgggagccaggc

SEQ ID NO: 6486603 - DNA, 17 bp, Homo sapiens
tggcccatgtatggcca

SEQ ID NO: 6486604 - DNA, 18 bp, Homo sapiens
tggcccatgtatggccag

SEQ ID NO: 6486605 - DNA, 15 bp, Homo sapiens
tggcccattctactt

SEQ ID NO: 6486606 - DNA, 20 bp, Homo sapiens
tggcccattctacttgctct

SEQ ID NO: 6486607 - DNA, 16 bp, Homo sapiens
tggcccattcttgagt

SEQ ID NO: 6486608 - DNA, 13 bp, Homo sapiens
tggccccaaatgt

SEQ ID NO: 6486609 - DNA, 16 bp, Homo sapiens
tggccccaccctgggc

SEQ ID NO: 6486610 - DNA, 21 bp, Homo sapiens
tggccccaccgagctggagcg

SEQ ID NO: 6486611 - DNA, 13 bp, Homo sapiens
tggccccacctgg

SEQ ID NO: 6486612 - DNA, 17 bp, Homo sapiens
tggccccacctggccct

SEQ ID NO: 6486613 - DNA, 23 bp, Homo sapiens
tggccccacctggccctctctga

SEQ ID NO: 6486614 - DNA, 16 bp, Homo sapiens
tggccccactttgaag

SEQ ID NO: 6486615 - DNA, 18 bp, Homo sapiens
tggccccagccctgctgg

SEQ ID NO: 6486616 - DNA, 13 bp, Homo sapiens
tggccccagcctg

SEQ ID NO: 6486617 - DNA, 22 bp, Homo sapiens
tggccccagcctggcccagctc

SEQ ID NO: 6486618 - DNA, 15 bp, Homo sapiens
tggccccagcctggg

SEQ ID NO: 6486619 - DNA, 17 bp, Homo sapiens
tggccccagctggctgg

SEQ ID NO: 6486620 - DNA, 19 bp, Homo sapiens
tggccccagctggctgggt

SEQ ID NO: 6486621 - DNA, 22 bp, Homo sapiens
tggccccaggcccacagcgtgg

SEQ ID NO: 6486622 - DNA, 13 bp, Homo sapiens
tggccccagggga

SEQ ID NO: 6486623 - DNA, 14 bp, Homo sapiens
tggccccagggttg

SEQ ID NO: 6486624 - DNA, 16 bp, Homo sapiens
tggccccaggtgccac

SEQ ID NO: 6486625 - DNA, 21 bp, Homo sapiens
tggccccagtgcggttcctca

SEQ ID NO: 6486626 - DNA, 19 bp, Homo sapiens
tggccccatccagcatgtg

SEQ ID NO: 6486627 - DNA, 13 bp, Homo sapiens
tggccccatccca

SEQ ID NO: 6486628 - DNA, 16 bp, Homo sapiens
tggccccatcctggcc

SEQ ID NO: 6486629 - DNA, 16 bp, Homo sapiens
tggcccccaataaagg

SEQ ID NO: 6486630 - DNA, 17 bp, Homo sapiens
tggcccccacatggtga

SEQ ID NO: 6486631 - DNA, 19 bp, Homo sapiens
tggcccccactcacaggga

SEQ ID NO: 6486632 - DNA, 13 bp, Homo sapiens
tggcccccactgg

SEQ ID NO: 6486633 - DNA, 14 bp, Homo sapiens
tggcccccactggc

SEQ ID NO: 6486634 - DNA, 18 bp, Homo sapiens
tggcccccactggctgtg

SEQ ID NO: 6486635 - DNA, 13 bp, Homo sapiens
tggcccccagccc

SEQ ID NO: 6486636 - DNA, 17 bp, Homo sapiens
tggcccccagccctggg

SEQ ID NO: 6486637 - DNA, 15 bp, Homo sapiens
tggcccccagcttca

SEQ ID NO: 6486638 - DNA, 13 bp, Homo sapiens
tggcccccagggg

SEQ ID NO: 6486639 - DNA, 17 bp, Homo sapiens
tggcccccaggggcagg

SEQ ID NO: 6486640 - DNA, 22 bp, Homo sapiens
tggcccccatacttggctgctt

SEQ ID NO: 6486641 - DNA, 22 bp, Homo sapiens
tggcccccccagccccacaccc

SEQ ID NO: 6486642 - DNA, 16 bp, Homo sapiens
tggcccccctccaggc

SEQ ID NO: 6486643 - DNA, 21 bp, Homo sapiens
tggcccccctccaggcatgct

SEQ ID NO: 6486644 - DNA, 18 bp, Homo sapiens
tggcccccgacccagctc

SEQ ID NO: 6486645 - DNA, 19 bp, Homo sapiens
tggcccccgacccagctct

SEQ ID NO: 6486646 - DNA, 14 bp, Homo sapiens
tggcccccgggcct

SEQ ID NO: 6486647 - DNA, 15 bp, Homo sapiens
tggcccccgggcctg

SEQ ID NO: 6486648 - DNA, 16 bp, Homo sapiens
tggcccccgggcctgc

SEQ ID NO: 6486649 - DNA, 20 bp, Homo sapiens
tggcccccgggcctgcacag

SEQ ID NO: 6486650 - DNA, 21 bp, Homo sapiens
tggcccccgggcctgcacaga

SEQ ID NO: 6486651 - DNA, 19 bp, Homo sapiens
tggccccctcattcagaga

SEQ ID NO: 6486652 - DNA, 14 bp, Homo sapiens
tggccccctgtcct

SEQ ID NO: 6486653 - DNA, 14 bp, Homo sapiens
tggccccctgtgcc

SEQ ID NO: 6486654 - DNA, 16 bp, Homo sapiens
tggccccctgtgccag

SEQ ID NO: 6486655 - DNA, 21 bp, Homo sapiens
tggcccccttcaggagcctgg

SEQ ID NO: 6486656 - DNA, 18 bp, Homo sapiens
tggccccctttcccgggc

SEQ ID NO: 6486657 - DNA, 19 bp, Homo sapiens
tggccccgacaggtcttcc

SEQ ID NO: 6486658 - DNA, 18 bp, Homo sapiens
tggccccgcccctgcccc

SEQ ID NO: 6486659 - DNA, 15 bp, Homo sapiens
tggccccgccctcag

SEQ ID NO: 6486660 - DNA, 21 bp, Homo sapiens
tggccccgccgcctggtactc

SEQ ID NO: 6486661 - DNA, 20 bp, Homo sapiens
tggccccgggctctggccac

SEQ ID NO: 6486662 - DNA, 21 bp, Homo sapiens
tggccccgggctctggccacc

SEQ ID NO: 6486663 - DNA, 19 bp, Homo sapiens
tggcccctagaatcagcct

SEQ ID NO: 6486664 - DNA, 20 bp, Homo sapiens
tggcccctaggctgctgctg

SEQ ID NO: 6486665 - DNA, 12 bp, Homo sapiens
tggcccctcaac

SEQ ID NO: 6486666 - DNA, 12 bp, Homo sapiens
tggcccctcacc

SEQ ID NO: 6486667 - DNA, 17 bp, Homo sapiens
tggcccctcacccacca

SEQ ID NO: 6486668 - DNA, 23 bp, Homo sapiens
tggcccctcacccaccatggacc

SEQ ID NO: 6486669 - DNA, 16 bp, Homo sapiens
tggcccctcacctggg

SEQ ID NO: 6486670 - DNA, 20 bp, Homo sapiens
tggcccctcacctgggcctt

SEQ ID NO: 6486671 - DNA, 16 bp, Homo sapiens
tggcccctccaggaac

SEQ ID NO: 6486672 - DNA, 12 bp, Homo sapiens
tggcccctccca

SEQ ID NO: 6486673 - DNA, 23 bp, Homo sapiens
tggcccctccccaactccttcct

SEQ ID NO: 6486674 - DNA, 12 bp, Homo sapiens
tgaatccaaatg

SEQ ID NO: 6486675 - DNA, 13 bp, Homo sapiens
tgaatccaaatgt

SEQ ID NO: 6486676 - DNA, 21 bp, Homo sapiens
tgaatccaaatgtgaaagatg

SEQ ID NO: 6486677 - DNA, 13 bp, Homo sapiens
tgaatccacctcg

SEQ ID NO: 6486678 - DNA, 13 bp, Homo sapiens
tgaatccacctgc

SEQ ID NO: 6486679 - DNA, 16 bp, Homo sapiens
tgaatccacctgcagt

SEQ ID NO: 6486680 - DNA, 18 bp, Homo sapiens
tgaatccacctgcagtta

SEQ ID NO: 6486681 - DNA, 18 bp, Homo sapiens
tgaatccatcaggacttg

SEQ ID NO: 6486682 - DNA, 21 bp, Homo sapiens
tgaatccatcgatttgtatta

SEQ ID NO: 6486683 - DNA, 23 bp, Homo sapiens
tgaatccatgatcaaaatgcata

SEQ ID NO: 6486684 - DNA, 19 bp, Homo sapiens
tgaatccatgggtctggct

SEQ ID NO: 6486685 - DNA, 20 bp, Homo sapiens
tgaatccatgggtctggcta

SEQ ID NO: 6486686 - DNA, 20 bp, Homo sapiens
tgaatcccatcaggctgtta

SEQ ID NO: 6486687 - DNA, 21 bp, Homo sapiens
tgaatcccatcaggctgttat

SEQ ID NO: 6486688 - DNA, 22 bp, Homo sapiens
tgaatcccatcaggctgttatt

SEQ ID NO: 6486689 - DNA, 22 bp, Homo sapiens
tgaatcctaagggctggtctct

SEQ ID NO: 6486690 - DNA, 14 bp, Homo sapiens
tgaatcctcagaga

SEQ ID NO: 6486691 - DNA, 20 bp, Homo sapiens
tgaatcctctattaattact

SEQ ID NO: 6486692 - DNA, 17 bp, Homo sapiens
tgaatcctcttctttat

SEQ ID NO: 6486693 - DNA, 12 bp, Homo sapiens
tgaatcctgtta

SEQ ID NO: 6486694 - DNA, 16 bp, Homo sapiens
tgaatccttttaatct

SEQ ID NO: 6486695 - DNA, 20 bp, Homo sapiens
tgaatccttttaatctagag

SEQ ID NO: 6486696 - DNA, 16 bp, Homo sapiens
tgaatcgcagctgtgg

SEQ ID NO: 6486697 - DNA, 15 bp, Homo sapiens
tgaatctaagcagca

SEQ ID NO: 6486698 - DNA, 14 bp, Homo sapiens
tgaatctacatttg

SEQ ID NO: 6486699 - DNA, 16 bp, Homo sapiens
tgaatctacatttgtt

SEQ ID NO: 6486700 - DNA, 23 bp, Homo sapiens
tgaatctagcttattttgaggct

SEQ ID NO: 6486701 - DNA, 12 bp, Homo sapiens
tgaatctataaa

SEQ ID NO: 6486702 - DNA, 18 bp, Homo sapiens
tgaatctataaaagaatt

SEQ ID NO: 6486703 - DNA, 12 bp, Homo sapiens
tgaatctatgcc

SEQ ID NO: 6486704 - DNA, 18 bp, Homo sapiens
tgaatctatgccaaagat

SEQ ID NO: 6486705 - DNA, 15 bp, Homo sapiens
tgaatctatgctggt

SEQ ID NO: 6486706 - DNA, 23 bp, Homo sapiens
tgaatctatggctttaaataaat

SEQ ID NO: 6486707 - DNA, 21 bp, Homo sapiens
tgaatctattatactgtatta

SEQ ID NO: 6486708 - DNA, 16 bp, Homo sapiens
tgaatctatttaagta

SEQ ID NO: 6486709 - DNA, 22 bp, Homo sapiens
tgaatctatttttaaaatcata

SEQ ID NO: 6486710 - DNA, 14 bp, Homo sapiens
tgaatctcaatttg

SEQ ID NO: 6486711 - DNA, 15 bp, Homo sapiens
tgaatctccttgttg

SEQ ID NO: 6486712 - DNA, 17 bp, Homo sapiens
tgaatctcgttcccaaa

SEQ ID NO: 6486713 - DNA, 23 bp, Homo sapiens
tgaatctcgttgaggccaaggaa

SEQ ID NO: 6486714 - DNA, 22 bp, Homo sapiens
tgaatctctaaaatgctgttct

SEQ ID NO: 6486715 - DNA, 16 bp, Homo sapiens
tgaatctcttaattct

SEQ ID NO: 6486716 - DNA, 17 bp, Homo sapiens
tgaatctgaccacagac

SEQ ID NO: 6486717 - DNA, 19 bp, Homo sapiens
tgaatctgagagatgctgt

SEQ ID NO: 6486718 - DNA, 14 bp, Homo sapiens
tgaatctgattgca

SEQ ID NO: 6486719 - DNA, 15 bp, Homo sapiens
tgaatctgattttta

SEQ ID NO: 6486720 - DNA, 20 bp, Homo sapiens
tgaatctgcgagtagatgaa

SEQ ID NO: 6486721 - DNA, 13 bp, Homo sapiens
tgaatctgctttt

SEQ ID NO: 6486722 - DNA, 18 bp, Homo sapiens
tgaatctgcttttcctct

SEQ ID NO: 6486723 - DNA, 19 bp, Homo sapiens
tgaatctgcttttcctctg

SEQ ID NO: 6486724 - DNA, 14 bp, Homo sapiens
tgaatctgggaggg

SEQ ID NO: 6486725 - DNA, 16 bp, Homo sapiens
tgaatctgggagggaa

SEQ ID NO: 6486726 - DNA, 14 bp, Homo sapiens
tgaatctgtacatg

SEQ ID NO: 6486727 - DNA, 15 bp, Homo sapiens
tgaatctgtacatgt

SEQ ID NO: 6486728 - DNA, 13 bp, Homo sapiens
tgaatctgtctat

SEQ ID NO: 6486729 - DNA, 14 bp, Homo sapiens
tgaatctgtctatc

SEQ ID NO: 6486730 - DNA, 13 bp, Homo sapiens
tgaatctgttact

SEQ ID NO: 6486731 - DNA, 17 bp, Homo sapiens
tgaatctgttactgaaa

SEQ ID NO: 6486732 - DNA, 18 bp, Homo sapiens
tgaatctgttgatggaga

SEQ ID NO: 6486733 - DNA, 13 bp, Homo sapiens
tgaatcttaattt

SEQ ID NO: 6486734 - DNA, 16 bp, Homo sapiens
tgaatcttatggtgga

SEQ ID NO: 6486735 - DNA, 19 bp, Homo sapiens
tgaatcttcacgacaatgt

SEQ ID NO: 6486736 - DNA, 21 bp, Homo sapiens
tgaatcttgagagtgttcctg

SEQ ID NO: 6486737 - DNA, 14 bp, Homo sapiens
tgaatcttgcgttt

SEQ ID NO: 6486738 - DNA, 13 bp, Homo sapiens
tgaatcttgtctc

SEQ ID NO: 6486739 - DNA, 21 bp, Homo sapiens
tgaatcttgtctcaatgctca

SEQ ID NO: 6486740 - DNA, 24 bp, Homo sapiens
tgaatcttgtctcaatgctcataa

SEQ ID NO: 6486741 - DNA, 19 bp, Homo sapiens
tgaatcttgttcaaaatgc

SEQ ID NO: 6486742 - DNA, 16 bp, Homo sapiens
tgaatctttcatacat

SEQ ID NO: 6486743 - DNA, 17 bp, Homo sapiens
tgaatctttcatacata

SEQ ID NO: 6486744 - DNA, 19 bp, Homo sapiens
tgaatctttccaataaacc

SEQ ID NO: 6486745 - DNA, 12 bp, Homo sapiens
tgaatctttctc

SEQ ID NO: 6486746 - DNA, 19 bp, Homo sapiens
tgaatctttctcctggtga

SEQ ID NO: 6486747 - DNA, 22 bp, Homo sapiens
tgaatctttgactgaagccgtg

SEQ ID NO: 6486748 - DNA, 20 bp, Homo sapiens
tgaatctttttatcccattt

SEQ ID NO: 6486749 - DNA, 21 bp, Homo sapiens
tgaatcttttttttatataaa

SEQ ID NO: 6486750 - DNA, 22 bp, Homo sapiens
tgaatgaaaaatttaagcattg

SEQ ID NO: 6486751 - DNA, 11 bp, Homo sapiens
tgaatgaaaac

SEQ ID NO: 6486752 - DNA, 15 bp, Homo sapiens
tgaatgaaaataact

SEQ ID NO: 6486753 - DNA, 17 bp, Homo sapiens
tgaatgaaaataactga

SEQ ID NO: 6486754 - DNA, 21 bp, Homo sapiens
tgaatgaaaataactgaacca

SEQ ID NO: 6486755 - DNA, 14 bp, Homo sapiens
tgaatgaaaataca

SEQ ID NO: 6486756 - DNA, 18 bp, Homo sapiens
tgaatgaaacccccacac

SEQ ID NO: 6486757 - DNA, 20 bp, Homo sapiens
tgaatgaaacccccacacac

SEQ ID NO: 6486758 - DNA, 19 bp, Homo sapiens
tgaatgaaagattaaacag

SEQ ID NO: 6486759 - DNA, 20 bp, Homo sapiens
tgaatgaaagtcttgtgact

SEQ ID NO: 6486760 - DNA, 21 bp, Homo sapiens
tgaatgaaatataaactgtga

SEQ ID NO: 6486761 - DNA, 20 bp, Homo sapiens
tgaatgaaattccactttgt

SEQ ID NO: 6486762 - DNA, 17 bp, Homo sapiens
tgaatgaacccctggct

SEQ ID NO: 6486763 - DNA, 16 bp, Homo sapiens
tgaatgaagcagtatt

SEQ ID NO: 6486764 - DNA, 13 bp, Homo sapiens
tgaatgaatggga

SEQ ID NO: 6486765 - DNA, 17 bp, Homo sapiens
tgaatgacaacagaagc

SEQ ID NO: 6486766 - DNA, 16 bp, Homo sapiens
tgaatgaccacttgat

SEQ ID NO: 6486767 - DNA, 19 bp, Homo sapiens
tgaatgactccactgtttt

SEQ ID NO: 6486768 - DNA, 20 bp, Homo sapiens
tgaatgactccaggaagaag

SEQ ID NO: 6486769 - DNA, 21 bp, Homo sapiens
tgaatgacttccccaatatct

SEQ ID NO: 6486770 - DNA, 21 bp, Homo sapiens
tgaatgagccaaaatgacttt

SEQ ID NO: 6486771 - DNA, 17 bp, Homo sapiens
tgaatgaggaacaatca

SEQ ID NO: 6486772 - DNA, 19 bp, Homo sapiens
tgaatgaggcggagctcca

SEQ ID NO: 6486773 - DNA, 21 bp, Homo sapiens
tgaatgagtaaataaactctt

SEQ ID NO: 6486774 - DNA, 14 bp, Homo sapiens
tgaatgagtctgct

SEQ ID NO: 6486775 - DNA, 15 bp, Homo sapiens
tgaatgagtctgctt

SEQ ID NO: 6486776 - DNA, 23 bp, Homo sapiens
tgaatgagtctgttgtgtgtcat

SEQ ID NO: 6486777 - DNA, 13 bp, Homo sapiens
tgaatgagtgtgt

SEQ ID NO: 6486778 - DNA, 17 bp, Homo sapiens
tgaatgataagcaggaa

SEQ ID NO: 6486779 - DNA, 16 bp, Homo sapiens
tgaatgatcctgtctc

SEQ ID NO: 6486780 - DNA, 13 bp, Homo sapiens
tgaatgatctatt

SEQ ID NO: 6486781 - DNA, 15 bp, Homo sapiens
tgaatgatctctctg

SEQ ID NO: 6486782 - DNA, 18 bp, Homo sapiens
tgaatgatctctctgaat

SEQ ID NO: 6486783 - DNA, 19 bp, Homo sapiens
tgaatgatgttttagaatg

SEQ ID NO: 6486784 - DNA, 15 bp, Homo sapiens
tgaatgattaaatta

SEQ ID NO: 6486785 - DNA, 19 bp, Homo sapiens
tgaatgattaaattatgaa

SEQ ID NO: 6486786 - DNA, 23 bp, Homo sapiens
tgaatgcaaaattgttttcactt

SEQ ID NO: 6486787 - DNA, 19 bp, Homo sapiens
tgaatgcaaaccatagcac

SEQ ID NO: 6486788 - DNA, 18 bp, Homo sapiens
tgaatgcaccatggtcaa

SEQ ID NO: 6486789 - DNA, 19 bp, Homo sapiens
tgaatgcaccatggtcaaa

SEQ ID NO: 6486790 - DNA, 17 bp, Homo sapiens
tgaatgcagcactgctg

SEQ ID NO: 6486791 - DNA, 21 bp, Homo sapiens
tgaatgcagcactgctgcctc

SEQ ID NO: 6486792 - DNA, 20 bp, Homo sapiens
tgaatgcaggttttatcaga

SEQ ID NO: 6486793 - DNA, 14 bp, Homo sapiens
tgaatgcagtataa

SEQ ID NO: 6486794 - DNA, 16 bp, Homo sapiens
tgaatgcataaaatgt

SEQ ID NO: 6486795 - DNA, 16 bp, Homo sapiens
tgaatgcataatgttt

SEQ ID NO: 6486796 - DNA, 18 bp, Homo sapiens
tgaatgcataatgtttaa

SEQ ID NO: 6486797 - DNA, 12 bp, Homo sapiens
tgaatgcatgtg

SEQ ID NO: 6486798 - DNA, 13 bp, Homo sapiens
tgaatgcattggc

SEQ ID NO: 6486799 - DNA, 13 bp, Homo sapiens
tgaatgcattttg

SEQ ID NO: 6486800 - DNA, 15 bp, Homo sapiens
tgaatgccaaagcca

SEQ ID NO: 6486801 - DNA, 20 bp, Homo sapiens
tgaatgccacgcggtacaaa

SEQ ID NO: 6486802 - DNA, 20 bp, Homo sapiens
tgaatgcccagtgagactgt

SEQ ID NO: 6486803 - DNA, 18 bp, Homo sapiens
tgaatgcccccagctggc

SEQ ID NO: 6486804 - DNA, 17 bp, Homo sapiens
tgaatgccggggacaga

SEQ ID NO: 6486805 - DNA, 21 bp, Homo sapiens
tgaatgccgtgcctgcaaaac

SEQ ID NO: 6486806 - DNA, 18 bp, Homo sapiens
tgaatgcctcctgtgggg

SEQ ID NO: 6486807 - DNA, 15 bp, Homo sapiens
tgaatgccttatttt

SEQ ID NO: 6486808 - DNA, 14 bp, Homo sapiens
tgaatgcctttcaa

SEQ ID NO: 6486809 - DNA, 22 bp, Homo sapiens
tgaatgcgctttattgcccatg

SEQ ID NO: 6486810 - DNA, 20 bp, Homo sapiens
tgaatgctatgttctgggaa

SEQ ID NO: 6486811 - DNA, 12 bp, Homo sapiens
tgaatgctattt

SEQ ID NO: 6486812 - DNA, 14 bp, Homo sapiens
tgaatgctgagacc

SEQ ID NO: 6486813 - DNA, 17 bp, Homo sapiens
tgaatgctgagctgaag

SEQ ID NO: 6486814 - DNA, 18 bp, Homo sapiens
tgaatgctgagctgaaga

SEQ ID NO: 6486815 - DNA, 13 bp, Homo sapiens
tgaatgctgccac

SEQ ID NO: 6486816 - DNA, 14 bp, Homo sapiens
tgaatgctgccagt

SEQ ID NO: 6486817 - DNA, 22 bp, Homo sapiens
tgaatgctgtacctttctgaca

SEQ ID NO: 6486818 - DNA, 12 bp, Homo sapiens
tgaatgctgtgg

SEQ ID NO: 6486819 - DNA, 17 bp, Homo sapiens
tgaatgcttaaagaatt

SEQ ID NO: 6486820 - DNA, 22 bp, Homo sapiens
tgaatgcttaaagaattcaaat

SEQ ID NO: 6486821 - DNA, 18 bp, Homo sapiens
tgaatgcttaaagcaagg

SEQ ID NO: 6486822 - DNA, 19 bp, Homo sapiens
tgaatgcttataggtggcc

SEQ ID NO: 6486823 - DNA, 21 bp, Homo sapiens
tgaatgcttataggtggcctc

SEQ ID NO: 6486824 - DNA, 16 bp, Homo sapiens
tgaatgcttctgattt

SEQ ID NO: 6486825 - DNA, 19 bp, Homo sapiens
tgaatgctttttgaatgtt

SEQ ID NO: 6486826 - DNA, 21 bp, Homo sapiens
tgaatggaagcaaaattataa

SEQ ID NO: 6486827 - DNA, 17 bp, Homo sapiens
tgaatggacaaagctca

SEQ ID NO: 6486828 - DNA, 22 bp, Homo sapiens
tgaatggacggtttaggtgaaa

SEQ ID NO: 6486829 - DNA, 19 bp, Homo sapiens
tgaatggaggacttttctg

SEQ ID NO: 6486830 - DNA, 13 bp, Homo sapiens
tgaatggattaaa

SEQ ID NO: 6486831 - DNA, 16 bp, Homo sapiens
tgaatggattaaatgg

SEQ ID NO: 6486832 - DNA, 19 bp, Homo sapiens
tgaatggattaaatggcac

SEQ ID NO: 6486833 - DNA, 15 bp, Homo sapiens
tgaatggattggatt

SEQ ID NO: 6486834 - DNA, 16 bp, Homo sapiens
tgaatggcatttgctg

SEQ ID NO: 6486835 - DNA, 20 bp, Homo sapiens
tgaatggcggtttttatcca

SEQ ID NO: 6486836 - DNA, 21 bp, Homo sapiens
tgaatggctatgtttttaatg

SEQ ID NO: 6486837 - DNA, 15 bp, Homo sapiens
tgaatggctttgtat

SEQ ID NO: 6486838 - DNA, 17 bp, Homo sapiens
tgaatggctttgtatag

SEQ ID NO: 6486839 - DNA, 18 bp, Homo sapiens
tgaatggctttgtcttga

SEQ ID NO: 6486840 - DNA, 14 bp, Homo sapiens
tgaatgggaaaaga

SEQ ID NO: 6486841 - DNA, 13 bp, Homo sapiens
tgaatgggaaagt

SEQ ID NO: 6486842 - DNA, 18 bp, Homo sapiens
tgaatgggacagagttga

SEQ ID NO: 6486843 - DNA, 21 bp, Homo sapiens
tgaatgggatattttgaaatg

SEQ ID NO: 6486844 - DNA, 23 bp, Homo sapiens
tgaatggggaagggagtctctct

SEQ ID NO: 6486845 - DNA, 20 bp, Homo sapiens
tgaatggtatggaactctct

SEQ ID NO: 6486846 - DNA, 15 bp, Homo sapiens
tgaatggtccagggt

SEQ ID NO: 6486847 - DNA, 14 bp, Homo sapiens
tgaatggtcttctg

SEQ ID NO: 6486848 - DNA, 17 bp, Homo sapiens
tgaatggtgcaatgaat

SEQ ID NO: 6486849 - DNA, 17 bp, Homo sapiens
tgaatggtgcagaaaaa

SEQ ID NO: 6486850 - DNA, 18 bp, Homo sapiens
tgaatggtgttgtatgcc

SEQ ID NO: 6486851 - DNA, 20 bp, Homo sapiens
tgaatggtgttgtatgcctt

SEQ ID NO: 6486852 - DNA, 19 bp, Homo sapiens
tgaatggttccatgcctga

SEQ ID NO: 6486853 - DNA, 13 bp, Homo sapiens
tggcccctcctcc

SEQ ID NO: 6486854 - DNA, 18 bp, Homo sapiens
tggcccctccttctcccc

SEQ ID NO: 6486855 - DNA, 20 bp, Homo sapiens
tggcccctccttctcccctc

SEQ ID NO: 6486856 - DNA, 22 bp, Homo sapiens
tggcccctccttgcaaccaggc

SEQ ID NO: 6486857 - DNA, 23 bp, Homo sapiens
tggcccctctctgtttaccctcc

SEQ ID NO: 6486858 - DNA, 22 bp, Homo sapiens
tggcccctctgctgtcctgcag

SEQ ID NO: 6486859 - DNA, 14 bp, Homo sapiens
tggcccctgagatc

SEQ ID NO: 6486860 - DNA, 21 bp, Homo sapiens
tggcccctgagcccagagaag

SEQ ID NO: 6486861 - DNA, 16 bp, Homo sapiens
tggcccctgcccggct

SEQ ID NO: 6486862 - DNA, 13 bp, Homo sapiens
tggcccctgcctg

SEQ ID NO: 6486863 - DNA, 18 bp, Homo sapiens
tggcccctgtctcggggc

SEQ ID NO: 6486864 - DNA, 15 bp, Homo sapiens
tggcccctgtgtgag

SEQ ID NO: 6486865 - DNA, 21 bp, Homo sapiens
tggccccttcacttctgacca

SEQ ID NO: 6486866 - DNA, 20 bp, Homo sapiens
tggccccttctatgcccagc

SEQ ID NO: 6486867 - DNA, 16 bp, Homo sapiens
tggcccctttgggccc

SEQ ID NO: 6486868 - DNA, 14 bp, Homo sapiens
tggcccgaagcgtg

SEQ ID NO: 6486869 - DNA, 15 bp, Homo sapiens
tggcccgaagcgtgc

SEQ ID NO: 6486870 - DNA, 15 bp, Homo sapiens
tggcccgacagcctg

SEQ ID NO: 6486871 - DNA, 19 bp, Homo sapiens
tggcccgcatgtgcattct

SEQ ID NO: 6486872 - DNA, 16 bp, Homo sapiens
tggcccgccctcacct

SEQ ID NO: 6486873 - DNA, 19 bp, Homo sapiens
tggcccgccctcacctctg

SEQ ID NO: 6486874 - DNA, 20 bp, Homo sapiens
tggcccgccctcacctctga

SEQ ID NO: 6486875 - DNA, 15 bp, Homo sapiens
tggcccgcggcctgc

SEQ ID NO: 6486876 - DNA, 18 bp, Homo sapiens
tggcccggaagaaccaga

SEQ ID NO: 6486877 - DNA, 17 bp, Homo sapiens
tggcccggatgctgctt

SEQ ID NO: 6486878 - DNA, 20 bp, Homo sapiens
tggcccggcccctcctgact

SEQ ID NO: 6486879 - DNA, 15 bp, Homo sapiens
tggcccgtgacagac

SEQ ID NO: 6486880 - DNA, 13 bp, Homo sapiens
tggcccgtggcct

SEQ ID NO: 6486881 - DNA, 14 bp, Homo sapiens
tggcccgtggcctg

SEQ ID NO: 6486882 - DNA, 20 bp, Homo sapiens
tggcccgtggcttggcatct

SEQ ID NO: 6486883 - DNA, 22 bp, Homo sapiens
tggcccgtggcttggcatctgt

SEQ ID NO: 6486884 - DNA, 13 bp, Homo sapiens
tggccctagactc

SEQ ID NO: 6486885 - DNA, 15 bp, Homo sapiens
tggccctaggcactg

SEQ ID NO: 6486886 - DNA, 19 bp, Homo sapiens
tggccctcaaggcctccca

SEQ ID NO: 6486887 - DNA, 23 bp, Homo sapiens
tggccctcaaggcctcccacagt

SEQ ID NO: 6486888 - DNA, 15 bp, Homo sapiens
tggccctcactcaag

SEQ ID NO: 6486889 - DNA, 15 bp, Homo sapiens
tggccctcagctccc

SEQ ID NO: 6486890 - DNA, 23 bp, Homo sapiens
tggccctccaccttgttcctgcc

SEQ ID NO: 6486891 - DNA, 21 bp, Homo sapiens
tggccctcccagtacctcctg

SEQ ID NO: 6486892 - DNA, 14 bp, Homo sapiens
tggccctccccaca

SEQ ID NO: 6486893 - DNA, 14 bp, Homo sapiens
tggccctccctccc

SEQ ID NO: 6486894 - DNA, 17 bp, Homo sapiens
tggccctccctccctag

SEQ ID NO: 6486895 - DNA, 15 bp, Homo sapiens
tggccctcctcagct

SEQ ID NO: 6486896 - DNA, 16 bp, Homo sapiens
tggccctcctcagctc

SEQ ID NO: 6486897 - DNA, 21 bp, Homo sapiens
tggccctcctcagctccctgc

SEQ ID NO: 6486898 - DNA, 22 bp, Homo sapiens
tggccctcggtggctgcacaga

SEQ ID NO: 6486899 - DNA, 15 bp, Homo sapiens
tggccctctgtgttg

SEQ ID NO: 6486900 - DNA, 14 bp, Homo sapiens
tggccctcttctta

SEQ ID NO: 6486901 - DNA, 20 bp, Homo sapiens
tggccctcttgcgggcctgg

SEQ ID NO: 6486902 - DNA, 21 bp, Homo sapiens
tggccctcttgcgggcctgga

SEQ ID NO: 6486903 - DNA, 14 bp, Homo sapiens
tggccctgactgtc

SEQ ID NO: 6486904 - DNA, 15 bp, Homo sapiens
tggccctgcccagcc

SEQ ID NO: 6486905 - DNA, 12 bp, Homo sapiens
tggccctgcccc

SEQ ID NO: 6486906 - DNA, 14 bp, Homo sapiens
tggccctgcccctc

SEQ ID NO: 6486907 - DNA, 16 bp, Homo sapiens
tggccctgccctcccc

SEQ ID NO: 6486908 - DNA, 14 bp, Homo sapiens
tggccctgcccttg

SEQ ID NO: 6486909 - DNA, 20 bp, Homo sapiens
tggccctgcccttggcacca

SEQ ID NO: 6486910 - DNA, 12 bp, Homo sapiens
tggccctgcctc

SEQ ID NO: 6486911 - DNA, 14 bp, Homo sapiens
tggccctgcctcac

SEQ ID NO: 6486912 - DNA, 21 bp, Homo sapiens
tggccctgcctcctgggaaga

SEQ ID NO: 6486913 - DNA, 23 bp, Homo sapiens
tggccctgcggggcggcatccga

SEQ ID NO: 6486914 - DNA, 18 bp, Homo sapiens
tggccctgctgcccccta

SEQ ID NO: 6486915 - DNA, 15 bp, Homo sapiens
tggccctggacaagc

SEQ ID NO: 6486916 - DNA, 16 bp, Homo sapiens
tggccctggacacagc

SEQ ID NO: 6486917 - DNA, 14 bp, Homo sapiens
tggccctggagcca

SEQ ID NO: 6486918 - DNA, 12 bp, Homo sapiens
tggccctggcat

SEQ ID NO: 6486919 - DNA, 13 bp, Homo sapiens
tggccctggcctg

SEQ ID NO: 6486920 - DNA, 14 bp, Homo sapiens
tggccctggcctgc

SEQ ID NO: 6486921 - DNA, 17 bp, Homo sapiens
tggccctggcctgctgg

SEQ ID NO: 6486922 - DNA, 14 bp, Homo sapiens
tggccctggctctg

SEQ ID NO: 6486923 - DNA, 17 bp, Homo sapiens
tggccctggctctgctg

SEQ ID NO: 6486924 - DNA, 14 bp, Homo sapiens
tggccctggctgcc

SEQ ID NO: 6486925 - DNA, 18 bp, Homo sapiens
tggccctgggccccgcct

SEQ ID NO: 6486926 - DNA, 19 bp, Homo sapiens
tggccctgggccccgcctc

SEQ ID NO: 6486927 - DNA, 23 bp, Homo sapiens
tggccctgggccccgcctcaagg

SEQ ID NO: 6486928 - DNA, 19 bp, Homo sapiens
tggccctggggatcttccc

SEQ ID NO: 6486929 - DNA, 16 bp, Homo sapiens
tggccctggggccatg

SEQ ID NO: 6486930 - DNA, 13 bp, Homo sapiens
tggccctggggtc

SEQ ID NO: 6486931 - DNA, 16 bp, Homo sapiens
tggccctgtagctctg

SEQ ID NO: 6486932 - DNA, 14 bp, Homo sapiens
tggccctgtcccag

SEQ ID NO: 6486933 - DNA, 15 bp, Homo sapiens
tggccctgtccctcc

SEQ ID NO: 6486934 - DNA, 17 bp, Homo sapiens
tggccctgtccctccca

SEQ ID NO: 6486935 - DNA, 19 bp, Homo sapiens
tggccctgtgactatggct

SEQ ID NO: 6486936 - DNA, 13 bp, Homo sapiens
tggccctgtgcag

SEQ ID NO: 6486937 - DNA, 19 bp, Homo sapiens
tggccctgtgcctgggccc

SEQ ID NO: 6486938 - DNA, 20 bp, Homo sapiens
tggccctgtgcctgggccct

SEQ ID NO: 6486939 - DNA, 13 bp, Homo sapiens
tggccctgtgcta

SEQ ID NO: 6486940 - DNA, 12 bp, Homo sapiens
tggccctgtggg

SEQ ID NO: 6486941 - DNA, 19 bp, Homo sapiens
tggccctgtgggagtccac

SEQ ID NO: 6486942 - DNA, 20 bp, Homo sapiens
tggccctgtgggagtccact

SEQ ID NO: 6486943 - DNA, 13 bp, Homo sapiens
tggccctgtgtag

SEQ ID NO: 6486944 - DNA, 21 bp, Homo sapiens
tggccctgttctcctccccaa

SEQ ID NO: 6486945 - DNA, 19 bp, Homo sapiens
tggcccttacacactcagg

SEQ ID NO: 6486946 - DNA, 23 bp, Homo sapiens
tggcccttacttgcttctctagc

SEQ ID NO: 6486947 - DNA, 12 bp, Homo sapiens
tggcccttcagt

SEQ ID NO: 6486948 - DNA, 18 bp, Homo sapiens
tggcccttcagtctgctc

SEQ ID NO: 6486949 - DNA, 19 bp, Homo sapiens
tggcccttcagtctgctcc

SEQ ID NO: 6486950 - DNA, 22 bp, Homo sapiens
tggcccttcagtctgctccacc

SEQ ID NO: 6486951 - DNA, 23 bp, Homo sapiens
tggcccttcagtctgctccacca

SEQ ID NO: 6486952 - DNA, 18 bp, Homo sapiens
tggcccttcctcctccac

SEQ ID NO: 6486953 - DNA, 13 bp, Homo sapiens
tggcccttcctgg

SEQ ID NO: 6486954 - DNA, 17 bp, Homo sapiens
tggcccttcctggacag

SEQ ID NO: 6486955 - DNA, 18 bp, Homo sapiens
tggcccttcctggacagc

SEQ ID NO: 6486956 - DNA, 12 bp, Homo sapiens
tggcccttcctt

SEQ ID NO: 6486957 - DNA, 14 bp, Homo sapiens
tggcccttccttca

SEQ ID NO: 6486958 - DNA, 15 bp, Homo sapiens
tggcccttccttcac

SEQ ID NO: 6486959 - DNA, 23 bp, Homo sapiens
tggcccttgcagttcagcaccac

SEQ ID NO: 6486960 - DNA, 21 bp, Homo sapiens
tggcccttgcctttgtggcct

SEQ ID NO: 6486961 - DNA, 19 bp, Homo sapiens
tggcccttggaataaagtt

SEQ ID NO: 6486962 - DNA, 13 bp, Homo sapiens
tggcccttgggga

SEQ ID NO: 6486963 - DNA, 15 bp, Homo sapiens
tggcccttgtctttt

SEQ ID NO: 6486964 - DNA, 13 bp, Homo sapiens
tggccctttcccc

SEQ ID NO: 6486965 - DNA, 21 bp, Homo sapiens
tggccctttccccttcccctc

SEQ ID NO: 6486966 - DNA, 22 bp, Homo sapiens
tggccgaaccccccactccctg

SEQ ID NO: 6486967 - DNA, 19 bp, Homo sapiens
tggccgaagccccttggag

SEQ ID NO: 6486968 - DNA, 15 bp, Homo sapiens
tggccgactcaggga

SEQ ID NO: 6486969 - DNA, 14 bp, Homo sapiens
tggccgactctgca

SEQ ID NO: 6486970 - DNA, 17 bp, Homo sapiens
tggccgagctcctgggg

SEQ ID NO: 6486971 - DNA, 16 bp, Homo sapiens
tggccgagctgaagaa

SEQ ID NO: 6486972 - DNA, 20 bp, Homo sapiens
tggccgagggtcctggctcc

SEQ ID NO: 6486973 - DNA, 17 bp, Homo sapiens
tggccgagtccaagctg

SEQ ID NO: 6486974 - DNA, 21 bp, Homo sapiens
tggccgcaacttcccaggccg

SEQ ID NO: 6486975 - DNA, 22 bp, Homo sapiens
tggccgcacctaaagcagccag

SEQ ID NO: 6486976 - DNA, 17 bp, Homo sapiens
tggccgcacgcctctcc

SEQ ID NO: 6486977 - DNA, 21 bp, Homo sapiens
tggccgcataggcccagccag

SEQ ID NO: 6486978 - DNA, 14 bp, Homo sapiens
tggccgccaccccc

SEQ ID NO: 6486979 - DNA, 18 bp, Homo sapiens
tggccgccatccgggacg

SEQ ID NO: 6486980 - DNA, 17 bp, Homo sapiens
tggccgccatctgcgca

SEQ ID NO: 6486981 - DNA, 16 bp, Homo sapiens
tggccgcctcaccccc

SEQ ID NO: 6486982 - DNA, 18 bp, Homo sapiens
tggccgcctcaccccctc

SEQ ID NO: 6486983 - DNA, 17 bp, Homo sapiens
tggccgcctccaggagc

SEQ ID NO: 6486984 - DNA, 14 bp, Homo sapiens
tggccgcctgcagc

SEQ ID NO: 6486985 - DNA, 18 bp, Homo sapiens
tggccgcctggcaggtgg

SEQ ID NO: 6486986 - DNA, 22 bp, Homo sapiens
tggccgcgccaaataatgtctc

SEQ ID NO: 6486987 - DNA, 23 bp, Homo sapiens
tggccgcgccaaataatgtctct

SEQ ID NO: 6486988 - DNA, 18 bp, Homo sapiens
tggccgcgctccgggctt

SEQ ID NO: 6486989 - DNA, 20 bp, Homo sapiens
tggccgcgtcacttctctga

SEQ ID NO: 6486990 - DNA, 19 bp, Homo sapiens
tggccgctaagttgctgat

SEQ ID NO: 6486991 - DNA, 14 bp, Homo sapiens
tggccgctcctccc

SEQ ID NO: 6486992 - DNA, 16 bp, Homo sapiens
tggccgctcctccctg

SEQ ID NO: 6486993 - DNA, 17 bp, Homo sapiens
tggccgctcctccctgc

SEQ ID NO: 6486994 - DNA, 14 bp, Homo sapiens
tggccgctgagcgc

SEQ ID NO: 6486995 - DNA, 19 bp, Homo sapiens
tggccgctgagcgcccccg

SEQ ID NO: 6486996 - DNA, 14 bp, Homo sapiens
tggccgctgcccac

SEQ ID NO: 6486997 - DNA, 17 bp, Homo sapiens
tggccgctgtgccaggc

SEQ ID NO: 6486998 - DNA, 21 bp, Homo sapiens
tggccgctgtgccaggcgagg

SEQ ID NO: 6486999 - DNA, 18 bp, Homo sapiens
tggccgcttctagagcct

SEQ ID NO: 6487000 - DNA, 24 bp, Homo sapiens
tggccggcaaccccagttctgctc

SEQ ID NO: 6487001 - DNA, 21 bp, Homo sapiens
tggccggccagccagccactc

SEQ ID NO: 6487002 - DNA, 22 bp, Homo sapiens
tggccggccagccagccactct

SEQ ID NO: 6487003 - DNA, 20 bp, Homo sapiens
tggccggcccaggcctccac

SEQ ID NO: 6487004 - DNA, 13 bp, Homo sapiens
tggccggccctgc

SEQ ID NO: 6487005 - DNA, 14 bp, Homo sapiens
tggccggccctgcc

SEQ ID NO: 6487006 - DNA, 15 bp, Homo sapiens
tggccggccctgccc

SEQ ID NO: 6487007 - DNA, 21 bp, Homo sapiens
tggccggccctgccccccaca

SEQ ID NO: 6487008 - DNA, 14 bp, Homo sapiens
tggccggcctcctc

SEQ ID NO: 6487009 - DNA, 21 bp, Homo sapiens
tggccggcctcctcctcaccc

SEQ ID NO: 6487010 - DNA, 20 bp, Homo sapiens
tggccggcggctactctgga

SEQ ID NO: 6487011 - DNA, 14 bp, Homo sapiens
tggccggctccagt

SEQ ID NO: 6487012 - DNA, 14 bp, Homo sapiens
tggccggctctggt

SEQ ID NO: 6487013 - DNA, 17 bp, Homo sapiens
tggccggctctggtggc

SEQ ID NO: 6487014 - DNA, 15 bp, Homo sapiens
tggccgggaccccga

SEQ ID NO: 6487015 - DNA, 23 bp, Homo sapiens
tggccgggaccccgagcctggct

SEQ ID NO: 6487016 - DNA, 22 bp, Homo sapiens
tggccgggactgctgctctccc

SEQ ID NO: 6487017 - DNA, 15 bp, Homo sapiens
tggccgggagcctga

SEQ ID NO: 6487018 - DNA, 16 bp, Homo sapiens
tggccgggcacagctg

SEQ ID NO: 6487019 - DNA, 23 bp, Homo sapiens
tggccgggcacagtggctcacgc

SEQ ID NO: 6487020 - DNA, 12 bp, Homo sapiens
tggccgggcagg

SEQ ID NO: 6487021 - DNA, 21 bp, Homo sapiens
tggccgggcaggcgtgactca

SEQ ID NO: 6487022 - DNA, 13 bp, Homo sapiens
tggccgggcaggg

SEQ ID NO: 6487023 - DNA, 14 bp, Homo sapiens
tggccgggcatggt

SEQ ID NO: 6487024 - DNA, 17 bp, Homo sapiens
tggccgggcatggtagc

SEQ ID NO: 6487025 - DNA, 15 bp, Homo sapiens
tggccgggggtgggg

SEQ ID NO: 6487026 - DNA, 22 bp, Homo sapiens
tggccgggggtgggggcctgct

SEQ ID NO: 6487027 - DNA, 19 bp, Homo sapiens
tggccgggtcaccctgtga

SEQ ID NO: 6487028 - DNA, 22 bp, Homo sapiens
tggccgggttggaggcctcacc

SEQ ID NO: 6487029 - DNA, 23 bp, Homo sapiens
tggccgggttggaggcctcaccc

SEQ ID NO: 6487030 - DNA, 16 bp, Homo sapiens
tggccggtaggctgct

SEQ ID NO: 6487031 - DNA, 18 bp, Homo sapiens
tggccggtaggctgctgg

SEQ ID NO: 6487032 - DNA, 23 bp, Homo sapiens
tgaatggttccatgcctgagggt

SEQ ID NO: 6487033 - DNA, 23 bp, Homo sapiens
tgaatggttctttatcatttctc

SEQ ID NO: 6487034 - DNA, 18 bp, Homo sapiens
tgaatggttgcaaagtgt

SEQ ID NO: 6487035 - DNA, 19 bp, Homo sapiens
tgaatggttgcaaagtgtt

SEQ ID NO: 6487036 - DNA, 24 bp, Homo sapiens
tgaatggttgtacgttttgcacat

SEQ ID NO: 6487037 - DNA, 12 bp, Homo sapiens
tgaatggttttt

SEQ ID NO: 6487038 - DNA, 15 bp, Homo sapiens
tgaatgtaaaagaaa

SEQ ID NO: 6487039 - DNA, 17 bp, Homo sapiens
tgaatgtaaaagacact

SEQ ID NO: 6487040 - DNA, 21 bp, Homo sapiens
tgaatgtaaatttgtactatt

SEQ ID NO: 6487041 - DNA, 22 bp, Homo sapiens
tgaatgtaaatttgtactattt

SEQ ID NO: 6487042 - DNA, 14 bp, Homo sapiens
tgaatgtaatttgt

SEQ ID NO: 6487043 - DNA, 16 bp, Homo sapiens
tgaatgtacaaagata

SEQ ID NO: 6487044 - DNA, 21 bp, Homo sapiens
tgaatgtacaccacatgctat

SEQ ID NO: 6487045 - DNA, 17 bp, Homo sapiens
tgaatgtaccttattta

SEQ ID NO: 6487046 - DNA, 14 bp, Homo sapiens
tgaatgtactatgt

SEQ ID NO: 6487047 - DNA, 19 bp, Homo sapiens
tgaatgtactatgtctgaa

SEQ ID NO: 6487048 - DNA, 19 bp, Homo sapiens
tgaatgtagacggaacagt

SEQ ID NO: 6487049 - DNA, 23 bp, Homo sapiens
tgaatgtaggctggctttcagag

SEQ ID NO: 6487050 - DNA, 15 bp, Homo sapiens
tgaatgtatgtgcac

SEQ ID NO: 6487051 - DNA, 22 bp, Homo sapiens
tgaatgtattcttttatataac

SEQ ID NO: 6487052 - DNA, 19 bp, Homo sapiens
tgaatgtattttggttgct

SEQ ID NO: 6487053 - DNA, 22 bp, Homo sapiens
tgaatgtattttggttgctgat

SEQ ID NO: 6487054 - DNA, 20 bp, Homo sapiens
tgaatgtcaaacagtgccaa

SEQ ID NO: 6487055 - DNA, 18 bp, Homo sapiens
tgaatgtcaagaaaagga

SEQ ID NO: 6487056 - DNA, 11 bp, Homo sapiens
tgaatgtcaca

SEQ ID NO: 6487057 - DNA, 17 bp, Homo sapiens
tgaatgtcacaaattga

SEQ ID NO: 6487058 - DNA, 14 bp, Homo sapiens
tgaatgtcagtgtg

SEQ ID NO: 6487059 - DNA, 15 bp, Homo sapiens
tgaatgtcagtgtga

SEQ ID NO: 6487060 - DNA, 18 bp, Homo sapiens
tgaatgtcagtgtgactg

SEQ ID NO: 6487061 - DNA, 17 bp, Homo sapiens
tgaatgtcagttgttat

SEQ ID NO: 6487062 - DNA, 16 bp, Homo sapiens
tgaatgtcataaagaa

SEQ ID NO: 6487063 - DNA, 17 bp, Homo sapiens
tgaatgtcataaagaag

SEQ ID NO: 6487064 - DNA, 18 bp, Homo sapiens
tgaatgtcattatttgat

SEQ ID NO: 6487065 - DNA, 19 bp, Homo sapiens
tgaatgtcattatttgata

SEQ ID NO: 6487066 - DNA, 17 bp, Homo sapiens
tgaatgtccccattcta

SEQ ID NO: 6487067 - DNA, 18 bp, Homo sapiens
tgaatgtctaaaattgtt

SEQ ID NO: 6487068 - DNA, 14 bp, Homo sapiens
tgaatgtcttcctt

SEQ ID NO: 6487069 - DNA, 22 bp, Homo sapiens
tgaatgtcttccttttctttct

SEQ ID NO: 6487070 - DNA, 13 bp, Homo sapiens
tgaatgtgaaaca

SEQ ID NO: 6487071 - DNA, 15 bp, Homo sapiens
tgaatgtgaagcctt

SEQ ID NO: 6487072 - DNA, 20 bp, Homo sapiens
tgaatgtgcaaaaaaagaaa

SEQ ID NO: 6487073 - DNA, 14 bp, Homo sapiens
tgaatgtggcagtt

SEQ ID NO: 6487074 - DNA, 18 bp, Homo sapiens
tgaatgtggctgaagttg

SEQ ID NO: 6487075 - DNA, 15 bp, Homo sapiens
tgaatgtgggcactg

SEQ ID NO: 6487076 - DNA, 15 bp, Homo sapiens
tgaatgtggtctcag

SEQ ID NO: 6487077 - DNA, 16 bp, Homo sapiens
tgaatgtgtgagaaaa

SEQ ID NO: 6487078 - DNA, 18 bp, Homo sapiens
tgaatgtgtgagaaaaac

SEQ ID NO: 6487079 - DNA, 16 bp, Homo sapiens
tgaatgtgttgatttg

SEQ ID NO: 6487080 - DNA, 21 bp, Homo sapiens
tgaatgtgtttcacagtttga

SEQ ID NO: 6487081 - DNA, 21 bp, Homo sapiens
tgaatgttaaagggatatttt

SEQ ID NO: 6487082 - DNA, 18 bp, Homo sapiens
tgaatgttaaataaattg

SEQ ID NO: 6487083 - DNA, 14 bp, Homo sapiens
tgaatgttaagaat

SEQ ID NO: 6487084 - DNA, 17 bp, Homo sapiens
tgaatgttacaacgaat

SEQ ID NO: 6487085 - DNA, 23 bp, Homo sapiens
tgaatgttatttgttattttcag

SEQ ID NO: 6487086 - DNA, 19 bp, Homo sapiens
tgaatgttcaatctgtgta

SEQ ID NO: 6487087 - DNA, 23 bp, Homo sapiens
tgaatgttctgacattaacagtt

SEQ ID NO: 6487088 - DNA, 11 bp, Homo sapiens
tgaatgttctt

SEQ ID NO: 6487089 - DNA, 19 bp, Homo sapiens
tgaatgtttacactctttg

SEQ ID NO: 6487090 - DNA, 22 bp, Homo sapiens
tgaatgtttacactctttgtaa

SEQ ID NO: 6487091 - DNA, 13 bp, Homo sapiens
tgaatgtttacat

SEQ ID NO: 6487092 - DNA, 23 bp, Homo sapiens
tgaatgtttagtgtgctgctgtt

SEQ ID NO: 6487093 - DNA, 18 bp, Homo sapiens
tgaatgtttatgttctca

SEQ ID NO: 6487094 - DNA, 20 bp, Homo sapiens
tgaatgttttatttatcaaa

SEQ ID NO: 6487095 - DNA, 13 bp, Homo sapiens
tgaatgttttcaa

SEQ ID NO: 6487096 - DNA, 16 bp, Homo sapiens
tgaatgtttttctaaa

SEQ ID NO: 6487097 - DNA, 16 bp, Homo sapiens
tgaattaaaaaagctc

SEQ ID NO: 6487098 - DNA, 14 bp, Homo sapiens
tgaattaaaacttc

SEQ ID NO: 6487099 - DNA, 14 bp, Homo sapiens
tgaattaaaatggt

SEQ ID NO: 6487100 - DNA, 23 bp, Homo sapiens
tgaattaaaattgtcccatttgc

SEQ ID NO: 6487101 - DNA, 13 bp, Homo sapiens
tgaattaaacatg

SEQ ID NO: 6487102 - DNA, 12 bp, Homo sapiens
tgaattaacaca

SEQ ID NO: 6487103 - DNA, 18 bp, Homo sapiens
tgaattaacacagtgttt

SEQ ID NO: 6487104 - DNA, 21 bp, Homo sapiens
tgaattaacacagtgtttcaa

SEQ ID NO: 6487105 - DNA, 22 bp, Homo sapiens
tgaattaacacagtgtttcaat

SEQ ID NO: 6487106 - DNA, 20 bp, Homo sapiens
tgaattaagaaagattaaat

SEQ ID NO: 6487107 - DNA, 23 bp, Homo sapiens
tgaattaagaaagattaaatata

SEQ ID NO: 6487108 - DNA, 22 bp, Homo sapiens
tgaattaataataaagctacca

SEQ ID NO: 6487109 - DNA, 23 bp, Homo sapiens
tgaattaatcatctataaagaag

SEQ ID NO: 6487110 - DNA, 23 bp, Homo sapiens
tgaattaatctagaaaatgaaaa

SEQ ID NO: 6487111 - DNA, 20 bp, Homo sapiens
tgaattaatgacagagccag

SEQ ID NO: 6487112 - DNA, 19 bp, Homo sapiens
tgaattaattaatttggag

SEQ ID NO: 6487113 - DNA, 13 bp, Homo sapiens
tgaattacagtga

SEQ ID NO: 6487114 - DNA, 14 bp, Homo sapiens
tgaattacatttgt

SEQ ID NO: 6487115 - DNA, 23 bp, Homo sapiens
tgaattaccatagagtaatgatg

SEQ ID NO: 6487116 - DNA, 13 bp, Homo sapiens
tgaattactaact

SEQ ID NO: 6487117 - DNA, 20 bp, Homo sapiens
tgaattactgtatataaact

SEQ ID NO: 6487118 - DNA, 13 bp, Homo sapiens
tgaattagaaaat

SEQ ID NO: 6487119 - DNA, 14 bp, Homo sapiens
tgaattagaagaaa

SEQ ID NO: 6487120 - DNA, 19 bp, Homo sapiens
tgaattagaagaaaatgga

SEQ ID NO: 6487121 - DNA, 19 bp, Homo sapiens
tgaattagattatttctgt

SEQ ID NO: 6487122 - DNA, 14 bp, Homo sapiens
tgaattagccaaaa

SEQ ID NO: 6487123 - DNA, 18 bp, Homo sapiens
tgaattagccaaaacact

SEQ ID NO: 6487124 - DNA, 20 bp, Homo sapiens
tgaattaggctgtaactact

SEQ ID NO: 6487125 - DNA, 21 bp, Homo sapiens
tgaattaggctgtaactactt

SEQ ID NO: 6487126 - DNA, 21 bp, Homo sapiens
tgaattaggggacactgtctt

SEQ ID NO: 6487127 - DNA, 16 bp, Homo sapiens
tgaattagtaactgta

SEQ ID NO: 6487128 - DNA, 15 bp, Homo sapiens
tgaattagtgagtat

SEQ ID NO: 6487129 - DNA, 23 bp, Homo sapiens
tgaattataaatgtgtttatagc

SEQ ID NO: 6487130 - DNA, 14 bp, Homo sapiens
tgaattataacagt

SEQ ID NO: 6487131 - DNA, 16 bp, Homo sapiens
tgaattataacagtta

SEQ ID NO: 6487132 - DNA, 18 bp, Homo sapiens
tgaattataacagttata

SEQ ID NO: 6487133 - DNA, 22 bp, Homo sapiens
tgaattataacagttatatttt

SEQ ID NO: 6487134 - DNA, 16 bp, Homo sapiens
tgaattataactagac

SEQ ID NO: 6487135 - DNA, 20 bp, Homo sapiens
tgaattatcagcaaagaaaa

SEQ ID NO: 6487136 - DNA, 22 bp, Homo sapiens
tgaattatccacatgaaaataa

SEQ ID NO: 6487137 - DNA, 17 bp, Homo sapiens
tgaattatcttggatga

SEQ ID NO: 6487138 - DNA, 14 bp, Homo sapiens
tgaattatgtgcac

SEQ ID NO: 6487139 - DNA, 11 bp, Homo sapiens
tgaattattaa

SEQ ID NO: 6487140 - DNA, 18 bp, Homo sapiens
tgaattattaatgaatgc

SEQ ID NO: 6487141 - DNA, 21 bp, Homo sapiens
tgaattattacactgtaagaa

SEQ ID NO: 6487142 - DNA, 17 bp, Homo sapiens
tgaattattgacactga

SEQ ID NO: 6487143 - DNA, 22 bp, Homo sapiens
tgaattattgggcttaatataa

SEQ ID NO: 6487144 - DNA, 14 bp, Homo sapiens
tgaattattttgca

SEQ ID NO: 6487145 - DNA, 13 bp, Homo sapiens
tgaattattttgt

SEQ ID NO: 6487146 - DNA, 20 bp, Homo sapiens
tgaattattttgttgtgatt

SEQ ID NO: 6487147 - DNA, 21 bp, Homo sapiens
tgaattcaaagcttgtgaaaa

SEQ ID NO: 6487148 - DNA, 17 bp, Homo sapiens
tgaattcacaaacaaat

SEQ ID NO: 6487149 - DNA, 12 bp, Homo sapiens
tgaattcagatt

SEQ ID NO: 6487150 - DNA, 18 bp, Homo sapiens
tgaattcatactctgttg

SEQ ID NO: 6487151 - DNA, 12 bp, Homo sapiens
tgaattcattat

SEQ ID NO: 6487152 - DNA, 13 bp, Homo sapiens
tgaattcattata

SEQ ID NO: 6487153 - DNA, 16 bp, Homo sapiens
tgaattcatttgctga

SEQ ID NO: 6487154 - DNA, 18 bp, Homo sapiens
tgaattccaactcacttt

SEQ ID NO: 6487155 - DNA, 17 bp, Homo sapiens
tgaattccataatacat

SEQ ID NO: 6487156 - DNA, 16 bp, Homo sapiens
tgaattcccagactct

SEQ ID NO: 6487157 - DNA, 18 bp, Homo sapiens
tgaattcctagaattaaa

SEQ ID NO: 6487158 - DNA, 22 bp, Homo sapiens
tgaattcctctcaaattcagct

SEQ ID NO: 6487159 - DNA, 21 bp, Homo sapiens
tgaattcctgtcttccaaatt

SEQ ID NO: 6487160 - DNA, 23 bp, Homo sapiens
tgaattcgagacaggcagaatca

SEQ ID NO: 6487161 - DNA, 16 bp, Homo sapiens
tgaattcgatgcgtat

SEQ ID NO: 6487162 - DNA, 15 bp, Homo sapiens
tgaattcgtttctga

SEQ ID NO: 6487163 - DNA, 19 bp, Homo sapiens
tgaattctgcaatgttttc

SEQ ID NO: 6487164 - DNA, 13 bp, Homo sapiens
tgaattctgcctt

SEQ ID NO: 6487165 - DNA, 18 bp, Homo sapiens
tgaattctgggattactg

SEQ ID NO: 6487166 - DNA, 20 bp, Homo sapiens
tgaattctgtgaagaatgaa

SEQ ID NO: 6487167 - DNA, 14 bp, Homo sapiens
tgaattctgttgta

SEQ ID NO: 6487168 - DNA, 16 bp, Homo sapiens
tgaattctgttgtaat

SEQ ID NO: 6487169 - DNA, 15 bp, Homo sapiens
tgaattcttcaacag

SEQ ID NO: 6487170 - DNA, 18 bp, Homo sapiens
tgaattcttcctctcctt

SEQ ID NO: 6487171 - DNA, 12 bp, Homo sapiens
tgaattcttgag

SEQ ID NO: 6487172 - DNA, 14 bp, Homo sapiens
tgaattcttgatct

SEQ ID NO: 6487173 - DNA, 20 bp, Homo sapiens
tgaattcttggttgaggaaa

SEQ ID NO: 6487174 - DNA, 15 bp, Homo sapiens
tgaattctttagatt

SEQ ID NO: 6487175 - DNA, 23 bp, Homo sapiens
tgaattctttatcccattttatc

SEQ ID NO: 6487176 - DNA, 15 bp, Homo sapiens
tgaattgaaaaacaa

SEQ ID NO: 6487177 - DNA, 14 bp, Homo sapiens
tgaattgaaatggg

SEQ ID NO: 6487178 - DNA, 13 bp, Homo sapiens
tgaattgaaattt

SEQ ID NO: 6487179 - DNA, 16 bp, Homo sapiens
tgaattgaaattttat

SEQ ID NO: 6487180 - DNA, 15 bp, Homo sapiens
tgaattgagaaaaga

SEQ ID NO: 6487181 - DNA, 20 bp, Homo sapiens
tgaattgagcctaaaaataa

SEQ ID NO: 6487182 - DNA, 18 bp, Homo sapiens
tgaattgagctgcagaaa

SEQ ID NO: 6487183 - DNA, 15 bp, Homo sapiens
tgaattgataaaaga

SEQ ID NO: 6487184 - DNA, 17 bp, Homo sapiens
tgaattgataataaact

SEQ ID NO: 6487185 - DNA, 22 bp, Homo sapiens
tgaattgatgactatatataaa

SEQ ID NO: 6487186 - DNA, 21 bp, Homo sapiens
tgaattgcattttttaaaaca

SEQ ID NO: 6487187 - DNA, 22 bp, Homo sapiens
tgaattgcattttttaaaacaa

SEQ ID NO: 6487188 - DNA, 17 bp, Homo sapiens
tgaattgcctgccatgg

SEQ ID NO: 6487189 - DNA, 20 bp, Homo sapiens
tgaattgcctgttcataaaa

SEQ ID NO: 6487190 - DNA, 22 bp, Homo sapiens
tgaattgcgttggtctctgcat

SEQ ID NO: 6487191 - DNA, 16 bp, Homo sapiens
tgaattgctaattctg

SEQ ID NO: 6487192 - DNA, 16 bp, Homo sapiens
tgaattgctatcattt

SEQ ID NO: 6487193 - DNA, 13 bp, Homo sapiens
tgaattgctgtct

SEQ ID NO: 6487194 - DNA, 20 bp, Homo sapiens
tgaattgctgtctagcctta

SEQ ID NO: 6487195 - DNA, 15 bp, Homo sapiens
tgaattgctttatgg

SEQ ID NO: 6487196 - DNA, 15 bp, Homo sapiens
tgaattggaaagact

SEQ ID NO: 6487197 - DNA, 12 bp, Homo sapiens
tgaattggaact

SEQ ID NO: 6487198 - DNA, 18 bp, Homo sapiens
tgaattggaagggaaaaa

SEQ ID NO: 6487199 - DNA, 17 bp, Homo sapiens
tgaattggcaggataag

SEQ ID NO: 6487200 - DNA, 14 bp, Homo sapiens
tgaattggcatttc

SEQ ID NO: 6487201 - DNA, 20 bp, Homo sapiens
tgaattggcctgaacagatg

SEQ ID NO: 6487202 - DNA, 21 bp, Homo sapiens
tgaattggcctgaacagatgt

SEQ ID NO: 6487203 - DNA, 21 bp, Homo sapiens
tgaattggctaaaagacatgc

SEQ ID NO: 6487204 - DNA, 16 bp, Homo sapiens
tgaattggctgccaag

SEQ ID NO: 6487205 - DNA, 22 bp, Homo sapiens
tgaattggctgccaagagtcca

SEQ ID NO: 6487206 - DNA, 19 bp, Homo sapiens
tgaattgggaacattatca

SEQ ID NO: 6487207 - DNA, 14 bp, Homo sapiens
tgaattggtgaata

SEQ ID NO: 6487208 - DNA, 16 bp, Homo sapiens
tgaattggtgaataaa

SEQ ID NO: 6487209 - DNA, 18 bp, Homo sapiens
tgaattgtaactgttctt

SEQ ID NO: 6487210 - DNA, 15 bp, Homo sapiens
tggccggtccacccc

SEQ ID NO: 6487211 - DNA, 16 bp, Homo sapiens
tggccggtccaccccg

SEQ ID NO: 6487212 - DNA, 18 bp, Homo sapiens
tggccggtctgcaagtca

SEQ ID NO: 6487213 - DNA, 20 bp, Homo sapiens
tggccggtctgcaagtcaga

SEQ ID NO: 6487214 - DNA, 21 bp, Homo sapiens
tggccggtctgcaagtcagag

SEQ ID NO: 6487215 - DNA, 15 bp, Homo sapiens
tggccggtgccagct

SEQ ID NO: 6487216 - DNA, 13 bp, Homo sapiens
tggccggtgctgg

SEQ ID NO: 6487217 - DNA, 16 bp, Homo sapiens
tggccggtgctgggtt

SEQ ID NO: 6487218 - DNA, 15 bp, Homo sapiens
tggccggtggttttg

SEQ ID NO: 6487219 - DNA, 17 bp, Homo sapiens
tggccgtgaatgggtgc

SEQ ID NO: 6487220 - DNA, 14 bp, Homo sapiens
tggccgtgggcctg

SEQ ID NO: 6487221 - DNA, 15 bp, Homo sapiens
tggccgttcagcctg

SEQ ID NO: 6487222 - DNA, 16 bp, Homo sapiens
tggcctaaaaatgcaa

SEQ ID NO: 6487223 - DNA, 18 bp, Homo sapiens
tggcctaaaactggcctg

SEQ ID NO: 6487224 - DNA, 17 bp, Homo sapiens
tggcctaaaatcttgga

SEQ ID NO: 6487225 - DNA, 21 bp, Homo sapiens
tggcctaaacctcagttatta

SEQ ID NO: 6487226 - DNA, 15 bp, Homo sapiens
tggcctaaagccagc

SEQ ID NO: 6487227 - DNA, 15 bp, Homo sapiens
tggcctaaatttctt

SEQ ID NO: 6487228 - DNA, 23 bp, Homo sapiens
tggcctaacctgccgagagtcca

SEQ ID NO: 6487229 - DNA, 22 bp, Homo sapiens
tggcctaagaggctgccctcct

SEQ ID NO: 6487230 - DNA, 14 bp, Homo sapiens
tggcctaaggctgc

SEQ ID NO: 6487231 - DNA, 22 bp, Homo sapiens
tggcctaatattgaaaatgtca

SEQ ID NO: 6487232 - DNA, 15 bp, Homo sapiens
tggcctaatttacaa

SEQ ID NO: 6487233 - DNA, 19 bp, Homo sapiens
tggcctacaaatcagtaat

SEQ ID NO: 6487234 - DNA, 12 bp, Homo sapiens
tggcctacattc

SEQ ID NO: 6487235 - DNA, 14 bp, Homo sapiens
tggcctacattctt

SEQ ID NO: 6487236 - DNA, 16 bp, Homo sapiens
tggcctacattcttta

SEQ ID NO: 6487237 - DNA, 20 bp, Homo sapiens
tggcctacattctttattct

SEQ ID NO: 6487238 - DNA, 20 bp, Homo sapiens
tggcctaccacagctgcctc

SEQ ID NO: 6487239 - DNA, 21 bp, Homo sapiens
tggcctaccacagctgcctcc

SEQ ID NO: 6487240 - DNA, 22 bp, Homo sapiens
tggcctaccacagctgcctccg

SEQ ID NO: 6487241 - DNA, 20 bp, Homo sapiens
tggcctacccctttctccag

SEQ ID NO: 6487242 - DNA, 22 bp, Homo sapiens
tggcctaccttgtgagggagag

SEQ ID NO: 6487243 - DNA, 20 bp, Homo sapiens
tggcctagcatacgtacaca

SEQ ID NO: 6487244 - DNA, 14 bp, Homo sapiens
tggcctagcccacc

SEQ ID NO: 6487245 - DNA, 17 bp, Homo sapiens
tggcctagcccaccctg

SEQ ID NO: 6487246 - DNA, 18 bp, Homo sapiens
tggcctagcccaccctgc

SEQ ID NO: 6487247 - DNA, 20 bp, Homo sapiens
tggcctaggggccagggctt

SEQ ID NO: 6487248 - DNA, 13 bp, Homo sapiens
tggcctatctcct

SEQ ID NO: 6487249 - DNA, 15 bp, Homo sapiens
tggcctatctcctag

SEQ ID NO: 6487250 - DNA, 14 bp, Homo sapiens
tggcctatgaccct

SEQ ID NO: 6487251 - DNA, 17 bp, Homo sapiens
tggcctatgaccctgtg

SEQ ID NO: 6487252 - DNA, 23 bp, Homo sapiens
tggcctatgaccctgtgcctgtg

SEQ ID NO: 6487253 - DNA, 19 bp, Homo sapiens
tggcctatgtggtctaagg

SEQ ID NO: 6487254 - DNA, 21 bp, Homo sapiens
tggcctattatattaaaatat

SEQ ID NO: 6487255 - DNA, 15 bp, Homo sapiens
tggcctatttaagcc

SEQ ID NO: 6487256 - DNA, 16 bp, Homo sapiens
tggcctatttaagccc

SEQ ID NO: 6487257 - DNA, 19 bp, Homo sapiens
tggcctatttaagccccct

SEQ ID NO: 6487258 - DNA, 18 bp, Homo sapiens
tggcctatttcagctgct

SEQ ID NO: 6487259 - DNA, 23 bp, Homo sapiens
tggcctcaaaacagaagcagctt

SEQ ID NO: 6487260 - DNA, 15 bp, Homo sapiens
tggcctcaaagcaag

SEQ ID NO: 6487261 - DNA, 16 bp, Homo sapiens
tggcctcaaccctccc

SEQ ID NO: 6487262 - DNA, 21 bp, Homo sapiens
tggcctcaaccctccctcagc

SEQ ID NO: 6487263 - DNA, 22 bp, Homo sapiens
tggcctcaaccctccctcagcc

SEQ ID NO: 6487264 - DNA, 20 bp, Homo sapiens
tggcctcaagagcacacaga

SEQ ID NO: 6487265 - DNA, 22 bp, Homo sapiens
tggcctcaagagcacacagaga

SEQ ID NO: 6487266 - DNA, 23 bp, Homo sapiens
tggcctcaagcaaggaagcagag

SEQ ID NO: 6487267 - DNA, 23 bp, Homo sapiens
tggcctcacctgggttccccacc

SEQ ID NO: 6487268 - DNA, 18 bp, Homo sapiens
tggcctcacgcccagcct

SEQ ID NO: 6487269 - DNA, 23 bp, Homo sapiens
tggcctcactggctggggcagag

SEQ ID NO: 6487270 - DNA, 16 bp, Homo sapiens
tggcctcacttccctg

SEQ ID NO: 6487271 - DNA, 20 bp, Homo sapiens
tggcctcacttccctgggaa

SEQ ID NO: 6487272 - DNA, 22 bp, Homo sapiens
tggcctcacttgattcatctct

SEQ ID NO: 6487273 - DNA, 12 bp, Homo sapiens
tggcctcagact

SEQ ID NO: 6487274 - DNA, 19 bp, Homo sapiens
tggcctcagactgcaccca

SEQ ID NO: 6487275 - DNA, 12 bp, Homo sapiens
tggcctcagagc

SEQ ID NO: 6487276 - DNA, 13 bp, Homo sapiens
tggcctcagagct

SEQ ID NO: 6487277 - DNA, 15 bp, Homo sapiens
tggcctcagagcttc

SEQ ID NO: 6487278 - DNA, 22 bp, Homo sapiens
tggcctcagagcttcctgggga

SEQ ID NO: 6487279 - DNA, 22 bp, Homo sapiens
tggcctcagaggaccctttcca

SEQ ID NO: 6487280 - DNA, 11 bp, Homo sapiens
tggcctcagcc

SEQ ID NO: 6487281 - DNA, 12 bp, Homo sapiens
tggcctcagccc

SEQ ID NO: 6487282 - DNA, 13 bp, Homo sapiens
tggcctcagccct

SEQ ID NO: 6487283 - DNA, 14 bp, Homo sapiens
tggcctcagccctc

SEQ ID NO: 6487284 - DNA, 15 bp, Homo sapiens
tggcctcagccctca

SEQ ID NO: 6487285 - DNA, 15 bp, Homo sapiens
tggcctcagccctgc

SEQ ID NO: 6487286 - DNA, 17 bp, Homo sapiens
tggcctcagccctgctc

SEQ ID NO: 6487287 - DNA, 23 bp, Homo sapiens
tggcctcagccctgctccctgcc

SEQ ID NO: 6487288 - DNA, 18 bp, Homo sapiens
tggcctcagctgaatgcc

SEQ ID NO: 6487289 - DNA, 13 bp, Homo sapiens
tggcctcagctgc

SEQ ID NO: 6487290 - DNA, 19 bp, Homo sapiens
tggcctcagctgcctcact

SEQ ID NO: 6487291 - DNA, 13 bp, Homo sapiens
tggcctcagggcc

SEQ ID NO: 6487292 - DNA, 18 bp, Homo sapiens
tggcctcagttcccagct

SEQ ID NO: 6487293 - DNA, 13 bp, Homo sapiens
tggcctcatctca

SEQ ID NO: 6487294 - DNA, 19 bp, Homo sapiens
tggcctcatctcagaccct

SEQ ID NO: 6487295 - DNA, 15 bp, Homo sapiens
tggcctcatctctgc

SEQ ID NO: 6487296 - DNA, 15 bp, Homo sapiens
tggcctcatgtggct

SEQ ID NO: 6487297 - DNA, 22 bp, Homo sapiens
tggcctcattactttaccaccc

SEQ ID NO: 6487298 - DNA, 17 bp, Homo sapiens
tggcctcattcagcaga

SEQ ID NO: 6487299 - DNA, 20 bp, Homo sapiens
tggcctcatttaaaacaaga

SEQ ID NO: 6487300 - DNA, 13 bp, Homo sapiens
tggcctcatttca

SEQ ID NO: 6487301 - DNA, 13 bp, Homo sapiens
tggcctccaagtc

SEQ ID NO: 6487302 - DNA, 23 bp, Homo sapiens
tggcctccaagtccacagtggaa

SEQ ID NO: 6487303 - DNA, 14 bp, Homo sapiens
tggcctccagctcc

SEQ ID NO: 6487304 - DNA, 14 bp, Homo sapiens
tggcctccatcctc

SEQ ID NO: 6487305 - DNA, 11 bp, Homo sapiens
tggcctcccaa

SEQ ID NO: 6487306 - DNA, 13 bp, Homo sapiens
tggcctcccaaag

SEQ ID NO: 6487307 - DNA, 20 bp, Homo sapiens
tggcctcccaaagtgctgag

SEQ ID NO: 6487308 - DNA, 20 bp, Homo sapiens
tggcctcccaaagtgctggg

SEQ ID NO: 6487309 - DNA, 23 bp, Homo sapiens
tggcctcccaaagtgctgggatt

SEQ ID NO: 6487310 - DNA, 20 bp, Homo sapiens
tggcctcccaactcacccca

SEQ ID NO: 6487311 - DNA, 21 bp, Homo sapiens
tggcctcccaactcaccccag

SEQ ID NO: 6487312 - DNA, 22 bp, Homo sapiens
tggcctcccaactcaccccagc

SEQ ID NO: 6487313 - DNA, 17 bp, Homo sapiens
tggcctcccaataaagc

SEQ ID NO: 6487314 - DNA, 18 bp, Homo sapiens
tggcctcccaataaagct

SEQ ID NO: 6487315 - DNA, 20 bp, Homo sapiens
tggcctcccaataaagctgg

SEQ ID NO: 6487316 - DNA, 13 bp, Homo sapiens
tggcctcccaccc

SEQ ID NO: 6487317 - DNA, 15 bp, Homo sapiens
tggcctcccacccga

SEQ ID NO: 6487318 - DNA, 22 bp, Homo sapiens
tggcctcccacccgatgctgct

SEQ ID NO: 6487319 - DNA, 12 bp, Homo sapiens
tggcctcccagc

SEQ ID NO: 6487320 - DNA, 14 bp, Homo sapiens
tggcctcccagcca

SEQ ID NO: 6487321 - DNA, 17 bp, Homo sapiens
tggcctccccatgggca

SEQ ID NO: 6487322 - DNA, 22 bp, Homo sapiens
tggcctccccatgggcacagtg

SEQ ID NO: 6487323 - DNA, 14 bp, Homo sapiens
tggcctcccctgcg

SEQ ID NO: 6487324 - DNA, 16 bp, Homo sapiens
tggcctcccctgcgga

SEQ ID NO: 6487325 - DNA, 15 bp, Homo sapiens
tggcctcccctgctg

SEQ ID NO: 6487326 - DNA, 13 bp, Homo sapiens
tggcctccctcca

SEQ ID NO: 6487327 - DNA, 14 bp, Homo sapiens
tggcctccctccag

SEQ ID NO: 6487328 - DNA, 15 bp, Homo sapiens
tggcctccctccaga

SEQ ID NO: 6487329 - DNA, 19 bp, Homo sapiens
tggcctccctgctgtgcca

SEQ ID NO: 6487330 - DNA, 13 bp, Homo sapiens
tggcctccctggc

SEQ ID NO: 6487331 - DNA, 22 bp, Homo sapiens
tggcctcccttctcctttctaa

SEQ ID NO: 6487332 - DNA, 20 bp, Homo sapiens
tggcctccctttgtgtgcat

SEQ ID NO: 6487333 - DNA, 12 bp, Homo sapiens
tggcctccggcc

SEQ ID NO: 6487334 - DNA, 21 bp, Homo sapiens
tggcctccggcgtcagcctcc

SEQ ID NO: 6487335 - DNA, 21 bp, Homo sapiens
tggcctccgtcctgtcactga

SEQ ID NO: 6487336 - DNA, 19 bp, Homo sapiens
tggcctcctcccttagctc

SEQ ID NO: 6487337 - DNA, 21 bp, Homo sapiens
tggcctcctggcccgccctca

SEQ ID NO: 6487338 - DNA, 14 bp, Homo sapiens
tggcctcgcctggg

SEQ ID NO: 6487339 - DNA, 15 bp, Homo sapiens
tggcctcgcctgggc

SEQ ID NO: 6487340 - DNA, 16 bp, Homo sapiens
tggcctcggcgggctt

SEQ ID NO: 6487341 - DNA, 19 bp, Homo sapiens
tggcctcgggacacctgcc

SEQ ID NO: 6487342 - DNA, 17 bp, Homo sapiens
tggcctcgtgaggggca

SEQ ID NO: 6487343 - DNA, 19 bp, Homo sapiens
tggcctcgtgaggggcaag

SEQ ID NO: 6487344 - DNA, 13 bp, Homo sapiens
tggcctctagaac

SEQ ID NO: 6487345 - DNA, 20 bp, Homo sapiens
tggcctctagaacacccact

SEQ ID NO: 6487346 - DNA, 22 bp, Homo sapiens
tggcctctagaacacccactgg

SEQ ID NO: 6487347 - DNA, 23 bp, Homo sapiens
tggcctctagaacacccactggc

SEQ ID NO: 6487348 - DNA, 14 bp, Homo sapiens
tggcctctccccag

SEQ ID NO: 6487349 - DNA, 16 bp, Homo sapiens
tggcctctccccagga

SEQ ID NO: 6487350 - DNA, 21 bp, Homo sapiens
tggcctctctctctctcctca

SEQ ID NO: 6487351 - DNA, 18 bp, Homo sapiens
tggcctctctgacatatg

SEQ ID NO: 6487352 - DNA, 16 bp, Homo sapiens
tggcctctctgtacac

SEQ ID NO: 6487353 - DNA, 13 bp, Homo sapiens
tggcctctgcact

SEQ ID NO: 6487354 - DNA, 15 bp, Homo sapiens
tggcctctgcactcc

SEQ ID NO: 6487355 - DNA, 11 bp, Homo sapiens
tggcctctgcc

SEQ ID NO: 6487356 - DNA, 13 bp, Homo sapiens
tggcctctgccat

SEQ ID NO: 6487357 - DNA, 12 bp, Homo sapiens
tggcctctgccc

SEQ ID NO: 6487358 - DNA, 14 bp, Homo sapiens
tggcctctgcccct

SEQ ID NO: 6487359 - DNA, 17 bp, Homo sapiens
tggcctctgcctccacc

SEQ ID NO: 6487360 - DNA, 14 bp, Homo sapiens
tggcctctgcctgg

SEQ ID NO: 6487361 - DNA, 15 bp, Homo sapiens
tggcctctgctggtc

SEQ ID NO: 6487362 - DNA, 19 bp, Homo sapiens
tggcctctgcttacttttt

SEQ ID NO: 6487363 - DNA, 13 bp, Homo sapiens
tggcctctgcttt

SEQ ID NO: 6487364 - DNA, 14 bp, Homo sapiens
tggcctctggccag

SEQ ID NO: 6487365 - DNA, 14 bp, Homo sapiens
tggcctctggcctg

SEQ ID NO: 6487366 - DNA, 15 bp, Homo sapiens
tggcctctggcctgg

SEQ ID NO: 6487367 - DNA, 18 bp, Homo sapiens
tggcctctggcctgggaa

SEQ ID NO: 6487368 - DNA, 16 bp, Homo sapiens
tggcctctggctctca

SEQ ID NO: 6487369 - DNA, 18 bp, Homo sapiens
tggcctctgggcagtgtg

SEQ ID NO: 6487370 - DNA, 19 bp, Homo sapiens
tggcctctgggcagtgtgg

SEQ ID NO: 6487371 - DNA, 13 bp, Homo sapiens
tggcctctggggc

SEQ ID NO: 6487372 - DNA, 18 bp, Homo sapiens
tggcctctggggcaggac

SEQ ID NO: 6487373 - DNA, 15 bp, Homo sapiens
tggcctctgtgatta

SEQ ID NO: 6487374 - DNA, 19 bp, Homo sapiens
tggcctctgtgattacata

SEQ ID NO: 6487375 - DNA, 21 bp, Homo sapiens
tggcctctgtgattacataga

SEQ ID NO: 6487376 - DNA, 23 bp, Homo sapiens
tggcctctgtggagccccagcat

SEQ ID NO: 6487377 - DNA, 13 bp, Homo sapiens
tggcctcttcaga

SEQ ID NO: 6487378 - DNA, 22 bp, Homo sapiens
tggcctcttcaggcctgctagt

SEQ ID NO: 6487379 - DNA, 14 bp, Homo sapiens
tggcctcttgaaga

SEQ ID NO: 6487380 - DNA, 17 bp, Homo sapiens
tggcctcttggcacctg

SEQ ID NO: 6487381 - DNA, 14 bp, Homo sapiens
tggcctcttgtccc

SEQ ID NO: 6487382 - DNA, 15 bp, Homo sapiens
tggcctcttgtccct

SEQ ID NO: 6487383 - DNA, 20 bp, Homo sapiens
tggcctctttcctcagcctt

SEQ ID NO: 6487384 - DNA, 14 bp, Homo sapiens
tggcctctttgtct

SEQ ID NO: 6487385 - DNA, 22 bp, Homo sapiens
tggcctctttgtctaaaacaat

SEQ ID NO: 6487386 - DNA, 16 bp, Homo sapiens
tggcctgaacagatgt

SEQ ID NO: 6487387 - DNA, 17 bp, Homo sapiens
tggcctgaacagatgta

SEQ ID NO: 6487388 - DNA, 19 bp, Homo sapiens
tggcctgacagctctgttt

SEQ ID NO: 6487389 - DNA, 17 bp, Homo sapiens
tggcctgacctggcaca

SEQ ID NO: 6487390 - DNA, 13 bp, Homo sapiens
tgaattgtaagga

SEQ ID NO: 6487391 - DNA, 12 bp, Homo sapiens
tgaattgtacag

SEQ ID NO: 6487392 - DNA, 21 bp, Homo sapiens
tgaattgtacctatttctgat

SEQ ID NO: 6487393 - DNA, 21 bp, Homo sapiens
tgaattgtattttttgttgaa

SEQ ID NO: 6487394 - DNA, 15 bp, Homo sapiens
tgaattgtccccagt

SEQ ID NO: 6487395 - DNA, 18 bp, Homo sapiens
tgaattgtcttttagaca

SEQ ID NO: 6487396 - DNA, 13 bp, Homo sapiens
tgaattgtgaaat

SEQ ID NO: 6487397 - DNA, 20 bp, Homo sapiens
tgaattgtgtattgatgcaa

SEQ ID NO: 6487398 - DNA, 22 bp, Homo sapiens
tgaattgtgtcccccataaaag

SEQ ID NO: 6487399 - DNA, 19 bp, Homo sapiens
tgaattgtgtggagaagtg

SEQ ID NO: 6487400 - DNA, 15 bp, Homo sapiens
tgaattgttatgaaa

SEQ ID NO: 6487401 - DNA, 13 bp, Homo sapiens
tgaattgttgggg

SEQ ID NO: 6487402 - DNA, 14 bp, Homo sapiens
tgaattgtttataa

SEQ ID NO: 6487403 - DNA, 15 bp, Homo sapiens
tgaattgtttgaacc

SEQ ID NO: 6487404 - DNA, 17 bp, Homo sapiens
tgaattgttttctttaa

SEQ ID NO: 6487405 - DNA, 18 bp, Homo sapiens
tgaatttaaataaagtta

SEQ ID NO: 6487406 - DNA, 13 bp, Homo sapiens
tgaatttaacaat

SEQ ID NO: 6487407 - DNA, 16 bp, Homo sapiens
tgaatttaacaatgcg

SEQ ID NO: 6487408 - DNA, 18 bp, Homo sapiens
tgaatttaacaatgcgaa

SEQ ID NO: 6487409 - DNA, 17 bp, Homo sapiens
tgaatttaagcatgagt

SEQ ID NO: 6487410 - DNA, 19 bp, Homo sapiens
tgaatttaagcatgagtgg

SEQ ID NO: 6487411 - DNA, 18 bp, Homo sapiens
tgaatttaattctttcaa

SEQ ID NO: 6487412 - DNA, 13 bp, Homo sapiens
tgaatttaccatc

SEQ ID NO: 6487413 - DNA, 11 bp, Homo sapiens
tgaatttagaa

SEQ ID NO: 6487414 - DNA, 16 bp, Homo sapiens
tgaatttagaaatatt

SEQ ID NO: 6487415 - DNA, 20 bp, Homo sapiens
tgaatttagtgagatttacc

SEQ ID NO: 6487416 - DNA, 21 bp, Homo sapiens
tgaatttagtgagcataggtg

SEQ ID NO: 6487417 - DNA, 15 bp, Homo sapiens
tgaatttatataaag

SEQ ID NO: 6487418 - DNA, 19 bp, Homo sapiens
tgaatttatataaagtatt

SEQ ID NO: 6487419 - DNA, 17 bp, Homo sapiens
tgaatttatcattttag

SEQ ID NO: 6487420 - DNA, 16 bp, Homo sapiens
tgaatttatctgaata

SEQ ID NO: 6487421 - DNA, 14 bp, Homo sapiens
tgaatttatcttta

SEQ ID NO: 6487422 - DNA, 19 bp, Homo sapiens
tgaatttatctttaccaaa

SEQ ID NO: 6487423 - DNA, 18 bp, Homo sapiens
tgaatttattgatattta

SEQ ID NO: 6487424 - DNA, 12 bp, Homo sapiens
tgaatttattgg

SEQ ID NO: 6487425 - DNA, 12 bp, Homo sapiens
tgaatttcaaaa

SEQ ID NO: 6487426 - DNA, 17 bp, Homo sapiens
tgaatttcaaacatttg

SEQ ID NO: 6487427 - DNA, 14 bp, Homo sapiens
tgaatttcagtcct

SEQ ID NO: 6487428 - DNA, 23 bp, Homo sapiens
tgaatttcattctcttgaaggtg

SEQ ID NO: 6487429 - DNA, 16 bp, Homo sapiens
tgaatttcctatctgt

SEQ ID NO: 6487430 - DNA, 19 bp, Homo sapiens
tgaatttctaccagatgtg

SEQ ID NO: 6487431 - DNA, 17 bp, Homo sapiens
tgaatttctcctttcct

SEQ ID NO: 6487432 - DNA, 15 bp, Homo sapiens
tgaatttctgccata

SEQ ID NO: 6487433 - DNA, 21 bp, Homo sapiens
tgaatttcttcactgttgaaa

SEQ ID NO: 6487434 - DNA, 18 bp, Homo sapiens
tgaatttcttcttttcct

SEQ ID NO: 6487435 - DNA, 22 bp, Homo sapiens
tgaatttctttgatttaactga

SEQ ID NO: 6487436 - DNA, 16 bp, Homo sapiens
tgaatttgaatgaaaa

SEQ ID NO: 6487437 - DNA, 18 bp, Homo sapiens
tgaatttgaggagggaat

SEQ ID NO: 6487438 - DNA, 11 bp, Homo sapiens
tgaatttgcaa

SEQ ID NO: 6487439 - DNA, 17 bp, Homo sapiens
tgaatttgcaaagtact

SEQ ID NO: 6487440 - DNA, 16 bp, Homo sapiens
tgaatttgcaacagta

SEQ ID NO: 6487441 - DNA, 11 bp, Homo sapiens
tgaatttgcat

SEQ ID NO: 6487442 - DNA, 12 bp, Homo sapiens
tgaatttgcatg

SEQ ID NO: 6487443 - DNA, 14 bp, Homo sapiens
tgaatttgcctaat

SEQ ID NO: 6487444 - DNA, 16 bp, Homo sapiens
tgaatttggaatgttc

SEQ ID NO: 6487445 - DNA, 17 bp, Homo sapiens
tgaatttggagactctg

SEQ ID NO: 6487446 - DNA, 14 bp, Homo sapiens
tgaatttgggcctc

SEQ ID NO: 6487447 - DNA, 17 bp, Homo sapiens
tgaatttgggcctcttg

SEQ ID NO: 6487448 - DNA, 21 bp, Homo sapiens
tgaatttgtaatgtcttgagc

SEQ ID NO: 6487449 - DNA, 13 bp, Homo sapiens
tgaatttgtactt

SEQ ID NO: 6487450 - DNA, 14 bp, Homo sapiens
tgaatttgtatatg

SEQ ID NO: 6487451 - DNA, 13 bp, Homo sapiens
tgaatttgtccaa

SEQ ID NO: 6487452 - DNA, 21 bp, Homo sapiens
tgaatttgtgtggtatgtcac

SEQ ID NO: 6487453 - DNA, 17 bp, Homo sapiens
tgaatttgttcttaaaa

SEQ ID NO: 6487454 - DNA, 23 bp, Homo sapiens
tgaatttgttctttctgatttta

SEQ ID NO: 6487455 - DNA, 21 bp, Homo sapiens
tgaattttaaaacatgctgtt

SEQ ID NO: 6487456 - DNA, 14 bp, Homo sapiens
tgaattttaaagta

SEQ ID NO: 6487457 - DNA, 17 bp, Homo sapiens
tgaattttaaatctaaa

SEQ ID NO: 6487458 - DNA, 21 bp, Homo sapiens
tgaattttaaattaaagcaaa

SEQ ID NO: 6487459 - DNA, 22 bp, Homo sapiens
tgaattttagacgatcacagaa

SEQ ID NO: 6487460 - DNA, 19 bp, Homo sapiens
tgaattttataaataaaat

SEQ ID NO: 6487461 - DNA, 16 bp, Homo sapiens
tgaattttattgaaag

SEQ ID NO: 6487462 - DNA, 17 bp, Homo sapiens
tgaattttattgaaagc

SEQ ID NO: 6487463 - DNA, 23 bp, Homo sapiens
tgaattttcaaaggcttccaatg

SEQ ID NO: 6487464 - DNA, 13 bp, Homo sapiens
tgaattttcaagc

SEQ ID NO: 6487465 - DNA, 16 bp, Homo sapiens
tgaattttcaaggcct

SEQ ID NO: 6487466 - DNA, 19 bp, Homo sapiens
tgaattttcaaggccttca

SEQ ID NO: 6487467 - DNA, 20 bp, Homo sapiens
tgaattttcaaggccttcag

SEQ ID NO: 6487468 - DNA, 18 bp, Homo sapiens
tgaattttcacatgaaca

SEQ ID NO: 6487469 - DNA, 14 bp, Homo sapiens
tgaattttcatttt

SEQ ID NO: 6487470 - DNA, 17 bp, Homo sapiens
tgaattttcattttaca

SEQ ID NO: 6487471 - DNA, 18 bp, Homo sapiens
tgaattttccgggaactt

SEQ ID NO: 6487472 - DNA, 20 bp, Homo sapiens
tgaattttctgcagctgttt

SEQ ID NO: 6487473 - DNA, 22 bp, Homo sapiens
tgaattttctgcagctgtttca

SEQ ID NO: 6487474 - DNA, 17 bp, Homo sapiens
tgaattttctggaaaat

SEQ ID NO: 6487475 - DNA, 20 bp, Homo sapiens
tgaattttgagtctatccta

SEQ ID NO: 6487476 - DNA, 13 bp, Homo sapiens
tgaattttgggga

SEQ ID NO: 6487477 - DNA, 13 bp, Homo sapiens
tgaattttgtaag

SEQ ID NO: 6487478 - DNA, 18 bp, Homo sapiens
tgaattttgtatgctgaa

SEQ ID NO: 6487479 - DNA, 18 bp, Homo sapiens
tgaattttgttctctggg

SEQ ID NO: 6487480 - DNA, 22 bp, Homo sapiens
tgaattttgttctctgggagaa

SEQ ID NO: 6487481 - DNA, 18 bp, Homo sapiens
tgaattttgtttggactt

SEQ ID NO: 6487482 - DNA, 17 bp, Homo sapiens
tgaatttttaaacaagt

SEQ ID NO: 6487483 - DNA, 17 bp, Homo sapiens
tgaatttttaagcaaat

SEQ ID NO: 6487484 - DNA, 23 bp, Homo sapiens
tgaatttttatatatatatctgt

SEQ ID NO: 6487485 - DNA, 20 bp, Homo sapiens
tgaatttttatgatttcttg

SEQ ID NO: 6487486 - DNA, 15 bp, Homo sapiens
tgaatttttatgtgt

SEQ ID NO: 6487487 - DNA, 21 bp, Homo sapiens
tgaatttttatttctttttaa

SEQ ID NO: 6487488 - DNA, 15 bp, Homo sapiens
tgaatttttcctatg

SEQ ID NO: 6487489 - DNA, 15 bp, Homo sapiens
tgaatttttctaaac

SEQ ID NO: 6487490 - DNA, 22 bp, Homo sapiens
tgaatttttctctaactcagaa

SEQ ID NO: 6487491 - DNA, 15 bp, Homo sapiens
tgaatttttctcttc

SEQ ID NO: 6487492 - DNA, 21 bp, Homo sapiens
tgaatttttcttcctctccac

SEQ ID NO: 6487493 - DNA, 13 bp, Homo sapiens
tgaatttttgcaa

SEQ ID NO: 6487494 - DNA, 22 bp, Homo sapiens
tgaatttttgcaataatgcagt

SEQ ID NO: 6487495 - DNA, 23 bp, Homo sapiens
tgaatttttgcaataatgcagta

SEQ ID NO: 6487496 - DNA, 19 bp, Homo sapiens
tgaatttttgcctatcttt

SEQ ID NO: 6487497 - DNA, 17 bp, Homo sapiens
tgaattttttaaatgaa

SEQ ID NO: 6487498 - DNA, 16 bp, Homo sapiens
tgaattttttgaaatg

SEQ ID NO: 6487499 - DNA, 21 bp, Homo sapiens
tgaatttttttcatcttctct

SEQ ID NO: 6487500 - DNA, 23 bp, Homo sapiens
tgaatttttttcatcttctctgg

SEQ ID NO: 6487501 - DNA, 16 bp, Homo sapiens
tgaatttttttctgca

SEQ ID NO: 6487502 - DNA, 22 bp, Homo sapiens
tgaatttttttgtaataagcaa

SEQ ID NO: 6487503 - DNA, 22 bp, Homo sapiens
tgaattttttttaacattcctc

SEQ ID NO: 6487504 - DNA, 16 bp, Homo sapiens
tgaatttttttttcct

SEQ ID NO: 6487505 - DNA, 19 bp, Homo sapiens
tgaatttttttttcctagc

SEQ ID NO: 6487506 - DNA, 14 bp, Homo sapiens
tgacaaaaataaca

SEQ ID NO: 6487507 - DNA, 16 bp, Homo sapiens
tgacaaaaataacact

SEQ ID NO: 6487508 - DNA, 19 bp, Homo sapiens
tgacaaaactaaccttgaa

SEQ ID NO: 6487509 - DNA, 14 bp, Homo sapiens
tgacaaaagaaaat

SEQ ID NO: 6487510 - DNA, 18 bp, Homo sapiens
tgacaaaagatacaaaag

SEQ ID NO: 6487511 - DNA, 21 bp, Homo sapiens
tgacaaaaggctcggaatgtt

SEQ ID NO: 6487512 - DNA, 20 bp, Homo sapiens
tgacaaaagtaaatgggagg

SEQ ID NO: 6487513 - DNA, 18 bp, Homo sapiens
tgacaaaataacatttga

SEQ ID NO: 6487514 - DNA, 22 bp, Homo sapiens
tgacaaaatacttgtctgtttt

SEQ ID NO: 6487515 - DNA, 13 bp, Homo sapiens
tgacaaaatgact

SEQ ID NO: 6487516 - DNA, 16 bp, Homo sapiens
tgacaaaatgactggc

SEQ ID NO: 6487517 - DNA, 20 bp, Homo sapiens
tgacaaaatgactggctcct

SEQ ID NO: 6487518 - DNA, 22 bp, Homo sapiens
tgacaaaatgactggctcctga

SEQ ID NO: 6487519 - DNA, 10 bp, Homo sapiens
tgacaaaatt

SEQ ID NO: 6487520 - DNA, 17 bp, Homo sapiens
tgacaaaattggccaga

SEQ ID NO: 6487521 - DNA, 18 bp, Homo sapiens
tgacaaacacaattctag

SEQ ID NO: 6487522 - DNA, 20 bp, Homo sapiens
tgacaaacatgatactgctg

SEQ ID NO: 6487523 - DNA, 22 bp, Homo sapiens
tgacaaacccaggagtttgtgt

SEQ ID NO: 6487524 - DNA, 20 bp, Homo sapiens
tgacaaacccggaagatcag

SEQ ID NO: 6487525 - DNA, 16 bp, Homo sapiens
tgacaaacctagcttt

SEQ ID NO: 6487526 - DNA, 22 bp, Homo sapiens
tgacaaacctagcttttaaaaa

SEQ ID NO: 6487527 - DNA, 17 bp, Homo sapiens
tgacaaagaaacccaag

SEQ ID NO: 6487528 - DNA, 19 bp, Homo sapiens
tgacaaagaaacccaagtg

SEQ ID NO: 6487529 - DNA, 18 bp, Homo sapiens
tgacaaagactcctctgg

SEQ ID NO: 6487530 - DNA, 21 bp, Homo sapiens
tgacaaagactcctctgggcc

SEQ ID NO: 6487531 - DNA, 14 bp, Homo sapiens
tgacaaagatgcat

SEQ ID NO: 6487532 - DNA, 14 bp, Homo sapiens
tgacaaagatggct

SEQ ID NO: 6487533 - DNA, 18 bp, Homo sapiens
tgacaaagatggctcaga

SEQ ID NO: 6487534 - DNA, 14 bp, Homo sapiens
tgacaaagcttccc

SEQ ID NO: 6487535 - DNA, 16 bp, Homo sapiens
tgacaaagcttggaag

SEQ ID NO: 6487536 - DNA, 21 bp, Homo sapiens
tgacaaaggagccttgataat

SEQ ID NO: 6487537 - DNA, 17 bp, Homo sapiens
tgacaaaggcaagcact

SEQ ID NO: 6487538 - DNA, 20 bp, Homo sapiens
tgacaaaggtaaatcagact

SEQ ID NO: 6487539 - DNA, 12 bp, Homo sapiens
tgacaaagtgtt

SEQ ID NO: 6487540 - DNA, 23 bp, Homo sapiens
tgacaaagtgttgaaaatgtatt

SEQ ID NO: 6487541 - DNA, 16 bp, Homo sapiens
tgacaaagttatatat

SEQ ID NO: 6487542 - DNA, 14 bp, Homo sapiens
tgacaaataagatt

SEQ ID NO: 6487543 - DNA, 19 bp, Homo sapiens
tgacaaataagattaataa

SEQ ID NO: 6487544 - DNA, 14 bp, Homo sapiens
tgacaaatattctg

SEQ ID NO: 6487545 - DNA, 22 bp, Homo sapiens
tgacaaatattttcatgtattt

SEQ ID NO: 6487546 - DNA, 19 bp, Homo sapiens
tgacaaatcaagtttccaa

SEQ ID NO: 6487547 - DNA, 23 bp, Homo sapiens
tgacaaatctgtgtatattattt

SEQ ID NO: 6487548 - DNA, 17 bp, Homo sapiens
tgacaaatgtaaacatt

SEQ ID NO: 6487549 - DNA, 15 bp, Homo sapiens
tgacaaatgtttcta

SEQ ID NO: 6487550 - DNA, 19 bp, Homo sapiens
tgacaaatgtttctaaggt

SEQ ID NO: 6487551 - DNA, 14 bp, Homo sapiens
tgacaacaaatttt

SEQ ID NO: 6487552 - DNA, 15 bp, Homo sapiens
tgacaacaaattttg

SEQ ID NO: 6487553 - DNA, 19 bp, Homo sapiens
tgacaacaaattttggttt

SEQ ID NO: 6487554 - DNA, 13 bp, Homo sapiens
tgacaacacaaat

SEQ ID NO: 6487555 - DNA, 15 bp, Homo sapiens
tgacaacacttaata

SEQ ID NO: 6487556 - DNA, 11 bp, Homo sapiens
tgacaacagaa

SEQ ID NO: 6487557 - DNA, 12 bp, Homo sapiens
tgacaacagaaa

SEQ ID NO: 6487558 - DNA, 14 bp, Homo sapiens
tgacaacagaaaaa

SEQ ID NO: 6487559 - DNA, 15 bp, Homo sapiens
tgacaacagacttct

SEQ ID NO: 6487560 - DNA, 18 bp, Homo sapiens
tgacaacagacttctgaa

SEQ ID NO: 6487561 - DNA, 19 bp, Homo sapiens
tgacaacagacttctgaaa

SEQ ID NO: 6487562 - DNA, 18 bp, Homo sapiens
tgacaacatggcttctcc

SEQ ID NO: 6487563 - DNA, 24 bp, Homo sapiens
tgacaacatggcttctcctttggc

SEQ ID NO: 6487564 - DNA, 23 bp, Homo sapiens
tgacaacatttctatagccaaaa

SEQ ID NO: 6487565 - DNA, 12 bp, Homo sapiens
tgacaacatttt

SEQ ID NO: 6487566 - DNA, 23 bp, Homo sapiens
tgacaacatttttgtacattatg

SEQ ID NO: 6487567 - DNA, 23 bp, Homo sapiens
tgacaaccaccgctccccagccc

SEQ ID NO: 6487568 - DNA, 16 bp, Homo sapiens
tgacaaccattaaagt

SEQ ID NO: 6487569 - DNA, 12 bp, Homo sapiens
tggcctgactgg

SEQ ID NO: 6487570 - DNA, 15 bp, Homo sapiens
tggcctgactggttg

SEQ ID NO: 6487571 - DNA, 20 bp, Homo sapiens
tggcctgactggttgtcaga

SEQ ID NO: 6487572 - DNA, 17 bp, Homo sapiens
tggcctgagacagtgcg

SEQ ID NO: 6487573 - DNA, 18 bp, Homo sapiens
tggcctgagatgcaggtg

SEQ ID NO: 6487574 - DNA, 20 bp, Homo sapiens
tggcctgagcatccagacct

SEQ ID NO: 6487575 - DNA, 15 bp, Homo sapiens
tggcctgagcgcagc

SEQ ID NO: 6487576 - DNA, 19 bp, Homo sapiens
tggcctgagcgcagcgcct

SEQ ID NO: 6487577 - DNA, 11 bp, Homo sapiens
tggcctgagct

SEQ ID NO: 6487578 - DNA, 17 bp, Homo sapiens
tggcctgaggacccggc

SEQ ID NO: 6487579 - DNA, 21 bp, Homo sapiens
tggcctgaggtcaatggtgca

SEQ ID NO: 6487580 - DNA, 18 bp, Homo sapiens
tggcctgagtcctggtcc

SEQ ID NO: 6487581 - DNA, 18 bp, Homo sapiens
tggcctgatctctgctcc

SEQ ID NO: 6487582 - DNA, 22 bp, Homo sapiens
tggcctgatctctgctccctgc

SEQ ID NO: 6487583 - DNA, 18 bp, Homo sapiens
tggcctgatcttggctca

SEQ ID NO: 6487584 - DNA, 16 bp, Homo sapiens
tggcctgcaaactggg

SEQ ID NO: 6487585 - DNA, 24 bp, Homo sapiens
tggcctgcacggtgggccttgctg

SEQ ID NO: 6487586 - DNA, 14 bp, Homo sapiens
tggcctgcaggagg

SEQ ID NO: 6487587 - DNA, 22 bp, Homo sapiens
tggcctgccagacactgcgccc

SEQ ID NO: 6487588 - DNA, 16 bp, Homo sapiens
tggcctgccaggctcc

SEQ ID NO: 6487589 - DNA, 13 bp, Homo sapiens
tggcctgcccagc

SEQ ID NO: 6487590 - DNA, 15 bp, Homo sapiens
tggcctgcccagcct

SEQ ID NO: 6487591 - DNA, 18 bp, Homo sapiens
tggcctgccccagctctc

SEQ ID NO: 6487592 - DNA, 13 bp, Homo sapiens
tggcctgcccgtg

SEQ ID NO: 6487593 - DNA, 16 bp, Homo sapiens
tggcctgcccgtgccc

SEQ ID NO: 6487594 - DNA, 14 bp, Homo sapiens
tggcctgcctccca

SEQ ID NO: 6487595 - DNA, 20 bp, Homo sapiens
tggcctgcgcctgcacctgc

SEQ ID NO: 6487596 - DNA, 20 bp, Homo sapiens
tggcctgcggccgggctgcc

SEQ ID NO: 6487597 - DNA, 22 bp, Homo sapiens
tggcctgcggccgggctgccct

SEQ ID NO: 6487598 - DNA, 18 bp, Homo sapiens
tggcctgcggtggaggga

SEQ ID NO: 6487599 - DNA, 22 bp, Homo sapiens
tggcctgctagcggctgaacag

SEQ ID NO: 6487600 - DNA, 15 bp, Homo sapiens
tggcctgctgcgccc

SEQ ID NO: 6487601 - DNA, 21 bp, Homo sapiens
tggcctgctgggctctccacc

SEQ ID NO: 6487602 - DNA, 22 bp, Homo sapiens
tggcctgctgggctctccacct

SEQ ID NO: 6487603 - DNA, 17 bp, Homo sapiens
tggcctgctgggcttgg

SEQ ID NO: 6487604 - DNA, 11 bp, Homo sapiens
tggcctggaca

SEQ ID NO: 6487605 - DNA, 16 bp, Homo sapiens
tggcctggaccattcc

SEQ ID NO: 6487606 - DNA, 21 bp, Homo sapiens
tggcctggaggctcagcccac

SEQ ID NO: 6487607 - DNA, 18 bp, Homo sapiens
tggcctggagggactttt

SEQ ID NO: 6487608 - DNA, 16 bp, Homo sapiens
tggcctggaggtgggg

SEQ ID NO: 6487609 - DNA, 18 bp, Homo sapiens
tggcctggatccatcctg

SEQ ID NO: 6487610 - DNA, 24 bp, Homo sapiens
tggcctggatccatcctgctagca

SEQ ID NO: 6487611 - DNA, 14 bp, Homo sapiens
tggcctggatctcc

SEQ ID NO: 6487612 - DNA, 12 bp, Homo sapiens
tggcctggcacg

SEQ ID NO: 6487613 - DNA, 15 bp, Homo sapiens
tggcctggcatctgt

SEQ ID NO: 6487614 - DNA, 16 bp, Homo sapiens
tggcctggcatctgtg

SEQ ID NO: 6487615 - DNA, 17 bp, Homo sapiens
tggcctggcatctgtgt

SEQ ID NO: 6487616 - DNA, 10 bp, Homo sapiens
tggcctggcc

SEQ ID NO: 6487617 - DNA, 15 bp, Homo sapiens
tggcctggccagacc

SEQ ID NO: 6487618 - DNA, 15 bp, Homo sapiens
tggcctggccaggag

SEQ ID NO: 6487619 - DNA, 13 bp, Homo sapiens
tggcctggccagt

SEQ ID NO: 6487620 - DNA, 14 bp, Homo sapiens
tggcctggccagtg

SEQ ID NO: 6487621 - DNA, 19 bp, Homo sapiens
tggcctggccatttccaag

SEQ ID NO: 6487622 - DNA, 12 bp, Homo sapiens
tggcctggcccc

SEQ ID NO: 6487623 - DNA, 13 bp, Homo sapiens
tggcctggccctg

SEQ ID NO: 6487624 - DNA, 14 bp, Homo sapiens
tggcctggccctgc

SEQ ID NO: 6487625 - DNA, 16 bp, Homo sapiens
tggcctggccctgccc

SEQ ID NO: 6487626 - DNA, 14 bp, Homo sapiens
tggcctggcctggc

SEQ ID NO: 6487627 - DNA, 17 bp, Homo sapiens
tggcctggcctggccct

SEQ ID NO: 6487628 - DNA, 14 bp, Homo sapiens
tggcctggctccgc

SEQ ID NO: 6487629 - DNA, 19 bp, Homo sapiens
tggcctgggaaaagggcag

SEQ ID NO: 6487630 - DNA, 13 bp, Homo sapiens
tggcctgggagag

SEQ ID NO: 6487631 - DNA, 13 bp, Homo sapiens
tggcctgggccac

SEQ ID NO: 6487632 - DNA, 15 bp, Homo sapiens
tggcctgggccacac

SEQ ID NO: 6487633 - DNA, 18 bp, Homo sapiens
tggcctgggccacacctg

SEQ ID NO: 6487634 - DNA, 17 bp, Homo sapiens
tggcctgggcttggccc

SEQ ID NO: 6487635 - DNA, 13 bp, Homo sapiens
tggcctgggggct

SEQ ID NO: 6487636 - DNA, 18 bp, Homo sapiens
tggcctgggtcctcggcc

SEQ ID NO: 6487637 - DNA, 17 bp, Homo sapiens
tggcctgggtctccctg

SEQ ID NO: 6487638 - DNA, 16 bp, Homo sapiens
tggcctggtaggtctg

SEQ ID NO: 6487639 - DNA, 18 bp, Homo sapiens
tggcctggtaggtctgga

SEQ ID NO: 6487640 - DNA, 15 bp, Homo sapiens
tggcctggtccaggc

SEQ ID NO: 6487641 - DNA, 15 bp, Homo sapiens
tggcctggtccctgg

SEQ ID NO: 6487642 - DNA, 22 bp, Homo sapiens
tggcctggtgggtcagggggag

SEQ ID NO: 6487643 - DNA, 16 bp, Homo sapiens
tggcctggttcaattt

SEQ ID NO: 6487644 - DNA, 19 bp, Homo sapiens
tggcctggtttcctcgaga

SEQ ID NO: 6487645 - DNA, 19 bp, Homo sapiens
tggcctgtagaatagcctg

SEQ ID NO: 6487646 - DNA, 23 bp, Homo sapiens
tggcctgtagaatagcctgtggc

SEQ ID NO: 6487647 - DNA, 18 bp, Homo sapiens
tggcctgtcagagcttga

SEQ ID NO: 6487648 - DNA, 14 bp, Homo sapiens
tggcctgtccctag

SEQ ID NO: 6487649 - DNA, 16 bp, Homo sapiens
tggcctgtctcatccc

SEQ ID NO: 6487650 - DNA, 22 bp, Homo sapiens
tggcctgtctctattagctggg

SEQ ID NO: 6487651 - DNA, 20 bp, Homo sapiens
tggcctgtgagcaagagcca

SEQ ID NO: 6487652 - DNA, 15 bp, Homo sapiens
tggcctgtgatgttt

SEQ ID NO: 6487653 - DNA, 17 bp, Homo sapiens
tggcctgtgatgtttta

SEQ ID NO: 6487654 - DNA, 12 bp, Homo sapiens
tggcctgtgctt

SEQ ID NO: 6487655 - DNA, 22 bp, Homo sapiens
tggcctgtgcttggaggcctca

SEQ ID NO: 6487656 - DNA, 20 bp, Homo sapiens
tggcctgtggcacagccctg

SEQ ID NO: 6487657 - DNA, 16 bp, Homo sapiens
tggcctgtggcaggcc

SEQ ID NO: 6487658 - DNA, 13 bp, Homo sapiens
tggcctgtgtcca

SEQ ID NO: 6487659 - DNA, 14 bp, Homo sapiens
tggcctgtgtccca

SEQ ID NO: 6487660 - DNA, 18 bp, Homo sapiens
tggcctgtgtctggcccc

SEQ ID NO: 6487661 - DNA, 22 bp, Homo sapiens
tggcctgtgtggccacttctgt

SEQ ID NO: 6487662 - DNA, 23 bp, Homo sapiens
tggcctgttcaacaatcagtcat

SEQ ID NO: 6487663 - DNA, 15 bp, Homo sapiens
tggcctgttccctag

SEQ ID NO: 6487664 - DNA, 16 bp, Homo sapiens
tggcctgttctgtagg

SEQ ID NO: 6487665 - DNA, 18 bp, Homo sapiens
tggcctgttctgtaggag

SEQ ID NO: 6487666 - DNA, 16 bp, Homo sapiens
tggcctgtttgatgta

SEQ ID NO: 6487667 - DNA, 21 bp, Homo sapiens
tggcctgtttgatgtatgtgt

SEQ ID NO: 6487668 - DNA, 23 bp, Homo sapiens
tggcctgttttagaaggttctct

SEQ ID NO: 6487669 - DNA, 23 bp, Homo sapiens
tggccttaaaaggggcccaagcc

SEQ ID NO: 6487670 - DNA, 16 bp, Homo sapiens
tggccttaaagaggga

SEQ ID NO: 6487671 - DNA, 17 bp, Homo sapiens
tggccttaactggccct

SEQ ID NO: 6487672 - DNA, 20 bp, Homo sapiens
tggccttaactggccctcgg

SEQ ID NO: 6487673 - DNA, 23 bp, Homo sapiens
tggccttaagaactgtgtctggc

SEQ ID NO: 6487674 - DNA, 14 bp, Homo sapiens
tggccttaagtctt

SEQ ID NO: 6487675 - DNA, 21 bp, Homo sapiens
tggccttaagtctttttgaag

SEQ ID NO: 6487676 - DNA, 18 bp, Homo sapiens
tggccttacaataccgta

SEQ ID NO: 6487677 - DNA, 16 bp, Homo sapiens
tggccttacccctgcc

SEQ ID NO: 6487678 - DNA, 18 bp, Homo sapiens
tggccttatggatttgga

SEQ ID NO: 6487679 - DNA, 13 bp, Homo sapiens
tggccttccccag

SEQ ID NO: 6487680 - DNA, 21 bp, Homo sapiens
tggccttccccttttgcctgg

SEQ ID NO: 6487681 - DNA, 18 bp, Homo sapiens
tggccttccctccccaca

SEQ ID NO: 6487682 - DNA, 23 bp, Homo sapiens
tggccttcgtctccatctctggt

SEQ ID NO: 6487683 - DNA, 14 bp, Homo sapiens
tggccttctaggaa

SEQ ID NO: 6487684 - DNA, 22 bp, Homo sapiens
tggccttctcctacttagggaa

SEQ ID NO: 6487685 - DNA, 13 bp, Homo sapiens
tggccttctgctg

SEQ ID NO: 6487686 - DNA, 18 bp, Homo sapiens
tggccttctgctgcccag

SEQ ID NO: 6487687 - DNA, 18 bp, Homo sapiens
tggccttgaaaccacctt

SEQ ID NO: 6487688 - DNA, 13 bp, Homo sapiens
tggccttgaagtg

SEQ ID NO: 6487689 - DNA, 14 bp, Homo sapiens
tggccttgaagtgt

SEQ ID NO: 6487690 - DNA, 13 bp, Homo sapiens
tggccttgcagct

SEQ ID NO: 6487691 - DNA, 21 bp, Homo sapiens
tggccttgccccaggccctgc

SEQ ID NO: 6487692 - DNA, 21 bp, Homo sapiens
tggccttgcccgccagcctca

SEQ ID NO: 6487693 - DNA, 22 bp, Homo sapiens
tggccttgcccgccagcctcag

SEQ ID NO: 6487694 - DNA, 16 bp, Homo sapiens
tggccttgcctccagg

SEQ ID NO: 6487695 - DNA, 22 bp, Homo sapiens
tggccttgctcttctccttgat

SEQ ID NO: 6487696 - DNA, 13 bp, Homo sapiens
tggccttggcatg

SEQ ID NO: 6487697 - DNA, 21 bp, Homo sapiens
tggccttggcttttctagcct

SEQ ID NO: 6487698 - DNA, 13 bp, Homo sapiens
tggccttgggagg

SEQ ID NO: 6487699 - DNA, 18 bp, Homo sapiens
tggccttgggccctctgg

SEQ ID NO: 6487700 - DNA, 17 bp, Homo sapiens
tggccttggtatgtgcc

SEQ ID NO: 6487701 - DNA, 18 bp, Homo sapiens
tggccttggtatgtgcca

SEQ ID NO: 6487702 - DNA, 19 bp, Homo sapiens
tggccttggtatgtgccag

SEQ ID NO: 6487703 - DNA, 22 bp, Homo sapiens
tggccttggtatgtgccaggct

SEQ ID NO: 6487704 - DNA, 14 bp, Homo sapiens
tggccttggtcctt

SEQ ID NO: 6487705 - DNA, 18 bp, Homo sapiens
tggccttggttcctccag

SEQ ID NO: 6487706 - DNA, 14 bp, Homo sapiens
tggccttgtacttg

SEQ ID NO: 6487707 - DNA, 16 bp, Homo sapiens
tggccttgtcaggacc

SEQ ID NO: 6487708 - DNA, 21 bp, Homo sapiens
tggccttgtcaggacccaggc

SEQ ID NO: 6487709 - DNA, 22 bp, Homo sapiens
tggccttgtcaggacccaggcc

SEQ ID NO: 6487710 - DNA, 23 bp, Homo sapiens
tggccttgtccccagctccacct

SEQ ID NO: 6487711 - DNA, 20 bp, Homo sapiens
tggccttgtcctcagccagt

SEQ ID NO: 6487712 - DNA, 16 bp, Homo sapiens
tggccttgtggtccaa

SEQ ID NO: 6487713 - DNA, 22 bp, Homo sapiens
tggccttgttctctctatggta

SEQ ID NO: 6487714 - DNA, 17 bp, Homo sapiens
tggcctttacagaaaat

SEQ ID NO: 6487715 - DNA, 19 bp, Homo sapiens
tggcctttatgttctttca

SEQ ID NO: 6487716 - DNA, 14 bp, Homo sapiens
tggcctttcacttt

SEQ ID NO: 6487717 - DNA, 20 bp, Homo sapiens
tggcctttcatattttagct

SEQ ID NO: 6487718 - DNA, 12 bp, Homo sapiens
tggcctttcctt

SEQ ID NO: 6487719 - DNA, 14 bp, Homo sapiens
tggcctttccttcc

SEQ ID NO: 6487720 - DNA, 21 bp, Homo sapiens
tggcctttccttccctctctg

SEQ ID NO: 6487721 - DNA, 22 bp, Homo sapiens
tggcctttccttccctctctga

SEQ ID NO: 6487722 - DNA, 13 bp, Homo sapiens
tggcctttccttg

SEQ ID NO: 6487723 - DNA, 19 bp, Homo sapiens
tggcctttccttgtatgtg

SEQ ID NO: 6487724 - DNA, 18 bp, Homo sapiens
tggcctttgcttatgaat

SEQ ID NO: 6487725 - DNA, 21 bp, Homo sapiens
tggcctttgcttatgaatatt

SEQ ID NO: 6487726 - DNA, 23 bp, Homo sapiens
tggcctttggacccagggcctga

SEQ ID NO: 6487727 - DNA, 13 bp, Homo sapiens
tggccttttccta

SEQ ID NO: 6487728 - DNA, 20 bp, Homo sapiens
tggccttttgctacgtgcct

SEQ ID NO: 6487729 - DNA, 21 bp, Homo sapiens
tggccttttgctacgtgcctc

SEQ ID NO: 6487730 - DNA, 18 bp, Homo sapiens
tggccttttttataacta

SEQ ID NO: 6487731 - DNA, 14 bp, Homo sapiens
tggcgaagcctgag

SEQ ID NO: 6487732 - DNA, 15 bp, Homo sapiens
tggcgaagcctgagc

SEQ ID NO: 6487733 - DNA, 21 bp, Homo sapiens
tggcgaagcctgagcaggcag

SEQ ID NO: 6487734 - DNA, 23 bp, Homo sapiens
tggcgaagcctgagcaggcaggg

SEQ ID NO: 6487735 - DNA, 20 bp, Homo sapiens
tggcgacactcagggcagct

SEQ ID NO: 6487736 - DNA, 19 bp, Homo sapiens
tggcgactctgcagagtca

SEQ ID NO: 6487737 - DNA, 13 bp, Homo sapiens
tggcgagaggaga

SEQ ID NO: 6487738 - DNA, 19 bp, Homo sapiens
tggcgagccatttgtccca

SEQ ID NO: 6487739 - DNA, 12 bp, Homo sapiens
tggcgagccctt

SEQ ID NO: 6487740 - DNA, 22 bp, Homo sapiens
tggcgaggcctctctcaggagc

SEQ ID NO: 6487741 - DNA, 16 bp, Homo sapiens
tggcgagtccagacac

SEQ ID NO: 6487742 - DNA, 19 bp, Homo sapiens
tggcgagtgaatgccagtg

SEQ ID NO: 6487743 - DNA, 23 bp, Homo sapiens
tggcgatctcccagggctctctg

SEQ ID NO: 6487744 - DNA, 13 bp, Homo sapiens
tggcgatgccagc

SEQ ID NO: 6487745 - DNA, 19 bp, Homo sapiens
tggcgatgccagccaagct

SEQ ID NO: 6487746 - DNA, 17 bp, Homo sapiens
tggcgatggggactctg

SEQ ID NO: 6487747 - DNA, 17 bp, Homo sapiens
tggcgattccctctcac

SEQ ID NO: 6487748 - DNA, 16 bp, Homo sapiens
tgacaacctagaatgt

SEQ ID NO: 6487749 - DNA, 16 bp, Homo sapiens
tgacaacctttgtgta

SEQ ID NO: 6487750 - DNA, 21 bp, Homo sapiens
tgacaacctttgtgtaataaa

SEQ ID NO: 6487751 - DNA, 16 bp, Homo sapiens
tgacaacgaaagtaaa

SEQ ID NO: 6487752 - DNA, 20 bp, Homo sapiens
tgacaactcattttcatatt

SEQ ID NO: 6487753 - DNA, 21 bp, Homo sapiens
tgacaactgcacatgaaagtt

SEQ ID NO: 6487754 - DNA, 15 bp, Homo sapiens
tgacaactggcaggc

SEQ ID NO: 6487755 - DNA, 21 bp, Homo sapiens
tgacaactgtctaactttaga

SEQ ID NO: 6487756 - DNA, 12 bp, Homo sapiens
tgacaactgtga

SEQ ID NO: 6487757 - DNA, 15 bp, Homo sapiens
tgacaactgtgaagc

SEQ ID NO: 6487758 - DNA, 22 bp, Homo sapiens
tgacaacttctaattgccatgt

SEQ ID NO: 6487759 - DNA, 22 bp, Homo sapiens
tgacaagaaaggctgctgtact

SEQ ID NO: 6487760 - DNA, 23 bp, Homo sapiens
tgacaagaatggaatagaaatgt

SEQ ID NO: 6487761 - DNA, 21 bp, Homo sapiens
tgacaagagttggggacagaa

SEQ ID NO: 6487762 - DNA, 19 bp, Homo sapiens
tgacaagatggaaaataaa

SEQ ID NO: 6487763 - DNA, 13 bp, Homo sapiens
tgacaagatggga

SEQ ID NO: 6487764 - DNA, 21 bp, Homo sapiens
tgacaagatgggacagcaaca

SEQ ID NO: 6487765 - DNA, 13 bp, Homo sapiens
tgacaagcagata

SEQ ID NO: 6487766 - DNA, 23 bp, Homo sapiens
tgacaagcatcagtagctgagtg

SEQ ID NO: 6487767 - DNA, 13 bp, Homo sapiens
tgacaagccccag

SEQ ID NO: 6487768 - DNA, 19 bp, Homo sapiens
tgacaagcctcagcaaacc

SEQ ID NO: 6487769 - DNA, 22 bp, Homo sapiens
tgacaagctcctggtcttgaga

SEQ ID NO: 6487770 - DNA, 18 bp, Homo sapiens
tgacaagctgacttggca

SEQ ID NO: 6487771 - DNA, 17 bp, Homo sapiens
tgacaagctggccaaag

SEQ ID NO: 6487772 - DNA, 16 bp, Homo sapiens
tgacaagctgtatcac

SEQ ID NO: 6487773 - DNA, 13 bp, Homo sapiens
tgacaaggaaaat

SEQ ID NO: 6487774 - DNA, 14 bp, Homo sapiens
tgacaaggccccag

SEQ ID NO: 6487775 - DNA, 18 bp, Homo sapiens
tgacaaggccccagagac

SEQ ID NO: 6487776 - DNA, 15 bp, Homo sapiens
tgacaaggcctgctt

SEQ ID NO: 6487777 - DNA, 21 bp, Homo sapiens
tgacaagggctgacctgcctc

SEQ ID NO: 6487778 - DNA, 19 bp, Homo sapiens
tgacaaggtgtgcagtggc

SEQ ID NO: 6487779 - DNA, 21 bp, Homo sapiens
tgacaagtgacttatttgctc

SEQ ID NO: 6487780 - DNA, 13 bp, Homo sapiens
tgacaagtggagg

SEQ ID NO: 6487781 - DNA, 13 bp, Homo sapiens
tgacaagtgtgtc

SEQ ID NO: 6487782 - DNA, 20 bp, Homo sapiens
tgacaataaaaatgttttga

SEQ ID NO: 6487783 - DNA, 12 bp, Homo sapiens
tgacaataaaac

SEQ ID NO: 6487784 - DNA, 14 bp, Homo sapiens
tgacaataaaacat

SEQ ID NO: 6487785 - DNA, 15 bp, Homo sapiens
tgacaataaaatatt

SEQ ID NO: 6487786 - DNA, 15 bp, Homo sapiens
tgacaataaagcttg

SEQ ID NO: 6487787 - DNA, 22 bp, Homo sapiens
tgacaataaaggaactaatcct

SEQ ID NO: 6487788 - DNA, 13 bp, Homo sapiens
tgacaataaattt

SEQ ID NO: 6487789 - DNA, 20 bp, Homo sapiens
tgacaataatattgttgtat

SEQ ID NO: 6487790 - DNA, 17 bp, Homo sapiens
tgacaataatttcaggt

SEQ ID NO: 6487791 - DNA, 23 bp, Homo sapiens
tgacaatactgtatcagatgtga

SEQ ID NO: 6487792 - DNA, 19 bp, Homo sapiens
tgacaatagaagaaataat

SEQ ID NO: 6487793 - DNA, 17 bp, Homo sapiens
tgacaatagttatgcct

SEQ ID NO: 6487794 - DNA, 23 bp, Homo sapiens
tgacaatagttatgcctgtacta

SEQ ID NO: 6487795 - DNA, 15 bp, Homo sapiens
tgacaatcaactcta

SEQ ID NO: 6487796 - DNA, 14 bp, Homo sapiens
tgacaatcatctcc

SEQ ID NO: 6487797 - DNA, 13 bp, Homo sapiens
tgacaatcatgtg

SEQ ID NO: 6487798 - DNA, 15 bp, Homo sapiens
tgacaatcatgtgtg

SEQ ID NO: 6487799 - DNA, 18 bp, Homo sapiens
tgacaatctaccaactgt

SEQ ID NO: 6487800 - DNA, 20 bp, Homo sapiens
tgacaatgactaagccaagc

SEQ ID NO: 6487801 - DNA, 21 bp, Homo sapiens
tgacaatgactaagccaagct

SEQ ID NO: 6487802 - DNA, 13 bp, Homo sapiens
tgacaatgatgat

SEQ ID NO: 6487803 - DNA, 22 bp, Homo sapiens
tgacaatgcgtggcacatctaa

SEQ ID NO: 6487804 - DNA, 16 bp, Homo sapiens
tgacaatggcagctag

SEQ ID NO: 6487805 - DNA, 13 bp, Homo sapiens
tgacaatgttgta

SEQ ID NO: 6487806 - DNA, 15 bp, Homo sapiens
tgacaatgttgtcct

SEQ ID NO: 6487807 - DNA, 18 bp, Homo sapiens
tgacaattactcaggttt

SEQ ID NO: 6487808 - DNA, 14 bp, Homo sapiens
tgacaattatgaaa

SEQ ID NO: 6487809 - DNA, 23 bp, Homo sapiens
tgacaattcctagataaaaagat

SEQ ID NO: 6487810 - DNA, 12 bp, Homo sapiens
tgacaattctgc

SEQ ID NO: 6487811 - DNA, 17 bp, Homo sapiens
tgacaattctgggtgcg

SEQ ID NO: 6487812 - DNA, 17 bp, Homo sapiens
tgacaattctgttttta

SEQ ID NO: 6487813 - DNA, 14 bp, Homo sapiens
tgacaattgggagc

SEQ ID NO: 6487814 - DNA, 13 bp, Homo sapiens
tgacaattgtcac

SEQ ID NO: 6487815 - DNA, 15 bp, Homo sapiens
tgacaatttatggaa

SEQ ID NO: 6487816 - DNA, 17 bp, Homo sapiens
tgacaatttcaaaatgc

SEQ ID NO: 6487817 - DNA, 19 bp, Homo sapiens
tgacaatttcaaaatgcat

SEQ ID NO: 6487818 - DNA, 20 bp, Homo sapiens
tgacaatttcaaaatgcatg

SEQ ID NO: 6487819 - DNA, 21 bp, Homo sapiens
tgacaattttacctattctga

SEQ ID NO: 6487820 - DNA, 22 bp, Homo sapiens
tgacaattttacctattctgaa

SEQ ID NO: 6487821 - DNA, 17 bp, Homo sapiens
tgacaattttgtcttaa

SEQ ID NO: 6487822 - DNA, 18 bp, Homo sapiens
tgacaattttgtcttaag

SEQ ID NO: 6487823 - DNA, 16 bp, Homo sapiens
tgacacaaacctgcct

SEQ ID NO: 6487824 - DNA, 19 bp, Homo sapiens
tgacacaaacctgcctggg

SEQ ID NO: 6487825 - DNA, 14 bp, Homo sapiens
tgacacaaagcttc

SEQ ID NO: 6487826 - DNA, 19 bp, Homo sapiens
tgacacaaagcttctaaag

SEQ ID NO: 6487827 - DNA, 15 bp, Homo sapiens
tgacacaaaggaagt

SEQ ID NO: 6487828 - DNA, 14 bp, Homo sapiens
tgacacaaaggtgg

SEQ ID NO: 6487829 - DNA, 16 bp, Homo sapiens
tgacacaaaggtggaa

SEQ ID NO: 6487830 - DNA, 12 bp, Homo sapiens
tgacacaaattg

SEQ ID NO: 6487831 - DNA, 17 bp, Homo sapiens
tgacacaagtggacctt

SEQ ID NO: 6487832 - DNA, 19 bp, Homo sapiens
tgacacaagtggaccttag

SEQ ID NO: 6487833 - DNA, 20 bp, Homo sapiens
tgacacaagtgtattatttc

SEQ ID NO: 6487834 - DNA, 18 bp, Homo sapiens
tgacacaatctcagctca

SEQ ID NO: 6487835 - DNA, 18 bp, Homo sapiens
tgacacaatggtagctct

SEQ ID NO: 6487836 - DNA, 20 bp, Homo sapiens
tgacacaatggtagctctga

SEQ ID NO: 6487837 - DNA, 13 bp, Homo sapiens
tgacacacagaaa

SEQ ID NO: 6487838 - DNA, 14 bp, Homo sapiens
tgacacacagcact

SEQ ID NO: 6487839 - DNA, 15 bp, Homo sapiens
tgacacacagcactc

SEQ ID NO: 6487840 - DNA, 16 bp, Homo sapiens
tgacacacagcactct

SEQ ID NO: 6487841 - DNA, 13 bp, Homo sapiens
tgacacacagcag

SEQ ID NO: 6487842 - DNA, 14 bp, Homo sapiens
tgacacacagcagc

SEQ ID NO: 6487843 - DNA, 14 bp, Homo sapiens
tgacacacagctct

SEQ ID NO: 6487844 - DNA, 18 bp, Homo sapiens
tgacacacagctctgtcc

SEQ ID NO: 6487845 - DNA, 21 bp, Homo sapiens
tgacacacagctctgtcctgg

SEQ ID NO: 6487846 - DNA, 15 bp, Homo sapiens
tgacacactacacca

SEQ ID NO: 6487847 - DNA, 21 bp, Homo sapiens
tgacacactacaccacacaca

SEQ ID NO: 6487848 - DNA, 22 bp, Homo sapiens
tgacacactacaccacacacaa

SEQ ID NO: 6487849 - DNA, 18 bp, Homo sapiens
tgacacactcaccattta

SEQ ID NO: 6487850 - DNA, 17 bp, Homo sapiens
tgacacagaagccccac

SEQ ID NO: 6487851 - DNA, 22 bp, Homo sapiens
tgacacagacattttgtgtgag

SEQ ID NO: 6487852 - DNA, 13 bp, Homo sapiens
tgacacagactca

SEQ ID NO: 6487853 - DNA, 22 bp, Homo sapiens
tgacacagactcatcctgaaca

SEQ ID NO: 6487854 - DNA, 16 bp, Homo sapiens
tgacacaggaaaccaa

SEQ ID NO: 6487855 - DNA, 16 bp, Homo sapiens
tgacacaggatgaagg

SEQ ID NO: 6487856 - DNA, 21 bp, Homo sapiens
tgacacaggccagccccatct

SEQ ID NO: 6487857 - DNA, 23 bp, Homo sapiens
tgacacaggccagccccatcttg

SEQ ID NO: 6487858 - DNA, 19 bp, Homo sapiens
tgacacaggggacactgaa

SEQ ID NO: 6487859 - DNA, 21 bp, Homo sapiens
tgacacaggtcagggctcaga

SEQ ID NO: 6487860 - DNA, 23 bp, Homo sapiens
tgacacaggtcagggctcagagt

SEQ ID NO: 6487861 - DNA, 16 bp, Homo sapiens
tgacacaggtctttcc

SEQ ID NO: 6487862 - DNA, 15 bp, Homo sapiens
tgacacagtcagcat

SEQ ID NO: 6487863 - DNA, 23 bp, Homo sapiens
tgacacagtcttggctcactgca

SEQ ID NO: 6487864 - DNA, 21 bp, Homo sapiens
tgacacataaaagtaattaat

SEQ ID NO: 6487865 - DNA, 22 bp, Homo sapiens
tgacacataaatctgtctgatt

SEQ ID NO: 6487866 - DNA, 17 bp, Homo sapiens
tgacacatagtttttca

SEQ ID NO: 6487867 - DNA, 12 bp, Homo sapiens
tgacacatcagc

SEQ ID NO: 6487868 - DNA, 17 bp, Homo sapiens
tgacacatcagcatgtt

SEQ ID NO: 6487869 - DNA, 21 bp, Homo sapiens
tgacacatcagcatgttttct

SEQ ID NO: 6487870 - DNA, 17 bp, Homo sapiens
tgacacatcgttttggg

SEQ ID NO: 6487871 - DNA, 22 bp, Homo sapiens
tgacacatgctctcaatatata

SEQ ID NO: 6487872 - DNA, 22 bp, Homo sapiens
tgacacatggcccctccccctg

SEQ ID NO: 6487873 - DNA, 17 bp, Homo sapiens
tgacacattaatgataa

SEQ ID NO: 6487874 - DNA, 17 bp, Homo sapiens
tgacacattctcttttt

SEQ ID NO: 6487875 - DNA, 17 bp, Homo sapiens
tgacaccaaaatgaacc

SEQ ID NO: 6487876 - DNA, 18 bp, Homo sapiens
tgacaccaaatattttca

SEQ ID NO: 6487877 - DNA, 23 bp, Homo sapiens
tgacaccaaccagacagcacagg

SEQ ID NO: 6487878 - DNA, 17 bp, Homo sapiens
tgacaccaataaatgtt

SEQ ID NO: 6487879 - DNA, 23 bp, Homo sapiens
tgacaccacacttgttttctttg

SEQ ID NO: 6487880 - DNA, 16 bp, Homo sapiens
tgacaccaccactgtg

SEQ ID NO: 6487881 - DNA, 20 bp, Homo sapiens
tgacaccaccactgtgtccc

SEQ ID NO: 6487882 - DNA, 22 bp, Homo sapiens
tgacaccacgctggagctgtgt

SEQ ID NO: 6487883 - DNA, 24 bp, Homo sapiens
tgacaccagctgttctgtcccttg

SEQ ID NO: 6487884 - DNA, 16 bp, Homo sapiens
tgacaccaggcaagaa

SEQ ID NO: 6487885 - DNA, 15 bp, Homo sapiens
tgacaccagggccag

SEQ ID NO: 6487886 - DNA, 17 bp, Homo sapiens
tgacaccattctcctgc

SEQ ID NO: 6487887 - DNA, 21 bp, Homo sapiens
tgacacccacaatcccaccta

SEQ ID NO: 6487888 - DNA, 23 bp, Homo sapiens
tgacacccacaatcccacctagc

SEQ ID NO: 6487889 - DNA, 24 bp, Homo sapiens
tgacacccacaatcccacctagcc

SEQ ID NO: 6487890 - DNA, 14 bp, Homo sapiens
tgacacccaccctg

SEQ ID NO: 6487891 - DNA, 14 bp, Homo sapiens
tgacacccaggctg

SEQ ID NO: 6487892 - DNA, 17 bp, Homo sapiens
tgacaccccccttctga

SEQ ID NO: 6487893 - DNA, 18 bp, Homo sapiens
tgacaccccccttctgaa

SEQ ID NO: 6487894 - DNA, 16 bp, Homo sapiens
tgacaccccctccccg

SEQ ID NO: 6487895 - DNA, 17 bp, Homo sapiens
tgacacccctggcctga

SEQ ID NO: 6487896 - DNA, 22 bp, Homo sapiens
tgacacccgtgagcgcctgtgc

SEQ ID NO: 6487897 - DNA, 15 bp, Homo sapiens
tgacaccctggcctg

SEQ ID NO: 6487898 - DNA, 17 bp, Homo sapiens
tgacaccctggtcctga

SEQ ID NO: 6487899 - DNA, 18 bp, Homo sapiens
tgacaccgtcgaccagga

SEQ ID NO: 6487900 - DNA, 15 bp, Homo sapiens
tgacacctaactctt

SEQ ID NO: 6487901 - DNA, 18 bp, Homo sapiens
tgacacctaccatgctgc

SEQ ID NO: 6487902 - DNA, 20 bp, Homo sapiens
tgacacctaccatgctgctt

SEQ ID NO: 6487903 - DNA, 15 bp, Homo sapiens
tgacacctccccctt

SEQ ID NO: 6487904 - DNA, 17 bp, Homo sapiens
tgacacctcttttttcg

SEQ ID NO: 6487905 - DNA, 19 bp, Homo sapiens
tgacacctgccgctgcttg

SEQ ID NO: 6487906 - DNA, 18 bp, Homo sapiens
tgacacctggtgcgggcc

SEQ ID NO: 6487907 - DNA, 23 bp, Homo sapiens
tgacacctggtgcgggcctggcc

SEQ ID NO: 6487908 - DNA, 17 bp, Homo sapiens
tgacacctttaaaaagc

SEQ ID NO: 6487909 - DNA, 18 bp, Homo sapiens
tgacacctttgcaggcat

SEQ ID NO: 6487910 - DNA, 21 bp, Homo sapiens
tgacacgacttctgtttcaca

SEQ ID NO: 6487911 - DNA, 19 bp, Homo sapiens
tgacacgcctaaggtcaca

SEQ ID NO: 6487912 - DNA, 16 bp, Homo sapiens
tgacacgcttctgagc

SEQ ID NO: 6487913 - DNA, 17 bp, Homo sapiens
tgacacgcttctgagca

SEQ ID NO: 6487914 - DNA, 23 bp, Homo sapiens
tgacacggggatcatctctgtga

SEQ ID NO: 6487915 - DNA, 16 bp, Homo sapiens
tgacacggtagcacca

SEQ ID NO: 6487916 - DNA, 18 bp, Homo sapiens
tgacacggtaggccaagc

SEQ ID NO: 6487917 - DNA, 23 bp, Homo sapiens
tgacacggtaggccaagctgaag

SEQ ID NO: 6487918 - DNA, 18 bp, Homo sapiens
tgacacggtgaaatccag

SEQ ID NO: 6487919 - DNA, 20 bp, Homo sapiens
tgacacggtgaaatccaggt

SEQ ID NO: 6487920 - DNA, 15 bp, Homo sapiens
tgacactaagaaaat

SEQ ID NO: 6487921 - DNA, 18 bp, Homo sapiens
tgacactatagtttaaaa

SEQ ID NO: 6487922 - DNA, 20 bp, Homo sapiens
tgacactatagtttaaaaca

SEQ ID NO: 6487923 - DNA, 17 bp, Homo sapiens
tgacactatatctgtat

SEQ ID NO: 6487924 - DNA, 22 bp, Homo sapiens
tgacactatatctgtatataaa

SEQ ID NO: 6487925 - DNA, 18 bp, Homo sapiens
tggcgattccctctcacc

SEQ ID NO: 6487926 - DNA, 16 bp, Homo sapiens
tggcgcaaggccgagc

SEQ ID NO: 6487927 - DNA, 20 bp, Homo sapiens
tggcgcaaggtcctcttgaa

SEQ ID NO: 6487928 - DNA, 16 bp, Homo sapiens
tggcgcaatctcgcct

SEQ ID NO: 6487929 - DNA, 15 bp, Homo sapiens
tggcgcacccggcag

SEQ ID NO: 6487930 - DNA, 14 bp, Homo sapiens
tggcgcaccctccc

SEQ ID NO: 6487931 - DNA, 18 bp, Homo sapiens
tggcgcaccctcccctcc

SEQ ID NO: 6487932 - DNA, 23 bp, Homo sapiens
tggcgcagcatattcaggaagct

SEQ ID NO: 6487933 - DNA, 13 bp, Homo sapiens
tggcgcagccaag

SEQ ID NO: 6487934 - DNA, 16 bp, Homo sapiens
tggcgcagccaaggcc

SEQ ID NO: 6487935 - DNA, 15 bp, Homo sapiens
tggcgcaggaactca

SEQ ID NO: 6487936 - DNA, 14 bp, Homo sapiens
tggcgcaggtgggc

SEQ ID NO: 6487937 - DNA, 22 bp, Homo sapiens
tggcgcatagtgtgctcggaca

SEQ ID NO: 6487938 - DNA, 18 bp, Homo sapiens
tggcgccaggggcaggca

SEQ ID NO: 6487939 - DNA, 14 bp, Homo sapiens
tggcgcccaggggc

SEQ ID NO: 6487940 - DNA, 17 bp, Homo sapiens
tggcgccccatgggccc

SEQ ID NO: 6487941 - DNA, 15 bp, Homo sapiens
tggcgccccctggtg

SEQ ID NO: 6487942 - DNA, 11 bp, Homo sapiens
tggcgccctgc

SEQ ID NO: 6487943 - DNA, 17 bp, Homo sapiens
tggcgccgcgtggacag

SEQ ID NO: 6487944 - DNA, 19 bp, Homo sapiens
tggcgccgcgtggacagcc

SEQ ID NO: 6487945 - DNA, 21 bp, Homo sapiens
tggcgccgcgtggacagccgg

SEQ ID NO: 6487946 - DNA, 17 bp, Homo sapiens
tggcgcctccgagggac

SEQ ID NO: 6487947 - DNA, 19 bp, Homo sapiens
tggcgcctgctccctccag

SEQ ID NO: 6487948 - DNA, 20 bp, Homo sapiens
tggcgcctgctccctccaga

SEQ ID NO: 6487949 - DNA, 16 bp, Homo sapiens
tggcgcgcctgccttt

SEQ ID NO: 6487950 - DNA, 18 bp, Homo sapiens
tggcgcgggaggcaccag

SEQ ID NO: 6487951 - DNA, 19 bp, Homo sapiens
tggcgcgggaggcaccagc

SEQ ID NO: 6487952 - DNA, 23 bp, Homo sapiens
tggcgcgggaggcaccagctctg

SEQ ID NO: 6487953 - DNA, 13 bp, Homo sapiens
tggcgctaggcat

SEQ ID NO: 6487954 - DNA, 22 bp, Homo sapiens
tggcgctaggggacttggggat

SEQ ID NO: 6487955 - DNA, 16 bp, Homo sapiens
tggcgctcagcagccc

SEQ ID NO: 6487956 - DNA, 15 bp, Homo sapiens
tggcgctctcagctt

SEQ ID NO: 6487957 - DNA, 19 bp, Homo sapiens
tggcgctctcagctttccc

SEQ ID NO: 6487958 - DNA, 23 bp, Homo sapiens
tggcgctgagggtttttctaagt

SEQ ID NO: 6487959 - DNA, 14 bp, Homo sapiens
tggcgctgcccctg

SEQ ID NO: 6487960 - DNA, 16 bp, Homo sapiens
tggcgctgcccctggc

SEQ ID NO: 6487961 - DNA, 12 bp, Homo sapiens
tggcgctgtgcg

SEQ ID NO: 6487962 - DNA, 13 bp, Homo sapiens
tggcgcttagaga

SEQ ID NO: 6487963 - DNA, 20 bp, Homo sapiens
tggcgcttagagaggacaat

SEQ ID NO: 6487964 - DNA, 20 bp, Homo sapiens
tggcgcttggatctggggtg

SEQ ID NO: 6487965 - DNA, 17 bp, Homo sapiens
tggcggaacctggctgc

SEQ ID NO: 6487966 - DNA, 18 bp, Homo sapiens
tggcggaacctggctgcg

SEQ ID NO: 6487967 - DNA, 14 bp, Homo sapiens
tggcggacgcagct

SEQ ID NO: 6487968 - DNA, 15 bp, Homo sapiens
tggcggagatgcttc

SEQ ID NO: 6487969 - DNA, 12 bp, Homo sapiens
tggcggaggcca

SEQ ID NO: 6487970 - DNA, 18 bp, Homo sapiens
tggcggcaaaagcccatt

SEQ ID NO: 6487971 - DNA, 15 bp, Homo sapiens
tggcggcacacatct

SEQ ID NO: 6487972 - DNA, 21 bp, Homo sapiens
tggcggcacgtccttgggcgt

SEQ ID NO: 6487973 - DNA, 14 bp, Homo sapiens
tggcggcagacaca

SEQ ID NO: 6487974 - DNA, 14 bp, Homo sapiens
tggcggcagcagcc

SEQ ID NO: 6487975 - DNA, 15 bp, Homo sapiens
tggcggcagcagcca

SEQ ID NO: 6487976 - DNA, 23 bp, Homo sapiens
tggcggcagcagccatcatagga

SEQ ID NO: 6487977 - DNA, 17 bp, Homo sapiens
tggcggcagggccaggc

SEQ ID NO: 6487978 - DNA, 20 bp, Homo sapiens
tggcggcagggccaggctgg

SEQ ID NO: 6487979 - DNA, 12 bp, Homo sapiens
tggcggcagggg

SEQ ID NO: 6487980 - DNA, 19 bp, Homo sapiens
tggcggcaggggttggcag

SEQ ID NO: 6487981 - DNA, 21 bp, Homo sapiens
tggcggcccctcagcctgcct

SEQ ID NO: 6487982 - DNA, 15 bp, Homo sapiens
tggcggcccggccgg

SEQ ID NO: 6487983 - DNA, 15 bp, Homo sapiens
tggcggcctgcagtg

SEQ ID NO: 6487984 - DNA, 14 bp, Homo sapiens
tggcggcctgtggg

SEQ ID NO: 6487985 - DNA, 16 bp, Homo sapiens
tggcggctactcagca

SEQ ID NO: 6487986 - DNA, 17 bp, Homo sapiens
tggcggctgcacaacag

SEQ ID NO: 6487987 - DNA, 13 bp, Homo sapiens
tggcggcttcctg

SEQ ID NO: 6487988 - DNA, 17 bp, Homo sapiens
tggcgggactggagaaa

SEQ ID NO: 6487989 - DNA, 19 bp, Homo sapiens
tggcgggatgggccaccgc

SEQ ID NO: 6487990 - DNA, 12 bp, Homo sapiens
tggcgggcagcc

SEQ ID NO: 6487991 - DNA, 16 bp, Homo sapiens
tggcgggcagcccctg

SEQ ID NO: 6487992 - DNA, 14 bp, Homo sapiens
tggcgggcccactc

SEQ ID NO: 6487993 - DNA, 19 bp, Homo sapiens
tggcgggccctggagctca

SEQ ID NO: 6487994 - DNA, 17 bp, Homo sapiens
tggcgggcctttttcct

SEQ ID NO: 6487995 - DNA, 14 bp, Homo sapiens
tggcgggcgcctgt

SEQ ID NO: 6487996 - DNA, 19 bp, Homo sapiens
tggcggggaggaggaaatc

SEQ ID NO: 6487997 - DNA, 20 bp, Homo sapiens
tggcgggggcacgtgtgggc

SEQ ID NO: 6487998 - DNA, 18 bp, Homo sapiens
tggcggtgatcagcagag

SEQ ID NO: 6487999 - DNA, 13 bp, Homo sapiens
tggcggtgcctgg

SEQ ID NO: 6488000 - DNA, 18 bp, Homo sapiens
tggcggtgcgtgcctgta

SEQ ID NO: 6488001 - DNA, 21 bp, Homo sapiens
tggcgtaagatgatggatttg

SEQ ID NO: 6488002 - DNA, 16 bp, Homo sapiens
tggcgtaagtacagag

SEQ ID NO: 6488003 - DNA, 16 bp, Homo sapiens
tggcgtaatgggcctg

SEQ ID NO: 6488004 - DNA, 18 bp, Homo sapiens
tggcgtaatgggcctgcc

SEQ ID NO: 6488005 - DNA, 18 bp, Homo sapiens
tggcgtaggctacagaga

SEQ ID NO: 6488006 - DNA, 20 bp, Homo sapiens
tggcgtaggctacagagaag

SEQ ID NO: 6488007 - DNA, 21 bp, Homo sapiens
tggcgtaggctacagagaagc

SEQ ID NO: 6488008 - DNA, 21 bp, Homo sapiens
tggcgtcctctccctcctggc

SEQ ID NO: 6488009 - DNA, 22 bp, Homo sapiens
tggcgtcctctccctcctggcc

SEQ ID NO: 6488010 - DNA, 16 bp, Homo sapiens
tggcgtcctgcccttg

SEQ ID NO: 6488011 - DNA, 20 bp, Homo sapiens
tggcgtctgcctaggagctg

SEQ ID NO: 6488012 - DNA, 13 bp, Homo sapiens
tggcgtctgctct

SEQ ID NO: 6488013 - DNA, 19 bp, Homo sapiens
tggcgtctgctctggtggc

SEQ ID NO: 6488014 - DNA, 20 bp, Homo sapiens
tggcgtctgctctggtggct

SEQ ID NO: 6488015 - DNA, 15 bp, Homo sapiens
tggcgtctgtcttca

SEQ ID NO: 6488016 - DNA, 22 bp, Homo sapiens
tggcgtctgtcttcaagggctt

SEQ ID NO: 6488017 - DNA, 15 bp, Homo sapiens
tggcgtgagctgccc

SEQ ID NO: 6488018 - DNA, 16 bp, Homo sapiens
tggcgtgagctgcccg

SEQ ID NO: 6488019 - DNA, 15 bp, Homo sapiens
tggcgtgctcagacc

SEQ ID NO: 6488020 - DNA, 13 bp, Homo sapiens
tggcgtggaggag

SEQ ID NO: 6488021 - DNA, 17 bp, Homo sapiens
tggcgtggcccgtggcc

SEQ ID NO: 6488022 - DNA, 12 bp, Homo sapiens
tggcgtggcctc

SEQ ID NO: 6488023 - DNA, 17 bp, Homo sapiens
tggcgtgggagccagcc

SEQ ID NO: 6488024 - DNA, 13 bp, Homo sapiens
tggcgtgtcccag

SEQ ID NO: 6488025 - DNA, 17 bp, Homo sapiens
tggcgttgtgggcaggc

SEQ ID NO: 6488026 - DNA, 12 bp, Homo sapiens
tggctaaagata

SEQ ID NO: 6488027 - DNA, 16 bp, Homo sapiens
tggctaacagtctagt

SEQ ID NO: 6488028 - DNA, 21 bp, Homo sapiens
tggctaacctgttacactggg

SEQ ID NO: 6488029 - DNA, 16 bp, Homo sapiens
tggctaactgatgaat

SEQ ID NO: 6488030 - DNA, 22 bp, Homo sapiens
tggctaagaccacagacgggca

SEQ ID NO: 6488031 - DNA, 14 bp, Homo sapiens
tggctaagcctctg

SEQ ID NO: 6488032 - DNA, 14 bp, Homo sapiens
tggctaaggcatca

SEQ ID NO: 6488033 - DNA, 17 bp, Homo sapiens
tggctaataaactgtat

SEQ ID NO: 6488034 - DNA, 20 bp, Homo sapiens
tggctaatggagtgtttgaa

SEQ ID NO: 6488035 - DNA, 22 bp, Homo sapiens
tggctaatggagtgtttgaaaa

SEQ ID NO: 6488036 - DNA, 13 bp, Homo sapiens
tggctacatctcc

SEQ ID NO: 6488037 - DNA, 16 bp, Homo sapiens
tggctaccttgtggga

SEQ ID NO: 6488038 - DNA, 17 bp, Homo sapiens
tggctaccttgtgggaa

SEQ ID NO: 6488039 - DNA, 21 bp, Homo sapiens
tggctaccttgtgggaataaa

SEQ ID NO: 6488040 - DNA, 19 bp, Homo sapiens
tggctacgcctcttctgtc

SEQ ID NO: 6488041 - DNA, 22 bp, Homo sapiens
tggctacgcctcttctgtccct

SEQ ID NO: 6488042 - DNA, 23 bp, Homo sapiens
tggctacgcctcttctgtccctg

SEQ ID NO: 6488043 - DNA, 20 bp, Homo sapiens
tggctactccctggaccacg

SEQ ID NO: 6488044 - DNA, 23 bp, Homo sapiens
tggctactccctggaccacgagg

SEQ ID NO: 6488045 - DNA, 21 bp, Homo sapiens
tggctactctgtgccagagcc

SEQ ID NO: 6488046 - DNA, 24 bp, Homo sapiens
tggctactctgtgccagagcctgg

SEQ ID NO: 6488047 - DNA, 16 bp, Homo sapiens
tggctacttcccttcc

SEQ ID NO: 6488048 - DNA, 20 bp, Homo sapiens
tggctagaatatcctacttc

SEQ ID NO: 6488049 - DNA, 13 bp, Homo sapiens
tggctagagccga

SEQ ID NO: 6488050 - DNA, 14 bp, Homo sapiens
tggctagagccgag

SEQ ID NO: 6488051 - DNA, 22 bp, Homo sapiens
tggctagaggccagccccaccc

SEQ ID NO: 6488052 - DNA, 15 bp, Homo sapiens
tggctagagtcctca

SEQ ID NO: 6488053 - DNA, 23 bp, Homo sapiens
tggctagattaaccttctctgtc

SEQ ID NO: 6488054 - DNA, 17 bp, Homo sapiens
tggctagcgcaagacca

SEQ ID NO: 6488055 - DNA, 19 bp, Homo sapiens
tggctaggaaagggaagcc

SEQ ID NO: 6488056 - DNA, 22 bp, Homo sapiens
tggctaggactgtggaggggag

SEQ ID NO: 6488057 - DNA, 16 bp, Homo sapiens
tggctagtactgtatt

SEQ ID NO: 6488058 - DNA, 18 bp, Homo sapiens
tggctagtcaagctcctc

SEQ ID NO: 6488059 - DNA, 23 bp, Homo sapiens
tggctagtcaagctcctcctccc

SEQ ID NO: 6488060 - DNA, 16 bp, Homo sapiens
tggctagtcagagaga

SEQ ID NO: 6488061 - DNA, 22 bp, Homo sapiens
tggctataacatgtctttcagc

SEQ ID NO: 6488062 - DNA, 17 bp, Homo sapiens
tggctatagatgtcttt

SEQ ID NO: 6488063 - DNA, 15 bp, Homo sapiens
tggctataggtgcta

SEQ ID NO: 6488064 - DNA, 19 bp, Homo sapiens
tggctataggtgctacaaa

SEQ ID NO: 6488065 - DNA, 21 bp, Homo sapiens
tggctatattaggcatgttca

SEQ ID NO: 6488066 - DNA, 16 bp, Homo sapiens
tggctatcaaaagaaa

SEQ ID NO: 6488067 - DNA, 23 bp, Homo sapiens
tggctatcaaaagaaatagaaaa

SEQ ID NO: 6488068 - DNA, 18 bp, Homo sapiens
tggctatcctagagaggc

SEQ ID NO: 6488069 - DNA, 16 bp, Homo sapiens
tggctatctactacca

SEQ ID NO: 6488070 - DNA, 20 bp, Homo sapiens
tggctatgaaaatgagccct

SEQ ID NO: 6488071 - DNA, 21 bp, Homo sapiens
tggctatgaaaatgagccctg

SEQ ID NO: 6488072 - DNA, 23 bp, Homo sapiens
tggctatgaaaatgagccctggc

SEQ ID NO: 6488073 - DNA, 16 bp, Homo sapiens
tggctatgggaatcag

SEQ ID NO: 6488074 - DNA, 22 bp, Homo sapiens
tggctatgggaatcagctggtg

SEQ ID NO: 6488075 - DNA, 13 bp, Homo sapiens
tggctatgttttt

SEQ ID NO: 6488076 - DNA, 17 bp, Homo sapiens
tggctatgtttttaatg

SEQ ID NO: 6488077 - DNA, 18 bp, Homo sapiens
tggctatgtttttaatgt

SEQ ID NO: 6488078 - DNA, 13 bp, Homo sapiens
tggctattaaaaa

SEQ ID NO: 6488079 - DNA, 22 bp, Homo sapiens
tggctattagagatcaacccct

SEQ ID NO: 6488080 - DNA, 18 bp, Homo sapiens
tggctattgaagatgctg

SEQ ID NO: 6488081 - DNA, 20 bp, Homo sapiens
tggctattgaagatgctgcc

SEQ ID NO: 6488082 - DNA, 15 bp, Homo sapiens
tggctattgtccttg

SEQ ID NO: 6488083 - DNA, 13 bp, Homo sapiens
tggctatttctgt

SEQ ID NO: 6488084 - DNA, 16 bp, Homo sapiens
tggctatttctgtgtc

SEQ ID NO: 6488085 - DNA, 15 bp, Homo sapiens
tggctatttttgaag

SEQ ID NO: 6488086 - DNA, 18 bp, Homo sapiens
tggctcaagacaaggctg

SEQ ID NO: 6488087 - DNA, 22 bp, Homo sapiens
tggctcaagacaaggctggcaa

SEQ ID NO: 6488088 - DNA, 15 bp, Homo sapiens
tggctcaaggattca

SEQ ID NO: 6488089 - DNA, 18 bp, Homo sapiens
tggctcaagtagaaaagc

SEQ ID NO: 6488090 - DNA, 13 bp, Homo sapiens
tggctcacaaggc

SEQ ID NO: 6488091 - DNA, 18 bp, Homo sapiens
tggctcacaaggcccagg

SEQ ID NO: 6488092 - DNA, 15 bp, Homo sapiens
tggctcacacctgca

SEQ ID NO: 6488093 - DNA, 19 bp, Homo sapiens
tggctcacacctgtaatcc

SEQ ID NO: 6488094 - DNA, 15 bp, Homo sapiens
tggctcacactgaga

SEQ ID NO: 6488095 - DNA, 13 bp, Homo sapiens
tggctcacagcca

SEQ ID NO: 6488096 - DNA, 14 bp, Homo sapiens
tggctcacagccac

SEQ ID NO: 6488097 - DNA, 22 bp, Homo sapiens
tggctcacagccaccacctgga

SEQ ID NO: 6488098 - DNA, 22 bp, Homo sapiens
tggctcacagtacagcatgtgc

SEQ ID NO: 6488099 - DNA, 19 bp, Homo sapiens
tggctcacatggtttacat

SEQ ID NO: 6488100 - DNA, 16 bp, Homo sapiens
tggctcacccagtcct

SEQ ID NO: 6488101 - DNA, 14 bp, Homo sapiens
tggctcaccttccg

SEQ ID NO: 6488102 - DNA, 23 bp, Homo sapiens
tggctcacgccccgctgtgtcct

SEQ ID NO: 6488103 - DNA, 23 bp, Homo sapiens
tggctcacgcctataatcccagc

SEQ ID NO: 6488104 - DNA, 18 bp, Homo sapiens
tgacactcatcaggtaaa

SEQ ID NO: 6488105 - DNA, 18 bp, Homo sapiens
tgacactccagttgcaga

SEQ ID NO: 6488106 - DNA, 20 bp, Homo sapiens
tgacactcccacccagtctc

SEQ ID NO: 6488107 - DNA, 15 bp, Homo sapiens
tgacactctccttgc

SEQ ID NO: 6488108 - DNA, 18 bp, Homo sapiens
tgacactctccttgcagt

SEQ ID NO: 6488109 - DNA, 10 bp, Homo sapiens
tgacactgaa

SEQ ID NO: 6488110 - DNA, 20 bp, Homo sapiens
tgacactgaaagttttgtaa

SEQ ID NO: 6488111 - DNA, 17 bp, Homo sapiens
tgacactgaaatgcctt

SEQ ID NO: 6488112 - DNA, 22 bp, Homo sapiens
tgacactgaaatgccttacttt

SEQ ID NO: 6488113 - DNA, 13 bp, Homo sapiens
tgacactgagccc

SEQ ID NO: 6488114 - DNA, 16 bp, Homo sapiens
tgacactgctctaaca

SEQ ID NO: 6488115 - DNA, 19 bp, Homo sapiens
tgacactgctctaacagcc

SEQ ID NO: 6488116 - DNA, 21 bp, Homo sapiens
tgacactggaagggtccggct

SEQ ID NO: 6488117 - DNA, 13 bp, Homo sapiens
tgacactggacca

SEQ ID NO: 6488118 - DNA, 15 bp, Homo sapiens
tgacactgtccctct

SEQ ID NO: 6488119 - DNA, 18 bp, Homo sapiens
tgacactgtgaccctggg

SEQ ID NO: 6488120 - DNA, 20 bp, Homo sapiens
tgacactgtgaccctgggtc

SEQ ID NO: 6488121 - DNA, 17 bp, Homo sapiens
tgacactgtttcctgat

SEQ ID NO: 6488122 - DNA, 23 bp, Homo sapiens
tgacactgtttcctgataataaa

SEQ ID NO: 6488123 - DNA, 13 bp, Homo sapiens
tgacactgttttc

SEQ ID NO: 6488124 - DNA, 17 bp, Homo sapiens
tgacacttaaaaatggt

SEQ ID NO: 6488125 - DNA, 20 bp, Homo sapiens
tgacacttcagagagctggt

SEQ ID NO: 6488126 - DNA, 14 bp, Homo sapiens
tgacacttccagtc

SEQ ID NO: 6488127 - DNA, 23 bp, Homo sapiens
tgacactttctgctggaagctgt

SEQ ID NO: 6488128 - DNA, 18 bp, Homo sapiens
tgacacttttaaaaaaca

SEQ ID NO: 6488129 - DNA, 19 bp, Homo sapiens
tgacacttttaaaaaacaa

SEQ ID NO: 6488130 - DNA, 23 bp, Homo sapiens
tgacactttttgtattttttcct

SEQ ID NO: 6488131 - DNA, 23 bp, Homo sapiens
tgacagaaaatatgtattaacac

SEQ ID NO: 6488132 - DNA, 15 bp, Homo sapiens
tgacagaacactgtc

SEQ ID NO: 6488133 - DNA, 16 bp, Homo sapiens
tgacagaagctatttc

SEQ ID NO: 6488134 - DNA, 17 bp, Homo sapiens
tgacagaaggtgccact

SEQ ID NO: 6488135 - DNA, 12 bp, Homo sapiens
tgacagaatata

SEQ ID NO: 6488136 - DNA, 15 bp, Homo sapiens
tgacagaatatacac

SEQ ID NO: 6488137 - DNA, 22 bp, Homo sapiens
tgacagaatatacacattttgt

SEQ ID NO: 6488138 - DNA, 22 bp, Homo sapiens
tgacagaatatgtttcaaactt

SEQ ID NO: 6488139 - DNA, 20 bp, Homo sapiens
tgacagaatttgtgaatata

SEQ ID NO: 6488140 - DNA, 14 bp, Homo sapiens
tgacagacacaggc

SEQ ID NO: 6488141 - DNA, 17 bp, Homo sapiens
tgacagacacaggcccg

SEQ ID NO: 6488142 - DNA, 17 bp, Homo sapiens
tgacagaccacatcttt

SEQ ID NO: 6488143 - DNA, 15 bp, Homo sapiens
tgacagactcctgag

SEQ ID NO: 6488144 - DNA, 14 bp, Homo sapiens
tgacagactctcgt

SEQ ID NO: 6488145 - DNA, 22 bp, Homo sapiens
tgacagactttggacagtggcc

SEQ ID NO: 6488146 - DNA, 15 bp, Homo sapiens
tgacagagacccaga

SEQ ID NO: 6488147 - DNA, 18 bp, Homo sapiens
tgacagagacccagatct

SEQ ID NO: 6488148 - DNA, 20 bp, Homo sapiens
tgacagagagagatactctg

SEQ ID NO: 6488149 - DNA, 21 bp, Homo sapiens
tgacagagagagatactctgg

SEQ ID NO: 6488150 - DNA, 23 bp, Homo sapiens
tgacagagagagatactctggga

SEQ ID NO: 6488151 - DNA, 20 bp, Homo sapiens
tgacagagagttctggtgag

SEQ ID NO: 6488152 - DNA, 22 bp, Homo sapiens
tgacagagcaagactctgtcta

SEQ ID NO: 6488153 - DNA, 22 bp, Homo sapiens
tgacagagcaagtgagaccctg

SEQ ID NO: 6488154 - DNA, 22 bp, Homo sapiens
tgacagagcagctaactccgag

SEQ ID NO: 6488155 - DNA, 23 bp, Homo sapiens
tgacagagcagctaactccgaga

SEQ ID NO: 6488156 - DNA, 16 bp, Homo sapiens
tgacagagcaggtctg

SEQ ID NO: 6488157 - DNA, 22 bp, Homo sapiens
tgacagagcaggtctgcaggcc

SEQ ID NO: 6488158 - DNA, 12 bp, Homo sapiens
tgacagagccag

SEQ ID NO: 6488159 - DNA, 13 bp, Homo sapiens
tgacagagccaga

SEQ ID NO: 6488160 - DNA, 15 bp, Homo sapiens
tgacagagccagagg

SEQ ID NO: 6488161 - DNA, 16 bp, Homo sapiens
tgacagagccagaggc

SEQ ID NO: 6488162 - DNA, 22 bp, Homo sapiens
tgacagagccatatgtacccta

SEQ ID NO: 6488163 - DNA, 23 bp, Homo sapiens
tgacagagccctatctatgtcct

SEQ ID NO: 6488164 - DNA, 22 bp, Homo sapiens
tgacagagcctgccccagcgct

SEQ ID NO: 6488165 - DNA, 23 bp, Homo sapiens
tgacagagccttctgaggacatt

SEQ ID NO: 6488166 - DNA, 19 bp, Homo sapiens
tgacagagcgagactccat

SEQ ID NO: 6488167 - DNA, 19 bp, Homo sapiens
tgacagagggacagtgggc

SEQ ID NO: 6488168 - DNA, 14 bp, Homo sapiens
tgacagagtgagac

SEQ ID NO: 6488169 - DNA, 22 bp, Homo sapiens
tgacagagtgagaccctgtctc

SEQ ID NO: 6488170 - DNA, 22 bp, Homo sapiens
tgacagagtgagactctgtctc

SEQ ID NO: 6488171 - DNA, 19 bp, Homo sapiens
tgacagatacatagatgga

SEQ ID NO: 6488172 - DNA, 20 bp, Homo sapiens
tgacagatacatagatggac

SEQ ID NO: 6488173 - DNA, 21 bp, Homo sapiens
tgacagatacatagatggacc

SEQ ID NO: 6488174 - DNA, 17 bp, Homo sapiens
tgacagatataaaatag

SEQ ID NO: 6488175 - DNA, 19 bp, Homo sapiens
tgacagatatatttaagcc

SEQ ID NO: 6488176 - DNA, 21 bp, Homo sapiens
tgacagatatatttaagcctt

SEQ ID NO: 6488177 - DNA, 21 bp, Homo sapiens
tgacagatcaagctgtgagac

SEQ ID NO: 6488178 - DNA, 22 bp, Homo sapiens
tgacagatcctccatttttgtt

SEQ ID NO: 6488179 - DNA, 23 bp, Homo sapiens
tgacagatgcaagttattttatt

SEQ ID NO: 6488180 - DNA, 15 bp, Homo sapiens
tgacagatgccaact

SEQ ID NO: 6488181 - DNA, 19 bp, Homo sapiens
tgacagatgccaacttccc

SEQ ID NO: 6488182 - DNA, 22 bp, Homo sapiens
tgacagatgccaacttcccaca

SEQ ID NO: 6488183 - DNA, 20 bp, Homo sapiens
tgacagatgcttttgctaat

SEQ ID NO: 6488184 - DNA, 18 bp, Homo sapiens
tgacagatgttatttttg

SEQ ID NO: 6488185 - DNA, 18 bp, Homo sapiens
tgacagattgacagggac

SEQ ID NO: 6488186 - DNA, 17 bp, Homo sapiens
tgacagcaaaatgttga

SEQ ID NO: 6488187 - DNA, 14 bp, Homo sapiens
tgacagcaaacaca

SEQ ID NO: 6488188 - DNA, 19 bp, Homo sapiens
tgacagcaaacacagtcac

SEQ ID NO: 6488189 - DNA, 17 bp, Homo sapiens
tgacagcaattcatggt

SEQ ID NO: 6488190 - DNA, 18 bp, Homo sapiens
tgacagcacctgagaaga

SEQ ID NO: 6488191 - DNA, 22 bp, Homo sapiens
tgacagcactaaacttggtgct

SEQ ID NO: 6488192 - DNA, 14 bp, Homo sapiens
tgacagcagcatct

SEQ ID NO: 6488193 - DNA, 16 bp, Homo sapiens
tgacagcagcatctct

SEQ ID NO: 6488194 - DNA, 15 bp, Homo sapiens
tgacagcagcctgtg

SEQ ID NO: 6488195 - DNA, 19 bp, Homo sapiens
tgacagcagctctgtcccc

SEQ ID NO: 6488196 - DNA, 21 bp, Homo sapiens
tgacagcagctctgtccccac

SEQ ID NO: 6488197 - DNA, 14 bp, Homo sapiens
tgacagcaggtggg

SEQ ID NO: 6488198 - DNA, 20 bp, Homo sapiens
tgacagcagtcggttggagc

SEQ ID NO: 6488199 - DNA, 21 bp, Homo sapiens
tgacagcatatagaatatatt

SEQ ID NO: 6488200 - DNA, 14 bp, Homo sapiens
tgacagcatcctct

SEQ ID NO: 6488201 - DNA, 16 bp, Homo sapiens
tgacagcatcctctct

SEQ ID NO: 6488202 - DNA, 18 bp, Homo sapiens
tgacagcatgtgccctcc

SEQ ID NO: 6488203 - DNA, 23 bp, Homo sapiens
tgacagcatgtgccctcctgagg

SEQ ID NO: 6488204 - DNA, 20 bp, Homo sapiens
tgacagccacaccgtggcag

SEQ ID NO: 6488205 - DNA, 14 bp, Homo sapiens
tgacagccagaact

SEQ ID NO: 6488206 - DNA, 16 bp, Homo sapiens
tgacagcccgcaggat

SEQ ID NO: 6488207 - DNA, 22 bp, Homo sapiens
tgacagcctccaccttgagcac

SEQ ID NO: 6488208 - DNA, 12 bp, Homo sapiens
tgacagcctctg

SEQ ID NO: 6488209 - DNA, 20 bp, Homo sapiens
tgacagcctctgactcacca

SEQ ID NO: 6488210 - DNA, 14 bp, Homo sapiens
tgacagcctctgca

SEQ ID NO: 6488211 - DNA, 14 bp, Homo sapiens
tgacagcctgcagc

SEQ ID NO: 6488212 - DNA, 13 bp, Homo sapiens
tgacagccttctt

SEQ ID NO: 6488213 - DNA, 14 bp, Homo sapiens
tgacagccttgggc

SEQ ID NO: 6488214 - DNA, 20 bp, Homo sapiens
tgacagccttgggcctttca

SEQ ID NO: 6488215 - DNA, 17 bp, Homo sapiens
tgacagcgcacagctgc

SEQ ID NO: 6488216 - DNA, 16 bp, Homo sapiens
tgacagcgccatgtgt

SEQ ID NO: 6488217 - DNA, 17 bp, Homo sapiens
tgacagcgccatgtgtg

SEQ ID NO: 6488218 - DNA, 20 bp, Homo sapiens
tgacagcgccatgtgtgtca

SEQ ID NO: 6488219 - DNA, 22 bp, Homo sapiens
tgacagctactaacctggagac

SEQ ID NO: 6488220 - DNA, 23 bp, Homo sapiens
tgacagctactaacctggagaca

SEQ ID NO: 6488221 - DNA, 22 bp, Homo sapiens
tgacagctaggatgtgcattct

SEQ ID NO: 6488222 - DNA, 14 bp, Homo sapiens
tgacagctccggga

SEQ ID NO: 6488223 - DNA, 20 bp, Homo sapiens
tgacagctctttttgtgaag

SEQ ID NO: 6488224 - DNA, 16 bp, Homo sapiens
tgacagctgcaagcca

SEQ ID NO: 6488225 - DNA, 12 bp, Homo sapiens
tgacagctgctc

SEQ ID NO: 6488226 - DNA, 22 bp, Homo sapiens
tgacagctgctcctagagggag

SEQ ID NO: 6488227 - DNA, 18 bp, Homo sapiens
tgacagctgtccctgtca

SEQ ID NO: 6488228 - DNA, 22 bp, Homo sapiens
tgacagctgttccacaggggct

SEQ ID NO: 6488229 - DNA, 18 bp, Homo sapiens
tgacagcttggaaaggga

SEQ ID NO: 6488230 - DNA, 20 bp, Homo sapiens
tgacagcttggaaagggaag

SEQ ID NO: 6488231 - DNA, 14 bp, Homo sapiens
tgacagctttctaa

SEQ ID NO: 6488232 - DNA, 15 bp, Homo sapiens
tgacagctttctaac

SEQ ID NO: 6488233 - DNA, 16 bp, Homo sapiens
tgacagctttctggga

SEQ ID NO: 6488234 - DNA, 17 bp, Homo sapiens
tgacaggaaagccctcc

SEQ ID NO: 6488235 - DNA, 21 bp, Homo sapiens
tgacaggaacccatcactgtg

SEQ ID NO: 6488236 - DNA, 14 bp, Homo sapiens
tgacaggaagactg

SEQ ID NO: 6488237 - DNA, 18 bp, Homo sapiens
tgacaggaagactggaga

SEQ ID NO: 6488238 - DNA, 21 bp, Homo sapiens
tgacaggaagcccaaggcagt

SEQ ID NO: 6488239 - DNA, 21 bp, Homo sapiens
tgacaggacatttgacatgag

SEQ ID NO: 6488240 - DNA, 14 bp, Homo sapiens
tgacaggacgctga

SEQ ID NO: 6488241 - DNA, 23 bp, Homo sapiens
tgacaggacgctgaccgtggagc

SEQ ID NO: 6488242 - DNA, 21 bp, Homo sapiens
tgacaggatgtggcactgctt

SEQ ID NO: 6488243 - DNA, 19 bp, Homo sapiens
tgacaggcaatgctggctg

SEQ ID NO: 6488244 - DNA, 23 bp, Homo sapiens
tgacaggcactattctaatcagt

SEQ ID NO: 6488245 - DNA, 14 bp, Homo sapiens
tgacaggcagacac

SEQ ID NO: 6488246 - DNA, 15 bp, Homo sapiens
tgacaggcagcagag

SEQ ID NO: 6488247 - DNA, 16 bp, Homo sapiens
tgacaggcagcagaga

SEQ ID NO: 6488248 - DNA, 20 bp, Homo sapiens
tgacaggcagtgttcttggg

SEQ ID NO: 6488249 - DNA, 18 bp, Homo sapiens
tgacaggcgccgcctcgc

SEQ ID NO: 6488250 - DNA, 13 bp, Homo sapiens
tgacaggctctcc

SEQ ID NO: 6488251 - DNA, 19 bp, Homo sapiens
tgacaggctctcctggctg

SEQ ID NO: 6488252 - DNA, 19 bp, Homo sapiens
tgacaggctgtgactcttc

SEQ ID NO: 6488253 - DNA, 17 bp, Homo sapiens
tgacagggaaaatatag

SEQ ID NO: 6488254 - DNA, 13 bp, Homo sapiens
tgacagggaagct

SEQ ID NO: 6488255 - DNA, 17 bp, Homo sapiens
tgacagggacatgccct

SEQ ID NO: 6488256 - DNA, 22 bp, Homo sapiens
tgacagggacatgccctgtgtg

SEQ ID NO: 6488257 - DNA, 11 bp, Homo sapiens
tgacagggcac

SEQ ID NO: 6488258 - DNA, 16 bp, Homo sapiens
tgacagggcacaccgg

SEQ ID NO: 6488259 - DNA, 20 bp, Homo sapiens
tgacagggcacaccgggcac

SEQ ID NO: 6488260 - DNA, 16 bp, Homo sapiens
tgacagggcagagcag

SEQ ID NO: 6488261 - DNA, 16 bp, Homo sapiens
tgacagggccagtgca

SEQ ID NO: 6488262 - DNA, 18 bp, Homo sapiens
tgacagggccagtggggc

SEQ ID NO: 6488263 - DNA, 20 bp, Homo sapiens
tgacagggccagtggggcct

SEQ ID NO: 6488264 - DNA, 21 bp, Homo sapiens
tgacagggcccagttaaatat

SEQ ID NO: 6488265 - DNA, 22 bp, Homo sapiens
tgacagggcccagttaaatatg

SEQ ID NO: 6488266 - DNA, 23 bp, Homo sapiens
tgacagggcccagttaaatatga

SEQ ID NO: 6488267 - DNA, 18 bp, Homo sapiens
tgacaggggctcaggata

SEQ ID NO: 6488268 - DNA, 17 bp, Homo sapiens
tgacaggtaaattaaga

SEQ ID NO: 6488269 - DNA, 16 bp, Homo sapiens
tgacaggtcttttcaa

SEQ ID NO: 6488270 - DNA, 17 bp, Homo sapiens
tgacaggtcttttcaaa

SEQ ID NO: 6488271 - DNA, 20 bp, Homo sapiens
tgacaggtgcctgtccttga

SEQ ID NO: 6488272 - DNA, 16 bp, Homo sapiens
tgacaggtgtgagcca

SEQ ID NO: 6488273 - DNA, 21 bp, Homo sapiens
tgacaggttggccgtttgctt

SEQ ID NO: 6488274 - DNA, 20 bp, Homo sapiens
tgacaggttttccaaaagta

SEQ ID NO: 6488275 - DNA, 13 bp, Homo sapiens
tgacagtaatatt

SEQ ID NO: 6488276 - DNA, 22 bp, Homo sapiens
tgacagtacccgactgtttatt

SEQ ID NO: 6488277 - DNA, 15 bp, Homo sapiens
tgacagtagcatact

SEQ ID NO: 6488278 - DNA, 16 bp, Homo sapiens
tgacagtagcatactg

SEQ ID NO: 6488279 - DNA, 13 bp, Homo sapiens
tggctcacgcctg

SEQ ID NO: 6488280 - DNA, 16 bp, Homo sapiens
tggctcacgcctgtaa

SEQ ID NO: 6488281 - DNA, 17 bp, Homo sapiens
tggctcacgcctgtaat

SEQ ID NO: 6488282 - DNA, 19 bp, Homo sapiens
tggctcacgcctgtaatcc

SEQ ID NO: 6488283 - DNA, 22 bp, Homo sapiens
tggctcactacaacctccacct

SEQ ID NO: 6488284 - DNA, 17 bp, Homo sapiens
tggctcactactgaaca

SEQ ID NO: 6488285 - DNA, 18 bp, Homo sapiens
tggctcactatggtgcca

SEQ ID NO: 6488286 - DNA, 13 bp, Homo sapiens
tggctcactgcag

SEQ ID NO: 6488287 - DNA, 17 bp, Homo sapiens
tggctcactgcagcctc

SEQ ID NO: 6488288 - DNA, 13 bp, Homo sapiens
tggctcagacccc

SEQ ID NO: 6488289 - DNA, 19 bp, Homo sapiens
tggctcagacccctcagcc

SEQ ID NO: 6488290 - DNA, 22 bp, Homo sapiens
tggctcagacccctcagcccca

SEQ ID NO: 6488291 - DNA, 23 bp, Homo sapiens
tggctcagacccctcagccccag

SEQ ID NO: 6488292 - DNA, 22 bp, Homo sapiens
tggctcagagggggactgctgc

SEQ ID NO: 6488293 - DNA, 11 bp, Homo sapiens
tggctcagagt

SEQ ID NO: 6488294 - DNA, 15 bp, Homo sapiens
tggctcagcccggga

SEQ ID NO: 6488295 - DNA, 16 bp, Homo sapiens
tggctcagcctgtctc

SEQ ID NO: 6488296 - DNA, 22 bp, Homo sapiens
tggctcagctcggggagcctta

SEQ ID NO: 6488297 - DNA, 18 bp, Homo sapiens
tggctcagctgtggtccc

SEQ ID NO: 6488298 - DNA, 20 bp, Homo sapiens
tggctcagcttctaatccca

SEQ ID NO: 6488299 - DNA, 13 bp, Homo sapiens
tggctcaggaaga

SEQ ID NO: 6488300 - DNA, 22 bp, Homo sapiens
tggctcaggaagaaaccccaag

SEQ ID NO: 6488301 - DNA, 16 bp, Homo sapiens
tggctcaggcaagccc

SEQ ID NO: 6488302 - DNA, 18 bp, Homo sapiens
tggctcaggcaagcccct

SEQ ID NO: 6488303 - DNA, 13 bp, Homo sapiens
tggctcaggcaga

SEQ ID NO: 6488304 - DNA, 22 bp, Homo sapiens
tggctcaggcagacaagagctg

SEQ ID NO: 6488305 - DNA, 19 bp, Homo sapiens
tggctcagggcccacctcc

SEQ ID NO: 6488306 - DNA, 20 bp, Homo sapiens
tggctcagggcccacctcct

SEQ ID NO: 6488307 - DNA, 12 bp, Homo sapiens
tggctcagggga

SEQ ID NO: 6488308 - DNA, 18 bp, Homo sapiens
tggctcaggggagcaagc

SEQ ID NO: 6488309 - DNA, 20 bp, Homo sapiens
tggctcaggtggggtcactc

SEQ ID NO: 6488310 - DNA, 14 bp, Homo sapiens
tggctcagtgcctt

SEQ ID NO: 6488311 - DNA, 19 bp, Homo sapiens
tggctcatattcctgcagc

SEQ ID NO: 6488312 - DNA, 14 bp, Homo sapiens
tggctcatgcctgt

SEQ ID NO: 6488313 - DNA, 22 bp, Homo sapiens
tggctcatttgcttttgtcact

SEQ ID NO: 6488314 - DNA, 23 bp, Homo sapiens
tggctccacacacacaaaaaaag

SEQ ID NO: 6488315 - DNA, 13 bp, Homo sapiens
tggctccacatcc

SEQ ID NO: 6488316 - DNA, 11 bp, Homo sapiens
tggctccaccg

SEQ ID NO: 6488317 - DNA, 17 bp, Homo sapiens
tggctccaccttgatgg

SEQ ID NO: 6488318 - DNA, 22 bp, Homo sapiens
tggctccactcttgatctctct

SEQ ID NO: 6488319 - DNA, 21 bp, Homo sapiens
tggctccagaatgtgctgcct

SEQ ID NO: 6488320 - DNA, 22 bp, Homo sapiens
tggctccagaatgtgctgcctt

SEQ ID NO: 6488321 - DNA, 21 bp, Homo sapiens
tggctccagatgcagggcagt

SEQ ID NO: 6488322 - DNA, 15 bp, Homo sapiens
tggctccagcctgga

SEQ ID NO: 6488323 - DNA, 20 bp, Homo sapiens
tggctccaggcagaaggaga

SEQ ID NO: 6488324 - DNA, 14 bp, Homo sapiens
tggctccagtctca

SEQ ID NO: 6488325 - DNA, 15 bp, Homo sapiens
tggctccagtctgct

SEQ ID NO: 6488326 - DNA, 20 bp, Homo sapiens
tggctccagtctgctgccct

SEQ ID NO: 6488327 - DNA, 15 bp, Homo sapiens
tggctccatgctcct

SEQ ID NO: 6488328 - DNA, 20 bp, Homo sapiens
tggctccattggtgttgaca

SEQ ID NO: 6488329 - DNA, 17 bp, Homo sapiens
tggctcccaagggaggc

SEQ ID NO: 6488330 - DNA, 17 bp, Homo sapiens
tggctcccacaggcagc

SEQ ID NO: 6488331 - DNA, 18 bp, Homo sapiens
tggctcccacaggcagct

SEQ ID NO: 6488332 - DNA, 19 bp, Homo sapiens
tggctcccacaggcagctt

SEQ ID NO: 6488333 - DNA, 18 bp, Homo sapiens
tggctcccacctgtagtc

SEQ ID NO: 6488334 - DNA, 14 bp, Homo sapiens
tggctcccagcaga

SEQ ID NO: 6488335 - DNA, 13 bp, Homo sapiens
tggctcccaggac

SEQ ID NO: 6488336 - DNA, 14 bp, Homo sapiens
tggctcccaggaca

SEQ ID NO: 6488337 - DNA, 15 bp, Homo sapiens
tggctcccaggacac

SEQ ID NO: 6488338 - DNA, 21 bp, Homo sapiens
tggctcccaggggctccctcc

SEQ ID NO: 6488339 - DNA, 20 bp, Homo sapiens
tggctcccagggtggaggaa

SEQ ID NO: 6488340 - DNA, 23 bp, Homo sapiens
tggctcccatgaccatactgagg

SEQ ID NO: 6488341 - DNA, 18 bp, Homo sapiens
tggctcccattcactctt

SEQ ID NO: 6488342 - DNA, 15 bp, Homo sapiens
tggctccccaaaggg

SEQ ID NO: 6488343 - DNA, 14 bp, Homo sapiens
tggctccccaaggc

SEQ ID NO: 6488344 - DNA, 19 bp, Homo sapiens
tggctccccacctggacac

SEQ ID NO: 6488345 - DNA, 16 bp, Homo sapiens
tggctccccctcccca

SEQ ID NO: 6488346 - DNA, 20 bp, Homo sapiens
tggctccccctccccaggct

SEQ ID NO: 6488347 - DNA, 22 bp, Homo sapiens
tggctccccctccccaggctgg

SEQ ID NO: 6488348 - DNA, 17 bp, Homo sapiens
tggctccccctctgctt

SEQ ID NO: 6488349 - DNA, 19 bp, Homo sapiens
tggctccccgagggctcag

SEQ ID NO: 6488350 - DNA, 22 bp, Homo sapiens
tggctccccgagggctcagaag

SEQ ID NO: 6488351 - DNA, 17 bp, Homo sapiens
tggctcccctgcagccc

SEQ ID NO: 6488352 - DNA, 22 bp, Homo sapiens
tggctcccctgcagccctggcc

SEQ ID NO: 6488353 - DNA, 12 bp, Homo sapiens
tggctcccctgg

SEQ ID NO: 6488354 - DNA, 15 bp, Homo sapiens
tggctcccctggggt

SEQ ID NO: 6488355 - DNA, 20 bp, Homo sapiens
tggctcccgctttggggagc

SEQ ID NO: 6488356 - DNA, 17 bp, Homo sapiens
tggctccctcactctca

SEQ ID NO: 6488357 - DNA, 18 bp, Homo sapiens
tggctccctcactctcag

SEQ ID NO: 6488358 - DNA, 19 bp, Homo sapiens
tggctccctcactctcagg

SEQ ID NO: 6488359 - DNA, 17 bp, Homo sapiens
tggctccctcctccagg

SEQ ID NO: 6488360 - DNA, 19 bp, Homo sapiens
tggctccctcctccaggcc

SEQ ID NO: 6488361 - DNA, 16 bp, Homo sapiens
tggctccctctctcct

SEQ ID NO: 6488362 - DNA, 20 bp, Homo sapiens
tggctccctctctcctggac

SEQ ID NO: 6488363 - DNA, 22 bp, Homo sapiens
tggctccctctctcctggactg

SEQ ID NO: 6488364 - DNA, 14 bp, Homo sapiens
tggctccctcttgg

SEQ ID NO: 6488365 - DNA, 12 bp, Homo sapiens
tggctccctggg

SEQ ID NO: 6488366 - DNA, 13 bp, Homo sapiens
tggctccctgggc

SEQ ID NO: 6488367 - DNA, 16 bp, Homo sapiens
tggctccctgggctgg

SEQ ID NO: 6488368 - DNA, 15 bp, Homo sapiens
tggctccctgggggc

SEQ ID NO: 6488369 - DNA, 19 bp, Homo sapiens
tggctccgaacaccctcga

SEQ ID NO: 6488370 - DNA, 14 bp, Homo sapiens
tggctccggcctct

SEQ ID NO: 6488371 - DNA, 20 bp, Homo sapiens
tggctcctaccactggacag

SEQ ID NO: 6488372 - DNA, 18 bp, Homo sapiens
tggctcctaccccatctc

SEQ ID NO: 6488373 - DNA, 16 bp, Homo sapiens
tggctcctcccagcac

SEQ ID NO: 6488374 - DNA, 14 bp, Homo sapiens
tggctcctcccggt

SEQ ID NO: 6488375 - DNA, 21 bp, Homo sapiens
tggctcctccgtctgaccctc

SEQ ID NO: 6488376 - DNA, 15 bp, Homo sapiens
tggctcctcctagga

SEQ ID NO: 6488377 - DNA, 12 bp, Homo sapiens
tggctcctcctg

SEQ ID NO: 6488378 - DNA, 12 bp, Homo sapiens
tggctcctctca

SEQ ID NO: 6488379 - DNA, 23 bp, Homo sapiens
tggctcctctgtggtgtctgcct

SEQ ID NO: 6488380 - DNA, 11 bp, Homo sapiens
tggctcctgaa

SEQ ID NO: 6488381 - DNA, 13 bp, Homo sapiens
tggctcctgagaa

SEQ ID NO: 6488382 - DNA, 20 bp, Homo sapiens
tggctcctgaggggcatctg

SEQ ID NO: 6488383 - DNA, 21 bp, Homo sapiens
tggctcctgaggggcatctgc

SEQ ID NO: 6488384 - DNA, 12 bp, Homo sapiens
tggctcctgcca

SEQ ID NO: 6488385 - DNA, 13 bp, Homo sapiens
tggctcctgccac

SEQ ID NO: 6488386 - DNA, 15 bp, Homo sapiens
tggctcctgccactg

SEQ ID NO: 6488387 - DNA, 15 bp, Homo sapiens
tggctcctgcccact

SEQ ID NO: 6488388 - DNA, 14 bp, Homo sapiens
tggctcctgccttg

SEQ ID NO: 6488389 - DNA, 23 bp, Homo sapiens
tggctcctgccttgatgaagccc

SEQ ID NO: 6488390 - DNA, 20 bp, Homo sapiens
tggctcctggggatggccag

SEQ ID NO: 6488391 - DNA, 15 bp, Homo sapiens
tggctcctgtttcca

SEQ ID NO: 6488392 - DNA, 17 bp, Homo sapiens
tggctccttcaccaccc

SEQ ID NO: 6488393 - DNA, 19 bp, Homo sapiens
tggctccttcccatcgctg

SEQ ID NO: 6488394 - DNA, 20 bp, Homo sapiens
tggctccttgcagcagggct

SEQ ID NO: 6488395 - DNA, 20 bp, Homo sapiens
tggctccttgtgccagagaa

SEQ ID NO: 6488396 - DNA, 14 bp, Homo sapiens
tggctcctttacaa

SEQ ID NO: 6488397 - DNA, 18 bp, Homo sapiens
tggctcctttacaaaaga

SEQ ID NO: 6488398 - DNA, 15 bp, Homo sapiens
tggctcctttcccac

SEQ ID NO: 6488399 - DNA, 17 bp, Homo sapiens
tggctcctttcccacag

SEQ ID NO: 6488400 - DNA, 18 bp, Homo sapiens
tggctcctttcccacagt

SEQ ID NO: 6488401 - DNA, 20 bp, Homo sapiens
tggctcctttgcctctgcta

SEQ ID NO: 6488402 - DNA, 18 bp, Homo sapiens
tggctcgaatctctgtgc

SEQ ID NO: 6488403 - DNA, 19 bp, Homo sapiens
tggctcgaatctctgtgcc

SEQ ID NO: 6488404 - DNA, 19 bp, Homo sapiens
tggctcgcagggtgcagga

SEQ ID NO: 6488405 - DNA, 21 bp, Homo sapiens
tggctcggcgcccccacccct

SEQ ID NO: 6488406 - DNA, 21 bp, Homo sapiens
tggctcggggtaaaaagtggc

SEQ ID NO: 6488407 - DNA, 16 bp, Homo sapiens
tggctcgggtgcccag

SEQ ID NO: 6488408 - DNA, 16 bp, Homo sapiens
tggctcgtgggctctg

SEQ ID NO: 6488409 - DNA, 17 bp, Homo sapiens
tggctcgtgggctctgg

SEQ ID NO: 6488410 - DNA, 18 bp, Homo sapiens
tggctcgtgggctctggc

SEQ ID NO: 6488411 - DNA, 20 bp, Homo sapiens
tggctcgtgggctctggctc

SEQ ID NO: 6488412 - DNA, 16 bp, Homo sapiens
tggctcgtgtttcaca

SEQ ID NO: 6488413 - DNA, 17 bp, Homo sapiens
tggctcgttctcttctc

SEQ ID NO: 6488414 - DNA, 17 bp, Homo sapiens
tggctctaactccttga

SEQ ID NO: 6488415 - DNA, 15 bp, Homo sapiens
tggctctacacatat

SEQ ID NO: 6488416 - DNA, 13 bp, Homo sapiens
tggctctaccctg

SEQ ID NO: 6488417 - DNA, 17 bp, Homo sapiens
tggctctaccttcctgt

SEQ ID NO: 6488418 - DNA, 19 bp, Homo sapiens
tggctctaccttcctgtcc

SEQ ID NO: 6488419 - DNA, 20 bp, Homo sapiens
tggctctacgtttaggcacc

SEQ ID NO: 6488420 - DNA, 18 bp, Homo sapiens
tggctctcaagtgaaaga

SEQ ID NO: 6488421 - DNA, 16 bp, Homo sapiens
tggctctcagaaggta

SEQ ID NO: 6488422 - DNA, 18 bp, Homo sapiens
tggctctcagagcagcag

SEQ ID NO: 6488423 - DNA, 13 bp, Homo sapiens
tggctctcagagg

SEQ ID NO: 6488424 - DNA, 18 bp, Homo sapiens
tggctctcaggggccagt

SEQ ID NO: 6488425 - DNA, 21 bp, Homo sapiens
tggctctcagttaaaatgtga

SEQ ID NO: 6488426 - DNA, 13 bp, Homo sapiens
tggctctcccacc

SEQ ID NO: 6488427 - DNA, 15 bp, Homo sapiens
tggctctcccacccc

SEQ ID NO: 6488428 - DNA, 17 bp, Homo sapiens
tggctctcccatttcct

SEQ ID NO: 6488429 - DNA, 13 bp, Homo sapiens
tggctctcctggc

SEQ ID NO: 6488430 - DNA, 17 bp, Homo sapiens
tggctctcctggccctg

SEQ ID NO: 6488431 - DNA, 16 bp, Homo sapiens
tggctctcctgtagct

SEQ ID NO: 6488432 - DNA, 14 bp, Homo sapiens
tggctctctccagg

SEQ ID NO: 6488433 - DNA, 18 bp, Homo sapiens
tggctctgaatgtagcca

SEQ ID NO: 6488434 - DNA, 20 bp, Homo sapiens
tggctctgaatgtagccagc

SEQ ID NO: 6488435 - DNA, 19 bp, Homo sapiens
tggctctgaccgaaacagc

SEQ ID NO: 6488436 - DNA, 19 bp, Homo sapiens
tggctctgagcgcctccat

SEQ ID NO: 6488437 - DNA, 22 bp, Homo sapiens
tggctctgaggtgcctgtccca

SEQ ID NO: 6488438 - DNA, 21 bp, Homo sapiens
tggctctgattggaatttctg

SEQ ID NO: 6488439 - DNA, 23 bp, Homo sapiens
tggctctgcaatgggcactggga

SEQ ID NO: 6488440 - DNA, 15 bp, Homo sapiens
tggctctgccagcgt

SEQ ID NO: 6488441 - DNA, 22 bp, Homo sapiens
tggctctgccagcgtccccggc

SEQ ID NO: 6488442 - DNA, 13 bp, Homo sapiens
tggctctgccagt

SEQ ID NO: 6488443 - DNA, 17 bp, Homo sapiens
tggctctgccagtcggt

SEQ ID NO: 6488444 - DNA, 17 bp, Homo sapiens
tggctctgccccctccc

SEQ ID NO: 6488445 - DNA, 19 bp, Homo sapiens
tggctctgccccctccccc

SEQ ID NO: 6488446 - DNA, 15 bp, Homo sapiens
tggctctgccccgca

SEQ ID NO: 6488447 - DNA, 14 bp, Homo sapiens
tggctctgcccctc

SEQ ID NO: 6488448 - DNA, 16 bp, Homo sapiens
tggctctgcccctcag

SEQ ID NO: 6488449 - DNA, 21 bp, Homo sapiens
tggctctgcccctcagggggc

SEQ ID NO: 6488450 - DNA, 14 bp, Homo sapiens
tggctctgccctgg

SEQ ID NO: 6488451 - DNA, 15 bp, Homo sapiens
tggctctgccctgga

SEQ ID NO: 6488452 - DNA, 13 bp, Homo sapiens
tggctctgcctca

SEQ ID NO: 6488453 - DNA, 19 bp, Homo sapiens
tggctctgctgtccccttg

SEQ ID NO: 6488454 - DNA, 17 bp, Homo sapiens
tggctctggaatgacat

SEQ ID NO: 6488455 - DNA, 13 bp, Homo sapiens
tggctctggagac

SEQ ID NO: 6488456 - DNA, 12 bp, Homo sapiens
tggctctgggac

SEQ ID NO: 6488457 - DNA, 18 bp, Homo sapiens
tggctctgggagagccag

SEQ ID NO: 6488458 - DNA, 21 bp, Homo sapiens
tgacagtagcatactgatgag

SEQ ID NO: 6488459 - DNA, 17 bp, Homo sapiens
tgacagtagctcttaga

SEQ ID NO: 6488460 - DNA, 18 bp, Homo sapiens
tgacagtagctcttagac

SEQ ID NO: 6488461 - DNA, 21 bp, Homo sapiens
tgacagtagtaccaaatgctt

SEQ ID NO: 6488462 - DNA, 15 bp, Homo sapiens
tgacagtatatgtca

SEQ ID NO: 6488463 - DNA, 23 bp, Homo sapiens
tgacagtattaacatcaaagact

SEQ ID NO: 6488464 - DNA, 19 bp, Homo sapiens
tgacagtattccatttctg

SEQ ID NO: 6488465 - DNA, 14 bp, Homo sapiens
tgacagtcataaat

SEQ ID NO: 6488466 - DNA, 24 bp, Homo sapiens
tgacagtcataaatactgtcaaac

SEQ ID NO: 6488467 - DNA, 11 bp, Homo sapiens
tgacagtcatc

SEQ ID NO: 6488468 - DNA, 19 bp, Homo sapiens
tgacagtcatcatcagggc

SEQ ID NO: 6488469 - DNA, 23 bp, Homo sapiens
tgacagtcatcatcagggcctgg

SEQ ID NO: 6488470 - DNA, 15 bp, Homo sapiens
tgacagtccacaggg

SEQ ID NO: 6488471 - DNA, 21 bp, Homo sapiens
tgacagtcccttgctgacatg

SEQ ID NO: 6488472 - DNA, 18 bp, Homo sapiens
tgacagtccgtcaaaaca

SEQ ID NO: 6488473 - DNA, 20 bp, Homo sapiens
tgacagtctcaaatttttca

SEQ ID NO: 6488474 - DNA, 23 bp, Homo sapiens
tgacagtcttgtgcttttcctat

SEQ ID NO: 6488475 - DNA, 14 bp, Homo sapiens
tgacagtgaaacaa

SEQ ID NO: 6488476 - DNA, 12 bp, Homo sapiens
tgacagtgaggt

SEQ ID NO: 6488477 - DNA, 21 bp, Homo sapiens
tgacagtgcctcttccagtga

SEQ ID NO: 6488478 - DNA, 14 bp, Homo sapiens
tgacagtgcctggg

SEQ ID NO: 6488479 - DNA, 21 bp, Homo sapiens
tgacagtgcctgggaatgtat

SEQ ID NO: 6488480 - DNA, 19 bp, Homo sapiens
tgacagtgctctaggctgc

SEQ ID NO: 6488481 - DNA, 11 bp, Homo sapiens
tgacagtggct

SEQ ID NO: 6488482 - DNA, 17 bp, Homo sapiens
tgacagtggctgacaag

SEQ ID NO: 6488483 - DNA, 13 bp, Homo sapiens
tgacagtggctgc

SEQ ID NO: 6488484 - DNA, 20 bp, Homo sapiens
tgacagtggctgctctggga

SEQ ID NO: 6488485 - DNA, 16 bp, Homo sapiens
tgacagtggtgtgtgg

SEQ ID NO: 6488486 - DNA, 20 bp, Homo sapiens
tgacagtggttatatttcaa

SEQ ID NO: 6488487 - DNA, 14 bp, Homo sapiens
tgacagtgtatggg

SEQ ID NO: 6488488 - DNA, 19 bp, Homo sapiens
tgacagtgtgggacaggct

SEQ ID NO: 6488489 - DNA, 16 bp, Homo sapiens
tgacagtgttgaaaat

SEQ ID NO: 6488490 - DNA, 20 bp, Homo sapiens
tgacagttacttacacacct

SEQ ID NO: 6488491 - DNA, 16 bp, Homo sapiens
tgacagttcccagagt

SEQ ID NO: 6488492 - DNA, 15 bp, Homo sapiens
tgacagtttccaaat

SEQ ID NO: 6488493 - DNA, 20 bp, Homo sapiens
tgacagtttcttttgtgttc

SEQ ID NO: 6488494 - DNA, 23 bp, Homo sapiens
tgacagttttccataaagaagat

SEQ ID NO: 6488495 - DNA, 17 bp, Homo sapiens
tgacagtttttctgttt

SEQ ID NO: 6488496 - DNA, 15 bp, Homo sapiens
tgacagtttttgaca

SEQ ID NO: 6488497 - DNA, 18 bp, Homo sapiens
tgacataaaatttacatt

SEQ ID NO: 6488498 - DNA, 22 bp, Homo sapiens
tgacataaaatttacatttaat

SEQ ID NO: 6488499 - DNA, 19 bp, Homo sapiens
tgacataaacccatctgta

SEQ ID NO: 6488500 - DNA, 20 bp, Homo sapiens
tgacataaacccatctgtaa

SEQ ID NO: 6488501 - DNA, 22 bp, Homo sapiens
tgacataaacccatctgtaata

SEQ ID NO: 6488502 - DNA, 22 bp, Homo sapiens
tgacataacaccaaacttcatt

SEQ ID NO: 6488503 - DNA, 22 bp, Homo sapiens
tgacataaccaacattaaaact

SEQ ID NO: 6488504 - DNA, 15 bp, Homo sapiens
tgacataataaagac

SEQ ID NO: 6488505 - DNA, 16 bp, Homo sapiens
tgacataatatattct

SEQ ID NO: 6488506 - DNA, 17 bp, Homo sapiens
tgacataatgtagtgag

SEQ ID NO: 6488507 - DNA, 18 bp, Homo sapiens
tgacataatgtagtgagt

SEQ ID NO: 6488508 - DNA, 15 bp, Homo sapiens
tgacataattctaag

SEQ ID NO: 6488509 - DNA, 20 bp, Homo sapiens
tgacataccccctcccccac

SEQ ID NO: 6488510 - DNA, 13 bp, Homo sapiens
tgacataccttag

SEQ ID NO: 6488511 - DNA, 15 bp, Homo sapiens
tgacataccttgctt

SEQ ID NO: 6488512 - DNA, 15 bp, Homo sapiens
tgacataccttttat

SEQ ID NO: 6488513 - DNA, 18 bp, Homo sapiens
tgacatagagaaaaggct

SEQ ID NO: 6488514 - DNA, 14 bp, Homo sapiens
tgacatagcctcat

SEQ ID NO: 6488515 - DNA, 17 bp, Homo sapiens
tgacataggccaaggcc

SEQ ID NO: 6488516 - DNA, 16 bp, Homo sapiens
tgacatagtctggctg

SEQ ID NO: 6488517 - DNA, 16 bp, Homo sapiens
tgacatagtggatgga

SEQ ID NO: 6488518 - DNA, 20 bp, Homo sapiens
tgacatagtggatggacaga

SEQ ID NO: 6488519 - DNA, 23 bp, Homo sapiens
tgacatagtggatggacagatgg

SEQ ID NO: 6488520 - DNA, 15 bp, Homo sapiens
tgacatatcacatgt

SEQ ID NO: 6488521 - DNA, 16 bp, Homo sapiens
tgacatatcacatgtc

SEQ ID NO: 6488522 - DNA, 17 bp, Homo sapiens
tgacatattcaagtgat

SEQ ID NO: 6488523 - DNA, 15 bp, Homo sapiens
tgacatattggctct

SEQ ID NO: 6488524 - DNA, 11 bp, Homo sapiens
tgacatattta

SEQ ID NO: 6488525 - DNA, 20 bp, Homo sapiens
tgacatatttaatgttttaa

SEQ ID NO: 6488526 - DNA, 14 bp, Homo sapiens
tgacatcaaaaaag

SEQ ID NO: 6488527 - DNA, 15 bp, Homo sapiens
tgacatcaaaacttg

SEQ ID NO: 6488528 - DNA, 16 bp, Homo sapiens
tgacatcaaagcctgg

SEQ ID NO: 6488529 - DNA, 19 bp, Homo sapiens
tgacatcaaagcctggcct

SEQ ID NO: 6488530 - DNA, 14 bp, Homo sapiens
tgacatcaagtgta

SEQ ID NO: 6488531 - DNA, 16 bp, Homo sapiens
tgacatcaagtgtaat

SEQ ID NO: 6488532 - DNA, 14 bp, Homo sapiens
tgacatcacagcag

SEQ ID NO: 6488533 - DNA, 15 bp, Homo sapiens
tgacatcacagcagc

SEQ ID NO: 6488534 - DNA, 18 bp, Homo sapiens
tgacatcacagcagcctc

SEQ ID NO: 6488535 - DNA, 19 bp, Homo sapiens
tgacatcacagggcctcag

SEQ ID NO: 6488536 - DNA, 17 bp, Homo sapiens
tgacatcactggcatgg

SEQ ID NO: 6488537 - DNA, 13 bp, Homo sapiens
tgacatcacttgt

SEQ ID NO: 6488538 - DNA, 21 bp, Homo sapiens
tgacatcagaagtaactccca

SEQ ID NO: 6488539 - DNA, 13 bp, Homo sapiens
tgacatcagattt

SEQ ID NO: 6488540 - DNA, 14 bp, Homo sapiens
tgacatcagatttc

SEQ ID NO: 6488541 - DNA, 15 bp, Homo sapiens
tgacatcagatttct

SEQ ID NO: 6488542 - DNA, 18 bp, Homo sapiens
tgacatcagatttcttaa

SEQ ID NO: 6488543 - DNA, 22 bp, Homo sapiens
tgacatcagatttcttaatgtc

SEQ ID NO: 6488544 - DNA, 11 bp, Homo sapiens
tgacatcagca

SEQ ID NO: 6488545 - DNA, 15 bp, Homo sapiens
tgacatcagcacttt

SEQ ID NO: 6488546 - DNA, 18 bp, Homo sapiens
tgacatcagcgtagtgtt

SEQ ID NO: 6488547 - DNA, 20 bp, Homo sapiens
tgacatcaggtgatccacct

SEQ ID NO: 6488548 - DNA, 23 bp, Homo sapiens
tgacatcaggtgatccacctgcc

SEQ ID NO: 6488549 - DNA, 19 bp, Homo sapiens
tgacatcatgttagtcttt

SEQ ID NO: 6488550 - DNA, 16 bp, Homo sapiens
tgacatccaaatctag

SEQ ID NO: 6488551 - DNA, 22 bp, Homo sapiens
tgacatccagcagtccaaggta

SEQ ID NO: 6488552 - DNA, 15 bp, Homo sapiens
tgacatccaggatgg

SEQ ID NO: 6488553 - DNA, 12 bp, Homo sapiens
tgacatcccagg

SEQ ID NO: 6488554 - DNA, 20 bp, Homo sapiens
tgacatcccaggaggggcct

SEQ ID NO: 6488555 - DNA, 13 bp, Homo sapiens
tgacatcccttcc

SEQ ID NO: 6488556 - DNA, 17 bp, Homo sapiens
tgacatcccttcctgga

SEQ ID NO: 6488557 - DNA, 20 bp, Homo sapiens
tgacatcccttcctggaaac

SEQ ID NO: 6488558 - DNA, 15 bp, Homo sapiens
tgacatctaattcaa

SEQ ID NO: 6488559 - DNA, 21 bp, Homo sapiens
tgacatctacgaagccacagg

SEQ ID NO: 6488560 - DNA, 13 bp, Homo sapiens
tgacatctctttg

SEQ ID NO: 6488561 - DNA, 23 bp, Homo sapiens
tgacatctgattggcagatgagc

SEQ ID NO: 6488562 - DNA, 20 bp, Homo sapiens
tgacatcttgaatccttcca

SEQ ID NO: 6488563 - DNA, 17 bp, Homo sapiens
tgacatgaaaagttatt

SEQ ID NO: 6488564 - DNA, 21 bp, Homo sapiens
tgacatgacgtggtaaaatgt

SEQ ID NO: 6488565 - DNA, 22 bp, Homo sapiens
tgacatgacgtggtaaaatgtg

SEQ ID NO: 6488566 - DNA, 23 bp, Homo sapiens
tgacatgaggaaaataatgtaat

SEQ ID NO: 6488567 - DNA, 11 bp, Homo sapiens
tgacatgcact

SEQ ID NO: 6488568 - DNA, 17 bp, Homo sapiens
tgacatgcactgaccct

SEQ ID NO: 6488569 - DNA, 13 bp, Homo sapiens
tgacatgcagtta

SEQ ID NO: 6488570 - DNA, 14 bp, Homo sapiens
tgacatgcagttat

SEQ ID NO: 6488571 - DNA, 12 bp, Homo sapiens
tgacatgccacc

SEQ ID NO: 6488572 - DNA, 16 bp, Homo sapiens
tgacatgccctccctt

SEQ ID NO: 6488573 - DNA, 21 bp, Homo sapiens
tgacatgccctcccttctccc

SEQ ID NO: 6488574 - DNA, 22 bp, Homo sapiens
tgacatgccctcccttctccct

SEQ ID NO: 6488575 - DNA, 23 bp, Homo sapiens
tgacatgccctcccttctccctg

SEQ ID NO: 6488576 - DNA, 17 bp, Homo sapiens
tgacatgcgggctgggc

SEQ ID NO: 6488577 - DNA, 19 bp, Homo sapiens
tgacatgcgggctgggcag

SEQ ID NO: 6488578 - DNA, 22 bp, Homo sapiens
tgacatggaaagggtcttcctt

SEQ ID NO: 6488579 - DNA, 23 bp, Homo sapiens
tgacatggaggcactgaagcccg

SEQ ID NO: 6488580 - DNA, 22 bp, Homo sapiens
tgacatggattggatttcagtt

SEQ ID NO: 6488581 - DNA, 15 bp, Homo sapiens
tgacatgggccttta

SEQ ID NO: 6488582 - DNA, 21 bp, Homo sapiens
tgacatggggaaggcagaggc

SEQ ID NO: 6488583 - DNA, 18 bp, Homo sapiens
tgacatgggtattttata

SEQ ID NO: 6488584 - DNA, 16 bp, Homo sapiens
tgacatggtgcctgag

SEQ ID NO: 6488585 - DNA, 17 bp, Homo sapiens
tgacatggtgcctgaga

SEQ ID NO: 6488586 - DNA, 15 bp, Homo sapiens
tgacatggtgcctta

SEQ ID NO: 6488587 - DNA, 16 bp, Homo sapiens
tgacatgtagcttctt

SEQ ID NO: 6488588 - DNA, 17 bp, Homo sapiens
tgacatgtagcttcttc

SEQ ID NO: 6488589 - DNA, 15 bp, Homo sapiens
tgacatgtgaaacct

SEQ ID NO: 6488590 - DNA, 16 bp, Homo sapiens
tgacatgtgaaacctt

SEQ ID NO: 6488591 - DNA, 17 bp, Homo sapiens
tgacatgtgcagtgctg

SEQ ID NO: 6488592 - DNA, 18 bp, Homo sapiens
tgacatgtgcagtgctgt

SEQ ID NO: 6488593 - DNA, 15 bp, Homo sapiens
tgacatgtgcctgta

SEQ ID NO: 6488594 - DNA, 17 bp, Homo sapiens
tgacatgtggaaagtga

SEQ ID NO: 6488595 - DNA, 17 bp, Homo sapiens
tgacatgtggggccagg

SEQ ID NO: 6488596 - DNA, 20 bp, Homo sapiens
tgacatgtggggccaggtca

SEQ ID NO: 6488597 - DNA, 18 bp, Homo sapiens
tgacatgttatatatttt

SEQ ID NO: 6488598 - DNA, 19 bp, Homo sapiens
tgacatgttatatattttt

SEQ ID NO: 6488599 - DNA, 15 bp, Homo sapiens
tgacatgttgtcaca

SEQ ID NO: 6488600 - DNA, 13 bp, Homo sapiens
tgacattaaaaga

SEQ ID NO: 6488601 - DNA, 20 bp, Homo sapiens
tgacattaaatgcaataatt

SEQ ID NO: 6488602 - DNA, 21 bp, Homo sapiens
tgacattaacagttttccatg

SEQ ID NO: 6488603 - DNA, 22 bp, Homo sapiens
tgacattaacagttttccatga

SEQ ID NO: 6488604 - DNA, 21 bp, Homo sapiens
tgacattaagaatgttggttt

SEQ ID NO: 6488605 - DNA, 13 bp, Homo sapiens
tgacattactgta

SEQ ID NO: 6488606 - DNA, 22 bp, Homo sapiens
tgacattatgttttatttaaat

SEQ ID NO: 6488607 - DNA, 21 bp, Homo sapiens
tgacattattaaagttttcaa

SEQ ID NO: 6488608 - DNA, 14 bp, Homo sapiens
tgacattcactgag

SEQ ID NO: 6488609 - DNA, 14 bp, Homo sapiens
tgacattcagaaaa

SEQ ID NO: 6488610 - DNA, 13 bp, Homo sapiens
tgacattcccctc

SEQ ID NO: 6488611 - DNA, 16 bp, Homo sapiens
tgacattcctttgaat

SEQ ID NO: 6488612 - DNA, 24 bp, Homo sapiens
tgacattcgtgaaaaccaaccctg

SEQ ID NO: 6488613 - DNA, 14 bp, Homo sapiens
tgacattctacagt

SEQ ID NO: 6488614 - DNA, 22 bp, Homo sapiens
tgacattctcaggaagccccca

SEQ ID NO: 6488615 - DNA, 13 bp, Homo sapiens
tgacattctctat

SEQ ID NO: 6488616 - DNA, 20 bp, Homo sapiens
tgacattctctattgtaatt

SEQ ID NO: 6488617 - DNA, 18 bp, Homo sapiens
tgacattctgaatgcttc

SEQ ID NO: 6488618 - DNA, 19 bp, Homo sapiens
tgacattctgaatgcttct

SEQ ID NO: 6488619 - DNA, 21 bp, Homo sapiens
tgacattgaaatctaggaaaa

SEQ ID NO: 6488620 - DNA, 16 bp, Homo sapiens
tgacattgactatttt

SEQ ID NO: 6488621 - DNA, 17 bp, Homo sapiens
tgacattgatttctaat

SEQ ID NO: 6488622 - DNA, 19 bp, Homo sapiens
tgacattgatttctaatga

SEQ ID NO: 6488623 - DNA, 14 bp, Homo sapiens
tgacattgcacctg

SEQ ID NO: 6488624 - DNA, 14 bp, Homo sapiens
tgacattgccaaaa

SEQ ID NO: 6488625 - DNA, 18 bp, Homo sapiens
tgacattgccaaaaagga

SEQ ID NO: 6488626 - DNA, 15 bp, Homo sapiens
tgacattgcgtttga

SEQ ID NO: 6488627 - DNA, 19 bp, Homo sapiens
tgacattgcgtttgacctt

SEQ ID NO: 6488628 - DNA, 20 bp, Homo sapiens
tgacattgctccaagatgtt

SEQ ID NO: 6488629 - DNA, 22 bp, Homo sapiens
tgacattgctggtcatccttgg

SEQ ID NO: 6488630 - DNA, 13 bp, Homo sapiens
tgacattgcttta

SEQ ID NO: 6488631 - DNA, 19 bp, Homo sapiens
tgacattgtatgtatctat

SEQ ID NO: 6488632 - DNA, 21 bp, Homo sapiens
tgacattgtcagaatgttgtg

SEQ ID NO: 6488633 - DNA, 12 bp, Homo sapiens
tgacattgtctc

SEQ ID NO: 6488634 - DNA, 20 bp, Homo sapiens
tgacattgtggcacattctt

SEQ ID NO: 6488635 - DNA, 21 bp, Homo sapiens
tgacattgttggccaaagcca

SEQ ID NO: 6488636 - DNA, 21 bp, Homo sapiens
tggctctgggagagccagctt

SEQ ID NO: 6488637 - DNA, 15 bp, Homo sapiens
tggctctgggatcct

SEQ ID NO: 6488638 - DNA, 11 bp, Homo sapiens
tggctctgggg

SEQ ID NO: 6488639 - DNA, 18 bp, Homo sapiens
tggctctggggtatgtgt

SEQ ID NO: 6488640 - DNA, 12 bp, Homo sapiens
tggctctgggtg

SEQ ID NO: 6488641 - DNA, 23 bp, Homo sapiens
tggctctggtatgaattcacccg

SEQ ID NO: 6488642 - DNA, 22 bp, Homo sapiens
tggctctgttgctgtcctccag

SEQ ID NO: 6488643 - DNA, 15 bp, Homo sapiens
tggctcttccaggct

SEQ ID NO: 6488644 - DNA, 16 bp, Homo sapiens
tggctcttccaggctg

SEQ ID NO: 6488645 - DNA, 19 bp, Homo sapiens
tggctcttccaggctggga

SEQ ID NO: 6488646 - DNA, 20 bp, Homo sapiens
tggctcttccaggctgggag

SEQ ID NO: 6488647 - DNA, 19 bp, Homo sapiens
tggctcttctaacctcagc

SEQ ID NO: 6488648 - DNA, 15 bp, Homo sapiens
tggctcttctgccca

SEQ ID NO: 6488649 - DNA, 20 bp, Homo sapiens
tggctcttgatacccccctc

SEQ ID NO: 6488650 - DNA, 15 bp, Homo sapiens
tggctcttgcctgta

SEQ ID NO: 6488651 - DNA, 15 bp, Homo sapiens
tggctctttcagaga

SEQ ID NO: 6488652 - DNA, 20 bp, Homo sapiens
tggctctttctatcctgctc

SEQ ID NO: 6488653 - DNA, 16 bp, Homo sapiens
tggctctttgggctgg

SEQ ID NO: 6488654 - DNA, 16 bp, Homo sapiens
tggctgaaaatcacta

SEQ ID NO: 6488655 - DNA, 19 bp, Homo sapiens
tggctgaaaatgcaaagct

SEQ ID NO: 6488656 - DNA, 16 bp, Homo sapiens
tggctgaaaggaagct

SEQ ID NO: 6488657 - DNA, 21 bp, Homo sapiens
tggctgaaattatgtcaaatg

SEQ ID NO: 6488658 - DNA, 20 bp, Homo sapiens
tggctgaaattctcctggag

SEQ ID NO: 6488659 - DNA, 16 bp, Homo sapiens
tggctgaacagtgctc

SEQ ID NO: 6488660 - DNA, 20 bp, Homo sapiens
tggctgaacagtgctctgcc

SEQ ID NO: 6488661 - DNA, 20 bp, Homo sapiens
tggctgaaccctgtgctggt

SEQ ID NO: 6488662 - DNA, 23 bp, Homo sapiens
tggctgaaccctgtgctggtgtc

SEQ ID NO: 6488663 - DNA, 11 bp, Homo sapiens
tggctgaagaa

SEQ ID NO: 6488664 - DNA, 18 bp, Homo sapiens
tggctgaagaaacacagc

SEQ ID NO: 6488665 - DNA, 18 bp, Homo sapiens
tggctgaagaggaccaga

SEQ ID NO: 6488666 - DNA, 21 bp, Homo sapiens
tggctgaagaggaccagagga

SEQ ID NO: 6488667 - DNA, 24 bp, Homo sapiens
tggctgaagaggaccagaggagca

SEQ ID NO: 6488668 - DNA, 16 bp, Homo sapiens
tggctgaagctggagc

SEQ ID NO: 6488669 - DNA, 17 bp, Homo sapiens
tggctgaagctggagca

SEQ ID NO: 6488670 - DNA, 18 bp, Homo sapiens
tggctgaagctggagcag

SEQ ID NO: 6488671 - DNA, 19 bp, Homo sapiens
tggctgaagctggagcagc

SEQ ID NO: 6488672 - DNA, 14 bp, Homo sapiens
tggctgaaggactg

SEQ ID NO: 6488673 - DNA, 19 bp, Homo sapiens
tggctgaccaggccctgct

SEQ ID NO: 6488674 - DNA, 17 bp, Homo sapiens
tggctgacccagtccct

SEQ ID NO: 6488675 - DNA, 14 bp, Homo sapiens
tggctgacctgctg

SEQ ID NO: 6488676 - DNA, 14 bp, Homo sapiens
tggctgactgggaa

SEQ ID NO: 6488677 - DNA, 13 bp, Homo sapiens
tggctgactgggg

SEQ ID NO: 6488678 - DNA, 17 bp, Homo sapiens
tggctgacttcatctgg

SEQ ID NO: 6488679 - DNA, 16 bp, Homo sapiens
tggctgactttgctct

SEQ ID NO: 6488680 - DNA, 20 bp, Homo sapiens
tggctgagagagtggcattg

SEQ ID NO: 6488681 - DNA, 17 bp, Homo sapiens
tggctgagatagcagag

SEQ ID NO: 6488682 - DNA, 21 bp, Homo sapiens
tggctgagcaaatattaaaat

SEQ ID NO: 6488683 - DNA, 13 bp, Homo sapiens
tggctgagccccc

SEQ ID NO: 6488684 - DNA, 16 bp, Homo sapiens
tggctgagcccctggg

SEQ ID NO: 6488685 - DNA, 17 bp, Homo sapiens
tggctgagcccctgggg

SEQ ID NO: 6488686 - DNA, 20 bp, Homo sapiens
tggctgagcccctggggaaa

SEQ ID NO: 6488687 - DNA, 20 bp, Homo sapiens
tggctgaggcttgggcccag

SEQ ID NO: 6488688 - DNA, 23 bp, Homo sapiens
tggctgagggatgacttacctgt

SEQ ID NO: 6488689 - DNA, 15 bp, Homo sapiens
tggctgagggcagtt

SEQ ID NO: 6488690 - DNA, 23 bp, Homo sapiens
tggctgagggcagttcgcagcca

SEQ ID NO: 6488691 - DNA, 13 bp, Homo sapiens
tggctgataaaag

SEQ ID NO: 6488692 - DNA, 17 bp, Homo sapiens
tggctgatgatccagaa

SEQ ID NO: 6488693 - DNA, 13 bp, Homo sapiens
tggctgattggaa

SEQ ID NO: 6488694 - DNA, 16 bp, Homo sapiens
tggctgattggaaaat

SEQ ID NO: 6488695 - DNA, 18 bp, Homo sapiens
tggctgatttcaaatgca

SEQ ID NO: 6488696 - DNA, 20 bp, Homo sapiens
tggctgcaaataaggacagc

SEQ ID NO: 6488697 - DNA, 23 bp, Homo sapiens
tggctgcaagcccacctcggccc

SEQ ID NO: 6488698 - DNA, 23 bp, Homo sapiens
tggctgcaagtggttaagaatgt

SEQ ID NO: 6488699 - DNA, 20 bp, Homo sapiens
tggctgcacagcccaaccag

SEQ ID NO: 6488700 - DNA, 22 bp, Homo sapiens
tggctgcaccacttccagggtt

SEQ ID NO: 6488701 - DNA, 19 bp, Homo sapiens
tggctgcacctttttgcat

SEQ ID NO: 6488702 - DNA, 13 bp, Homo sapiens
tggctgcactctt

SEQ ID NO: 6488703 - DNA, 16 bp, Homo sapiens
tggctgcagagacctt

SEQ ID NO: 6488704 - DNA, 23 bp, Homo sapiens
tggctgcagcagcggtggcctct

SEQ ID NO: 6488705 - DNA, 17 bp, Homo sapiens
tggctgcagcctcagga

SEQ ID NO: 6488706 - DNA, 15 bp, Homo sapiens
tggctgcagcctccg

SEQ ID NO: 6488707 - DNA, 16 bp, Homo sapiens
tggctgcagcctccgg

SEQ ID NO: 6488708 - DNA, 10 bp, Homo sapiens
tggctgcagg

SEQ ID NO: 6488709 - DNA, 22 bp, Homo sapiens
tggctgcaggaagaaacttttt

SEQ ID NO: 6488710 - DNA, 14 bp, Homo sapiens
tggctgcaggaatc

SEQ ID NO: 6488711 - DNA, 16 bp, Homo sapiens
tggctgcaggaatctt

SEQ ID NO: 6488712 - DNA, 19 bp, Homo sapiens
tggctgcaggaatctttaa

SEQ ID NO: 6488713 - DNA, 13 bp, Homo sapiens
tggctgcaggcac

SEQ ID NO: 6488714 - DNA, 13 bp, Homo sapiens
tggctgcagggag

SEQ ID NO: 6488715 - DNA, 21 bp, Homo sapiens
tggctgcaggtgttctgctga

SEQ ID NO: 6488716 - DNA, 13 bp, Homo sapiens
tggctgccaagag

SEQ ID NO: 6488717 - DNA, 20 bp, Homo sapiens
tggctgccaatgggagctca

SEQ ID NO: 6488718 - DNA, 13 bp, Homo sapiens
tggctgccacacc

SEQ ID NO: 6488719 - DNA, 19 bp, Homo sapiens
tggctgccacacccagggg

SEQ ID NO: 6488720 - DNA, 17 bp, Homo sapiens
tggctgccagcccactg

SEQ ID NO: 6488721 - DNA, 12 bp, Homo sapiens
tggctgccaggc

SEQ ID NO: 6488722 - DNA, 21 bp, Homo sapiens
tggctgcccagacccctctgg

SEQ ID NO: 6488723 - DNA, 14 bp, Homo sapiens
tggctgcccaggag

SEQ ID NO: 6488724 - DNA, 18 bp, Homo sapiens
tggctgccccacaggcca

SEQ ID NO: 6488725 - DNA, 21 bp, Homo sapiens
tggctgccccacaggccacac

SEQ ID NO: 6488726 - DNA, 16 bp, Homo sapiens
tggctgccctggccct

SEQ ID NO: 6488727 - DNA, 17 bp, Homo sapiens
tggctgccggaggagca

SEQ ID NO: 6488728 - DNA, 17 bp, Homo sapiens
tggctgcctcatttaga

SEQ ID NO: 6488729 - DNA, 18 bp, Homo sapiens
tggctgcctccactccca

SEQ ID NO: 6488730 - DNA, 16 bp, Homo sapiens
tggctgccttctttcc

SEQ ID NO: 6488731 - DNA, 22 bp, Homo sapiens
tggctgccttgtgaaggaatta

SEQ ID NO: 6488732 - DNA, 21 bp, Homo sapiens
tggctgcggtgtttggcaatg

SEQ ID NO: 6488733 - DNA, 13 bp, Homo sapiens
tggctgctagcac

SEQ ID NO: 6488734 - DNA, 14 bp, Homo sapiens
tggctgctagcact

SEQ ID NO: 6488735 - DNA, 15 bp, Homo sapiens
tggctgctcactgtc

SEQ ID NO: 6488736 - DNA, 20 bp, Homo sapiens
tggctgctcccagcctcttg

SEQ ID NO: 6488737 - DNA, 21 bp, Homo sapiens
tggctgctcccagcctcttgc

SEQ ID NO: 6488738 - DNA, 13 bp, Homo sapiens
tggctgctccctg

SEQ ID NO: 6488739 - DNA, 18 bp, Homo sapiens
tggctgctccctgctccc

SEQ ID NO: 6488740 - DNA, 12 bp, Homo sapiens
tggctgctctgg

SEQ ID NO: 6488741 - DNA, 15 bp, Homo sapiens
tggctgctgaagctg

SEQ ID NO: 6488742 - DNA, 15 bp, Homo sapiens
tggctgctgacagga

SEQ ID NO: 6488743 - DNA, 13 bp, Homo sapiens
tggctgctgcagt

SEQ ID NO: 6488744 - DNA, 12 bp, Homo sapiens
tggctgctgcca

SEQ ID NO: 6488745 - DNA, 14 bp, Homo sapiens
tggctgctgcccag

SEQ ID NO: 6488746 - DNA, 16 bp, Homo sapiens
tggctgctgcccccac

SEQ ID NO: 6488747 - DNA, 14 bp, Homo sapiens
tggctgctgcctgc

SEQ ID NO: 6488748 - DNA, 13 bp, Homo sapiens
tggctgctgctca

SEQ ID NO: 6488749 - DNA, 15 bp, Homo sapiens
tggctgctgcttctt

SEQ ID NO: 6488750 - DNA, 11 bp, Homo sapiens
tggctgctggc

SEQ ID NO: 6488751 - DNA, 13 bp, Homo sapiens
tggctgctggccc

SEQ ID NO: 6488752 - DNA, 21 bp, Homo sapiens
tggctgctggcccacagctct

SEQ ID NO: 6488753 - DNA, 14 bp, Homo sapiens
tggctgctgtggga

SEQ ID NO: 6488754 - DNA, 16 bp, Homo sapiens
tggctgctgtgggaaa

SEQ ID NO: 6488755 - DNA, 14 bp, Homo sapiens
tggctgctgttgct

SEQ ID NO: 6488756 - DNA, 16 bp, Homo sapiens
tggctgcttcaaggat

SEQ ID NO: 6488757 - DNA, 21 bp, Homo sapiens
tggctgcttcaaggatcctga

SEQ ID NO: 6488758 - DNA, 16 bp, Homo sapiens
tggctgcttcctgtga

SEQ ID NO: 6488759 - DNA, 22 bp, Homo sapiens
tggctggaaagcagagcctcct

SEQ ID NO: 6488760 - DNA, 18 bp, Homo sapiens
tggctggaacactgtact

SEQ ID NO: 6488761 - DNA, 16 bp, Homo sapiens
tggctggaagagggtg

SEQ ID NO: 6488762 - DNA, 19 bp, Homo sapiens
tggctggaagatcctgcgg

SEQ ID NO: 6488763 - DNA, 21 bp, Homo sapiens
tggctggaagatcctgcgggt

SEQ ID NO: 6488764 - DNA, 16 bp, Homo sapiens
tggctggaatagtaaa

SEQ ID NO: 6488765 - DNA, 23 bp, Homo sapiens
tggctggaatagtaaactaaagt

SEQ ID NO: 6488766 - DNA, 11 bp, Homo sapiens
tggctggaatt

SEQ ID NO: 6488767 - DNA, 13 bp, Homo sapiens
tggctggactgga

SEQ ID NO: 6488768 - DNA, 11 bp, Homo sapiens
tggctggagac

SEQ ID NO: 6488769 - DNA, 21 bp, Homo sapiens
tggctggagaggaaaagccag

SEQ ID NO: 6488770 - DNA, 15 bp, Homo sapiens
tggctggagccccat

SEQ ID NO: 6488771 - DNA, 15 bp, Homo sapiens
tggctggaggaagga

SEQ ID NO: 6488772 - DNA, 22 bp, Homo sapiens
tggctggaggaagtggggtctg

SEQ ID NO: 6488773 - DNA, 16 bp, Homo sapiens
tggctggaggagctgg

SEQ ID NO: 6488774 - DNA, 17 bp, Homo sapiens
tggctggaggagctggc

SEQ ID NO: 6488775 - DNA, 22 bp, Homo sapiens
tggctggatgggggtgaagtat

SEQ ID NO: 6488776 - DNA, 15 bp, Homo sapiens
tggctggatgtgcat

SEQ ID NO: 6488777 - DNA, 22 bp, Homo sapiens
tggctggcagctgagagccctg

SEQ ID NO: 6488778 - DNA, 23 bp, Homo sapiens
tggctggcagctgagagccctgc

SEQ ID NO: 6488779 - DNA, 17 bp, Homo sapiens
tggctggcccgtcatgt

SEQ ID NO: 6488780 - DNA, 15 bp, Homo sapiens
tggctggcctcaccc

SEQ ID NO: 6488781 - DNA, 14 bp, Homo sapiens
tggctggcgcctgt

SEQ ID NO: 6488782 - DNA, 22 bp, Homo sapiens
tggctggctaactggaagcatg

SEQ ID NO: 6488783 - DNA, 13 bp, Homo sapiens
tggctggctccta

SEQ ID NO: 6488784 - DNA, 13 bp, Homo sapiens
tggctggctgcag

SEQ ID NO: 6488785 - DNA, 15 bp, Homo sapiens
tggctgggaactcac

SEQ ID NO: 6488786 - DNA, 15 bp, Homo sapiens
tggctgggacgtggc

SEQ ID NO: 6488787 - DNA, 19 bp, Homo sapiens
tggctgggacgtggctcag

SEQ ID NO: 6488788 - DNA, 17 bp, Homo sapiens
tggctgggactcctggt

SEQ ID NO: 6488789 - DNA, 20 bp, Homo sapiens
tggctgggactcctggtgcc

SEQ ID NO: 6488790 - DNA, 18 bp, Homo sapiens
tggctgggactgggaaca

SEQ ID NO: 6488791 - DNA, 23 bp, Homo sapiens
tggctgggagggggcccttccag

SEQ ID NO: 6488792 - DNA, 22 bp, Homo sapiens
tggctgggatcagagcaggagc

SEQ ID NO: 6488793 - DNA, 12 bp, Homo sapiens
tggctgggccca

SEQ ID NO: 6488794 - DNA, 18 bp, Homo sapiens
tggctgggcccagcaggg

SEQ ID NO: 6488795 - DNA, 15 bp, Homo sapiens
tggctgggcccctgg

SEQ ID NO: 6488796 - DNA, 19 bp, Homo sapiens
tggctgggcccctggggac

SEQ ID NO: 6488797 - DNA, 20 bp, Homo sapiens
tggctgggcccctggggaca

SEQ ID NO: 6488798 - DNA, 15 bp, Homo sapiens
tggctgggccttcac

SEQ ID NO: 6488799 - DNA, 23 bp, Homo sapiens
tggctgggctacaatttgttaat

SEQ ID NO: 6488800 - DNA, 17 bp, Homo sapiens
tggctgggctggctgaa

SEQ ID NO: 6488801 - DNA, 15 bp, Homo sapiens
tggctggggacttgg

SEQ ID NO: 6488802 - DNA, 20 bp, Homo sapiens
tggctggggacttggccgct

SEQ ID NO: 6488803 - DNA, 16 bp, Homo sapiens
tggctggggcagaggg

SEQ ID NO: 6488804 - DNA, 20 bp, Homo sapiens
tggctggggcagaggggcag

SEQ ID NO: 6488805 - DNA, 12 bp, Homo sapiens
tggctggggccg

SEQ ID NO: 6488806 - DNA, 20 bp, Homo sapiens
tggctggggccgctggggtc

SEQ ID NO: 6488807 - DNA, 13 bp, Homo sapiens
tggctggggccgg

SEQ ID NO: 6488808 - DNA, 22 bp, Homo sapiens
tggctggggcctatcagtgtgc

SEQ ID NO: 6488809 - DNA, 23 bp, Homo sapiens
tggctggggctggcacgggtgtc

SEQ ID NO: 6488810 - DNA, 11 bp, Homo sapiens
tggctggggga

SEQ ID NO: 6488811 - DNA, 20 bp, Homo sapiens
tggctgggggagggactgct

SEQ ID NO: 6488812 - DNA, 22 bp, Homo sapiens
tggctgggggagggactgctga

SEQ ID NO: 6488813 - DNA, 19 bp, Homo sapiens
tggctgggggcatggggga

SEQ ID NO: 6488814 - DNA, 15 bp, Homo sapiens
tggctgggggcctca

SEQ ID NO: 6488815 - DNA, 15 bp, Homo sapiens
tgacatttaataact

SEQ ID NO: 6488816 - DNA, 17 bp, Homo sapiens
tgacatttaatgccatc

SEQ ID NO: 6488817 - DNA, 23 bp, Homo sapiens
tgacatttaatttagtgatctta

SEQ ID NO: 6488818 - DNA, 17 bp, Homo sapiens
tgacatttacaggaggg

SEQ ID NO: 6488819 - DNA, 19 bp, Homo sapiens
tgacatttagaactttaag

SEQ ID NO: 6488820 - DNA, 19 bp, Homo sapiens
tgacatttaggattttgtg

SEQ ID NO: 6488821 - DNA, 21 bp, Homo sapiens
tgacatttatatttgtgtatt

SEQ ID NO: 6488822 - DNA, 16 bp, Homo sapiens
tgacatttatgtctca

SEQ ID NO: 6488823 - DNA, 21 bp, Homo sapiens
tgacatttatttttctcatga

SEQ ID NO: 6488824 - DNA, 22 bp, Homo sapiens
tgacatttcaatcactgaaaat

SEQ ID NO: 6488825 - DNA, 14 bp, Homo sapiens
tgacatttcacttc

SEQ ID NO: 6488826 - DNA, 14 bp, Homo sapiens
tgacatttcatctg

SEQ ID NO: 6488827 - DNA, 17 bp, Homo sapiens
tgacatttcattagcca

SEQ ID NO: 6488828 - DNA, 19 bp, Homo sapiens
tgacatttcattagccatg

SEQ ID NO: 6488829 - DNA, 14 bp, Homo sapiens
tgacatttcccaag

SEQ ID NO: 6488830 - DNA, 12 bp, Homo sapiens
tgacatttctaa

SEQ ID NO: 6488831 - DNA, 17 bp, Homo sapiens
tgacatttctaacatat

SEQ ID NO: 6488832 - DNA, 22 bp, Homo sapiens
tgacatttctaacatatgtatt

SEQ ID NO: 6488833 - DNA, 13 bp, Homo sapiens
tgacatttgcttt

SEQ ID NO: 6488834 - DNA, 22 bp, Homo sapiens
tgacatttgctttgggcagagg

SEQ ID NO: 6488835 - DNA, 21 bp, Homo sapiens
tgacatttggagtgttcccct

SEQ ID NO: 6488836 - DNA, 21 bp, Homo sapiens
tgacatttgggagacatgtga

SEQ ID NO: 6488837 - DNA, 15 bp, Homo sapiens
tgacatttggtggta

SEQ ID NO: 6488838 - DNA, 17 bp, Homo sapiens
tgacatttgtagttgag

SEQ ID NO: 6488839 - DNA, 16 bp, Homo sapiens
tgacatttgtagttgg

SEQ ID NO: 6488840 - DNA, 19 bp, Homo sapiens
tgacatttgtattctcaga

SEQ ID NO: 6488841 - DNA, 14 bp, Homo sapiens
tgacatttgtcatt

SEQ ID NO: 6488842 - DNA, 18 bp, Homo sapiens
tgacatttgtcattttca

SEQ ID NO: 6488843 - DNA, 18 bp, Homo sapiens
tgacatttgtcctgcaga

SEQ ID NO: 6488844 - DNA, 21 bp, Homo sapiens
tgacatttgtcctgcagagct

SEQ ID NO: 6488845 - DNA, 12 bp, Homo sapiens
tgacattttaca

SEQ ID NO: 6488846 - DNA, 20 bp, Homo sapiens
tgacattttctttttaaatt

SEQ ID NO: 6488847 - DNA, 14 bp, Homo sapiens
tgacattttgccaa

SEQ ID NO: 6488848 - DNA, 18 bp, Homo sapiens
tgacattttgtagctagt

SEQ ID NO: 6488849 - DNA, 20 bp, Homo sapiens
tgacattttgtagctagttt

SEQ ID NO: 6488850 - DNA, 23 bp, Homo sapiens
tgacattttgtagctagtttaaa

SEQ ID NO: 6488851 - DNA, 20 bp, Homo sapiens
tgacatttttcctctctgca

SEQ ID NO: 6488852 - DNA, 13 bp, Homo sapiens
tgacatttttctg

SEQ ID NO: 6488853 - DNA, 16 bp, Homo sapiens
tgacatttttgccaaa

SEQ ID NO: 6488854 - DNA, 21 bp, Homo sapiens
tgacatttttttctgatttgt

SEQ ID NO: 6488855 - DNA, 23 bp, Homo sapiens
tgacatttttttctgatttgtcc

SEQ ID NO: 6488856 - DNA, 23 bp, Homo sapiens
tgaccaaaaaaaagcatgaatat

SEQ ID NO: 6488857 - DNA, 19 bp, Homo sapiens
tgaccaaaaccagagggca

SEQ ID NO: 6488858 - DNA, 21 bp, Homo sapiens
tgaccaaaaccagagggcagt

SEQ ID NO: 6488859 - DNA, 23 bp, Homo sapiens
tgaccaaaagtgagatgggaagg

SEQ ID NO: 6488860 - DNA, 12 bp, Homo sapiens
tgaccaaaatac

SEQ ID NO: 6488861 - DNA, 16 bp, Homo sapiens
tgaccaaaatcccctt

SEQ ID NO: 6488862 - DNA, 14 bp, Homo sapiens
tgaccaaaccagcc

SEQ ID NO: 6488863 - DNA, 15 bp, Homo sapiens
tgaccaaaccagcct

SEQ ID NO: 6488864 - DNA, 17 bp, Homo sapiens
tgaccaaagactgcaga

SEQ ID NO: 6488865 - DNA, 22 bp, Homo sapiens
tgaccaaagatgacctgtggta

SEQ ID NO: 6488866 - DNA, 20 bp, Homo sapiens
tgaccaaagtcccttcctgc

SEQ ID NO: 6488867 - DNA, 16 bp, Homo sapiens
tgaccaaattgggaga

SEQ ID NO: 6488868 - DNA, 18 bp, Homo sapiens
tgaccaacaggctgttct

SEQ ID NO: 6488869 - DNA, 15 bp, Homo sapiens
tgaccaacatggaga

SEQ ID NO: 6488870 - DNA, 17 bp, Homo sapiens
tgaccaacatggagaaa

SEQ ID NO: 6488871 - DNA, 20 bp, Homo sapiens
tgaccaacatggagaaaccc

SEQ ID NO: 6488872 - DNA, 23 bp, Homo sapiens
tgaccaacatggagaaaccctgt

SEQ ID NO: 6488873 - DNA, 18 bp, Homo sapiens
tgaccaacctgtttctac

SEQ ID NO: 6488874 - DNA, 20 bp, Homo sapiens
tgaccaacctgtttctacct

SEQ ID NO: 6488875 - DNA, 20 bp, Homo sapiens
tgaccaactagacattctgt

SEQ ID NO: 6488876 - DNA, 12 bp, Homo sapiens
tgaccaactgtg

SEQ ID NO: 6488877 - DNA, 18 bp, Homo sapiens
tgaccaactgttggattc

SEQ ID NO: 6488878 - DNA, 16 bp, Homo sapiens
tgaccaagaaaaagaa

SEQ ID NO: 6488879 - DNA, 16 bp, Homo sapiens
tgaccaagaactgcat

SEQ ID NO: 6488880 - DNA, 21 bp, Homo sapiens
tgaccaagactgagccagctt

SEQ ID NO: 6488881 - DNA, 19 bp, Homo sapiens
tgaccaagcaggaagctca

SEQ ID NO: 6488882 - DNA, 20 bp, Homo sapiens
tgaccaagggaagtgaccaa

SEQ ID NO: 6488883 - DNA, 23 bp, Homo sapiens
tgaccaaggtaccgatttctgct

SEQ ID NO: 6488884 - DNA, 13 bp, Homo sapiens
tgaccaaggtgaa

SEQ ID NO: 6488885 - DNA, 20 bp, Homo sapiens
tgaccaaggtgaagatggcc

SEQ ID NO: 6488886 - DNA, 14 bp, Homo sapiens
tgaccaagtataaa

SEQ ID NO: 6488887 - DNA, 20 bp, Homo sapiens
tgaccaagttataaatcaat

SEQ ID NO: 6488888 - DNA, 14 bp, Homo sapiens
tgaccaatacattt

SEQ ID NO: 6488889 - DNA, 16 bp, Homo sapiens
tgaccaatacatttgt

SEQ ID NO: 6488890 - DNA, 23 bp, Homo sapiens
tgaccaatactactgtaaatgta

SEQ ID NO: 6488891 - DNA, 19 bp, Homo sapiens
tgaccaatattgtacagtt

SEQ ID NO: 6488892 - DNA, 21 bp, Homo sapiens
tgaccaatcctatgtcatttc

SEQ ID NO: 6488893 - DNA, 23 bp, Homo sapiens
tgaccaatcctatgtcatttcta

SEQ ID NO: 6488894 - DNA, 21 bp, Homo sapiens
tgaccaatcgggagtagcaag

SEQ ID NO: 6488895 - DNA, 19 bp, Homo sapiens
tgaccaatctctgtgactc

SEQ ID NO: 6488896 - DNA, 18 bp, Homo sapiens
tgaccaatgatggtcacc

SEQ ID NO: 6488897 - DNA, 20 bp, Homo sapiens
tgaccaatgcattaccttct

SEQ ID NO: 6488898 - DNA, 16 bp, Homo sapiens
tgaccaattgagtaag

SEQ ID NO: 6488899 - DNA, 19 bp, Homo sapiens
tgaccaattgagtaagaac

SEQ ID NO: 6488900 - DNA, 20 bp, Homo sapiens
tgaccaattgccctgccagg

SEQ ID NO: 6488901 - DNA, 22 bp, Homo sapiens
tgaccaattgccctgccaggct

SEQ ID NO: 6488902 - DNA, 15 bp, Homo sapiens
tgaccacaccaacca

SEQ ID NO: 6488903 - DNA, 22 bp, Homo sapiens
tgaccacacccgaagtcctgtc

SEQ ID NO: 6488904 - DNA, 23 bp, Homo sapiens
tgaccacacccgaagtcctgtca

SEQ ID NO: 6488905 - DNA, 21 bp, Homo sapiens
tgaccacaccttggccttctg

SEQ ID NO: 6488906 - DNA, 21 bp, Homo sapiens
tgaccacacgctgtctcttga

SEQ ID NO: 6488907 - DNA, 17 bp, Homo sapiens
tgaccacactccagctg

SEQ ID NO: 6488908 - DNA, 19 bp, Homo sapiens
tgaccacactccagctggg

SEQ ID NO: 6488909 - DNA, 16 bp, Homo sapiens
tgaccacagcacagcc

SEQ ID NO: 6488910 - DNA, 22 bp, Homo sapiens
tgaccacagcatcattttgcat

SEQ ID NO: 6488911 - DNA, 18 bp, Homo sapiens
tgaccaccagttaacgta

SEQ ID NO: 6488912 - DNA, 20 bp, Homo sapiens
tgaccaccccctgttccctg

SEQ ID NO: 6488913 - DNA, 13 bp, Homo sapiens
tgaccaccctccc

SEQ ID NO: 6488914 - DNA, 19 bp, Homo sapiens
tgaccaccctcccctctct

SEQ ID NO: 6488915 - DNA, 20 bp, Homo sapiens
tgaccaccctgcctgtggag

SEQ ID NO: 6488916 - DNA, 20 bp, Homo sapiens
tgaccacgcacctccacgcc

SEQ ID NO: 6488917 - DNA, 21 bp, Homo sapiens
tgaccacggacgtttccatca

SEQ ID NO: 6488918 - DNA, 14 bp, Homo sapiens
tgaccacgggcctc

SEQ ID NO: 6488919 - DNA, 16 bp, Homo sapiens
tgaccacgggcctcag

SEQ ID NO: 6488920 - DNA, 22 bp, Homo sapiens
tgaccacgggcctcagtttccc

SEQ ID NO: 6488921 - DNA, 16 bp, Homo sapiens
tgaccactccagagaa

SEQ ID NO: 6488922 - DNA, 16 bp, Homo sapiens
tgaccactgcagaaga

SEQ ID NO: 6488923 - DNA, 15 bp, Homo sapiens
tgaccactgggcctg

SEQ ID NO: 6488924 - DNA, 17 bp, Homo sapiens
tgaccactgggcctgct

SEQ ID NO: 6488925 - DNA, 20 bp, Homo sapiens
tgaccacttgaggcctgatc

SEQ ID NO: 6488926 - DNA, 18 bp, Homo sapiens
tgaccacttgatatgact

SEQ ID NO: 6488927 - DNA, 21 bp, Homo sapiens
tgaccagaaaatatgatatat

SEQ ID NO: 6488928 - DNA, 14 bp, Homo sapiens
tgaccagaaatggt

SEQ ID NO: 6488929 - DNA, 15 bp, Homo sapiens
tgaccagaacttttt

SEQ ID NO: 6488930 - DNA, 16 bp, Homo sapiens
tgaccagaactttttc

SEQ ID NO: 6488931 - DNA, 19 bp, Homo sapiens
tgaccagaactttttcctc

SEQ ID NO: 6488932 - DNA, 16 bp, Homo sapiens
tgaccagaagccttgg

SEQ ID NO: 6488933 - DNA, 21 bp, Homo sapiens
tgaccagaagtggcaggagga

SEQ ID NO: 6488934 - DNA, 21 bp, Homo sapiens
tgaccagaccaaggcagggcc

SEQ ID NO: 6488935 - DNA, 14 bp, Homo sapiens
tgaccagacctaga

SEQ ID NO: 6488936 - DNA, 16 bp, Homo sapiens
tgaccagacctagacc

SEQ ID NO: 6488937 - DNA, 19 bp, Homo sapiens
tgaccagacctagacctgg

SEQ ID NO: 6488938 - DNA, 21 bp, Homo sapiens
tgaccagacctagacctgggc

SEQ ID NO: 6488939 - DNA, 17 bp, Homo sapiens
tgaccagatctttctct

SEQ ID NO: 6488940 - DNA, 19 bp, Homo sapiens
tgaccagatctttctcttc

SEQ ID NO: 6488941 - DNA, 19 bp, Homo sapiens
tgaccagcaacttgtcttt

SEQ ID NO: 6488942 - DNA, 14 bp, Homo sapiens
tgaccagcacactg

SEQ ID NO: 6488943 - DNA, 11 bp, Homo sapiens
tgaccagcagc

SEQ ID NO: 6488944 - DNA, 15 bp, Homo sapiens
tgaccagcagcagct

SEQ ID NO: 6488945 - DNA, 20 bp, Homo sapiens
tgaccagcagcagctttcag

SEQ ID NO: 6488946 - DNA, 14 bp, Homo sapiens
tgaccagcaggagg

SEQ ID NO: 6488947 - DNA, 18 bp, Homo sapiens
tgaccagcaggagggaag

SEQ ID NO: 6488948 - DNA, 11 bp, Homo sapiens
tgaccagccac

SEQ ID NO: 6488949 - DNA, 20 bp, Homo sapiens
tgaccagccccgtgtagccc

SEQ ID NO: 6488950 - DNA, 16 bp, Homo sapiens
tgaccagcggaaacag

SEQ ID NO: 6488951 - DNA, 15 bp, Homo sapiens
tgaccagcggctgct

SEQ ID NO: 6488952 - DNA, 12 bp, Homo sapiens
tgaccagctccc

SEQ ID NO: 6488953 - DNA, 13 bp, Homo sapiens
tgaccagctcccc

SEQ ID NO: 6488954 - DNA, 17 bp, Homo sapiens
tgaccagctccccctcc

SEQ ID NO: 6488955 - DNA, 19 bp, Homo sapiens
tgaccagctccccctccct

SEQ ID NO: 6488956 - DNA, 19 bp, Homo sapiens
tgaccagctctcttcctgt

SEQ ID NO: 6488957 - DNA, 12 bp, Homo sapiens
tgaccaggaaag

SEQ ID NO: 6488958 - DNA, 16 bp, Homo sapiens
tgaccaggatcccaag

SEQ ID NO: 6488959 - DNA, 21 bp, Homo sapiens
tgaccaggatggagcaagctc

SEQ ID NO: 6488960 - DNA, 22 bp, Homo sapiens
tgaccaggcacctcccctcccg

SEQ ID NO: 6488961 - DNA, 15 bp, Homo sapiens
tgaccaggcagtttt

SEQ ID NO: 6488962 - DNA, 17 bp, Homo sapiens
tgaccaggccctgctca

SEQ ID NO: 6488963 - DNA, 15 bp, Homo sapiens
tgaccaggcctgggc

SEQ ID NO: 6488964 - DNA, 12 bp, Homo sapiens
tgaccaggctgg

SEQ ID NO: 6488965 - DNA, 20 bp, Homo sapiens
tgaccaggggccctacctgg

SEQ ID NO: 6488966 - DNA, 18 bp, Homo sapiens
tgaccagtataaaattac

SEQ ID NO: 6488967 - DNA, 14 bp, Homo sapiens
tgaccagtcaaggg

SEQ ID NO: 6488968 - DNA, 15 bp, Homo sapiens
tgaccagtctgaccc

SEQ ID NO: 6488969 - DNA, 23 bp, Homo sapiens
tgaccagtgagaactctctccct

SEQ ID NO: 6488970 - DNA, 14 bp, Homo sapiens
tgaccagtgcctgt

SEQ ID NO: 6488971 - DNA, 24 bp, Homo sapiens
tgaccagttctggccaggagctgg

SEQ ID NO: 6488972 - DNA, 18 bp, Homo sapiens
tgaccagttgcagtcact

SEQ ID NO: 6488973 - DNA, 13 bp, Homo sapiens
tgaccagtttacc

SEQ ID NO: 6488974 - DNA, 15 bp, Homo sapiens
tgaccagtttctttt

SEQ ID NO: 6488975 - DNA, 22 bp, Homo sapiens
tgaccagtttcttttcttttgt

SEQ ID NO: 6488976 - DNA, 22 bp, Homo sapiens
tgaccataatcctagccccgag

SEQ ID NO: 6488977 - DNA, 21 bp, Homo sapiens
tgaccatatagattttattat

SEQ ID NO: 6488978 - DNA, 15 bp, Homo sapiens
tgaccatcatgccct

SEQ ID NO: 6488979 - DNA, 22 bp, Homo sapiens
tgaccatccactctaccctccc

SEQ ID NO: 6488980 - DNA, 23 bp, Homo sapiens
tgaccatccactctaccctccca

SEQ ID NO: 6488981 - DNA, 14 bp, Homo sapiens
tgaccatcccatga

SEQ ID NO: 6488982 - DNA, 16 bp, Homo sapiens
tgaccatcctgtcctt

SEQ ID NO: 6488983 - DNA, 19 bp, Homo sapiens
tgaccatcgtccttcctct

SEQ ID NO: 6488984 - DNA, 21 bp, Homo sapiens
tgaccatctctcttattaata

SEQ ID NO: 6488985 - DNA, 22 bp, Homo sapiens
tgaccatctcttaggtctaatg

SEQ ID NO: 6488986 - DNA, 18 bp, Homo sapiens
tgaccatctgtttgagaa

SEQ ID NO: 6488987 - DNA, 13 bp, Homo sapiens
tgaccatgcaatt

SEQ ID NO: 6488988 - DNA, 19 bp, Homo sapiens
tgaccatgctcatctgctg

SEQ ID NO: 6488989 - DNA, 21 bp, Homo sapiens
tgaccatggttttggctctcc

SEQ ID NO: 6488990 - DNA, 12 bp, Homo sapiens
tgaccatgtact

SEQ ID NO: 6488991 - DNA, 20 bp, Homo sapiens
tggctgggggcctcagtgcc

SEQ ID NO: 6488992 - DNA, 21 bp, Homo sapiens
tggctgggggcctcagtgcca

SEQ ID NO: 6488993 - DNA, 18 bp, Homo sapiens
tggctggggtggcctgtg

SEQ ID NO: 6488994 - DNA, 19 bp, Homo sapiens
tggctggggtggcctgtgt

SEQ ID NO: 6488995 - DNA, 20 bp, Homo sapiens
tggctggggtggcctgtgtg

SEQ ID NO: 6488996 - DNA, 22 bp, Homo sapiens
tggctggggtggcctgtgtggc

SEQ ID NO: 6488997 - DNA, 22 bp, Homo sapiens
tggctgggtcagggccagactg

SEQ ID NO: 6488998 - DNA, 16 bp, Homo sapiens
tggctgggtcgcccct

SEQ ID NO: 6488999 - DNA, 20 bp, Homo sapiens
tggctgggtcgcccctcctc

SEQ ID NO: 6489000 - DNA, 13 bp, Homo sapiens
tggctgggttcag

SEQ ID NO: 6489001 - DNA, 19 bp, Homo sapiens
tggctgggttcaggtccca

SEQ ID NO: 6489002 - DNA, 19 bp, Homo sapiens
tggctgggttttcaggggc

SEQ ID NO: 6489003 - DNA, 14 bp, Homo sapiens
tggctggtactttc

SEQ ID NO: 6489004 - DNA, 17 bp, Homo sapiens
tggctggtagcagcagg

SEQ ID NO: 6489005 - DNA, 23 bp, Homo sapiens
tggctggtagcagcaggctcagg

SEQ ID NO: 6489006 - DNA, 14 bp, Homo sapiens
tggctggtcctccc

SEQ ID NO: 6489007 - DNA, 15 bp, Homo sapiens
tggctggtcctccca

SEQ ID NO: 6489008 - DNA, 17 bp, Homo sapiens
tggctggtcctcccatt

SEQ ID NO: 6489009 - DNA, 19 bp, Homo sapiens
tggctggtgagaccccgca

SEQ ID NO: 6489010 - DNA, 23 bp, Homo sapiens
tggctggtgagaccccgcactgc

SEQ ID NO: 6489011 - DNA, 16 bp, Homo sapiens
tggctggtgagccggt

SEQ ID NO: 6489012 - DNA, 20 bp, Homo sapiens
tggctggtgagccggtcagg

SEQ ID NO: 6489013 - DNA, 18 bp, Homo sapiens
tggctggtgcctgagccc

SEQ ID NO: 6489014 - DNA, 16 bp, Homo sapiens
tggctggtgggaaggc

SEQ ID NO: 6489015 - DNA, 17 bp, Homo sapiens
tggctggtgggaaggcc

SEQ ID NO: 6489016 - DNA, 13 bp, Homo sapiens
tggctggtgtccc

SEQ ID NO: 6489017 - DNA, 14 bp, Homo sapiens
tggctggtgtcccc

SEQ ID NO: 6489018 - DNA, 21 bp, Homo sapiens
tggctggtgtccccttcccct

SEQ ID NO: 6489019 - DNA, 20 bp, Homo sapiens
tggctggtgtggtacagaga

SEQ ID NO: 6489020 - DNA, 23 bp, Homo sapiens
tggctggtgtggtacagagaagc

SEQ ID NO: 6489021 - DNA, 23 bp, Homo sapiens
tggctgtaaaaacacaaatgtgt

SEQ ID NO: 6489022 - DNA, 13 bp, Homo sapiens
tggctgtaaaact

SEQ ID NO: 6489023 - DNA, 14 bp, Homo sapiens
tggctgtaaaactt

SEQ ID NO: 6489024 - DNA, 16 bp, Homo sapiens
tggctgtaaactataa

SEQ ID NO: 6489025 - DNA, 16 bp, Homo sapiens
tggctgtaacctgctg

SEQ ID NO: 6489026 - DNA, 17 bp, Homo sapiens
tggctgtaatcagttat

SEQ ID NO: 6489027 - DNA, 15 bp, Homo sapiens
tggctgtaatttaat

SEQ ID NO: 6489028 - DNA, 21 bp, Homo sapiens
tggctgtaatttaattcccct

SEQ ID NO: 6489029 - DNA, 19 bp, Homo sapiens
tggctgtactgccaaggta

SEQ ID NO: 6489030 - DNA, 20 bp, Homo sapiens
tggctgtagaaggagacaga

SEQ ID NO: 6489031 - DNA, 12 bp, Homo sapiens
tggctgtattca

SEQ ID NO: 6489032 - DNA, 14 bp, Homo sapiens
tggctgtattcaga

SEQ ID NO: 6489033 - DNA, 15 bp, Homo sapiens
tggctgtatttgctg

SEQ ID NO: 6489034 - DNA, 17 bp, Homo sapiens
tggctgtatttttagag

SEQ ID NO: 6489035 - DNA, 18 bp, Homo sapiens
tggctgtcaaatccatgt

SEQ ID NO: 6489036 - DNA, 14 bp, Homo sapiens
tggctgtcagcagg

SEQ ID NO: 6489037 - DNA, 12 bp, Homo sapiens
tggctgtccagt

SEQ ID NO: 6489038 - DNA, 17 bp, Homo sapiens
tggctgtcccctgcaag

SEQ ID NO: 6489039 - DNA, 20 bp, Homo sapiens
tggctgtcctcttaagacac

SEQ ID NO: 6489040 - DNA, 14 bp, Homo sapiens
tggctgtccttccc

SEQ ID NO: 6489041 - DNA, 20 bp, Homo sapiens
tggctgtccttccccttccc

SEQ ID NO: 6489042 - DNA, 14 bp, Homo sapiens
tggctgtctagaat

SEQ ID NO: 6489043 - DNA, 13 bp, Homo sapiens
tggctgtctgcac

SEQ ID NO: 6489044 - DNA, 17 bp, Homo sapiens
tggctgtctgtgggccg

SEQ ID NO: 6489045 - DNA, 12 bp, Homo sapiens
tggctgtgaaag

SEQ ID NO: 6489046 - DNA, 14 bp, Homo sapiens
tggctgtgaactga

SEQ ID NO: 6489047 - DNA, 11 bp, Homo sapiens
tggctgtgaca

SEQ ID NO: 6489048 - DNA, 19 bp, Homo sapiens
tggctgtgacaaccctggc

SEQ ID NO: 6489049 - DNA, 22 bp, Homo sapiens
tggctgtgacaaccctggcctc

SEQ ID NO: 6489050 - DNA, 23 bp, Homo sapiens
tggctgtgacaaccctggcctca

SEQ ID NO: 6489051 - DNA, 16 bp, Homo sapiens
tggctgtgacacctgg

SEQ ID NO: 6489052 - DNA, 18 bp, Homo sapiens
tggctgtgacctcttcaa

SEQ ID NO: 6489053 - DNA, 17 bp, Homo sapiens
tggctgtgagacgaggc

SEQ ID NO: 6489054 - DNA, 23 bp, Homo sapiens
tggctgtgagacgaggcaggggc

SEQ ID NO: 6489055 - DNA, 15 bp, Homo sapiens
tggctgtgagcagcc

SEQ ID NO: 6489056 - DNA, 16 bp, Homo sapiens
tggctgtgagcagcct

SEQ ID NO: 6489057 - DNA, 15 bp, Homo sapiens
tggctgtgaggcccc

SEQ ID NO: 6489058 - DNA, 20 bp, Homo sapiens
tggctgtgatgtcacagttt

SEQ ID NO: 6489059 - DNA, 15 bp, Homo sapiens
tggctgtgcccagca

SEQ ID NO: 6489060 - DNA, 16 bp, Homo sapiens
tggctgtgcccagcag

SEQ ID NO: 6489061 - DNA, 17 bp, Homo sapiens
tggctgtgcccagcagg

SEQ ID NO: 6489062 - DNA, 18 bp, Homo sapiens
tggctgtgcccagcaggc

SEQ ID NO: 6489063 - DNA, 21 bp, Homo sapiens
tggctgtgcccagcaggccca

SEQ ID NO: 6489064 - DNA, 23 bp, Homo sapiens
tggctgtgcccagcaggcccagc

SEQ ID NO: 6489065 - DNA, 16 bp, Homo sapiens
tggctgtgcccctgat

SEQ ID NO: 6489066 - DNA, 19 bp, Homo sapiens
tggctgtgcccctgatgca

SEQ ID NO: 6489067 - DNA, 15 bp, Homo sapiens
tggctgtgcctctgc

SEQ ID NO: 6489068 - DNA, 17 bp, Homo sapiens
tggctgtgcctctgcct

SEQ ID NO: 6489069 - DNA, 22 bp, Homo sapiens
tggctgtgcctctgcctgtctc

SEQ ID NO: 6489070 - DNA, 13 bp, Homo sapiens
tggctgtggaggc

SEQ ID NO: 6489071 - DNA, 20 bp, Homo sapiens
tggctgtggaggcctgatgc

SEQ ID NO: 6489072 - DNA, 18 bp, Homo sapiens
tggctgtggcccctcctt

SEQ ID NO: 6489073 - DNA, 23 bp, Homo sapiens
tggctgtggcccctccttctccc

SEQ ID NO: 6489074 - DNA, 20 bp, Homo sapiens
tggctgtggcctaacctgcc

SEQ ID NO: 6489075 - DNA, 13 bp, Homo sapiens
tggctgtgggctc

SEQ ID NO: 6489076 - DNA, 14 bp, Homo sapiens
tggctgtgggctcc

SEQ ID NO: 6489077 - DNA, 18 bp, Homo sapiens
tggctgtggggagtgttt

SEQ ID NO: 6489078 - DNA, 22 bp, Homo sapiens
tggctgtggttcctaagcctgt

SEQ ID NO: 6489079 - DNA, 20 bp, Homo sapiens
tggctgtgtaaccttgggtg

SEQ ID NO: 6489080 - DNA, 13 bp, Homo sapiens
tggctgtgtcctc

SEQ ID NO: 6489081 - DNA, 17 bp, Homo sapiens
tggctgtgtctaaactg

SEQ ID NO: 6489082 - DNA, 16 bp, Homo sapiens
tggctgtgtctctccc

SEQ ID NO: 6489083 - DNA, 14 bp, Homo sapiens
tggctgtgtgactt

SEQ ID NO: 6489084 - DNA, 22 bp, Homo sapiens
tggctgttaaccacccgccccg

SEQ ID NO: 6489085 - DNA, 19 bp, Homo sapiens
tggctgttatctgtcttta

SEQ ID NO: 6489086 - DNA, 20 bp, Homo sapiens
tggctgttcatgctccaaga

SEQ ID NO: 6489087 - DNA, 15 bp, Homo sapiens
tggctgttccagact

SEQ ID NO: 6489088 - DNA, 18 bp, Homo sapiens
tggctgttcctgattttt

SEQ ID NO: 6489089 - DNA, 16 bp, Homo sapiens
tggctgttggctgggg

SEQ ID NO: 6489090 - DNA, 18 bp, Homo sapiens
tggctgtttagcagaact

SEQ ID NO: 6489091 - DNA, 15 bp, Homo sapiens
tggctgtttcatcag

SEQ ID NO: 6489092 - DNA, 14 bp, Homo sapiens
tggctgtttgagat

SEQ ID NO: 6489093 - DNA, 22 bp, Homo sapiens
tggcttaaaaatacttaataaa

SEQ ID NO: 6489094 - DNA, 14 bp, Homo sapiens
tggcttaaacattt

SEQ ID NO: 6489095 - DNA, 15 bp, Homo sapiens
tggcttaaacatttt

SEQ ID NO: 6489096 - DNA, 21 bp, Homo sapiens
tggcttaaagggatggacttg

SEQ ID NO: 6489097 - DNA, 17 bp, Homo sapiens
tggcttaaagtgaagga

SEQ ID NO: 6489098 - DNA, 13 bp, Homo sapiens
tggcttaaatata

SEQ ID NO: 6489099 - DNA, 18 bp, Homo sapiens
tggcttaagcctgtgtat

SEQ ID NO: 6489100 - DNA, 16 bp, Homo sapiens
tggcttaagtgagcag

SEQ ID NO: 6489101 - DNA, 19 bp, Homo sapiens
tggcttaagtgagcagaac

SEQ ID NO: 6489102 - DNA, 22 bp, Homo sapiens
tggcttaagtgagcagaacagg

SEQ ID NO: 6489103 - DNA, 20 bp, Homo sapiens
tggcttaatgcttctttcat

SEQ ID NO: 6489104 - DNA, 11 bp, Homo sapiens
tggcttaattc

SEQ ID NO: 6489105 - DNA, 15 bp, Homo sapiens
tggcttacatttgaa

SEQ ID NO: 6489106 - DNA, 19 bp, Homo sapiens
tggcttacctgacctcttg

SEQ ID NO: 6489107 - DNA, 20 bp, Homo sapiens
tggcttactacatgtgggag

SEQ ID NO: 6489108 - DNA, 23 bp, Homo sapiens
tggcttactacatgtgggagctt

SEQ ID NO: 6489109 - DNA, 14 bp, Homo sapiens
tggcttagaaattt

SEQ ID NO: 6489110 - DNA, 18 bp, Homo sapiens
tggcttagcgttctgttt

SEQ ID NO: 6489111 - DNA, 20 bp, Homo sapiens
tggcttagttaagtcatcca

SEQ ID NO: 6489112 - DNA, 13 bp, Homo sapiens
tggcttataaaca

SEQ ID NO: 6489113 - DNA, 16 bp, Homo sapiens
tggcttataaacacat

SEQ ID NO: 6489114 - DNA, 16 bp, Homo sapiens
tggcttatgaaagagg

SEQ ID NO: 6489115 - DNA, 19 bp, Homo sapiens
tggcttatttaatatgctt

SEQ ID NO: 6489116 - DNA, 16 bp, Homo sapiens
tggcttatttgtataa

SEQ ID NO: 6489117 - DNA, 14 bp, Homo sapiens
tggcttattttaat

SEQ ID NO: 6489118 - DNA, 21 bp, Homo sapiens
tggcttattttttaaaataat

SEQ ID NO: 6489119 - DNA, 13 bp, Homo sapiens
tggcttcaaaaag

SEQ ID NO: 6489120 - DNA, 15 bp, Homo sapiens
tggcttcaaaaagcc

SEQ ID NO: 6489121 - DNA, 19 bp, Homo sapiens
tggcttcaaaaagccacag

SEQ ID NO: 6489122 - DNA, 22 bp, Homo sapiens
tggcttcaaatattatgcaggg

SEQ ID NO: 6489123 - DNA, 17 bp, Homo sapiens
tggcttcaagttgtaaa

SEQ ID NO: 6489124 - DNA, 20 bp, Homo sapiens
tggcttcaagttgtaaaaat

SEQ ID NO: 6489125 - DNA, 16 bp, Homo sapiens
tggcttcactcctgct

SEQ ID NO: 6489126 - DNA, 18 bp, Homo sapiens
tggcttcactcctgctgt

SEQ ID NO: 6489127 - DNA, 23 bp, Homo sapiens
tggcttcactctccctgacggct

SEQ ID NO: 6489128 - DNA, 13 bp, Homo sapiens
tggcttcagcccc

SEQ ID NO: 6489129 - DNA, 16 bp, Homo sapiens
tggcttcagctccagc

SEQ ID NO: 6489130 - DNA, 17 bp, Homo sapiens
tggcttcagctccagcc

SEQ ID NO: 6489131 - DNA, 18 bp, Homo sapiens
tggcttcagctccagccc

SEQ ID NO: 6489132 - DNA, 20 bp, Homo sapiens
tggcttcagctccagcccct

SEQ ID NO: 6489133 - DNA, 16 bp, Homo sapiens
tggcttcatctgtcaa

SEQ ID NO: 6489134 - DNA, 18 bp, Homo sapiens
tggcttcatgtggcactt

SEQ ID NO: 6489135 - DNA, 12 bp, Homo sapiens
tggcttcatttc

SEQ ID NO: 6489136 - DNA, 23 bp, Homo sapiens
tggcttccagaaaaccccagcat

SEQ ID NO: 6489137 - DNA, 20 bp, Homo sapiens
tggcttccagcgggccctct

SEQ ID NO: 6489138 - DNA, 14 bp, Homo sapiens
tggcttccagcttc

SEQ ID NO: 6489139 - DNA, 21 bp, Homo sapiens
tggcttccagcttcaggcacc

SEQ ID NO: 6489140 - DNA, 23 bp, Homo sapiens
tggcttccagcttcaggcaccag

SEQ ID NO: 6489141 - DNA, 20 bp, Homo sapiens
tggcttccaggtatctccag

SEQ ID NO: 6489142 - DNA, 21 bp, Homo sapiens
tggcttccaggtatctccagg

SEQ ID NO: 6489143 - DNA, 23 bp, Homo sapiens
tggcttcccaaatgtgtgcccag

SEQ ID NO: 6489144 - DNA, 20 bp, Homo sapiens
tggcttcccatagtggggcc

SEQ ID NO: 6489145 - DNA, 18 bp, Homo sapiens
tggcttcccatctgtggt

SEQ ID NO: 6489146 - DNA, 15 bp, Homo sapiens
tggcttccccactcc

SEQ ID NO: 6489147 - DNA, 15 bp, Homo sapiens
tggcttcccctccac

SEQ ID NO: 6489148 - DNA, 15 bp, Homo sapiens
tggcttcccgctcag

SEQ ID NO: 6489149 - DNA, 16 bp, Homo sapiens
tggcttcccgctcagc

SEQ ID NO: 6489150 - DNA, 17 bp, Homo sapiens
tggcttcccgctcagcc

SEQ ID NO: 6489151 - DNA, 15 bp, Homo sapiens
tggcttccctctctg

SEQ ID NO: 6489152 - DNA, 16 bp, Homo sapiens
tggcttccctgcccaa

SEQ ID NO: 6489153 - DNA, 13 bp, Homo sapiens
tggcttccctgga

SEQ ID NO: 6489154 - DNA, 13 bp, Homo sapiens
tggcttccgctgt

SEQ ID NO: 6489155 - DNA, 15 bp, Homo sapiens
tggcttccgctgtca

SEQ ID NO: 6489156 - DNA, 22 bp, Homo sapiens
tggcttccgctgtcacccagca

SEQ ID NO: 6489157 - DNA, 19 bp, Homo sapiens
tggcttccgtgagacacaa

SEQ ID NO: 6489158 - DNA, 14 bp, Homo sapiens
tggcttcctcctga

SEQ ID NO: 6489159 - DNA, 13 bp, Homo sapiens
tggcttcctctgc

SEQ ID NO: 6489160 - DNA, 15 bp, Homo sapiens
tggcttcctctgctg

SEQ ID NO: 6489161 - DNA, 17 bp, Homo sapiens
tggcttcctctgctgca

SEQ ID NO: 6489162 - DNA, 22 bp, Homo sapiens
tggcttcctctgctgcatcccc

SEQ ID NO: 6489163 - DNA, 12 bp, Homo sapiens
tggcttcctggc

SEQ ID NO: 6489164 - DNA, 20 bp, Homo sapiens
tggcttcggacaaaatatct

SEQ ID NO: 6489165 - DNA, 14 bp, Homo sapiens
tggcttcggagggc

SEQ ID NO: 6489166 - DNA, 22 bp, Homo sapiens
tggcttcggagggccgcagggc

SEQ ID NO: 6489167 - DNA, 22 bp, Homo sapiens
tggcttcgtcatttgcaagctg

SEQ ID NO: 6489168 - DNA, 16 bp, Homo sapiens
tggcttctatgatcag

SEQ ID NO: 6489169 - DNA, 14 bp, Homo sapiens
tggcttctccaggg

SEQ ID NO: 6489170 - DNA, 16 bp, Homo sapiens
tgaccatgttcattat

SEQ ID NO: 6489171 - DNA, 18 bp, Homo sapiens
tgaccatgttcattataa

SEQ ID NO: 6489172 - DNA, 16 bp, Homo sapiens
tgaccattaataaaga

SEQ ID NO: 6489173 - DNA, 18 bp, Homo sapiens
tgaccattattcacaggt

SEQ ID NO: 6489174 - DNA, 22 bp, Homo sapiens
tgaccattctcaccctgtgaaa

SEQ ID NO: 6489175 - DNA, 23 bp, Homo sapiens
tgaccattctcaccctgtgaaac

SEQ ID NO: 6489176 - DNA, 16 bp, Homo sapiens
tgaccattctccacct

SEQ ID NO: 6489177 - DNA, 20 bp, Homo sapiens
tgaccattctccacctgcca

SEQ ID NO: 6489178 - DNA, 22 bp, Homo sapiens
tgaccattctccacctgccagg

SEQ ID NO: 6489179 - DNA, 17 bp, Homo sapiens
tgaccattgaaaaagga

SEQ ID NO: 6489180 - DNA, 21 bp, Homo sapiens
tgaccattgaaaaaggaaaaa

SEQ ID NO: 6489181 - DNA, 18 bp, Homo sapiens
tgaccattggctgcgcta

SEQ ID NO: 6489182 - DNA, 12 bp, Homo sapiens
tgaccatttttt

SEQ ID NO: 6489183 - DNA, 15 bp, Homo sapiens
tgacccaaaatgtga

SEQ ID NO: 6489184 - DNA, 15 bp, Homo sapiens
tgacccaaagcaaaa

SEQ ID NO: 6489185 - DNA, 13 bp, Homo sapiens
tgacccaacaccc

SEQ ID NO: 6489186 - DNA, 17 bp, Homo sapiens
tgacccaactgatcctg

SEQ ID NO: 6489187 - DNA, 21 bp, Homo sapiens
tgacccaactgatcctgctcc

SEQ ID NO: 6489188 - DNA, 15 bp, Homo sapiens
tgacccaagaggtgg

SEQ ID NO: 6489189 - DNA, 18 bp, Homo sapiens
tgacccaatgctcctgga

SEQ ID NO: 6489190 - DNA, 16 bp, Homo sapiens
tgacccacactgccag

SEQ ID NO: 6489191 - DNA, 16 bp, Homo sapiens
tgacccacagcctcca

SEQ ID NO: 6489192 - DNA, 12 bp, Homo sapiens
tgacccacagct

SEQ ID NO: 6489193 - DNA, 19 bp, Homo sapiens
tgacccacagctctgggcc

SEQ ID NO: 6489194 - DNA, 22 bp, Homo sapiens
tgacccacagctctgggcctct

SEQ ID NO: 6489195 - DNA, 15 bp, Homo sapiens
tgacccacatgccat

SEQ ID NO: 6489196 - DNA, 15 bp, Homo sapiens
tgacccacccctgtg

SEQ ID NO: 6489197 - DNA, 16 bp, Homo sapiens
tgacccacccctgtgc

SEQ ID NO: 6489198 - DNA, 15 bp, Homo sapiens
tgacccacctgcgct

SEQ ID NO: 6489199 - DNA, 16 bp, Homo sapiens
tgacccacggggcagt

SEQ ID NO: 6489200 - DNA, 16 bp, Homo sapiens
tgacccactcacactt

SEQ ID NO: 6489201 - DNA, 20 bp, Homo sapiens
tgacccactgatctctacta

SEQ ID NO: 6489202 - DNA, 12 bp, Homo sapiens
tgacccactgct

SEQ ID NO: 6489203 - DNA, 17 bp, Homo sapiens
tgacccactggttcctt

SEQ ID NO: 6489204 - DNA, 17 bp, Homo sapiens
tgacccacttctcatca

SEQ ID NO: 6489205 - DNA, 18 bp, Homo sapiens
tgacccagagtggagtct

SEQ ID NO: 6489206 - DNA, 20 bp, Homo sapiens
tgacccagcactgcccaaag

SEQ ID NO: 6489207 - DNA, 18 bp, Homo sapiens
tgacccagcatctcccag

SEQ ID NO: 6489208 - DNA, 12 bp, Homo sapiens
tgacccagccct

SEQ ID NO: 6489209 - DNA, 15 bp, Homo sapiens
tgacccagctactga

SEQ ID NO: 6489210 - DNA, 21 bp, Homo sapiens
tgacccaggatatctgaaaat

SEQ ID NO: 6489211 - DNA, 16 bp, Homo sapiens
tgacccaggccgcagc

SEQ ID NO: 6489212 - DNA, 19 bp, Homo sapiens
tgacccaggccgcagctct

SEQ ID NO: 6489213 - DNA, 14 bp, Homo sapiens
tgacccaggctggg

SEQ ID NO: 6489214 - DNA, 19 bp, Homo sapiens
tgacccaggctgggcaagg

SEQ ID NO: 6489215 - DNA, 18 bp, Homo sapiens
tgacccagggactctcca

SEQ ID NO: 6489216 - DNA, 15 bp, Homo sapiens
tgacccagtccctgg

SEQ ID NO: 6489217 - DNA, 16 bp, Homo sapiens
tgacccagtccctggg

SEQ ID NO: 6489218 - DNA, 12 bp, Homo sapiens
tgacccagtgtg

SEQ ID NO: 6489219 - DNA, 23 bp, Homo sapiens
tgacccatcccttttcctttctg

SEQ ID NO: 6489220 - DNA, 14 bp, Homo sapiens
tgacccatgctgcc

SEQ ID NO: 6489221 - DNA, 18 bp, Homo sapiens
tgacccatgctgccctgt

SEQ ID NO: 6489222 - DNA, 21 bp, Homo sapiens
tgacccatgctgccctgtgag

SEQ ID NO: 6489223 - DNA, 18 bp, Homo sapiens
tgacccatgggcaggaga

SEQ ID NO: 6489224 - DNA, 17 bp, Homo sapiens
tgacccattcacatttt

SEQ ID NO: 6489225 - DNA, 20 bp, Homo sapiens
tgaccccaagggggctgctg

SEQ ID NO: 6489226 - DNA, 23 bp, Homo sapiens
tgaccccaagggggctgctgctc

SEQ ID NO: 6489227 - DNA, 19 bp, Homo sapiens
tgaccccacacgccggggc

SEQ ID NO: 6489228 - DNA, 20 bp, Homo sapiens
tgaccccacttatgctgctg

SEQ ID NO: 6489229 - DNA, 16 bp, Homo sapiens
tgaccccagcccagac

SEQ ID NO: 6489230 - DNA, 16 bp, Homo sapiens
tgaccccagctccagg

SEQ ID NO: 6489231 - DNA, 17 bp, Homo sapiens
tgaccccagctccaggc

SEQ ID NO: 6489232 - DNA, 18 bp, Homo sapiens
tgaccccagctccaggca

SEQ ID NO: 6489233 - DNA, 19 bp, Homo sapiens
tgaccccagctccaggcag

SEQ ID NO: 6489234 - DNA, 21 bp, Homo sapiens
tgaccccagctccaggcagga

SEQ ID NO: 6489235 - DNA, 20 bp, Homo sapiens
tgaccccaggagggaggcag

SEQ ID NO: 6489236 - DNA, 23 bp, Homo sapiens
tgaccccaggcagctcgagcatg

SEQ ID NO: 6489237 - DNA, 12 bp, Homo sapiens
tgaccccagggc

SEQ ID NO: 6489238 - DNA, 21 bp, Homo sapiens
tgaccccagggcacaggagct

SEQ ID NO: 6489239 - DNA, 16 bp, Homo sapiens
tgaccccagggcctgt

SEQ ID NO: 6489240 - DNA, 19 bp, Homo sapiens
tgaccccagggcctgtctc

SEQ ID NO: 6489241 - DNA, 17 bp, Homo sapiens
tgaccccagtttcttct

SEQ ID NO: 6489242 - DNA, 16 bp, Homo sapiens
tgaccccattcctgat

SEQ ID NO: 6489243 - DNA, 20 bp, Homo sapiens
tgacccccaggtattgtctt

SEQ ID NO: 6489244 - DNA, 13 bp, Homo sapiens
tgacccccatcgc

SEQ ID NO: 6489245 - DNA, 15 bp, Homo sapiens
tgacccccatgtaaa

SEQ ID NO: 6489246 - DNA, 19 bp, Homo sapiens
tgacccccatgtaaatatt

SEQ ID NO: 6489247 - DNA, 15 bp, Homo sapiens
tgacccccccagctt

SEQ ID NO: 6489248 - DNA, 23 bp, Homo sapiens
tgaccccccccattagaatgtga

SEQ ID NO: 6489249 - DNA, 15 bp, Homo sapiens
tgaccccctcccctg

SEQ ID NO: 6489250 - DNA, 17 bp, Homo sapiens
tgacccccttcctgtcc

SEQ ID NO: 6489251 - DNA, 21 bp, Homo sapiens
tgaccccgacgccacagccca

SEQ ID NO: 6489252 - DNA, 23 bp, Homo sapiens
tgaccccggtggcggccccagca

SEQ ID NO: 6489253 - DNA, 13 bp, Homo sapiens
tgacccctacccc

SEQ ID NO: 6489254 - DNA, 21 bp, Homo sapiens
tgacccctaccccctcatccc

SEQ ID NO: 6489255 - DNA, 17 bp, Homo sapiens
tgacccctcatagccct

SEQ ID NO: 6489256 - DNA, 20 bp, Homo sapiens
tgacccctcatagccctcac

SEQ ID NO: 6489257 - DNA, 21 bp, Homo sapiens
tgacccctcctcactggccat

SEQ ID NO: 6489258 - DNA, 15 bp, Homo sapiens
tgacccctcctgggg

SEQ ID NO: 6489259 - DNA, 23 bp, Homo sapiens
tgacccctcctggggccaggccg

SEQ ID NO: 6489260 - DNA, 15 bp, Homo sapiens
tgacccctctcctca

SEQ ID NO: 6489261 - DNA, 12 bp, Homo sapiens
tgacccctctgg

SEQ ID NO: 6489262 - DNA, 13 bp, Homo sapiens
tgacccctctggt

SEQ ID NO: 6489263 - DNA, 14 bp, Homo sapiens
tgacccctgcctgt

SEQ ID NO: 6489264 - DNA, 20 bp, Homo sapiens
tgacccctgcctgttggcag

SEQ ID NO: 6489265 - DNA, 14 bp, Homo sapiens
tgacccctgctttg

SEQ ID NO: 6489266 - DNA, 19 bp, Homo sapiens
tgacccctgctttgcccca

SEQ ID NO: 6489267 - DNA, 12 bp, Homo sapiens
tgacccctggcc

SEQ ID NO: 6489268 - DNA, 22 bp, Homo sapiens
tgacccctggccggcccaggcc

SEQ ID NO: 6489269 - DNA, 17 bp, Homo sapiens
tgacccctgtgtgacat

SEQ ID NO: 6489270 - DNA, 15 bp, Homo sapiens
tgaccccttccctgt

SEQ ID NO: 6489271 - DNA, 14 bp, Homo sapiens
tgaccccttcctgt

SEQ ID NO: 6489272 - DNA, 22 bp, Homo sapiens
tgaccccttcctgtctggccca

SEQ ID NO: 6489273 - DNA, 13 bp, Homo sapiens
tgacccctttccc

SEQ ID NO: 6489274 - DNA, 14 bp, Homo sapiens
tgacccctttcccc

SEQ ID NO: 6489275 - DNA, 17 bp, Homo sapiens
tgacccctttcccccac

SEQ ID NO: 6489276 - DNA, 14 bp, Homo sapiens
tgacccggaggcca

SEQ ID NO: 6489277 - DNA, 20 bp, Homo sapiens
tgacccggaggccacatgag

SEQ ID NO: 6489278 - DNA, 18 bp, Homo sapiens
tgacccggattggccctg

SEQ ID NO: 6489279 - DNA, 20 bp, Homo sapiens
tgacccggattggccctgcc

SEQ ID NO: 6489280 - DNA, 21 bp, Homo sapiens
tgacccggattggccctgccc

SEQ ID NO: 6489281 - DNA, 19 bp, Homo sapiens
tgacccggcaccccctgca

SEQ ID NO: 6489282 - DNA, 21 bp, Homo sapiens
tgacccggcaccccctgcagc

SEQ ID NO: 6489283 - DNA, 12 bp, Homo sapiens
tgacccggggca

SEQ ID NO: 6489284 - DNA, 15 bp, Homo sapiens
tgacccgtacacacc

SEQ ID NO: 6489285 - DNA, 18 bp, Homo sapiens
tgacccgtgaatgtgcct

SEQ ID NO: 6489286 - DNA, 16 bp, Homo sapiens
tgaccctactcccttg

SEQ ID NO: 6489287 - DNA, 21 bp, Homo sapiens
tgaccctatgggtctaggaca

SEQ ID NO: 6489288 - DNA, 12 bp, Homo sapiens
tgaccctcacct

SEQ ID NO: 6489289 - DNA, 15 bp, Homo sapiens
tgaccctcagctgtc

SEQ ID NO: 6489290 - DNA, 18 bp, Homo sapiens
tgaccctcagctgtcacc

SEQ ID NO: 6489291 - DNA, 19 bp, Homo sapiens
tgaccctcaggcacacctt

SEQ ID NO: 6489292 - DNA, 20 bp, Homo sapiens
tgaccctcaggcacaccttg

SEQ ID NO: 6489293 - DNA, 13 bp, Homo sapiens
tgaccctcattct

SEQ ID NO: 6489294 - DNA, 11 bp, Homo sapiens
tgaccctccaa

SEQ ID NO: 6489295 - DNA, 13 bp, Homo sapiens
tgaccctccaaat

SEQ ID NO: 6489296 - DNA, 16 bp, Homo sapiens
tgaccctcccagtctc

SEQ ID NO: 6489297 - DNA, 14 bp, Homo sapiens
tgaccctccctacc

SEQ ID NO: 6489298 - DNA, 16 bp, Homo sapiens
tgaccctcctgtccag

SEQ ID NO: 6489299 - DNA, 21 bp, Homo sapiens
tgaccctcctgtccagcaggt

SEQ ID NO: 6489300 - DNA, 16 bp, Homo sapiens
tgaccctcctgttgca

SEQ ID NO: 6489301 - DNA, 21 bp, Homo sapiens
tgaccctcctgttgcacccag

SEQ ID NO: 6489302 - DNA, 12 bp, Homo sapiens
tgaccctctgtc

SEQ ID NO: 6489303 - DNA, 13 bp, Homo sapiens
tgaccctctgtcc

SEQ ID NO: 6489304 - DNA, 23 bp, Homo sapiens
tgaccctgaaaggaacactggct

SEQ ID NO: 6489305 - DNA, 15 bp, Homo sapiens
tgaccctgaagtgag

SEQ ID NO: 6489306 - DNA, 13 bp, Homo sapiens
tgaccctgaggag

SEQ ID NO: 6489307 - DNA, 21 bp, Homo sapiens
tgaccctgagggctcctccat

SEQ ID NO: 6489308 - DNA, 16 bp, Homo sapiens
tgaccctgatcagtct

SEQ ID NO: 6489309 - DNA, 12 bp, Homo sapiens
tgaccctgcctc

SEQ ID NO: 6489310 - DNA, 18 bp, Homo sapiens
tgaccctgcctctcccag

SEQ ID NO: 6489311 - DNA, 19 bp, Homo sapiens
tgaccctgcctctcccagg

SEQ ID NO: 6489312 - DNA, 20 bp, Homo sapiens
tgaccctgcgaaggggccct

SEQ ID NO: 6489313 - DNA, 12 bp, Homo sapiens
tgaccctggagc

SEQ ID NO: 6489314 - DNA, 16 bp, Homo sapiens
tgaccctggagcccgg

SEQ ID NO: 6489315 - DNA, 11 bp, Homo sapiens
tgaccctgggc

SEQ ID NO: 6489316 - DNA, 13 bp, Homo sapiens
tgaccctgggcaa

SEQ ID NO: 6489317 - DNA, 19 bp, Homo sapiens
tgaccctgtatatagccca

SEQ ID NO: 6489318 - DNA, 19 bp, Homo sapiens
tgaccctgtcacttgctgg

SEQ ID NO: 6489319 - DNA, 14 bp, Homo sapiens
tgaccctgtgcccc

SEQ ID NO: 6489320 - DNA, 13 bp, Homo sapiens
tgaccctgtgcct

SEQ ID NO: 6489321 - DNA, 14 bp, Homo sapiens
tgaccctgtgcctg

SEQ ID NO: 6489322 - DNA, 16 bp, Homo sapiens
tgaccctgtgcctgtg

SEQ ID NO: 6489323 - DNA, 17 bp, Homo sapiens
tgaccctgtgcctgtgt

SEQ ID NO: 6489324 - DNA, 20 bp, Homo sapiens
tgacccttacagcctctgac

SEQ ID NO: 6489325 - DNA, 22 bp, Homo sapiens
tgacccttacagcctctgactt

SEQ ID NO: 6489326 - DNA, 20 bp, Homo sapiens
tgacccttccagacatacga

SEQ ID NO: 6489327 - DNA, 21 bp, Homo sapiens
tgacccttccagacatacgaa

SEQ ID NO: 6489328 - DNA, 21 bp, Homo sapiens
tgacccttcccaatcagcact

SEQ ID NO: 6489329 - DNA, 22 bp, Homo sapiens
tgacccttgggcctgggcctct

SEQ ID NO: 6489330 - DNA, 15 bp, Homo sapiens
tgacccttgtcatct

SEQ ID NO: 6489331 - DNA, 21 bp, Homo sapiens
tgacccttgtcatctctctgc

SEQ ID NO: 6489332 - DNA, 19 bp, Homo sapiens
tgaccgaaacagcgctggg

SEQ ID NO: 6489333 - DNA, 22 bp, Homo sapiens
tgaccgaagggacggggcccgc

SEQ ID NO: 6489334 - DNA, 12 bp, Homo sapiens
tgaccgagagaa

SEQ ID NO: 6489335 - DNA, 17 bp, Homo sapiens
tgaccgagccctggaga

SEQ ID NO: 6489336 - DNA, 13 bp, Homo sapiens
tgaccgcccagct

SEQ ID NO: 6489337 - DNA, 14 bp, Homo sapiens
tgaccgcccagctc

SEQ ID NO: 6489338 - DNA, 13 bp, Homo sapiens
tgaccgccctccg

SEQ ID NO: 6489339 - DNA, 19 bp, Homo sapiens
tgaccgcgactaatttcaa

SEQ ID NO: 6489340 - DNA, 14 bp, Homo sapiens
tgaccgcttccccg

SEQ ID NO: 6489341 - DNA, 22 bp, Homo sapiens
tgaccgcttccccgatgtgagc

SEQ ID NO: 6489342 - DNA, 17 bp, Homo sapiens
tgaccggaatggtcaaa

SEQ ID NO: 6489343 - DNA, 16 bp, Homo sapiens
tgaccggacttttctg

SEQ ID NO: 6489344 - DNA, 16 bp, Homo sapiens
tgaccggcacctgcga

SEQ ID NO: 6489345 - DNA, 18 bp, Homo sapiens
tgaccggcccgccacctt

SEQ ID NO: 6489346 - DNA, 21 bp, Homo sapiens
tgaccggctgccgtttgagga

SEQ ID NO: 6489347 - DNA, 22 bp, Homo sapiens
tgaccgggggctgctgggcgtc

SEQ ID NO: 6489348 - DNA, 20 bp, Homo sapiens
tgaccggggtcctgaggctg

SEQ ID NO: 6489349 - DNA, 20 bp, Homo sapiens
tgaccgggtctgcttctgca

SEQ ID NO: 6489350 - DNA, 15 bp, Homo sapiens
tggcttctccaggga

SEQ ID NO: 6489351 - DNA, 23 bp, Homo sapiens
tggcttctccatcctcatttgca

SEQ ID NO: 6489352 - DNA, 19 bp, Homo sapiens
tggcttctccctggggacg

SEQ ID NO: 6489353 - DNA, 24 bp, Homo sapiens
tggcttctccctggggacggggct

SEQ ID NO: 6489354 - DNA, 15 bp, Homo sapiens
tggcttctcctgtga

SEQ ID NO: 6489355 - DNA, 16 bp, Homo sapiens
tggcttctcctgtgac

SEQ ID NO: 6489356 - DNA, 19 bp, Homo sapiens
tggcttctcctttggcatg

SEQ ID NO: 6489357 - DNA, 11 bp, Homo sapiens
tggcttctctc

SEQ ID NO: 6489358 - DNA, 22 bp, Homo sapiens
tggcttctctcttttcctcctc

SEQ ID NO: 6489359 - DNA, 16 bp, Homo sapiens
tggcttctctgaggaa

SEQ ID NO: 6489360 - DNA, 23 bp, Homo sapiens
tggcttctctgccctgccctggc

SEQ ID NO: 6489361 - DNA, 12 bp, Homo sapiens
tggcttctgatg

SEQ ID NO: 6489362 - DNA, 17 bp, Homo sapiens
tggcttctgcttgtcat

SEQ ID NO: 6489363 - DNA, 14 bp, Homo sapiens
tggcttctggagcc

SEQ ID NO: 6489364 - DNA, 15 bp, Homo sapiens
tggcttctggccagg

SEQ ID NO: 6489365 - DNA, 11 bp, Homo sapiens
tggcttctggg

SEQ ID NO: 6489366 - DNA, 16 bp, Homo sapiens
tggcttctgggacctg

SEQ ID NO: 6489367 - DNA, 22 bp, Homo sapiens
tggcttctgtgattaggtgaag

SEQ ID NO: 6489368 - DNA, 12 bp, Homo sapiens
tggcttctgtgc

SEQ ID NO: 6489369 - DNA, 13 bp, Homo sapiens
tggcttctgtgca

SEQ ID NO: 6489370 - DNA, 14 bp, Homo sapiens
tggcttctgtgggg

SEQ ID NO: 6489371 - DNA, 15 bp, Homo sapiens
tggcttctgtttcta

SEQ ID NO: 6489372 - DNA, 15 bp, Homo sapiens
tggcttcttaaaaac

SEQ ID NO: 6489373 - DNA, 16 bp, Homo sapiens
tggcttcttaaaaact

SEQ ID NO: 6489374 - DNA, 23 bp, Homo sapiens
tggcttcttaaaaactgtgtatc

SEQ ID NO: 6489375 - DNA, 18 bp, Homo sapiens
tggcttcttctttaggat

SEQ ID NO: 6489376 - DNA, 13 bp, Homo sapiens
tggcttctttcca

SEQ ID NO: 6489377 - DNA, 18 bp, Homo sapiens
tggcttctttgctttctc

SEQ ID NO: 6489378 - DNA, 20 bp, Homo sapiens
tggcttgaagccaagtcagc

SEQ ID NO: 6489379 - DNA, 15 bp, Homo sapiens
tggcttgacagcatg

SEQ ID NO: 6489380 - DNA, 21 bp, Homo sapiens
tggcttgagctagagataaaa

SEQ ID NO: 6489381 - DNA, 15 bp, Homo sapiens
tggcttgagtgaatt

SEQ ID NO: 6489382 - DNA, 17 bp, Homo sapiens
tggcttgccccaggact

SEQ ID NO: 6489383 - DNA, 22 bp, Homo sapiens
tggcttgccccaggactctggc

SEQ ID NO: 6489384 - DNA, 16 bp, Homo sapiens
tggcttgcccctgtgg

SEQ ID NO: 6489385 - DNA, 13 bp, Homo sapiens
tggcttgctccag

SEQ ID NO: 6489386 - DNA, 21 bp, Homo sapiens
tggcttgctcccgccccaggg

SEQ ID NO: 6489387 - DNA, 22 bp, Homo sapiens
tggcttgctcccgccccagggt

SEQ ID NO: 6489388 - DNA, 23 bp, Homo sapiens
tggcttgctcccgccccagggtc

SEQ ID NO: 6489389 - DNA, 21 bp, Homo sapiens
tggcttgctttcttctcctgt

SEQ ID NO: 6489390 - DNA, 15 bp, Homo sapiens
tggcttggaggaaat

SEQ ID NO: 6489391 - DNA, 16 bp, Homo sapiens
tggcttggcatctgtg

SEQ ID NO: 6489392 - DNA, 17 bp, Homo sapiens
tggcttggcatctgtgt

SEQ ID NO: 6489393 - DNA, 19 bp, Homo sapiens
tggcttggccacagccagg

SEQ ID NO: 6489394 - DNA, 22 bp, Homo sapiens
tggcttggccacagccagggga

SEQ ID NO: 6489395 - DNA, 19 bp, Homo sapiens
tggcttggccctggcagcc

SEQ ID NO: 6489396 - DNA, 22 bp, Homo sapiens
tggcttggcctatctcctaggg

SEQ ID NO: 6489397 - DNA, 13 bp, Homo sapiens
tggcttggcttta

SEQ ID NO: 6489398 - DNA, 16 bp, Homo sapiens
tggcttgggaaactga

SEQ ID NO: 6489399 - DNA, 17 bp, Homo sapiens
tggcttgggcagggtct

SEQ ID NO: 6489400 - DNA, 15 bp, Homo sapiens
tggcttggggagcag

SEQ ID NO: 6489401 - DNA, 22 bp, Homo sapiens
tggcttggggtcaagaaacagc

SEQ ID NO: 6489402 - DNA, 22 bp, Homo sapiens
tggcttgtacatttttaaattc

SEQ ID NO: 6489403 - DNA, 14 bp, Homo sapiens
tggcttgtagaatt

SEQ ID NO: 6489404 - DNA, 19 bp, Homo sapiens
tggcttgtagaattgttat

SEQ ID NO: 6489405 - DNA, 13 bp, Homo sapiens
tggcttgtgaact

SEQ ID NO: 6489406 - DNA, 14 bp, Homo sapiens
tggcttgtgaactg

SEQ ID NO: 6489407 - DNA, 17 bp, Homo sapiens
tggcttgtgaactgctg

SEQ ID NO: 6489408 - DNA, 14 bp, Homo sapiens
tggcttgtgtgttt

SEQ ID NO: 6489409 - DNA, 21 bp, Homo sapiens
tggcttgttcatcatccagat

SEQ ID NO: 6489410 - DNA, 21 bp, Homo sapiens
tggctttaaccgtttttcaag

SEQ ID NO: 6489411 - DNA, 23 bp, Homo sapiens
tggctttaagccttcaaaactat

SEQ ID NO: 6489412 - DNA, 14 bp, Homo sapiens
tggctttaattgta

SEQ ID NO: 6489413 - DNA, 20 bp, Homo sapiens
tggctttaggagcagtggga

SEQ ID NO: 6489414 - DNA, 16 bp, Homo sapiens
tggctttatgcacatt

SEQ ID NO: 6489415 - DNA, 23 bp, Homo sapiens
tggctttattactcccctaagtc

SEQ ID NO: 6489416 - DNA, 12 bp, Homo sapiens
tggctttcaaag

SEQ ID NO: 6489417 - DNA, 17 bp, Homo sapiens
tggctttcaaggctggg

SEQ ID NO: 6489418 - DNA, 19 bp, Homo sapiens
tggctttcaaggctggggc

SEQ ID NO: 6489419 - DNA, 21 bp, Homo sapiens
tggctttcaaggctggggcat

SEQ ID NO: 6489420 - DNA, 23 bp, Homo sapiens
tggctttcaaggctggggcatgg

SEQ ID NO: 6489421 - DNA, 14 bp, Homo sapiens
tggctttcatcctg

SEQ ID NO: 6489422 - DNA, 15 bp, Homo sapiens
tggctttcatcctgt

SEQ ID NO: 6489423 - DNA, 20 bp, Homo sapiens
tggctttcatcctgtgtccc

SEQ ID NO: 6489424 - DNA, 21 bp, Homo sapiens
tggctttccaggagacatata

SEQ ID NO: 6489425 - DNA, 14 bp, Homo sapiens
tggctttccaggca

SEQ ID NO: 6489426 - DNA, 15 bp, Homo sapiens
tggctttcctgctgg

SEQ ID NO: 6489427 - DNA, 17 bp, Homo sapiens
tggctttcctgtttcta

SEQ ID NO: 6489428 - DNA, 19 bp, Homo sapiens
tggctttccttgtggcaga

SEQ ID NO: 6489429 - DNA, 22 bp, Homo sapiens
tggctttctctccttggccttt

SEQ ID NO: 6489430 - DNA, 18 bp, Homo sapiens
tggctttgacatgaaaag

SEQ ID NO: 6489431 - DNA, 15 bp, Homo sapiens
tggctttgaggccga

SEQ ID NO: 6489432 - DNA, 15 bp, Homo sapiens
tggctttgcagctgc

SEQ ID NO: 6489433 - DNA, 18 bp, Homo sapiens
tggctttgcagctgctgt

SEQ ID NO: 6489434 - DNA, 20 bp, Homo sapiens
tggctttgcagctgctgtct

SEQ ID NO: 6489435 - DNA, 13 bp, Homo sapiens
tggctttgcccac

SEQ ID NO: 6489436 - DNA, 18 bp, Homo sapiens
tggctttgcccacccctc

SEQ ID NO: 6489437 - DNA, 20 bp, Homo sapiens
tggctttgcccacccctcac

SEQ ID NO: 6489438 - DNA, 22 bp, Homo sapiens
tggctttgctctattaagattg

SEQ ID NO: 6489439 - DNA, 13 bp, Homo sapiens
tggctttggaata

SEQ ID NO: 6489440 - DNA, 14 bp, Homo sapiens
tggctttggcactc

SEQ ID NO: 6489441 - DNA, 18 bp, Homo sapiens
tggctttggcagtgtttt

SEQ ID NO: 6489442 - DNA, 17 bp, Homo sapiens
tggctttggcttcttgg

SEQ ID NO: 6489443 - DNA, 21 bp, Homo sapiens
tggctttgggaaagcccagac

SEQ ID NO: 6489444 - DNA, 16 bp, Homo sapiens
tggctttggtccccag

SEQ ID NO: 6489445 - DNA, 14 bp, Homo sapiens
tggctttggtctct

SEQ ID NO: 6489446 - DNA, 14 bp, Homo sapiens
tggctttgtataga

SEQ ID NO: 6489447 - DNA, 22 bp, Homo sapiens
tggctttgtatagaacctcttt

SEQ ID NO: 6489448 - DNA, 20 bp, Homo sapiens
tggctttgtcacttttcctt

SEQ ID NO: 6489449 - DNA, 20 bp, Homo sapiens
tggctttgtgattcaatctg

SEQ ID NO: 6489450 - DNA, 19 bp, Homo sapiens
tggctttgtgctgctgagt

SEQ ID NO: 6489451 - DNA, 14 bp, Homo sapiens
tggctttgtgctta

SEQ ID NO: 6489452 - DNA, 14 bp, Homo sapiens
tggctttgttttct

SEQ ID NO: 6489453 - DNA, 19 bp, Homo sapiens
tggctttgttttcttagtt

SEQ ID NO: 6489454 - DNA, 19 bp, Homo sapiens
tggcttttaaacctgttcc

SEQ ID NO: 6489455 - DNA, 14 bp, Homo sapiens
tggcttttaagcca

SEQ ID NO: 6489456 - DNA, 12 bp, Homo sapiens
tggcttttactt

SEQ ID NO: 6489457 - DNA, 16 bp, Homo sapiens
tggcttttagacagat

SEQ ID NO: 6489458 - DNA, 22 bp, Homo sapiens
tggcttttattaatgcactttc

SEQ ID NO: 6489459 - DNA, 14 bp, Homo sapiens
tggcttttctgatc

SEQ ID NO: 6489460 - DNA, 19 bp, Homo sapiens
tggcttttctgatccagtt

SEQ ID NO: 6489461 - DNA, 19 bp, Homo sapiens
tggcttttctggctgggga

SEQ ID NO: 6489462 - DNA, 16 bp, Homo sapiens
tggcttttgaatcaaa

SEQ ID NO: 6489463 - DNA, 17 bp, Homo sapiens
tggcttttgcctgtaag

SEQ ID NO: 6489464 - DNA, 19 bp, Homo sapiens
tggctttttaaattttcca

SEQ ID NO: 6489465 - DNA, 19 bp, Homo sapiens
tggctttttactattaaca

SEQ ID NO: 6489466 - DNA, 23 bp, Homo sapiens
tggctttttactattaacatgat

SEQ ID NO: 6489467 - DNA, 15 bp, Homo sapiens
tggctttttcagagt

SEQ ID NO: 6489468 - DNA, 16 bp, Homo sapiens
tggctttttcctctga

SEQ ID NO: 6489469 - DNA, 17 bp, Homo sapiens
tggctttttctgccact

SEQ ID NO: 6489470 - DNA, 23 bp, Homo sapiens
tggctttttctgccactgaggag

SEQ ID NO: 6489471 - DNA, 13 bp, Homo sapiens
tggctttttgaaa

SEQ ID NO: 6489472 - DNA, 15 bp, Homo sapiens
tggctttttgaatta

SEQ ID NO: 6489473 - DNA, 21 bp, Homo sapiens
tggctttttgtcaaataaaat

SEQ ID NO: 6489474 - DNA, 18 bp, Homo sapiens
tggctttttgttcagaat

SEQ ID NO: 6489475 - DNA, 14 bp, Homo sapiens
tgggaaaaaaacaa

SEQ ID NO: 6489476 - DNA, 16 bp, Homo sapiens
tgggaaaaaaacaaac

SEQ ID NO: 6489477 - DNA, 15 bp, Homo sapiens
tgggaaaaaaactga

SEQ ID NO: 6489478 - DNA, 21 bp, Homo sapiens
tgggaaaaaaacttggcactt

SEQ ID NO: 6489479 - DNA, 20 bp, Homo sapiens
tgggaaaaaagttttgatga

SEQ ID NO: 6489480 - DNA, 22 bp, Homo sapiens
tgggaaaaaagttttgatgaaa

SEQ ID NO: 6489481 - DNA, 17 bp, Homo sapiens
tgggaaaaagagactct

SEQ ID NO: 6489482 - DNA, 23 bp, Homo sapiens
tgggaaaaagcaggactgtgcct

SEQ ID NO: 6489483 - DNA, 17 bp, Homo sapiens
tgggaaaaatgtaggag

SEQ ID NO: 6489484 - DNA, 16 bp, Homo sapiens
tgggaaaacagaggaa

SEQ ID NO: 6489485 - DNA, 17 bp, Homo sapiens
tgggaaaacagaggaat

SEQ ID NO: 6489486 - DNA, 20 bp, Homo sapiens
tgggaaaagcccacaggcct

SEQ ID NO: 6489487 - DNA, 21 bp, Homo sapiens
tgggaaaagggcaggagccta

SEQ ID NO: 6489488 - DNA, 19 bp, Homo sapiens
tgggaaaatggcagaaaga

SEQ ID NO: 6489489 - DNA, 10 bp, Homo sapiens
tgggaaacac

SEQ ID NO: 6489490 - DNA, 17 bp, Homo sapiens
tgggaaacactccttgc

SEQ ID NO: 6489491 - DNA, 18 bp, Homo sapiens
tgggaaacactccttgca

SEQ ID NO: 6489492 - DNA, 20 bp, Homo sapiens
tgggaaacactccttgcatc

SEQ ID NO: 6489493 - DNA, 19 bp, Homo sapiens
tgggaaacctgcctttgta

SEQ ID NO: 6489494 - DNA, 20 bp, Homo sapiens
tgggaaacggaatgaccttg

SEQ ID NO: 6489495 - DNA, 16 bp, Homo sapiens
tgggaaacgggttgtg

SEQ ID NO: 6489496 - DNA, 21 bp, Homo sapiens
tgggaaacttgtcacttgcat

SEQ ID NO: 6489497 - DNA, 14 bp, Homo sapiens
tgggaaagaagttg

SEQ ID NO: 6489498 - DNA, 21 bp, Homo sapiens
tgggaaagagaaagagacaga

SEQ ID NO: 6489499 - DNA, 17 bp, Homo sapiens
tgggaaagcattgtaaa

SEQ ID NO: 6489500 - DNA, 15 bp, Homo sapiens
tgggaaagccacctc

SEQ ID NO: 6489501 - DNA, 20 bp, Homo sapiens
tgggaaagccacctctccct

SEQ ID NO: 6489502 - DNA, 22 bp, Homo sapiens
tgggaaagcccctgcccctcct

SEQ ID NO: 6489503 - DNA, 23 bp, Homo sapiens
tgggaaagcgcggacgtgctggg

SEQ ID NO: 6489504 - DNA, 20 bp, Homo sapiens
tgggaaagcggcgccacaga

SEQ ID NO: 6489505 - DNA, 20 bp, Homo sapiens
tgggaaaggaaaaccaggga

SEQ ID NO: 6489506 - DNA, 16 bp, Homo sapiens
tgggaaaggcagggcc

SEQ ID NO: 6489507 - DNA, 20 bp, Homo sapiens
tgggaaaggcagggccctga

SEQ ID NO: 6489508 - DNA, 13 bp, Homo sapiens
tgggaaagggacc

SEQ ID NO: 6489509 - DNA, 20 bp, Homo sapiens
tgggaaagggattttcagcc

SEQ ID NO: 6489510 - DNA, 20 bp, Homo sapiens
tgggaaaggggagtaggtgg

SEQ ID NO: 6489511 - DNA, 14 bp, Homo sapiens
tgggaaaggtgctc

SEQ ID NO: 6489512 - DNA, 16 bp, Homo sapiens
tgggaaaggtgctcaa

SEQ ID NO: 6489513 - DNA, 17 bp, Homo sapiens
tgggaaaggtgctcaaa

SEQ ID NO: 6489514 - DNA, 21 bp, Homo sapiens
tgggaaaggtgctcaaagatg

SEQ ID NO: 6489515 - DNA, 12 bp, Homo sapiens
tgggaaagtgca

SEQ ID NO: 6489516 - DNA, 16 bp, Homo sapiens
tgggaaataaagaaaa

SEQ ID NO: 6489517 - DNA, 17 bp, Homo sapiens
tgggaaataagagagaa

SEQ ID NO: 6489518 - DNA, 23 bp, Homo sapiens
tgggaaatagcggccctggagga

SEQ ID NO: 6489519 - DNA, 20 bp, Homo sapiens
tgggaaatagtctgatttta

SEQ ID NO: 6489520 - DNA, 15 bp, Homo sapiens
tgggaaatgagccag

SEQ ID NO: 6489521 - DNA, 15 bp, Homo sapiens
tgggaaatggcttga

SEQ ID NO: 6489522 - DNA, 17 bp, Homo sapiens
tgggaaatgttttaatg

SEQ ID NO: 6489523 - DNA, 21 bp, Homo sapiens
tgggaaattaaatccaataaa

SEQ ID NO: 6489524 - DNA, 20 bp, Homo sapiens
tgggaaattcttgcactgta

SEQ ID NO: 6489525 - DNA, 15 bp, Homo sapiens
tgggaaattgaagtg

SEQ ID NO: 6489526 - DNA, 21 bp, Homo sapiens
tgggaaattgaagtgtcttct

SEQ ID NO: 6489527 - DNA, 22 bp, Homo sapiens
tgggaaattgaagtgtcttctg

SEQ ID NO: 6489528 - DNA, 21 bp, Homo sapiens
tgaccgtactctcacatgtgg

SEQ ID NO: 6489529 - DNA, 13 bp, Homo sapiens
tgaccgtgaggcc

SEQ ID NO: 6489530 - DNA, 16 bp, Homo sapiens
tgaccgtgaggccaga

SEQ ID NO: 6489531 - DNA, 23 bp, Homo sapiens
tgaccgtgggcggggccttgcgg

SEQ ID NO: 6489532 - DNA, 19 bp, Homo sapiens
tgaccgtgttggtctgtac

SEQ ID NO: 6489533 - DNA, 17 bp, Homo sapiens
tgaccgttttcatcctg

SEQ ID NO: 6489534 - DNA, 23 bp, Homo sapiens
tgaccgttttcatcctggcctcc

SEQ ID NO: 6489535 - DNA, 17 bp, Homo sapiens
tgacctaagtcaggtaa

SEQ ID NO: 6489536 - DNA, 16 bp, Homo sapiens
tgacctacaaatcaat

SEQ ID NO: 6489537 - DNA, 19 bp, Homo sapiens
tgacctacctcaaagggca

SEQ ID NO: 6489538 - DNA, 13 bp, Homo sapiens
tgacctactctca

SEQ ID NO: 6489539 - DNA, 22 bp, Homo sapiens
tgacctagttttccatgcgtgt

SEQ ID NO: 6489540 - DNA, 23 bp, Homo sapiens
tgacctatacctgtgtttcttgc

SEQ ID NO: 6489541 - DNA, 19 bp, Homo sapiens
tgacctatagtaagtgctt

SEQ ID NO: 6489542 - DNA, 13 bp, Homo sapiens
tgacctatgagcc

SEQ ID NO: 6489543 - DNA, 18 bp, Homo sapiens
tgacctcaacctgtgatg

SEQ ID NO: 6489544 - DNA, 21 bp, Homo sapiens
tgacctcaagtgatctgtcca

SEQ ID NO: 6489545 - DNA, 14 bp, Homo sapiens
tgacctcaatggag

SEQ ID NO: 6489546 - DNA, 20 bp, Homo sapiens
tgacctcacacacctctgcc

SEQ ID NO: 6489547 - DNA, 21 bp, Homo sapiens
tgacctcacacacctctgccc

SEQ ID NO: 6489548 - DNA, 22 bp, Homo sapiens
tgacctcacacacctctgcccc

SEQ ID NO: 6489549 - DNA, 20 bp, Homo sapiens
tgacctcaccggcatgctgg

SEQ ID NO: 6489550 - DNA, 21 bp, Homo sapiens
tgacctcaccggcatgctggc

SEQ ID NO: 6489551 - DNA, 16 bp, Homo sapiens
tgacctcactgtcctg

SEQ ID NO: 6489552 - DNA, 13 bp, Homo sapiens
tgacctcagcaaa

SEQ ID NO: 6489553 - DNA, 16 bp, Homo sapiens
tgacctcagctttgat

SEQ ID NO: 6489554 - DNA, 22 bp, Homo sapiens
tgacctcagctttgatatttca

SEQ ID NO: 6489555 - DNA, 20 bp, Homo sapiens
tgacctcaggtgatccaccc

SEQ ID NO: 6489556 - DNA, 19 bp, Homo sapiens
tgacctcaggtgatccgcc

SEQ ID NO: 6489557 - DNA, 18 bp, Homo sapiens
tgacctcatgatctgccc

SEQ ID NO: 6489558 - DNA, 21 bp, Homo sapiens
tgacctcattaaccgatgctt

SEQ ID NO: 6489559 - DNA, 17 bp, Homo sapiens
tgacctccacagcttcc

SEQ ID NO: 6489560 - DNA, 13 bp, Homo sapiens
tgacctccagctt

SEQ ID NO: 6489561 - DNA, 22 bp, Homo sapiens
tgacctccagggaatcagaaag

SEQ ID NO: 6489562 - DNA, 23 bp, Homo sapiens
tgacctccagggaatcagaaagg

SEQ ID NO: 6489563 - DNA, 15 bp, Homo sapiens
tgacctccagtcctg

SEQ ID NO: 6489564 - DNA, 17 bp, Homo sapiens
tgacctccagtcctgct

SEQ ID NO: 6489565 - DNA, 18 bp, Homo sapiens
tgacctccagtcctgctg

SEQ ID NO: 6489566 - DNA, 20 bp, Homo sapiens
tgacctccagtcctgctggc

SEQ ID NO: 6489567 - DNA, 22 bp, Homo sapiens
tgacctccatgactgcacagta

SEQ ID NO: 6489568 - DNA, 13 bp, Homo sapiens
tgacctccatttc

SEQ ID NO: 6489569 - DNA, 13 bp, Homo sapiens
tgacctccccacc

SEQ ID NO: 6489570 - DNA, 17 bp, Homo sapiens
tgacctcccctccccag

SEQ ID NO: 6489571 - DNA, 18 bp, Homo sapiens
tgacctcccctccccagc

SEQ ID NO: 6489572 - DNA, 19 bp, Homo sapiens
tgacctcccctccccagcc

SEQ ID NO: 6489573 - DNA, 13 bp, Homo sapiens
tgacctccctcta

SEQ ID NO: 6489574 - DNA, 14 bp, Homo sapiens
tgacctccctctaa

SEQ ID NO: 6489575 - DNA, 23 bp, Homo sapiens
tgacctccgcccctgcccccgct

SEQ ID NO: 6489576 - DNA, 18 bp, Homo sapiens
tgacctccgtcctctccc

SEQ ID NO: 6489577 - DNA, 19 bp, Homo sapiens
tgacctcctccctgttatt

SEQ ID NO: 6489578 - DNA, 22 bp, Homo sapiens
tgacctcctctgggccctgtcg

SEQ ID NO: 6489579 - DNA, 12 bp, Homo sapiens
tgacctcctgca

SEQ ID NO: 6489580 - DNA, 14 bp, Homo sapiens
tgacctccttctgc

SEQ ID NO: 6489581 - DNA, 17 bp, Homo sapiens
tgacctcggacagagcc

SEQ ID NO: 6489582 - DNA, 19 bp, Homo sapiens
tgacctcggacagagcccc

SEQ ID NO: 6489583 - DNA, 17 bp, Homo sapiens
tgacctcgtgatccgcc

SEQ ID NO: 6489584 - DNA, 16 bp, Homo sapiens
tgacctcgtgatctac

SEQ ID NO: 6489585 - DNA, 18 bp, Homo sapiens
tgacctcgtgatctgccc

SEQ ID NO: 6489586 - DNA, 21 bp, Homo sapiens
tgacctctataattgccactg

SEQ ID NO: 6489587 - DNA, 17 bp, Homo sapiens
tgacctctcagggcctg

SEQ ID NO: 6489588 - DNA, 21 bp, Homo sapiens
tgacctctcataaatttactt

SEQ ID NO: 6489589 - DNA, 13 bp, Homo sapiens
tgacctctccagc

SEQ ID NO: 6489590 - DNA, 14 bp, Homo sapiens
tgacctctccagca

SEQ ID NO: 6489591 - DNA, 17 bp, Homo sapiens
tgacctctccagcatcc

SEQ ID NO: 6489592 - DNA, 20 bp, Homo sapiens
tgacctctccagcatcccag

SEQ ID NO: 6489593 - DNA, 21 bp, Homo sapiens
tgacctctccagcatcccagc

SEQ ID NO: 6489594 - DNA, 23 bp, Homo sapiens
tgacctctccagcatcccagcct

SEQ ID NO: 6489595 - DNA, 16 bp, Homo sapiens
tgacctctgcagcaat

SEQ ID NO: 6489596 - DNA, 23 bp, Homo sapiens
tgacctctgcagcaataaagcag

SEQ ID NO: 6489597 - DNA, 13 bp, Homo sapiens
tgacctctgcctg

SEQ ID NO: 6489598 - DNA, 14 bp, Homo sapiens
tgacctctgcctga

SEQ ID NO: 6489599 - DNA, 13 bp, Homo sapiens
tgacctctgctga

SEQ ID NO: 6489600 - DNA, 17 bp, Homo sapiens
tgacctctgctgagtgc

SEQ ID NO: 6489601 - DNA, 17 bp, Homo sapiens
tgacctctgttgtcctc

SEQ ID NO: 6489602 - DNA, 22 bp, Homo sapiens
tgacctctgttgtcctcccctt

SEQ ID NO: 6489603 - DNA, 13 bp, Homo sapiens
tgacctcttcaaa

SEQ ID NO: 6489604 - DNA, 15 bp, Homo sapiens
tgacctcttgctgtc

SEQ ID NO: 6489605 - DNA, 16 bp, Homo sapiens
tgacctcttgctgtct

SEQ ID NO: 6489606 - DNA, 17 bp, Homo sapiens
tgacctcttgctgtctc

SEQ ID NO: 6489607 - DNA, 16 bp, Homo sapiens
tgacctgaactctgca

SEQ ID NO: 6489608 - DNA, 11 bp, Homo sapiens
tgacctgaatt

SEQ ID NO: 6489609 - DNA, 19 bp, Homo sapiens
tgacctgaattgaaagaga

SEQ ID NO: 6489610 - DNA, 16 bp, Homo sapiens
tgacctgacacctgcc

SEQ ID NO: 6489611 - DNA, 19 bp, Homo sapiens
tgacctgacacctgccgct

SEQ ID NO: 6489612 - DNA, 21 bp, Homo sapiens
tgacctgaccccattcctgat

SEQ ID NO: 6489613 - DNA, 21 bp, Homo sapiens
tgacctgaccggcacctgcga

SEQ ID NO: 6489614 - DNA, 21 bp, Homo sapiens
tgacctgacgatcttccccct

SEQ ID NO: 6489615 - DNA, 23 bp, Homo sapiens
tgacctgacgatcttcccccttc

SEQ ID NO: 6489616 - DNA, 22 bp, Homo sapiens
tgacctgacttgcctccgtgtc

SEQ ID NO: 6489617 - DNA, 17 bp, Homo sapiens
tgacctgagatgtgtga

SEQ ID NO: 6489618 - DNA, 14 bp, Homo sapiens
tgacctgaggaagc

SEQ ID NO: 6489619 - DNA, 23 bp, Homo sapiens
tgacctgaggagacatctacaca

SEQ ID NO: 6489620 - DNA, 12 bp, Homo sapiens
tgacctgaggcc

SEQ ID NO: 6489621 - DNA, 12 bp, Homo sapiens
tgacctgaggct

SEQ ID NO: 6489622 - DNA, 18 bp, Homo sapiens
tgacctgaggctcctgtg

SEQ ID NO: 6489623 - DNA, 15 bp, Homo sapiens
tgacctgaggctgtg

SEQ ID NO: 6489624 - DNA, 17 bp, Homo sapiens
tgacctgaggctgtggt

SEQ ID NO: 6489625 - DNA, 12 bp, Homo sapiens
tgacctgagggc

SEQ ID NO: 6489626 - DNA, 16 bp, Homo sapiens
tgacctgatcacctct

SEQ ID NO: 6489627 - DNA, 15 bp, Homo sapiens
tgacctgatttcaga

SEQ ID NO: 6489628 - DNA, 15 bp, Homo sapiens
tgacctgcaaaaatg

SEQ ID NO: 6489629 - DNA, 19 bp, Homo sapiens
tgacctgcaaaaatgctgg

SEQ ID NO: 6489630 - DNA, 20 bp, Homo sapiens
tgacctgcaggccaagagca

SEQ ID NO: 6489631 - DNA, 17 bp, Homo sapiens
tgacctgcagtcagggc

SEQ ID NO: 6489632 - DNA, 21 bp, Homo sapiens
tgacctgcagtcagggcccag

SEQ ID NO: 6489633 - DNA, 16 bp, Homo sapiens
tgacctgccaggcaca

SEQ ID NO: 6489634 - DNA, 14 bp, Homo sapiens
tgacctgcccatgt

SEQ ID NO: 6489635 - DNA, 13 bp, Homo sapiens
tgacctgccccaa

SEQ ID NO: 6489636 - DNA, 21 bp, Homo sapiens
tgacctgcccccgctctgcca

SEQ ID NO: 6489637 - DNA, 18 bp, Homo sapiens
tgacctgccctacatatc

SEQ ID NO: 6489638 - DNA, 19 bp, Homo sapiens
tgacctgccctacatatct

SEQ ID NO: 6489639 - DNA, 23 bp, Homo sapiens
tgacctgcctcccttcatgcatg

SEQ ID NO: 6489640 - DNA, 20 bp, Homo sapiens
tgacctgcctctcacacaca

SEQ ID NO: 6489641 - DNA, 20 bp, Homo sapiens
tgacctgcgggtcctcagct

SEQ ID NO: 6489642 - DNA, 22 bp, Homo sapiens
tgacctgcgggtcctcagctgc

SEQ ID NO: 6489643 - DNA, 18 bp, Homo sapiens
tgacctgctaggccagag

SEQ ID NO: 6489644 - DNA, 17 bp, Homo sapiens
tgacctgctccgccagg

SEQ ID NO: 6489645 - DNA, 18 bp, Homo sapiens
tgacctgctccgccagga

SEQ ID NO: 6489646 - DNA, 15 bp, Homo sapiens
tgacctgctccgctg

SEQ ID NO: 6489647 - DNA, 19 bp, Homo sapiens
tgacctgctccgctgctcc

SEQ ID NO: 6489648 - DNA, 14 bp, Homo sapiens
tgacctgctcctgc

SEQ ID NO: 6489649 - DNA, 15 bp, Homo sapiens
tgacctgctcctgcc

SEQ ID NO: 6489650 - DNA, 18 bp, Homo sapiens
tgacctgctcctgcccac

SEQ ID NO: 6489651 - DNA, 11 bp, Homo sapiens
tgacctgctga

SEQ ID NO: 6489652 - DNA, 19 bp, Homo sapiens
tgacctgctgaattgttta

SEQ ID NO: 6489653 - DNA, 13 bp, Homo sapiens
tgacctgctgacc

SEQ ID NO: 6489654 - DNA, 13 bp, Homo sapiens
tgacctgctgtgg

SEQ ID NO: 6489655 - DNA, 14 bp, Homo sapiens
tgacctggaagagc

SEQ ID NO: 6489656 - DNA, 14 bp, Homo sapiens
tgacctggagggga

SEQ ID NO: 6489657 - DNA, 15 bp, Homo sapiens
tgacctggccccctc

SEQ ID NO: 6489658 - DNA, 12 bp, Homo sapiens
tgacctgggccc

SEQ ID NO: 6489659 - DNA, 19 bp, Homo sapiens
tgacctgggtatcccctgc

SEQ ID NO: 6489660 - DNA, 21 bp, Homo sapiens
tgacctgggtatcccctgcct

SEQ ID NO: 6489661 - DNA, 13 bp, Homo sapiens
tgacctggtcagg

SEQ ID NO: 6489662 - DNA, 13 bp, Homo sapiens
tgacctggtctgg

SEQ ID NO: 6489663 - DNA, 17 bp, Homo sapiens
tgacctgtcagaataaa

SEQ ID NO: 6489664 - DNA, 14 bp, Homo sapiens
tgacctgtcctctt

SEQ ID NO: 6489665 - DNA, 13 bp, Homo sapiens
tgacctgtgacca

SEQ ID NO: 6489666 - DNA, 11 bp, Homo sapiens
tgacctgtgca

SEQ ID NO: 6489667 - DNA, 17 bp, Homo sapiens
tgacctgtggtaagcaa

SEQ ID NO: 6489668 - DNA, 15 bp, Homo sapiens
tgacctgtgtcacta

SEQ ID NO: 6489669 - DNA, 15 bp, Homo sapiens
tgacctgtttctctg

SEQ ID NO: 6489670 - DNA, 16 bp, Homo sapiens
tgacctgtttctctgc

SEQ ID NO: 6489671 - DNA, 19 bp, Homo sapiens
tgaccttaaggaaaagtaa

SEQ ID NO: 6489672 - DNA, 21 bp, Homo sapiens
tgaccttagtgtttctgtgca

SEQ ID NO: 6489673 - DNA, 22 bp, Homo sapiens
tgaccttatgagaaactgcatg

SEQ ID NO: 6489674 - DNA, 20 bp, Homo sapiens
tgaccttcatttcatgtata

SEQ ID NO: 6489675 - DNA, 13 bp, Homo sapiens
tgaccttcccagg

SEQ ID NO: 6489676 - DNA, 14 bp, Homo sapiens
tgaccttcccaggg

SEQ ID NO: 6489677 - DNA, 11 bp, Homo sapiens
tgaccttcctc

SEQ ID NO: 6489678 - DNA, 18 bp, Homo sapiens
tgaccttcctcgcagaga

SEQ ID NO: 6489679 - DNA, 16 bp, Homo sapiens
tgaccttcctctgggg

SEQ ID NO: 6489680 - DNA, 18 bp, Homo sapiens
tgaccttcctctggggct

SEQ ID NO: 6489681 - DNA, 21 bp, Homo sapiens
tgaccttcctctggggctcta

SEQ ID NO: 6489682 - DNA, 24 bp, Homo sapiens
tgaccttcctctggggctctaggg

SEQ ID NO: 6489683 - DNA, 20 bp, Homo sapiens
tgaccttcggcagtggctgg

SEQ ID NO: 6489684 - DNA, 21 bp, Homo sapiens
tgaccttcggcagtggctggg

SEQ ID NO: 6489685 - DNA, 22 bp, Homo sapiens
tgaccttcggcagtggctgggg

SEQ ID NO: 6489686 - DNA, 22 bp, Homo sapiens
tgaccttctcttagattatgtt

SEQ ID NO: 6489687 - DNA, 17 bp, Homo sapiens
tgaccttctgcggctcc

SEQ ID NO: 6489688 - DNA, 21 bp, Homo sapiens
tgaccttctgtcgtccccaga

SEQ ID NO: 6489689 - DNA, 20 bp, Homo sapiens
tgaccttgaactcctgggct

SEQ ID NO: 6489690 - DNA, 22 bp, Homo sapiens
tgaccttgatgagctgtgcaca

SEQ ID NO: 6489691 - DNA, 16 bp, Homo sapiens
tgaccttgctgccaca

SEQ ID NO: 6489692 - DNA, 19 bp, Homo sapiens
tgaccttggagagacacag

SEQ ID NO: 6489693 - DNA, 20 bp, Homo sapiens
tgaccttggagagacacagc

SEQ ID NO: 6489694 - DNA, 13 bp, Homo sapiens
tgaccttggagga

SEQ ID NO: 6489695 - DNA, 20 bp, Homo sapiens
tgaccttggctgactggggc

SEQ ID NO: 6489696 - DNA, 21 bp, Homo sapiens
tgaccttggctgactggggct

SEQ ID NO: 6489697 - DNA, 21 bp, Homo sapiens
tgaccttgtaatgtaactgct

SEQ ID NO: 6489698 - DNA, 14 bp, Homo sapiens
tgacctttcaatag

SEQ ID NO: 6489699 - DNA, 15 bp, Homo sapiens
tgacctttcaatagg

SEQ ID NO: 6489700 - DNA, 16 bp, Homo sapiens
tgacctttcaatagga

SEQ ID NO: 6489701 - DNA, 14 bp, Homo sapiens
tgacctttccagcc

SEQ ID NO: 6489702 - DNA, 14 bp, Homo sapiens
tgacctttgacctc

SEQ ID NO: 6489703 - DNA, 18 bp, Homo sapiens
tgacctttgacctcggtg

SEQ ID NO: 6489704 - DNA, 14 bp, Homo sapiens
tgacctttgtacag

SEQ ID NO: 6489705 - DNA, 19 bp, Homo sapiens
tgacctttgtacagcccag

SEQ ID NO: 6489706 - DNA, 23 bp, Homo sapiens
tgggaaattgaagtgtcttctgt

SEQ ID NO: 6489707 - DNA, 18 bp, Homo sapiens
tgggaacaaattagagga

SEQ ID NO: 6489708 - DNA, 21 bp, Homo sapiens
tgggaacaaattagaggagac

SEQ ID NO: 6489709 - DNA, 14 bp, Homo sapiens
tgggaacaaggaag

SEQ ID NO: 6489710 - DNA, 12 bp, Homo sapiens
tgggaacaggcc

SEQ ID NO: 6489711 - DNA, 13 bp, Homo sapiens
tgggaacaggccc

SEQ ID NO: 6489712 - DNA, 14 bp, Homo sapiens
tgggaacaggcccc

SEQ ID NO: 6489713 - DNA, 16 bp, Homo sapiens
tgggaacaggccccac

SEQ ID NO: 6489714 - DNA, 19 bp, Homo sapiens
tgggaacaggccccacgcc

SEQ ID NO: 6489715 - DNA, 23 bp, Homo sapiens
tgggaacagtaaagaaagcagaa

SEQ ID NO: 6489716 - DNA, 19 bp, Homo sapiens
tgggaacatgacccagcct

SEQ ID NO: 6489717 - DNA, 21 bp, Homo sapiens
tgggaacatgacccagcctga

SEQ ID NO: 6489718 - DNA, 19 bp, Homo sapiens
tgggaacatgctggaaata

SEQ ID NO: 6489719 - DNA, 14 bp, Homo sapiens
tgggaacatttatt

SEQ ID NO: 6489720 - DNA, 18 bp, Homo sapiens
tgggaacatttattttat

SEQ ID NO: 6489721 - DNA, 23 bp, Homo sapiens
tgggaacatttattttatgagaa

SEQ ID NO: 6489722 - DNA, 20 bp, Homo sapiens
tgggaaccaagctattcctt

SEQ ID NO: 6489723 - DNA, 18 bp, Homo sapiens
tgggaaccaagggccctc

SEQ ID NO: 6489724 - DNA, 20 bp, Homo sapiens
tgggaaccccgcagcccgtg

SEQ ID NO: 6489725 - DNA, 20 bp, Homo sapiens
tgggaaccccttcatcctct

SEQ ID NO: 6489726 - DNA, 22 bp, Homo sapiens
tgggaaccccttcatcctctga

SEQ ID NO: 6489727 - DNA, 18 bp, Homo sapiens
tgggaacccgactgtgaa

SEQ ID NO: 6489728 - DNA, 19 bp, Homo sapiens
tgggaacccgactgtgaaa

SEQ ID NO: 6489729 - DNA, 15 bp, Homo sapiens
tgggaacctcccaga

SEQ ID NO: 6489730 - DNA, 24 bp, Homo sapiens
tgggaacgcagatgatccatgagt

SEQ ID NO: 6489731 - DNA, 23 bp, Homo sapiens
tgggaacggctgatgtggactgt

SEQ ID NO: 6489732 - DNA, 19 bp, Homo sapiens
tgggaacggggtggacgag

SEQ ID NO: 6489733 - DNA, 17 bp, Homo sapiens
tgggaacgtgtgtccag

SEQ ID NO: 6489734 - DNA, 16 bp, Homo sapiens
tgggaactatgaggag

SEQ ID NO: 6489735 - DNA, 18 bp, Homo sapiens
tgggaactatgaggagcc

SEQ ID NO: 6489736 - DNA, 17 bp, Homo sapiens
tgggaactcacctgggg

SEQ ID NO: 6489737 - DNA, 17 bp, Homo sapiens
tgggaactctcctggcc

SEQ ID NO: 6489738 - DNA, 14 bp, Homo sapiens
tgggaactgaaatc

SEQ ID NO: 6489739 - DNA, 16 bp, Homo sapiens
tgggaactgcagacct

SEQ ID NO: 6489740 - DNA, 14 bp, Homo sapiens
tgggaactggaggg

SEQ ID NO: 6489741 - DNA, 17 bp, Homo sapiens
tgggaactggagggtga

SEQ ID NO: 6489742 - DNA, 12 bp, Homo sapiens
tgggaactgggc

SEQ ID NO: 6489743 - DNA, 17 bp, Homo sapiens
tgggaactgggccagca

SEQ ID NO: 6489744 - DNA, 13 bp, Homo sapiens
tgggaactgtgtt

SEQ ID NO: 6489745 - DNA, 23 bp, Homo sapiens
tgggaagaacaaggccctgaggg

SEQ ID NO: 6489746 - DNA, 18 bp, Homo sapiens
tgggaagaagaagacctc

SEQ ID NO: 6489747 - DNA, 23 bp, Homo sapiens
tgggaagaccagctttgcagtga

SEQ ID NO: 6489748 - DNA, 18 bp, Homo sapiens
tgggaagacgaggccctc

SEQ ID NO: 6489749 - DNA, 19 bp, Homo sapiens
tgggaagacgcctgagctc

SEQ ID NO: 6489750 - DNA, 23 bp, Homo sapiens
tgggaagactcctagctgtcctt

SEQ ID NO: 6489751 - DNA, 21 bp, Homo sapiens
tgggaagactgttgtgctcca

SEQ ID NO: 6489752 - DNA, 22 bp, Homo sapiens
tgggaagactgttgtgctccat

SEQ ID NO: 6489753 - DNA, 14 bp, Homo sapiens
tgggaagagaagaa

SEQ ID NO: 6489754 - DNA, 15 bp, Homo sapiens
tgggaagagaaggga

SEQ ID NO: 6489755 - DNA, 16 bp, Homo sapiens
tgggaagagaagggaa

SEQ ID NO: 6489756 - DNA, 13 bp, Homo sapiens
tgggaagagctgg

SEQ ID NO: 6489757 - DNA, 20 bp, Homo sapiens
tgggaagagcttagaaactg

SEQ ID NO: 6489758 - DNA, 14 bp, Homo sapiens
tgggaagaggactt

SEQ ID NO: 6489759 - DNA, 23 bp, Homo sapiens
tgggaagagggggctggccatgg

SEQ ID NO: 6489760 - DNA, 20 bp, Homo sapiens
tgggaagataggctctgcac

SEQ ID NO: 6489761 - DNA, 22 bp, Homo sapiens
tgggaagataggctctgcacag

SEQ ID NO: 6489762 - DNA, 18 bp, Homo sapiens
tgggaagatgaggttctg

SEQ ID NO: 6489763 - DNA, 19 bp, Homo sapiens
tgggaagatgaggttctga

SEQ ID NO: 6489764 - DNA, 17 bp, Homo sapiens
tgggaagatgctggccc

SEQ ID NO: 6489765 - DNA, 19 bp, Homo sapiens
tgggaagatgctggcccca

SEQ ID NO: 6489766 - DNA, 21 bp, Homo sapiens
tgggaagatgtctcagagcct

SEQ ID NO: 6489767 - DNA, 15 bp, Homo sapiens
tgggaagattctcta

SEQ ID NO: 6489768 - DNA, 21 bp, Homo sapiens
tgggaagcagggaattcctgg

SEQ ID NO: 6489769 - DNA, 21 bp, Homo sapiens
tgggaagcagtttcagataaa

SEQ ID NO: 6489770 - DNA, 21 bp, Homo sapiens
tgggaagccatattcacacct

SEQ ID NO: 6489771 - DNA, 19 bp, Homo sapiens
tgggaagcccatcctgacc

SEQ ID NO: 6489772 - DNA, 22 bp, Homo sapiens
tgggaagcccatcctgaccagc

SEQ ID NO: 6489773 - DNA, 13 bp, Homo sapiens
tgggaagcccgga

SEQ ID NO: 6489774 - DNA, 21 bp, Homo sapiens
tgggaagcccggactgaccaa

SEQ ID NO: 6489775 - DNA, 12 bp, Homo sapiens
tgggaagctggg

SEQ ID NO: 6489776 - DNA, 12 bp, Homo sapiens
tgggaaggaaac

SEQ ID NO: 6489777 - DNA, 14 bp, Homo sapiens
tgggaaggaaaggc

SEQ ID NO: 6489778 - DNA, 17 bp, Homo sapiens
tgggaaggaaaggcaga

SEQ ID NO: 6489779 - DNA, 15 bp, Homo sapiens
tgggaaggaaatata

SEQ ID NO: 6489780 - DNA, 16 bp, Homo sapiens
tgggaaggaagcccgc

SEQ ID NO: 6489781 - DNA, 13 bp, Homo sapiens
tgggaaggacaca

SEQ ID NO: 6489782 - DNA, 14 bp, Homo sapiens
tgggaaggacacag

SEQ ID NO: 6489783 - DNA, 18 bp, Homo sapiens
tgggaaggacacagcagt

SEQ ID NO: 6489784 - DNA, 20 bp, Homo sapiens
tgggaaggacacagcagtat

SEQ ID NO: 6489785 - DNA, 17 bp, Homo sapiens
tgggaaggagggagctg

SEQ ID NO: 6489786 - DNA, 20 bp, Homo sapiens
tgggaaggagggagctgctc

SEQ ID NO: 6489787 - DNA, 14 bp, Homo sapiens
tgggaaggagggga

SEQ ID NO: 6489788 - DNA, 16 bp, Homo sapiens
tgggaaggccacctcc

SEQ ID NO: 6489789 - DNA, 18 bp, Homo sapiens
tgggaaggcttgggattt

SEQ ID NO: 6489790 - DNA, 23 bp, Homo sapiens
tgggaagggagagttctttgctg

SEQ ID NO: 6489791 - DNA, 13 bp, Homo sapiens
tgggaagggctta

SEQ ID NO: 6489792 - DNA, 19 bp, Homo sapiens
tgggaaggggacccccgcc

SEQ ID NO: 6489793 - DNA, 12 bp, Homo sapiens
tgggaaggggag

SEQ ID NO: 6489794 - DNA, 16 bp, Homo sapiens
tgggaaggggatggac

SEQ ID NO: 6489795 - DNA, 22 bp, Homo sapiens
tgggaaggggatggacaccccc

SEQ ID NO: 6489796 - DNA, 14 bp, Homo sapiens
tgggaagggggcag

SEQ ID NO: 6489797 - DNA, 15 bp, Homo sapiens
tgggaaggggtcctg

SEQ ID NO: 6489798 - DNA, 20 bp, Homo sapiens
tgggaaggggtgccctctgg

SEQ ID NO: 6489799 - DNA, 15 bp, Homo sapiens
tgggaaggggtttct

SEQ ID NO: 6489800 - DNA, 22 bp, Homo sapiens
tgggaaggtgggtgaggctggg

SEQ ID NO: 6489801 - DNA, 21 bp, Homo sapiens
tgggaaggttagaaaggcagc

SEQ ID NO: 6489802 - DNA, 20 bp, Homo sapiens
tgggaaggtttttaagggcc

SEQ ID NO: 6489803 - DNA, 17 bp, Homo sapiens
tgggaagtcgaggctgc

SEQ ID NO: 6489804 - DNA, 18 bp, Homo sapiens
tgggaagtcgaggctgca

SEQ ID NO: 6489805 - DNA, 22 bp, Homo sapiens
tgggaagtggaggttgagtgag

SEQ ID NO: 6489806 - DNA, 23 bp, Homo sapiens
tgggaagttaaagggaagaaaac

SEQ ID NO: 6489807 - DNA, 13 bp, Homo sapiens
tgggaagtttgct

SEQ ID NO: 6489808 - DNA, 17 bp, Homo sapiens
tgggaagtttgctgtgc

SEQ ID NO: 6489809 - DNA, 11 bp, Homo sapiens
tgggaataaaa

SEQ ID NO: 6489810 - DNA, 16 bp, Homo sapiens
tgggaataaaagtatt

SEQ ID NO: 6489811 - DNA, 17 bp, Homo sapiens
tgggaataaaagtatta

SEQ ID NO: 6489812 - DNA, 22 bp, Homo sapiens
tgggaataatagcacatgattt

SEQ ID NO: 6489813 - DNA, 22 bp, Homo sapiens
tgggaatacaaaaggtttgaga

SEQ ID NO: 6489814 - DNA, 15 bp, Homo sapiens
tgggaatacctgtgg

SEQ ID NO: 6489815 - DNA, 20 bp, Homo sapiens
tgggaatataatattgtctc

SEQ ID NO: 6489816 - DNA, 14 bp, Homo sapiens
tgggaatatttgaa

SEQ ID NO: 6489817 - DNA, 19 bp, Homo sapiens
tgggaatatttgaatcttg

SEQ ID NO: 6489818 - DNA, 22 bp, Homo sapiens
tgggaatatttgaatcttgtct

SEQ ID NO: 6489819 - DNA, 12 bp, Homo sapiens
tgggaatcatgg

SEQ ID NO: 6489820 - DNA, 23 bp, Homo sapiens
tgggaatcattccactatacaat

SEQ ID NO: 6489821 - DNA, 16 bp, Homo sapiens
tgggaatcctgctgcc

SEQ ID NO: 6489822 - DNA, 18 bp, Homo sapiens
tgggaatcctgctgccag

SEQ ID NO: 6489823 - DNA, 19 bp, Homo sapiens
tgggaatctcccagacttg

SEQ ID NO: 6489824 - DNA, 14 bp, Homo sapiens
tgggaatgaagctt

SEQ ID NO: 6489825 - DNA, 15 bp, Homo sapiens
tgggaatgagacata

SEQ ID NO: 6489826 - DNA, 22 bp, Homo sapiens
tgggaatgaggcttgctgagag

SEQ ID NO: 6489827 - DNA, 23 bp, Homo sapiens
tgggaatgcgctcttcaccagga

SEQ ID NO: 6489828 - DNA, 16 bp, Homo sapiens
tgggaatgcggcaaga

SEQ ID NO: 6489829 - DNA, 14 bp, Homo sapiens
tgggaatggaataa

SEQ ID NO: 6489830 - DNA, 17 bp, Homo sapiens
tgggaatggaataacta

SEQ ID NO: 6489831 - DNA, 18 bp, Homo sapiens
tgggaatggaataactat

SEQ ID NO: 6489832 - DNA, 17 bp, Homo sapiens
tgggaatggaggggcag

SEQ ID NO: 6489833 - DNA, 16 bp, Homo sapiens
tgggaatgttctttct

SEQ ID NO: 6489834 - DNA, 17 bp, Homo sapiens
tgggaatgttctttctg

SEQ ID NO: 6489835 - DNA, 22 bp, Homo sapiens
tgggaattctttacaataaaca

SEQ ID NO: 6489836 - DNA, 19 bp, Homo sapiens
tgggaattgcgctcagggg

SEQ ID NO: 6489837 - DNA, 14 bp, Homo sapiens
tgggaattggggag

SEQ ID NO: 6489838 - DNA, 14 bp, Homo sapiens
tgggaattgtgtgt

SEQ ID NO: 6489839 - DNA, 17 bp, Homo sapiens
tgggaatttatttatgt

SEQ ID NO: 6489840 - DNA, 18 bp, Homo sapiens
tgggaatttatttatgtt

SEQ ID NO: 6489841 - DNA, 13 bp, Homo sapiens
tgggaatttcaat

SEQ ID NO: 6489842 - DNA, 15 bp, Homo sapiens
tgggaattttaactt

SEQ ID NO: 6489843 - DNA, 21 bp, Homo sapiens
tgggacaacaaagaggacacc

SEQ ID NO: 6489844 - DNA, 23 bp, Homo sapiens
tgggacaacaaagaggacaccat

SEQ ID NO: 6489845 - DNA, 22 bp, Homo sapiens
tgggacaactgtagaggcagtt

SEQ ID NO: 6489846 - DNA, 21 bp, Homo sapiens
tgggacaagcaggccgccctc

SEQ ID NO: 6489847 - DNA, 18 bp, Homo sapiens
tgggacaagttagtcttt

SEQ ID NO: 6489848 - DNA, 15 bp, Homo sapiens
tgggacaatggcaat

SEQ ID NO: 6489849 - DNA, 22 bp, Homo sapiens
tgggacaattagataaatgtcc

SEQ ID NO: 6489850 - DNA, 14 bp, Homo sapiens
tgggacacagaccc

SEQ ID NO: 6489851 - DNA, 16 bp, Homo sapiens
tgggacacagacccag

SEQ ID NO: 6489852 - DNA, 18 bp, Homo sapiens
tgggacaccagggaagaa

SEQ ID NO: 6489853 - DNA, 16 bp, Homo sapiens
tgggacacctgggaga

SEQ ID NO: 6489854 - DNA, 16 bp, Homo sapiens
tgggacactgggcagc

SEQ ID NO: 6489855 - DNA, 19 bp, Homo sapiens
tgggacacttccctgggcc

SEQ ID NO: 6489856 - DNA, 18 bp, Homo sapiens
tgggacagacagcagctg

SEQ ID NO: 6489857 - DNA, 19 bp, Homo sapiens
tgggacagacagcagctgg

SEQ ID NO: 6489858 - DNA, 21 bp, Homo sapiens
tgggacagacagcagctggac

SEQ ID NO: 6489859 - DNA, 21 bp, Homo sapiens
tgggacagacggaaatgaaat

SEQ ID NO: 6489860 - DNA, 18 bp, Homo sapiens
tgggacagaggagcaagg

SEQ ID NO: 6489861 - DNA, 15 bp, Homo sapiens
tgggacagccactgg

SEQ ID NO: 6489862 - DNA, 15 bp, Homo sapiens
tgggacagccagagc

SEQ ID NO: 6489863 - DNA, 16 bp, Homo sapiens
tgggacagccagagct

SEQ ID NO: 6489864 - DNA, 14 bp, Homo sapiens
tgggacagcccaga

SEQ ID NO: 6489865 - DNA, 18 bp, Homo sapiens
tgggacagccccagggcc

SEQ ID NO: 6489866 - DNA, 15 bp, Homo sapiens
tgggacagcctcttc

SEQ ID NO: 6489867 - DNA, 22 bp, Homo sapiens
tgggacagcctcttcagcccct

SEQ ID NO: 6489868 - DNA, 21 bp, Homo sapiens
tgggacaggctcttctttccc

SEQ ID NO: 6489869 - DNA, 22 bp, Homo sapiens
tgggacaggctcttctttccca

SEQ ID NO: 6489870 - DNA, 14 bp, Homo sapiens
tgggacagggaggc

SEQ ID NO: 6489871 - DNA, 18 bp, Homo sapiens
tgggacagggaggccaca

SEQ ID NO: 6489872 - DNA, 16 bp, Homo sapiens
tgggacagggcatggc

SEQ ID NO: 6489873 - DNA, 14 bp, Homo sapiens
tgggacagggcttc

SEQ ID NO: 6489874 - DNA, 23 bp, Homo sapiens
tgggacagtttatcatgaagcct

SEQ ID NO: 6489875 - DNA, 23 bp, Homo sapiens
tgggacatcaggagactgggctc

SEQ ID NO: 6489876 - DNA, 15 bp, Homo sapiens
tgggacatggaaaag

SEQ ID NO: 6489877 - DNA, 17 bp, Homo sapiens
tgggacatggcacaggc

SEQ ID NO: 6489878 - DNA, 19 bp, Homo sapiens
tgggaccaaaactgcctac

SEQ ID NO: 6489879 - DNA, 16 bp, Homo sapiens
tgggaccaaacctagc

SEQ ID NO: 6489880 - DNA, 15 bp, Homo sapiens
tgggaccaaaggggg

SEQ ID NO: 6489881 - DNA, 13 bp, Homo sapiens
tgggaccaacctg

SEQ ID NO: 6489882 - DNA, 17 bp, Homo sapiens
tgggaccaacctgacct

SEQ ID NO: 6489883 - DNA, 20 bp, Homo sapiens
tgacctttgtacagcccaga

SEQ ID NO: 6489884 - DNA, 15 bp, Homo sapiens
tgaccttttcttcat

SEQ ID NO: 6489885 - DNA, 16 bp, Homo sapiens
tgaccttttcttcatt

SEQ ID NO: 6489886 - DNA, 19 bp, Homo sapiens
tgaccttttcttcattttg

SEQ ID NO: 6489887 - DNA, 21 bp, Homo sapiens
tgacctttttaatccaggccc

SEQ ID NO: 6489888 - DNA, 22 bp, Homo sapiens
tgacgaaatggaaacacacaca

SEQ ID NO: 6489889 - DNA, 12 bp, Homo sapiens
tgacgaactggc

SEQ ID NO: 6489890 - DNA, 13 bp, Homo sapiens
tgacgaactggct

SEQ ID NO: 6489891 - DNA, 13 bp, Homo sapiens
tgacgaggctcaa

SEQ ID NO: 6489892 - DNA, 14 bp, Homo sapiens
tgacgaggctgggc

SEQ ID NO: 6489893 - DNA, 14 bp, Homo sapiens
tgacgatgatgtac

SEQ ID NO: 6489894 - DNA, 21 bp, Homo sapiens
tgacgattccttctctgaaca

SEQ ID NO: 6489895 - DNA, 16 bp, Homo sapiens
tgacgattttggaaat

SEQ ID NO: 6489896 - DNA, 18 bp, Homo sapiens
tgacgattttggaaatga

SEQ ID NO: 6489897 - DNA, 15 bp, Homo sapiens
tgacgcagcccccca

SEQ ID NO: 6489898 - DNA, 15 bp, Homo sapiens
tgacgcatcctgcag

SEQ ID NO: 6489899 - DNA, 23 bp, Homo sapiens
tgacgccagggtatgaagagtgt

SEQ ID NO: 6489900 - DNA, 15 bp, Homo sapiens
tgacgccatcccagc

SEQ ID NO: 6489901 - DNA, 16 bp, Homo sapiens
tgacgccatcccagcc

SEQ ID NO: 6489902 - DNA, 12 bp, Homo sapiens
tgacgcccacct

SEQ ID NO: 6489903 - DNA, 13 bp, Homo sapiens
tgacgcccagctc

SEQ ID NO: 6489904 - DNA, 19 bp, Homo sapiens
tgacgcccgagagcctcgc

SEQ ID NO: 6489905 - DNA, 12 bp, Homo sapiens
tgacgccctgcg

SEQ ID NO: 6489906 - DNA, 22 bp, Homo sapiens
tgacgccctgcgttggagccac

SEQ ID NO: 6489907 - DNA, 22 bp, Homo sapiens
tgacgccgcgcactcagccgtg

SEQ ID NO: 6489908 - DNA, 14 bp, Homo sapiens
tgacgcctctggac

SEQ ID NO: 6489909 - DNA, 20 bp, Homo sapiens
tgacgcctgagacagcacca

SEQ ID NO: 6489910 - DNA, 21 bp, Homo sapiens
tgacgcctgagacagcaccac

SEQ ID NO: 6489911 - DNA, 18 bp, Homo sapiens
tgacgcgtggtcacagga

SEQ ID NO: 6489912 - DNA, 16 bp, Homo sapiens
tgacgctcagccccag

SEQ ID NO: 6489913 - DNA, 20 bp, Homo sapiens
tgacgctgaataaatgtctt

SEQ ID NO: 6489914 - DNA, 23 bp, Homo sapiens
tgacgctgatacataactaaatt

SEQ ID NO: 6489915 - DNA, 17 bp, Homo sapiens
tgacgctgcatgagaca

SEQ ID NO: 6489916 - DNA, 21 bp, Homo sapiens
tgacgctggaccttttcttta

SEQ ID NO: 6489917 - DNA, 19 bp, Homo sapiens
tgacgcttgtgacagtgcc

SEQ ID NO: 6489918 - DNA, 14 bp, Homo sapiens
tgacggaagaacat

SEQ ID NO: 6489919 - DNA, 21 bp, Homo sapiens
tgacggaaggacctatgtttg

SEQ ID NO: 6489920 - DNA, 23 bp, Homo sapiens
tgacggactcagactcctggctt

SEQ ID NO: 6489921 - DNA, 19 bp, Homo sapiens
tgacggatgattggattat

SEQ ID NO: 6489922 - DNA, 13 bp, Homo sapiens
tgacggccaggct

SEQ ID NO: 6489923 - DNA, 14 bp, Homo sapiens
tgacggccctcatc

SEQ ID NO: 6489924 - DNA, 13 bp, Homo sapiens
tgacggccctgca

SEQ ID NO: 6489925 - DNA, 14 bp, Homo sapiens
tgacggccctgcaa

SEQ ID NO: 6489926 - DNA, 12 bp, Homo sapiens
tgacggcctgcc

SEQ ID NO: 6489927 - DNA, 15 bp, Homo sapiens
tgacggcctgcctgc

SEQ ID NO: 6489928 - DNA, 15 bp, Homo sapiens
tgacggcgcccccag

SEQ ID NO: 6489929 - DNA, 16 bp, Homo sapiens
tgacggctgccattgg

SEQ ID NO: 6489930 - DNA, 23 bp, Homo sapiens
tgacggctggggacccacccagc

SEQ ID NO: 6489931 - DNA, 21 bp, Homo sapiens
tgacggctgggtgtttcagtt

SEQ ID NO: 6489932 - DNA, 18 bp, Homo sapiens
tgacggctgtgtatttct

SEQ ID NO: 6489933 - DNA, 16 bp, Homo sapiens
tgacgggagcctcctc

SEQ ID NO: 6489934 - DNA, 18 bp, Homo sapiens
tgacgggaggccccagct

SEQ ID NO: 6489935 - DNA, 17 bp, Homo sapiens
tgacgggatgctcttta

SEQ ID NO: 6489936 - DNA, 22 bp, Homo sapiens
tgacgggatgctctttaaataa

SEQ ID NO: 6489937 - DNA, 15 bp, Homo sapiens
tgacgggccgcagga

SEQ ID NO: 6489938 - DNA, 16 bp, Homo sapiens
tgacgggccgcaggag

SEQ ID NO: 6489939 - DNA, 15 bp, Homo sapiens
tgacgggctgtccgt

SEQ ID NO: 6489940 - DNA, 22 bp, Homo sapiens
tgacggtcctttaggcagcctg

SEQ ID NO: 6489941 - DNA, 23 bp, Homo sapiens
tgacggtcctttaggcagcctgc

SEQ ID NO: 6489942 - DNA, 15 bp, Homo sapiens
tgacggtgacaaaga

SEQ ID NO: 6489943 - DNA, 19 bp, Homo sapiens
tgacggtgttaattttgct

SEQ ID NO: 6489944 - DNA, 21 bp, Homo sapiens
tgacggtgttaattttgctaa

SEQ ID NO: 6489945 - DNA, 18 bp, Homo sapiens
tgacggttcctacacagg

SEQ ID NO: 6489946 - DNA, 23 bp, Homo sapiens
tgacggttcctacacaggacagg

SEQ ID NO: 6489947 - DNA, 13 bp, Homo sapiens
tgacgtaagctct

SEQ ID NO: 6489948 - DNA, 18 bp, Homo sapiens
tgacgtaagctctatctg

SEQ ID NO: 6489949 - DNA, 18 bp, Homo sapiens
tgacgtacaagtagttct

SEQ ID NO: 6489950 - DNA, 18 bp, Homo sapiens
tgacgtagaaagatcctt

SEQ ID NO: 6489951 - DNA, 15 bp, Homo sapiens
tgacgtattgtgaaa

SEQ ID NO: 6489952 - DNA, 17 bp, Homo sapiens
tgacgtattgtgaaatt

SEQ ID NO: 6489953 - DNA, 21 bp, Homo sapiens
tgacgtcaagtgatctgcctg

SEQ ID NO: 6489954 - DNA, 21 bp, Homo sapiens
tgacgtcagcgcaccaaaact

SEQ ID NO: 6489955 - DNA, 23 bp, Homo sapiens
tgacgtcggccgaccaggctgga

SEQ ID NO: 6489956 - DNA, 19 bp, Homo sapiens
tgacgtctagctatgctgt

SEQ ID NO: 6489957 - DNA, 17 bp, Homo sapiens
tgacgtctgccaccagc

SEQ ID NO: 6489958 - DNA, 18 bp, Homo sapiens
tgacgtctgggtggccct

SEQ ID NO: 6489959 - DNA, 18 bp, Homo sapiens
tgacgtcttaggtggcag

SEQ ID NO: 6489960 - DNA, 22 bp, Homo sapiens
tgacgtgaccaattgccctgcc

SEQ ID NO: 6489961 - DNA, 22 bp, Homo sapiens
tgacgtgaccggacttttctgc

SEQ ID NO: 6489962 - DNA, 24 bp, Homo sapiens
tgacgtgaccggacttttctgcaa

SEQ ID NO: 6489963 - DNA, 15 bp, Homo sapiens
tgacgtgactcagag

SEQ ID NO: 6489964 - DNA, 17 bp, Homo sapiens
tgacgtgactcagagct

SEQ ID NO: 6489965 - DNA, 19 bp, Homo sapiens
tgacgtgcacaaaccttct

SEQ ID NO: 6489966 - DNA, 16 bp, Homo sapiens
tgacgtgccttttgca

SEQ ID NO: 6489967 - DNA, 19 bp, Homo sapiens
tgacgtgccttttgcaccc

SEQ ID NO: 6489968 - DNA, 22 bp, Homo sapiens
tgacgtgccttttgcacccctc

SEQ ID NO: 6489969 - DNA, 23 bp, Homo sapiens
tgacgtgctccgtagctctgctg

SEQ ID NO: 6489970 - DNA, 20 bp, Homo sapiens
tgacgtgtaaatgctggtat

SEQ ID NO: 6489971 - DNA, 18 bp, Homo sapiens
tgacgtgtgtggctggga

SEQ ID NO: 6489972 - DNA, 21 bp, Homo sapiens
tgacgtgtgtggctgggacct

SEQ ID NO: 6489973 - DNA, 14 bp, Homo sapiens
tgacgttccgggca

SEQ ID NO: 6489974 - DNA, 18 bp, Homo sapiens
tgacgttgatctcctggt

SEQ ID NO: 6489975 - DNA, 14 bp, Homo sapiens
tgacgtttcttctt

SEQ ID NO: 6489976 - DNA, 19 bp, Homo sapiens
tgacgtttcttctttctag

SEQ ID NO: 6489977 - DNA, 15 bp, Homo sapiens
tgactaaaaatgcat

SEQ ID NO: 6489978 - DNA, 14 bp, Homo sapiens
tgactaaaatattt

SEQ ID NO: 6489979 - DNA, 13 bp, Homo sapiens
tgactaaaatgct

SEQ ID NO: 6489980 - DNA, 15 bp, Homo sapiens
tgactaaaccattgt

SEQ ID NO: 6489981 - DNA, 18 bp, Homo sapiens
tgactaaactaccacctc

SEQ ID NO: 6489982 - DNA, 18 bp, Homo sapiens
tgactaaactttttttct

SEQ ID NO: 6489983 - DNA, 16 bp, Homo sapiens
tgactaaagctatgtt

SEQ ID NO: 6489984 - DNA, 23 bp, Homo sapiens
tgactaaagtaccagattataat

SEQ ID NO: 6489985 - DNA, 19 bp, Homo sapiens
tgactaaattcgtgatttt

SEQ ID NO: 6489986 - DNA, 12 bp, Homo sapiens
tgactaaatttt

SEQ ID NO: 6489987 - DNA, 20 bp, Homo sapiens
tgactaactagacaccaaag

SEQ ID NO: 6489988 - DNA, 23 bp, Homo sapiens
tgactaactagacaccaaagttc

SEQ ID NO: 6489989 - DNA, 20 bp, Homo sapiens
tgactaactcaaatacacat

SEQ ID NO: 6489990 - DNA, 21 bp, Homo sapiens
tgactaactcaaatacacatt

SEQ ID NO: 6489991 - DNA, 23 bp, Homo sapiens
tgactaagaaatgccagtggtgg

SEQ ID NO: 6489992 - DNA, 15 bp, Homo sapiens
tgactaagaaattct

SEQ ID NO: 6489993 - DNA, 14 bp, Homo sapiens
tgactaagccaagc

SEQ ID NO: 6489994 - DNA, 16 bp, Homo sapiens
tgactaagccaagctg

SEQ ID NO: 6489995 - DNA, 21 bp, Homo sapiens
tgactaagccaagctgtgttc

SEQ ID NO: 6489996 - DNA, 22 bp, Homo sapiens
tgactaagccaagctgtgttca

SEQ ID NO: 6489997 - DNA, 23 bp, Homo sapiens
tgactaagccaagctgtgttcat

SEQ ID NO: 6489998 - DNA, 12 bp, Homo sapiens
tgactaagcctt

SEQ ID NO: 6489999 - DNA, 17 bp, Homo sapiens
tgactaagttgcaagat

SEQ ID NO: 6490000 - DNA, 18 bp, Homo sapiens
tgactaagttgcaagatc

SEQ ID NO: 6490001 - DNA, 23 bp, Homo sapiens
tgactaataaaaaactgtgaacc

SEQ ID NO: 6490002 - DNA, 23 bp, Homo sapiens
tgactaatagggataatccaggt

SEQ ID NO: 6490003 - DNA, 20 bp, Homo sapiens
tgactaatccttaataacta

SEQ ID NO: 6490004 - DNA, 23 bp, Homo sapiens
tgactaatgctttttagaaagca

SEQ ID NO: 6490005 - DNA, 17 bp, Homo sapiens
tgactaattcttgcata

SEQ ID NO: 6490006 - DNA, 23 bp, Homo sapiens
tgactaattcttgcatattttgt

SEQ ID NO: 6490007 - DNA, 22 bp, Homo sapiens
tgactaattgtataacaggtta

SEQ ID NO: 6490008 - DNA, 18 bp, Homo sapiens
tgactaattttacatgtt

SEQ ID NO: 6490009 - DNA, 19 bp, Homo sapiens
tgactaattttgtattttt

SEQ ID NO: 6490010 - DNA, 14 bp, Homo sapiens
tgactaccgtgcca

SEQ ID NO: 6490011 - DNA, 15 bp, Homo sapiens
tgactaccgtgccag

SEQ ID NO: 6490012 - DNA, 18 bp, Homo sapiens
tgactaccgtgccagcag

SEQ ID NO: 6490013 - DNA, 20 bp, Homo sapiens
tgactaccgtgccagcagcg

SEQ ID NO: 6490014 - DNA, 22 bp, Homo sapiens
tgactacctactggtgtaatct

SEQ ID NO: 6490015 - DNA, 13 bp, Homo sapiens
tgactacctcaga

SEQ ID NO: 6490016 - DNA, 18 bp, Homo sapiens
tgactactactctgccaa

SEQ ID NO: 6490017 - DNA, 19 bp, Homo sapiens
tgactacttagcatcctaa

SEQ ID NO: 6490018 - DNA, 22 bp, Homo sapiens
tgactacttagcatcctaagaa

SEQ ID NO: 6490019 - DNA, 15 bp, Homo sapiens
tgactagaaattctt

SEQ ID NO: 6490020 - DNA, 16 bp, Homo sapiens
tgactagaactcctgt

SEQ ID NO: 6490021 - DNA, 16 bp, Homo sapiens
tgactagagtgatgac

SEQ ID NO: 6490022 - DNA, 14 bp, Homo sapiens
tgactagatatcaa

SEQ ID NO: 6490023 - DNA, 23 bp, Homo sapiens
tgactagatgatggatgccaata

SEQ ID NO: 6490024 - DNA, 22 bp, Homo sapiens
tgactagcactagacatgtcat

SEQ ID NO: 6490025 - DNA, 14 bp, Homo sapiens
tgactaggaaaaaa

SEQ ID NO: 6490026 - DNA, 22 bp, Homo sapiens
tgactaggcatacactgtagtt

SEQ ID NO: 6490027 - DNA, 20 bp, Homo sapiens
tgactagggattcaggctgc

SEQ ID NO: 6490028 - DNA, 21 bp, Homo sapiens
tgactagggattcaggctgct

SEQ ID NO: 6490029 - DNA, 17 bp, Homo sapiens
tgactagggtcctcagg

SEQ ID NO: 6490030 - DNA, 18 bp, Homo sapiens
tgactagggtcctcaggc

SEQ ID NO: 6490031 - DNA, 23 bp, Homo sapiens
tgactaggtattgtctactctga

SEQ ID NO: 6490032 - DNA, 17 bp, Homo sapiens
tgactaggttctgtaga

SEQ ID NO: 6490033 - DNA, 16 bp, Homo sapiens
tgactagtcacctggg

SEQ ID NO: 6490034 - DNA, 17 bp, Homo sapiens
tgactagtcacctgggg

SEQ ID NO: 6490035 - DNA, 17 bp, Homo sapiens
tgactagtcatagaaat

SEQ ID NO: 6490036 - DNA, 14 bp, Homo sapiens
tgactagtgctgaa

SEQ ID NO: 6490037 - DNA, 17 bp, Homo sapiens
tgactagtgctgaagct

SEQ ID NO: 6490038 - DNA, 15 bp, Homo sapiens
tgactagtttaaaga

SEQ ID NO: 6490039 - DNA, 15 bp, Homo sapiens
tgactataaaaactg

SEQ ID NO: 6490040 - DNA, 15 bp, Homo sapiens
tgactataaacatta

SEQ ID NO: 6490041 - DNA, 22 bp, Homo sapiens
tgactataaacattaaaagaag

SEQ ID NO: 6490042 - DNA, 14 bp, Homo sapiens
tgactataaagctg

SEQ ID NO: 6490043 - DNA, 16 bp, Homo sapiens
tgactataaagctgtt

SEQ ID NO: 6490044 - DNA, 21 bp, Homo sapiens
tgactataccaactgggcctc

SEQ ID NO: 6490045 - DNA, 22 bp, Homo sapiens
tgactataccaactgggcctct

SEQ ID NO: 6490046 - DNA, 23 bp, Homo sapiens
tgactataccaactgggcctctg

SEQ ID NO: 6490047 - DNA, 18 bp, Homo sapiens
tgactatataatttattt

SEQ ID NO: 6490048 - DNA, 23 bp, Homo sapiens
tgactatataatttatttccact

SEQ ID NO: 6490049 - DNA, 16 bp, Homo sapiens
tgactatcaaactgaa

SEQ ID NO: 6490050 - DNA, 22 bp, Homo sapiens
tgactatcaaactgaagccaga

SEQ ID NO: 6490051 - DNA, 17 bp, Homo sapiens
tgactatcacatacaat

SEQ ID NO: 6490052 - DNA, 19 bp, Homo sapiens
tgactatcacatacaattt

SEQ ID NO: 6490053 - DNA, 23 bp, Homo sapiens
tgactatcacatacaatttgcac

SEQ ID NO: 6490054 - DNA, 21 bp, Homo sapiens
tgactatcccaacagtcatgt

SEQ ID NO: 6490055 - DNA, 24 bp, Homo sapiens
tgactatgcagaggcctgggggac

SEQ ID NO: 6490056 - DNA, 21 bp, Homo sapiens
tgactatggagtcttgtgaaa

SEQ ID NO: 6490057 - DNA, 15 bp, Homo sapiens
tgactatgtattttt

SEQ ID NO: 6490058 - DNA, 16 bp, Homo sapiens
tgggaccaggctccaa

SEQ ID NO: 6490059 - DNA, 18 bp, Homo sapiens
tgggaccagggatggggg

SEQ ID NO: 6490060 - DNA, 15 bp, Homo sapiens
tgggaccaggtctgt

SEQ ID NO: 6490061 - DNA, 17 bp, Homo sapiens
tgggacccacctccccc

SEQ ID NO: 6490062 - DNA, 13 bp, Homo sapiens
tgggacccaggct

SEQ ID NO: 6490063 - DNA, 14 bp, Homo sapiens
tgggacccaggctc

SEQ ID NO: 6490064 - DNA, 21 bp, Homo sapiens
tgggacccatagatcttctga

SEQ ID NO: 6490065 - DNA, 19 bp, Homo sapiens
tgggaccccagagaaaacc

SEQ ID NO: 6490066 - DNA, 13 bp, Homo sapiens
tgggaccccaggc

SEQ ID NO: 6490067 - DNA, 14 bp, Homo sapiens
tgggacccccgtgg

SEQ ID NO: 6490068 - DNA, 17 bp, Homo sapiens
tgggacccccgtggggc

SEQ ID NO: 6490069 - DNA, 22 bp, Homo sapiens
tgggacccccgtggggcaggga

SEQ ID NO: 6490070 - DNA, 21 bp, Homo sapiens
tgggacccctcccaacctcaa

SEQ ID NO: 6490071 - DNA, 15 bp, Homo sapiens
tgggaccctcagcag

SEQ ID NO: 6490072 - DNA, 13 bp, Homo sapiens
tgggaccctccag

SEQ ID NO: 6490073 - DNA, 13 bp, Homo sapiens
tgggaccctgctt

SEQ ID NO: 6490074 - DNA, 19 bp, Homo sapiens
tgggaccctgctttagagc

SEQ ID NO: 6490075 - DNA, 22 bp, Homo sapiens
tgggaccgcctggccctccctc

SEQ ID NO: 6490076 - DNA, 21 bp, Homo sapiens
tgggaccgctacaccactctg

SEQ ID NO: 6490077 - DNA, 22 bp, Homo sapiens
tgggaccgctacaccactctgg

SEQ ID NO: 6490078 - DNA, 20 bp, Homo sapiens
tgggaccgtgccccacctcc

SEQ ID NO: 6490079 - DNA, 17 bp, Homo sapiens
tgggaccgtgcgagctg

SEQ ID NO: 6490080 - DNA, 18 bp, Homo sapiens
tgggaccgtgcgagctgc

SEQ ID NO: 6490081 - DNA, 16 bp, Homo sapiens
tgggacctaatgctgg

SEQ ID NO: 6490082 - DNA, 21 bp, Homo sapiens
tgggacctaatgctggcctga

SEQ ID NO: 6490083 - DNA, 23 bp, Homo sapiens
tgggacctcagttttatcatttt

SEQ ID NO: 6490084 - DNA, 20 bp, Homo sapiens
tgggacctccccagcccagg

SEQ ID NO: 6490085 - DNA, 17 bp, Homo sapiens
tgggacctcctccctca

SEQ ID NO: 6490086 - DNA, 14 bp, Homo sapiens
tgggacctgatgac

SEQ ID NO: 6490087 - DNA, 19 bp, Homo sapiens
tgggacctgatgacctggg

SEQ ID NO: 6490088 - DNA, 13 bp, Homo sapiens
tgggacctgggcc

SEQ ID NO: 6490089 - DNA, 20 bp, Homo sapiens
tgggacctgtggtcatgtga

SEQ ID NO: 6490090 - DNA, 15 bp, Homo sapiens
tgggacgctctgctg

SEQ ID NO: 6490091 - DNA, 16 bp, Homo sapiens
tgggacgctctgctgt

SEQ ID NO: 6490092 - DNA, 15 bp, Homo sapiens
tgggacggaagtggc

SEQ ID NO: 6490093 - DNA, 18 bp, Homo sapiens
tgggacggctgagctggg

SEQ ID NO: 6490094 - DNA, 23 bp, Homo sapiens
tgggacggtgcccaagccagagg

SEQ ID NO: 6490095 - DNA, 17 bp, Homo sapiens
tgggacgtgtacagcac

SEQ ID NO: 6490096 - DNA, 22 bp, Homo sapiens
tgggacgtgtacagcacagaat

SEQ ID NO: 6490097 - DNA, 15 bp, Homo sapiens
tgggactacaggcac

SEQ ID NO: 6490098 - DNA, 16 bp, Homo sapiens
tgggactacaggcacc

SEQ ID NO: 6490099 - DNA, 22 bp, Homo sapiens
tgggactagaggctcagtggtg

SEQ ID NO: 6490100 - DNA, 17 bp, Homo sapiens
tgggactagcctggctt

SEQ ID NO: 6490101 - DNA, 15 bp, Homo sapiens
tgggactcaggatat

SEQ ID NO: 6490102 - DNA, 19 bp, Homo sapiens
tgggactcagttcttggcc

SEQ ID NO: 6490103 - DNA, 22 bp, Homo sapiens
tgggactcagttcttggcctgc

SEQ ID NO: 6490104 - DNA, 16 bp, Homo sapiens
tgggactccaggtctt

SEQ ID NO: 6490105 - DNA, 18 bp, Homo sapiens
tgggactccatagctcct

SEQ ID NO: 6490106 - DNA, 16 bp, Homo sapiens
tgggactcctggtgcc

SEQ ID NO: 6490107 - DNA, 24 bp, Homo sapiens
tgggactcctggtgcccctcgcca

SEQ ID NO: 6490108 - DNA, 15 bp, Homo sapiens
tgggactctcctcct

SEQ ID NO: 6490109 - DNA, 23 bp, Homo sapiens
tgggactctcctcctcccctcct

SEQ ID NO: 6490110 - DNA, 17 bp, Homo sapiens
tgggactcttccctggg

SEQ ID NO: 6490111 - DNA, 15 bp, Homo sapiens
tgggactgagccagt

SEQ ID NO: 6490112 - DNA, 16 bp, Homo sapiens
tgggactgagtgctga

SEQ ID NO: 6490113 - DNA, 16 bp, Homo sapiens
tgggactgatgtcatc

SEQ ID NO: 6490114 - DNA, 17 bp, Homo sapiens
tgggactgatgtcatct

SEQ ID NO: 6490115 - DNA, 15 bp, Homo sapiens
tgggactgctgaaga

SEQ ID NO: 6490116 - DNA, 13 bp, Homo sapiens
tgggactgctgtg

SEQ ID NO: 6490117 - DNA, 12 bp, Homo sapiens
tgggactggagt

SEQ ID NO: 6490118 - DNA, 23 bp, Homo sapiens
tgggactggccaggtttctgccc

SEQ ID NO: 6490119 - DNA, 16 bp, Homo sapiens
tgggactggcccaccc

SEQ ID NO: 6490120 - DNA, 18 bp, Homo sapiens
tgggactggcccacccct

SEQ ID NO: 6490121 - DNA, 14 bp, Homo sapiens
tgggactggcctct

SEQ ID NO: 6490122 - DNA, 16 bp, Homo sapiens
tgggactggcctctgc

SEQ ID NO: 6490123 - DNA, 12 bp, Homo sapiens
tgggactgggag

SEQ ID NO: 6490124 - DNA, 13 bp, Homo sapiens
tgggactgggagg

SEQ ID NO: 6490125 - DNA, 16 bp, Homo sapiens
tgggactgggagggcc

SEQ ID NO: 6490126 - DNA, 14 bp, Homo sapiens
tgggactgtacaca

SEQ ID NO: 6490127 - DNA, 18 bp, Homo sapiens
tgggactgtacacacttt

SEQ ID NO: 6490128 - DNA, 16 bp, Homo sapiens
tgggactgtcttgaga

SEQ ID NO: 6490129 - DNA, 14 bp, Homo sapiens
tgggactgtgcctg

SEQ ID NO: 6490130 - DNA, 22 bp, Homo sapiens
tgggactgtgcctggctccctg

SEQ ID NO: 6490131 - DNA, 15 bp, Homo sapiens
tgggacttcttaccc

SEQ ID NO: 6490132 - DNA, 21 bp, Homo sapiens
tgggacttcttacccaaagca

SEQ ID NO: 6490133 - DNA, 20 bp, Homo sapiens
tgggacttcttttcacattc

SEQ ID NO: 6490134 - DNA, 18 bp, Homo sapiens
tgggacttgaaatcaaat

SEQ ID NO: 6490135 - DNA, 16 bp, Homo sapiens
tgggacttgaacaaag

SEQ ID NO: 6490136 - DNA, 19 bp, Homo sapiens
tgggacttgaacaaagaca

SEQ ID NO: 6490137 - DNA, 20 bp, Homo sapiens
tgggacttggagagcaaagg

SEQ ID NO: 6490138 - DNA, 19 bp, Homo sapiens
tgggactttcccacccagg

SEQ ID NO: 6490139 - DNA, 18 bp, Homo sapiens
tgggacttttctttctta

SEQ ID NO: 6490140 - DNA, 22 bp, Homo sapiens
tgggagaaaacgccagtgtgtt

SEQ ID NO: 6490141 - DNA, 15 bp, Homo sapiens
tgggagaaaagccag

SEQ ID NO: 6490142 - DNA, 22 bp, Homo sapiens
tgggagaaagaccatgcattta

SEQ ID NO: 6490143 - DNA, 13 bp, Homo sapiens
tgggagaaagcaa

SEQ ID NO: 6490144 - DNA, 12 bp, Homo sapiens
tgggagaaatca

SEQ ID NO: 6490145 - DNA, 18 bp, Homo sapiens
tgggagaaattgacagat

SEQ ID NO: 6490146 - DNA, 15 bp, Homo sapiens
tgggagaacctcagg

SEQ ID NO: 6490147 - DNA, 22 bp, Homo sapiens
tgggagaacctcaggcttcctt

SEQ ID NO: 6490148 - DNA, 23 bp, Homo sapiens
tgggagaacctcaggcttccttg

SEQ ID NO: 6490149 - DNA, 15 bp, Homo sapiens
tgggagaagaggggt

SEQ ID NO: 6490150 - DNA, 14 bp, Homo sapiens
tgggagaagccgca

SEQ ID NO: 6490151 - DNA, 17 bp, Homo sapiens
tgggagaagggcagagt

SEQ ID NO: 6490152 - DNA, 20 bp, Homo sapiens
tgggagaaggtctccaaggg

SEQ ID NO: 6490153 - DNA, 14 bp, Homo sapiens
tgggagaaggtgct

SEQ ID NO: 6490154 - DNA, 16 bp, Homo sapiens
tgggagaagtggcccc

SEQ ID NO: 6490155 - DNA, 15 bp, Homo sapiens
tgggagaatcagcag

SEQ ID NO: 6490156 - DNA, 23 bp, Homo sapiens
tgggagaatcgctcctgcagccc

SEQ ID NO: 6490157 - DNA, 22 bp, Homo sapiens
tgggagaattcttacatgtttt

SEQ ID NO: 6490158 - DNA, 22 bp, Homo sapiens
tgggagacaaaggaggaattta

SEQ ID NO: 6490159 - DNA, 22 bp, Homo sapiens
tgggagacaattagcagaatgg

SEQ ID NO: 6490160 - DNA, 19 bp, Homo sapiens
tgggagacacccaaagggt

SEQ ID NO: 6490161 - DNA, 12 bp, Homo sapiens
tgggagacagca

SEQ ID NO: 6490162 - DNA, 17 bp, Homo sapiens
tgggagacagcagcctg

SEQ ID NO: 6490163 - DNA, 18 bp, Homo sapiens
tgggagacagtctaggaa

SEQ ID NO: 6490164 - DNA, 13 bp, Homo sapiens
tgggagacatgga

SEQ ID NO: 6490165 - DNA, 14 bp, Homo sapiens
tgggagacatgtga

SEQ ID NO: 6490166 - DNA, 21 bp, Homo sapiens
tgggagaccggcctgccagga

SEQ ID NO: 6490167 - DNA, 23 bp, Homo sapiens
tgggagaccggcctgccaggagg

SEQ ID NO: 6490168 - DNA, 14 bp, Homo sapiens
tgggagacctgttg

SEQ ID NO: 6490169 - DNA, 20 bp, Homo sapiens
tgggagacctgttggcctgt

SEQ ID NO: 6490170 - DNA, 21 bp, Homo sapiens
tgggagacctgttggcctgtg

SEQ ID NO: 6490171 - DNA, 18 bp, Homo sapiens
tgggagactctttgaaat

SEQ ID NO: 6490172 - DNA, 20 bp, Homo sapiens
tgggagactctttgaaatga

SEQ ID NO: 6490173 - DNA, 16 bp, Homo sapiens
tgggagactgagcttg

SEQ ID NO: 6490174 - DNA, 19 bp, Homo sapiens
tgggagagaagagaatgca

SEQ ID NO: 6490175 - DNA, 14 bp, Homo sapiens
tgggagagactgtg

SEQ ID NO: 6490176 - DNA, 12 bp, Homo sapiens
tgggagagactt

SEQ ID NO: 6490177 - DNA, 13 bp, Homo sapiens
tgggagagccaag

SEQ ID NO: 6490178 - DNA, 16 bp, Homo sapiens
tgggagagccatacat

SEQ ID NO: 6490179 - DNA, 11 bp, Homo sapiens
tgggagagccc

SEQ ID NO: 6490180 - DNA, 18 bp, Homo sapiens
tgggagagctagaaagtt

SEQ ID NO: 6490181 - DNA, 13 bp, Homo sapiens
tgggagaggaagc

SEQ ID NO: 6490182 - DNA, 17 bp, Homo sapiens
tgggagaggaagccacg

SEQ ID NO: 6490183 - DNA, 18 bp, Homo sapiens
tgggagaggagaggctgc

SEQ ID NO: 6490184 - DNA, 19 bp, Homo sapiens
tgggagaggagaggctgct

SEQ ID NO: 6490185 - DNA, 20 bp, Homo sapiens
tgggagaggatttttttctg

SEQ ID NO: 6490186 - DNA, 23 bp, Homo sapiens
tgggagaggcaataaataaatgt

SEQ ID NO: 6490187 - DNA, 13 bp, Homo sapiens
tgggagaggcaga

SEQ ID NO: 6490188 - DNA, 17 bp, Homo sapiens
tgggagaggctgggagg

SEQ ID NO: 6490189 - DNA, 20 bp, Homo sapiens
tgggagagggcgcaggccgt

SEQ ID NO: 6490190 - DNA, 23 bp, Homo sapiens
tgggagagtacctgtgtgtttcg

SEQ ID NO: 6490191 - DNA, 19 bp, Homo sapiens
tgggagagtccaggcctgg

SEQ ID NO: 6490192 - DNA, 13 bp, Homo sapiens
tgggagagtgagg

SEQ ID NO: 6490193 - DNA, 14 bp, Homo sapiens
tgggagagtgaggt

SEQ ID NO: 6490194 - DNA, 13 bp, Homo sapiens
tgggagagtgctc

SEQ ID NO: 6490195 - DNA, 22 bp, Homo sapiens
tgggagagtgctcaacctacag

SEQ ID NO: 6490196 - DNA, 18 bp, Homo sapiens
tgggagagtgtcaaccag

SEQ ID NO: 6490197 - DNA, 21 bp, Homo sapiens
tgggagagtgtcaaccagaca

SEQ ID NO: 6490198 - DNA, 23 bp, Homo sapiens
tgggagagtgtcaaccagacaga

SEQ ID NO: 6490199 - DNA, 23 bp, Homo sapiens
tgggagataattatcagtcatga

SEQ ID NO: 6490200 - DNA, 23 bp, Homo sapiens
tgggagatgaaaacctgcatttt

SEQ ID NO: 6490201 - DNA, 16 bp, Homo sapiens
tgggagatgctctctg

SEQ ID NO: 6490202 - DNA, 16 bp, Homo sapiens
tgggagatgctgggac

SEQ ID NO: 6490203 - DNA, 20 bp, Homo sapiens
tgggagattatcagtagaaa

SEQ ID NO: 6490204 - DNA, 23 bp, Homo sapiens
tgggagattcaagggacccatga

SEQ ID NO: 6490205 - DNA, 18 bp, Homo sapiens
tgggagatttttttgagt

SEQ ID NO: 6490206 - DNA, 13 bp, Homo sapiens
tgggagcaaaaga

SEQ ID NO: 6490207 - DNA, 12 bp, Homo sapiens
tgggagcagaaa

SEQ ID NO: 6490208 - DNA, 14 bp, Homo sapiens
tgggagcagaacag

SEQ ID NO: 6490209 - DNA, 23 bp, Homo sapiens
tgggagcagcccgctgagtggac

SEQ ID NO: 6490210 - DNA, 17 bp, Homo sapiens
tgggagcagcttcttgg

SEQ ID NO: 6490211 - DNA, 21 bp, Homo sapiens
tgggagcagcttcttgggctg

SEQ ID NO: 6490212 - DNA, 24 bp, Homo sapiens
tgggagcagcttcttgggctgagt

SEQ ID NO: 6490213 - DNA, 17 bp, Homo sapiens
tgggagcagtccatgca

SEQ ID NO: 6490214 - DNA, 19 bp, Homo sapiens
tgggagcagtccatgcatg

SEQ ID NO: 6490215 - DNA, 22 bp, Homo sapiens
tgggagccaatactgagtgcct

SEQ ID NO: 6490216 - DNA, 10 bp, Homo sapiens
tgggagccac

SEQ ID NO: 6490217 - DNA, 21 bp, Homo sapiens
tgggagccaccactcctgcct

SEQ ID NO: 6490218 - DNA, 13 bp, Homo sapiens
tgggagccactgc

SEQ ID NO: 6490219 - DNA, 14 bp, Homo sapiens
tgggagccactgcc

SEQ ID NO: 6490220 - DNA, 18 bp, Homo sapiens
tgggagccagagcctctg

SEQ ID NO: 6490221 - DNA, 16 bp, Homo sapiens
tgggagccagctgctt

SEQ ID NO: 6490222 - DNA, 17 bp, Homo sapiens
tgggagccagctgcttt

SEQ ID NO: 6490223 - DNA, 16 bp, Homo sapiens
tgggagccaggactcc

SEQ ID NO: 6490224 - DNA, 19 bp, Homo sapiens
tgggagccaggactcccag

SEQ ID NO: 6490225 - DNA, 20 bp, Homo sapiens
tgggagccaggactcccaga

SEQ ID NO: 6490226 - DNA, 21 bp, Homo sapiens
tgggagccaggactcccagaa

SEQ ID NO: 6490227 - DNA, 13 bp, Homo sapiens
tgggagccaggct

SEQ ID NO: 6490228 - DNA, 15 bp, Homo sapiens
tgggagccattttgt

SEQ ID NO: 6490229 - DNA, 14 bp, Homo sapiens
tgggagcccagagg

SEQ ID NO: 6490230 - DNA, 13 bp, Homo sapiens
tgggagcccagca

SEQ ID NO: 6490231 - DNA, 16 bp, Homo sapiens
tgggagcccagcacac

SEQ ID NO: 6490232 - DNA, 13 bp, Homo sapiens
tgggagccccagg

SEQ ID NO: 6490233 - DNA, 20 bp, Homo sapiens
tgggagcccccaccacaaac

SEQ ID NO: 6490234 - DNA, 15 bp, Homo sapiens
tgggagcccccagcc

SEQ ID NO: 6490235 - DNA, 16 bp, Homo sapiens
tgggagcccccagcct

SEQ ID NO: 6490236 - DNA, 18 bp, Homo sapiens
tgggagcccccagcctgt

SEQ ID NO: 6490237 - DNA, 19 bp, Homo sapiens
tgactatgtctagagcctc

SEQ ID NO: 6490238 - DNA, 22 bp, Homo sapiens
tgactatgtctagagcctcttg

SEQ ID NO: 6490239 - DNA, 13 bp, Homo sapiens
tgactattaaatg

SEQ ID NO: 6490240 - DNA, 23 bp, Homo sapiens
tgactattaaatgttgcacatca

SEQ ID NO: 6490241 - DNA, 16 bp, Homo sapiens
tgactattatgttgtt

SEQ ID NO: 6490242 - DNA, 17 bp, Homo sapiens
tgactattatgttgtta

SEQ ID NO: 6490243 - DNA, 22 bp, Homo sapiens
tgactattatgttgttagagaa

SEQ ID NO: 6490244 - DNA, 19 bp, Homo sapiens
tgactattctgagatgact

SEQ ID NO: 6490245 - DNA, 20 bp, Homo sapiens
tgactattctgtatctttca

SEQ ID NO: 6490246 - DNA, 17 bp, Homo sapiens
tgactattcttgatgta

SEQ ID NO: 6490247 - DNA, 21 bp, Homo sapiens
tgactattcttgatgtaaaat

SEQ ID NO: 6490248 - DNA, 22 bp, Homo sapiens
tgactatttttgtttttattaa

SEQ ID NO: 6490249 - DNA, 23 bp, Homo sapiens
tgactatttttgtttttattaaa

SEQ ID NO: 6490250 - DNA, 19 bp, Homo sapiens
tgactattttttaataaaa

SEQ ID NO: 6490251 - DNA, 16 bp, Homo sapiens
tgactcaaatctccag

SEQ ID NO: 6490252 - DNA, 12 bp, Homo sapiens
tgactcaagaag

SEQ ID NO: 6490253 - DNA, 17 bp, Homo sapiens
tgactcaagattcccag

SEQ ID NO: 6490254 - DNA, 20 bp, Homo sapiens
tgactcaagattcccaggag

SEQ ID NO: 6490255 - DNA, 13 bp, Homo sapiens
tgactcaaggcca

SEQ ID NO: 6490256 - DNA, 18 bp, Homo sapiens
tgactcaagtttttacaa

SEQ ID NO: 6490257 - DNA, 21 bp, Homo sapiens
tgactcaagtttttacaaaat

SEQ ID NO: 6490258 - DNA, 18 bp, Homo sapiens
tgactcaattatttgcat

SEQ ID NO: 6490259 - DNA, 19 bp, Homo sapiens
tgactcacaagaagaccag

SEQ ID NO: 6490260 - DNA, 15 bp, Homo sapiens
tgactcacccaagca

SEQ ID NO: 6490261 - DNA, 17 bp, Homo sapiens
tgactcacttcaatgtg

SEQ ID NO: 6490262 - DNA, 19 bp, Homo sapiens
tgactcacttcaatgtgtc

SEQ ID NO: 6490263 - DNA, 22 bp, Homo sapiens
tgactcagaaacagaagaaaaa

SEQ ID NO: 6490264 - DNA, 12 bp, Homo sapiens
tgactcagagct

SEQ ID NO: 6490265 - DNA, 13 bp, Homo sapiens
tgactcagagctt

SEQ ID NO: 6490266 - DNA, 13 bp, Homo sapiens
tgactcagaggct

SEQ ID NO: 6490267 - DNA, 16 bp, Homo sapiens
tgactcagaggctggg

SEQ ID NO: 6490268 - DNA, 18 bp, Homo sapiens
tgactcagaggctgggag

SEQ ID NO: 6490269 - DNA, 16 bp, Homo sapiens
tgactcagatgtctct

SEQ ID NO: 6490270 - DNA, 16 bp, Homo sapiens
tgactcagcagaggca

SEQ ID NO: 6490271 - DNA, 19 bp, Homo sapiens
tgactcaggagcctcctag

SEQ ID NO: 6490272 - DNA, 14 bp, Homo sapiens
tgactcagggctcc

SEQ ID NO: 6490273 - DNA, 15 bp, Homo sapiens
tgactcagggctcct

SEQ ID NO: 6490274 - DNA, 17 bp, Homo sapiens
tgactcagggctcctgg

SEQ ID NO: 6490275 - DNA, 19 bp, Homo sapiens
tgactcaggtggtgtcctt

SEQ ID NO: 6490276 - DNA, 15 bp, Homo sapiens
tgactcagtgcaggg

SEQ ID NO: 6490277 - DNA, 16 bp, Homo sapiens
tgactcagtgtatttt

SEQ ID NO: 6490278 - DNA, 22 bp, Homo sapiens
tgactcataggtccctgacatt

SEQ ID NO: 6490279 - DNA, 21 bp, Homo sapiens
tgactcatcaattttgtctat

SEQ ID NO: 6490280 - DNA, 15 bp, Homo sapiens
tgactcatggcagct

SEQ ID NO: 6490281 - DNA, 20 bp, Homo sapiens
tgactcatggcagctgtttc

SEQ ID NO: 6490282 - DNA, 20 bp, Homo sapiens
tgactccacgatcctgccac

SEQ ID NO: 6490283 - DNA, 22 bp, Homo sapiens
tgactccacgatcctgccaccc

SEQ ID NO: 6490284 - DNA, 18 bp, Homo sapiens
tgactccactcaaagagg

SEQ ID NO: 6490285 - DNA, 20 bp, Homo sapiens
tgactccagaatttcccaaa

SEQ ID NO: 6490286 - DNA, 23 bp, Homo sapiens
tgactccagaatttcccaaagca

SEQ ID NO: 6490287 - DNA, 14 bp, Homo sapiens
tgactccagagtct

SEQ ID NO: 6490288 - DNA, 20 bp, Homo sapiens
tgactccagagtctgagccc

SEQ ID NO: 6490289 - DNA, 14 bp, Homo sapiens
tgactccagcctgc

SEQ ID NO: 6490290 - DNA, 11 bp, Homo sapiens
tgactccagga

SEQ ID NO: 6490291 - DNA, 13 bp, Homo sapiens
tgactccaggaag

SEQ ID NO: 6490292 - DNA, 13 bp, Homo sapiens
tgactccagggtg

SEQ ID NO: 6490293 - DNA, 22 bp, Homo sapiens
tgactcccaaagagctgcctaa

SEQ ID NO: 6490294 - DNA, 17 bp, Homo sapiens
tgactcccattttggtg

SEQ ID NO: 6490295 - DNA, 15 bp, Homo sapiens
tgactccccagccca

SEQ ID NO: 6490296 - DNA, 19 bp, Homo sapiens
tgactcccccagtcccctt

SEQ ID NO: 6490297 - DNA, 22 bp, Homo sapiens
tgactcccccagtccccttccc

SEQ ID NO: 6490298 - DNA, 21 bp, Homo sapiens
tgactccctccccacccaaga

SEQ ID NO: 6490299 - DNA, 15 bp, Homo sapiens
tgactccctgtgggg

SEQ ID NO: 6490300 - DNA, 20 bp, Homo sapiens
tgactcctatgatctcaggt

SEQ ID NO: 6490301 - DNA, 15 bp, Homo sapiens
tgactcctcaattcc

SEQ ID NO: 6490302 - DNA, 16 bp, Homo sapiens
tgactcctccaaggtt

SEQ ID NO: 6490303 - DNA, 21 bp, Homo sapiens
tgactcctcccttccccactc

SEQ ID NO: 6490304 - DNA, 13 bp, Homo sapiens
tgactcctctggc

SEQ ID NO: 6490305 - DNA, 14 bp, Homo sapiens
tgactcctctggct

SEQ ID NO: 6490306 - DNA, 16 bp, Homo sapiens
tgactcctctggcttt

SEQ ID NO: 6490307 - DNA, 23 bp, Homo sapiens
tgactcctgaaggtttcctggtc

SEQ ID NO: 6490308 - DNA, 21 bp, Homo sapiens
tgactcctgctggtacctgcc

SEQ ID NO: 6490309 - DNA, 11 bp, Homo sapiens
tgactcctgga

SEQ ID NO: 6490310 - DNA, 13 bp, Homo sapiens
tgactcctggact

SEQ ID NO: 6490311 - DNA, 14 bp, Homo sapiens
tgactcctggactc

SEQ ID NO: 6490312 - DNA, 20 bp, Homo sapiens
tgactcctggactccggagg

SEQ ID NO: 6490313 - DNA, 15 bp, Homo sapiens
tgactccttaccaat

SEQ ID NO: 6490314 - DNA, 16 bp, Homo sapiens
tgactccttctgccag

SEQ ID NO: 6490315 - DNA, 18 bp, Homo sapiens
tgactccttggtgctaaa

SEQ ID NO: 6490316 - DNA, 14 bp, Homo sapiens
tgactccttgtggt

SEQ ID NO: 6490317 - DNA, 14 bp, Homo sapiens
tgactcctttccaa

SEQ ID NO: 6490318 - DNA, 15 bp, Homo sapiens
tgactcgaaactgac

SEQ ID NO: 6490319 - DNA, 21 bp, Homo sapiens
tgactcggcagtgtgcagtgg

SEQ ID NO: 6490320 - DNA, 14 bp, Homo sapiens
tgactcgggagctg

SEQ ID NO: 6490321 - DNA, 15 bp, Homo sapiens
tgactcgggagctgc

SEQ ID NO: 6490322 - DNA, 17 bp, Homo sapiens
tgactcgggagctgcac

SEQ ID NO: 6490323 - DNA, 16 bp, Homo sapiens
tgactcgggctcctgt

SEQ ID NO: 6490324 - DNA, 17 bp, Homo sapiens
tgactcgggctcctgtg

SEQ ID NO: 6490325 - DNA, 21 bp, Homo sapiens
tgactcgggctcctgtgccct

SEQ ID NO: 6490326 - DNA, 15 bp, Homo sapiens
tgactcggtgtaaaa

SEQ ID NO: 6490327 - DNA, 20 bp, Homo sapiens
tgactcggtgtaaaaccatg

SEQ ID NO: 6490328 - DNA, 18 bp, Homo sapiens
tgactcgttacctgccgc

SEQ ID NO: 6490329 - DNA, 21 bp, Homo sapiens
tgactctaaagaaacagaaga

SEQ ID NO: 6490330 - DNA, 17 bp, Homo sapiens
tgactctaagctcagtg

SEQ ID NO: 6490331 - DNA, 17 bp, Homo sapiens
tgactctagcaaggctc

SEQ ID NO: 6490332 - DNA, 19 bp, Homo sapiens
tgactctcacctgtactat

SEQ ID NO: 6490333 - DNA, 14 bp, Homo sapiens
tgactctccactcc

SEQ ID NO: 6490334 - DNA, 11 bp, Homo sapiens
tgactctccag

SEQ ID NO: 6490335 - DNA, 15 bp, Homo sapiens
tgactctccagggag

SEQ ID NO: 6490336 - DNA, 15 bp, Homo sapiens
tgactctctgagctg

SEQ ID NO: 6490337 - DNA, 19 bp, Homo sapiens
tgactctctgagctgggga

SEQ ID NO: 6490338 - DNA, 11 bp, Homo sapiens
tgactctgaaa

SEQ ID NO: 6490339 - DNA, 21 bp, Homo sapiens
tgactctgagaaaatgcgaga

SEQ ID NO: 6490340 - DNA, 13 bp, Homo sapiens
tgactctgccccc

SEQ ID NO: 6490341 - DNA, 11 bp, Homo sapiens
tgactctgcct

SEQ ID NO: 6490342 - DNA, 22 bp, Homo sapiens
tgactctgcctaaccatgggct

SEQ ID NO: 6490343 - DNA, 12 bp, Homo sapiens
tgactctgctct

SEQ ID NO: 6490344 - DNA, 16 bp, Homo sapiens
tgactctgctcttgca

SEQ ID NO: 6490345 - DNA, 17 bp, Homo sapiens
tgactctggcaaagctt

SEQ ID NO: 6490346 - DNA, 15 bp, Homo sapiens
tgactctggctgcca

SEQ ID NO: 6490347 - DNA, 21 bp, Homo sapiens
tgactctgggtccttcctgaa

SEQ ID NO: 6490348 - DNA, 16 bp, Homo sapiens
tgactctgtccaactc

SEQ ID NO: 6490349 - DNA, 14 bp, Homo sapiens
tgactctgtgctga

SEQ ID NO: 6490350 - DNA, 24 bp, Homo sapiens
tgactctgttgatctacccgtgcc

SEQ ID NO: 6490351 - DNA, 14 bp, Homo sapiens
tgactcttaagaag

SEQ ID NO: 6490352 - DNA, 15 bp, Homo sapiens
tgactcttactcctt

SEQ ID NO: 6490353 - DNA, 13 bp, Homo sapiens
tgactcttattta

SEQ ID NO: 6490354 - DNA, 20 bp, Homo sapiens
tgactcttccgtgcatccca

SEQ ID NO: 6490355 - DNA, 16 bp, Homo sapiens
tgactcttctctcaac

SEQ ID NO: 6490356 - DNA, 19 bp, Homo sapiens
tgactcttcttatcacact

SEQ ID NO: 6490357 - DNA, 21 bp, Homo sapiens
tgactcttgagttgtttttgt

SEQ ID NO: 6490358 - DNA, 22 bp, Homo sapiens
tgactcttgagttgtttttgta

SEQ ID NO: 6490359 - DNA, 14 bp, Homo sapiens
tgactcttgccttt

SEQ ID NO: 6490360 - DNA, 20 bp, Homo sapiens
tgactcttgcctttccacct

SEQ ID NO: 6490361 - DNA, 14 bp, Homo sapiens
tgactcttgcgtgt

SEQ ID NO: 6490362 - DNA, 19 bp, Homo sapiens
tgactcttggagcctcttt

SEQ ID NO: 6490363 - DNA, 19 bp, Homo sapiens
tgactcttggcacagcatg

SEQ ID NO: 6490364 - DNA, 20 bp, Homo sapiens
tgactcttgttttcagtttc

SEQ ID NO: 6490365 - DNA, 16 bp, Homo sapiens
tgactctttattgtct

SEQ ID NO: 6490366 - DNA, 17 bp, Homo sapiens
tgactctttattgtctg

SEQ ID NO: 6490367 - DNA, 20 bp, Homo sapiens
tgactctttattgtctgtaa

SEQ ID NO: 6490368 - DNA, 13 bp, Homo sapiens
tgactctttcaaa

SEQ ID NO: 6490369 - DNA, 20 bp, Homo sapiens
tgactctttcaaagaaatcc

SEQ ID NO: 6490370 - DNA, 22 bp, Homo sapiens
tgactctttttggactcagccc

SEQ ID NO: 6490371 - DNA, 22 bp, Homo sapiens
tgactgaaaaaaaaaaagaaga

SEQ ID NO: 6490372 - DNA, 16 bp, Homo sapiens
tgactgaaaatgaact

SEQ ID NO: 6490373 - DNA, 15 bp, Homo sapiens
tgactgaaagaagaa

SEQ ID NO: 6490374 - DNA, 19 bp, Homo sapiens
tgactgaaagaagaacagc

SEQ ID NO: 6490375 - DNA, 22 bp, Homo sapiens
tgactgaaagaagaacagctgt

SEQ ID NO: 6490376 - DNA, 14 bp, Homo sapiens
tgactgaaattact

SEQ ID NO: 6490377 - DNA, 13 bp, Homo sapiens
tgactgaacatta

SEQ ID NO: 6490378 - DNA, 13 bp, Homo sapiens
tgactgaactgca

SEQ ID NO: 6490379 - DNA, 14 bp, Homo sapiens
tgactgaactgtaa

SEQ ID NO: 6490380 - DNA, 20 bp, Homo sapiens
tgactgaagaagatgagcct

SEQ ID NO: 6490381 - DNA, 19 bp, Homo sapiens
tgactgaagatgcagctca

SEQ ID NO: 6490382 - DNA, 13 bp, Homo sapiens
tgactgaagcaca

SEQ ID NO: 6490383 - DNA, 17 bp, Homo sapiens
tgactgaagcgaacatc

SEQ ID NO: 6490384 - DNA, 22 bp, Homo sapiens
tgactgaagcgaacatcttcat

SEQ ID NO: 6490385 - DNA, 14 bp, Homo sapiens
tgactgaaggaaaa

SEQ ID NO: 6490386 - DNA, 17 bp, Homo sapiens
tgactgaagtaataact

SEQ ID NO: 6490387 - DNA, 14 bp, Homo sapiens
tgactgaagtactg

SEQ ID NO: 6490388 - DNA, 18 bp, Homo sapiens
tgactgaattctgccttg

SEQ ID NO: 6490389 - DNA, 17 bp, Homo sapiens
tgactgaatttctatgg

SEQ ID NO: 6490390 - DNA, 15 bp, Homo sapiens
tgactgaatttcttt

SEQ ID NO: 6490391 - DNA, 21 bp, Homo sapiens
tgactgaatttgggcctcttg

SEQ ID NO: 6490392 - DNA, 16 bp, Homo sapiens
tgactgacacaggcca

SEQ ID NO: 6490393 - DNA, 17 bp, Homo sapiens
tgactgacacaggccag

SEQ ID NO: 6490394 - DNA, 18 bp, Homo sapiens
tgactgacacaggccagc

SEQ ID NO: 6490395 - DNA, 20 bp, Homo sapiens
tgactgacccaaaatgtgaa

SEQ ID NO: 6490396 - DNA, 22 bp, Homo sapiens
tgactgacccaaaatgtgaatg

SEQ ID NO: 6490397 - DNA, 23 bp, Homo sapiens
tgactgacggctgtgtatttctg

SEQ ID NO: 6490398 - DNA, 16 bp, Homo sapiens
tgactgagaagatgtt

SEQ ID NO: 6490399 - DNA, 20 bp, Homo sapiens
tgactgagatttgtaaatct

SEQ ID NO: 6490400 - DNA, 19 bp, Homo sapiens
tgactgagcaagaccctgt

SEQ ID NO: 6490401 - DNA, 16 bp, Homo sapiens
tgactgagcaggctgt

SEQ ID NO: 6490402 - DNA, 17 bp, Homo sapiens
tgactgaggcaggcatg

SEQ ID NO: 6490403 - DNA, 13 bp, Homo sapiens
tgactgaggcctg

SEQ ID NO: 6490404 - DNA, 21 bp, Homo sapiens
tgactgatcctgaacaagaaa

SEQ ID NO: 6490405 - DNA, 20 bp, Homo sapiens
tgactgatgctttcagatta

SEQ ID NO: 6490406 - DNA, 20 bp, Homo sapiens
tgactgatgttaggctgggc

SEQ ID NO: 6490407 - DNA, 15 bp, Homo sapiens
tgactgattcttcag

SEQ ID NO: 6490408 - DNA, 17 bp, Homo sapiens
tgactgattcttcagca

SEQ ID NO: 6490409 - DNA, 21 bp, Homo sapiens
tgactgcaagcatttttccat

SEQ ID NO: 6490410 - DNA, 23 bp, Homo sapiens
tgactgcacacagctaggcatgc

SEQ ID NO: 6490411 - DNA, 16 bp, Homo sapiens
tgactgcacccagctc

SEQ ID NO: 6490412 - DNA, 17 bp, Homo sapiens
tgactgcacccagctcc

SEQ ID NO: 6490413 - DNA, 18 bp, Homo sapiens
tgactgcacccagctcca

SEQ ID NO: 6490414 - DNA, 22 bp, Homo sapiens
tgactgcactgttgctgactac

SEQ ID NO: 6490415 - DNA, 13 bp, Homo sapiens
tgactgcagcccc

SEQ ID NO: 6490416 - DNA, 20 bp, Homo sapiens
tgggagcccccagcctgtca

SEQ ID NO: 6490417 - DNA, 21 bp, Homo sapiens
tgggagccctgaccttggctg

SEQ ID NO: 6490418 - DNA, 20 bp, Homo sapiens
tgggagccgggaccctcagg

SEQ ID NO: 6490419 - DNA, 23 bp, Homo sapiens
tgggagccgggcaaactggccgc

SEQ ID NO: 6490420 - DNA, 23 bp, Homo sapiens
tgggagccgggtctgcctcttct

SEQ ID NO: 6490421 - DNA, 20 bp, Homo sapiens
tgggagccgtcagcctgtga

SEQ ID NO: 6490422 - DNA, 16 bp, Homo sapiens
tgggagcctaaggaag

SEQ ID NO: 6490423 - DNA, 21 bp, Homo sapiens
tgggagcctagctcctgccac

SEQ ID NO: 6490424 - DNA, 16 bp, Homo sapiens
tgggagcctcagactc

SEQ ID NO: 6490425 - DNA, 18 bp, Homo sapiens
tgggagcctcataaagat

SEQ ID NO: 6490426 - DNA, 17 bp, Homo sapiens
tgggagcctcgcccctc

SEQ ID NO: 6490427 - DNA, 23 bp, Homo sapiens
tgggagcctcgcccctccagtgt

SEQ ID NO: 6490428 - DNA, 16 bp, Homo sapiens
tgggagcctgaggcag

SEQ ID NO: 6490429 - DNA, 18 bp, Homo sapiens
tgggagcctgaggcatga

SEQ ID NO: 6490430 - DNA, 22 bp, Homo sapiens
tgggagcctggttcagacacag

SEQ ID NO: 6490431 - DNA, 19 bp, Homo sapiens
tgggagcctgtggccagca

SEQ ID NO: 6490432 - DNA, 22 bp, Homo sapiens
tgggagcgtcagggttggtgtg

SEQ ID NO: 6490433 - DNA, 20 bp, Homo sapiens
tgggagcgtgggaggcggga

SEQ ID NO: 6490434 - DNA, 11 bp, Homo sapiens
tgggagctcag

SEQ ID NO: 6490435 - DNA, 16 bp, Homo sapiens
tgggagctcctctcct

SEQ ID NO: 6490436 - DNA, 19 bp, Homo sapiens
tgggagctcctctcctgga

SEQ ID NO: 6490437 - DNA, 22 bp, Homo sapiens
tgggagctcctctcctggagga

SEQ ID NO: 6490438 - DNA, 18 bp, Homo sapiens
tgggagctgagcagcctc

SEQ ID NO: 6490439 - DNA, 14 bp, Homo sapiens
tgggagctgcctgt

SEQ ID NO: 6490440 - DNA, 17 bp, Homo sapiens
tgggagctgcctgttca

SEQ ID NO: 6490441 - DNA, 21 bp, Homo sapiens
tgggagctgcctgttcagctc

SEQ ID NO: 6490442 - DNA, 23 bp, Homo sapiens
tgggagctgcctgttcagctcca

SEQ ID NO: 6490443 - DNA, 21 bp, Homo sapiens
tgggagctgcgccggacagag

SEQ ID NO: 6490444 - DNA, 18 bp, Homo sapiens
tgggagctggttagaaat

SEQ ID NO: 6490445 - DNA, 19 bp, Homo sapiens
tgggagctggttagaaatg

SEQ ID NO: 6490446 - DNA, 20 bp, Homo sapiens
tgggagcttgattctcagca

SEQ ID NO: 6490447 - DNA, 13 bp, Homo sapiens
tgggagctttaaa

SEQ ID NO: 6490448 - DNA, 16 bp, Homo sapiens
tgggagcttttgtaga

SEQ ID NO: 6490449 - DNA, 21 bp, Homo sapiens
tgggaggaaagggcctggcca

SEQ ID NO: 6490450 - DNA, 22 bp, Homo sapiens
tgggaggaaagggcctggccag

SEQ ID NO: 6490451 - DNA, 15 bp, Homo sapiens
tgggaggaaaggtga

SEQ ID NO: 6490452 - DNA, 11 bp, Homo sapiens
tgggaggaagc

SEQ ID NO: 6490453 - DNA, 12 bp, Homo sapiens
tgggaggaagca

SEQ ID NO: 6490454 - DNA, 16 bp, Homo sapiens
tgggaggaagcaaaag

SEQ ID NO: 6490455 - DNA, 13 bp, Homo sapiens
tgggaggaagcag

SEQ ID NO: 6490456 - DNA, 15 bp, Homo sapiens
tgggaggaagcagaa

SEQ ID NO: 6490457 - DNA, 17 bp, Homo sapiens
tgggaggaagcagaata

SEQ ID NO: 6490458 - DNA, 20 bp, Homo sapiens
tgggaggaagcagaataaag

SEQ ID NO: 6490459 - DNA, 22 bp, Homo sapiens
tgggaggaagcagaataaagca

SEQ ID NO: 6490460 - DNA, 24 bp, Homo sapiens
tgggaggaagcaggttgaggggct

SEQ ID NO: 6490461 - DNA, 13 bp, Homo sapiens
tgggaggaaggac

SEQ ID NO: 6490462 - DNA, 17 bp, Homo sapiens
tgggaggacaggcaggc

SEQ ID NO: 6490463 - DNA, 16 bp, Homo sapiens
tgggaggagaccagcg

SEQ ID NO: 6490464 - DNA, 17 bp, Homo sapiens
tgggaggagagccactg

SEQ ID NO: 6490465 - DNA, 18 bp, Homo sapiens
tgggaggagagccactgg

SEQ ID NO: 6490466 - DNA, 18 bp, Homo sapiens
tgggaggagcgaaatcta

SEQ ID NO: 6490467 - DNA, 17 bp, Homo sapiens
tgggaggaggaaagaga

SEQ ID NO: 6490468 - DNA, 14 bp, Homo sapiens
tgggaggaggaaga

SEQ ID NO: 6490469 - DNA, 13 bp, Homo sapiens
tgggaggaggcct

SEQ ID NO: 6490470 - DNA, 18 bp, Homo sapiens
tgggaggagggagaggga

SEQ ID NO: 6490471 - DNA, 19 bp, Homo sapiens
tgggaggagggagagggag

SEQ ID NO: 6490472 - DNA, 15 bp, Homo sapiens
tgggaggagggaggc

SEQ ID NO: 6490473 - DNA, 12 bp, Homo sapiens
tgggaggagggg

SEQ ID NO: 6490474 - DNA, 21 bp, Homo sapiens
tgggaggagggggcccggctg

SEQ ID NO: 6490475 - DNA, 18 bp, Homo sapiens
tgggaggatacagaggag

SEQ ID NO: 6490476 - DNA, 15 bp, Homo sapiens
tgggaggatcatttg

SEQ ID NO: 6490477 - DNA, 20 bp, Homo sapiens
tgggaggatcctgagctgct

SEQ ID NO: 6490478 - DNA, 21 bp, Homo sapiens
tgggaggatctcttgagcctg

SEQ ID NO: 6490479 - DNA, 22 bp, Homo sapiens
tgggaggatctcttgagcctgg

SEQ ID NO: 6490480 - DNA, 21 bp, Homo sapiens
tgggaggattgcttgagctca

SEQ ID NO: 6490481 - DNA, 15 bp, Homo sapiens
tgggaggcaagaaaa

SEQ ID NO: 6490482 - DNA, 17 bp, Homo sapiens
tgggaggcaagaaaagg

SEQ ID NO: 6490483 - DNA, 19 bp, Homo sapiens
tgggaggcaagaggggtgg

SEQ ID NO: 6490484 - DNA, 14 bp, Homo sapiens
tgggaggcagaggt

SEQ ID NO: 6490485 - DNA, 21 bp, Homo sapiens
tgggaggcagccgaggcctgg

SEQ ID NO: 6490486 - DNA, 22 bp, Homo sapiens
tgggaggcaggtcgggctgcca

SEQ ID NO: 6490487 - DNA, 18 bp, Homo sapiens
tgggaggcatggccctgg

SEQ ID NO: 6490488 - DNA, 22 bp, Homo sapiens
tgggaggccaaacacccaagca

SEQ ID NO: 6490489 - DNA, 12 bp, Homo sapiens
tgggaggccaag

SEQ ID NO: 6490490 - DNA, 16 bp, Homo sapiens
tgggaggccaaggcag

SEQ ID NO: 6490491 - DNA, 17 bp, Homo sapiens
tgggaggccaaggcagg

SEQ ID NO: 6490492 - DNA, 19 bp, Homo sapiens
tgggaggccaaggcaggta

SEQ ID NO: 6490493 - DNA, 15 bp, Homo sapiens
tgggaggccaggcga

SEQ ID NO: 6490494 - DNA, 18 bp, Homo sapiens
tgggaggccaggcgagcc

SEQ ID NO: 6490495 - DNA, 18 bp, Homo sapiens
tgggaggccccactgggg

SEQ ID NO: 6490496 - DNA, 19 bp, Homo sapiens
tgggaggcccctggtggca

SEQ ID NO: 6490497 - DNA, 23 bp, Homo sapiens
tgggaggcccggggcccttcctc

SEQ ID NO: 6490498 - DNA, 17 bp, Homo sapiens
tgggaggccgaggtggg

SEQ ID NO: 6490499 - DNA, 22 bp, Homo sapiens
tgggaggcctcgtaccagccag

SEQ ID NO: 6490500 - DNA, 22 bp, Homo sapiens
tgggaggcggagagtacagtga

SEQ ID NO: 6490501 - DNA, 16 bp, Homo sapiens
tgggaggcgtgccccc

SEQ ID NO: 6490502 - DNA, 21 bp, Homo sapiens
tgggaggcgtgcccccctcct

SEQ ID NO: 6490503 - DNA, 20 bp, Homo sapiens
tgggaggctcacccccttct

SEQ ID NO: 6490504 - DNA, 15 bp, Homo sapiens
tgggaggctcccaga

SEQ ID NO: 6490505 - DNA, 15 bp, Homo sapiens
tgggaggctcccctt

SEQ ID NO: 6490506 - DNA, 14 bp, Homo sapiens
tgggaggctcctgt

SEQ ID NO: 6490507 - DNA, 17 bp, Homo sapiens
tgggaggctcctgttag

SEQ ID NO: 6490508 - DNA, 14 bp, Homo sapiens
tgggaggctctgga

SEQ ID NO: 6490509 - DNA, 23 bp, Homo sapiens
tgggaggctctggagcccactgt

SEQ ID NO: 6490510 - DNA, 11 bp, Homo sapiens
tgggaggctga

SEQ ID NO: 6490511 - DNA, 17 bp, Homo sapiens
tgggaggctgaagtggg

SEQ ID NO: 6490512 - DNA, 19 bp, Homo sapiens
tgggaggctgagatgggag

SEQ ID NO: 6490513 - DNA, 13 bp, Homo sapiens
tgggaggctgagg

SEQ ID NO: 6490514 - DNA, 17 bp, Homo sapiens
tgggaggctgaggcagg

SEQ ID NO: 6490515 - DNA, 15 bp, Homo sapiens
tgggaggctgaggcg

SEQ ID NO: 6490516 - DNA, 13 bp, Homo sapiens
tgggaggctgcag

SEQ ID NO: 6490517 - DNA, 14 bp, Homo sapiens
tgggaggctgcagc

SEQ ID NO: 6490518 - DNA, 15 bp, Homo sapiens
tgggaggctgcagcc

SEQ ID NO: 6490519 - DNA, 19 bp, Homo sapiens
tgggaggctgcagccaggc

SEQ ID NO: 6490520 - DNA, 23 bp, Homo sapiens
tgggaggctgtggagagaagtga

SEQ ID NO: 6490521 - DNA, 14 bp, Homo sapiens
tgggagggacaggg

SEQ ID NO: 6490522 - DNA, 12 bp, Homo sapiens
tgggagggagga

SEQ ID NO: 6490523 - DNA, 22 bp, Homo sapiens
tgggagggaggctcaggtccct

SEQ ID NO: 6490524 - DNA, 14 bp, Homo sapiens
tgggagggaggggg

SEQ ID NO: 6490525 - DNA, 15 bp, Homo sapiens
tgggagggaggggga

SEQ ID NO: 6490526 - DNA, 16 bp, Homo sapiens
tgggagggagggggag

SEQ ID NO: 6490527 - DNA, 21 bp, Homo sapiens
tgggagggagggggaggtgaa

SEQ ID NO: 6490528 - DNA, 20 bp, Homo sapiens
tgggagggatcagccccgcc

SEQ ID NO: 6490529 - DNA, 17 bp, Homo sapiens
tgggagggcagcagggc

SEQ ID NO: 6490530 - DNA, 18 bp, Homo sapiens
tgggagggcagcagggct

SEQ ID NO: 6490531 - DNA, 23 bp, Homo sapiens
tgggagggcgtcaggcagaggca

SEQ ID NO: 6490532 - DNA, 16 bp, Homo sapiens
tgggagggctgaaccc

SEQ ID NO: 6490533 - DNA, 17 bp, Homo sapiens
tgggaggggaagaaaaa

SEQ ID NO: 6490534 - DNA, 18 bp, Homo sapiens
tgggaggggaagggctgg

SEQ ID NO: 6490535 - DNA, 19 bp, Homo sapiens
tgggaggggaagggctggg

SEQ ID NO: 6490536 - DNA, 11 bp, Homo sapiens
tgggaggggca

SEQ ID NO: 6490537 - DNA, 12 bp, Homo sapiens
tgggaggggcag

SEQ ID NO: 6490538 - DNA, 14 bp, Homo sapiens
tgggaggggcaggc

SEQ ID NO: 6490539 - DNA, 18 bp, Homo sapiens
tgggaggggcaggctgac

SEQ ID NO: 6490540 - DNA, 17 bp, Homo sapiens
tgggagggggaggaagt

SEQ ID NO: 6490541 - DNA, 15 bp, Homo sapiens
tgggagggggcaggg

SEQ ID NO: 6490542 - DNA, 13 bp, Homo sapiens
tgggagggggccc

SEQ ID NO: 6490543 - DNA, 16 bp, Homo sapiens
tgggagggggcccttc

SEQ ID NO: 6490544 - DNA, 15 bp, Homo sapiens
tgggagggggctcca

SEQ ID NO: 6490545 - DNA, 18 bp, Homo sapiens
tgggagggggctccatgg

SEQ ID NO: 6490546 - DNA, 20 bp, Homo sapiens
tgggagggggctccatggag

SEQ ID NO: 6490547 - DNA, 17 bp, Homo sapiens
tgggagggttcccctgg

SEQ ID NO: 6490548 - DNA, 18 bp, Homo sapiens
tgggagggttggcacctg

SEQ ID NO: 6490549 - DNA, 21 bp, Homo sapiens
tgggaggtaggctgtggggtg

SEQ ID NO: 6490550 - DNA, 20 bp, Homo sapiens
tgggaggtatgggctggggg

SEQ ID NO: 6490551 - DNA, 18 bp, Homo sapiens
tgggaggtcaaggctgca

SEQ ID NO: 6490552 - DNA, 20 bp, Homo sapiens
tgggaggtcaaggctgcagt

SEQ ID NO: 6490553 - DNA, 17 bp, Homo sapiens
tgggaggtcccagggcc

SEQ ID NO: 6490554 - DNA, 19 bp, Homo sapiens
tgggaggtcccagggccct

SEQ ID NO: 6490555 - DNA, 13 bp, Homo sapiens
tgggaggtcgagg

SEQ ID NO: 6490556 - DNA, 19 bp, Homo sapiens
tgggaggtgagaccacctc

SEQ ID NO: 6490557 - DNA, 21 bp, Homo sapiens
tgggaggtgcgtgttcagcag

SEQ ID NO: 6490558 - DNA, 19 bp, Homo sapiens
tgggaggtggaagaaggga

SEQ ID NO: 6490559 - DNA, 20 bp, Homo sapiens
tgggaggtggaagcagaggc

SEQ ID NO: 6490560 - DNA, 22 bp, Homo sapiens
tgggaggtggaagcagaggccc

SEQ ID NO: 6490561 - DNA, 19 bp, Homo sapiens
tgggaggtggaggttgcat

SEQ ID NO: 6490562 - DNA, 14 bp, Homo sapiens
tgggaggtggccag

SEQ ID NO: 6490563 - DNA, 21 bp, Homo sapiens
tgggaggtggccaggcctgcc

SEQ ID NO: 6490564 - DNA, 17 bp, Homo sapiens
tgggaggttgaagcaga

SEQ ID NO: 6490565 - DNA, 17 bp, Homo sapiens
tgggaggttgggaggct

SEQ ID NO: 6490566 - DNA, 16 bp, Homo sapiens
tgggagtaacagggca

SEQ ID NO: 6490567 - DNA, 14 bp, Homo sapiens
tgggagtacaaaag

SEQ ID NO: 6490568 - DNA, 20 bp, Homo sapiens
tgggagtactctcatcacta

SEQ ID NO: 6490569 - DNA, 15 bp, Homo sapiens
tgggagtaggctcca

SEQ ID NO: 6490570 - DNA, 16 bp, Homo sapiens
tgggagtaggctccag

SEQ ID NO: 6490571 - DNA, 17 bp, Homo sapiens
tgggagtaggctccaga

SEQ ID NO: 6490572 - DNA, 20 bp, Homo sapiens
tgggagtaggctccagacag

SEQ ID NO: 6490573 - DNA, 22 bp, Homo sapiens
tgggagtaggctccagacagga

SEQ ID NO: 6490574 - DNA, 17 bp, Homo sapiens
tgggagtatacggaaac

SEQ ID NO: 6490575 - DNA, 15 bp, Homo sapiens
tgggagtcaagtgtg

SEQ ID NO: 6490576 - DNA, 15 bp, Homo sapiens
tgggagtcacacagt

SEQ ID NO: 6490577 - DNA, 16 bp, Homo sapiens
tgggagtcagagccct

SEQ ID NO: 6490578 - DNA, 18 bp, Homo sapiens
tgggagtcagagccctgg

SEQ ID NO: 6490579 - DNA, 20 bp, Homo sapiens
tgggagtcaggacctccggg

SEQ ID NO: 6490580 - DNA, 23 bp, Homo sapiens
tgggagtcaggcctgggcaggac

SEQ ID NO: 6490581 - DNA, 19 bp, Homo sapiens
tgggagtccactttcctct

SEQ ID NO: 6490582 - DNA, 23 bp, Homo sapiens
tgggagtccactttcctctctct

SEQ ID NO: 6490583 - DNA, 13 bp, Homo sapiens
tgggagtcccctt

SEQ ID NO: 6490584 - DNA, 17 bp, Homo sapiens
tgggagtccttacctcg

SEQ ID NO: 6490585 - DNA, 14 bp, Homo sapiens
tgggagtctgaaat

SEQ ID NO: 6490586 - DNA, 17 bp, Homo sapiens
tgggagtcttaataaaa

SEQ ID NO: 6490587 - DNA, 15 bp, Homo sapiens
tgggagtcttgggtg

SEQ ID NO: 6490588 - DNA, 19 bp, Homo sapiens
tgggagtcttgggtggcgc

SEQ ID NO: 6490589 - DNA, 11 bp, Homo sapiens
tgggagtgagg

SEQ ID NO: 6490590 - DNA, 12 bp, Homo sapiens
tgggagtgaggg

SEQ ID NO: 6490591 - DNA, 23 bp, Homo sapiens
tgggagtgaggggttacctccct

SEQ ID NO: 6490592 - DNA, 15 bp, Homo sapiens
tgggagtggcccctg

SEQ ID NO: 6490593 - DNA, 14 bp, Homo sapiens
tgggagtgggagag

SEQ ID NO: 6490594 - DNA, 14 bp, Homo sapiens
tgactgcagccccc

SEQ ID NO: 6490595 - DNA, 16 bp, Homo sapiens
tgactgcagttgaaca

SEQ ID NO: 6490596 - DNA, 19 bp, Homo sapiens
tgactgcattgccgctgta

SEQ ID NO: 6490597 - DNA, 15 bp, Homo sapiens
tgactgccaagccag

SEQ ID NO: 6490598 - DNA, 22 bp, Homo sapiens
tgactgccaggaccccaggtca

SEQ ID NO: 6490599 - DNA, 19 bp, Homo sapiens
tgactgccaggataaagct

SEQ ID NO: 6490600 - DNA, 20 bp, Homo sapiens
tgactgccccaactcctgga

SEQ ID NO: 6490601 - DNA, 21 bp, Homo sapiens
tgactgcccggcacagatgct

SEQ ID NO: 6490602 - DNA, 22 bp, Homo sapiens
tgactgcccggcacagatgctc

SEQ ID NO: 6490603 - DNA, 21 bp, Homo sapiens
tgactgccctcttactgtttt

SEQ ID NO: 6490604 - DNA, 16 bp, Homo sapiens
tgactgccttgcctcc

SEQ ID NO: 6490605 - DNA, 17 bp, Homo sapiens
tgactgcgatcttcaga

SEQ ID NO: 6490606 - DNA, 20 bp, Homo sapiens
tgactgctcagaacttgctg

SEQ ID NO: 6490607 - DNA, 22 bp, Homo sapiens
tgactgctcagaacttgctgct

SEQ ID NO: 6490608 - DNA, 13 bp, Homo sapiens
tgactgctcaggc

SEQ ID NO: 6490609 - DNA, 16 bp, Homo sapiens
tgactgctcaggcctc

SEQ ID NO: 6490610 - DNA, 17 bp, Homo sapiens
tgactgctcaggcctca

SEQ ID NO: 6490611 - DNA, 20 bp, Homo sapiens
tgactgctccccagccctgg

SEQ ID NO: 6490612 - DNA, 23 bp, Homo sapiens
tgactgctccccagccctggctc

SEQ ID NO: 6490613 - DNA, 11 bp, Homo sapiens
tgactgctgct

SEQ ID NO: 6490614 - DNA, 20 bp, Homo sapiens
tgactgctgctccccacccc

SEQ ID NO: 6490615 - DNA, 13 bp, Homo sapiens
tgactgcttataa

SEQ ID NO: 6490616 - DNA, 21 bp, Homo sapiens
tgactgcttcacggactcttt

SEQ ID NO: 6490617 - DNA, 21 bp, Homo sapiens
tgactgcttttaaatgaccaa

SEQ ID NO: 6490618 - DNA, 14 bp, Homo sapiens
tgactggaggaggc

SEQ ID NO: 6490619 - DNA, 13 bp, Homo sapiens
tgactggaggcct

SEQ ID NO: 6490620 - DNA, 23 bp, Homo sapiens
tgactggcaaaggaccagcgtcc

SEQ ID NO: 6490621 - DNA, 19 bp, Homo sapiens
tgactggcaccaacacttt

SEQ ID NO: 6490622 - DNA, 12 bp, Homo sapiens
tgactggcaggt

SEQ ID NO: 6490623 - DNA, 24 bp, Homo sapiens
tgactggcaggtgcagatgggctg

SEQ ID NO: 6490624 - DNA, 14 bp, Homo sapiens
tgactggcatttta

SEQ ID NO: 6490625 - DNA, 18 bp, Homo sapiens
tgactggcattttataga

SEQ ID NO: 6490626 - DNA, 19 bp, Homo sapiens
tgactggcccacacgtgca

SEQ ID NO: 6490627 - DNA, 12 bp, Homo sapiens
tgactggctcct

SEQ ID NO: 6490628 - DNA, 22 bp, Homo sapiens
tgactggctcctgacttaacgt

SEQ ID NO: 6490629 - DNA, 14 bp, Homo sapiens
tgactggctgtctg

SEQ ID NO: 6490630 - DNA, 12 bp, Homo sapiens
tgactggcttgc

SEQ ID NO: 6490631 - DNA, 21 bp, Homo sapiens
tgactggcttgctcccgcccc

SEQ ID NO: 6490632 - DNA, 17 bp, Homo sapiens
tgactgggcaacactgc

SEQ ID NO: 6490633 - DNA, 18 bp, Homo sapiens
tgactgggcaacactgca

SEQ ID NO: 6490634 - DNA, 14 bp, Homo sapiens
tgactgggcctccc

SEQ ID NO: 6490635 - DNA, 13 bp, Homo sapiens
tgactgggctggg

SEQ ID NO: 6490636 - DNA, 14 bp, Homo sapiens
tgactgggggcaga

SEQ ID NO: 6490637 - DNA, 20 bp, Homo sapiens
tgactgggggcctctgcctc

SEQ ID NO: 6490638 - DNA, 23 bp, Homo sapiens
tgactgggtagaggtatgtttgt

SEQ ID NO: 6490639 - DNA, 23 bp, Homo sapiens
tgactgggtttctctgtatagta

SEQ ID NO: 6490640 - DNA, 17 bp, Homo sapiens
tgactggtcccccatgg

SEQ ID NO: 6490641 - DNA, 16 bp, Homo sapiens
tgactggttcagaaat

SEQ ID NO: 6490642 - DNA, 21 bp, Homo sapiens
tgactggtttacaggccctgc

SEQ ID NO: 6490643 - DNA, 21 bp, Homo sapiens
tgactgtaaacatagatagtg

SEQ ID NO: 6490644 - DNA, 16 bp, Homo sapiens
tgactgtaagtagaca

SEQ ID NO: 6490645 - DNA, 14 bp, Homo sapiens
tgactgtaatattt

SEQ ID NO: 6490646 - DNA, 16 bp, Homo sapiens
tgactgtactcctccc

SEQ ID NO: 6490647 - DNA, 15 bp, Homo sapiens
tgactgtagccacag

SEQ ID NO: 6490648 - DNA, 12 bp, Homo sapiens
tgactgtatcta

SEQ ID NO: 6490649 - DNA, 21 bp, Homo sapiens
tgactgtatctaggcatttca

SEQ ID NO: 6490650 - DNA, 18 bp, Homo sapiens
tgactgtatctgtgtaga

SEQ ID NO: 6490651 - DNA, 16 bp, Homo sapiens
tgactgtatggcactc

SEQ ID NO: 6490652 - DNA, 12 bp, Homo sapiens
tgactgtatttt

SEQ ID NO: 6490653 - DNA, 19 bp, Homo sapiens
tgactgtcacttgctgctt

SEQ ID NO: 6490654 - DNA, 15 bp, Homo sapiens
tgactgtcagggagg

SEQ ID NO: 6490655 - DNA, 22 bp, Homo sapiens
tgactgtcagggagggccaggg

SEQ ID NO: 6490656 - DNA, 18 bp, Homo sapiens
tgactgtcgtgtttacaa

SEQ ID NO: 6490657 - DNA, 21 bp, Homo sapiens
tgactgtcgtgtttacaaaag

SEQ ID NO: 6490658 - DNA, 22 bp, Homo sapiens
tgactgtcgtgtttacaaaagg

SEQ ID NO: 6490659 - DNA, 18 bp, Homo sapiens
tgactgtgaactgggcat

SEQ ID NO: 6490660 - DNA, 14 bp, Homo sapiens
tgactgtgatttat

SEQ ID NO: 6490661 - DNA, 18 bp, Homo sapiens
tgactgtgtgttgtgaaa

SEQ ID NO: 6490662 - DNA, 20 bp, Homo sapiens
tgactgtgtgttgtgaaata

SEQ ID NO: 6490663 - DNA, 15 bp, Homo sapiens
tgactgtgttcagtg

SEQ ID NO: 6490664 - DNA, 18 bp, Homo sapiens
tgactgttcaagagcaca

SEQ ID NO: 6490665 - DNA, 22 bp, Homo sapiens
tgactgttgagggcctggggaa

SEQ ID NO: 6490666 - DNA, 16 bp, Homo sapiens
tgactgttgcatagaa

SEQ ID NO: 6490667 - DNA, 13 bp, Homo sapiens
tgactgttgcccc

SEQ ID NO: 6490668 - DNA, 22 bp, Homo sapiens
tgactgttgtagcattttcctg

SEQ ID NO: 6490669 - DNA, 23 bp, Homo sapiens
tgactgttgtagcattttcctgt

SEQ ID NO: 6490670 - DNA, 13 bp, Homo sapiens
tgactgtttattt

SEQ ID NO: 6490671 - DNA, 17 bp, Homo sapiens
tgactgtttatttaagg

SEQ ID NO: 6490672 - DNA, 21 bp, Homo sapiens
tgactgtttatttaaggatgg

SEQ ID NO: 6490673 - DNA, 21 bp, Homo sapiens
tgactgtttcattcactgtgc

SEQ ID NO: 6490674 - DNA, 18 bp, Homo sapiens
tgactgtttcttttgtaa

SEQ ID NO: 6490675 - DNA, 22 bp, Homo sapiens
tgactgtttggcttataaacac

SEQ ID NO: 6490676 - DNA, 21 bp, Homo sapiens
tgactgttttctcttgagagg

SEQ ID NO: 6490677 - DNA, 15 bp, Homo sapiens
tgactgtttttaccc

SEQ ID NO: 6490678 - DNA, 18 bp, Homo sapiens
tgactgtttttacccata

SEQ ID NO: 6490679 - DNA, 20 bp, Homo sapiens
tgactgtttttcggacagtt

SEQ ID NO: 6490680 - DNA, 18 bp, Homo sapiens
tgacttaaaaaatcagaa

SEQ ID NO: 6490681 - DNA, 19 bp, Homo sapiens
tgacttaacatagccaaaa

SEQ ID NO: 6490682 - DNA, 22 bp, Homo sapiens
tgacttaacatagccaaaatgt

SEQ ID NO: 6490683 - DNA, 21 bp, Homo sapiens
tgacttaactttaacttttga

SEQ ID NO: 6490684 - DNA, 13 bp, Homo sapiens
tgacttaatgtga

SEQ ID NO: 6490685 - DNA, 19 bp, Homo sapiens
tgacttacaatttgcacaa

SEQ ID NO: 6490686 - DNA, 17 bp, Homo sapiens
tgacttacctgttcagt

SEQ ID NO: 6490687 - DNA, 13 bp, Homo sapiens
tgacttactgtac

SEQ ID NO: 6490688 - DNA, 19 bp, Homo sapiens
tgacttactgtttcttacc

SEQ ID NO: 6490689 - DNA, 13 bp, Homo sapiens
tgacttagaaact

SEQ ID NO: 6490690 - DNA, 14 bp, Homo sapiens
tgacttagaaactg

SEQ ID NO: 6490691 - DNA, 23 bp, Homo sapiens
tgacttagatattaaaatttggt

SEQ ID NO: 6490692 - DNA, 14 bp, Homo sapiens
tgacttagcctcct

SEQ ID NO: 6490693 - DNA, 20 bp, Homo sapiens
tgacttagcgtcaagacatt

SEQ ID NO: 6490694 - DNA, 23 bp, Homo sapiens
tgacttagcgtcaagacatttgc

SEQ ID NO: 6490695 - DNA, 20 bp, Homo sapiens
tgacttaggtaaaataaaag

SEQ ID NO: 6490696 - DNA, 18 bp, Homo sapiens
tgacttattatgcataaa

SEQ ID NO: 6490697 - DNA, 22 bp, Homo sapiens
tgacttattccctgagactttt

SEQ ID NO: 6490698 - DNA, 19 bp, Homo sapiens
tgacttattgattaagtat

SEQ ID NO: 6490699 - DNA, 20 bp, Homo sapiens
tgacttatttatataaattt

SEQ ID NO: 6490700 - DNA, 13 bp, Homo sapiens
tgacttatttctg

SEQ ID NO: 6490701 - DNA, 13 bp, Homo sapiens
tgacttatttgct

SEQ ID NO: 6490702 - DNA, 22 bp, Homo sapiens
tgacttattttgtcttattctt

SEQ ID NO: 6490703 - DNA, 13 bp, Homo sapiens
tgacttcacagca

SEQ ID NO: 6490704 - DNA, 13 bp, Homo sapiens
tgacttcactgta

SEQ ID NO: 6490705 - DNA, 22 bp, Homo sapiens
tgacttcagaaactttttctaa

SEQ ID NO: 6490706 - DNA, 17 bp, Homo sapiens
tgacttcagactctctc

SEQ ID NO: 6490707 - DNA, 19 bp, Homo sapiens
tgacttcagactctctcct

SEQ ID NO: 6490708 - DNA, 22 bp, Homo sapiens
tgacttcagactctctcctctc

SEQ ID NO: 6490709 - DNA, 23 bp, Homo sapiens
tgacttcagcaggggtgggaggc

SEQ ID NO: 6490710 - DNA, 16 bp, Homo sapiens
tgacttcagctgcctg

SEQ ID NO: 6490711 - DNA, 17 bp, Homo sapiens
tgacttcagctgcctga

SEQ ID NO: 6490712 - DNA, 23 bp, Homo sapiens
tgacttcagggaaggtgaaacag

SEQ ID NO: 6490713 - DNA, 17 bp, Homo sapiens
tgacttcaggggctgcc

SEQ ID NO: 6490714 - DNA, 21 bp, Homo sapiens
tgacttcaggtggagagcact

SEQ ID NO: 6490715 - DNA, 20 bp, Homo sapiens
tgacttcagtgaatattttt

SEQ ID NO: 6490716 - DNA, 22 bp, Homo sapiens
tgacttcattaataataaattc

SEQ ID NO: 6490717 - DNA, 13 bp, Homo sapiens
tgacttcatttct

SEQ ID NO: 6490718 - DNA, 16 bp, Homo sapiens
tgacttcatttgtgcc

SEQ ID NO: 6490719 - DNA, 14 bp, Homo sapiens
tgacttccacacct

SEQ ID NO: 6490720 - DNA, 14 bp, Homo sapiens
tgacttcccagctg

SEQ ID NO: 6490721 - DNA, 17 bp, Homo sapiens
tgacttcccagctggca

SEQ ID NO: 6490722 - DNA, 18 bp, Homo sapiens
tgacttcccagctggcag

SEQ ID NO: 6490723 - DNA, 20 bp, Homo sapiens
tgacttccccaatatcttgc

SEQ ID NO: 6490724 - DNA, 21 bp, Homo sapiens
tgacttccccaatatcttgct

SEQ ID NO: 6490725 - DNA, 16 bp, Homo sapiens
tgacttcctctggtgt

SEQ ID NO: 6490726 - DNA, 18 bp, Homo sapiens
tgacttcctctggtgttt

SEQ ID NO: 6490727 - DNA, 22 bp, Homo sapiens
tgacttctaagtaaaaccacag

SEQ ID NO: 6490728 - DNA, 23 bp, Homo sapiens
tgacttctaagtaaaaccacagc

SEQ ID NO: 6490729 - DNA, 24 bp, Homo sapiens
tgacttctaagtaaaaccacagca

SEQ ID NO: 6490730 - DNA, 14 bp, Homo sapiens
tgacttctccaggt

SEQ ID NO: 6490731 - DNA, 11 bp, Homo sapiens
tgacttctccc

SEQ ID NO: 6490732 - DNA, 17 bp, Homo sapiens
tgacttctctgaatcag

SEQ ID NO: 6490733 - DNA, 18 bp, Homo sapiens
tgacttctcttgaattat

SEQ ID NO: 6490734 - DNA, 13 bp, Homo sapiens
tgacttctgcctg

SEQ ID NO: 6490735 - DNA, 15 bp, Homo sapiens
tgacttctgcctgga

SEQ ID NO: 6490736 - DNA, 13 bp, Homo sapiens
tgacttctgctga

SEQ ID NO: 6490737 - DNA, 18 bp, Homo sapiens
tgacttctggcttatgct

SEQ ID NO: 6490738 - DNA, 13 bp, Homo sapiens
tgacttctgtggt

SEQ ID NO: 6490739 - DNA, 20 bp, Homo sapiens
tgacttctgtggtccctctg

SEQ ID NO: 6490740 - DNA, 13 bp, Homo sapiens
tgacttgaaaaga

SEQ ID NO: 6490741 - DNA, 18 bp, Homo sapiens
tgacttgaaaagaaagaa

SEQ ID NO: 6490742 - DNA, 13 bp, Homo sapiens
tgacttgaataaa

SEQ ID NO: 6490743 - DNA, 14 bp, Homo sapiens
tgacttgaataaag

SEQ ID NO: 6490744 - DNA, 17 bp, Homo sapiens
tgacttgaataaagtac

SEQ ID NO: 6490745 - DNA, 16 bp, Homo sapiens
tgacttgaatgtacaa

SEQ ID NO: 6490746 - DNA, 17 bp, Homo sapiens
tgacttgaatgtacaaa

SEQ ID NO: 6490747 - DNA, 20 bp, Homo sapiens
tgacttgaatgtacaaagat

SEQ ID NO: 6490748 - DNA, 19 bp, Homo sapiens
tgacttgacagaacactgt

SEQ ID NO: 6490749 - DNA, 16 bp, Homo sapiens
tgacttgagccctgcc

SEQ ID NO: 6490750 - DNA, 12 bp, Homo sapiens
tgacttgagtgt

SEQ ID NO: 6490751 - DNA, 23 bp, Homo sapiens
tgacttgcacagggattctcaca

SEQ ID NO: 6490752 - DNA, 20 bp, Homo sapiens
tgacttgcacatctctgcag

SEQ ID NO: 6490753 - DNA, 17 bp, Homo sapiens
tgacttgcatgaagaga

SEQ ID NO: 6490754 - DNA, 15 bp, Homo sapiens
tgacttgccactgcc

SEQ ID NO: 6490755 - DNA, 22 bp, Homo sapiens
tgacttgccatgaaggcacctg

SEQ ID NO: 6490756 - DNA, 24 bp, Homo sapiens
tgacttgccatgaaggcacctgcc

SEQ ID NO: 6490757 - DNA, 13 bp, Homo sapiens
tgacttgcccagt

SEQ ID NO: 6490758 - DNA, 22 bp, Homo sapiens
tgacttgctgtgtgaccctggg

SEQ ID NO: 6490759 - DNA, 23 bp, Homo sapiens
tgacttggatcccaaagcaagga

SEQ ID NO: 6490760 - DNA, 13 bp, Homo sapiens
tgacttggcactt

SEQ ID NO: 6490761 - DNA, 20 bp, Homo sapiens
tgacttggcacttaagtgca

SEQ ID NO: 6490762 - DNA, 13 bp, Homo sapiens
tgacttggctggt

SEQ ID NO: 6490763 - DNA, 16 bp, Homo sapiens
tgacttggctggtgtg

SEQ ID NO: 6490764 - DNA, 21 bp, Homo sapiens
tgacttggctggtgtggtaca

SEQ ID NO: 6490765 - DNA, 17 bp, Homo sapiens
tgacttgggcaccccca

SEQ ID NO: 6490766 - DNA, 22 bp, Homo sapiens
tgacttgggcacccccagcctg

SEQ ID NO: 6490767 - DNA, 23 bp, Homo sapiens
tgacttggtggcttttccttgaa

SEQ ID NO: 6490768 - DNA, 23 bp, Homo sapiens
tgacttgtacaaacagtatttct

SEQ ID NO: 6490769 - DNA, 20 bp, Homo sapiens
tgacttgtataacatcactg

SEQ ID NO: 6490770 - DNA, 14 bp, Homo sapiens
tgacttgtctgcct

SEQ ID NO: 6490771 - DNA, 19 bp, Homo sapiens
tgggagtgggcacctcaga

SEQ ID NO: 6490772 - DNA, 16 bp, Homo sapiens
tgggagtgggcccaat

SEQ ID NO: 6490773 - DNA, 13 bp, Homo sapiens
tgggagtggggag

SEQ ID NO: 6490774 - DNA, 14 bp, Homo sapiens
tgggagtggggagc

SEQ ID NO: 6490775 - DNA, 24 bp, Homo sapiens
tgggagtggggcctttgccagcag

SEQ ID NO: 6490776 - DNA, 13 bp, Homo sapiens
tgggagtgtgggc

SEQ ID NO: 6490777 - DNA, 14 bp, Homo sapiens
tgggagtgtgtctg

SEQ ID NO: 6490778 - DNA, 15 bp, Homo sapiens
tgggagtgtgtctgc

SEQ ID NO: 6490779 - DNA, 17 bp, Homo sapiens
tgggagtgtgtctgctg

SEQ ID NO: 6490780 - DNA, 15 bp, Homo sapiens
tgggagtgttctgtg

SEQ ID NO: 6490781 - DNA, 19 bp, Homo sapiens
tgggagttaaggaggaaat

SEQ ID NO: 6490782 - DNA, 19 bp, Homo sapiens
tgggagttcctagcaagtt

SEQ ID NO: 6490783 - DNA, 14 bp, Homo sapiens
tgggagttgtagtt

SEQ ID NO: 6490784 - DNA, 20 bp, Homo sapiens
tgggagtttttatgagaaac

SEQ ID NO: 6490785 - DNA, 21 bp, Homo sapiens
tgggataaacatcacatgaga

SEQ ID NO: 6490786 - DNA, 23 bp, Homo sapiens
tgggataaagatgcaaggaccag

SEQ ID NO: 6490787 - DNA, 16 bp, Homo sapiens
tgggataaagcaaggg

SEQ ID NO: 6490788 - DNA, 17 bp, Homo sapiens
tgggataaagcaagggg

SEQ ID NO: 6490789 - DNA, 20 bp, Homo sapiens
tgggataaaggcccagactc

SEQ ID NO: 6490790 - DNA, 14 bp, Homo sapiens
tgggataaatgcca

SEQ ID NO: 6490791 - DNA, 17 bp, Homo sapiens
tgggataactgatttct

SEQ ID NO: 6490792 - DNA, 18 bp, Homo sapiens
tgggataactgatttcta

SEQ ID NO: 6490793 - DNA, 15 bp, Homo sapiens
tgggatacaacctcc

SEQ ID NO: 6490794 - DNA, 18 bp, Homo sapiens
tgggatacacacggctcc

SEQ ID NO: 6490795 - DNA, 23 bp, Homo sapiens
tgggatactgcttattttatgat

SEQ ID NO: 6490796 - DNA, 17 bp, Homo sapiens
tgggatagagaatgttc

SEQ ID NO: 6490797 - DNA, 16 bp, Homo sapiens
tgggatagaggaatca

SEQ ID NO: 6490798 - DNA, 16 bp, Homo sapiens
tgggataggagggtgc

SEQ ID NO: 6490799 - DNA, 16 bp, Homo sapiens
tgggataggggcagag

SEQ ID NO: 6490800 - DNA, 18 bp, Homo sapiens
tgggatagtgttctgctc

SEQ ID NO: 6490801 - DNA, 19 bp, Homo sapiens
tgggatagtgttctgctcc

SEQ ID NO: 6490802 - DNA, 21 bp, Homo sapiens
tgggatagtttgggggaactt

SEQ ID NO: 6490803 - DNA, 22 bp, Homo sapiens
tgggatataatacctttctaag

SEQ ID NO: 6490804 - DNA, 12 bp, Homo sapiens
tgggatatcatt

SEQ ID NO: 6490805 - DNA, 15 bp, Homo sapiens
tgggatatcatttta

SEQ ID NO: 6490806 - DNA, 16 bp, Homo sapiens
tgggatatcattttaa

SEQ ID NO: 6490807 - DNA, 15 bp, Homo sapiens
tgggatatgacaagc

SEQ ID NO: 6490808 - DNA, 15 bp, Homo sapiens
tgggatatggctgcc

SEQ ID NO: 6490809 - DNA, 24 bp, Homo sapiens
tgggatattctttagcttacctgg

SEQ ID NO: 6490810 - DNA, 22 bp, Homo sapiens
tgggatcaaagctaggaaaggc

SEQ ID NO: 6490811 - DNA, 16 bp, Homo sapiens
tgggatcagagcagga

SEQ ID NO: 6490812 - DNA, 13 bp, Homo sapiens
tgggatcagcctc

SEQ ID NO: 6490813 - DNA, 13 bp, Homo sapiens
tgggatcaggagc

SEQ ID NO: 6490814 - DNA, 15 bp, Homo sapiens
tgggatcagtggggc

SEQ ID NO: 6490815 - DNA, 15 bp, Homo sapiens
tgggatcatccagag

SEQ ID NO: 6490816 - DNA, 20 bp, Homo sapiens
tgggatcatgatagacttgt

SEQ ID NO: 6490817 - DNA, 19 bp, Homo sapiens
tgggatcattatttcatga

SEQ ID NO: 6490818 - DNA, 15 bp, Homo sapiens
tgggatcattgcatt

SEQ ID NO: 6490819 - DNA, 16 bp, Homo sapiens
tgggatcatttttcca

SEQ ID NO: 6490820 - DNA, 22 bp, Homo sapiens
tgggatcatttttccaggactc

SEQ ID NO: 6490821 - DNA, 19 bp, Homo sapiens
tgggatccacttcttggtt

SEQ ID NO: 6490822 - DNA, 23 bp, Homo sapiens
tgggatccacttcttggttcctg

SEQ ID NO: 6490823 - DNA, 17 bp, Homo sapiens
tgggatccagagagaag

SEQ ID NO: 6490824 - DNA, 19 bp, Homo sapiens
tgggatccagagagaagca

SEQ ID NO: 6490825 - DNA, 20 bp, Homo sapiens
tgggatccaggcccctccct

SEQ ID NO: 6490826 - DNA, 12 bp, Homo sapiens
tgggatccagtg

SEQ ID NO: 6490827 - DNA, 20 bp, Homo sapiens
tgggatccctctgggcactg

SEQ ID NO: 6490828 - DNA, 23 bp, Homo sapiens
tgggatccctgtctttcctaaga

SEQ ID NO: 6490829 - DNA, 22 bp, Homo sapiens
tgggatccgagggcccctctcc

SEQ ID NO: 6490830 - DNA, 23 bp, Homo sapiens
tgggatccgcatccagccgtgct

SEQ ID NO: 6490831 - DNA, 12 bp, Homo sapiens
tgggatcctcca

SEQ ID NO: 6490832 - DNA, 13 bp, Homo sapiens
tgggatcctccct

SEQ ID NO: 6490833 - DNA, 19 bp, Homo sapiens
tgggatcctccctcatggc

SEQ ID NO: 6490834 - DNA, 21 bp, Homo sapiens
tgggatcctgactaagccttt

SEQ ID NO: 6490835 - DNA, 21 bp, Homo sapiens
tgggatccttgggcccatcac

SEQ ID NO: 6490836 - DNA, 22 bp, Homo sapiens
tgggatcgtgcatttgaggggc

SEQ ID NO: 6490837 - DNA, 13 bp, Homo sapiens
tgggatctgactg

SEQ ID NO: 6490838 - DNA, 16 bp, Homo sapiens
tgggatctgactgcac

SEQ ID NO: 6490839 - DNA, 15 bp, Homo sapiens
tgggatctgagctcc

SEQ ID NO: 6490840 - DNA, 15 bp, Homo sapiens
tgggatctgaggagt

SEQ ID NO: 6490841 - DNA, 13 bp, Homo sapiens
tgggatctgcccc

SEQ ID NO: 6490842 - DNA, 13 bp, Homo sapiens
tgggatctgggga

SEQ ID NO: 6490843 - DNA, 15 bp, Homo sapiens
tgggatctggggaga

SEQ ID NO: 6490844 - DNA, 15 bp, Homo sapiens
tgggatctgtaagga

SEQ ID NO: 6490845 - DNA, 22 bp, Homo sapiens
tgggatctgtaaggaactggaa

SEQ ID NO: 6490846 - DNA, 19 bp, Homo sapiens
tgggatctgttttctggaa

SEQ ID NO: 6490847 - DNA, 19 bp, Homo sapiens
tgggatcttgaagaagctc

SEQ ID NO: 6490848 - DNA, 20 bp, Homo sapiens
tgggatctttctgggagctg

SEQ ID NO: 6490849 - DNA, 22 bp, Homo sapiens
tgggatctttctgggagctgcg

SEQ ID NO: 6490850 - DNA, 14 bp, Homo sapiens
tgggatgaatgcca

SEQ ID NO: 6490851 - DNA, 19 bp, Homo sapiens
tgggatgagagttttggat

SEQ ID NO: 6490852 - DNA, 14 bp, Homo sapiens
tgggatgagcctct

SEQ ID NO: 6490853 - DNA, 16 bp, Homo sapiens
tgggatgagcctctcc

SEQ ID NO: 6490854 - DNA, 16 bp, Homo sapiens
tgggatgcccttcccc

SEQ ID NO: 6490855 - DNA, 18 bp, Homo sapiens
tgggatgctagccccaga

SEQ ID NO: 6490856 - DNA, 21 bp, Homo sapiens
tgggatgctatttcagccaat

SEQ ID NO: 6490857 - DNA, 22 bp, Homo sapiens
tgggatgctatttcagccaatc

SEQ ID NO: 6490858 - DNA, 15 bp, Homo sapiens
tgggatgctgaccca

SEQ ID NO: 6490859 - DNA, 20 bp, Homo sapiens
tgggatgcttgcctagggcc

SEQ ID NO: 6490860 - DNA, 13 bp, Homo sapiens
tgggatggaacct

SEQ ID NO: 6490861 - DNA, 18 bp, Homo sapiens
tgggatggaacctcagga

SEQ ID NO: 6490862 - DNA, 18 bp, Homo sapiens
tgggatggaccctcgcag

SEQ ID NO: 6490863 - DNA, 21 bp, Homo sapiens
tgggatggacgctgccgggag

SEQ ID NO: 6490864 - DNA, 23 bp, Homo sapiens
tgggatggagagtggggagaggc

SEQ ID NO: 6490865 - DNA, 16 bp, Homo sapiens
tgggatggaggagaag

SEQ ID NO: 6490866 - DNA, 18 bp, Homo sapiens
tgggatggaggtatacaa

SEQ ID NO: 6490867 - DNA, 16 bp, Homo sapiens
tgggatggatgctggg

SEQ ID NO: 6490868 - DNA, 23 bp, Homo sapiens
tgggatggcatttggtctcaggc

SEQ ID NO: 6490869 - DNA, 23 bp, Homo sapiens
tgggatggctatattaggcatgt

SEQ ID NO: 6490870 - DNA, 18 bp, Homo sapiens
tgggatgggacagggagg

SEQ ID NO: 6490871 - DNA, 16 bp, Homo sapiens
tgggatgggcacaggc

SEQ ID NO: 6490872 - DNA, 14 bp, Homo sapiens
tgggatgggctcta

SEQ ID NO: 6490873 - DNA, 17 bp, Homo sapiens
tgggatgggctctacct

SEQ ID NO: 6490874 - DNA, 19 bp, Homo sapiens
tgggatggtcggatctcac

SEQ ID NO: 6490875 - DNA, 18 bp, Homo sapiens
tgggatggtgactcctga

SEQ ID NO: 6490876 - DNA, 17 bp, Homo sapiens
tgggatggtggagggcc

SEQ ID NO: 6490877 - DNA, 13 bp, Homo sapiens
tgggatgtagaac

SEQ ID NO: 6490878 - DNA, 14 bp, Homo sapiens
tgggatgtcacagt

SEQ ID NO: 6490879 - DNA, 22 bp, Homo sapiens
tgggatgtcacagtccaaccag

SEQ ID NO: 6490880 - DNA, 22 bp, Homo sapiens
tgggatgtcctctttactccct

SEQ ID NO: 6490881 - DNA, 16 bp, Homo sapiens
tgggatgtgagcccca

SEQ ID NO: 6490882 - DNA, 22 bp, Homo sapiens
tgggatgtgctgttttctgtaa

SEQ ID NO: 6490883 - DNA, 20 bp, Homo sapiens
tgggatgtggttttcttaag

SEQ ID NO: 6490884 - DNA, 22 bp, Homo sapiens
tgggattaagaaaccttgctct

SEQ ID NO: 6490885 - DNA, 23 bp, Homo sapiens
tgggattaagaaaccttgctctc

SEQ ID NO: 6490886 - DNA, 14 bp, Homo sapiens
tgggattaagtaca

SEQ ID NO: 6490887 - DNA, 21 bp, Homo sapiens
tgggattacagacatgagcca

SEQ ID NO: 6490888 - DNA, 18 bp, Homo sapiens
tgggattacaggcgcctg

SEQ ID NO: 6490889 - DNA, 18 bp, Homo sapiens
tgggattacaggctcctg

SEQ ID NO: 6490890 - DNA, 13 bp, Homo sapiens
tgggattagaaac

SEQ ID NO: 6490891 - DNA, 17 bp, Homo sapiens
tgggattatatatccct

SEQ ID NO: 6490892 - DNA, 21 bp, Homo sapiens
tgggattatgggtcacaggaa

SEQ ID NO: 6490893 - DNA, 13 bp, Homo sapiens
tgggattcaattt

SEQ ID NO: 6490894 - DNA, 14 bp, Homo sapiens
tgggattcagagaa

SEQ ID NO: 6490895 - DNA, 20 bp, Homo sapiens
tgggattcaggaaaaggcct

SEQ ID NO: 6490896 - DNA, 22 bp, Homo sapiens
tgggattcaggaaaaggcctgg

SEQ ID NO: 6490897 - DNA, 23 bp, Homo sapiens
tgggattcaggaaaaggcctggg

SEQ ID NO: 6490898 - DNA, 18 bp, Homo sapiens
tgggattcaggaatgggc

SEQ ID NO: 6490899 - DNA, 17 bp, Homo sapiens
tgggattcctgacccag

SEQ ID NO: 6490900 - DNA, 20 bp, Homo sapiens
tgggattcctgacccaggcc

SEQ ID NO: 6490901 - DNA, 21 bp, Homo sapiens
tgggattcctgacccaggccg

SEQ ID NO: 6490902 - DNA, 24 bp, Homo sapiens
tgggattcctgacccaggccgcag

SEQ ID NO: 6490903 - DNA, 21 bp, Homo sapiens
tgggattctggacaggatgtg

SEQ ID NO: 6490904 - DNA, 23 bp, Homo sapiens
tgggattgaaggggcttctaatg

SEQ ID NO: 6490905 - DNA, 13 bp, Homo sapiens
tgggattgggggg

SEQ ID NO: 6490906 - DNA, 15 bp, Homo sapiens
tgggattggtgggct

SEQ ID NO: 6490907 - DNA, 16 bp, Homo sapiens
tgggatttaatttcca

SEQ ID NO: 6490908 - DNA, 17 bp, Homo sapiens
tgggatttaatttccag

SEQ ID NO: 6490909 - DNA, 18 bp, Homo sapiens
tgggatttatatctatag

SEQ ID NO: 6490910 - DNA, 17 bp, Homo sapiens
tgggatttctatgcagt

SEQ ID NO: 6490911 - DNA, 19 bp, Homo sapiens
tgggatttcttcgctgctc

SEQ ID NO: 6490912 - DNA, 19 bp, Homo sapiens
tgggatttgaactgagccg

SEQ ID NO: 6490913 - DNA, 15 bp, Homo sapiens
tgggatttgctcctg

SEQ ID NO: 6490914 - DNA, 21 bp, Homo sapiens
tgggatttggggcctcaagaa

SEQ ID NO: 6490915 - DNA, 19 bp, Homo sapiens
tgggattttatctgtggat

SEQ ID NO: 6490916 - DNA, 15 bp, Homo sapiens
tgggattttctagtt

SEQ ID NO: 6490917 - DNA, 20 bp, Homo sapiens
tgggattttctagtttcctg

SEQ ID NO: 6490918 - DNA, 16 bp, Homo sapiens
tgggcaaaaaactcga

SEQ ID NO: 6490919 - DNA, 15 bp, Homo sapiens
tgggcaaacagagct

SEQ ID NO: 6490920 - DNA, 19 bp, Homo sapiens
tgggcaaaccctggtgctt

SEQ ID NO: 6490921 - DNA, 21 bp, Homo sapiens
tgggcaaacccttctcttctc

SEQ ID NO: 6490922 - DNA, 22 bp, Homo sapiens
tgggcaaagccacaaggctggc

SEQ ID NO: 6490923 - DNA, 16 bp, Homo sapiens
tgggcaaagggaagta

SEQ ID NO: 6490924 - DNA, 15 bp, Homo sapiens
tgggcaacaaagtga

SEQ ID NO: 6490925 - DNA, 22 bp, Homo sapiens
tgggcaacacatgcagaataat

SEQ ID NO: 6490926 - DNA, 12 bp, Homo sapiens
tgggcaacagag

SEQ ID NO: 6490927 - DNA, 14 bp, Homo sapiens
tgggcaacagagca

SEQ ID NO: 6490928 - DNA, 15 bp, Homo sapiens
tgggcaacagagcaa

SEQ ID NO: 6490929 - DNA, 16 bp, Homo sapiens
tgggcaacagagcaag

SEQ ID NO: 6490930 - DNA, 20 bp, Homo sapiens
tgggcaacccccagcctgct

SEQ ID NO: 6490931 - DNA, 20 bp, Homo sapiens
tgggcaacgagtgaaactcc

SEQ ID NO: 6490932 - DNA, 18 bp, Homo sapiens
tgggcaactcgtgacagc

SEQ ID NO: 6490933 - DNA, 15 bp, Homo sapiens
tgggcaactggctga

SEQ ID NO: 6490934 - DNA, 19 bp, Homo sapiens
tgggcaagacctcttccct

SEQ ID NO: 6490935 - DNA, 14 bp, Homo sapiens
tgggcaagcaagga

SEQ ID NO: 6490936 - DNA, 15 bp, Homo sapiens
tgggcaaggggccag

SEQ ID NO: 6490937 - DNA, 19 bp, Homo sapiens
tgggcaagtcccttgacct

SEQ ID NO: 6490938 - DNA, 15 bp, Homo sapiens
tgggcaataaaagat

SEQ ID NO: 6490939 - DNA, 17 bp, Homo sapiens
tgggcaatataaccaat

SEQ ID NO: 6490940 - DNA, 22 bp, Homo sapiens
tgggcaatataaccaatgttta

SEQ ID NO: 6490941 - DNA, 15 bp, Homo sapiens
tgggcaatatagcaa

SEQ ID NO: 6490942 - DNA, 18 bp, Homo sapiens
tgggcaatattctctgta

SEQ ID NO: 6490943 - DNA, 17 bp, Homo sapiens
tgggcaatgaaaccaaa

SEQ ID NO: 6490944 - DNA, 18 bp, Homo sapiens
tgggcaattccagaaatc

SEQ ID NO: 6490945 - DNA, 13 bp, Homo sapiens
tgggcaatttaga

SEQ ID NO: 6490946 - DNA, 15 bp, Homo sapiens
tgggcaatttagaaa

SEQ ID NO: 6490947 - DNA, 20 bp, Homo sapiens
tgggcacaattcctgtgctc

SEQ ID NO: 6490948 - DNA, 15 bp, Homo sapiens
tgacttgtgtcccat

SEQ ID NO: 6490949 - DNA, 19 bp, Homo sapiens
tgacttgttcatttttctc

SEQ ID NO: 6490950 - DNA, 16 bp, Homo sapiens
tgacttgttctgagta

SEQ ID NO: 6490951 - DNA, 15 bp, Homo sapiens
tgacttgtttgtctt

SEQ ID NO: 6490952 - DNA, 13 bp, Homo sapiens
tgacttgtttgtg

SEQ ID NO: 6490953 - DNA, 23 bp, Homo sapiens
tgacttgtttgtgcatcctgtga

SEQ ID NO: 6490954 - DNA, 17 bp, Homo sapiens
tgactttaatttatgta

SEQ ID NO: 6490955 - DNA, 14 bp, Homo sapiens
tgactttagaaaca

SEQ ID NO: 6490956 - DNA, 15 bp, Homo sapiens
tgactttataaattt

SEQ ID NO: 6490957 - DNA, 18 bp, Homo sapiens
tgactttatatggatgat

SEQ ID NO: 6490958 - DNA, 18 bp, Homo sapiens
tgactttatgttgtatga

SEQ ID NO: 6490959 - DNA, 17 bp, Homo sapiens
tgactttatttttctaa

SEQ ID NO: 6490960 - DNA, 22 bp, Homo sapiens
tgactttcaaagtggatgcaat

SEQ ID NO: 6490961 - DNA, 20 bp, Homo sapiens
tgactttcagattgtatctg

SEQ ID NO: 6490962 - DNA, 15 bp, Homo sapiens
tgactttcaggaatt

SEQ ID NO: 6490963 - DNA, 16 bp, Homo sapiens
tgactttcaggctact

SEQ ID NO: 6490964 - DNA, 12 bp, Homo sapiens
tgactttcaggt

SEQ ID NO: 6490965 - DNA, 15 bp, Homo sapiens
tgactttcataataa

SEQ ID NO: 6490966 - DNA, 17 bp, Homo sapiens
tgactttcattggaaat

SEQ ID NO: 6490967 - DNA, 13 bp, Homo sapiens
tgactttccagaa

SEQ ID NO: 6490968 - DNA, 13 bp, Homo sapiens
tgactttccttag

SEQ ID NO: 6490969 - DNA, 13 bp, Homo sapiens
tgactttctcagc

SEQ ID NO: 6490970 - DNA, 20 bp, Homo sapiens
tgactttctccctgttcctt

SEQ ID NO: 6490971 - DNA, 14 bp, Homo sapiens
tgactttgaaaata

SEQ ID NO: 6490972 - DNA, 14 bp, Homo sapiens
tgactttgaattta

SEQ ID NO: 6490973 - DNA, 19 bp, Homo sapiens
tgactttgaatttatataa

SEQ ID NO: 6490974 - DNA, 22 bp, Homo sapiens
tgactttgaatttatataaagt

SEQ ID NO: 6490975 - DNA, 17 bp, Homo sapiens
tgactttgacaattact

SEQ ID NO: 6490976 - DNA, 18 bp, Homo sapiens
tgactttgacaattactc

SEQ ID NO: 6490977 - DNA, 14 bp, Homo sapiens
tgactttgcagatg

SEQ ID NO: 6490978 - DNA, 16 bp, Homo sapiens
tgactttgcttgcttt

SEQ ID NO: 6490979 - DNA, 20 bp, Homo sapiens
tgactttggagacgatgctt

SEQ ID NO: 6490980 - DNA, 16 bp, Homo sapiens
tgactttggctgcatg

SEQ ID NO: 6490981 - DNA, 13 bp, Homo sapiens
tgactttggggac

SEQ ID NO: 6490982 - DNA, 21 bp, Homo sapiens
tgactttggggacaccctcct

SEQ ID NO: 6490983 - DNA, 23 bp, Homo sapiens
tgactttggggacaccctcctgc

SEQ ID NO: 6490984 - DNA, 19 bp, Homo sapiens
tgactttggggattctccc

SEQ ID NO: 6490985 - DNA, 14 bp, Homo sapiens
tgactttggttttt

SEQ ID NO: 6490986 - DNA, 17 bp, Homo sapiens
tgactttgtctctcctg

SEQ ID NO: 6490987 - DNA, 23 bp, Homo sapiens
tgactttgtctctcctggctggg

SEQ ID NO: 6490988 - DNA, 16 bp, Homo sapiens
tgacttttaaaatttg

SEQ ID NO: 6490989 - DNA, 15 bp, Homo sapiens
tgacttttaaagatt

SEQ ID NO: 6490990 - DNA, 16 bp, Homo sapiens
tgacttttaaagattt

SEQ ID NO: 6490991 - DNA, 21 bp, Homo sapiens
tgacttttagacagtggtaaa

SEQ ID NO: 6490992 - DNA, 18 bp, Homo sapiens
tgacttttataaagcatg

SEQ ID NO: 6490993 - DNA, 19 bp, Homo sapiens
tgacttttattgagctctt

SEQ ID NO: 6490994 - DNA, 20 bp, Homo sapiens
tgacttttccaaataaacat

SEQ ID NO: 6490995 - DNA, 23 bp, Homo sapiens
tgacttttccaaataaacatttt

SEQ ID NO: 6490996 - DNA, 18 bp, Homo sapiens
tgacttttccaagccctt

SEQ ID NO: 6490997 - DNA, 13 bp, Homo sapiens
tgacttttccatg

SEQ ID NO: 6490998 - DNA, 18 bp, Homo sapiens
tgacttttccatgtatct

SEQ ID NO: 6490999 - DNA, 22 bp, Homo sapiens
tgacttttccatgtatctacct

SEQ ID NO: 6491000 - DNA, 14 bp, Homo sapiens
tgacttttctgacc

SEQ ID NO: 6491001 - DNA, 13 bp, Homo sapiens
tgacttttgaaga

SEQ ID NO: 6491002 - DNA, 14 bp, Homo sapiens
tgacttttgcttta

SEQ ID NO: 6491003 - DNA, 17 bp, Homo sapiens
tgactttttagccagtg

SEQ ID NO: 6491004 - DNA, 18 bp, Homo sapiens
tgactttttagccagtga

SEQ ID NO: 6491005 - DNA, 22 bp, Homo sapiens
tgactttttataatgtggattt

SEQ ID NO: 6491006 - DNA, 13 bp, Homo sapiens
tgactttttctgt

SEQ ID NO: 6491007 - DNA, 14 bp, Homo sapiens
tgactttttgcatt

SEQ ID NO: 6491008 - DNA, 14 bp, Homo sapiens
tgactttttttgta

SEQ ID NO: 6491009 - DNA, 18 bp, Homo sapiens
tgactttttttgtatgtg

SEQ ID NO: 6491010 - DNA, 15 bp, Homo sapiens
tgagaaaaaaacagc

SEQ ID NO: 6491011 - DNA, 16 bp, Homo sapiens
tgagaaaaaaacagca

SEQ ID NO: 6491012 - DNA, 21 bp, Homo sapiens
tgagaaaaaaatatataatac

SEQ ID NO: 6491013 - DNA, 19 bp, Homo sapiens
tgagaaaaagcattaaaaa

SEQ ID NO: 6491014 - DNA, 20 bp, Homo sapiens
tgagaaaaagcattaaaaat

SEQ ID NO: 6491015 - DNA, 18 bp, Homo sapiens
tgagaaaaagctcctgtc

SEQ ID NO: 6491016 - DNA, 20 bp, Homo sapiens
tgagaaaaagtcctgtcagt

SEQ ID NO: 6491017 - DNA, 19 bp, Homo sapiens
tgagaaaaataaatggaaa

SEQ ID NO: 6491018 - DNA, 23 bp, Homo sapiens
tgagaaaaatagagcaaaatcaa

SEQ ID NO: 6491019 - DNA, 14 bp, Homo sapiens
tgagaaaacaggct

SEQ ID NO: 6491020 - DNA, 12 bp, Homo sapiens
tgagaaaacatg

SEQ ID NO: 6491021 - DNA, 21 bp, Homo sapiens
tgagaaaacgaaactgctcta

SEQ ID NO: 6491022 - DNA, 23 bp, Homo sapiens
tgagaaaacgaagtctttttcat

SEQ ID NO: 6491023 - DNA, 19 bp, Homo sapiens
tgagaaaagctttgaaccc

SEQ ID NO: 6491024 - DNA, 14 bp, Homo sapiens
tgagaaaagtagtc

SEQ ID NO: 6491025 - DNA, 15 bp, Homo sapiens
tgagaaaagtattct

SEQ ID NO: 6491026 - DNA, 19 bp, Homo sapiens
tgagaaaagtattctcaaa

SEQ ID NO: 6491027 - DNA, 12 bp, Homo sapiens
tgagaaaatata

SEQ ID NO: 6491028 - DNA, 16 bp, Homo sapiens
tgagaaaatataataa

SEQ ID NO: 6491029 - DNA, 23 bp, Homo sapiens
tgagaaaatgtaaaataaaggct

SEQ ID NO: 6491030 - DNA, 15 bp, Homo sapiens
tgagaaacactattt

SEQ ID NO: 6491031 - DNA, 20 bp, Homo sapiens
tgagaaacactatttgtgac

SEQ ID NO: 6491032 - DNA, 22 bp, Homo sapiens
tgagaaacagctacagctttgg

SEQ ID NO: 6491033 - DNA, 19 bp, Homo sapiens
tgagaaacagctcagccag

SEQ ID NO: 6491034 - DNA, 20 bp, Homo sapiens
tgagaaacagctcagccagt

SEQ ID NO: 6491035 - DNA, 20 bp, Homo sapiens
tgagaaacatctcaataaag

SEQ ID NO: 6491036 - DNA, 18 bp, Homo sapiens
tgagaaacccaccagcct

SEQ ID NO: 6491037 - DNA, 18 bp, Homo sapiens
tgagaaacctgtatcttt

SEQ ID NO: 6491038 - DNA, 21 bp, Homo sapiens
tgagaaacctgtatctttcta

SEQ ID NO: 6491039 - DNA, 15 bp, Homo sapiens
tgagaaactgctgca

SEQ ID NO: 6491040 - DNA, 18 bp, Homo sapiens
tgagaaacttaaatgtta

SEQ ID NO: 6491041 - DNA, 12 bp, Homo sapiens
tgagaaagaaag

SEQ ID NO: 6491042 - DNA, 18 bp, Homo sapiens
tgagaaagaataggggct

SEQ ID NO: 6491043 - DNA, 18 bp, Homo sapiens
tgagaaagacatctgagg

SEQ ID NO: 6491044 - DNA, 20 bp, Homo sapiens
tgagaaagacatctgaggaa

SEQ ID NO: 6491045 - DNA, 20 bp, Homo sapiens
tgagaaagactattcaaaca

SEQ ID NO: 6491046 - DNA, 23 bp, Homo sapiens
tgagaaagatgttccagtgagga

SEQ ID NO: 6491047 - DNA, 15 bp, Homo sapiens
tgagaaagcccacct

SEQ ID NO: 6491048 - DNA, 21 bp, Homo sapiens
tgagaaagcccacctgggctg

SEQ ID NO: 6491049 - DNA, 13 bp, Homo sapiens
tgagaaagccctg

SEQ ID NO: 6491050 - DNA, 16 bp, Homo sapiens
tgagaaagccttcttt

SEQ ID NO: 6491051 - DNA, 18 bp, Homo sapiens
tgagaaagctaaaatggt

SEQ ID NO: 6491052 - DNA, 16 bp, Homo sapiens
tgagaaagcttttatt

SEQ ID NO: 6491053 - DNA, 19 bp, Homo sapiens
tgagaaagcttttattcct

SEQ ID NO: 6491054 - DNA, 12 bp, Homo sapiens
tgagaaaggaaa

SEQ ID NO: 6491055 - DNA, 13 bp, Homo sapiens
tgagaaaggacag

SEQ ID NO: 6491056 - DNA, 19 bp, Homo sapiens
tgagaaaggacagagccag

SEQ ID NO: 6491057 - DNA, 21 bp, Homo sapiens
tgagaaagtcttatttattca

SEQ ID NO: 6491058 - DNA, 18 bp, Homo sapiens
tgagaaatacagaagaaa

SEQ ID NO: 6491059 - DNA, 21 bp, Homo sapiens
tgagaaataggtatcaaaata

SEQ ID NO: 6491060 - DNA, 21 bp, Homo sapiens
tgagaaatatggacacttaat

SEQ ID NO: 6491061 - DNA, 20 bp, Homo sapiens
tgagaaatcacaatgagaaa

SEQ ID NO: 6491062 - DNA, 14 bp, Homo sapiens
tgagaaatcctgga

SEQ ID NO: 6491063 - DNA, 13 bp, Homo sapiens
tgagaaatctaaa

SEQ ID NO: 6491064 - DNA, 18 bp, Homo sapiens
tgagaaatgaaatattgt

SEQ ID NO: 6491065 - DNA, 22 bp, Homo sapiens
tgagaaatgaataatttcccaa

SEQ ID NO: 6491066 - DNA, 16 bp, Homo sapiens
tgagaaatgaatgctg

SEQ ID NO: 6491067 - DNA, 11 bp, Homo sapiens
tgagaaatgca

SEQ ID NO: 6491068 - DNA, 13 bp, Homo sapiens
tgagaaatgcata

SEQ ID NO: 6491069 - DNA, 12 bp, Homo sapiens
tgagaaatgtct

SEQ ID NO: 6491070 - DNA, 11 bp, Homo sapiens
tgagaaatgtg

SEQ ID NO: 6491071 - DNA, 14 bp, Homo sapiens
tgagaaattaagta

SEQ ID NO: 6491072 - DNA, 13 bp, Homo sapiens
tgagaaattacag

SEQ ID NO: 6491073 - DNA, 20 bp, Homo sapiens
tgagaaattatgaaagttaa

SEQ ID NO: 6491074 - DNA, 21 bp, Homo sapiens
tgagaaattgtgccaaagata

SEQ ID NO: 6491075 - DNA, 22 bp, Homo sapiens
tgagaaattgtgccaaagatag

SEQ ID NO: 6491076 - DNA, 15 bp, Homo sapiens
tgagaaatttaaact

SEQ ID NO: 6491077 - DNA, 20 bp, Homo sapiens
tgagaaatttttttccagaa

SEQ ID NO: 6491078 - DNA, 16 bp, Homo sapiens
tgagaacaaagctgtt

SEQ ID NO: 6491079 - DNA, 20 bp, Homo sapiens
tgagaacaaagctgttaaac

SEQ ID NO: 6491080 - DNA, 19 bp, Homo sapiens
tgagaacaaccaaaatctt

SEQ ID NO: 6491081 - DNA, 12 bp, Homo sapiens
tgagaacactgt

SEQ ID NO: 6491082 - DNA, 23 bp, Homo sapiens
tgagaacagataaagattgtgtg

SEQ ID NO: 6491083 - DNA, 21 bp, Homo sapiens
tgagaacagatctccaaagct

SEQ ID NO: 6491084 - DNA, 20 bp, Homo sapiens
tgagaacagcatatgatttc

SEQ ID NO: 6491085 - DNA, 23 bp, Homo sapiens
tgagaacatggtgtgtgtctctg

SEQ ID NO: 6491086 - DNA, 17 bp, Homo sapiens
tgagaacattaggcccc

SEQ ID NO: 6491087 - DNA, 18 bp, Homo sapiens
tgagaacattaggcccca

SEQ ID NO: 6491088 - DNA, 20 bp, Homo sapiens
tgagaacattaggccccagc

SEQ ID NO: 6491089 - DNA, 13 bp, Homo sapiens
tgagaaccaaaag

SEQ ID NO: 6491090 - DNA, 18 bp, Homo sapiens
tgagaaccaaaagatgcc

SEQ ID NO: 6491091 - DNA, 17 bp, Homo sapiens
tgagaaccagtctcctc

SEQ ID NO: 6491092 - DNA, 18 bp, Homo sapiens
tgagaaccagtctcctca

SEQ ID NO: 6491093 - DNA, 22 bp, Homo sapiens
tgagaaccattgttctgaatgc

SEQ ID NO: 6491094 - DNA, 13 bp, Homo sapiens
tgagaacccagag

SEQ ID NO: 6491095 - DNA, 14 bp, Homo sapiens
tgagaacccagaga

SEQ ID NO: 6491096 - DNA, 13 bp, Homo sapiens
tgagaacccccta

SEQ ID NO: 6491097 - DNA, 16 bp, Homo sapiens
tgagaaccctgcgtgg

SEQ ID NO: 6491098 - DNA, 22 bp, Homo sapiens
tgagaaccctgcgtggggacag

SEQ ID NO: 6491099 - DNA, 19 bp, Homo sapiens
tgagaacctaatgcactct

SEQ ID NO: 6491100 - DNA, 12 bp, Homo sapiens
tgagaacctggc

SEQ ID NO: 6491101 - DNA, 14 bp, Homo sapiens
tgagaacctggcct

SEQ ID NO: 6491102 - DNA, 17 bp, Homo sapiens
tgagaaccttttcaaac

SEQ ID NO: 6491103 - DNA, 21 bp, Homo sapiens
tgagaacgtaaagaacttttt

SEQ ID NO: 6491104 - DNA, 23 bp, Homo sapiens
tgagaactcagaagagaaataca

SEQ ID NO: 6491105 - DNA, 22 bp, Homo sapiens
tgagaactccagctggtgcccc

SEQ ID NO: 6491106 - DNA, 15 bp, Homo sapiens
tgagaactcctgact

SEQ ID NO: 6491107 - DNA, 23 bp, Homo sapiens
tgagaactcgttcacctccaagc

SEQ ID NO: 6491108 - DNA, 15 bp, Homo sapiens
tgagaactgacaaag

SEQ ID NO: 6491109 - DNA, 17 bp, Homo sapiens
tgagaactgactttctc

SEQ ID NO: 6491110 - DNA, 18 bp, Homo sapiens
tgagaactgaggagcgga

SEQ ID NO: 6491111 - DNA, 17 bp, Homo sapiens
tgagaactgcatatgtt

SEQ ID NO: 6491112 - DNA, 20 bp, Homo sapiens
tgagaactgcatatgtttcg

SEQ ID NO: 6491113 - DNA, 19 bp, Homo sapiens
tgagaactggttcttgcct

SEQ ID NO: 6491114 - DNA, 20 bp, Homo sapiens
tgagaactggttcttgcctt

SEQ ID NO: 6491115 - DNA, 22 bp, Homo sapiens
tgagaactggttcttgccttcc

SEQ ID NO: 6491116 - DNA, 18 bp, Homo sapiens
tgagaactgtgaatatgt

SEQ ID NO: 6491117 - DNA, 20 bp, Homo sapiens
tgagaacttctcttcccata

SEQ ID NO: 6491118 - DNA, 15 bp, Homo sapiens
tgagaacttgacaag

SEQ ID NO: 6491119 - DNA, 17 bp, Homo sapiens
tgagaacttttcataga

SEQ ID NO: 6491120 - DNA, 19 bp, Homo sapiens
tgagaagaaaaatggaaaa

SEQ ID NO: 6491121 - DNA, 23 bp, Homo sapiens
tgagaagaaaacatctattctct

SEQ ID NO: 6491122 - DNA, 20 bp, Homo sapiens
tgagaagaaaatggaaccag

SEQ ID NO: 6491123 - DNA, 14 bp, Homo sapiens
tgagaagaatattg

SEQ ID NO: 6491124 - DNA, 22 bp, Homo sapiens
tgagaagaatattgttcctaag

SEQ ID NO: 6491125 - DNA, 15 bp, Homo sapiens
tgagaagaatgaaaa

SEQ ID NO: 6491126 - DNA, 21 bp, Homo sapiens
tgggcacaattcctgtgctca

SEQ ID NO: 6491127 - DNA, 12 bp, Homo sapiens
tgggcacacgct

SEQ ID NO: 6491128 - DNA, 22 bp, Homo sapiens
tgggcacacgctgctctgcccc

SEQ ID NO: 6491129 - DNA, 19 bp, Homo sapiens
tgggcacagattgaagaat

SEQ ID NO: 6491130 - DNA, 14 bp, Homo sapiens
tgggcacagtccag

SEQ ID NO: 6491131 - DNA, 12 bp, Homo sapiens
tgggcacagtgc

SEQ ID NO: 6491132 - DNA, 14 bp, Homo sapiens
tgggcacagtttgg

SEQ ID NO: 6491133 - DNA, 23 bp, Homo sapiens
tgggcacatagcataggctgggg

SEQ ID NO: 6491134 - DNA, 15 bp, Homo sapiens
tgggcacatgaggag

SEQ ID NO: 6491135 - DNA, 17 bp, Homo sapiens
tgggcacatgaggaggg

SEQ ID NO: 6491136 - DNA, 16 bp, Homo sapiens
tgggcaccacaaaata

SEQ ID NO: 6491137 - DNA, 18 bp, Homo sapiens
tgggcaccacaaaatata

SEQ ID NO: 6491138 - DNA, 15 bp, Homo sapiens
tgggcaccagcttct

SEQ ID NO: 6491139 - DNA, 17 bp, Homo sapiens
tgggcaccagcttcttt

SEQ ID NO: 6491140 - DNA, 21 bp, Homo sapiens
tgggcaccagcttctttctcg

SEQ ID NO: 6491141 - DNA, 18 bp, Homo sapiens
tgggcacccacctccacc

SEQ ID NO: 6491142 - DNA, 21 bp, Homo sapiens
tgggcacccagcctctaggga

SEQ ID NO: 6491143 - DNA, 15 bp, Homo sapiens
tgggcacccccagcc

SEQ ID NO: 6491144 - DNA, 21 bp, Homo sapiens
tgggcacccccagcctgggcc

SEQ ID NO: 6491145 - DNA, 14 bp, Homo sapiens
tgggcacccctgcc

SEQ ID NO: 6491146 - DNA, 17 bp, Homo sapiens
tgggcacccctgcctcc

SEQ ID NO: 6491147 - DNA, 13 bp, Homo sapiens
tgggcaccctgca

SEQ ID NO: 6491148 - DNA, 22 bp, Homo sapiens
tgggcaccctgcaggcaggcag

SEQ ID NO: 6491149 - DNA, 16 bp, Homo sapiens
tgggcaccgggacccc

SEQ ID NO: 6491150 - DNA, 18 bp, Homo sapiens
tgggcaccgtgtcctcct

SEQ ID NO: 6491151 - DNA, 13 bp, Homo sapiens
tgggcacctcaga

SEQ ID NO: 6491152 - DNA, 24 bp, Homo sapiens
tgggcacctctagtgctactgcta

SEQ ID NO: 6491153 - DNA, 15 bp, Homo sapiens
tgggcacctctgctg

SEQ ID NO: 6491154 - DNA, 16 bp, Homo sapiens
tgggcacctctgctgt

SEQ ID NO: 6491155 - DNA, 21 bp, Homo sapiens
tgggcacctgcgcacaggtgg

SEQ ID NO: 6491156 - DNA, 16 bp, Homo sapiens
tgggcacgcctgctgg

SEQ ID NO: 6491157 - DNA, 18 bp, Homo sapiens
tgggcacgcctgctggcc

SEQ ID NO: 6491158 - DNA, 21 bp, Homo sapiens
tgggcacgctgtgggcaggtg

SEQ ID NO: 6491159 - DNA, 16 bp, Homo sapiens
tgggcacggccctcct

SEQ ID NO: 6491160 - DNA, 16 bp, Homo sapiens
tgggcactaagggtgg

SEQ ID NO: 6491161 - DNA, 17 bp, Homo sapiens
tgggcactaagggtgga

SEQ ID NO: 6491162 - DNA, 20 bp, Homo sapiens
tgggcactagctagatgctt

SEQ ID NO: 6491163 - DNA, 20 bp, Homo sapiens
tgggcactatttatttacaa

SEQ ID NO: 6491164 - DNA, 12 bp, Homo sapiens
tgggcactgaag

SEQ ID NO: 6491165 - DNA, 20 bp, Homo sapiens
tgggcactgcggctgtctcc

SEQ ID NO: 6491166 - DNA, 18 bp, Homo sapiens
tgggcactgctctcacct

SEQ ID NO: 6491167 - DNA, 23 bp, Homo sapiens
tgggcactgctgggtggcccatc

SEQ ID NO: 6491168 - DNA, 16 bp, Homo sapiens
tgggcactggcccagg

SEQ ID NO: 6491169 - DNA, 15 bp, Homo sapiens
tgggcactgggatga

SEQ ID NO: 6491170 - DNA, 22 bp, Homo sapiens
tgggcactgggatgagccgctg

SEQ ID NO: 6491171 - DNA, 18 bp, Homo sapiens
tgggcactgggcactagc

SEQ ID NO: 6491172 - DNA, 14 bp, Homo sapiens
tgggcactgggccg

SEQ ID NO: 6491173 - DNA, 14 bp, Homo sapiens
tgggcactggggcc

SEQ ID NO: 6491174 - DNA, 17 bp, Homo sapiens
tgggcacttccctgctg

SEQ ID NO: 6491175 - DNA, 18 bp, Homo sapiens
tgggcagaagatagagat

SEQ ID NO: 6491176 - DNA, 23 bp, Homo sapiens
tgggcagaaggaagacttcatcc

SEQ ID NO: 6491177 - DNA, 18 bp, Homo sapiens
tgggcagaagggagaagg

SEQ ID NO: 6491178 - DNA, 17 bp, Homo sapiens
tgggcagaatcctgggc

SEQ ID NO: 6491179 - DNA, 18 bp, Homo sapiens
tgggcagaatcctgggcc

SEQ ID NO: 6491180 - DNA, 20 bp, Homo sapiens
tgggcagaatcctgggcccc

SEQ ID NO: 6491181 - DNA, 23 bp, Homo sapiens
tgggcagaatcctgggcccccag

SEQ ID NO: 6491182 - DNA, 19 bp, Homo sapiens
tgggcagacaggtgggaga

SEQ ID NO: 6491183 - DNA, 23 bp, Homo sapiens
tgggcagagcagagaccatccct

SEQ ID NO: 6491184 - DNA, 14 bp, Homo sapiens
tgggcagagcccaa

SEQ ID NO: 6491185 - DNA, 13 bp, Homo sapiens
tgggcagagcctg

SEQ ID NO: 6491186 - DNA, 14 bp, Homo sapiens
tgggcagagcctgt

SEQ ID NO: 6491187 - DNA, 14 bp, Homo sapiens
tgggcagagctggc

SEQ ID NO: 6491188 - DNA, 12 bp, Homo sapiens
tgggcagaggaa

SEQ ID NO: 6491189 - DNA, 15 bp, Homo sapiens
tgggcagaggaaagc

SEQ ID NO: 6491190 - DNA, 16 bp, Homo sapiens
tgggcagaggaaagca

SEQ ID NO: 6491191 - DNA, 20 bp, Homo sapiens
tgggcagaggaatgtgggct

SEQ ID NO: 6491192 - DNA, 21 bp, Homo sapiens
tgggcagaggggagaggaagc

SEQ ID NO: 6491193 - DNA, 22 bp, Homo sapiens
tgggcagatcatttgaggccag

SEQ ID NO: 6491194 - DNA, 15 bp, Homo sapiens
tgggcagatctaccc

SEQ ID NO: 6491195 - DNA, 22 bp, Homo sapiens
tgggcagatgtcccccactgct

SEQ ID NO: 6491196 - DNA, 15 bp, Homo sapiens
tgggcagattttcag

SEQ ID NO: 6491197 - DNA, 14 bp, Homo sapiens
tgggcagcaaggct

SEQ ID NO: 6491198 - DNA, 19 bp, Homo sapiens
tgggcagcaattcacgctg

SEQ ID NO: 6491199 - DNA, 14 bp, Homo sapiens
tgggcagcaccctc

SEQ ID NO: 6491200 - DNA, 22 bp, Homo sapiens
tgggcagcaccctcccccgcag

SEQ ID NO: 6491201 - DNA, 17 bp, Homo sapiens
tgggcagcacctccggg

SEQ ID NO: 6491202 - DNA, 21 bp, Homo sapiens
tgggcagcagcatcccagcct

SEQ ID NO: 6491203 - DNA, 22 bp, Homo sapiens
tgggcagcagcatcccagcctt

SEQ ID NO: 6491204 - DNA, 15 bp, Homo sapiens
tgggcagcagctcag

SEQ ID NO: 6491205 - DNA, 19 bp, Homo sapiens
tgggcagcagctcagcctc

SEQ ID NO: 6491206 - DNA, 13 bp, Homo sapiens
tgggcagccagac

SEQ ID NO: 6491207 - DNA, 21 bp, Homo sapiens
tgggcagccagaccagcaggc

SEQ ID NO: 6491208 - DNA, 13 bp, Homo sapiens
tgggcagccagga

SEQ ID NO: 6491209 - DNA, 20 bp, Homo sapiens
tgggcagcccaaagctgcag

SEQ ID NO: 6491210 - DNA, 13 bp, Homo sapiens
tgggcagcccaga

SEQ ID NO: 6491211 - DNA, 16 bp, Homo sapiens
tgggcagccccagaga

SEQ ID NO: 6491212 - DNA, 11 bp, Homo sapiens
tgggcagcccg

SEQ ID NO: 6491213 - DNA, 12 bp, Homo sapiens
tgggcagcccgc

SEQ ID NO: 6491214 - DNA, 13 bp, Homo sapiens
tgggcagcgccct

SEQ ID NO: 6491215 - DNA, 22 bp, Homo sapiens
tgggcagctaccatttcccttt

SEQ ID NO: 6491216 - DNA, 19 bp, Homo sapiens
tgggcagctcatctctgtc

SEQ ID NO: 6491217 - DNA, 12 bp, Homo sapiens
tgggcagctcct

SEQ ID NO: 6491218 - DNA, 20 bp, Homo sapiens
tgggcagctgcctcccctcc

SEQ ID NO: 6491219 - DNA, 22 bp, Homo sapiens
tgggcagctgcctcccctcctc

SEQ ID NO: 6491220 - DNA, 14 bp, Homo sapiens
tgggcagctgggcc

SEQ ID NO: 6491221 - DNA, 18 bp, Homo sapiens
tgggcagcttagggccct

SEQ ID NO: 6491222 - DNA, 12 bp, Homo sapiens
tgggcaggaagg

SEQ ID NO: 6491223 - DNA, 23 bp, Homo sapiens
tgggcaggaagtgaagagatcct

SEQ ID NO: 6491224 - DNA, 16 bp, Homo sapiens
tgggcaggaccctgct

SEQ ID NO: 6491225 - DNA, 18 bp, Homo sapiens
tgggcaggactcagctcc

SEQ ID NO: 6491226 - DNA, 23 bp, Homo sapiens
tgggcaggactcagctccccaga

SEQ ID NO: 6491227 - DNA, 11 bp, Homo sapiens
tgggcaggagg

SEQ ID NO: 6491228 - DNA, 21 bp, Homo sapiens
tgggcaggaggccccaggctg

SEQ ID NO: 6491229 - DNA, 19 bp, Homo sapiens
tgggcaggagtcaccatgc

SEQ ID NO: 6491230 - DNA, 20 bp, Homo sapiens
tgggcaggatctcaagccag

SEQ ID NO: 6491231 - DNA, 21 bp, Homo sapiens
tgggcaggatctcaagccagc

SEQ ID NO: 6491232 - DNA, 17 bp, Homo sapiens
tgggcagggaggcacca

SEQ ID NO: 6491233 - DNA, 15 bp, Homo sapiens
tgggcagggccctgt

SEQ ID NO: 6491234 - DNA, 12 bp, Homo sapiens
tgggcagggcct

SEQ ID NO: 6491235 - DNA, 16 bp, Homo sapiens
tgggcagggcctggcg

SEQ ID NO: 6491236 - DNA, 21 bp, Homo sapiens
tgggcagggctgggagaactt

SEQ ID NO: 6491237 - DNA, 16 bp, Homo sapiens
tgggcagggtctctgc

SEQ ID NO: 6491238 - DNA, 17 bp, Homo sapiens
tgggcagggtctctgct

SEQ ID NO: 6491239 - DNA, 13 bp, Homo sapiens
tgggcaggtcctg

SEQ ID NO: 6491240 - DNA, 15 bp, Homo sapiens
tgggcaggtcctggg

SEQ ID NO: 6491241 - DNA, 19 bp, Homo sapiens
tgggcaggtcctggggagg

SEQ ID NO: 6491242 - DNA, 20 bp, Homo sapiens
tgggcaggtctcctctggga

SEQ ID NO: 6491243 - DNA, 15 bp, Homo sapiens
tgggcaggtctgaga

SEQ ID NO: 6491244 - DNA, 11 bp, Homo sapiens
tgggcaggtgg

SEQ ID NO: 6491245 - DNA, 22 bp, Homo sapiens
tgggcaggtggccgcccctgag

SEQ ID NO: 6491246 - DNA, 18 bp, Homo sapiens
tgggcaggtggcctctgc

SEQ ID NO: 6491247 - DNA, 21 bp, Homo sapiens
tgggcaggtggcctctgctgg

SEQ ID NO: 6491248 - DNA, 15 bp, Homo sapiens
tgggcaggtggtggc

SEQ ID NO: 6491249 - DNA, 18 bp, Homo sapiens
tgggcaggttcctggggc

SEQ ID NO: 6491250 - DNA, 15 bp, Homo sapiens
tgggcagtcaccacc

SEQ ID NO: 6491251 - DNA, 19 bp, Homo sapiens
tgggcagtcaccacccagc

SEQ ID NO: 6491252 - DNA, 20 bp, Homo sapiens
tgggcagtcaccacccagcc

SEQ ID NO: 6491253 - DNA, 21 bp, Homo sapiens
tgggcagtcaccacccagccc

SEQ ID NO: 6491254 - DNA, 20 bp, Homo sapiens
tgggcagtcgtaagggttgc

SEQ ID NO: 6491255 - DNA, 22 bp, Homo sapiens
tgggcagtctttcttgaaattg

SEQ ID NO: 6491256 - DNA, 11 bp, Homo sapiens
tgggcagtgcc

SEQ ID NO: 6491257 - DNA, 20 bp, Homo sapiens
tgggcagtgccacagcctgc

SEQ ID NO: 6491258 - DNA, 22 bp, Homo sapiens
tgggcagtgccacagcctgctg

SEQ ID NO: 6491259 - DNA, 17 bp, Homo sapiens
tgggcagtgccagccaa

SEQ ID NO: 6491260 - DNA, 12 bp, Homo sapiens
tgggcagtgccc

SEQ ID NO: 6491261 - DNA, 15 bp, Homo sapiens
tgggcagtgccccag

SEQ ID NO: 6491262 - DNA, 14 bp, Homo sapiens
tgggcagtgcctcc

SEQ ID NO: 6491263 - DNA, 14 bp, Homo sapiens
tgggcagtggagag

SEQ ID NO: 6491264 - DNA, 15 bp, Homo sapiens
tgggcagtggagagg

SEQ ID NO: 6491265 - DNA, 16 bp, Homo sapiens
tgggcagttggccagg

SEQ ID NO: 6491266 - DNA, 16 bp, Homo sapiens
tgggcagttgggagtg

SEQ ID NO: 6491267 - DNA, 22 bp, Homo sapiens
tgggcagtttttctgtatttta

SEQ ID NO: 6491268 - DNA, 15 bp, Homo sapiens
tgggcataaactgtt

SEQ ID NO: 6491269 - DNA, 22 bp, Homo sapiens
tgggcataggctgcccaatctg

SEQ ID NO: 6491270 - DNA, 20 bp, Homo sapiens
tgggcatagtggcacttgcc

SEQ ID NO: 6491271 - DNA, 15 bp, Homo sapiens
tgggcatcagaaaac

SEQ ID NO: 6491272 - DNA, 21 bp, Homo sapiens
tgggcatcagaaaacagggtc

SEQ ID NO: 6491273 - DNA, 21 bp, Homo sapiens
tgggcatccacccagtgctgc

SEQ ID NO: 6491274 - DNA, 17 bp, Homo sapiens
tgggcatcccagcttgc

SEQ ID NO: 6491275 - DNA, 23 bp, Homo sapiens
tgggcatctcgtgccagggcagg

SEQ ID NO: 6491276 - DNA, 14 bp, Homo sapiens
tgggcatctctaga

SEQ ID NO: 6491277 - DNA, 15 bp, Homo sapiens
tgggcatctggccct

SEQ ID NO: 6491278 - DNA, 20 bp, Homo sapiens
tgggcatctggccctgctgc

SEQ ID NO: 6491279 - DNA, 22 bp, Homo sapiens
tgggcatctggccctgctgccc

SEQ ID NO: 6491280 - DNA, 15 bp, Homo sapiens
tgggcatctgttctg

SEQ ID NO: 6491281 - DNA, 15 bp, Homo sapiens
tgggcatcttttgta

SEQ ID NO: 6491282 - DNA, 16 bp, Homo sapiens
tgggcatgaatggaga

SEQ ID NO: 6491283 - DNA, 20 bp, Homo sapiens
tgggcatgccaccctcacac

SEQ ID NO: 6491284 - DNA, 16 bp, Homo sapiens
tgggcatggcagggcc

SEQ ID NO: 6491285 - DNA, 17 bp, Homo sapiens
tgggcatggccgcttct

SEQ ID NO: 6491286 - DNA, 21 bp, Homo sapiens
tgggcatggggtgggcctctg

SEQ ID NO: 6491287 - DNA, 22 bp, Homo sapiens
tgggcatggtaccagccctggg

SEQ ID NO: 6491288 - DNA, 19 bp, Homo sapiens
tgggcatggtgttctcctg

SEQ ID NO: 6491289 - DNA, 15 bp, Homo sapiens
tgggcatgtgggctt

SEQ ID NO: 6491290 - DNA, 16 bp, Homo sapiens
tgggcatgtgggcttc

SEQ ID NO: 6491291 - DNA, 14 bp, Homo sapiens
tgggcattagcaag

SEQ ID NO: 6491292 - DNA, 20 bp, Homo sapiens
tgggcattagtgtcccccct

SEQ ID NO: 6491293 - DNA, 23 bp, Homo sapiens
tgggcattgacaaatctgtgtat

SEQ ID NO: 6491294 - DNA, 17 bp, Homo sapiens
tgggcattgatggggaa

SEQ ID NO: 6491295 - DNA, 18 bp, Homo sapiens
tgggcattgatggggaag

SEQ ID NO: 6491296 - DNA, 23 bp, Homo sapiens
tgggcattgatggggaaggaggc

SEQ ID NO: 6491297 - DNA, 14 bp, Homo sapiens
tgggcattgcagcc

SEQ ID NO: 6491298 - DNA, 16 bp, Homo sapiens
tgggcattgcagcctt

SEQ ID NO: 6491299 - DNA, 18 bp, Homo sapiens
tgggcattgcagccttgc

SEQ ID NO: 6491300 - DNA, 19 bp, Homo sapiens
tgggcattgcagccttgcg

SEQ ID NO: 6491301 - DNA, 23 bp, Homo sapiens
tgggcattgcagccttgcgctgt

SEQ ID NO: 6491302 - DNA, 12 bp, Homo sapiens
tgggcattgctt

SEQ ID NO: 6491303 - DNA, 15 bp, Homo sapiens
tgggcattgggctga

SEQ ID NO: 6491304 - DNA, 16 bp, Homo sapiens
tgagaagaatgaaaat

SEQ ID NO: 6491305 - DNA, 17 bp, Homo sapiens
tgagaagactcctgggc

SEQ ID NO: 6491306 - DNA, 18 bp, Homo sapiens
tgagaagagagatcaaat

SEQ ID NO: 6491307 - DNA, 15 bp, Homo sapiens
tgagaagaggagccc

SEQ ID NO: 6491308 - DNA, 15 bp, Homo sapiens
tgagaagagggcctg

SEQ ID NO: 6491309 - DNA, 17 bp, Homo sapiens
tgagaagagggcctgtg

SEQ ID NO: 6491310 - DNA, 23 bp, Homo sapiens
tgagaagagggcctgtgggagcc

SEQ ID NO: 6491311 - DNA, 20 bp, Homo sapiens
tgagaagagttttctcagag

SEQ ID NO: 6491312 - DNA, 13 bp, Homo sapiens
tgagaagataaaa

SEQ ID NO: 6491313 - DNA, 19 bp, Homo sapiens
tgagaagataatcattgct

SEQ ID NO: 6491314 - DNA, 18 bp, Homo sapiens
tgagaagatcggaacagc

SEQ ID NO: 6491315 - DNA, 20 bp, Homo sapiens
tgagaagatcggaacagctc

SEQ ID NO: 6491316 - DNA, 22 bp, Homo sapiens
tgagaagatctaccccagggag

SEQ ID NO: 6491317 - DNA, 13 bp, Homo sapiens
tgagaagatggca

SEQ ID NO: 6491318 - DNA, 16 bp, Homo sapiens
tgagaagatggcactg

SEQ ID NO: 6491319 - DNA, 18 bp, Homo sapiens
tgagaagatgggggctgg

SEQ ID NO: 6491320 - DNA, 22 bp, Homo sapiens
tgagaagatgggggctggaggg

SEQ ID NO: 6491321 - DNA, 23 bp, Homo sapiens
tgagaagatgttaattacttttg

SEQ ID NO: 6491322 - DNA, 23 bp, Homo sapiens
tgagaagattcttcccattctcc

SEQ ID NO: 6491323 - DNA, 15 bp, Homo sapiens
tgagaagccaagcct

SEQ ID NO: 6491324 - DNA, 16 bp, Homo sapiens
tgagaagccgtgggtg

SEQ ID NO: 6491325 - DNA, 14 bp, Homo sapiens
tgagaagccttcag

SEQ ID NO: 6491326 - DNA, 15 bp, Homo sapiens
tgagaagccttcagc

SEQ ID NO: 6491327 - DNA, 16 bp, Homo sapiens
tgagaagcgctgccct

SEQ ID NO: 6491328 - DNA, 22 bp, Homo sapiens
tgagaagcgctgccctgtgaga

SEQ ID NO: 6491329 - DNA, 17 bp, Homo sapiens
tgagaagctcagctgcc

SEQ ID NO: 6491330 - DNA, 23 bp, Homo sapiens
tgagaagctcagctgccttcctg

SEQ ID NO: 6491331 - DNA, 15 bp, Homo sapiens
tgagaagctgaggcc

SEQ ID NO: 6491332 - DNA, 13 bp, Homo sapiens
tgagaagctgctc

SEQ ID NO: 6491333 - DNA, 16 bp, Homo sapiens
tgagaagctgctcaac

SEQ ID NO: 6491334 - DNA, 15 bp, Homo sapiens
tgagaagctgctcca

SEQ ID NO: 6491335 - DNA, 21 bp, Homo sapiens
tgagaagctgctccaggcctg

SEQ ID NO: 6491336 - DNA, 20 bp, Homo sapiens
tgagaagctttgccctccta

SEQ ID NO: 6491337 - DNA, 16 bp, Homo sapiens
tgagaaggaaataaaa

SEQ ID NO: 6491338 - DNA, 16 bp, Homo sapiens
tgagaaggaactgata

SEQ ID NO: 6491339 - DNA, 21 bp, Homo sapiens
tgagaaggaactgatacatct

SEQ ID NO: 6491340 - DNA, 12 bp, Homo sapiens
tgagaaggagag

SEQ ID NO: 6491341 - DNA, 14 bp, Homo sapiens
tgagaaggagagaa

SEQ ID NO: 6491342 - DNA, 16 bp, Homo sapiens
tgagaaggagagaaag

SEQ ID NO: 6491343 - DNA, 22 bp, Homo sapiens
tgagaaggagtcagaaactgtt

SEQ ID NO: 6491344 - DNA, 13 bp, Homo sapiens
tgagaaggcagcc

SEQ ID NO: 6491345 - DNA, 20 bp, Homo sapiens
tgagaaggcagccaccagcg

SEQ ID NO: 6491346 - DNA, 18 bp, Homo sapiens
tgagaaggcaggcctccg

SEQ ID NO: 6491347 - DNA, 21 bp, Homo sapiens
tgagaaggcaggcctccgtct

SEQ ID NO: 6491348 - DNA, 23 bp, Homo sapiens
tgagaaggccaatagttttagat

SEQ ID NO: 6491349 - DNA, 17 bp, Homo sapiens
tgagaaggccagccctc

SEQ ID NO: 6491350 - DNA, 18 bp, Homo sapiens
tgagaaggccctgtgccc

SEQ ID NO: 6491351 - DNA, 16 bp, Homo sapiens
tgagaagggaaatctt

SEQ ID NO: 6491352 - DNA, 23 bp, Homo sapiens
tgagaagggcaggggtgtcctga

SEQ ID NO: 6491353 - DNA, 15 bp, Homo sapiens
tgagaagggcctgct

SEQ ID NO: 6491354 - DNA, 22 bp, Homo sapiens
tgagaagggcctgctctgcttt

SEQ ID NO: 6491355 - DNA, 12 bp, Homo sapiens
tgagaagggctc

SEQ ID NO: 6491356 - DNA, 20 bp, Homo sapiens
tgagaagggctcagagagga

SEQ ID NO: 6491357 - DNA, 21 bp, Homo sapiens
tgagaagggctcagagaggac

SEQ ID NO: 6491358 - DNA, 22 bp, Homo sapiens
tgagaagggctcagagaggaca

SEQ ID NO: 6491359 - DNA, 23 bp, Homo sapiens
tgagaagggctcagagaggacaa

SEQ ID NO: 6491360 - DNA, 13 bp, Homo sapiens
tgagaaggggcag

SEQ ID NO: 6491361 - DNA, 13 bp, Homo sapiens
tgagaaggtgcct

SEQ ID NO: 6491362 - DNA, 19 bp, Homo sapiens
tgagaaggtgcctgccata

SEQ ID NO: 6491363 - DNA, 11 bp, Homo sapiens
tgagaaggtta

SEQ ID NO: 6491364 - DNA, 17 bp, Homo sapiens
tgagaagtacagggcag

SEQ ID NO: 6491365 - DNA, 19 bp, Homo sapiens
tgagaagtacagggcagaa

SEQ ID NO: 6491366 - DNA, 20 bp, Homo sapiens
tgagaagtacagggcagaac

SEQ ID NO: 6491367 - DNA, 11 bp, Homo sapiens
tgagaagtacc

SEQ ID NO: 6491368 - DNA, 11 bp, Homo sapiens
tgagaagtact

SEQ ID NO: 6491369 - DNA, 21 bp, Homo sapiens
tgagaagtactttgtgctgat

SEQ ID NO: 6491370 - DNA, 18 bp, Homo sapiens
tgagaagtgaatgctggg

SEQ ID NO: 6491371 - DNA, 18 bp, Homo sapiens
tgagaagtgtatatagtt

SEQ ID NO: 6491372 - DNA, 13 bp, Homo sapiens
tgagaagtgtctt

SEQ ID NO: 6491373 - DNA, 12 bp, Homo sapiens
tgagaataaagc

SEQ ID NO: 6491374 - DNA, 12 bp, Homo sapiens
tgagaataattg

SEQ ID NO: 6491375 - DNA, 17 bp, Homo sapiens
tgagaataattgtgtac

SEQ ID NO: 6491376 - DNA, 12 bp, Homo sapiens
tgagaatagaaa

SEQ ID NO: 6491377 - DNA, 14 bp, Homo sapiens
tgagaatagaaatt

SEQ ID NO: 6491378 - DNA, 16 bp, Homo sapiens
tgagaatagaaatttg

SEQ ID NO: 6491379 - DNA, 23 bp, Homo sapiens
tgagaatagaaggaaactagctt

SEQ ID NO: 6491380 - DNA, 13 bp, Homo sapiens
tgagaatatacct

SEQ ID NO: 6491381 - DNA, 19 bp, Homo sapiens
tgagaatatagacagtgcc

SEQ ID NO: 6491382 - DNA, 17 bp, Homo sapiens
tgagaatattataaaaa

SEQ ID NO: 6491383 - DNA, 14 bp, Homo sapiens
tgagaatcatttag

SEQ ID NO: 6491384 - DNA, 19 bp, Homo sapiens
tgagaatcatttagcatgt

SEQ ID NO: 6491385 - DNA, 21 bp, Homo sapiens
tgagaatcccaaatttgattg

SEQ ID NO: 6491386 - DNA, 19 bp, Homo sapiens
tgagaatcccaattattta

SEQ ID NO: 6491387 - DNA, 17 bp, Homo sapiens
tgagaatcctgcctctc

SEQ ID NO: 6491388 - DNA, 12 bp, Homo sapiens
tgagaatctacc

SEQ ID NO: 6491389 - DNA, 21 bp, Homo sapiens
tgagaatctacccccagatcc

SEQ ID NO: 6491390 - DNA, 23 bp, Homo sapiens
tgagaatctatatttaacaagat

SEQ ID NO: 6491391 - DNA, 21 bp, Homo sapiens
tgagaatctgggggtgaggag

SEQ ID NO: 6491392 - DNA, 21 bp, Homo sapiens
tgagaatctgtgcagtcatca

SEQ ID NO: 6491393 - DNA, 19 bp, Homo sapiens
tgagaatctttattgagaa

SEQ ID NO: 6491394 - DNA, 20 bp, Homo sapiens
tgagaatctttattgagaaa

SEQ ID NO: 6491395 - DNA, 15 bp, Homo sapiens
tgagaatgaacaaag

SEQ ID NO: 6491396 - DNA, 22 bp, Homo sapiens
tgagaatgaccctgtcaagctt

SEQ ID NO: 6491397 - DNA, 18 bp, Homo sapiens
tgagaatgacctgccctg

SEQ ID NO: 6491398 - DNA, 15 bp, Homo sapiens
tgagaatgagtggga

SEQ ID NO: 6491399 - DNA, 22 bp, Homo sapiens
tgagaatgcccaactcttcatt

SEQ ID NO: 6491400 - DNA, 20 bp, Homo sapiens
tgagaatgcctaggccagct

SEQ ID NO: 6491401 - DNA, 20 bp, Homo sapiens
tgagaatgctagcaggctgt

SEQ ID NO: 6491402 - DNA, 10 bp, Homo sapiens
tgagaatggc

SEQ ID NO: 6491403 - DNA, 16 bp, Homo sapiens
tgagaatggcctggag

SEQ ID NO: 6491404 - DNA, 18 bp, Homo sapiens
tgagaatggcctggagca

SEQ ID NO: 6491405 - DNA, 20 bp, Homo sapiens
tgagaatggcctggagcagg

SEQ ID NO: 6491406 - DNA, 22 bp, Homo sapiens
tgagaatggcctggagcaggcc

SEQ ID NO: 6491407 - DNA, 19 bp, Homo sapiens
tgagaatgtcatttgctaa

SEQ ID NO: 6491408 - DNA, 18 bp, Homo sapiens
tgagaatgtcttgcttga

SEQ ID NO: 6491409 - DNA, 16 bp, Homo sapiens
tgagaatgtgccatgt

SEQ ID NO: 6491410 - DNA, 19 bp, Homo sapiens
tgagaatgtgccatgtata

SEQ ID NO: 6491411 - DNA, 13 bp, Homo sapiens
tgagaatgtgcct

SEQ ID NO: 6491412 - DNA, 18 bp, Homo sapiens
tgagaatgttaccagact

SEQ ID NO: 6491413 - DNA, 20 bp, Homo sapiens
tgagaatgttaccagacttc

SEQ ID NO: 6491414 - DNA, 17 bp, Homo sapiens
tgagaatgtttgaaaat

SEQ ID NO: 6491415 - DNA, 22 bp, Homo sapiens
tgagaattacagaaaatttgca

SEQ ID NO: 6491416 - DNA, 14 bp, Homo sapiens
tgagaattactgtt

SEQ ID NO: 6491417 - DNA, 15 bp, Homo sapiens
tgagaattactgttt

SEQ ID NO: 6491418 - DNA, 19 bp, Homo sapiens
tgagaattcaaatcctctt

SEQ ID NO: 6491419 - DNA, 17 bp, Homo sapiens
tgagaattcagctgccc

SEQ ID NO: 6491420 - DNA, 15 bp, Homo sapiens
tgagaattccctgtg

SEQ ID NO: 6491421 - DNA, 17 bp, Homo sapiens
tgagaattccctgtgga

SEQ ID NO: 6491422 - DNA, 15 bp, Homo sapiens
tgagaattgagggga

SEQ ID NO: 6491423 - DNA, 22 bp, Homo sapiens
tgagaattgggactctgttgct

SEQ ID NO: 6491424 - DNA, 19 bp, Homo sapiens
tgagaatttaaaaataaga

SEQ ID NO: 6491425 - DNA, 20 bp, Homo sapiens
tgagaatttggatacactct

SEQ ID NO: 6491426 - DNA, 17 bp, Homo sapiens
tgagacaaaaaggaaac

SEQ ID NO: 6491427 - DNA, 16 bp, Homo sapiens
tgagacaaaattttag

SEQ ID NO: 6491428 - DNA, 23 bp, Homo sapiens
tgagacaaatcctaggctcctgg

SEQ ID NO: 6491429 - DNA, 23 bp, Homo sapiens
tgagacaagaaaataagagctca

SEQ ID NO: 6491430 - DNA, 12 bp, Homo sapiens
tgagacaagccc

SEQ ID NO: 6491431 - DNA, 13 bp, Homo sapiens
tgagacaagccct

SEQ ID NO: 6491432 - DNA, 16 bp, Homo sapiens
tgagacaagccctggc

SEQ ID NO: 6491433 - DNA, 23 bp, Homo sapiens
tgagacacagagtggagccctca

SEQ ID NO: 6491434 - DNA, 18 bp, Homo sapiens
tgagacacagcccagaga

SEQ ID NO: 6491435 - DNA, 19 bp, Homo sapiens
tgagacacaggatgaagca

SEQ ID NO: 6491436 - DNA, 18 bp, Homo sapiens
tgagacacgatgccgaga

SEQ ID NO: 6491437 - DNA, 22 bp, Homo sapiens
tgagacacggagcccagccctc

SEQ ID NO: 6491438 - DNA, 19 bp, Homo sapiens
tgagacactgcacagaaga

SEQ ID NO: 6491439 - DNA, 13 bp, Homo sapiens
tgagacactgtca

SEQ ID NO: 6491440 - DNA, 14 bp, Homo sapiens
tgagacagaaacta

SEQ ID NO: 6491441 - DNA, 15 bp, Homo sapiens
tgagacagacattca

SEQ ID NO: 6491442 - DNA, 14 bp, Homo sapiens
tgagacagagcctc

SEQ ID NO: 6491443 - DNA, 13 bp, Homo sapiens
tgagacagcccgg

SEQ ID NO: 6491444 - DNA, 21 bp, Homo sapiens
tgagacagccggatcttggag

SEQ ID NO: 6491445 - DNA, 14 bp, Homo sapiens
tgagacagctctgc

SEQ ID NO: 6491446 - DNA, 17 bp, Homo sapiens
tgagacaggaaaaacca

SEQ ID NO: 6491447 - DNA, 18 bp, Homo sapiens
tgagacaggaaaaaccaa

SEQ ID NO: 6491448 - DNA, 22 bp, Homo sapiens
tgagacaggaaaaaccaacagg

SEQ ID NO: 6491449 - DNA, 22 bp, Homo sapiens
tgagacaggagaaacacttgaa

SEQ ID NO: 6491450 - DNA, 15 bp, Homo sapiens
tgagacaggagaatc

SEQ ID NO: 6491451 - DNA, 12 bp, Homo sapiens
tgagacaggctg

SEQ ID NO: 6491452 - DNA, 16 bp, Homo sapiens
tgagacaggctgggtc

SEQ ID NO: 6491453 - DNA, 22 bp, Homo sapiens
tgagacaggctgggtcctgcca

SEQ ID NO: 6491454 - DNA, 15 bp, Homo sapiens
tgagacagggtctca

SEQ ID NO: 6491455 - DNA, 19 bp, Homo sapiens
tgagacagggtcttgctct

SEQ ID NO: 6491456 - DNA, 22 bp, Homo sapiens
tgagacagggtcttgctctgtc

SEQ ID NO: 6491457 - DNA, 16 bp, Homo sapiens
tgagacagggtttttt

SEQ ID NO: 6491458 - DNA, 18 bp, Homo sapiens
tgagacaggtgcctgggg

SEQ ID NO: 6491459 - DNA, 16 bp, Homo sapiens
tgagacagtccagcct

SEQ ID NO: 6491460 - DNA, 17 bp, Homo sapiens
tgagacagtgaatttgg

SEQ ID NO: 6491461 - DNA, 17 bp, Homo sapiens
tgagacagtgcacatga

SEQ ID NO: 6491462 - DNA, 19 bp, Homo sapiens
tgagacagtgcacatgaac

SEQ ID NO: 6491463 - DNA, 13 bp, Homo sapiens
tgagacagtggga

SEQ ID NO: 6491464 - DNA, 20 bp, Homo sapiens
tgagacagtgggggtgcctg

SEQ ID NO: 6491465 - DNA, 21 bp, Homo sapiens
tgagacagtgggggtgcctgg

SEQ ID NO: 6491466 - DNA, 21 bp, Homo sapiens
tgagacagtttactttgccaa

SEQ ID NO: 6491467 - DNA, 22 bp, Homo sapiens
tgagacagtttactttgccaac

SEQ ID NO: 6491468 - DNA, 23 bp, Homo sapiens
tgagacagtttcttagcttttta

SEQ ID NO: 6491469 - DNA, 12 bp, Homo sapiens
tgagacatcagg

SEQ ID NO: 6491470 - DNA, 10 bp, Homo sapiens
tgagacatcc

SEQ ID NO: 6491471 - DNA, 13 bp, Homo sapiens
tgagacatccagc

SEQ ID NO: 6491472 - DNA, 18 bp, Homo sapiens
tgagacattaatttgtac

SEQ ID NO: 6491473 - DNA, 23 bp, Homo sapiens
tgagaccaaaatttaagttaact

SEQ ID NO: 6491474 - DNA, 14 bp, Homo sapiens
tgagaccaacctgg

SEQ ID NO: 6491475 - DNA, 18 bp, Homo sapiens
tgagaccaacttttcaat

SEQ ID NO: 6491476 - DNA, 20 bp, Homo sapiens
tgagaccaagccggtgccca

SEQ ID NO: 6491477 - DNA, 15 bp, Homo sapiens
tgagaccaagtctct

SEQ ID NO: 6491478 - DNA, 22 bp, Homo sapiens
tgagaccaagtctctctaagac

SEQ ID NO: 6491479 - DNA, 14 bp, Homo sapiens
tgagaccaccccca

SEQ ID NO: 6491480 - DNA, 15 bp, Homo sapiens
tgagaccacctctca

SEQ ID NO: 6491481 - DNA, 19 bp, Homo sapiens
tgagaccacctctcaatat

SEQ ID NO: 6491482 - DNA, 17 bp, Homo sapiens
tgggcattgggctgaca

SEQ ID NO: 6491483 - DNA, 22 bp, Homo sapiens
tgggcatttattttataacatg

SEQ ID NO: 6491484 - DNA, 13 bp, Homo sapiens
tgggcatttcaat

SEQ ID NO: 6491485 - DNA, 14 bp, Homo sapiens
tgggcatttcaatc

SEQ ID NO: 6491486 - DNA, 20 bp, Homo sapiens
tgggcatttcaatccatttt

SEQ ID NO: 6491487 - DNA, 15 bp, Homo sapiens
tgggcatttgtgagg

SEQ ID NO: 6491488 - DNA, 14 bp, Homo sapiens
tgggcattttcctc

SEQ ID NO: 6491489 - DNA, 16 bp, Homo sapiens
tgggcattttcctcct

SEQ ID NO: 6491490 - DNA, 19 bp, Homo sapiens
tgggcattttgacaacatg

SEQ ID NO: 6491491 - DNA, 23 bp, Homo sapiens
tgggccaaatccgctctcttcct

SEQ ID NO: 6491492 - DNA, 15 bp, Homo sapiens
tgggccaacaaggac

SEQ ID NO: 6491493 - DNA, 20 bp, Homo sapiens
tgggccaagagccgccgtgg

SEQ ID NO: 6491494 - DNA, 16 bp, Homo sapiens
tgggccaagccagctg

SEQ ID NO: 6491495 - DNA, 17 bp, Homo sapiens
tgggccaagccagctgc

SEQ ID NO: 6491496 - DNA, 20 bp, Homo sapiens
tgggccaagccagctgccta

SEQ ID NO: 6491497 - DNA, 14 bp, Homo sapiens
tgggccaagccagg

SEQ ID NO: 6491498 - DNA, 22 bp, Homo sapiens
tgggccaagccagggttccaga

SEQ ID NO: 6491499 - DNA, 21 bp, Homo sapiens
tgggccaattaaaatatatat

SEQ ID NO: 6491500 - DNA, 22 bp, Homo sapiens
tgggccaattaaaatatatata

SEQ ID NO: 6491501 - DNA, 23 bp, Homo sapiens
tgggccaattaaaatatatataa

SEQ ID NO: 6491502 - DNA, 21 bp, Homo sapiens
tgggccacacccaggaaggga

SEQ ID NO: 6491503 - DNA, 22 bp, Homo sapiens
tgggccacacccaggaagggaa

SEQ ID NO: 6491504 - DNA, 18 bp, Homo sapiens
tgggccacacctgagcgc

SEQ ID NO: 6491505 - DNA, 21 bp, Homo sapiens
tgggccaccagctccactggc

SEQ ID NO: 6491506 - DNA, 20 bp, Homo sapiens
tgggccaccaggatcagcca

SEQ ID NO: 6491507 - DNA, 23 bp, Homo sapiens
tgggccaccatgcactcaataaa

SEQ ID NO: 6491508 - DNA, 19 bp, Homo sapiens
tgggccaccatgtctggct

SEQ ID NO: 6491509 - DNA, 19 bp, Homo sapiens
tgggccacccaccagggct

SEQ ID NO: 6491510 - DNA, 16 bp, Homo sapiens
tgggccacctcctacc

SEQ ID NO: 6491511 - DNA, 15 bp, Homo sapiens
tgggccactctcccc

SEQ ID NO: 6491512 - DNA, 21 bp, Homo sapiens
tgggccactgccagcagctgt

SEQ ID NO: 6491513 - DNA, 18 bp, Homo sapiens
tgggccagacatgccaca

SEQ ID NO: 6491514 - DNA, 19 bp, Homo sapiens
tgggccagacatgccacaa

SEQ ID NO: 6491515 - DNA, 16 bp, Homo sapiens
tgggccagagctgaac

SEQ ID NO: 6491516 - DNA, 17 bp, Homo sapiens
tgggccagatgctgggc

SEQ ID NO: 6491517 - DNA, 20 bp, Homo sapiens
tgggccagatgctgggcagg

SEQ ID NO: 6491518 - DNA, 12 bp, Homo sapiens
tgggccagcaga

SEQ ID NO: 6491519 - DNA, 14 bp, Homo sapiens
tgggccagcagagc

SEQ ID NO: 6491520 - DNA, 19 bp, Homo sapiens
tgggccagcatagggggga

SEQ ID NO: 6491521 - DNA, 20 bp, Homo sapiens
tgggccagcccctcccacca

SEQ ID NO: 6491522 - DNA, 20 bp, Homo sapiens
tgggccagccgattcctcca

SEQ ID NO: 6491523 - DNA, 16 bp, Homo sapiens
tgggccagcctcagct

SEQ ID NO: 6491524 - DNA, 15 bp, Homo sapiens
tgggccagctgtcgc

SEQ ID NO: 6491525 - DNA, 17 bp, Homo sapiens
tgggccaggagctcagc

SEQ ID NO: 6491526 - DNA, 16 bp, Homo sapiens
tgggccaggcaggcga

SEQ ID NO: 6491527 - DNA, 12 bp, Homo sapiens
tgggccagggct

SEQ ID NO: 6491528 - DNA, 21 bp, Homo sapiens
tgggccagggctgccctgaga

SEQ ID NO: 6491529 - DNA, 22 bp, Homo sapiens
tgggccagggtctgtgtgaatg

SEQ ID NO: 6491530 - DNA, 17 bp, Homo sapiens
tgggccagtccccgagg

SEQ ID NO: 6491531 - DNA, 14 bp, Homo sapiens
tgggccagtcctgg

SEQ ID NO: 6491532 - DNA, 21 bp, Homo sapiens
tgggccagtcctggttgtctg

SEQ ID NO: 6491533 - DNA, 20 bp, Homo sapiens
tgggccagtctgtggatcag

SEQ ID NO: 6491534 - DNA, 14 bp, Homo sapiens
tgggccagtggcac

SEQ ID NO: 6491535 - DNA, 23 bp, Homo sapiens
tgggccagtggcactctgtgtgg

SEQ ID NO: 6491536 - DNA, 17 bp, Homo sapiens
tgggccatactggcctc

SEQ ID NO: 6491537 - DNA, 18 bp, Homo sapiens
tgggccatactggcctcg

SEQ ID NO: 6491538 - DNA, 24 bp, Homo sapiens
tgggccatactggcctcgcctggc

SEQ ID NO: 6491539 - DNA, 19 bp, Homo sapiens
tgggccatagtcattctgc

SEQ ID NO: 6491540 - DNA, 22 bp, Homo sapiens
tgggccatagtcattctgcctg

SEQ ID NO: 6491541 - DNA, 23 bp, Homo sapiens
tgggccatatgtgctatggagag

SEQ ID NO: 6491542 - DNA, 18 bp, Homo sapiens
tgggccatattccgcact

SEQ ID NO: 6491543 - DNA, 20 bp, Homo sapiens
tgggccatgcgaggggccag

SEQ ID NO: 6491544 - DNA, 21 bp, Homo sapiens
tgggccatggctttcatcctg

SEQ ID NO: 6491545 - DNA, 14 bp, Homo sapiens
tgggccatgtccaa

SEQ ID NO: 6491546 - DNA, 23 bp, Homo sapiens
tgggccatgtccaaagaggctgc

SEQ ID NO: 6491547 - DNA, 24 bp, Homo sapiens
tgggccatgtccaaagaggctgcc

SEQ ID NO: 6491548 - DNA, 13 bp, Homo sapiens
tgggccattaccc

SEQ ID NO: 6491549 - DNA, 15 bp, Homo sapiens
tgggccattacccca

SEQ ID NO: 6491550 - DNA, 17 bp, Homo sapiens
tgggcccaaaggcccag

SEQ ID NO: 6491551 - DNA, 21 bp, Homo sapiens
tgggcccaaaggcccagggag

SEQ ID NO: 6491552 - DNA, 22 bp, Homo sapiens
tgggcccaagacagatgcccca

SEQ ID NO: 6491553 - DNA, 18 bp, Homo sapiens
tgggcccaaggcccccac

SEQ ID NO: 6491554 - DNA, 14 bp, Homo sapiens
tgggcccacagagc

SEQ ID NO: 6491555 - DNA, 21 bp, Homo sapiens
tgggcccacagagcctggctt

SEQ ID NO: 6491556 - DNA, 13 bp, Homo sapiens
tgggcccacagcc

SEQ ID NO: 6491557 - DNA, 18 bp, Homo sapiens
tgggcccacagcccccac

SEQ ID NO: 6491558 - DNA, 19 bp, Homo sapiens
tgggcccacagcccccacc

SEQ ID NO: 6491559 - DNA, 23 bp, Homo sapiens
tgggcccacagcccccaccccag

SEQ ID NO: 6491560 - DNA, 19 bp, Homo sapiens
tgggcccacccaagcagga

SEQ ID NO: 6491561 - DNA, 22 bp, Homo sapiens
tgggcccagaactgcccccact

SEQ ID NO: 6491562 - DNA, 24 bp, Homo sapiens
tgggcccagagagaggcgtcctgg

SEQ ID NO: 6491563 - DNA, 17 bp, Homo sapiens
tgggcccagaggcacag

SEQ ID NO: 6491564 - DNA, 14 bp, Homo sapiens
tgggcccagatctg

SEQ ID NO: 6491565 - DNA, 14 bp, Homo sapiens
tgggcccagctggg

SEQ ID NO: 6491566 - DNA, 16 bp, Homo sapiens
tgggcccagctgggct

SEQ ID NO: 6491567 - DNA, 17 bp, Homo sapiens
tgggcccagctgggctc

SEQ ID NO: 6491568 - DNA, 20 bp, Homo sapiens
tgggcccaggaccagctggg

SEQ ID NO: 6491569 - DNA, 21 bp, Homo sapiens
tgggcccaggaggtcaagcct

SEQ ID NO: 6491570 - DNA, 15 bp, Homo sapiens
tgggcccaggcagca

SEQ ID NO: 6491571 - DNA, 17 bp, Homo sapiens
tgggcccaggcaggtct

SEQ ID NO: 6491572 - DNA, 18 bp, Homo sapiens
tgggcccaggcaggtctg

SEQ ID NO: 6491573 - DNA, 15 bp, Homo sapiens
tgggcccaggcccag

SEQ ID NO: 6491574 - DNA, 17 bp, Homo sapiens
tgggcccaggctctggg

SEQ ID NO: 6491575 - DNA, 12 bp, Homo sapiens
tgggcccaggga

SEQ ID NO: 6491576 - DNA, 14 bp, Homo sapiens
tgggcccagggaca

SEQ ID NO: 6491577 - DNA, 22 bp, Homo sapiens
tgggcccagggacaccagccag

SEQ ID NO: 6491578 - DNA, 18 bp, Homo sapiens
tgggcccatctccctgct

SEQ ID NO: 6491579 - DNA, 23 bp, Homo sapiens
tgggccccaccacctaggccact

SEQ ID NO: 6491580 - DNA, 14 bp, Homo sapiens
tgggccccaccctc

SEQ ID NO: 6491581 - DNA, 15 bp, Homo sapiens
tgggccccactggac

SEQ ID NO: 6491582 - DNA, 13 bp, Homo sapiens
tgggccccagccc

SEQ ID NO: 6491583 - DNA, 16 bp, Homo sapiens
tgggccccagccgtgg

SEQ ID NO: 6491584 - DNA, 15 bp, Homo sapiens
tgggccccaggcacc

SEQ ID NO: 6491585 - DNA, 17 bp, Homo sapiens
tgggccccagggaacta

SEQ ID NO: 6491586 - DNA, 21 bp, Homo sapiens
tgggccccaggggaacactgg

SEQ ID NO: 6491587 - DNA, 18 bp, Homo sapiens
tgggccccagttgtattt

SEQ ID NO: 6491588 - DNA, 22 bp, Homo sapiens
tgggccccagttgtatttattt

SEQ ID NO: 6491589 - DNA, 16 bp, Homo sapiens
tgggccccatgctctg

SEQ ID NO: 6491590 - DNA, 17 bp, Homo sapiens
tgggccccatgctctgc

SEQ ID NO: 6491591 - DNA, 19 bp, Homo sapiens
tgggccccatgctctgccc

SEQ ID NO: 6491592 - DNA, 19 bp, Homo sapiens
tgggccccatgttaacccc

SEQ ID NO: 6491593 - DNA, 19 bp, Homo sapiens
tgggccccattctccctcc

SEQ ID NO: 6491594 - DNA, 23 bp, Homo sapiens
tgggcccccagagacctttgccc

SEQ ID NO: 6491595 - DNA, 18 bp, Homo sapiens
tgggcccccagcctggcc

SEQ ID NO: 6491596 - DNA, 18 bp, Homo sapiens
tgggccccccagctcagg

SEQ ID NO: 6491597 - DNA, 19 bp, Homo sapiens
tgggccccccagctcaggg

SEQ ID NO: 6491598 - DNA, 16 bp, Homo sapiens
tgggccccgagccacg

SEQ ID NO: 6491599 - DNA, 19 bp, Homo sapiens
tgggccccgggctggagaa

SEQ ID NO: 6491600 - DNA, 14 bp, Homo sapiens
tgggcccctcaaca

SEQ ID NO: 6491601 - DNA, 14 bp, Homo sapiens
tgggcccctcaggg

SEQ ID NO: 6491602 - DNA, 16 bp, Homo sapiens
tgggcccctcagggga

SEQ ID NO: 6491603 - DNA, 23 bp, Homo sapiens
tgggcccctcaggggaagctgct

SEQ ID NO: 6491604 - DNA, 14 bp, Homo sapiens
tgggcccctcccta

SEQ ID NO: 6491605 - DNA, 19 bp, Homo sapiens
tgggcccctccctacctca

SEQ ID NO: 6491606 - DNA, 15 bp, Homo sapiens
tgggcccctctccca

SEQ ID NO: 6491607 - DNA, 17 bp, Homo sapiens
tgggcccctcttattcc

SEQ ID NO: 6491608 - DNA, 14 bp, Homo sapiens
tgggcccctgagga

SEQ ID NO: 6491609 - DNA, 13 bp, Homo sapiens
tgggcccctgcac

SEQ ID NO: 6491610 - DNA, 15 bp, Homo sapiens
tgggcccctgccaga

SEQ ID NO: 6491611 - DNA, 20 bp, Homo sapiens
tgggcccctgcctctctgca

SEQ ID NO: 6491612 - DNA, 23 bp, Homo sapiens
tgggcccctgcctctctgcaggt

SEQ ID NO: 6491613 - DNA, 14 bp, Homo sapiens
tgggcccctgctca

SEQ ID NO: 6491614 - DNA, 15 bp, Homo sapiens
tgggcccctggcact

SEQ ID NO: 6491615 - DNA, 13 bp, Homo sapiens
tgggcccctgggg

SEQ ID NO: 6491616 - DNA, 21 bp, Homo sapiens
tgggcccctggggacagagcc

SEQ ID NO: 6491617 - DNA, 21 bp, Homo sapiens
tgggcccgagggtcccaaggc

SEQ ID NO: 6491618 - DNA, 14 bp, Homo sapiens
tgggcccgctgcct

SEQ ID NO: 6491619 - DNA, 15 bp, Homo sapiens
tgggcccgctgcctc

SEQ ID NO: 6491620 - DNA, 18 bp, Homo sapiens
tgggcccgctgcctcttg

SEQ ID NO: 6491621 - DNA, 22 bp, Homo sapiens
tgggcccggagtaatcaggcag

SEQ ID NO: 6491622 - DNA, 16 bp, Homo sapiens
tgggcccgggcaggcc

SEQ ID NO: 6491623 - DNA, 18 bp, Homo sapiens
tgggcccgggcaggccag

SEQ ID NO: 6491624 - DNA, 23 bp, Homo sapiens
tgggcccggtccacaggtccaag

SEQ ID NO: 6491625 - DNA, 13 bp, Homo sapiens
tgggccctaccct

SEQ ID NO: 6491626 - DNA, 18 bp, Homo sapiens
tgggccctaccctcctgc

SEQ ID NO: 6491627 - DNA, 13 bp, Homo sapiens
tgggccctaggca

SEQ ID NO: 6491628 - DNA, 18 bp, Homo sapiens
tgggccctaggcatactc

SEQ ID NO: 6491629 - DNA, 20 bp, Homo sapiens
tgggccctcaagctttcctg

SEQ ID NO: 6491630 - DNA, 11 bp, Homo sapiens
tgggccctcct

SEQ ID NO: 6491631 - DNA, 13 bp, Homo sapiens
tgggccctctctt

SEQ ID NO: 6491632 - DNA, 13 bp, Homo sapiens
tgggccctctggt

SEQ ID NO: 6491633 - DNA, 14 bp, Homo sapiens
tgggccctctggtt

SEQ ID NO: 6491634 - DNA, 17 bp, Homo sapiens
tgggccctctgtccaca

SEQ ID NO: 6491635 - DNA, 19 bp, Homo sapiens
tgggccctctttccctgcg

SEQ ID NO: 6491636 - DNA, 23 bp, Homo sapiens
tgggccctctttccctgcgagac

SEQ ID NO: 6491637 - DNA, 15 bp, Homo sapiens
tgggccctgagccag

SEQ ID NO: 6491638 - DNA, 23 bp, Homo sapiens
tgggccctgcaggaggcctggga

SEQ ID NO: 6491639 - DNA, 21 bp, Homo sapiens
tgggccctgcattggcctggc

SEQ ID NO: 6491640 - DNA, 11 bp, Homo sapiens
tgggccctgcc

SEQ ID NO: 6491641 - DNA, 13 bp, Homo sapiens
tgggccctgcccg

SEQ ID NO: 6491642 - DNA, 12 bp, Homo sapiens
tgggccctgcct

SEQ ID NO: 6491643 - DNA, 13 bp, Homo sapiens
tgggccctgcctg

SEQ ID NO: 6491644 - DNA, 21 bp, Homo sapiens
tgggccctgcctgcagccagg

SEQ ID NO: 6491645 - DNA, 22 bp, Homo sapiens
tgggccctgcctgcagccaggg

SEQ ID NO: 6491646 - DNA, 19 bp, Homo sapiens
tgggccctggaggggccca

SEQ ID NO: 6491647 - DNA, 22 bp, Homo sapiens
tgggccctggaggggcccatgt

SEQ ID NO: 6491648 - DNA, 15 bp, Homo sapiens
tgggccctgggctga

SEQ ID NO: 6491649 - DNA, 16 bp, Homo sapiens
tgggccctggggcctg

SEQ ID NO: 6491650 - DNA, 22 bp, Homo sapiens
tgggccctggggcctgtactgc

SEQ ID NO: 6491651 - DNA, 19 bp, Homo sapiens
tgggccctggttcccccag

SEQ ID NO: 6491652 - DNA, 20 bp, Homo sapiens
tgggccctggttcccccagg

SEQ ID NO: 6491653 - DNA, 21 bp, Homo sapiens
tgggccctgtcgcccctcctt

SEQ ID NO: 6491654 - DNA, 22 bp, Homo sapiens
tgggcccttagaatgtgaaaaa

SEQ ID NO: 6491655 - DNA, 14 bp, Homo sapiens
tgggcccttcctgg

SEQ ID NO: 6491656 - DNA, 13 bp, Homo sapiens
tgggccctttgag

SEQ ID NO: 6491657 - DNA, 22 bp, Homo sapiens
tgggccgaacctgatacctgcc

SEQ ID NO: 6491658 - DNA, 17 bp, Homo sapiens
tgggccgaatcccccag

SEQ ID NO: 6491659 - DNA, 14 bp, Homo sapiens
tgagaccactgtta

SEQ ID NO: 6491660 - DNA, 13 bp, Homo sapiens
tgagaccagaagg

SEQ ID NO: 6491661 - DNA, 13 bp, Homo sapiens
tgagaccagcctg

SEQ ID NO: 6491662 - DNA, 16 bp, Homo sapiens
tgagaccagcctgcca

SEQ ID NO: 6491663 - DNA, 17 bp, Homo sapiens
tgagaccagcctgccag

SEQ ID NO: 6491664 - DNA, 18 bp, Homo sapiens
tgagaccagcctgccagg

SEQ ID NO: 6491665 - DNA, 22 bp, Homo sapiens
tgagaccagcctgccaggccct

SEQ ID NO: 6491666 - DNA, 23 bp, Homo sapiens
tgagaccagcctgccaggccctc

SEQ ID NO: 6491667 - DNA, 19 bp, Homo sapiens
tgagaccagcctgggcaac

SEQ ID NO: 6491668 - DNA, 14 bp, Homo sapiens
tgagaccagggtgg

SEQ ID NO: 6491669 - DNA, 18 bp, Homo sapiens
tgagaccagggtggccac

SEQ ID NO: 6491670 - DNA, 20 bp, Homo sapiens
tgagaccagggtggccacac

SEQ ID NO: 6491671 - DNA, 22 bp, Homo sapiens
tgagaccagtgtatcaggtcag

SEQ ID NO: 6491672 - DNA, 21 bp, Homo sapiens
tgagaccagttgggagcactg

SEQ ID NO: 6491673 - DNA, 23 bp, Homo sapiens
tgagaccagttgggagcactgga

SEQ ID NO: 6491674 - DNA, 22 bp, Homo sapiens
tgagaccatccattctcctcag

SEQ ID NO: 6491675 - DNA, 10 bp, Homo sapiens
tgagacccag

SEQ ID NO: 6491676 - DNA, 15 bp, Homo sapiens
tgagacccagcccct

SEQ ID NO: 6491677 - DNA, 21 bp, Homo sapiens
tgagacccagccccttcccct

SEQ ID NO: 6491678 - DNA, 21 bp, Homo sapiens
tgagacccattcctatttctt

SEQ ID NO: 6491679 - DNA, 22 bp, Homo sapiens
tgagacccccacacctcagttc

SEQ ID NO: 6491680 - DNA, 13 bp, Homo sapiens
tgagacccctggc

SEQ ID NO: 6491681 - DNA, 16 bp, Homo sapiens
tgagacccctggcctc

SEQ ID NO: 6491682 - DNA, 15 bp, Homo sapiens
tgagacccctgtctc

SEQ ID NO: 6491683 - DNA, 16 bp, Homo sapiens
tgagacccctttaaac

SEQ ID NO: 6491684 - DNA, 17 bp, Homo sapiens
tgagacccctttaaact

SEQ ID NO: 6491685 - DNA, 18 bp, Homo sapiens
tgagacccctttaaactg

SEQ ID NO: 6491686 - DNA, 22 bp, Homo sapiens
tgagaccctactgaagtggctg

SEQ ID NO: 6491687 - DNA, 19 bp, Homo sapiens
tgagaccctcgcagaccta

SEQ ID NO: 6491688 - DNA, 20 bp, Homo sapiens
tgagaccctcttctctgggc

SEQ ID NO: 6491689 - DNA, 22 bp, Homo sapiens
tgagaccctcttctctgggccc

SEQ ID NO: 6491690 - DNA, 16 bp, Homo sapiens
tgagaccctgggagag

SEQ ID NO: 6491691 - DNA, 13 bp, Homo sapiens
tgagaccctggtg

SEQ ID NO: 6491692 - DNA, 13 bp, Homo sapiens
tgagaccctgtct

SEQ ID NO: 6491693 - DNA, 15 bp, Homo sapiens
tgagaccctgttcta

SEQ ID NO: 6491694 - DNA, 16 bp, Homo sapiens
tgagacccttttctca

SEQ ID NO: 6491695 - DNA, 18 bp, Homo sapiens
tgagacccttttctcagg

SEQ ID NO: 6491696 - DNA, 13 bp, Homo sapiens
tgagacctcagcc

SEQ ID NO: 6491697 - DNA, 17 bp, Homo sapiens
tgagacctcccccaggg

SEQ ID NO: 6491698 - DNA, 21 bp, Homo sapiens
tgagacctcccccagggaggg

SEQ ID NO: 6491699 - DNA, 13 bp, Homo sapiens
tgagacctgacca

SEQ ID NO: 6491700 - DNA, 14 bp, Homo sapiens
tgagacctgcccct

SEQ ID NO: 6491701 - DNA, 22 bp, Homo sapiens
tgagacctgcccctcctctctg

SEQ ID NO: 6491702 - DNA, 23 bp, Homo sapiens
tgagacggagtctcgctctgtca

SEQ ID NO: 6491703 - DNA, 23 bp, Homo sapiens
tgagacggagtcttgctctgtag

SEQ ID NO: 6491704 - DNA, 15 bp, Homo sapiens
tgagactaaatgaga

SEQ ID NO: 6491705 - DNA, 16 bp, Homo sapiens
tgagactaagagaaac

SEQ ID NO: 6491706 - DNA, 15 bp, Homo sapiens
tgagactacaggtga

SEQ ID NO: 6491707 - DNA, 22 bp, Homo sapiens
tgagactataaagcagtagaca

SEQ ID NO: 6491708 - DNA, 19 bp, Homo sapiens
tgagactcacactctctgc

SEQ ID NO: 6491709 - DNA, 21 bp, Homo sapiens
tgagactcacactctctgcag

SEQ ID NO: 6491710 - DNA, 17 bp, Homo sapiens
tgagactcagtgcagat

SEQ ID NO: 6491711 - DNA, 21 bp, Homo sapiens
tgagactccagaatctgctgt

SEQ ID NO: 6491712 - DNA, 19 bp, Homo sapiens
tgagactcccgcctttgac

SEQ ID NO: 6491713 - DNA, 21 bp, Homo sapiens
tgagactcctcagcacccctc

SEQ ID NO: 6491714 - DNA, 15 bp, Homo sapiens
tgagactcgagaact

SEQ ID NO: 6491715 - DNA, 16 bp, Homo sapiens
tgagactcgagaactt

SEQ ID NO: 6491716 - DNA, 19 bp, Homo sapiens
tgagactcgcgacaatgca

SEQ ID NO: 6491717 - DNA, 19 bp, Homo sapiens
tgagactctcttaggagca

SEQ ID NO: 6491718 - DNA, 20 bp, Homo sapiens
tgagactctgtctcaaaaaa

SEQ ID NO: 6491719 - DNA, 18 bp, Homo sapiens
tgagactgaaagaaacta

SEQ ID NO: 6491720 - DNA, 16 bp, Homo sapiens
tgagactgcaggtggg

SEQ ID NO: 6491721 - DNA, 19 bp, Homo sapiens
tgagactgcaggtgggctg

SEQ ID NO: 6491722 - DNA, 15 bp, Homo sapiens
tgagactgccccacg

SEQ ID NO: 6491723 - DNA, 16 bp, Homo sapiens
tgagactgccctgccc

SEQ ID NO: 6491724 - DNA, 14 bp, Homo sapiens
tgagactggaaaag

SEQ ID NO: 6491725 - DNA, 14 bp, Homo sapiens
tgagactgggaact

SEQ ID NO: 6491726 - DNA, 21 bp, Homo sapiens
tgagactgggtaatttataaa

SEQ ID NO: 6491727 - DNA, 15 bp, Homo sapiens
tgagactgtacataa

SEQ ID NO: 6491728 - DNA, 21 bp, Homo sapiens
tgagactgtacataattgcat

SEQ ID NO: 6491729 - DNA, 17 bp, Homo sapiens
tgagactgtcaggaagt

SEQ ID NO: 6491730 - DNA, 21 bp, Homo sapiens
tgagactgtcggagaggctgt

SEQ ID NO: 6491731 - DNA, 17 bp, Homo sapiens
tgagacttaaaacatgg

SEQ ID NO: 6491732 - DNA, 18 bp, Homo sapiens
tgagacttaaaacatggt

SEQ ID NO: 6491733 - DNA, 21 bp, Homo sapiens
tgagacttaattttgtctttc

SEQ ID NO: 6491734 - DNA, 15 bp, Homo sapiens
tgagacttagataat

SEQ ID NO: 6491735 - DNA, 22 bp, Homo sapiens
tgagacttcctattaatttatt

SEQ ID NO: 6491736 - DNA, 20 bp, Homo sapiens
tgagacttgctctctggcct

SEQ ID NO: 6491737 - DNA, 12 bp, Homo sapiens
tgagactttaaa

SEQ ID NO: 6491738 - DNA, 20 bp, Homo sapiens
tgagactttaaaagcatttt

SEQ ID NO: 6491739 - DNA, 21 bp, Homo sapiens
tgagactttccgactgctttt

SEQ ID NO: 6491740 - DNA, 15 bp, Homo sapiens
tgagactttgcccag

SEQ ID NO: 6491741 - DNA, 14 bp, Homo sapiens
tgagagaaaagaaa

SEQ ID NO: 6491742 - DNA, 17 bp, Homo sapiens
tgagagaaacgtgaaac

SEQ ID NO: 6491743 - DNA, 15 bp, Homo sapiens
tgagagaagggacac

SEQ ID NO: 6491744 - DNA, 16 bp, Homo sapiens
tgagagaagttgggag

SEQ ID NO: 6491745 - DNA, 17 bp, Homo sapiens
tgagagaatctgcctgt

SEQ ID NO: 6491746 - DNA, 15 bp, Homo sapiens
tgagagaatggagac

SEQ ID NO: 6491747 - DNA, 16 bp, Homo sapiens
tgagagaatggagaca

SEQ ID NO: 6491748 - DNA, 15 bp, Homo sapiens
tgagagaatgtggaa

SEQ ID NO: 6491749 - DNA, 18 bp, Homo sapiens
tgagagaattgtatcatt

SEQ ID NO: 6491750 - DNA, 19 bp, Homo sapiens
tgagagacacactgaagaa

SEQ ID NO: 6491751 - DNA, 21 bp, Homo sapiens
tgagagacacactgaagaagc

SEQ ID NO: 6491752 - DNA, 14 bp, Homo sapiens
tgagagacacgctg

SEQ ID NO: 6491753 - DNA, 16 bp, Homo sapiens
tgagagacagtaacac

SEQ ID NO: 6491754 - DNA, 18 bp, Homo sapiens
tgagagacattaactcat

SEQ ID NO: 6491755 - DNA, 15 bp, Homo sapiens
tgagagaccctggcc

SEQ ID NO: 6491756 - DNA, 19 bp, Homo sapiens
tgagagacctgccctctct

SEQ ID NO: 6491757 - DNA, 17 bp, Homo sapiens
tgagagacctgctcagg

SEQ ID NO: 6491758 - DNA, 16 bp, Homo sapiens
tgagagacctgtgtga

SEQ ID NO: 6491759 - DNA, 21 bp, Homo sapiens
tgagagacctgtgtgaactat

SEQ ID NO: 6491760 - DNA, 22 bp, Homo sapiens
tgagagacgccactccctggga

SEQ ID NO: 6491761 - DNA, 19 bp, Homo sapiens
tgagagacgccctatttct

SEQ ID NO: 6491762 - DNA, 22 bp, Homo sapiens
tgagagactgccatacataata

SEQ ID NO: 6491763 - DNA, 12 bp, Homo sapiens
tgagagactttt

SEQ ID NO: 6491764 - DNA, 13 bp, Homo sapiens
tgagagagaaaag

SEQ ID NO: 6491765 - DNA, 19 bp, Homo sapiens
tgagagagaatgaggaagc

SEQ ID NO: 6491766 - DNA, 15 bp, Homo sapiens
tgagagagacaagaa

SEQ ID NO: 6491767 - DNA, 15 bp, Homo sapiens
tgagagagagactgt

SEQ ID NO: 6491768 - DNA, 15 bp, Homo sapiens
tgagagagagtgaga

SEQ ID NO: 6491769 - DNA, 16 bp, Homo sapiens
tgagagagagtgagag

SEQ ID NO: 6491770 - DNA, 18 bp, Homo sapiens
tgagagagagtgagagca

SEQ ID NO: 6491771 - DNA, 16 bp, Homo sapiens
tgagagagatgggagc

SEQ ID NO: 6491772 - DNA, 17 bp, Homo sapiens
tgagagagatgggagct

SEQ ID NO: 6491773 - DNA, 15 bp, Homo sapiens
tgagagaggaggcct

SEQ ID NO: 6491774 - DNA, 13 bp, Homo sapiens
tgagagaggccat

SEQ ID NO: 6491775 - DNA, 19 bp, Homo sapiens
tgagagaggctaaaatgtt

SEQ ID NO: 6491776 - DNA, 21 bp, Homo sapiens
tgagagaggctaaaatgtttt

SEQ ID NO: 6491777 - DNA, 20 bp, Homo sapiens
tgagagagtagttttgaaca

SEQ ID NO: 6491778 - DNA, 15 bp, Homo sapiens
tgagagagtgctgag

SEQ ID NO: 6491779 - DNA, 22 bp, Homo sapiens
tgagagagtggctggggcatgg

SEQ ID NO: 6491780 - DNA, 15 bp, Homo sapiens
tgagagagtgtggaa

SEQ ID NO: 6491781 - DNA, 23 bp, Homo sapiens
tgagagatgctgtagacatctgt

SEQ ID NO: 6491782 - DNA, 21 bp, Homo sapiens
tgagagattctgtgatctttt

SEQ ID NO: 6491783 - DNA, 12 bp, Homo sapiens
tgagagcaaatg

SEQ ID NO: 6491784 - DNA, 15 bp, Homo sapiens
tgagagcacaaagat

SEQ ID NO: 6491785 - DNA, 16 bp, Homo sapiens
tgagagcacagcgttt

SEQ ID NO: 6491786 - DNA, 21 bp, Homo sapiens
tgagagcagtttggtttctag

SEQ ID NO: 6491787 - DNA, 18 bp, Homo sapiens
tgagagcatctcaggagg

SEQ ID NO: 6491788 - DNA, 18 bp, Homo sapiens
tgagagccacgctggcct

SEQ ID NO: 6491789 - DNA, 23 bp, Homo sapiens
tgagagcccaagttatctttccc

SEQ ID NO: 6491790 - DNA, 12 bp, Homo sapiens
tgagagccccag

SEQ ID NO: 6491791 - DNA, 19 bp, Homo sapiens
tgagagccctgctgtggga

SEQ ID NO: 6491792 - DNA, 20 bp, Homo sapiens
tgagagccctgctgtgggag

SEQ ID NO: 6491793 - DNA, 16 bp, Homo sapiens
tgagagcgacacagac

SEQ ID NO: 6491794 - DNA, 18 bp, Homo sapiens
tgagagcgacacagacgt

SEQ ID NO: 6491795 - DNA, 15 bp, Homo sapiens
tgagagcgaggctga

SEQ ID NO: 6491796 - DNA, 19 bp, Homo sapiens
tgagagcgaggctgagcct

SEQ ID NO: 6491797 - DNA, 12 bp, Homo sapiens
tgagagctgagc

SEQ ID NO: 6491798 - DNA, 19 bp, Homo sapiens
tgagagctgctctggaaaa

SEQ ID NO: 6491799 - DNA, 12 bp, Homo sapiens
tgagagctgctg

SEQ ID NO: 6491800 - DNA, 16 bp, Homo sapiens
tgagagctgctgaggg

SEQ ID NO: 6491801 - DNA, 19 bp, Homo sapiens
tgagagctgctgagggacc

SEQ ID NO: 6491802 - DNA, 23 bp, Homo sapiens
tgagagctgctgagggaccttgg

SEQ ID NO: 6491803 - DNA, 17 bp, Homo sapiens
tgagagctgtgcatcag

SEQ ID NO: 6491804 - DNA, 12 bp, Homo sapiens
tgagagctttat

SEQ ID NO: 6491805 - DNA, 13 bp, Homo sapiens
tgagaggaaatca

SEQ ID NO: 6491806 - DNA, 18 bp, Homo sapiens
tgagaggacagattgtta

SEQ ID NO: 6491807 - DNA, 23 bp, Homo sapiens
tgagaggacttttctttgtggct

SEQ ID NO: 6491808 - DNA, 18 bp, Homo sapiens
tgagaggagaaatgcaat

SEQ ID NO: 6491809 - DNA, 19 bp, Homo sapiens
tgagaggagacttgtgaat

SEQ ID NO: 6491810 - DNA, 18 bp, Homo sapiens
tgagaggaggggtaaata

SEQ ID NO: 6491811 - DNA, 18 bp, Homo sapiens
tgagaggatgaacatctt

SEQ ID NO: 6491812 - DNA, 12 bp, Homo sapiens
tgagaggcagct

SEQ ID NO: 6491813 - DNA, 13 bp, Homo sapiens
tgagaggcagcta

SEQ ID NO: 6491814 - DNA, 16 bp, Homo sapiens
tgagaggcaggaatgg

SEQ ID NO: 6491815 - DNA, 13 bp, Homo sapiens
tgagaggcaggca

SEQ ID NO: 6491816 - DNA, 15 bp, Homo sapiens
tgagaggcatgacag

SEQ ID NO: 6491817 - DNA, 19 bp, Homo sapiens
tgagaggcatgacagctgt

SEQ ID NO: 6491818 - DNA, 14 bp, Homo sapiens
tgagaggcatttcc

SEQ ID NO: 6491819 - DNA, 17 bp, Homo sapiens
tgagaggcccccaccct

SEQ ID NO: 6491820 - DNA, 18 bp, Homo sapiens
tgagaggcccccaccctt

SEQ ID NO: 6491821 - DNA, 16 bp, Homo sapiens
tgagaggccctggatc

SEQ ID NO: 6491822 - DNA, 21 bp, Homo sapiens
tgagaggcctggagcccacaa

SEQ ID NO: 6491823 - DNA, 21 bp, Homo sapiens
tgagaggcgacaggagtattt

SEQ ID NO: 6491824 - DNA, 19 bp, Homo sapiens
tgagaggcgagctccttga

SEQ ID NO: 6491825 - DNA, 20 bp, Homo sapiens
tgagaggcgagtcaccctcc

SEQ ID NO: 6491826 - DNA, 19 bp, Homo sapiens
tgagaggctgaggtgggca

SEQ ID NO: 6491827 - DNA, 20 bp, Homo sapiens
tgagagggatgcagtgcctt

SEQ ID NO: 6491828 - DNA, 21 bp, Homo sapiens
tgagagggcagtgtttccttt

SEQ ID NO: 6491829 - DNA, 17 bp, Homo sapiens
tgagagggcatgcgcac

SEQ ID NO: 6491830 - DNA, 22 bp, Homo sapiens
tgagagggcatgcgcacaaggc

SEQ ID NO: 6491831 - DNA, 16 bp, Homo sapiens
tgagagggccctgcct

SEQ ID NO: 6491832 - DNA, 18 bp, Homo sapiens
tgagaggggaacagactg

SEQ ID NO: 6491833 - DNA, 13 bp, Homo sapiens
tgagaggggagag

SEQ ID NO: 6491834 - DNA, 12 bp, Homo sapiens
tgagaggggagg

SEQ ID NO: 6491835 - DNA, 15 bp, Homo sapiens
tgagaggggagggag

SEQ ID NO: 6491836 - DNA, 14 bp, Homo sapiens
tgagaggggagggc

SEQ ID NO: 6491837 - DNA, 19 bp, Homo sapiens
tgagaggggcgccttttca

SEQ ID NO: 6491838 - DNA, 21 bp, Homo sapiens
tgggccgaatcccccagggaa

SEQ ID NO: 6491839 - DNA, 13 bp, Homo sapiens
tgggccgagccac

SEQ ID NO: 6491840 - DNA, 15 bp, Homo sapiens
tgggccgaggccgct

SEQ ID NO: 6491841 - DNA, 21 bp, Homo sapiens
tgggccgcaagggcctggacg

SEQ ID NO: 6491842 - DNA, 14 bp, Homo sapiens
tgggccgcccctgg

SEQ ID NO: 6491843 - DNA, 22 bp, Homo sapiens
tgggccgcgtgccgggccccca

SEQ ID NO: 6491844 - DNA, 14 bp, Homo sapiens
tgggccgctgcacc

SEQ ID NO: 6491845 - DNA, 13 bp, Homo sapiens
tgggccgctgcca

SEQ ID NO: 6491846 - DNA, 18 bp, Homo sapiens
tgggccggccccaggctc

SEQ ID NO: 6491847 - DNA, 14 bp, Homo sapiens
tgggccggctgagt

SEQ ID NO: 6491848 - DNA, 18 bp, Homo sapiens
tgggccggctgagtggca

SEQ ID NO: 6491849 - DNA, 21 bp, Homo sapiens
tgggccggctgagtggcagca

SEQ ID NO: 6491850 - DNA, 17 bp, Homo sapiens
tgggccgggcccagggc

SEQ ID NO: 6491851 - DNA, 18 bp, Homo sapiens
tgggccgggcccagggcc

SEQ ID NO: 6491852 - DNA, 21 bp, Homo sapiens
tgggccgggcccagggcctct

SEQ ID NO: 6491853 - DNA, 23 bp, Homo sapiens
tgggccgggcccagggcctctgg

SEQ ID NO: 6491854 - DNA, 14 bp, Homo sapiens
tgggccgtatctgt

SEQ ID NO: 6491855 - DNA, 17 bp, Homo sapiens
tgggccgtatctgtcac

SEQ ID NO: 6491856 - DNA, 18 bp, Homo sapiens
tgggccgtatctgtcaca

SEQ ID NO: 6491857 - DNA, 14 bp, Homo sapiens
tgggccgtcccctc

SEQ ID NO: 6491858 - DNA, 15 bp, Homo sapiens
tgggccgtcccctct

SEQ ID NO: 6491859 - DNA, 16 bp, Homo sapiens
tgggccgtcccctctc

SEQ ID NO: 6491860 - DNA, 18 bp, Homo sapiens
tgggcctaggccaggagt

SEQ ID NO: 6491861 - DNA, 15 bp, Homo sapiens
tgggcctaggctgca

SEQ ID NO: 6491862 - DNA, 21 bp, Homo sapiens
tgggcctatggagagccctgg

SEQ ID NO: 6491863 - DNA, 22 bp, Homo sapiens
tgggcctatggagagccctggg

SEQ ID NO: 6491864 - DNA, 23 bp, Homo sapiens
tgggcctcaaggacttgaaagca

SEQ ID NO: 6491865 - DNA, 17 bp, Homo sapiens
tgggcctcacctgcccc

SEQ ID NO: 6491866 - DNA, 16 bp, Homo sapiens
tgggcctcaggctctg

SEQ ID NO: 6491867 - DNA, 17 bp, Homo sapiens
tgggcctcaggctctgc

SEQ ID NO: 6491868 - DNA, 19 bp, Homo sapiens
tgggcctcaggctctgcac

SEQ ID NO: 6491869 - DNA, 19 bp, Homo sapiens
tgggcctcagtgtgcccat

SEQ ID NO: 6491870 - DNA, 22 bp, Homo sapiens
tgggcctcagtgtgcccatctg

SEQ ID NO: 6491871 - DNA, 18 bp, Homo sapiens
tgggcctcatctgctcct

SEQ ID NO: 6491872 - DNA, 13 bp, Homo sapiens
tgggcctccacct

SEQ ID NO: 6491873 - DNA, 14 bp, Homo sapiens
tgggcctccacctc

SEQ ID NO: 6491874 - DNA, 20 bp, Homo sapiens
tgggcctccacctctgtgca

SEQ ID NO: 6491875 - DNA, 21 bp, Homo sapiens
tgggcctccacctctgtgcag

SEQ ID NO: 6491876 - DNA, 22 bp, Homo sapiens
tgggcctccatgccccagctct

SEQ ID NO: 6491877 - DNA, 16 bp, Homo sapiens
tgggcctcccactccc

SEQ ID NO: 6491878 - DNA, 20 bp, Homo sapiens
tgggcctcccactcccatgg

SEQ ID NO: 6491879 - DNA, 22 bp, Homo sapiens
tgggcctcccactcccatggct

SEQ ID NO: 6491880 - DNA, 15 bp, Homo sapiens
tgggcctcccctggg

SEQ ID NO: 6491881 - DNA, 22 bp, Homo sapiens
tgggcctcccttgggctggaag

SEQ ID NO: 6491882 - DNA, 13 bp, Homo sapiens
tgggcctcctcac

SEQ ID NO: 6491883 - DNA, 17 bp, Homo sapiens
tgggcctcctcctagct

SEQ ID NO: 6491884 - DNA, 20 bp, Homo sapiens
tgggcctcctcctagctgga

SEQ ID NO: 6491885 - DNA, 23 bp, Homo sapiens
tgggcctcctcctagctggagtg

SEQ ID NO: 6491886 - DNA, 14 bp, Homo sapiens
tgggcctcctgtgt

SEQ ID NO: 6491887 - DNA, 19 bp, Homo sapiens
tgggcctcggcccctccca

SEQ ID NO: 6491888 - DNA, 20 bp, Homo sapiens
tgggcctctcctgccctctg

SEQ ID NO: 6491889 - DNA, 21 bp, Homo sapiens
tgggcctctcctgccctctgc

SEQ ID NO: 6491890 - DNA, 14 bp, Homo sapiens
tgggcctctctggg

SEQ ID NO: 6491891 - DNA, 17 bp, Homo sapiens
tgggcctctctggggga

SEQ ID NO: 6491892 - DNA, 21 bp, Homo sapiens
tgggcctctctgggggaggca

SEQ ID NO: 6491893 - DNA, 22 bp, Homo sapiens
tgggcctctctgggggaggcag

SEQ ID NO: 6491894 - DNA, 16 bp, Homo sapiens
tgggcctctgcccctc

SEQ ID NO: 6491895 - DNA, 20 bp, Homo sapiens
tgggcctctgcttctctcac

SEQ ID NO: 6491896 - DNA, 14 bp, Homo sapiens
tgggcctcttattt

SEQ ID NO: 6491897 - DNA, 15 bp, Homo sapiens
tgggcctgacctcca

SEQ ID NO: 6491898 - DNA, 16 bp, Homo sapiens
tgggcctgacctccag

SEQ ID NO: 6491899 - DNA, 23 bp, Homo sapiens
tgggcctgacctccagtcctgct

SEQ ID NO: 6491900 - DNA, 22 bp, Homo sapiens
tgggcctgactgttgcccccca

SEQ ID NO: 6491901 - DNA, 13 bp, Homo sapiens
tgggcctgcagaa

SEQ ID NO: 6491902 - DNA, 20 bp, Homo sapiens
tgggcctgcccaatgctttg

SEQ ID NO: 6491903 - DNA, 12 bp, Homo sapiens
tgggcctgcctg

SEQ ID NO: 6491904 - DNA, 17 bp, Homo sapiens
tgggcctgcctgcctcc

SEQ ID NO: 6491905 - DNA, 19 bp, Homo sapiens
tgggcctgctccagacctg

SEQ ID NO: 6491906 - DNA, 20 bp, Homo sapiens
tgggcctgctccagacctga

SEQ ID NO: 6491907 - DNA, 20 bp, Homo sapiens
tgggcctgctgaggccttct

SEQ ID NO: 6491908 - DNA, 12 bp, Homo sapiens
tgggcctgctgc

SEQ ID NO: 6491909 - DNA, 13 bp, Homo sapiens
tgggcctgcttcc

SEQ ID NO: 6491910 - DNA, 20 bp, Homo sapiens
tgggcctgcttttccaggat

SEQ ID NO: 6491911 - DNA, 17 bp, Homo sapiens
tgggcctggagccctgg

SEQ ID NO: 6491912 - DNA, 13 bp, Homo sapiens
tgggcctggccag

SEQ ID NO: 6491913 - DNA, 15 bp, Homo sapiens
tgggcctggccagtc

SEQ ID NO: 6491914 - DNA, 13 bp, Homo sapiens
tgggcctggccct

SEQ ID NO: 6491915 - DNA, 16 bp, Homo sapiens
tgggcctggccctgct

SEQ ID NO: 6491916 - DNA, 17 bp, Homo sapiens
tgggcctggcggcctgt

SEQ ID NO: 6491917 - DNA, 21 bp, Homo sapiens
tgggcctggcggcctgtgggt

SEQ ID NO: 6491918 - DNA, 14 bp, Homo sapiens
tgggcctggctccc

SEQ ID NO: 6491919 - DNA, 21 bp, Homo sapiens
tgggcctggctccctcactct

SEQ ID NO: 6491920 - DNA, 16 bp, Homo sapiens
tgggcctgggcctctg

SEQ ID NO: 6491921 - DNA, 15 bp, Homo sapiens
tgggcctgggctcct

SEQ ID NO: 6491922 - DNA, 20 bp, Homo sapiens
tgggcctgggctcctggacc

SEQ ID NO: 6491923 - DNA, 22 bp, Homo sapiens
tgggcctggtctcaccctggag

SEQ ID NO: 6491924 - DNA, 15 bp, Homo sapiens
tgggcctgtctcaga

SEQ ID NO: 6491925 - DNA, 13 bp, Homo sapiens
tgggcctgtgcac

SEQ ID NO: 6491926 - DNA, 14 bp, Homo sapiens
tgggcctgtgcact

SEQ ID NO: 6491927 - DNA, 22 bp, Homo sapiens
tgggcctgtgcactgggcaggt

SEQ ID NO: 6491928 - DNA, 17 bp, Homo sapiens
tgggcctgtgcagcagc

SEQ ID NO: 6491929 - DNA, 18 bp, Homo sapiens
tgggcctgtgcagcagcc

SEQ ID NO: 6491930 - DNA, 21 bp, Homo sapiens
tgggcctgtgcagcagcccag

SEQ ID NO: 6491931 - DNA, 13 bp, Homo sapiens
tgggcctgtgtgt

SEQ ID NO: 6491932 - DNA, 14 bp, Homo sapiens
tgggcctgttctct

SEQ ID NO: 6491933 - DNA, 23 bp, Homo sapiens
tgggccttacctcccctgccagg

SEQ ID NO: 6491934 - DNA, 15 bp, Homo sapiens
tgggccttaggaaga

SEQ ID NO: 6491935 - DNA, 18 bp, Homo sapiens
tgggccttcagggagtga

SEQ ID NO: 6491936 - DNA, 12 bp, Homo sapiens
tgggccttgctg

SEQ ID NO: 6491937 - DNA, 14 bp, Homo sapiens
tgggccttgctgct

SEQ ID NO: 6491938 - DNA, 17 bp, Homo sapiens
tgggccttgctgctgct

SEQ ID NO: 6491939 - DNA, 12 bp, Homo sapiens
tgggccttggcc

SEQ ID NO: 6491940 - DNA, 17 bp, Homo sapiens
tgggccttggctgggcc

SEQ ID NO: 6491941 - DNA, 15 bp, Homo sapiens
tgggccttgggctcc

SEQ ID NO: 6491942 - DNA, 13 bp, Homo sapiens
tgggcctttccag

SEQ ID NO: 6491943 - DNA, 13 bp, Homo sapiens
tgggcctttcctg

SEQ ID NO: 6491944 - DNA, 15 bp, Homo sapiens
tgggcctttcctgtg

SEQ ID NO: 6491945 - DNA, 15 bp, Homo sapiens
tgggcgaaagggtga

SEQ ID NO: 6491946 - DNA, 13 bp, Homo sapiens
tgggcgacagagc

SEQ ID NO: 6491947 - DNA, 22 bp, Homo sapiens
tgggcgagcatgggggctgcca

SEQ ID NO: 6491948 - DNA, 21 bp, Homo sapiens
tgggcgagcccctccttctcc

SEQ ID NO: 6491949 - DNA, 20 bp, Homo sapiens
tgggcgagtcccggagcccc

SEQ ID NO: 6491950 - DNA, 23 bp, Homo sapiens
tgggcgatttgggggctcgggga

SEQ ID NO: 6491951 - DNA, 16 bp, Homo sapiens
tgggcgcaaaggtgcc

SEQ ID NO: 6491952 - DNA, 22 bp, Homo sapiens
tgggcgcagctgaagcctggac

SEQ ID NO: 6491953 - DNA, 14 bp, Homo sapiens
tgggcgcaggccca

SEQ ID NO: 6491954 - DNA, 21 bp, Homo sapiens
tgggcgcccaccctgggctcc

SEQ ID NO: 6491955 - DNA, 22 bp, Homo sapiens
tgggcgcccaccctgggctcca

SEQ ID NO: 6491956 - DNA, 21 bp, Homo sapiens
tgggcgccggttccacgtggg

SEQ ID NO: 6491957 - DNA, 19 bp, Homo sapiens
tgggcgccgtgctgggcag

SEQ ID NO: 6491958 - DNA, 23 bp, Homo sapiens
tgggcgccgtgctgggcagcccg

SEQ ID NO: 6491959 - DNA, 22 bp, Homo sapiens
tgggcgcggtggctcacgcctg

SEQ ID NO: 6491960 - DNA, 21 bp, Homo sapiens
tgggcgctctccctaccttgc

SEQ ID NO: 6491961 - DNA, 22 bp, Homo sapiens
tgggcgctctgccctccctggc

SEQ ID NO: 6491962 - DNA, 21 bp, Homo sapiens
tgggcggacaaaagggccagg

SEQ ID NO: 6491963 - DNA, 20 bp, Homo sapiens
tgggcggacggctgtggacc

SEQ ID NO: 6491964 - DNA, 15 bp, Homo sapiens
tgggcggcacagcct

SEQ ID NO: 6491965 - DNA, 16 bp, Homo sapiens
tgggcggctgagagcc

SEQ ID NO: 6491966 - DNA, 21 bp, Homo sapiens
tgggcggctgagagccccagc

SEQ ID NO: 6491967 - DNA, 14 bp, Homo sapiens
tgggcgggacacag

SEQ ID NO: 6491968 - DNA, 14 bp, Homo sapiens
tgggcggggccttg

SEQ ID NO: 6491969 - DNA, 16 bp, Homo sapiens
tgggcggggccttgcg

SEQ ID NO: 6491970 - DNA, 17 bp, Homo sapiens
tgggcgtacgctggtgc

SEQ ID NO: 6491971 - DNA, 14 bp, Homo sapiens
tgggcgtccagctc

SEQ ID NO: 6491972 - DNA, 15 bp, Homo sapiens
tgggcgtctgactcc

SEQ ID NO: 6491973 - DNA, 23 bp, Homo sapiens
tgggcgtgctagaggttgcagca

SEQ ID NO: 6491974 - DNA, 23 bp, Homo sapiens
tgggcgtggcctgcataggctcc

SEQ ID NO: 6491975 - DNA, 22 bp, Homo sapiens
tgggcgtggtagtgcaagctga

SEQ ID NO: 6491976 - DNA, 16 bp, Homo sapiens
tgggcgttgggagcct

SEQ ID NO: 6491977 - DNA, 19 bp, Homo sapiens
tgggcgttgggagcctagc

SEQ ID NO: 6491978 - DNA, 16 bp, Homo sapiens
tgggcgtttggggccc

SEQ ID NO: 6491979 - DNA, 20 bp, Homo sapiens
tgggcgtttggggccctcta

SEQ ID NO: 6491980 - DNA, 16 bp, Homo sapiens
tgggcgtttgtaaatt

SEQ ID NO: 6491981 - DNA, 18 bp, Homo sapiens
tgggcgtttgtaaattct

SEQ ID NO: 6491982 - DNA, 12 bp, Homo sapiens
tgggctaagcag

SEQ ID NO: 6491983 - DNA, 18 bp, Homo sapiens
tgggctacaaaccaggag

SEQ ID NO: 6491984 - DNA, 19 bp, Homo sapiens
tgggctacaaaccaggagc

SEQ ID NO: 6491985 - DNA, 20 bp, Homo sapiens
tgggctaccctaaagggaga

SEQ ID NO: 6491986 - DNA, 18 bp, Homo sapiens
tgggctactggcagctcc

SEQ ID NO: 6491987 - DNA, 19 bp, Homo sapiens
tgggctactggcagctcct

SEQ ID NO: 6491988 - DNA, 16 bp, Homo sapiens
tgggctactttgtcct

SEQ ID NO: 6491989 - DNA, 19 bp, Homo sapiens
tgggctagagtttccttat

SEQ ID NO: 6491990 - DNA, 14 bp, Homo sapiens
tgggctaggcctcc

SEQ ID NO: 6491991 - DNA, 22 bp, Homo sapiens
tgggctagggagaatgcagaga

SEQ ID NO: 6491992 - DNA, 19 bp, Homo sapiens
tgggctagtgtgagtggca

SEQ ID NO: 6491993 - DNA, 15 bp, Homo sapiens
tgggctatggacaca

SEQ ID NO: 6491994 - DNA, 18 bp, Homo sapiens
tgggctatggacacaggg

SEQ ID NO: 6491995 - DNA, 21 bp, Homo sapiens
tgggctatggacacagggtga

SEQ ID NO: 6491996 - DNA, 17 bp, Homo sapiens
tgggctattgctgctgc

SEQ ID NO: 6491997 - DNA, 21 bp, Homo sapiens
tgggctattgctgctgcccct

SEQ ID NO: 6491998 - DNA, 20 bp, Homo sapiens
tgggctcaaatgatcctccc

SEQ ID NO: 6491999 - DNA, 20 bp, Homo sapiens
tgggctcaagcaatcctcct

SEQ ID NO: 6492000 - DNA, 22 bp, Homo sapiens
tgggctcaagcaatcctcctgc

SEQ ID NO: 6492001 - DNA, 16 bp, Homo sapiens
tgggctcaagcagtct

SEQ ID NO: 6492002 - DNA, 18 bp, Homo sapiens
tgggctcaagctttcccg

SEQ ID NO: 6492003 - DNA, 20 bp, Homo sapiens
tgggctcaagtgatcctcac

SEQ ID NO: 6492004 - DNA, 22 bp, Homo sapiens
tgggctcaagtgatcttcccac

SEQ ID NO: 6492005 - DNA, 14 bp, Homo sapiens
tgggctcacaccag

SEQ ID NO: 6492006 - DNA, 20 bp, Homo sapiens
tgggctcacaccagccctgg

SEQ ID NO: 6492007 - DNA, 15 bp, Homo sapiens
tgggctcacaccggc

SEQ ID NO: 6492008 - DNA, 19 bp, Homo sapiens
tgggctcacattcccaagg

SEQ ID NO: 6492009 - DNA, 14 bp, Homo sapiens
tgggctcagcaggg

SEQ ID NO: 6492010 - DNA, 17 bp, Homo sapiens
tgggctcagcagggctg

SEQ ID NO: 6492011 - DNA, 23 bp, Homo sapiens
tgggctcagcagggctggtcacc

SEQ ID NO: 6492012 - DNA, 23 bp, Homo sapiens
tgggctcagcctgagcctctgct

SEQ ID NO: 6492013 - DNA, 14 bp, Homo sapiens
tgggctcagcctgg

SEQ ID NO: 6492014 - DNA, 12 bp, Homo sapiens
tgggctcagggc

SEQ ID NO: 6492015 - DNA, 21 bp, Homo sapiens
tgagaggggcgccttttcagc

SEQ ID NO: 6492016 - DNA, 18 bp, Homo sapiens
tgagagggggatgcccct

SEQ ID NO: 6492017 - DNA, 22 bp, Homo sapiens
tgagagggggatgcccctggcc

SEQ ID NO: 6492018 - DNA, 20 bp, Homo sapiens
tgagaggtagccgggctctg

SEQ ID NO: 6492019 - DNA, 18 bp, Homo sapiens
tgagaggtgaaagcataa

SEQ ID NO: 6492020 - DNA, 20 bp, Homo sapiens
tgagaggtgggggatgctga

SEQ ID NO: 6492021 - DNA, 22 bp, Homo sapiens
tgagaggtgggggatgctgagg

SEQ ID NO: 6492022 - DNA, 22 bp, Homo sapiens
tgagaggtttgactagatgatg

SEQ ID NO: 6492023 - DNA, 17 bp, Homo sapiens
tgagaggtttgcatcca

SEQ ID NO: 6492024 - DNA, 12 bp, Homo sapiens
tgagagtaagca

SEQ ID NO: 6492025 - DNA, 21 bp, Homo sapiens
tgagagtaattcatctgtgaa

SEQ ID NO: 6492026 - DNA, 14 bp, Homo sapiens
tgagagtagggccc

SEQ ID NO: 6492027 - DNA, 23 bp, Homo sapiens
tgagagtatttaggcagattgaa

SEQ ID NO: 6492028 - DNA, 16 bp, Homo sapiens
tgagagtcagctctct

SEQ ID NO: 6492029 - DNA, 14 bp, Homo sapiens
tgagagtcatctca

SEQ ID NO: 6492030 - DNA, 15 bp, Homo sapiens
tgagagtcatctcaa

SEQ ID NO: 6492031 - DNA, 17 bp, Homo sapiens
tgagagtcattcaggtg

SEQ ID NO: 6492032 - DNA, 15 bp, Homo sapiens
tgagagtctagattc

SEQ ID NO: 6492033 - DNA, 21 bp, Homo sapiens
tgagagtctagcactcatttt

SEQ ID NO: 6492034 - DNA, 13 bp, Homo sapiens
tgagagtggcttt

SEQ ID NO: 6492035 - DNA, 14 bp, Homo sapiens
tgagagtggggcta

SEQ ID NO: 6492036 - DNA, 16 bp, Homo sapiens
tgagagtgtctctgat

SEQ ID NO: 6492037 - DNA, 21 bp, Homo sapiens
tgagagtgtctctgataaaag

SEQ ID NO: 6492038 - DNA, 22 bp, Homo sapiens
tgagagtgtcttcacggcagga

SEQ ID NO: 6492039 - DNA, 14 bp, Homo sapiens
tgagagttcacaga

SEQ ID NO: 6492040 - DNA, 14 bp, Homo sapiens
tgagagttccagat

SEQ ID NO: 6492041 - DNA, 18 bp, Homo sapiens
tgagagttggctcaggca

SEQ ID NO: 6492042 - DNA, 19 bp, Homo sapiens
tgagagttggctcaggcag

SEQ ID NO: 6492043 - DNA, 20 bp, Homo sapiens
tgagagttggctcaggcaga

SEQ ID NO: 6492044 - DNA, 20 bp, Homo sapiens
tgagagttggggagaaactg

SEQ ID NO: 6492045 - DNA, 17 bp, Homo sapiens
tgagagttgtctctgtt

SEQ ID NO: 6492046 - DNA, 20 bp, Homo sapiens
tgagagtttcctcagaaccc

SEQ ID NO: 6492047 - DNA, 23 bp, Homo sapiens
tgagagtttctggattagctttt

SEQ ID NO: 6492048 - DNA, 18 bp, Homo sapiens
tgagagttttgtcttgaa

SEQ ID NO: 6492049 - DNA, 15 bp, Homo sapiens
tgagataaagtcaaa

SEQ ID NO: 6492050 - DNA, 22 bp, Homo sapiens
tgagataaccacaaccaggaag

SEQ ID NO: 6492051 - DNA, 15 bp, Homo sapiens
tgagataacttcctt

SEQ ID NO: 6492052 - DNA, 16 bp, Homo sapiens
tgagataacttccttc

SEQ ID NO: 6492053 - DNA, 20 bp, Homo sapiens
tgagataagtaggctggttt

SEQ ID NO: 6492054 - DNA, 16 bp, Homo sapiens
tgagataatatctgtg

SEQ ID NO: 6492055 - DNA, 19 bp, Homo sapiens
tgagataatatgagatttc

SEQ ID NO: 6492056 - DNA, 21 bp, Homo sapiens
tgagataatctaaatataaac

SEQ ID NO: 6492057 - DNA, 22 bp, Homo sapiens
tgagataatgtgatattataca

SEQ ID NO: 6492058 - DNA, 15 bp, Homo sapiens
tgagataatgttctg

SEQ ID NO: 6492059 - DNA, 14 bp, Homo sapiens
tgagataatttaac

SEQ ID NO: 6492060 - DNA, 13 bp, Homo sapiens
tgagatacaaagc

SEQ ID NO: 6492061 - DNA, 19 bp, Homo sapiens
tgagatacccagagagaaa

SEQ ID NO: 6492062 - DNA, 23 bp, Homo sapiens
tgagatacccagagagaaaaaga

SEQ ID NO: 6492063 - DNA, 16 bp, Homo sapiens
tgagatacgtctgtga

SEQ ID NO: 6492064 - DNA, 16 bp, Homo sapiens
tgagatactatcatta

SEQ ID NO: 6492065 - DNA, 23 bp, Homo sapiens
tgagatactttttcttttgtaag

SEQ ID NO: 6492066 - DNA, 15 bp, Homo sapiens
tgagatagaagaact

SEQ ID NO: 6492067 - DNA, 21 bp, Homo sapiens
tgagatagaagaactgcaaag

SEQ ID NO: 6492068 - DNA, 16 bp, Homo sapiens
tgagatagcattgtga

SEQ ID NO: 6492069 - DNA, 20 bp, Homo sapiens
tgagatagcccatcttcctg

SEQ ID NO: 6492070 - DNA, 18 bp, Homo sapiens
tgagatagcttagtgtct

SEQ ID NO: 6492071 - DNA, 16 bp, Homo sapiens
tgagatagcttcccca

SEQ ID NO: 6492072 - DNA, 17 bp, Homo sapiens
tgagatagttttcatcc

SEQ ID NO: 6492073 - DNA, 18 bp, Homo sapiens
tgagatagttttcatcca

SEQ ID NO: 6492074 - DNA, 21 bp, Homo sapiens
tgagatagttttcatccataa

SEQ ID NO: 6492075 - DNA, 17 bp, Homo sapiens
tgagatagttttcattt

SEQ ID NO: 6492076 - DNA, 22 bp, Homo sapiens
tgagatagttttcattttaact

SEQ ID NO: 6492077 - DNA, 20 bp, Homo sapiens
tgagatatacaaatatattt

SEQ ID NO: 6492078 - DNA, 18 bp, Homo sapiens
tgagatatgcaataaata

SEQ ID NO: 6492079 - DNA, 14 bp, Homo sapiens
tgagatattaaatt

SEQ ID NO: 6492080 - DNA, 12 bp, Homo sapiens
tgagatattaat

SEQ ID NO: 6492081 - DNA, 20 bp, Homo sapiens
tgagatattaatgcccagac

SEQ ID NO: 6492082 - DNA, 14 bp, Homo sapiens
tgagatattatttt

SEQ ID NO: 6492083 - DNA, 15 bp, Homo sapiens
tgagatatttattgt

SEQ ID NO: 6492084 - DNA, 20 bp, Homo sapiens
tgagatatttattgtttatt

SEQ ID NO: 6492085 - DNA, 23 bp, Homo sapiens
tgagatcaaaaaaatatatgaca

SEQ ID NO: 6492086 - DNA, 15 bp, Homo sapiens
tgagatcaaaacggt

SEQ ID NO: 6492087 - DNA, 15 bp, Homo sapiens
tgagatcaatgtgac

SEQ ID NO: 6492088 - DNA, 17 bp, Homo sapiens
tgagatcacaccactgc

SEQ ID NO: 6492089 - DNA, 14 bp, Homo sapiens
tgagatcacagcct

SEQ ID NO: 6492090 - DNA, 17 bp, Homo sapiens
tgagatcacagcctcca

SEQ ID NO: 6492091 - DNA, 19 bp, Homo sapiens
tgagatcacagcctccagg

SEQ ID NO: 6492092 - DNA, 21 bp, Homo sapiens
tgagatcacagcctccagggc

SEQ ID NO: 6492093 - DNA, 20 bp, Homo sapiens
tgagatcacgccattgtact

SEQ ID NO: 6492094 - DNA, 12 bp, Homo sapiens
tgagatcactga

SEQ ID NO: 6492095 - DNA, 18 bp, Homo sapiens
tgagatcactgactctga

SEQ ID NO: 6492096 - DNA, 22 bp, Homo sapiens
tgagatcactgactctgactca

SEQ ID NO: 6492097 - DNA, 16 bp, Homo sapiens
tgagatcagcattcaa

SEQ ID NO: 6492098 - DNA, 13 bp, Homo sapiens
tgagatcaggctc

SEQ ID NO: 6492099 - DNA, 22 bp, Homo sapiens
tgagatcagggcctgccccctg

SEQ ID NO: 6492100 - DNA, 16 bp, Homo sapiens
tgagatccagagaggc

SEQ ID NO: 6492101 - DNA, 22 bp, Homo sapiens
tgagatccagcacaactcagtc

SEQ ID NO: 6492102 - DNA, 12 bp, Homo sapiens
tgagatcccctg

SEQ ID NO: 6492103 - DNA, 16 bp, Homo sapiens
tgagatcccctgagcc

SEQ ID NO: 6492104 - DNA, 21 bp, Homo sapiens
tgagatccgtgaattctcgga

SEQ ID NO: 6492105 - DNA, 19 bp, Homo sapiens
tgagatcctcaaaaatcat

SEQ ID NO: 6492106 - DNA, 21 bp, Homo sapiens
tgagatcctcaaaaatcatca

SEQ ID NO: 6492107 - DNA, 20 bp, Homo sapiens
tgagatcctctttactctgg

SEQ ID NO: 6492108 - DNA, 23 bp, Homo sapiens
tgagatcctggagtgatatgatc

SEQ ID NO: 6492109 - DNA, 18 bp, Homo sapiens
tgagatccttccttttga

SEQ ID NO: 6492110 - DNA, 23 bp, Homo sapiens
tgagatcgtgctactgcactcca

SEQ ID NO: 6492111 - DNA, 22 bp, Homo sapiens
tgagatctaaaaataactgtaa

SEQ ID NO: 6492112 - DNA, 18 bp, Homo sapiens
tgagatctccctccaggg

SEQ ID NO: 6492113 - DNA, 19 bp, Homo sapiens
tgagatctccctccaggga

SEQ ID NO: 6492114 - DNA, 20 bp, Homo sapiens
tgagatctgctgtcctgttt

SEQ ID NO: 6492115 - DNA, 22 bp, Homo sapiens
tgagatctgctgtcctgtttct

SEQ ID NO: 6492116 - DNA, 15 bp, Homo sapiens
tgagatctgtataaa

SEQ ID NO: 6492117 - DNA, 18 bp, Homo sapiens
tgagatctgtataaataa

SEQ ID NO: 6492118 - DNA, 15 bp, Homo sapiens
tgagatctttctaaa

SEQ ID NO: 6492119 - DNA, 22 bp, Homo sapiens
tgagatgaaaaaaatacatcta

SEQ ID NO: 6492120 - DNA, 22 bp, Homo sapiens
tgagatgaaccctggcatttgg

SEQ ID NO: 6492121 - DNA, 17 bp, Homo sapiens
tgagatgagaggggaga

SEQ ID NO: 6492122 - DNA, 22 bp, Homo sapiens
tgagatgagggatgggcctggc

SEQ ID NO: 6492123 - DNA, 18 bp, Homo sapiens
tgagatgaggttttggaa

SEQ ID NO: 6492124 - DNA, 16 bp, Homo sapiens
tgagatgagtttctgg

SEQ ID NO: 6492125 - DNA, 20 bp, Homo sapiens
tgagatgagtttctggggaa

SEQ ID NO: 6492126 - DNA, 21 bp, Homo sapiens
tgagatgataaagtcccctta

SEQ ID NO: 6492127 - DNA, 15 bp, Homo sapiens
tgagatgatttaatt

SEQ ID NO: 6492128 - DNA, 18 bp, Homo sapiens
tgagatgatttaattctt

SEQ ID NO: 6492129 - DNA, 16 bp, Homo sapiens
tgagatgcagctggaa

SEQ ID NO: 6492130 - DNA, 20 bp, Homo sapiens
tgagatgctagaactccctt

SEQ ID NO: 6492131 - DNA, 15 bp, Homo sapiens
tgagatgctggcttg

SEQ ID NO: 6492132 - DNA, 16 bp, Homo sapiens
tgagatgctgggaggg

SEQ ID NO: 6492133 - DNA, 14 bp, Homo sapiens
tgagatgctgggct

SEQ ID NO: 6492134 - DNA, 19 bp, Homo sapiens
tgagatgcttcactttcct

SEQ ID NO: 6492135 - DNA, 17 bp, Homo sapiens
tgagatggagaggctga

SEQ ID NO: 6492136 - DNA, 18 bp, Homo sapiens
tgagatggagaggctgag

SEQ ID NO: 6492137 - DNA, 13 bp, Homo sapiens
tgagatggagctg

SEQ ID NO: 6492138 - DNA, 18 bp, Homo sapiens
tgagatggagtctcactc

SEQ ID NO: 6492139 - DNA, 19 bp, Homo sapiens
tgagatggatggacagaca

SEQ ID NO: 6492140 - DNA, 15 bp, Homo sapiens
tgagatggccctctg

SEQ ID NO: 6492141 - DNA, 16 bp, Homo sapiens
tgagatggtatgaaat

SEQ ID NO: 6492142 - DNA, 19 bp, Homo sapiens
tgagatggtgccccctggg

SEQ ID NO: 6492143 - DNA, 23 bp, Homo sapiens
tgagatggtggcattttgagaat

SEQ ID NO: 6492144 - DNA, 16 bp, Homo sapiens
tgagatggttcccaat

SEQ ID NO: 6492145 - DNA, 22 bp, Homo sapiens
tgagatggttcccaatatcatg

SEQ ID NO: 6492146 - DNA, 13 bp, Homo sapiens
tgagatgtagagt

SEQ ID NO: 6492147 - DNA, 16 bp, Homo sapiens
tgagatgtagagtttt

SEQ ID NO: 6492148 - DNA, 23 bp, Homo sapiens
tgagatgtagcccctctcctgga

SEQ ID NO: 6492149 - DNA, 17 bp, Homo sapiens
tgagatgtatgaaggct

SEQ ID NO: 6492150 - DNA, 13 bp, Homo sapiens
tgagatgtctgcg

SEQ ID NO: 6492151 - DNA, 15 bp, Homo sapiens
tgagatgtgagcctt

SEQ ID NO: 6492152 - DNA, 17 bp, Homo sapiens
tgagatgtgagccttgt

SEQ ID NO: 6492153 - DNA, 15 bp, Homo sapiens
tgagatgtgatgctg

SEQ ID NO: 6492154 - DNA, 16 bp, Homo sapiens
tgagatgtgctttgct

SEQ ID NO: 6492155 - DNA, 19 bp, Homo sapiens
tgagatgtgtatcagtgtt

SEQ ID NO: 6492156 - DNA, 12 bp, Homo sapiens
tgagatgtgtga

SEQ ID NO: 6492157 - DNA, 16 bp, Homo sapiens
tgagatgtgttcctcc

SEQ ID NO: 6492158 - DNA, 17 bp, Homo sapiens
tgagatgttgtgtggca

SEQ ID NO: 6492159 - DNA, 18 bp, Homo sapiens
tgagatgttgtgtggcaa

SEQ ID NO: 6492160 - DNA, 16 bp, Homo sapiens
tgagattaaaaatcta

SEQ ID NO: 6492161 - DNA, 12 bp, Homo sapiens
tgagattcaaga

SEQ ID NO: 6492162 - DNA, 17 bp, Homo sapiens
tgagattcaatattgaa

SEQ ID NO: 6492163 - DNA, 23 bp, Homo sapiens
tgagattcaatattgaatttttc

SEQ ID NO: 6492164 - DNA, 12 bp, Homo sapiens
tgagattccaga

SEQ ID NO: 6492165 - DNA, 17 bp, Homo sapiens
tgagattccagaacgcc

SEQ ID NO: 6492166 - DNA, 21 bp, Homo sapiens
tgagattccagaacgccctgt

SEQ ID NO: 6492167 - DNA, 19 bp, Homo sapiens
tgagattctaaatgttcat

SEQ ID NO: 6492168 - DNA, 21 bp, Homo sapiens
tgagattctgaagtatgaagt

SEQ ID NO: 6492169 - DNA, 21 bp, Homo sapiens
tgagattctgggaaaggtgct

SEQ ID NO: 6492170 - DNA, 20 bp, Homo sapiens
tgagattggaaaaaattaga

SEQ ID NO: 6492171 - DNA, 19 bp, Homo sapiens
tgagattggtcattaaata

SEQ ID NO: 6492172 - DNA, 13 bp, Homo sapiens
tgagattggtttt

SEQ ID NO: 6492173 - DNA, 15 bp, Homo sapiens
tgagattggttttcc

SEQ ID NO: 6492174 - DNA, 19 bp, Homo sapiens
tgagattggttttcctgtg

SEQ ID NO: 6492175 - DNA, 22 bp, Homo sapiens
tgagattggttttcctgtggca

SEQ ID NO: 6492176 - DNA, 13 bp, Homo sapiens
tgagattgtacat

SEQ ID NO: 6492177 - DNA, 16 bp, Homo sapiens
tgagattgtacatttt

SEQ ID NO: 6492178 - DNA, 12 bp, Homo sapiens
tgagattgtcct

SEQ ID NO: 6492179 - DNA, 16 bp, Homo sapiens
tgagattgtcctcatt

SEQ ID NO: 6492180 - DNA, 18 bp, Homo sapiens
tgagattgtgtttgttca

SEQ ID NO: 6492181 - DNA, 23 bp, Homo sapiens
tgagatttaacccctccactgct

SEQ ID NO: 6492182 - DNA, 16 bp, Homo sapiens
tgagatttattaaaga

SEQ ID NO: 6492183 - DNA, 14 bp, Homo sapiens
tgagatttcacagg

SEQ ID NO: 6492184 - DNA, 13 bp, Homo sapiens
tgagatttcatct

SEQ ID NO: 6492185 - DNA, 17 bp, Homo sapiens
tgagatttcctcctggc

SEQ ID NO: 6492186 - DNA, 18 bp, Homo sapiens
tgagatttcttaaatctt

SEQ ID NO: 6492187 - DNA, 18 bp, Homo sapiens
tgagatttgccagcacag

SEQ ID NO: 6492188 - DNA, 15 bp, Homo sapiens
tgagatttgtaaatc

SEQ ID NO: 6492189 - DNA, 19 bp, Homo sapiens
tgagattttcctccatttt

SEQ ID NO: 6492190 - DNA, 23 bp, Homo sapiens
tgagattttgtatatttaggaaa

SEQ ID NO: 6492191 - DNA, 14 bp, Homo sapiens
tgagatttttaaga

SEQ ID NO: 6492192 - DNA, 22 bp, Homo sapiens
tgggctcagggccaggtcctca

SEQ ID NO: 6492193 - DNA, 15 bp, Homo sapiens
tgggctccacacagc

SEQ ID NO: 6492194 - DNA, 23 bp, Homo sapiens
tgggctccacacagcagtgtccc

SEQ ID NO: 6492195 - DNA, 16 bp, Homo sapiens
tgggctccagagtagg

SEQ ID NO: 6492196 - DNA, 13 bp, Homo sapiens
tgggctcccacgc

SEQ ID NO: 6492197 - DNA, 22 bp, Homo sapiens
tgggctcccacgccctcctccc

SEQ ID NO: 6492198 - DNA, 12 bp, Homo sapiens
tgggctccccag

SEQ ID NO: 6492199 - DNA, 14 bp, Homo sapiens
tgggctccccagga

SEQ ID NO: 6492200 - DNA, 16 bp, Homo sapiens
tgggctcccctcttcc

SEQ ID NO: 6492201 - DNA, 15 bp, Homo sapiens
tgggctccctgactg

SEQ ID NO: 6492202 - DNA, 17 bp, Homo sapiens
tgggctccctggaggac

SEQ ID NO: 6492203 - DNA, 19 bp, Homo sapiens
tgggctccctggcccagcc

SEQ ID NO: 6492204 - DNA, 19 bp, Homo sapiens
tgggctcccttcccacctc

SEQ ID NO: 6492205 - DNA, 15 bp, Homo sapiens
tgggctcccttcctc

SEQ ID NO: 6492206 - DNA, 17 bp, Homo sapiens
tgggctcccttgtgcgt

SEQ ID NO: 6492207 - DNA, 19 bp, Homo sapiens
tgggctccctttgctgctg

SEQ ID NO: 6492208 - DNA, 17 bp, Homo sapiens
tgggctccgctgtgccc

SEQ ID NO: 6492209 - DNA, 21 bp, Homo sapiens
tgggctccggaggactcacca

SEQ ID NO: 6492210 - DNA, 14 bp, Homo sapiens
tgggctcctgcccc

SEQ ID NO: 6492211 - DNA, 15 bp, Homo sapiens
tgggctcctgcccct

SEQ ID NO: 6492212 - DNA, 11 bp, Homo sapiens
tgggctcctgg

SEQ ID NO: 6492213 - DNA, 19 bp, Homo sapiens
tgggctcctggaaccaatc

SEQ ID NO: 6492214 - DNA, 18 bp, Homo sapiens
tgggctcctggacccccc

SEQ ID NO: 6492215 - DNA, 23 bp, Homo sapiens
tgggctcctggcagaagggagca

SEQ ID NO: 6492216 - DNA, 14 bp, Homo sapiens
tgggctcctggctg

SEQ ID NO: 6492217 - DNA, 15 bp, Homo sapiens
tgggctcctggctgc

SEQ ID NO: 6492218 - DNA, 15 bp, Homo sapiens
tgggctctacctctc

SEQ ID NO: 6492219 - DNA, 18 bp, Homo sapiens
tgggctctcacccagtcc

SEQ ID NO: 6492220 - DNA, 18 bp, Homo sapiens
tgggctctccacctcagc

SEQ ID NO: 6492221 - DNA, 13 bp, Homo sapiens
tgggctctccggg

SEQ ID NO: 6492222 - DNA, 15 bp, Homo sapiens
tgggctctcgcggcc

SEQ ID NO: 6492223 - DNA, 20 bp, Homo sapiens
tgggctctctctagctcccc

SEQ ID NO: 6492224 - DNA, 19 bp, Homo sapiens
tgggctctctggacctgac

SEQ ID NO: 6492225 - DNA, 23 bp, Homo sapiens
tgggctctctggacctgaccaga

SEQ ID NO: 6492226 - DNA, 23 bp, Homo sapiens
tgggctctgaacacacacgccag

SEQ ID NO: 6492227 - DNA, 23 bp, Homo sapiens
tgggctctgacccaagtggggcc

SEQ ID NO: 6492228 - DNA, 11 bp, Homo sapiens
tgggctctgat

SEQ ID NO: 6492229 - DNA, 14 bp, Homo sapiens
tgggctctgatgaa

SEQ ID NO: 6492230 - DNA, 20 bp, Homo sapiens
tgggctctgcaattcccctc

SEQ ID NO: 6492231 - DNA, 22 bp, Homo sapiens
tgggctctgcaattcccctctg

SEQ ID NO: 6492232 - DNA, 17 bp, Homo sapiens
tgggctctgccccagct

SEQ ID NO: 6492233 - DNA, 20 bp, Homo sapiens
tgggctctgccccagctctg

SEQ ID NO: 6492234 - DNA, 21 bp, Homo sapiens
tgggctctgccccagctctgg

SEQ ID NO: 6492235 - DNA, 14 bp, Homo sapiens
tgggctctgcgtcc

SEQ ID NO: 6492236 - DNA, 12 bp, Homo sapiens
tgggctctgctg

SEQ ID NO: 6492237 - DNA, 15 bp, Homo sapiens
tgggctctgctgagt

SEQ ID NO: 6492238 - DNA, 12 bp, Homo sapiens
tgggctctggac

SEQ ID NO: 6492239 - DNA, 14 bp, Homo sapiens
tgggctctggactc

SEQ ID NO: 6492240 - DNA, 13 bp, Homo sapiens
tgggctctggctc

SEQ ID NO: 6492241 - DNA, 17 bp, Homo sapiens
tgggctctgtgggctgc

SEQ ID NO: 6492242 - DNA, 18 bp, Homo sapiens
tgggctctgttcttggct

SEQ ID NO: 6492243 - DNA, 19 bp, Homo sapiens
tgggctcttaactgttgct

SEQ ID NO: 6492244 - DNA, 13 bp, Homo sapiens
tgggctcttccaa

SEQ ID NO: 6492245 - DNA, 14 bp, Homo sapiens
tgggctcttggccg

SEQ ID NO: 6492246 - DNA, 17 bp, Homo sapiens
tgggctgaacactccaa

SEQ ID NO: 6492247 - DNA, 18 bp, Homo sapiens
tgggctgaactgagccta

SEQ ID NO: 6492248 - DNA, 18 bp, Homo sapiens
tgggctgaatgtatgtaa

SEQ ID NO: 6492249 - DNA, 21 bp, Homo sapiens
tgggctgaatgtatgtaaata

SEQ ID NO: 6492250 - DNA, 19 bp, Homo sapiens
tgggctgacacctaccatg

SEQ ID NO: 6492251 - DNA, 23 bp, Homo sapiens
tgggctgacatcaagtgtaatta

SEQ ID NO: 6492252 - DNA, 21 bp, Homo sapiens
tgggctgaccccggtggcggc

SEQ ID NO: 6492253 - DNA, 18 bp, Homo sapiens
tgggctgagccaaagcca

SEQ ID NO: 6492254 - DNA, 20 bp, Homo sapiens
tgggctgagccaaagccaga

SEQ ID NO: 6492255 - DNA, 17 bp, Homo sapiens
tgggctgagcccctacc

SEQ ID NO: 6492256 - DNA, 20 bp, Homo sapiens
tgggctgagcccctggtctt

SEQ ID NO: 6492257 - DNA, 22 bp, Homo sapiens
tgggctgagcccctggtcttct

SEQ ID NO: 6492258 - DNA, 18 bp, Homo sapiens
tgggctgagccctggcag

SEQ ID NO: 6492259 - DNA, 20 bp, Homo sapiens
tgggctgagctagcctccag

SEQ ID NO: 6492260 - DNA, 17 bp, Homo sapiens
tgggctgaggaggcagt

SEQ ID NO: 6492261 - DNA, 12 bp, Homo sapiens
tgggctgaggga

SEQ ID NO: 6492262 - DNA, 17 bp, Homo sapiens
tgggctgagtgacacaa

SEQ ID NO: 6492263 - DNA, 18 bp, Homo sapiens
tgggctgagtgacacaag

SEQ ID NO: 6492264 - DNA, 16 bp, Homo sapiens
tgggctgatggcctgg

SEQ ID NO: 6492265 - DNA, 16 bp, Homo sapiens
tgggctgatttacatg

SEQ ID NO: 6492266 - DNA, 20 bp, Homo sapiens
tgggctgcaaaatgaagaca

SEQ ID NO: 6492267 - DNA, 21 bp, Homo sapiens
tgggctgcagcagaggcactg

SEQ ID NO: 6492268 - DNA, 17 bp, Homo sapiens
tgggctgccaccagccc

SEQ ID NO: 6492269 - DNA, 18 bp, Homo sapiens
tgggctgccaccagcccc

SEQ ID NO: 6492270 - DNA, 19 bp, Homo sapiens
tgggctgcccacctggctg

SEQ ID NO: 6492271 - DNA, 21 bp, Homo sapiens
tgggctgcccacctggctgcc

SEQ ID NO: 6492272 - DNA, 13 bp, Homo sapiens
tgggctgccctgg

SEQ ID NO: 6492273 - DNA, 17 bp, Homo sapiens
tgggctgccctggtgct

SEQ ID NO: 6492274 - DNA, 19 bp, Homo sapiens
tgggctgccctggtgctgc

SEQ ID NO: 6492275 - DNA, 20 bp, Homo sapiens
tgggctgccctggtgctgcc

SEQ ID NO: 6492276 - DNA, 12 bp, Homo sapiens
tgggctgcctgg

SEQ ID NO: 6492277 - DNA, 17 bp, Homo sapiens
tgggctgcctggggatt

SEQ ID NO: 6492278 - DNA, 23 bp, Homo sapiens
tgggctgcgggaggccctggccc

SEQ ID NO: 6492279 - DNA, 16 bp, Homo sapiens
tgggctgctcctcatg

SEQ ID NO: 6492280 - DNA, 14 bp, Homo sapiens
tgggctgctcctga

SEQ ID NO: 6492281 - DNA, 15 bp, Homo sapiens
tgggctgctgcaggc

SEQ ID NO: 6492282 - DNA, 15 bp, Homo sapiens
tgggctgctggccat

SEQ ID NO: 6492283 - DNA, 22 bp, Homo sapiens
tgggctggaacgtgaactcagt

SEQ ID NO: 6492284 - DNA, 16 bp, Homo sapiens
tgggctggactggagg

SEQ ID NO: 6492285 - DNA, 17 bp, Homo sapiens
tgggctggactggccat

SEQ ID NO: 6492286 - DNA, 10 bp, Homo sapiens
tgggctggag

SEQ ID NO: 6492287 - DNA, 15 bp, Homo sapiens
tgggctggatgagct

SEQ ID NO: 6492288 - DNA, 14 bp, Homo sapiens
tgggctggcaccca

SEQ ID NO: 6492289 - DNA, 15 bp, Homo sapiens
tgggctggcacccac

SEQ ID NO: 6492290 - DNA, 18 bp, Homo sapiens
tgggctggcacccactgg

SEQ ID NO: 6492291 - DNA, 17 bp, Homo sapiens
tgggctggcagagggga

SEQ ID NO: 6492292 - DNA, 13 bp, Homo sapiens
tgggctggcccag

SEQ ID NO: 6492293 - DNA, 15 bp, Homo sapiens
tgggctggccgctgt

SEQ ID NO: 6492294 - DNA, 18 bp, Homo sapiens
tgggctggccgctgtgcc

SEQ ID NO: 6492295 - DNA, 15 bp, Homo sapiens
tgggctggcgggccc

SEQ ID NO: 6492296 - DNA, 12 bp, Homo sapiens
tgggctggctct

SEQ ID NO: 6492297 - DNA, 17 bp, Homo sapiens
tgggctggctctgaagc

SEQ ID NO: 6492298 - DNA, 18 bp, Homo sapiens
tgggctggctgccttctg

SEQ ID NO: 6492299 - DNA, 12 bp, Homo sapiens
tgggctgggaga

SEQ ID NO: 6492300 - DNA, 18 bp, Homo sapiens
tgggctgggagaaggtgc

SEQ ID NO: 6492301 - DNA, 15 bp, Homo sapiens
tgggctgggcagcct

SEQ ID NO: 6492302 - DNA, 17 bp, Homo sapiens
tgggctgggcagccttg

SEQ ID NO: 6492303 - DNA, 20 bp, Homo sapiens
tgggctgggcccacccaggg

SEQ ID NO: 6492304 - DNA, 17 bp, Homo sapiens
tgggctgggctgagccc

SEQ ID NO: 6492305 - DNA, 16 bp, Homo sapiens
tgggctgggctgggct

SEQ ID NO: 6492306 - DNA, 19 bp, Homo sapiens
tgggctgggctgggctgag

SEQ ID NO: 6492307 - DNA, 17 bp, Homo sapiens
tgggctggggaggagga

SEQ ID NO: 6492308 - DNA, 19 bp, Homo sapiens
tgggctggggaggaggaga

SEQ ID NO: 6492309 - DNA, 14 bp, Homo sapiens
tgggctggggcagg

SEQ ID NO: 6492310 - DNA, 22 bp, Homo sapiens
tgggctggggcaggggcctggg

SEQ ID NO: 6492311 - DNA, 23 bp, Homo sapiens
tgggctggggccaccatccctga

SEQ ID NO: 6492312 - DNA, 13 bp, Homo sapiens
tgggctggggctg

SEQ ID NO: 6492313 - DNA, 18 bp, Homo sapiens
tgggctggggctgctccc

SEQ ID NO: 6492314 - DNA, 16 bp, Homo sapiens
tgggctgggggccagg

SEQ ID NO: 6492315 - DNA, 13 bp, Homo sapiens
tgggctgggggct

SEQ ID NO: 6492316 - DNA, 19 bp, Homo sapiens
tgggctgggggctatgtat

SEQ ID NO: 6492317 - DNA, 17 bp, Homo sapiens
tgggctgggtgctggga

SEQ ID NO: 6492318 - DNA, 19 bp, Homo sapiens
tgggctgggtgctgggaag

SEQ ID NO: 6492319 - DNA, 12 bp, Homo sapiens
tgggctgggttg

SEQ ID NO: 6492320 - DNA, 22 bp, Homo sapiens
tgggctgggttgggtagggtgt

SEQ ID NO: 6492321 - DNA, 14 bp, Homo sapiens
tgggctggtatctc

SEQ ID NO: 6492322 - DNA, 20 bp, Homo sapiens
tgggctggtatctcagaaag

SEQ ID NO: 6492323 - DNA, 21 bp, Homo sapiens
tgggctggtatctcagaaagt

SEQ ID NO: 6492324 - DNA, 16 bp, Homo sapiens
tgggctggttgctgta

SEQ ID NO: 6492325 - DNA, 15 bp, Homo sapiens
tgggctgtcaacatt

SEQ ID NO: 6492326 - DNA, 20 bp, Homo sapiens
tgggctgtcactgcttgagg

SEQ ID NO: 6492327 - DNA, 16 bp, Homo sapiens
tgggctgtccagcctt

SEQ ID NO: 6492328 - DNA, 14 bp, Homo sapiens
tgggctgtctgtca

SEQ ID NO: 6492329 - DNA, 16 bp, Homo sapiens
tgggctgtctgtcacc

SEQ ID NO: 6492330 - DNA, 18 bp, Homo sapiens
tgggctgtctgtcaccag

SEQ ID NO: 6492331 - DNA, 19 bp, Homo sapiens
tgggctgtctgtcaccagc

SEQ ID NO: 6492332 - DNA, 19 bp, Homo sapiens
tgggctgtgaggacagggc

SEQ ID NO: 6492333 - DNA, 15 bp, Homo sapiens
tgggctgtgagtgta

SEQ ID NO: 6492334 - DNA, 21 bp, Homo sapiens
tgggctgtgtcctaaggccca

SEQ ID NO: 6492335 - DNA, 21 bp, Homo sapiens
tgggctgtgttgactgctgct

SEQ ID NO: 6492336 - DNA, 18 bp, Homo sapiens
tgggctgttctgtttcct

SEQ ID NO: 6492337 - DNA, 19 bp, Homo sapiens
tgggctgttctgtttcctg

SEQ ID NO: 6492338 - DNA, 17 bp, Homo sapiens
tgggctgttggcactca

SEQ ID NO: 6492339 - DNA, 20 bp, Homo sapiens
tgggctgttggctgggggca

SEQ ID NO: 6492340 - DNA, 12 bp, Homo sapiens
tgggctgtttct

SEQ ID NO: 6492341 - DNA, 13 bp, Homo sapiens
tgggctgtttctg

SEQ ID NO: 6492342 - DNA, 15 bp, Homo sapiens
tgggctgtttctgct

SEQ ID NO: 6492343 - DNA, 21 bp, Homo sapiens
tgggctgttttagtgccaggc

SEQ ID NO: 6492344 - DNA, 14 bp, Homo sapiens
tgggcttaaagcag

SEQ ID NO: 6492345 - DNA, 22 bp, Homo sapiens
tgggcttaaggcctaaggaagc

SEQ ID NO: 6492346 - DNA, 15 bp, Homo sapiens
tgggcttaattgaaa

SEQ ID NO: 6492347 - DNA, 16 bp, Homo sapiens
tgggcttagtatttct

SEQ ID NO: 6492348 - DNA, 18 bp, Homo sapiens
tgggcttagtatttctca

SEQ ID NO: 6492349 - DNA, 20 bp, Homo sapiens
tgggcttagtatttctcagg

SEQ ID NO: 6492350 - DNA, 13 bp, Homo sapiens
tgggcttatatct

SEQ ID NO: 6492351 - DNA, 22 bp, Homo sapiens
tgggcttatatctggcctctgc

SEQ ID NO: 6492352 - DNA, 18 bp, Homo sapiens
tgggcttatgtctctgcc

SEQ ID NO: 6492353 - DNA, 19 bp, Homo sapiens
tgggcttcaacagccaagc

SEQ ID NO: 6492354 - DNA, 20 bp, Homo sapiens
tgggcttcaacagccaagct

SEQ ID NO: 6492355 - DNA, 22 bp, Homo sapiens
tgggcttcaatcactgtaacct

SEQ ID NO: 6492356 - DNA, 18 bp, Homo sapiens
tgggcttcactgtataaa

SEQ ID NO: 6492357 - DNA, 11 bp, Homo sapiens
tgggcttcagc

SEQ ID NO: 6492358 - DNA, 22 bp, Homo sapiens
tgggcttcagcctagtggcttg

SEQ ID NO: 6492359 - DNA, 14 bp, Homo sapiens
tgggcttcagctgc

SEQ ID NO: 6492360 - DNA, 18 bp, Homo sapiens
tgggcttcagggcaggtg

SEQ ID NO: 6492361 - DNA, 18 bp, Homo sapiens
tgggcttcagtggcagct

SEQ ID NO: 6492362 - DNA, 15 bp, Homo sapiens
tgggcttcatcctcc

SEQ ID NO: 6492363 - DNA, 13 bp, Homo sapiens
tgggcttcattct

SEQ ID NO: 6492364 - DNA, 14 bp, Homo sapiens
tgggcttccacagt

SEQ ID NO: 6492365 - DNA, 15 bp, Homo sapiens
tgggcttcctgccct

SEQ ID NO: 6492366 - DNA, 18 bp, Homo sapiens
tgggcttcctgcccttcc

SEQ ID NO: 6492367 - DNA, 23 bp, Homo sapiens
tgggcttcctgcccttccctctg

SEQ ID NO: 6492368 - DNA, 14 bp, Homo sapiens
tgggcttcctgctg

SEQ ID NO: 6492369 - DNA, 15 bp, Homo sapiens
tgggcttcctggagc

SEQ ID NO: 6492370 - DNA, 20 bp, Homo sapiens
tgggcttcggagtgaatgtg

SEQ ID NO: 6492371 - DNA, 20 bp, Homo sapiens
tgggcttctgaaacttcata

SEQ ID NO: 6492372 - DNA, 15 bp, Homo sapiens
tgagatttttcatgt

SEQ ID NO: 6492373 - DNA, 17 bp, Homo sapiens
tgagatttttggttttt

SEQ ID NO: 6492374 - DNA, 18 bp, Homo sapiens
tgagattttttattgcta

SEQ ID NO: 6492375 - DNA, 16 bp, Homo sapiens
tgagattttttttccg

SEQ ID NO: 6492376 - DNA, 18 bp, Homo sapiens
tgagattttttttccgtg

SEQ ID NO: 6492377 - DNA, 19 bp, Homo sapiens
tgagatttttttttctctt

SEQ ID NO: 6492378 - DNA, 16 bp, Homo sapiens
tgagcaaacagaggag

SEQ ID NO: 6492379 - DNA, 20 bp, Homo sapiens
tgagcaaacagaggaggcca

SEQ ID NO: 6492380 - DNA, 23 bp, Homo sapiens
tgagcaaacagaggaggccagcc

SEQ ID NO: 6492381 - DNA, 14 bp, Homo sapiens
tgagcaaaccacat

SEQ ID NO: 6492382 - DNA, 18 bp, Homo sapiens
tgagcaaacctgccccat

SEQ ID NO: 6492383 - DNA, 20 bp, Homo sapiens
tgagcaaacctgccccatcc

SEQ ID NO: 6492384 - DNA, 21 bp, Homo sapiens
tgagcaaacctgccccatccc

SEQ ID NO: 6492385 - DNA, 13 bp, Homo sapiens
tgagcaaagcatc

SEQ ID NO: 6492386 - DNA, 21 bp, Homo sapiens
tgagcaaagcatcggtcatgt

SEQ ID NO: 6492387 - DNA, 15 bp, Homo sapiens
tgagcaaaggccctg

SEQ ID NO: 6492388 - DNA, 19 bp, Homo sapiens
tgagcaaatattaaaattg

SEQ ID NO: 6492389 - DNA, 19 bp, Homo sapiens
tgagcaaccacatttagaa

SEQ ID NO: 6492390 - DNA, 18 bp, Homo sapiens
tgagcaactcctgttctt

SEQ ID NO: 6492391 - DNA, 16 bp, Homo sapiens
tgagcaactcttgatt

SEQ ID NO: 6492392 - DNA, 17 bp, Homo sapiens
tgagcaactttcttaca

SEQ ID NO: 6492393 - DNA, 20 bp, Homo sapiens
tgagcaagatcttgtctcca

SEQ ID NO: 6492394 - DNA, 21 bp, Homo sapiens
tgagcaagatcttgtctccac

SEQ ID NO: 6492395 - DNA, 22 bp, Homo sapiens
tgagcaagatcttgtctccact

SEQ ID NO: 6492396 - DNA, 22 bp, Homo sapiens
tgagcaagcaccaacctccaga

SEQ ID NO: 6492397 - DNA, 15 bp, Homo sapiens
tgagcaagcccagga

SEQ ID NO: 6492398 - DNA, 20 bp, Homo sapiens
tgagcaaggacaacctgccc

SEQ ID NO: 6492399 - DNA, 14 bp, Homo sapiens
tgagcaaggacatt

SEQ ID NO: 6492400 - DNA, 18 bp, Homo sapiens
tgagcaaggacattgccc

SEQ ID NO: 6492401 - DNA, 23 bp, Homo sapiens
tgagcaaggacattgccccaaga

SEQ ID NO: 6492402 - DNA, 13 bp, Homo sapiens
tgagcaaggcaag

SEQ ID NO: 6492403 - DNA, 19 bp, Homo sapiens
tgagcaaggcaagaagtgg

SEQ ID NO: 6492404 - DNA, 20 bp, Homo sapiens
tgagcaaggcaagaagtggg

SEQ ID NO: 6492405 - DNA, 17 bp, Homo sapiens
tgagcaagggggcccaa

SEQ ID NO: 6492406 - DNA, 13 bp, Homo sapiens
tgagcaaggtgct

SEQ ID NO: 6492407 - DNA, 23 bp, Homo sapiens
tgagcaaggtgctcttgaacctg

SEQ ID NO: 6492408 - DNA, 12 bp, Homo sapiens
tgagcaataaag

SEQ ID NO: 6492409 - DNA, 15 bp, Homo sapiens
tgagcaataaagtgg

SEQ ID NO: 6492410 - DNA, 21 bp, Homo sapiens
tgagcaatggtaactgcacct

SEQ ID NO: 6492411 - DNA, 17 bp, Homo sapiens
tgagcaatgtataaccc

SEQ ID NO: 6492412 - DNA, 12 bp, Homo sapiens
tgagcaattcat

SEQ ID NO: 6492413 - DNA, 18 bp, Homo sapiens
tgagcacaaaatttggtc

SEQ ID NO: 6492414 - DNA, 23 bp, Homo sapiens
tgagcacacaacaggctgtgtgt

SEQ ID NO: 6492415 - DNA, 18 bp, Homo sapiens
tgagcacacccgtgtgca

SEQ ID NO: 6492416 - DNA, 22 bp, Homo sapiens
tgagcacagacggaggaagccg

SEQ ID NO: 6492417 - DNA, 17 bp, Homo sapiens
tgagcacagcctagggc

SEQ ID NO: 6492418 - DNA, 20 bp, Homo sapiens
tgagcacaggtgacagatca

SEQ ID NO: 6492419 - DNA, 22 bp, Homo sapiens
tgagcacagtcaggggctgggc

SEQ ID NO: 6492420 - DNA, 23 bp, Homo sapiens
tgagcacagtcaggggctgggca

SEQ ID NO: 6492421 - DNA, 19 bp, Homo sapiens
tgagcacatagtgtcctgc

SEQ ID NO: 6492422 - DNA, 20 bp, Homo sapiens
tgagcacatagtgtcctgcc

SEQ ID NO: 6492423 - DNA, 22 bp, Homo sapiens
tgagcacatagtgtcctgccca

SEQ ID NO: 6492424 - DNA, 23 bp, Homo sapiens
tgagcacatagtgtcctgcccac

SEQ ID NO: 6492425 - DNA, 18 bp, Homo sapiens
tgagcacatctctctgcc

SEQ ID NO: 6492426 - DNA, 20 bp, Homo sapiens
tgagcacatctcttcatgcg

SEQ ID NO: 6492427 - DNA, 16 bp, Homo sapiens
tgagcacatctgggag

SEQ ID NO: 6492428 - DNA, 20 bp, Homo sapiens
tgagcaccacacccagtggg

SEQ ID NO: 6492429 - DNA, 20 bp, Homo sapiens
tgagcaccaccagggctcca

SEQ ID NO: 6492430 - DNA, 21 bp, Homo sapiens
tgagcaccaccagggctccag

SEQ ID NO: 6492431 - DNA, 23 bp, Homo sapiens
tgagcaccaccagggctccagga

SEQ ID NO: 6492432 - DNA, 13 bp, Homo sapiens
tgagcaccccctc

SEQ ID NO: 6492433 - DNA, 14 bp, Homo sapiens
tgagcacctccagc

SEQ ID NO: 6492434 - DNA, 16 bp, Homo sapiens
tgagcacctcccagcc

SEQ ID NO: 6492435 - DNA, 20 bp, Homo sapiens
tgagcacctcccagcccctg

SEQ ID NO: 6492436 - DNA, 15 bp, Homo sapiens
tgagcacctctcaga

SEQ ID NO: 6492437 - DNA, 21 bp, Homo sapiens
tgagcacctgcttcatgctca

SEQ ID NO: 6492438 - DNA, 14 bp, Homo sapiens
tgagcacctgggga

SEQ ID NO: 6492439 - DNA, 18 bp, Homo sapiens
tgagcacgggcaaagaaa

SEQ ID NO: 6492440 - DNA, 21 bp, Homo sapiens
tgagcacgggcaaagaaaaca

SEQ ID NO: 6492441 - DNA, 19 bp, Homo sapiens
tgagcacgttggcgaggaa

SEQ ID NO: 6492442 - DNA, 20 bp, Homo sapiens
tgagcactaaggtgtgctct

SEQ ID NO: 6492443 - DNA, 22 bp, Homo sapiens
tgagcactaaggtgtgctctga

SEQ ID NO: 6492444 - DNA, 20 bp, Homo sapiens
tgagcactactctaccatgg

SEQ ID NO: 6492445 - DNA, 17 bp, Homo sapiens
tgagcactcccaagtct

SEQ ID NO: 6492446 - DNA, 18 bp, Homo sapiens
tgagcactcccaagtcta

SEQ ID NO: 6492447 - DNA, 20 bp, Homo sapiens
tgagcactcctgatttttat

SEQ ID NO: 6492448 - DNA, 16 bp, Homo sapiens
tgagcactcctggtgc

SEQ ID NO: 6492449 - DNA, 15 bp, Homo sapiens
tgagcactgccagga

SEQ ID NO: 6492450 - DNA, 22 bp, Homo sapiens
tgagcactgccaggagggacaa

SEQ ID NO: 6492451 - DNA, 15 bp, Homo sapiens
tgagcactgtttata

SEQ ID NO: 6492452 - DNA, 13 bp, Homo sapiens
tgagcactgtttt

SEQ ID NO: 6492453 - DNA, 12 bp, Homo sapiens
tgagcagaacag

SEQ ID NO: 6492454 - DNA, 14 bp, Homo sapiens
tgagcagaacaggt

SEQ ID NO: 6492455 - DNA, 22 bp, Homo sapiens
tgagcagaatacaatgggaaaa

SEQ ID NO: 6492456 - DNA, 23 bp, Homo sapiens
tgagcagaatgttgtacttgaaa

SEQ ID NO: 6492457 - DNA, 14 bp, Homo sapiens
tgagcagacaggct

SEQ ID NO: 6492458 - DNA, 11 bp, Homo sapiens
tgagcagaccg

SEQ ID NO: 6492459 - DNA, 16 bp, Homo sapiens
tgagcagactggtgag

SEQ ID NO: 6492460 - DNA, 21 bp, Homo sapiens
tgagcagactggtgagcagac

SEQ ID NO: 6492461 - DNA, 18 bp, Homo sapiens
tgagcagagagcaaagga

SEQ ID NO: 6492462 - DNA, 20 bp, Homo sapiens
tgagcagagagcaaaggaga

SEQ ID NO: 6492463 - DNA, 22 bp, Homo sapiens
tgagcagagatgtactgcaaag

SEQ ID NO: 6492464 - DNA, 18 bp, Homo sapiens
tgagcagagcccggagct

SEQ ID NO: 6492465 - DNA, 19 bp, Homo sapiens
tgagcagagcgatggagca

SEQ ID NO: 6492466 - DNA, 13 bp, Homo sapiens
tgagcagagggag

SEQ ID NO: 6492467 - DNA, 18 bp, Homo sapiens
tgagcagatcgtgccgtg

SEQ ID NO: 6492468 - DNA, 21 bp, Homo sapiens
tgagcagatcgtgccgtggag

SEQ ID NO: 6492469 - DNA, 22 bp, Homo sapiens
tgagcagatcgtgccgtggagc

SEQ ID NO: 6492470 - DNA, 16 bp, Homo sapiens
tgagcagatgggacaa

SEQ ID NO: 6492471 - DNA, 22 bp, Homo sapiens
tgagcagcaggcgtgcctcgtg

SEQ ID NO: 6492472 - DNA, 15 bp, Homo sapiens
tgagcagccgccagc

SEQ ID NO: 6492473 - DNA, 23 bp, Homo sapiens
tgagcagcctccactgtgtccag

SEQ ID NO: 6492474 - DNA, 19 bp, Homo sapiens
tgagcagcctctgccaggc

SEQ ID NO: 6492475 - DNA, 22 bp, Homo sapiens
tgagcagcctctgccaggcctg

SEQ ID NO: 6492476 - DNA, 14 bp, Homo sapiens
tgagcagcctctgg

SEQ ID NO: 6492477 - DNA, 15 bp, Homo sapiens
tgagcagctactgta

SEQ ID NO: 6492478 - DNA, 23 bp, Homo sapiens
tgagcagctactgtaactttttt

SEQ ID NO: 6492479 - DNA, 13 bp, Homo sapiens
tgagcagctgaat

SEQ ID NO: 6492480 - DNA, 22 bp, Homo sapiens
tgagcaggaagcgagcagaggc

SEQ ID NO: 6492481 - DNA, 17 bp, Homo sapiens
tgagcaggaaggcctgg

SEQ ID NO: 6492482 - DNA, 18 bp, Homo sapiens
tgagcaggaaggcctggg

SEQ ID NO: 6492483 - DNA, 12 bp, Homo sapiens
tgagcaggagca

SEQ ID NO: 6492484 - DNA, 16 bp, Homo sapiens
tgagcaggagcagaaa

SEQ ID NO: 6492485 - DNA, 18 bp, Homo sapiens
tgagcaggagcagaaaga

SEQ ID NO: 6492486 - DNA, 14 bp, Homo sapiens
tgagcaggagcttg

SEQ ID NO: 6492487 - DNA, 17 bp, Homo sapiens
tgagcaggagcttgggt

SEQ ID NO: 6492488 - DNA, 15 bp, Homo sapiens
tgagcaggattttaa

SEQ ID NO: 6492489 - DNA, 22 bp, Homo sapiens
tgagcaggccacacttcaaact

SEQ ID NO: 6492490 - DNA, 19 bp, Homo sapiens
tgagcaggcccgacagaga

SEQ ID NO: 6492491 - DNA, 21 bp, Homo sapiens
tgagcaggcccgacagagaga

SEQ ID NO: 6492492 - DNA, 22 bp, Homo sapiens
tgagcaggcccgacagagagat

SEQ ID NO: 6492493 - DNA, 13 bp, Homo sapiens
tgagcaggctgtg

SEQ ID NO: 6492494 - DNA, 16 bp, Homo sapiens
tgagcaggctgtgggg

SEQ ID NO: 6492495 - DNA, 14 bp, Homo sapiens
tgagcagggatctg

SEQ ID NO: 6492496 - DNA, 14 bp, Homo sapiens
tgagcagggccctc

SEQ ID NO: 6492497 - DNA, 12 bp, Homo sapiens
tgagcagggccg

SEQ ID NO: 6492498 - DNA, 13 bp, Homo sapiens
tgagcagggctca

SEQ ID NO: 6492499 - DNA, 14 bp, Homo sapiens
tgagcagggctcag

SEQ ID NO: 6492500 - DNA, 23 bp, Homo sapiens
tgagcagggctcagcggggacag

SEQ ID NO: 6492501 - DNA, 21 bp, Homo sapiens
tgagcagggcttgctcctgcc

SEQ ID NO: 6492502 - DNA, 18 bp, Homo sapiens
tgagcaggggaagcagga

SEQ ID NO: 6492503 - DNA, 15 bp, Homo sapiens
tgagcaggggcaggc

SEQ ID NO: 6492504 - DNA, 16 bp, Homo sapiens
tgagcaggggcaggcg

SEQ ID NO: 6492505 - DNA, 19 bp, Homo sapiens
tgagcaggggcaggcgcag

SEQ ID NO: 6492506 - DNA, 19 bp, Homo sapiens
tgagcaggggcccctgggg

SEQ ID NO: 6492507 - DNA, 21 bp, Homo sapiens
tgagcagggtcaagcctctta

SEQ ID NO: 6492508 - DNA, 16 bp, Homo sapiens
tgagcagggtggggtc

SEQ ID NO: 6492509 - DNA, 16 bp, Homo sapiens
tgagcaggtacatttc

SEQ ID NO: 6492510 - DNA, 22 bp, Homo sapiens
tgagcaggtacatttctgattc

SEQ ID NO: 6492511 - DNA, 16 bp, Homo sapiens
tgagcagtagaagcct

SEQ ID NO: 6492512 - DNA, 18 bp, Homo sapiens
tgagcagtcacactgtta

SEQ ID NO: 6492513 - DNA, 15 bp, Homo sapiens
tgagcagtccctgct

SEQ ID NO: 6492514 - DNA, 14 bp, Homo sapiens
tgagcagtccttgg

SEQ ID NO: 6492515 - DNA, 17 bp, Homo sapiens
tgagcagtccttggcct

SEQ ID NO: 6492516 - DNA, 16 bp, Homo sapiens
tgagcagtcgcctgcc

SEQ ID NO: 6492517 - DNA, 20 bp, Homo sapiens
tgagcagtcgcctgcctgca

SEQ ID NO: 6492518 - DNA, 15 bp, Homo sapiens
tgagcagtgagcaga

SEQ ID NO: 6492519 - DNA, 23 bp, Homo sapiens
tgagcagtgagttacagcgagag

SEQ ID NO: 6492520 - DNA, 15 bp, Homo sapiens
tgagcagtggctggt

SEQ ID NO: 6492521 - DNA, 22 bp, Homo sapiens
tgagcagtggctggtccagggc

SEQ ID NO: 6492522 - DNA, 21 bp, Homo sapiens
tgagcagtggggagcgggggc

SEQ ID NO: 6492523 - DNA, 17 bp, Homo sapiens
tgagcagtgtgtctcct

SEQ ID NO: 6492524 - DNA, 12 bp, Homo sapiens
tgagcagtgttg

SEQ ID NO: 6492525 - DNA, 17 bp, Homo sapiens
tgagcagtgttgcgttt

SEQ ID NO: 6492526 - DNA, 19 bp, Homo sapiens
tgagcagtgttgcgttttt

SEQ ID NO: 6492527 - DNA, 21 bp, Homo sapiens
tgagcagtgttgcgtttttcc

SEQ ID NO: 6492528 - DNA, 21 bp, Homo sapiens
tgagcagtgttggagtgagga

SEQ ID NO: 6492529 - DNA, 20 bp, Homo sapiens
tgagcagttcccaaggacag

SEQ ID NO: 6492530 - DNA, 15 bp, Homo sapiens
tgagcagttcccctg

SEQ ID NO: 6492531 - DNA, 21 bp, Homo sapiens
tgagcagttcccctggagccc

SEQ ID NO: 6492532 - DNA, 17 bp, Homo sapiens
tgagcatacctgtctca

SEQ ID NO: 6492533 - DNA, 16 bp, Homo sapiens
tgagcatagagaacaa

SEQ ID NO: 6492534 - DNA, 20 bp, Homo sapiens
tgagcatagagaacaaagta

SEQ ID NO: 6492535 - DNA, 13 bp, Homo sapiens
tgagcataggtga

SEQ ID NO: 6492536 - DNA, 19 bp, Homo sapiens
tgagcatatataatcaaaa

SEQ ID NO: 6492537 - DNA, 19 bp, Homo sapiens
tgagcatcaatcttgttac

SEQ ID NO: 6492538 - DNA, 20 bp, Homo sapiens
tgagcatcaatcttgttact

SEQ ID NO: 6492539 - DNA, 14 bp, Homo sapiens
tgagcatcacagaa

SEQ ID NO: 6492540 - DNA, 18 bp, Homo sapiens
tgagcatcacagaatgtg

SEQ ID NO: 6492541 - DNA, 14 bp, Homo sapiens
tgagcatcacagtt

SEQ ID NO: 6492542 - DNA, 15 bp, Homo sapiens
tgagcatcacagttt

SEQ ID NO: 6492543 - DNA, 15 bp, Homo sapiens
tgagcatcagagggc

SEQ ID NO: 6492544 - DNA, 22 bp, Homo sapiens
tgagcatcaggccaggccctct
